United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 179

SEQ ID NO: 7468271 - DNA, 22 bp, Homo sapiens
cagatttgccacttactcgttg

SEQ ID NO: 7468272 - DNA, 22 bp, Homo sapiens
cagatttctttagcaagctaag

SEQ ID NO: 7468273 - DNA, 22 bp, Homo sapiens
cagatttctttagcaagctaag

SEQ ID NO: 7468274 - DNA, 22 bp, Homo sapiens
cagattctccaggggctgcaga

SEQ ID NO: 7468275 - DNA, 22 bp, Homo sapiens
cagattctccaggggctgcaga

SEQ ID NO: 7468276 - DNA, 22 bp, Homo sapiens
cagattctccaggggctgcaga

SEQ ID NO: 7468277 - DNA, 22 bp, Homo sapiens
cagattctcactgtattcaggt

SEQ ID NO: 7468278 - DNA, 20 bp, Homo sapiens
cagattctccactaacatat

SEQ ID NO: 7468279 - DNA, 22 bp, Homo sapiens
cagattctccaggggctgcaga

SEQ ID NO: 7468280 - DNA, 20 bp, Homo sapiens
cagattctccactaacatat

SEQ ID NO: 7468281 - DNA, 22 bp, Homo sapiens
cagattccagtttgtggctccc

SEQ ID NO: 7468282 - DNA, 22 bp, Homo sapiens
cagattccggtcatctctcctt

SEQ ID NO: 7468283 - DNA, 22 bp, Homo sapiens
cagattctcactgtattcaggt

SEQ ID NO: 7468284 - DNA, 22 bp, Homo sapiens
cagattccggtcatctctcctt

SEQ ID NO: 7468285 - DNA, 22 bp, Homo sapiens
cagattctcactgtattcaggt

SEQ ID NO: 7468286 - DNA, 22 bp, Homo sapiens
cagattactttgtagcagtcag

SEQ ID NO: 7468287 - DNA, 22 bp, Homo sapiens
cagattccagtttgtggctccc

SEQ ID NO: 7468288 - DNA, 22 bp, Homo sapiens
cagattagttgtgctatggcct

SEQ ID NO: 7468289 - DNA, 22 bp, Homo sapiens
cagattactttgtagcagtcag

SEQ ID NO: 7468290 - DNA, 22 bp, Homo sapiens
cagattaagtgctcaacagtgt

SEQ ID NO: 7468291 - DNA, 22 bp, Homo sapiens
cagattaacacggagcttaaca

SEQ ID NO: 7468292 - DNA, 22 bp, Homo sapiens
cagattaagtgctcaacagtgt

SEQ ID NO: 7468293 - DNA, 22 bp, Homo sapiens
cagattaagtgctcaacagtgt

SEQ ID NO: 7468294 - DNA, 22 bp, Homo sapiens
cagattcttctgtatttttgct

SEQ ID NO: 7468295 - DNA, 22 bp, Homo sapiens
cagattcttcattgccccattc

SEQ ID NO: 7468296 - DNA, 22 bp, Homo sapiens
cagattcttctgtatttttgct

SEQ ID NO: 7468297 - DNA, 22 bp, Homo sapiens
cagattcttcattcattctaca

SEQ ID NO: 7468298 - DNA, 22 bp, Homo sapiens
cagattcttcattgccccattc

SEQ ID NO: 7468299 - DNA, 22 bp, Homo sapiens
cagattcttcattgccccattc

SEQ ID NO: 7468300 - DNA, 22 bp, Homo sapiens
cagattcttcattgccccattc

SEQ ID NO: 7468301 - DNA, 22 bp, Homo sapiens
cagattctgcagtcaacttgct

SEQ ID NO: 7468302 - DNA, 22 bp, Homo sapiens
cagattctgcagtcaacttgct

SEQ ID NO: 7468303 - DNA, 22 bp, Homo sapiens
cagattctgaagtctagctgct

SEQ ID NO: 7468304 - DNA, 22 bp, Homo sapiens
cagattctgcagtcaacttgct

SEQ ID NO: 7468305 - DNA, 22 bp, Homo sapiens
cagattctgaagtctagctgct

SEQ ID NO: 7468306 - DNA, 22 bp, Homo sapiens
cagattctccaggggctgcaga

SEQ ID NO: 7468307 - DNA, 22 bp, Homo sapiens
cagattctgaagtctagctgct

SEQ ID NO: 7468308 - DNA, 22 bp, Homo sapiens
cagattctgaagtctagctgct

SEQ ID NO: 7468309 - DNA, 22 bp, Homo sapiens
cagattctgggcccagcttgtc

SEQ ID NO: 7468310 - DNA, 22 bp, Homo sapiens
cagattctgggcccagcttgtc

SEQ ID NO: 7468311 - DNA, 22 bp, Homo sapiens
cagattctgggcccagcttgtc

SEQ ID NO: 7468312 - DNA, 22 bp, Homo sapiens
cagattctgggcccagcttgtc

SEQ ID NO: 7468313 - DNA, 22 bp, Homo sapiens
cagattcttaatttatgggatt

SEQ ID NO: 7468314 - DNA, 22 bp, Homo sapiens
cagattcttaatttatgggatt

SEQ ID NO: 7468315 - DNA, 22 bp, Homo sapiens
cagattcttcattcattctaca

SEQ ID NO: 7468316 - DNA, 22 bp, Homo sapiens
cagattcttcattcattctaca

SEQ ID NO: 7468317 - DNA, 22 bp, Homo sapiens
cagattcttcattcattctaca

SEQ ID NO: 7468318 - DNA, 22 bp, Homo sapiens
cagccaggcccagatcatgctg

SEQ ID NO: 7468319 - DNA, 22 bp, Homo sapiens
cagccaggcccccgagtcgttg

SEQ ID NO: 7468320 - DNA, 22 bp, Homo sapiens
cagccaggcccccgagtcgttg

SEQ ID NO: 7468321 - DNA, 22 bp, Homo sapiens
cagccaggcccccgagtcgttg

SEQ ID NO: 7468322 - DNA, 22 bp, Homo sapiens
cagccaggcccccgagtcgttg

SEQ ID NO: 7468323 - DNA, 22 bp, Homo sapiens
cagccaggcccagatcatgctg

SEQ ID NO: 7468324 - DNA, 22 bp, Homo sapiens
cagccaggatggagaactgttg

SEQ ID NO: 7468325 - DNA, 22 bp, Homo sapiens
cagccaggatggagaactgttg

SEQ ID NO: 7468326 - DNA, 22 bp, Homo sapiens
cagccaggatggagaactgttg

SEQ ID NO: 7468327 - DNA, 22 bp, Homo sapiens
cagccaggatggagaactgttg

SEQ ID NO: 7468328 - DNA, 22 bp, Homo sapiens
cagccaggagctccccctgctc

SEQ ID NO: 7468329 - DNA, 22 bp, Homo sapiens
cagccaggagctccccctgctc

SEQ ID NO: 7468330 - DNA, 22 bp, Homo sapiens
cagccaggcccagatcatgctg

SEQ ID NO: 7468331 - DNA, 22 bp, Homo sapiens
cagccaggcccagatcatgctg

SEQ ID NO: 7468332 - DNA, 22 bp, Homo sapiens
cagccaggagctccccctgctc

SEQ ID NO: 7468333 - DNA, 22 bp, Homo sapiens
cagccaggagctccccctgctc

SEQ ID NO: 7468334 - DNA, 22 bp, Homo sapiens
cagccaggagcctctgcaacta

SEQ ID NO: 7468335 - DNA, 22 bp, Homo sapiens
cagccaggagcctctgcaacta

SEQ ID NO: 7468336 - DNA, 22 bp, Homo sapiens
cagccaggagctccccctgctc

SEQ ID NO: 7468337 - DNA, 22 bp, Homo sapiens
cagccaggagcctctgcaacta

SEQ ID NO: 7468338 - DNA, 22 bp, Homo sapiens
cagccaggagcctctgcaacta

SEQ ID NO: 7468339 - DNA, 22 bp, Homo sapiens
cagccaggagcctctgcaacta

SEQ ID NO: 7468340 - DNA, 22 bp, Homo sapiens
cagccaggactcccatttagga

SEQ ID NO: 7468341 - DNA, 22 bp, Homo sapiens
cagccaggactcccatttagga

SEQ ID NO: 7468342 - DNA, 22 bp, Homo sapiens
gtccagccaccctggaggcacg

SEQ ID NO: 7468343 - DNA, 22 bp, Homo sapiens
gtccagccaccctggaggcacg

SEQ ID NO: 7468344 - DNA, 22 bp, Homo sapiens
gtccagccaccctggaggcacg

SEQ ID NO: 7468345 - DNA, 22 bp, Homo sapiens
gtccagcatttaggcttgctga

SEQ ID NO: 7468346 - DNA, 22 bp, Homo sapiens
gtccagcatttaggcttgctga

SEQ ID NO: 7468347 - DNA, 22 bp, Homo sapiens
cagccagaacctaggatgagct

SEQ ID NO: 7468348 - DNA, 22 bp, Homo sapiens
cagccagaaagtatgttaggga

SEQ ID NO: 7468349 - DNA, 22 bp, Homo sapiens
cagccagaacctaggatgagct

SEQ ID NO: 7468350 - DNA, 22 bp, Homo sapiens
cagccagaaagtctgttaggga

SEQ ID NO: 7468351 - DNA, 22 bp, Homo sapiens
cagccagaacctaggatgagct

SEQ ID NO: 7468352 - DNA, 22 bp, Homo sapiens
cagccagaaagtctgttaggga

SEQ ID NO: 7468353 - DNA, 22 bp, Homo sapiens
gtccagcaggatgcaagtgcca

SEQ ID NO: 7468354 - DNA, 22 bp, Homo sapiens
gtccagcaggatgcaagtgcca

SEQ ID NO: 7468355 - DNA, 22 bp, Homo sapiens
gtccagcaggatgcaagtgcca

SEQ ID NO: 7468356 - DNA, 22 bp, Homo sapiens
gtccagcatttaggcttgctga

SEQ ID NO: 7468357 - DNA, 22 bp, Homo sapiens
gtccagcatttaggcttgctga

SEQ ID NO: 7468358 - DNA, 22 bp, Homo sapiens
gtccagagtattcaagtaactt

SEQ ID NO: 7468359 - DNA, 22 bp, Homo sapiens
gtccagagttagaaatgaatat

SEQ ID NO: 7468360 - DNA, 20 bp, Homo sapiens
gtccagagtaatgtgctgac

SEQ ID NO: 7468361 - DNA, 22 bp, Homo sapiens
gtccagagtagtcgagtattct

SEQ ID NO: 7468362 - DNA, 22 bp, Homo sapiens
cagccagctgtcccaagtgcct

SEQ ID NO: 7468363 - DNA, 22 bp, Homo sapiens
cagccagctggtgcggcagagc

SEQ ID NO: 7468364 - DNA, 22 bp, Homo sapiens
cagccagaacctaggatgagct

SEQ ID NO: 7468365 - DNA, 22 bp, Homo sapiens
cagccagctggtgcggcagagc

SEQ ID NO: 7468366 - DNA, 22 bp, Homo sapiens
cagccagctgtcccaagtgcct

SEQ ID NO: 7468367 - DNA, 22 bp, Homo sapiens
cagccagctgtcccaagtgcct

SEQ ID NO: 7468368 - DNA, 22 bp, Homo sapiens
cagccaggacagggaaactagt

SEQ ID NO: 7468369 - DNA, 22 bp, Homo sapiens
cagccagcttcagatccaagcc

SEQ ID NO: 7468370 - DNA, 22 bp, Homo sapiens
cagccaggacagggaaactagt

SEQ ID NO: 7468371 - DNA, 22 bp, Homo sapiens
cagccagcttcagatccaagcc

SEQ ID NO: 7468372 - DNA, 22 bp, Homo sapiens
cagccaggacagggaaactagt

SEQ ID NO: 7468373 - DNA, 22 bp, Homo sapiens
cagccagcttcagatccaagcc

SEQ ID NO: 7468374 - DNA, 22 bp, Homo sapiens
cagccagctgtcccaagtgcct

SEQ ID NO: 7468375 - DNA, 22 bp, Homo sapiens
cagcatctgtaggactcctctt

SEQ ID NO: 7468376 - DNA, 22 bp, Homo sapiens
cagcatctgtatcctaggctga

SEQ ID NO: 7468377 - DNA, 22 bp, Homo sapiens
cagcatctgtaggactcctctt

SEQ ID NO: 7468378 - DNA, 22 bp, Homo sapiens
cagcatctgtaggactcctctt

SEQ ID NO: 7468379 - DNA, 22 bp, Homo sapiens
cagcatctgtaggactcctctt

SEQ ID NO: 7468380 - DNA, 22 bp, Homo sapiens
cagcatctggggaacattcaag

SEQ ID NO: 7468381 - DNA, 22 bp, Homo sapiens
cagcatctggggaacattcaag

SEQ ID NO: 7468382 - DNA, 22 bp, Homo sapiens
cagcatctggatttcctccact

SEQ ID NO: 7468383 - DNA, 19 bp, Homo sapiens
cagcatctgagccgtgtcc

SEQ ID NO: 7468384 - DNA, 22 bp, Homo sapiens
cagcatctggatttcctccact

SEQ ID NO: 7468385 - DNA, 22 bp, Homo sapiens
cagcatctggatttcctccact

SEQ ID NO: 7468386 - DNA, 19 bp, Homo sapiens
cagcatctgagccgtgtcc

SEQ ID NO: 7468387 - DNA, 22 bp, Homo sapiens
gtccagagaggcaggaggctac

SEQ ID NO: 7468388 - DNA, 22 bp, Homo sapiens
cagcatctgtttttctgaccca

SEQ ID NO: 7468389 - DNA, 22 bp, Homo sapiens
cagcatctgttggatggataag

SEQ ID NO: 7468390 - DNA, 22 bp, Homo sapiens
cagcatctgtttttctgaccca

SEQ ID NO: 7468391 - DNA, 22 bp, Homo sapiens
cagcatctgtttttctgaccca

SEQ ID NO: 7468392 - DNA, 22 bp, Homo sapiens
cagcatctgttggatggataag

SEQ ID NO: 7468393 - DNA, 22 bp, Homo sapiens
cagcatctgttggatggataag

SEQ ID NO: 7468394 - DNA, 22 bp, Homo sapiens
cagcatctgttcccaacgagat

SEQ ID NO: 7468395 - DNA, 22 bp, Homo sapiens
cagcatctgttcccaacgagat

SEQ ID NO: 7468396 - DNA, 22 bp, Homo sapiens
cagcatctgttcccaacgagat

SEQ ID NO: 7468397 - DNA, 22 bp, Homo sapiens
cagcatctgtatcctaggctga

SEQ ID NO: 7468398 - DNA, 22 bp, Homo sapiens
cagcatctgtatcctaggctga

SEQ ID NO: 7468399 - DNA, 22 bp, Homo sapiens
cagcatctgtatcctaggctga

SEQ ID NO: 7468400 - DNA, 22 bp, Homo sapiens
cagcatctgtatcctaggctga

SEQ ID NO: 7468401 - DNA, 22 bp, Homo sapiens
cagcatctcctgtgcagaggga

SEQ ID NO: 7468402 - DNA, 22 bp, Homo sapiens
cagcatctcctgtgcagaggga

SEQ ID NO: 7468403 - DNA, 22 bp, Homo sapiens
cagcatctcgtggctggataga

SEQ ID NO: 7468404 - DNA, 22 bp, Homo sapiens
cagcatctctgcaccctccccc

SEQ ID NO: 7468405 - DNA, 22 bp, Homo sapiens
cagcatctcctgtgcagaggga

SEQ ID NO: 7468406 - DNA, 22 bp, Homo sapiens
cagcatctcgtggctggataga

SEQ ID NO: 7468407 - DNA, 22 bp, Homo sapiens
cagcatctctgcctgcctgcaa

SEQ ID NO: 7468408 - DNA, 22 bp, Homo sapiens
cagcatctctgcctgcctgcaa

SEQ ID NO: 7468409 - DNA, 22 bp, Homo sapiens
cagcatctctgcctgcctgcaa

SEQ ID NO: 7468410 - DNA, 22 bp, Homo sapiens
cagcatctctgcctgcctgcaa

SEQ ID NO: 7468411 - DNA, 22 bp, Homo sapiens
cagcatctctgcaccctccccc

SEQ ID NO: 7468412 - DNA, 22 bp, Homo sapiens
cagcatctctttttgcattcct

SEQ ID NO: 7468413 - DNA, 22 bp, Homo sapiens
cagcatctctttttgcattcct

SEQ ID NO: 7468414 - DNA, 22 bp, Homo sapiens
cagcatctctgggagaagcatc

SEQ ID NO: 7468415 - DNA, 22 bp, Homo sapiens
cagcatctctgggagaagcatc

SEQ ID NO: 7468416 - DNA, 22 bp, Homo sapiens
cagcatctctgggagaagcatc

SEQ ID NO: 7468417 - DNA, 19 bp, Homo sapiens
cagcatctgagccgtgtcc

SEQ ID NO: 7468418 - DNA, 22 bp, Homo sapiens
cagcatctgaccaatatctaca

SEQ ID NO: 7468419 - DNA, 22 bp, Homo sapiens
cagcatctgaccaatatctaca

SEQ ID NO: 7468420 - DNA, 22 bp, Homo sapiens
cagcatctctttttgcattcct

SEQ ID NO: 7468421 - DNA, 22 bp, Homo sapiens
cagcatctgaccaatatctaca

SEQ ID NO: 7468422 - DNA, 22 bp, Homo sapiens
gtccagagctggcacactgtca

SEQ ID NO: 7468423 - DNA, 22 bp, Homo sapiens
gtccagagctggcacactgtca

SEQ ID NO: 7468424 - DNA, 22 bp, Homo sapiens
gtccagagggctgcaggatgct

SEQ ID NO: 7468425 - DNA, 22 bp, Homo sapiens
gtccagagggctgcaggatgct

SEQ ID NO: 7468426 - DNA, 22 bp, Homo sapiens
gtccagagggctgcaggatgct

SEQ ID NO: 7468427 - DNA, 22 bp, Homo sapiens
gtccagagggctgcaggatgct

SEQ ID NO: 7468428 - DNA, 22 bp, Homo sapiens
gtccagagggctgcaggatgct

SEQ ID NO: 7468429 - DNA, 22 bp, Homo sapiens
gtccagagggctgcaggatgct

SEQ ID NO: 7468430 - DNA, 22 bp, Homo sapiens
gtccagagggctgcaggatgct

SEQ ID NO: 7468431 - DNA, 22 bp, Homo sapiens
gtccagagggctgcaggatgct

SEQ ID NO: 7468432 - DNA, 22 bp, Homo sapiens
gtccagagggctgcaggatgct

SEQ ID NO: 7468433 - DNA, 22 bp, Homo sapiens
gtccagagggctgcaggatgct

SEQ ID NO: 7468434 - DNA, 22 bp, Homo sapiens
gtccagagggtcaagtttcttg

SEQ ID NO: 7468435 - DNA, 22 bp, Homo sapiens
gtccagagggtcaagtttcttg

SEQ ID NO: 7468436 - DNA, 22 bp, Homo sapiens
gtccagaggtccaggatcaagg

SEQ ID NO: 7468437 - DNA, 22 bp, Homo sapiens
gtccagaggtccaggatcaagg

SEQ ID NO: 7468438 - DNA, 22 bp, Homo sapiens
gtccagaggtccaggatcaagg

SEQ ID NO: 7468439 - DNA, 22 bp, Homo sapiens
gtccagaggtccaggatcaagg

SEQ ID NO: 7468440 - DNA, 20 bp, Homo sapiens
gtccagagtaatgtgctgac

SEQ ID NO: 7468441 - DNA, 20 bp, Homo sapiens
gtccagagtaatgtgctgac

SEQ ID NO: 7468442 - DNA, 20 bp, Homo sapiens
gtccagagtaatgtgctgac

SEQ ID NO: 7468443 - DNA, 20 bp, Homo sapiens
gtccagagtaatgtgctgac

SEQ ID NO: 7468444 - DNA, 20 bp, Homo sapiens
gtccagagtaatgtgctgac

SEQ ID NO: 7468445 - DNA, 22 bp, Homo sapiens
gtccagagccggaagagtgaca

SEQ ID NO: 7468446 - DNA, 22 bp, Homo sapiens
gtccagagccggaagagtgaca

SEQ ID NO: 7468447 - DNA, 22 bp, Homo sapiens
gtccagagatggacgagcagat

SEQ ID NO: 7468448 - DNA, 22 bp, Homo sapiens
gtccagagatggacgagcagat

SEQ ID NO: 7468449 - DNA, 22 bp, Homo sapiens
gtccagagagtaaagggggtaa

SEQ ID NO: 7468450 - DNA, 22 bp, Homo sapiens
gtccagagatggacgagcagat

SEQ ID NO: 7468451 - DNA, 22 bp, Homo sapiens
gtccagagctggcacactgtca

SEQ ID NO: 7468452 - DNA, 22 bp, Homo sapiens
gtccagagctggcacactgtca

SEQ ID NO: 7468453 - DNA, 22 bp, Homo sapiens
gtccagagccggaagagtgaca

SEQ ID NO: 7468454 - DNA, 22 bp, Homo sapiens
gtccagagatggacgagcagat

SEQ ID NO: 7468455 - DNA, 22 bp, Homo sapiens
gtccagagccggaagagtgaca

SEQ ID NO: 7468456 - DNA, 22 bp, Homo sapiens
gtccagagaggcaggaggctac

SEQ ID NO: 7468457 - DNA, 22 bp, Homo sapiens
gtccagagagtaaagggggtaa

SEQ ID NO: 7468458 - DNA, 22 bp, Homo sapiens
gtccagagagtaaagggggtaa

SEQ ID NO: 7468459 - DNA, 22 bp, Homo sapiens
gtccagagagtaaagggggtaa

SEQ ID NO: 7468460 - DNA, 22 bp, Homo sapiens
gtccagagaggcaggaggctac

SEQ ID NO: 7468461 - DNA, 22 bp, Homo sapiens
gtccagagaggcaggaggctac

SEQ ID NO: 7468462 - DNA, 22 bp, Homo sapiens
gtccagagaggcaggaggctac

SEQ ID NO: 7468463 - DNA, 22 bp, Homo sapiens
gtccagagaggcaggaggctac

SEQ ID NO: 7468464 - DNA, 22 bp, Homo sapiens
gtccagagaggcaggaggctac

SEQ ID NO: 7468465 - DNA, 22 bp, Homo sapiens
gtccagagaggcaggaggctac

SEQ ID NO: 7468466 - DNA, 22 bp, Homo sapiens
gtccagagaggcaggaggctac

SEQ ID NO: 7468467 - DNA, 22 bp, Homo sapiens
gtcagcagcatgtttaatcaaa

SEQ ID NO: 7468468 - DNA, 17 bp, Homo sapiens
gtcagcagcttgcttgt

SEQ ID NO: 7468469 - DNA, 17 bp, Homo sapiens
gtcagcagcttgcttgt

SEQ ID NO: 7468470 - DNA, 17 bp, Homo sapiens
gtcagcagcttgcttgt

SEQ ID NO: 7468471 - DNA, 22 bp, Homo sapiens
gtcagcagggctccctggcagg

SEQ ID NO: 7468472 - DNA, 21 bp, Homo sapiens
gtcagcagatccagcacttgt

SEQ ID NO: 7468473 - DNA, 21 bp, Homo sapiens
gtcagcagatccagcacttgt

SEQ ID NO: 7468474 - DNA, 22 bp, Homo sapiens
gtcagcagcatgtttaatcaaa

SEQ ID NO: 7468475 - DNA, 22 bp, Homo sapiens
gtcagcagcatgtttaatcaaa

SEQ ID NO: 7468476 - DNA, 22 bp, Homo sapiens
gtcagcagtgtcagctctgggg

SEQ ID NO: 7468477 - DNA, 22 bp, Homo sapiens
gtcagcagtggcagctcccggg

SEQ ID NO: 7468478 - DNA, 22 bp, Homo sapiens
gtcagcagtgtcagctctgggg

SEQ ID NO: 7468479 - DNA, 22 bp, Homo sapiens
gtcagcagtgtcagctctgggg

SEQ ID NO: 7468480 - DNA, 22 bp, Homo sapiens
gtcagcagggtccccttgagtg

SEQ ID NO: 7468481 - DNA, 22 bp, Homo sapiens
gtcagcagtggcagctcccggg

SEQ ID NO: 7468482 - DNA, 22 bp, Homo sapiens
gtcagcagggtccccttgagtg

SEQ ID NO: 7468483 - DNA, 22 bp, Homo sapiens
gtcagcacttttccgaggcaga

SEQ ID NO: 7468484 - DNA, 22 bp, Homo sapiens
gtcagcagaaacgccacatgca

SEQ ID NO: 7468485 - DNA, 22 bp, Homo sapiens
gtcagcagaaacgccacatgca

SEQ ID NO: 7468486 - DNA, 22 bp, Homo sapiens
gtcagcacttttccgaggcaga

SEQ ID NO: 7468487 - DNA, 22 bp, Homo sapiens
gtcagcacctctttggggagct

SEQ ID NO: 7468488 - DNA, 19 bp, Homo sapiens
gtcagcaccatggacaggg

SEQ ID NO: 7468489 - DNA, 19 bp, Homo sapiens
gtcagcaccatggacaggg

SEQ ID NO: 7468490 - DNA, 22 bp, Homo sapiens
gtcagcaattcaagagctctta

SEQ ID NO: 7468491 - DNA, 22 bp, Homo sapiens
gtcagcaattcaagagctctta

SEQ ID NO: 7468492 - DNA, 22 bp, Homo sapiens
gtcagcaatagttagtttacaa

SEQ ID NO: 7468493 - DNA, 22 bp, Homo sapiens
gtcagcaaggtgcaagcggctg

SEQ ID NO: 7468494 - DNA, 22 bp, Homo sapiens
gtcagcaagatgaatcagcagg

SEQ ID NO: 7468495 - DNA, 22 bp, Homo sapiens
gtcagcaaaaaatttatgtgag

SEQ ID NO: 7468496 - DNA, 22 bp, Homo sapiens
gtcagattaatagcaataataa

SEQ ID NO: 7468497 - DNA, 22 bp, Homo sapiens
gtcagattttcaagacgagagg

SEQ ID NO: 7468498 - DNA, 22 bp, Homo sapiens
gtcagatgatacactgttgtca

SEQ ID NO: 7468499 - DNA, 22 bp, Homo sapiens
gtcagattaatagcaataataa

SEQ ID NO: 7468500 - DNA, 22 bp, Homo sapiens
gtcagcatagttcacacacagt

SEQ ID NO: 7468501 - DNA, 22 bp, Homo sapiens
gtcagcagtgtcagctctgggg

SEQ ID NO: 7468502 - DNA, 22 bp, Homo sapiens
cagcagtgtctccagcatcaca

SEQ ID NO: 7468503 - DNA, 22 bp, Homo sapiens
cagcagtgtctccagcatcaca

SEQ ID NO: 7468504 - DNA, 22 bp, Homo sapiens
cagcagtgtctccagcatcaca

SEQ ID NO: 7468505 - DNA, 22 bp, Homo sapiens
cagcagtgtctccagcatcaca

SEQ ID NO: 7468506 - DNA, 22 bp, Homo sapiens
cagcatcccagagcccagagct

SEQ ID NO: 7468507 - DNA, 22 bp, Homo sapiens
cagcagtgtctccagcatcaca

SEQ ID NO: 7468508 - DNA, 22 bp, Homo sapiens
cagcatcattcatctggggtaa

SEQ ID NO: 7468509 - DNA, 22 bp, Homo sapiens
cagcatccctcaggggcctctg

SEQ ID NO: 7468510 - DNA, 22 bp, Homo sapiens
cagcatcccagagcccagagct

SEQ ID NO: 7468511 - DNA, 22 bp, Homo sapiens
gtcagcatagttcacacacagt

SEQ ID NO: 7468512 - DNA, 22 bp, Homo sapiens
cagcatccggcagcccgggcct

SEQ ID NO: 7468513 - DNA, 22 bp, Homo sapiens
cagcatccctcaggggcctctg

SEQ ID NO: 7468514 - DNA, 22 bp, Homo sapiens
cagcatccctcaggggcctctg

SEQ ID NO: 7468515 - DNA, 22 bp, Homo sapiens
cagcatccctcaggggcctctg

SEQ ID NO: 7468516 - DNA, 22 bp, Homo sapiens
cagcatcctttgctggtttccc

SEQ ID NO: 7468517 - DNA, 22 bp, Homo sapiens
cagcatcgtgtggaaagtggta

SEQ ID NO: 7468518 - DNA, 22 bp, Homo sapiens
cagcatctaatcttcatgccgg

SEQ ID NO: 7468519 - DNA, 22 bp, Homo sapiens
cagcatctaatcttcatgccgg

SEQ ID NO: 7468520 - DNA, 22 bp, Homo sapiens
cagcatctaatcttcatgccgg

SEQ ID NO: 7468521 - DNA, 22 bp, Homo sapiens
cagcatctaatcttcatgccgg

SEQ ID NO: 7468522 - DNA, 22 bp, Homo sapiens
cagcatctcctgtgcagaggga

SEQ ID NO: 7468523 - DNA, 22 bp, Homo sapiens
cagcatctcccaggcatttgcc

SEQ ID NO: 7468524 - DNA, 22 bp, Homo sapiens
cagcatctcctgtgcagaggga

SEQ ID NO: 7468525 - DNA, 22 bp, Homo sapiens
cagcatctccatggctttggag

SEQ ID NO: 7468526 - DNA, 22 bp, Homo sapiens
cagcatctccatggctttggag

SEQ ID NO: 7468527 - DNA, 22 bp, Homo sapiens
cagcatctcccaggcatttgcc

SEQ ID NO: 7468528 - DNA, 22 bp, Homo sapiens
cagcatctcccaggcatttgcc

SEQ ID NO: 7468529 - DNA, 22 bp, Homo sapiens
cagcatctccatggctttggag

SEQ ID NO: 7468530 - DNA, 22 bp, Homo sapiens
cagcatctccatggctttggag

SEQ ID NO: 7468531 - DNA, 22 bp, Homo sapiens
cagcatctcatttgacttctgc

SEQ ID NO: 7468532 - DNA, 22 bp, Homo sapiens
cagcatctcatttgacttctgc

SEQ ID NO: 7468533 - DNA, 22 bp, Homo sapiens
cagcatctcatttgacttctgc

SEQ ID NO: 7468534 - DNA, 22 bp, Homo sapiens
cagcatctcatttgacttctgc

SEQ ID NO: 7468535 - DNA, 22 bp, Homo sapiens
cagcatctcattcattcatgtt

SEQ ID NO: 7468536 - DNA, 22 bp, Homo sapiens
cagcatctcattcattcatgtt

SEQ ID NO: 7468537 - DNA, 22 bp, Homo sapiens
cagcatctcattcattcatgtt

SEQ ID NO: 7468538 - DNA, 22 bp, Homo sapiens
cagcatctcattcattcatgtt

SEQ ID NO: 7468539 - DNA, 22 bp, Homo sapiens
cagcatctcacttcccagaagg

SEQ ID NO: 7468540 - DNA, 22 bp, Homo sapiens
cagcatctcacttcccagaagg

SEQ ID NO: 7468541 - DNA, 22 bp, Homo sapiens
cagcatctcacttcccagaagg

SEQ ID NO: 7468542 - DNA, 20 bp, Homo sapiens
cagcatctagtgagatttgc

SEQ ID NO: 7468543 - DNA, 20 bp, Homo sapiens
cagcatctagtgagatttgc

SEQ ID NO: 7468544 - DNA, 20 bp, Homo sapiens
cagcatctagtgagatttgc

SEQ ID NO: 7468545 - DNA, 22 bp, Homo sapiens
gtcacactcttccctccacatg

SEQ ID NO: 7468546 - DNA, 22 bp, Homo sapiens
gtcacactcttccctccacatg

SEQ ID NO: 7468547 - DNA, 22 bp, Homo sapiens
gtcacacttctttctgtgtctc

SEQ ID NO: 7468548 - DNA, 22 bp, Homo sapiens
gtcacagaggctgccagggttg

SEQ ID NO: 7468549 - DNA, 22 bp, Homo sapiens
gtcacactcttccctccacatg

SEQ ID NO: 7468550 - DNA, 22 bp, Homo sapiens
gtcacactagggccaagtggag

SEQ ID NO: 7468551 - DNA, 22 bp, Homo sapiens
gtcacactcaaaagctaggatg

SEQ ID NO: 7468552 - DNA, 22 bp, Homo sapiens
gtcacagcctcaatcccatctg

SEQ ID NO: 7468553 - DNA, 22 bp, Homo sapiens
gtcacagcctcaatcccatctg

SEQ ID NO: 7468554 - DNA, 22 bp, Homo sapiens
gtcacaggaaagggtgtaaggg

SEQ ID NO: 7468555 - DNA, 22 bp, Homo sapiens
gtcacagcctcaatcccatctg

SEQ ID NO: 7468556 - DNA, 22 bp, Homo sapiens
gtcacaggaaagggtgtaaggg

SEQ ID NO: 7468557 - DNA, 22 bp, Homo sapiens
gtcacaggaaagggtgtaaggg

SEQ ID NO: 7468558 - DNA, 18 bp, Homo sapiens
gtcacagcagagaactgc

SEQ ID NO: 7468559 - DNA, 18 bp, Homo sapiens
gtcacagcagagaactgc

SEQ ID NO: 7468560 - DNA, 22 bp, Homo sapiens
gtcacagatggggaaacggagg

SEQ ID NO: 7468561 - DNA, 22 bp, Homo sapiens
gtcacagatggggaaacggagg

SEQ ID NO: 7468562 - DNA, 18 bp, Homo sapiens
gtcacagcagagaactgc

SEQ ID NO: 7468563 - DNA, 22 bp, Homo sapiens
gtcacagatctcttgagtcaag

SEQ ID NO: 7468564 - DNA, 22 bp, Homo sapiens
gtcacagatctcttgagtcaag

SEQ ID NO: 7468565 - DNA, 22 bp, Homo sapiens
gtcagatctttggggatgctgt

SEQ ID NO: 7468566 - DNA, 22 bp, Homo sapiens
gtcagatctttggggatgctgt

SEQ ID NO: 7468567 - DNA, 22 bp, Homo sapiens
gtcagatctttggggatgctgt

SEQ ID NO: 7468568 - DNA, 22 bp, Homo sapiens
gtcacaggcctggatgaggggc

SEQ ID NO: 7468569 - DNA, 22 bp, Homo sapiens
gtcacaggcagtaactaggacc

SEQ ID NO: 7468570 - DNA, 22 bp, Homo sapiens
gtcacagggtccccatatggag

SEQ ID NO: 7468571 - DNA, 22 bp, Homo sapiens
gtcacaggaagcagcaggcact

SEQ ID NO: 7468572 - DNA, 22 bp, Homo sapiens
gtcacaggaagcagcaggcact

SEQ ID NO: 7468573 - DNA, 22 bp, Homo sapiens
gtcacaggaagcagcaggcact

SEQ ID NO: 7468574 - DNA, 22 bp, Homo sapiens
gtcacaggaagcagcaggcact

SEQ ID NO: 7468575 - DNA, 22 bp, Homo sapiens
gtcacaggaagcagcaggcact

SEQ ID NO: 7468576 - DNA, 22 bp, Homo sapiens
gtcacaggaagcagcaggcact

SEQ ID NO: 7468577 - DNA, 22 bp, Homo sapiens
gtcacaggcagtaactaggacc

SEQ ID NO: 7468578 - DNA, 22 bp, Homo sapiens
gtcacaggcagtaactaggacc

SEQ ID NO: 7468579 - DNA, 22 bp, Homo sapiens
gtcacaggcagtaactaggacc

SEQ ID NO: 7468580 - DNA, 22 bp, Homo sapiens
gtcacaggcctggatgaggggc

SEQ ID NO: 7468581 - DNA, 22 bp, Homo sapiens
gtcacaggcctggatgaggggc

SEQ ID NO: 7468582 - DNA, 22 bp, Homo sapiens
gtagggagcccagagcccagtg

SEQ ID NO: 7468583 - DNA, 22 bp, Homo sapiens
gtattttacttacgcatgactt

SEQ ID NO: 7468584 - DNA, 22 bp, Homo sapiens
gtattttacttacgcatgactt

SEQ ID NO: 7468585 - DNA, 22 bp, Homo sapiens
gtattttatggcatgcagtggc

SEQ ID NO: 7468586 - DNA, 22 bp, Homo sapiens
gtattttatggcatgcagtggc

SEQ ID NO: 7468587 - DNA, 22 bp, Homo sapiens
gtattttatggcatgcagtggc

SEQ ID NO: 7468588 - DNA, 20 bp, Homo sapiens
gtagggaaggaatctgcagg

SEQ ID NO: 7468589 - DNA, 22 bp, Homo sapiens
gtaggctgtgtgaggctagaga

SEQ ID NO: 7468590 - DNA, 20 bp, Homo sapiens
gtagggaaggaatctgcagg

SEQ ID NO: 7468591 - DNA, 22 bp, Homo sapiens
gtagggaaggccaacttcatgt

SEQ ID NO: 7468592 - DNA, 22 bp, Homo sapiens
gtcacacaatagtaagtggtcc

SEQ ID NO: 7468593 - DNA, 22 bp, Homo sapiens
gtcacaattataggaactcaga

SEQ ID NO: 7468594 - DNA, 22 bp, Homo sapiens
gtcacacaatagtaagtggtcc

SEQ ID NO: 7468595 - DNA, 22 bp, Homo sapiens
gtcacacagagccctgtgctca

SEQ ID NO: 7468596 - DNA, 22 bp, Homo sapiens
gtcacacacatttctttggtgc

SEQ ID NO: 7468597 - DNA, 21 bp, Homo sapiens
gtcacacaggcctggagctga

SEQ ID NO: 7468598 - DNA, 21 bp, Homo sapiens
gtcacacaggcctggagctga

SEQ ID NO: 7468599 - DNA, 21 bp, Homo sapiens
gtcacacaggcctggagctga

SEQ ID NO: 7468600 - DNA, 22 bp, Homo sapiens
gtcacacagagccctgtgctca

SEQ ID NO: 7468601 - DNA, 22 bp, Homo sapiens
gtcacacaggttgaaatgcagt

SEQ ID NO: 7468602 - DNA, 22 bp, Homo sapiens
gtcacacaggttgaaatgcagt

SEQ ID NO: 7468603 - DNA, 22 bp, Homo sapiens
gtcacacagggcctccaaatca

SEQ ID NO: 7468604 - DNA, 22 bp, Homo sapiens
gtcacacaggttgaaatgcagt

SEQ ID NO: 7468605 - DNA, 22 bp, Homo sapiens
gtcacacaggttgaaatgcagt

SEQ ID NO: 7468606 - DNA, 21 bp, Homo sapiens
gtcacacaggcctggagctga

SEQ ID NO: 7468607 - DNA, 22 bp, Homo sapiens
gtcacacagagccctgtgctca

SEQ ID NO: 7468608 - DNA, 22 bp, Homo sapiens
gtcacacagggcctccaaatca

SEQ ID NO: 7468609 - DNA, 22 bp, Homo sapiens
gtgaattaggctatggcagagg

SEQ ID NO: 7468610 - DNA, 22 bp, Homo sapiens
gtgaattaggacaaaagggctt

SEQ ID NO: 7468611 - DNA, 22 bp, Homo sapiens
gtgaattaggacaaaagggctt

SEQ ID NO: 7468612 - DNA, 22 bp, Homo sapiens
gtgaatttctgactaaaagtgc

SEQ ID NO: 7468613 - DNA, 22 bp, Homo sapiens
gtcctgtgctcagacatggggg

SEQ ID NO: 7468614 - DNA, 22 bp, Homo sapiens
gtcctgtgccgaggtgggaagc

SEQ ID NO: 7468615 - DNA, 22 bp, Homo sapiens
gtcctgtgccgaggtgggaagc

SEQ ID NO: 7468616 - DNA, 22 bp, Homo sapiens
gtcctgtgctcagacatggggg

SEQ ID NO: 7468617 - DNA, 22 bp, Homo sapiens
gtgaattacatgtatttttaag

SEQ ID NO: 7468618 - DNA, 22 bp, Homo sapiens
gtcctgtgcaccgtgggatgtt

SEQ ID NO: 7468619 - DNA, 22 bp, Homo sapiens
gtcctgtgcaccgtgggatgtt

SEQ ID NO: 7468620 - DNA, 22 bp, Homo sapiens
gtcctgtgcaccgtgggatgtt

SEQ ID NO: 7468621 - DNA, 22 bp, Homo sapiens
gtcctgtgcccagaccctctgt

SEQ ID NO: 7468622 - DNA, 22 bp, Homo sapiens
gtcctgtgccctgggtggcgct

SEQ ID NO: 7468623 - DNA, 22 bp, Homo sapiens
gtcctgtgccctgggtggcgct

SEQ ID NO: 7468624 - DNA, 22 bp, Homo sapiens
gtcctgtgccctgggtggcgct

SEQ ID NO: 7468625 - DNA, 22 bp, Homo sapiens
gtcctgtgccgaggtgggaagc

SEQ ID NO: 7468626 - DNA, 22 bp, Homo sapiens
gtcctgtgccctgggtggcgct

SEQ ID NO: 7468627 - DNA, 22 bp, Homo sapiens
gtcctgtgccctgggtggcgct

SEQ ID NO: 7468628 - DNA, 22 bp, Homo sapiens
gtcctgtgccctgggtggcgct

SEQ ID NO: 7468629 - DNA, 22 bp, Homo sapiens
gtgagagggctgggctcatgat

SEQ ID NO: 7468630 - DNA, 22 bp, Homo sapiens
gtgagagggctgggctcatgat

SEQ ID NO: 7468631 - DNA, 22 bp, Homo sapiens
gtgagagggctgggctcatgat

SEQ ID NO: 7468632 - DNA, 22 bp, Homo sapiens
gtgagagggctgggctcatgat

SEQ ID NO: 7468633 - DNA, 22 bp, Homo sapiens
gtgagagggctgggctcatgat

SEQ ID NO: 7468634 - DNA, 22 bp, Homo sapiens
gtgagagggctgggctcatgat

SEQ ID NO: 7468635 - DNA, 22 bp, Homo sapiens
gtgagagattgattgtagcggc

SEQ ID NO: 7468636 - DNA, 22 bp, Homo sapiens
gtgagagatgctttcttaacgc

SEQ ID NO: 7468637 - DNA, 22 bp, Homo sapiens
gtgaatttctgactaaaagtgc

SEQ ID NO: 7468638 - DNA, 22 bp, Homo sapiens
gtgaatttctgactaaaagtgc

SEQ ID NO: 7468639 - DNA, 22 bp, Homo sapiens
gtgaatttctgactaaaagtgc

SEQ ID NO: 7468640 - DNA, 22 bp, Homo sapiens
gtgagagctcagctgccctggg

SEQ ID NO: 7468641 - DNA, 22 bp, Homo sapiens
gtgagagctgctagactgttat

SEQ ID NO: 7468642 - DNA, 22 bp, Homo sapiens
gtgagagcctgtctggatgtcg

SEQ ID NO: 7468643 - DNA, 22 bp, Homo sapiens
gtgagagcctgtctggatgtcg

SEQ ID NO: 7468644 - DNA, 22 bp, Homo sapiens
gtcctgtgcaccgtgggatgtt

SEQ ID NO: 7468645 - DNA, 22 bp, Homo sapiens
gtcctgtgcaccgtgggatgtt

SEQ ID NO: 7468646 - DNA, 22 bp, Homo sapiens
gtcctgtgatgagtaccaggtg

SEQ ID NO: 7468647 - DNA, 22 bp, Homo sapiens
gtcctgtgatgagtaccaggtg

SEQ ID NO: 7468648 - DNA, 22 bp, Homo sapiens
gtcctgtgacctgcatcctgag

SEQ ID NO: 7468649 - DNA, 22 bp, Homo sapiens
gtcctgtgacctgcatcctgag

SEQ ID NO: 7468650 - DNA, 22 bp, Homo sapiens
gtcctgtgacctgcatcctgag

SEQ ID NO: 7468651 - DNA, 22 bp, Homo sapiens
gtcctgtgagattcatgctcaa

SEQ ID NO: 7468652 - DNA, 22 bp, Homo sapiens
gtcctgtgagattcatgctcaa

SEQ ID NO: 7468653 - DNA, 22 bp, Homo sapiens
gtcctgtgagattcatgctcaa

SEQ ID NO: 7468654 - DNA, 22 bp, Homo sapiens
gtcctgtcccccaaggctgtgg

SEQ ID NO: 7468655 - DNA, 22 bp, Homo sapiens
gtcctgtcccccaaggctgtgg

SEQ ID NO: 7468656 - DNA, 22 bp, Homo sapiens
gtcctgtcccccaaggctgtgg

SEQ ID NO: 7468657 - DNA, 22 bp, Homo sapiens
gtcctgtgacctgcatcctgag

SEQ ID NO: 7468658 - DNA, 22 bp, Homo sapiens
gtcctgtgacctgcatcctgag

SEQ ID NO: 7468659 - DNA, 22 bp, Homo sapiens
gtcctggttttcacagaccttt

SEQ ID NO: 7468660 - DNA, 22 bp, Homo sapiens
gtcctgtcccccaaggctgtgg

SEQ ID NO: 7468661 - DNA, 17 bp, Homo sapiens
gtcctggtgtgtgagga

SEQ ID NO: 7468662 - DNA, 17 bp, Homo sapiens
gtcctggtgtgtgagga

SEQ ID NO: 7468663 - DNA, 22 bp, Homo sapiens
gtcctggtgccacctgcgggat

SEQ ID NO: 7468664 - DNA, 22 bp, Homo sapiens
gtcctggtgctggtcattgtcg

SEQ ID NO: 7468665 - DNA, 22 bp, Homo sapiens
gtcctggtgctggtcattgtcg

SEQ ID NO: 7468666 - DNA, 22 bp, Homo sapiens
gtcctggtataattgtttaaaa

SEQ ID NO: 7468667 - DNA, 22 bp, Homo sapiens
gtcctggtataattgtttaaaa

SEQ ID NO: 7468668 - DNA, 22 bp, Homo sapiens
gtcctggtcctgcctccccatg

SEQ ID NO: 7468669 - DNA, 22 bp, Homo sapiens
cagccaggcccccgagtcgttg

SEQ ID NO: 7468670 - DNA, 22 bp, Homo sapiens
gtcctggtcctgcctccccatg

SEQ ID NO: 7468671 - DNA, 22 bp, Homo sapiens
gtcctggtgaggtagtgggagg

SEQ ID NO: 7468672 - DNA, 22 bp, Homo sapiens
cagccctcctttcactcccagg

SEQ ID NO: 7468673 - DNA, 22 bp, Homo sapiens
cagccctcctttcactcccagg

SEQ ID NO: 7468674 - DNA, 22 bp, Homo sapiens
cagccctcctttcactcccagg

SEQ ID NO: 7468675 - DNA, 22 bp, Homo sapiens
cagccctcctttcactcccagg

SEQ ID NO: 7468676 - DNA, 22 bp, Homo sapiens
cagccctcctttcactcccagg

SEQ ID NO: 7468677 - DNA, 22 bp, Homo sapiens
cagccctcctaccctgccaggc

SEQ ID NO: 7468678 - DNA, 22 bp, Homo sapiens
cagccctcctaccctgccaggc

SEQ ID NO: 7468679 - DNA, 22 bp, Homo sapiens
cagccctcctaccctgccaggc

SEQ ID NO: 7468680 - DNA, 22 bp, Homo sapiens
cagccctcctaccctgccaggc

SEQ ID NO: 7468681 - DNA, 22 bp, Homo sapiens
cagccctcctaccctgccaggc

SEQ ID NO: 7468682 - DNA, 22 bp, Homo sapiens
cagccctcctaccctgccaggc

SEQ ID NO: 7468683 - DNA, 22 bp, Homo sapiens
cagccctcctaccctgccaggc

SEQ ID NO: 7468684 - DNA, 22 bp, Homo sapiens
cagccctcctaccctgccaggc

SEQ ID NO: 7468685 - DNA, 22 bp, Homo sapiens
cagccctcctaccctgccaggc

SEQ ID NO: 7468686 - DNA, 20 bp, Homo sapiens
cagccctccagtggaggcag

SEQ ID NO: 7468687 - DNA, 20 bp, Homo sapiens
cagccctccagtggaggcag

SEQ ID NO: 7468688 - DNA, 20 bp, Homo sapiens
cagccctccagtggaggcag

SEQ ID NO: 7468689 - DNA, 20 bp, Homo sapiens
cagccctccagtggaggcag

SEQ ID NO: 7468690 - DNA, 20 bp, Homo sapiens
cagccctccagtggaggcag

SEQ ID NO: 7468691 - DNA, 20 bp, Homo sapiens
cagccctccagtggaggcag

SEQ ID NO: 7468692 - DNA, 22 bp, Homo sapiens
cagccctctgaagaggcgcttg

SEQ ID NO: 7468693 - DNA, 22 bp, Homo sapiens
cagccctctgaagaggcgcttg

SEQ ID NO: 7468694 - DNA, 22 bp, Homo sapiens
cagccctctgaagaggcgcttg

SEQ ID NO: 7468695 - DNA, 22 bp, Homo sapiens
cagccctctctgggccccaagg

SEQ ID NO: 7468696 - DNA, 22 bp, Homo sapiens
cagccctctgaagaggcgcttg

SEQ ID NO: 7468697 - DNA, 22 bp, Homo sapiens
cagccctctgaagaggcgcttg

SEQ ID NO: 7468698 - DNA, 22 bp, Homo sapiens
cagccctctctgggccccaagg

SEQ ID NO: 7468699 - DNA, 22 bp, Homo sapiens
cagccctctctgggccccaagg

SEQ ID NO: 7468700 - DNA, 22 bp, Homo sapiens
cagccctcctttcactcccagg

SEQ ID NO: 7468701 - DNA, 22 bp, Homo sapiens
cagccctctctgggccccaagg

SEQ ID NO: 7468702 - DNA, 22 bp, Homo sapiens
cagccctctctgggccccaagg

SEQ ID NO: 7468703 - DNA, 22 bp, Homo sapiens
cagccctctctgggccccaagg

SEQ ID NO: 7468704 - DNA, 22 bp, Homo sapiens
cagccctgaaacaacctcctct

SEQ ID NO: 7468705 - DNA, 22 bp, Homo sapiens
cagccctgaaacaacctcctct

SEQ ID NO: 7468706 - DNA, 22 bp, Homo sapiens
cagccctgaaacaacctcctct

SEQ ID NO: 7468707 - DNA, 22 bp, Homo sapiens
cagccctgaaacaacctcctct

SEQ ID NO: 7468708 - DNA, 19 bp, Homo sapiens
cagccctcttaccactgtg

SEQ ID NO: 7468709 - DNA, 19 bp, Homo sapiens
cagccctcttaccactgtg

SEQ ID NO: 7468710 - DNA, 19 bp, Homo sapiens
cagccctcttaccactgtg

SEQ ID NO: 7468711 - DNA, 22 bp, Homo sapiens
cagccctctgaagaggcgcttg

SEQ ID NO: 7468712 - DNA, 22 bp, Homo sapiens
cagccctctgaagaggcgcttg

SEQ ID NO: 7468713 - DNA, 22 bp, Homo sapiens
cagccctctgaagaggcgcttg

SEQ ID NO: 7468714 - DNA, 19 bp, Homo sapiens
cagccctcttaccactgtg

SEQ ID NO: 7468715 - DNA, 19 bp, Homo sapiens
cagccctcttaccactgtg

SEQ ID NO: 7468716 - DNA, 19 bp, Homo sapiens
cagccctcttaccactgtg

SEQ ID NO: 7468717 - DNA, 22 bp, Homo sapiens
gtgagcagaacaggtggcttct

SEQ ID NO: 7468718 - DNA, 22 bp, Homo sapiens
gtgagcagaataagggttgaga

SEQ ID NO: 7468719 - DNA, 22 bp, Homo sapiens
gtgagcagacatcaaaggctgc

SEQ ID NO: 7468720 - DNA, 22 bp, Homo sapiens
gtgagcagaacaggtggcttct

SEQ ID NO: 7468721 - DNA, 18 bp, Homo sapiens
gtgagcagagagcatcac

SEQ ID NO: 7468722 - DNA, 18 bp, Homo sapiens
gtgagcagagagcatcac

SEQ ID NO: 7468723 - DNA, 18 bp, Homo sapiens
gtgagcagagagcatcac

SEQ ID NO: 7468724 - DNA, 18 bp, Homo sapiens
gtgagcagagagcatcac

SEQ ID NO: 7468725 - DNA, 22 bp, Homo sapiens
gtgagcaaaggttaaacattta

SEQ ID NO: 7468726 - DNA, 22 bp, Homo sapiens
gtgagattccttagattcatgg

SEQ ID NO: 7468727 - DNA, 22 bp, Homo sapiens
gtgagagtgtttggaaatagaa

SEQ ID NO: 7468728 - DNA, 22 bp, Homo sapiens
gtgagagtggtttatgtccatg

SEQ ID NO: 7468729 - DNA, 22 bp, Homo sapiens
gtgagagtaccacctcaacatc

SEQ ID NO: 7468730 - DNA, 22 bp, Homo sapiens
gtgagagtgtttggaaatagaa

SEQ ID NO: 7468731 - DNA, 22 bp, Homo sapiens
gtgagagtggtttatgtccatg

SEQ ID NO: 7468732 - DNA, 22 bp, Homo sapiens
gtgagatggagttggtgtcttt

SEQ ID NO: 7468733 - DNA, 18 bp, Homo sapiens
gtgagcagagagcatcac

SEQ ID NO: 7468734 - DNA, 22 bp, Homo sapiens
gtgagcagagatcgcgtgattg

SEQ ID NO: 7468735 - DNA, 22 bp, Homo sapiens
gtgagcagagatcgcgtgattg

SEQ ID NO: 7468736 - DNA, 23 bp, Homo sapiens
gtgagcagcaccatgaggctaga

SEQ ID NO: 7468737 - DNA, 23 bp, Homo sapiens
gtgagcagcaccatgaggctaga

SEQ ID NO: 7468738 - DNA, 22 bp, Homo sapiens
gtgagcagagatcgcgtgattg

SEQ ID NO: 7468739 - DNA, 23 bp, Homo sapiens
gtgagcagcaccatgaggctaga

SEQ ID NO: 7468740 - DNA, 23 bp, Homo sapiens
gtgagcagcaccatgaggctaga

SEQ ID NO: 7468741 - DNA, 23 bp, Homo sapiens
gtgagcagcaccatgaggctaga

SEQ ID NO: 7468742 - DNA, 23 bp, Homo sapiens
gtgagcagcccactaggaatgcc

SEQ ID NO: 7468743 - DNA, 22 bp, Homo sapiens
cagccctcatcccgcctgcgtt

SEQ ID NO: 7468744 - DNA, 22 bp, Homo sapiens
cagccctcatctcagcttcttt

SEQ ID NO: 7468745 - DNA, 22 bp, Homo sapiens
cagccctcatctcagcttcttt

SEQ ID NO: 7468746 - DNA, 22 bp, Homo sapiens
cagccctcatctcagcttcttt

SEQ ID NO: 7468747 - DNA, 22 bp, Homo sapiens
cagccctcatcccgcctgcgtt

SEQ ID NO: 7468748 - DNA, 22 bp, Homo sapiens
cagccctcatcccgcctgcgtt

SEQ ID NO: 7468749 - DNA, 22 bp, Homo sapiens
cagccctgtccagcagagggtg

SEQ ID NO: 7468750 - DNA, 22 bp, Homo sapiens
cagccctgtccagcagagggtg

SEQ ID NO: 7468751 - DNA, 22 bp, Homo sapiens
cagccctgtccagcagagggtg

SEQ ID NO: 7468752 - DNA, 22 bp, Homo sapiens
cagccctgtccagcagagggtg

SEQ ID NO: 7468753 - DNA, 22 bp, Homo sapiens
cagccctgtccagcagagggtg

SEQ ID NO: 7468754 - DNA, 22 bp, Homo sapiens
cagccctgtccagcagagggtg

SEQ ID NO: 7468755 - DNA, 22 bp, Homo sapiens
cagccctgtccaatgtctgctc

SEQ ID NO: 7468756 - DNA, 22 bp, Homo sapiens
cagccctgtccaatgtctgctc

SEQ ID NO: 7468757 - DNA, 22 bp, Homo sapiens
cagccctgtccagcagagggtg

SEQ ID NO: 7468758 - DNA, 22 bp, Homo sapiens
cagccctgtccaatgtctgctc

SEQ ID NO: 7468759 - DNA, 22 bp, Homo sapiens
cagccctgtccctgagggacct

SEQ ID NO: 7468760 - DNA, 22 bp, Homo sapiens
cagccctgtccctgagggacct

SEQ ID NO: 7468761 - DNA, 22 bp, Homo sapiens
cagccctgtccctgagggacct

SEQ ID NO: 7468762 - DNA, 22 bp, Homo sapiens
cagccctgtccctgagggacct

SEQ ID NO: 7468763 - DNA, 22 bp, Homo sapiens
cagccctgtccctgagggacct

SEQ ID NO: 7468764 - DNA, 22 bp, Homo sapiens
cagccctgtccctgagggacct

SEQ ID NO: 7468765 - DNA, 22 bp, Homo sapiens
cagccctgtccagcagagggtg

SEQ ID NO: 7468766 - DNA, 22 bp, Homo sapiens
cagccctgtccagcagagggtg

SEQ ID NO: 7468767 - DNA, 22 bp, Homo sapiens
cagccctgtccagcagagggtg

SEQ ID NO: 7468768 - DNA, 22 bp, Homo sapiens
cagccctgtccagcagagggtg

SEQ ID NO: 7468769 - DNA, 22 bp, Homo sapiens
cagccctggccccaggtggtct

SEQ ID NO: 7468770 - DNA, 22 bp, Homo sapiens
cagccctggccccaggtggtct

SEQ ID NO: 7468771 - DNA, 22 bp, Homo sapiens
cagccctggccccaggtggtct

SEQ ID NO: 7468772 - DNA, 22 bp, Homo sapiens
cagccctggccccaggtggtct

SEQ ID NO: 7468773 - DNA, 22 bp, Homo sapiens
cagccctggcccaggtgcctta

SEQ ID NO: 7468774 - DNA, 22 bp, Homo sapiens
cagccctgaaacaacctcctct

SEQ ID NO: 7468775 - DNA, 22 bp, Homo sapiens
cagccctggcccaggtgcctta

SEQ ID NO: 7468776 - DNA, 22 bp, Homo sapiens
cagccctggcccaggtgcctta

SEQ ID NO: 7468777 - DNA, 22 bp, Homo sapiens
cagccctggcccaggtgcctta

SEQ ID NO: 7468778 - DNA, 22 bp, Homo sapiens
cagccctgtccaatgtctgctc

SEQ ID NO: 7468779 - DNA, 22 bp, Homo sapiens
cagccctgtccaatgtctgctc

SEQ ID NO: 7468780 - DNA, 22 bp, Homo sapiens
cagccctgtccaatgtctgctc

SEQ ID NO: 7468781 - DNA, 22 bp, Homo sapiens
cagccctgtccaatgtctgctc

SEQ ID NO: 7468782 - DNA, 22 bp, Homo sapiens
cagccctgtccaatgtctgctc

SEQ ID NO: 7468783 - DNA, 22 bp, Homo sapiens
cagccctgtccaatgtctgctc

SEQ ID NO: 7468784 - DNA, 22 bp, Homo sapiens
cagccctggtgccaaggttccc

SEQ ID NO: 7468785 - DNA, 22 bp, Homo sapiens
cagccctgtccaatgtctgctc

SEQ ID NO: 7468786 - DNA, 22 bp, Homo sapiens
cagccctgtccaatgtctgctc

SEQ ID NO: 7468787 - DNA, 22 bp, Homo sapiens
cagccctggtgccaaggttccc

SEQ ID NO: 7468788 - DNA, 22 bp, Homo sapiens
cagccctggtgccaaggttccc

SEQ ID NO: 7468789 - DNA, 22 bp, Homo sapiens
cagccctggccccaggtggtct

SEQ ID NO: 7468790 - DNA, 22 bp, Homo sapiens
cagccctggccccaggtggtct

SEQ ID NO: 7468791 - DNA, 22 bp, Homo sapiens
cagccctggtgccaaggttccc

SEQ ID NO: 7468792 - DNA, 22 bp, Homo sapiens
cagccctggtgccaaggttccc

SEQ ID NO: 7468793 - DNA, 22 bp, Homo sapiens
cagccctgtctatgactgatga

SEQ ID NO: 7468794 - DNA, 22 bp, Homo sapiens
cagccctgtccctgagggacct

SEQ ID NO: 7468795 - DNA, 22 bp, Homo sapiens
cagccctgtccctgagggacct

SEQ ID NO: 7468796 - DNA, 22 bp, Homo sapiens
cagccctgtctatgactgatga

SEQ ID NO: 7468797 - DNA, 22 bp, Homo sapiens
cagccctgtccctgagggacct

SEQ ID NO: 7468798 - DNA, 22 bp, Homo sapiens
cagccctgtctatgactgatga

SEQ ID NO: 7468799 - DNA, 22 bp, Homo sapiens
cagccctgtctatgactgatga

SEQ ID NO: 7468800 - DNA, 22 bp, Homo sapiens
cagccctgtctatgactgatga

SEQ ID NO: 7468801 - DNA, 22 bp, Homo sapiens
cagccctgtctatgactgatga

SEQ ID NO: 7468802 - DNA, 22 bp, Homo sapiens
cagccctgtctatgactgatga

SEQ ID NO: 7468803 - DNA, 22 bp, Homo sapiens
ggtataaatgatcagatcgctg

SEQ ID NO: 7468804 - DNA, 22 bp, Homo sapiens
ggtagtttaagaaataattgtt

SEQ ID NO: 7468805 - DNA, 22 bp, Homo sapiens
ggtagtgttgagcagtgcaaat

SEQ ID NO: 7468806 - DNA, 22 bp, Homo sapiens
ggtagtcggccttgccctgggc

SEQ ID NO: 7468807 - DNA, 22 bp, Homo sapiens
ggtagtcatggatagctatgag

SEQ ID NO: 7468808 - DNA, 22 bp, Homo sapiens
ggtataaatgatcagatcgctg

SEQ ID NO: 7468809 - DNA, 22 bp, Homo sapiens
ggtataaatgatcagatcgctg

SEQ ID NO: 7468810 - DNA, 22 bp, Homo sapiens
ggtatactgcatgacattgggg

SEQ ID NO: 7468811 - DNA, 22 bp, Homo sapiens
ggtatactgcatgacattgggg

SEQ ID NO: 7468812 - DNA, 19 bp, Homo sapiens
ggtatatgggcctcacttg

SEQ ID NO: 7468813 - DNA, 19 bp, Homo sapiens
ggtatatgggcctcacttg

SEQ ID NO: 7468814 - DNA, 22 bp, Homo sapiens
ggtattcacaatatttaaagag

SEQ ID NO: 7468815 - DNA, 22 bp, Homo sapiens
ggtattcaatcagtgttcattc

SEQ ID NO: 7468816 - DNA, 22 bp, Homo sapiens
ggtatggatcagatgggctcaa

SEQ ID NO: 7468817 - DNA, 22 bp, Homo sapiens
ggtatgggcctgagaatctgtc

SEQ ID NO: 7468818 - DNA, 19 bp, Homo sapiens
ggtattcaagctatattag

SEQ ID NO: 7468819 - DNA, 22 bp, Homo sapiens
gggttcagtccctcttgctact

SEQ ID NO: 7468820 - DNA, 22 bp, Homo sapiens
gggttcagtccctcttgctact

SEQ ID NO: 7468821 - DNA, 22 bp, Homo sapiens
gggttcagtccctcttgctact

SEQ ID NO: 7468822 - DNA, 22 bp, Homo sapiens
gggttcagagtcaggtgtgata

SEQ ID NO: 7468823 - DNA, 22 bp, Homo sapiens
gggttcagagtcaggtgtgata

SEQ ID NO: 7468824 - DNA, 22 bp, Homo sapiens
gggttcaggttggcctgagcac

SEQ ID NO: 7468825 - DNA, 22 bp, Homo sapiens
gggttcaggttggcctgagcac

SEQ ID NO: 7468826 - DNA, 22 bp, Homo sapiens
gggttcaggttggcctgagcac

SEQ ID NO: 7468827 - DNA, 22 bp, Homo sapiens
gggttcagtccctcttgctact

SEQ ID NO: 7468828 - DNA, 22 bp, Homo sapiens
gggttcagtccctcttgctact

SEQ ID NO: 7468829 - DNA, 22 bp, Homo sapiens
gggttccctgcctggccactct

SEQ ID NO: 7468830 - DNA, 22 bp, Homo sapiens
gggttgaggcggatgtcggcgg

SEQ ID NO: 7468831 - DNA, 22 bp, Homo sapiens
gggttgaggcggatgtcggcgg

SEQ ID NO: 7468832 - DNA, 22 bp, Homo sapiens
gggttcatcaaaggacagactc

SEQ ID NO: 7468833 - DNA, 22 bp, Homo sapiens
gggttccctgcctggccactct

SEQ ID NO: 7468834 - DNA, 21 bp, Homo sapiens
gggtgtggaaattacatcctg

SEQ ID NO: 7468835 - DNA, 20 bp, Homo sapiens
gggtgtggcctgggaatttg

SEQ ID NO: 7468836 - DNA, 20 bp, Homo sapiens
gggtgtggcctgggaatttg

SEQ ID NO: 7468837 - DNA, 22 bp, Homo sapiens
gggtgtggctgcgtgccaataa

SEQ ID NO: 7468838 - DNA, 22 bp, Homo sapiens
gggtgtggctgcgtgccaataa

SEQ ID NO: 7468839 - DNA, 20 bp, Homo sapiens
gggtgtggcctgggaatttg

SEQ ID NO: 7468840 - DNA, 22 bp, Homo sapiens
gggtgggatctgtggagcctca

SEQ ID NO: 7468841 - DNA, 22 bp, Homo sapiens
gggtgggatctgtggagcctca

SEQ ID NO: 7468842 - DNA, 21 bp, Homo sapiens
gggtgtggaaattacatcctg

SEQ ID NO: 7468843 - DNA, 22 bp, Homo sapiens
gggtgtgcaggtcatggcgtct

SEQ ID NO: 7468844 - DNA, 22 bp, Homo sapiens
gggtgtgcaggtcatggcgtct

SEQ ID NO: 7468845 - DNA, 22 bp, Homo sapiens
gggtgggatgccgctgtctcca

SEQ ID NO: 7468846 - DNA, 22 bp, Homo sapiens
gggtgtgtcttttgctcctgga

SEQ ID NO: 7468847 - DNA, 20 bp, Homo sapiens
gggtgtgtgcagggcctggt

SEQ ID NO: 7468848 - DNA, 22 bp, Homo sapiens
gggtgtgtcttttgctcctgga

SEQ ID NO: 7468849 - DNA, 20 bp, Homo sapiens
gggtgtgggcccggccaggc

SEQ ID NO: 7468850 - DNA, 20 bp, Homo sapiens
gggtgtgggcccggccaggc

SEQ ID NO: 7468851 - DNA, 20 bp, Homo sapiens
gggtgtgggcccggccaggc

SEQ ID NO: 7468852 - DNA, 20 bp, Homo sapiens
gggtgtgggcccggccaggc

SEQ ID NO: 7468853 - DNA, 22 bp, Homo sapiens
gggtgtggctgcgtgccaataa

SEQ ID NO: 7468854 - DNA, 22 bp, Homo sapiens
gggtgtgttcctaaggaaacca

SEQ ID NO: 7468855 - DNA, 22 bp, Homo sapiens
gggtgtgtgcagggtggcactc

SEQ ID NO: 7468856 - DNA, 22 bp, Homo sapiens
gggtgtgtgcagggtggcactc

SEQ ID NO: 7468857 - DNA, 20 bp, Homo sapiens
gggtgtgtgcagggcctggt

SEQ ID NO: 7468858 - DNA, 20 bp, Homo sapiens
gggtgtgtgcagggcctggt

SEQ ID NO: 7468859 - DNA, 22 bp, Homo sapiens
gggtgtgttacaatgatgccga

SEQ ID NO: 7468860 - DNA, 22 bp, Homo sapiens
gggtgtgttcctaaggaaacca

SEQ ID NO: 7468861 - DNA, 22 bp, Homo sapiens
gggtgtttatgtattatgatgt

SEQ ID NO: 7468862 - DNA, 22 bp, Homo sapiens
gggtgttgattttacactaaaa

SEQ ID NO: 7468863 - DNA, 22 bp, Homo sapiens
gggttaaagcaggaagcatctt

SEQ ID NO: 7468864 - DNA, 22 bp, Homo sapiens
gggttaaacatgctatatgagt

SEQ ID NO: 7468865 - DNA, 22 bp, Homo sapiens
gggttaaaacaggaagatcagc

SEQ ID NO: 7468866 - DNA, 22 bp, Homo sapiens
gggttcagactaaagctatgca

SEQ ID NO: 7468867 - DNA, 18 bp, Homo sapiens
gggttcacctgcctttgg

SEQ ID NO: 7468868 - DNA, 22 bp, Homo sapiens
gggttcagactaaagctatgca

SEQ ID NO: 7468869 - DNA, 22 bp, Homo sapiens
gggttcagactaaagctatgca

SEQ ID NO: 7468870 - DNA, 22 bp, Homo sapiens
gggttaggttctagaggcacaa

SEQ ID NO: 7468871 - DNA, 22 bp, Homo sapiens
gggttaggttctagaggcacaa

SEQ ID NO: 7468872 - DNA, 22 bp, Homo sapiens
gggtcccagcataggggaagca

SEQ ID NO: 7468873 - DNA, 22 bp, Homo sapiens
gggtcccagaggcaaaggacta

SEQ ID NO: 7468874 - DNA, 19 bp, Homo sapiens
gggtcccaaaagatgtgct

SEQ ID NO: 7468875 - DNA, 22 bp, Homo sapiens
gggtcccagcataggggaagca

SEQ ID NO: 7468876 - DNA, 22 bp, Homo sapiens
gggtcccaggtctggaaaagca

SEQ ID NO: 7468877 - DNA, 22 bp, Homo sapiens
gggtcccaggtctggaaaagca

SEQ ID NO: 7468878 - DNA, 22 bp, Homo sapiens
gggtcccaggaaggagcagtgt

SEQ ID NO: 7468879 - DNA, 18 bp, Homo sapiens
gggtccccagctgcaggg

SEQ ID NO: 7468880 - DNA, 22 bp, Homo sapiens
gggtccagtttcatctgaggtt

SEQ ID NO: 7468881 - DNA, 22 bp, Homo sapiens
gggtccagtttcatctgaggtt

SEQ ID NO: 7468882 - DNA, 22 bp, Homo sapiens
gggtccagtttcatctgaggtt

SEQ ID NO: 7468883 - DNA, 22 bp, Homo sapiens
gggtccaggtcttcaggcagag

SEQ ID NO: 7468884 - DNA, 22 bp, Homo sapiens
gggtccaggtcttcaggcagag

SEQ ID NO: 7468885 - DNA, 22 bp, Homo sapiens
gggtccaggtcttcaggcagag

SEQ ID NO: 7468886 - DNA, 22 bp, Homo sapiens
gggtccagtagttggtggccgt

SEQ ID NO: 7468887 - DNA, 22 bp, Homo sapiens
gggtccaggtttagtcatttgt

SEQ ID NO: 7468888 - DNA, 22 bp, Homo sapiens
gggtccagtagttggtggccgt

SEQ ID NO: 7468889 - DNA, 22 bp, Homo sapiens
gggtccagtagttggtggccgt

SEQ ID NO: 7468890 - DNA, 22 bp, Homo sapiens
gggtccaggtcttcaggcagag

SEQ ID NO: 7468891 - DNA, 22 bp, Homo sapiens
gggtccaggtcttcaggcagag

SEQ ID NO: 7468892 - DNA, 22 bp, Homo sapiens
gggtccaggtcttcaggcagag

SEQ ID NO: 7468893 - DNA, 22 bp, Homo sapiens
gggtccaggtcttcaggcagag

SEQ ID NO: 7468894 - DNA, 22 bp, Homo sapiens
gggtccaggtcttcaggcagag

SEQ ID NO: 7468895 - DNA, 22 bp, Homo sapiens
gggtccaggtcttcaggcagag

SEQ ID NO: 7468896 - DNA, 22 bp, Homo sapiens
gggtccaggtcttcaggcagag

SEQ ID NO: 7468897 - DNA, 22 bp, Homo sapiens
gggtccaggtcttcaggcagag

SEQ ID NO: 7468898 - DNA, 21 bp, Homo sapiens
gggtagcagaggaggccgtgg

SEQ ID NO: 7468899 - DNA, 22 bp, Homo sapiens
gggtacctccgtgctgactgct

SEQ ID NO: 7468900 - DNA, 22 bp, Homo sapiens
gggtacttaatatttacggggt

SEQ ID NO: 7468901 - DNA, 22 bp, Homo sapiens
gggtagcatgtgtcagagtttg

SEQ ID NO: 7468902 - DNA, 22 bp, Homo sapiens
gggtacagttcttccagtgtca

SEQ ID NO: 7468903 - DNA, 22 bp, Homo sapiens
gggtacagttcttccagtgtca

SEQ ID NO: 7468904 - DNA, 22 bp, Homo sapiens
gggtacagttcttccagtgtca

SEQ ID NO: 7468905 - DNA, 22 bp, Homo sapiens
gggtaccaagctgcttgggggc

SEQ ID NO: 7468906 - DNA, 22 bp, Homo sapiens
gggtaccacagcaaccttcctg

SEQ ID NO: 7468907 - DNA, 22 bp, Homo sapiens
gggtccagggccagtggctgag

SEQ ID NO: 7468908 - DNA, 22 bp, Homo sapiens
gggtaggaaatccagaggtggc

SEQ ID NO: 7468909 - DNA, 22 bp, Homo sapiens
gggtaggaaatccagaggtggc

SEQ ID NO: 7468910 - DNA, 22 bp, Homo sapiens
gggtaggaaatccagaggtggc

SEQ ID NO: 7468911 - DNA, 22 bp, Homo sapiens
gggtaggaaatccagaggtggc

SEQ ID NO: 7468912 - DNA, 22 bp, Homo sapiens
gggtaggaaatccagaggtggc

SEQ ID NO: 7468913 - DNA, 22 bp, Homo sapiens
gggtaggaaatccagaggtggc

SEQ ID NO: 7468914 - DNA, 22 bp, Homo sapiens
gggtagccagacaaggggatgc

SEQ ID NO: 7468915 - DNA, 22 bp, Homo sapiens
gggtaggaaatccagaggtggc

SEQ ID NO: 7468916 - DNA, 22 bp, Homo sapiens
gggtaggaaatccagaggtggc

SEQ ID NO: 7468917 - DNA, 22 bp, Homo sapiens
gggtaggaaatccagaggtggc

SEQ ID NO: 7468918 - DNA, 20 bp, Homo sapiens
gggtccctccggcctgctat

SEQ ID NO: 7468919 - DNA, 20 bp, Homo sapiens
gggtccctccggcctgctat

SEQ ID NO: 7468920 - DNA, 18 bp, Homo sapiens
gggtccccagctgcaggg

SEQ ID NO: 7468921 - DNA, 22 bp, Homo sapiens
gggtcccctcatcatggagact

SEQ ID NO: 7468922 - DNA, 22 bp, Homo sapiens
gggtccctcgttctgggatctg

SEQ ID NO: 7468923 - DNA, 22 bp, Homo sapiens
gggtccctggaattacttgaca

SEQ ID NO: 7468924 - DNA, 22 bp, Homo sapiens
gggtccctggaattacttgaca

SEQ ID NO: 7468925 - DNA, 22 bp, Homo sapiens
gggtccctggaattacttgaca

SEQ ID NO: 7468926 - DNA, 22 bp, Homo sapiens
gggtccctggaattacttgaca

SEQ ID NO: 7468927 - DNA, 22 bp, Homo sapiens
gggtccctggaattacttgaca

SEQ ID NO: 7468928 - DNA, 20 bp, Homo sapiens
gggtcctgacttggtctcct

SEQ ID NO: 7468929 - DNA, 20 bp, Homo sapiens
gggtcctgacttggtctcct

SEQ ID NO: 7468930 - DNA, 20 bp, Homo sapiens
gggtcctgacttggtctcct

SEQ ID NO: 7468931 - DNA, 22 bp, Homo sapiens
gggtcctgcgtgggcccaggac

SEQ ID NO: 7468932 - DNA, 22 bp, Homo sapiens
gggtcctgcgtgggcccaggac

SEQ ID NO: 7468933 - DNA, 20 bp, Homo sapiens
gggtcctgacttggtctcct

SEQ ID NO: 7468934 - DNA, 20 bp, Homo sapiens
gggtcctgacttggtctcct

SEQ ID NO: 7468935 - DNA, 18 bp, Homo sapiens
gggtcctgtgggagacag

SEQ ID NO: 7468936 - DNA, 18 bp, Homo sapiens
gggtcctgttcttggaag

SEQ ID NO: 7468937 - DNA, 18 bp, Homo sapiens
gggtcctgttcttggaag

SEQ ID NO: 7468938 - DNA, 22 bp, Homo sapiens
gggtgggatctgtggagcctca

SEQ ID NO: 7468939 - DNA, 22 bp, Homo sapiens
gggtgggatctgtggagcctca

SEQ ID NO: 7468940 - DNA, 22 bp, Homo sapiens
gggtcctgcgtgggcccaggac

SEQ ID NO: 7468941 - DNA, 22 bp, Homo sapiens
gggtcctgcgtgggcccaggac

SEQ ID NO: 7468942 - DNA, 22 bp, Homo sapiens
gggtcctgcgtgggcccaggac

SEQ ID NO: 7468943 - DNA, 22 bp, Homo sapiens
gggtcctggaatctgcatttta

SEQ ID NO: 7468944 - DNA, 22 bp, Homo sapiens
gggtcctggaatctgcatttta

SEQ ID NO: 7468945 - DNA, 18 bp, Homo sapiens
gggtcctgtgggagacag

SEQ ID NO: 7468946 - DNA, 18 bp, Homo sapiens
gggtcctgtgggagacag

SEQ ID NO: 7468947 - DNA, 18 bp, Homo sapiens
gggtcctgtgggagacag

SEQ ID NO: 7468948 - DNA, 21 bp, Homo sapiens
gggtcctgggatgggatccag

SEQ ID NO: 7468949 - DNA, 22 bp, Homo sapiens
ggtcaagacgggctctgccctt

SEQ ID NO: 7468950 - DNA, 22 bp, Homo sapiens
ggtcaagtaacaaatcaggagc

SEQ ID NO: 7468951 - DNA, 22 bp, Homo sapiens
ggtcaagtaacaaatcaggagc

SEQ ID NO: 7468952 - DNA, 22 bp, Homo sapiens
ggtcacaaggtactgtaagaaa

SEQ ID NO: 7468953 - DNA, 22 bp, Homo sapiens
ggtcacaaggcagataataagg

SEQ ID NO: 7468954 - DNA, 22 bp, Homo sapiens
ggtcacacaccaggacctgcag

SEQ ID NO: 7468955 - DNA, 22 bp, Homo sapiens
ggtcacacaccaggacctgcag

SEQ ID NO: 7468956 - DNA, 21 bp, Homo sapiens
ggtcacacagctggtaaatag

SEQ ID NO: 7468957 - DNA, 22 bp, Homo sapiens
ggtcacaccccaagtacattcg

SEQ ID NO: 7468958 - DNA, 20 bp, Homo sapiens
cagatatcagaagcacagcc

SEQ ID NO: 7468959 - DNA, 22 bp, Homo sapiens
cagatatgataggattagcaca

SEQ ID NO: 7468960 - DNA, 22 bp, Homo sapiens
cagatatgctgagactcctgtg

SEQ ID NO: 7468961 - DNA, 22 bp, Homo sapiens
cagatatgctgagactcctgtg

SEQ ID NO: 7468962 - DNA, 22 bp, Homo sapiens
cagatatgctgagactcctgtg

SEQ ID NO: 7468963 - DNA, 22 bp, Homo sapiens
ggtcacagggaagggctctcaa

SEQ ID NO: 7468964 - DNA, 22 bp, Homo sapiens
cagatatattttccttattagg

SEQ ID NO: 7468965 - DNA, 20 bp, Homo sapiens
cagatatcagaagcacagcc

SEQ ID NO: 7468966 - DNA, 22 bp, Homo sapiens
ggtcacagggaagggctctcaa

SEQ ID NO: 7468967 - DNA, 22 bp, Homo sapiens
ggtcacagctttttcagcagca

SEQ ID NO: 7468968 - DNA, 22 bp, Homo sapiens
ggtcacagctttttcagcagca

SEQ ID NO: 7468969 - DNA, 22 bp, Homo sapiens
ggtcacagctttttcagcagca

SEQ ID NO: 7468970 - DNA, 22 bp, Homo sapiens
ggtcaaagtgaggagtcaggtt

SEQ ID NO: 7468971 - DNA, 22 bp, Homo sapiens
ggtcaaagtgaggagtcaggtt

SEQ ID NO: 7468972 - DNA, 22 bp, Homo sapiens
ggtcaaagtgaggagtcaggtt

SEQ ID NO: 7468973 - DNA, 22 bp, Homo sapiens
ggtcaaagttgaagaagggcat

SEQ ID NO: 7468974 - DNA, 22 bp, Homo sapiens
ggtcaaagttgaagaagggcat

SEQ ID NO: 7468975 - DNA, 22 bp, Homo sapiens
ggtcaacagaggtaatggtaac

SEQ ID NO: 7468976 - DNA, 22 bp, Homo sapiens
ggtcaaagggtgagatggcagg

SEQ ID NO: 7468977 - DNA, 22 bp, Homo sapiens
ggtcaaatatacataaaaactt

SEQ ID NO: 7468978 - DNA, 22 bp, Homo sapiens
ggtcaacactgtgaccaacagg

SEQ ID NO: 7468979 - DNA, 22 bp, Homo sapiens
ggtcaacagaatttgtactcag

SEQ ID NO: 7468980 - DNA, 22 bp, Homo sapiens
ggtatttatagtggtgcttagt

SEQ ID NO: 7468981 - DNA, 22 bp, Homo sapiens
ggtatttatatgtctgaagctg

SEQ ID NO: 7468982 - DNA, 22 bp, Homo sapiens
ggtatttatatgtctgaagctg

SEQ ID NO: 7468983 - DNA, 22 bp, Homo sapiens
ggtattgcttggttgcctagca

SEQ ID NO: 7468984 - DNA, 21 bp, Homo sapiens
ggtattctgtgtcacctttgg

SEQ ID NO: 7468985 - DNA, 22 bp, Homo sapiens
ggtattctaagctgtgtttact

SEQ ID NO: 7468986 - DNA, 22 bp, Homo sapiens
ggtatttactgagagccactct

SEQ ID NO: 7468987 - DNA, 22 bp, Homo sapiens
ggtatttactgagagccactct

SEQ ID NO: 7468988 - DNA, 22 bp, Homo sapiens
cagatgaagtattacagacatt

SEQ ID NO: 7468989 - DNA, 22 bp, Homo sapiens
cagatgaagtattacagacatt

SEQ ID NO: 7468990 - DNA, 22 bp, Homo sapiens
cagatgaagtttgcctagagct

SEQ ID NO: 7468991 - DNA, 22 bp, Homo sapiens
cagatgaataaatgatgaggta

SEQ ID NO: 7468992 - DNA, 22 bp, Homo sapiens
cagatgaataaatgatgaggta

SEQ ID NO: 7468993 - DNA, 22 bp, Homo sapiens
cagatgaataaatgatgaggta

SEQ ID NO: 7468994 - DNA, 21 bp, Homo sapiens
cagatgacccacatggtgtct

SEQ ID NO: 7468995 - DNA, 22 bp, Homo sapiens
cagatgaccaggctccacccag

SEQ ID NO: 7468996 - DNA, 22 bp, Homo sapiens
cagatatgtggattctattagc

SEQ ID NO: 7468997 - DNA, 19 bp, Homo sapiens
cagatgagaaaagtgaggt

SEQ ID NO: 7468998 - DNA, 19 bp, Homo sapiens
cagatgagaaaagtgaggt

SEQ ID NO: 7468999 - DNA, 19 bp, Homo sapiens
cagatgagaaaagtgaggt

SEQ ID NO: 7469000 - DNA, 19 bp, Homo sapiens
cagatgagaaaagtgaggt

SEQ ID NO: 7469001 - DNA, 19 bp, Homo sapiens
cagatgagaaaagtgaggt

SEQ ID NO: 7469002 - DNA, 19 bp, Homo sapiens
cagatgagaaaagtgaggt

SEQ ID NO: 7469003 - DNA, 22 bp, Homo sapiens
cagatgagagtggccagggttc

SEQ ID NO: 7469004 - DNA, 19 bp, Homo sapiens
cagatgagaaaagtgaggt

SEQ ID NO: 7469005 - DNA, 18 bp, Homo sapiens
cagatgagatgcaatctc

SEQ ID NO: 7469006 - DNA, 22 bp, Homo sapiens
cagatgagagtggccagggttc

SEQ ID NO: 7469007 - DNA, 22 bp, Homo sapiens
cagatgagagtggccagggttc

SEQ ID NO: 7469008 - DNA, 18 bp, Homo sapiens
cagatgagatgcaatctc

SEQ ID NO: 7469009 - DNA, 22 bp, Homo sapiens
cagatgagggctggaggtgagc

SEQ ID NO: 7469010 - DNA, 22 bp, Homo sapiens
cagatgagggctggaggtgagc

SEQ ID NO: 7469011 - DNA, 23 bp, Homo sapiens
cagatgaggttggcagcatggtc

SEQ ID NO: 7469012 - DNA, 23 bp, Homo sapiens
cagatgaggttggcagcatggtc

SEQ ID NO: 7469013 - DNA, 23 bp, Homo sapiens
cagatgaggttggcagcatggtc

SEQ ID NO: 7469014 - DNA, 23 bp, Homo sapiens
cagatgaggttggcagcatggtc

SEQ ID NO: 7469015 - DNA, 23 bp, Homo sapiens
cagatgaggttggcagcatggtc

SEQ ID NO: 7469016 - DNA, 23 bp, Homo sapiens
cagatgaggttggcagcatggtc

SEQ ID NO: 7469017 - DNA, 22 bp, Homo sapiens
cagatgaggcaacctcattgct

SEQ ID NO: 7469018 - DNA, 22 bp, Homo sapiens
cagatgaggacagatgactggg

SEQ ID NO: 7469019 - DNA, 22 bp, Homo sapiens
cagatgaggacagatgactggg

SEQ ID NO: 7469020 - DNA, 22 bp, Homo sapiens
cagatgagcatgggcacaagca

SEQ ID NO: 7469021 - DNA, 22 bp, Homo sapiens
cagatgagcatgggcacaagca

SEQ ID NO: 7469022 - DNA, 22 bp, Homo sapiens
cagatgagcatgggcacaagca

SEQ ID NO: 7469023 - DNA, 22 bp, Homo sapiens
cagatgagcatgggcacaagca

SEQ ID NO: 7469024 - DNA, 22 bp, Homo sapiens
cagatgagcatgggcacaagca

SEQ ID NO: 7469025 - DNA, 22 bp, Homo sapiens
ggtcctgcgtctggctcgcccg

SEQ ID NO: 7469026 - DNA, 22 bp, Homo sapiens
ggtcctgcgtctggctcgcccg

SEQ ID NO: 7469027 - DNA, 22 bp, Homo sapiens
ggtcctgctggctcagctgagc

SEQ ID NO: 7469028 - DNA, 22 bp, Homo sapiens
ggtcctggaaattgacggaaag

SEQ ID NO: 7469029 - DNA, 22 bp, Homo sapiens
ggtcctggaagtgtaagtggca

SEQ ID NO: 7469030 - DNA, 22 bp, Homo sapiens
ggtcctggaagtgtaagtggca

SEQ ID NO: 7469031 - DNA, 22 bp, Homo sapiens
ggtcctggaaattgacggaaag

SEQ ID NO: 7469032 - DNA, 22 bp, Homo sapiens
ggtcctggaaattgacggaaag

SEQ ID NO: 7469033 - DNA, 22 bp, Homo sapiens
ggtcctggcagctctgtgtcca

SEQ ID NO: 7469034 - DNA, 22 bp, Homo sapiens
ggtcctggcagctctgtgtcca

SEQ ID NO: 7469035 - DNA, 22 bp, Homo sapiens
ggtcctggcagctctgtgtcca

SEQ ID NO: 7469036 - DNA, 22 bp, Homo sapiens
ggtcctggcagctctgtgtcca

SEQ ID NO: 7469037 - DNA, 22 bp, Homo sapiens
ggtcctggaagtgtaagtggca

SEQ ID NO: 7469038 - DNA, 22 bp, Homo sapiens
ggtcctggaagtgtaagtggca

SEQ ID NO: 7469039 - DNA, 22 bp, Homo sapiens
ggtcctggaagtgtaagtggca

SEQ ID NO: 7469040 - DNA, 22 bp, Homo sapiens
ggtcctggatgagacaggtagt

SEQ ID NO: 7469041 - DNA, 22 bp, Homo sapiens
ggtcctggatgagacaggtagt

SEQ ID NO: 7469042 - DNA, 22 bp, Homo sapiens
ggtcctggatgagacaggtagt

SEQ ID NO: 7469043 - DNA, 22 bp, Homo sapiens
cagatggcacagatttagagtg

SEQ ID NO: 7469044 - DNA, 20 bp, Homo sapiens
cagatggcacgtcagggcat

SEQ ID NO: 7469045 - DNA, 22 bp, Homo sapiens
cagatggcacagatttagagtg

SEQ ID NO: 7469046 - DNA, 22 bp, Homo sapiens
ggtcctgggaagatgctcatga

SEQ ID NO: 7469047 - DNA, 22 bp, Homo sapiens
ggtcctgggaagatgctcatga

SEQ ID NO: 7469048 - DNA, 22 bp, Homo sapiens
ggtcctgggaagatgctcatga

SEQ ID NO: 7469049 - DNA, 22 bp, Homo sapiens
ggtcctggcagtctttggttgt

SEQ ID NO: 7469050 - DNA, 22 bp, Homo sapiens
cagattaacacggagcttaaca

SEQ ID NO: 7469051 - DNA, 19 bp, Homo sapiens
cagatgttttcagttcatt

SEQ ID NO: 7469052 - DNA, 22 bp, Homo sapiens
cagatgtggttaacatgtacat

SEQ ID NO: 7469053 - DNA, 22 bp, Homo sapiens
cagatgtggttaacatgtacat

SEQ ID NO: 7469054 - DNA, 22 bp, Homo sapiens
cagatgtggttaacatgtacat

SEQ ID NO: 7469055 - DNA, 22 bp, Homo sapiens
cagatgtggaatgcagcaggct

SEQ ID NO: 7469056 - DNA, 22 bp, Homo sapiens
cagatgcatgagttcattagga

SEQ ID NO: 7469057 - DNA, 22 bp, Homo sapiens
cagatgcatgtacagtgttgct

SEQ ID NO: 7469058 - DNA, 22 bp, Homo sapiens
cagatgcagcaaaatgacaggc

SEQ ID NO: 7469059 - DNA, 22 bp, Homo sapiens
cagatgctaagttatcagcagg

SEQ ID NO: 7469060 - DNA, 22 bp, Homo sapiens
cagatgcaggtctgctcacctg

SEQ ID NO: 7469061 - DNA, 18 bp, Homo sapiens
cagatgctaggcctccag

SEQ ID NO: 7469062 - DNA, 18 bp, Homo sapiens
cagatgctaggcctccag

SEQ ID NO: 7469063 - DNA, 22 bp, Homo sapiens
cagatgctaagttatcagcagg

SEQ ID NO: 7469064 - DNA, 22 bp, Homo sapiens
cagatgcagcaaaatgacaggc

SEQ ID NO: 7469065 - DNA, 22 bp, Homo sapiens
cagatgcagcaaaatgacaggc

SEQ ID NO: 7469066 - DNA, 22 bp, Homo sapiens
cagatgcaggtctgctcacctg

SEQ ID NO: 7469067 - DNA, 22 bp, Homo sapiens
cagatgcagcaaaatgacaggc

SEQ ID NO: 7469068 - DNA, 23 bp, Homo sapiens
cagatgaggttggcagcatggtc

SEQ ID NO: 7469069 - DNA, 22 bp, Homo sapiens
cagatgcacattctcatcagca

SEQ ID NO: 7469070 - DNA, 22 bp, Homo sapiens
cagatgcacattctcatcagca

SEQ ID NO: 7469071 - DNA, 22 bp, Homo sapiens
cagatgcagcaaaatgacaggc

SEQ ID NO: 7469072 - DNA, 22 bp, Homo sapiens
cagatgcacattctcatcagca

SEQ ID NO: 7469073 - DNA, 22 bp, Homo sapiens
cagatgcagcaaaatgacaggc

SEQ ID NO: 7469074 - DNA, 22 bp, Homo sapiens
ggtcctgcctgctgtccttcaa

SEQ ID NO: 7469075 - DNA, 22 bp, Homo sapiens
ggtcctgcctgctgtccttcaa

SEQ ID NO: 7469076 - DNA, 23 bp, Homo sapiens
ggtcctgcccccggtcgcccaaa

SEQ ID NO: 7469077 - DNA, 23 bp, Homo sapiens
ggtcctgcccccggtcgcccaaa

SEQ ID NO: 7469078 - DNA, 23 bp, Homo sapiens
ggtcctgcccccggtcgcccaaa

SEQ ID NO: 7469079 - DNA, 20 bp, Homo sapiens
ggtcctgccttcatcacttc

SEQ ID NO: 7469080 - DNA, 20 bp, Homo sapiens
ggtcctgccttcatcacttc

SEQ ID NO: 7469081 - DNA, 20 bp, Homo sapiens
ggtcctgccttcatcacttc

SEQ ID NO: 7469082 - DNA, 22 bp, Homo sapiens
ggtcctgcctgctgtccttcaa

SEQ ID NO: 7469083 - DNA, 22 bp, Homo sapiens
ggtcctgcattgccagcaagct

SEQ ID NO: 7469084 - DNA, 22 bp, Homo sapiens
ggtcctgaggggagctgaaggt

SEQ ID NO: 7469085 - DNA, 22 bp, Homo sapiens
ggtcctgagtacctatgtttat

SEQ ID NO: 7469086 - DNA, 22 bp, Homo sapiens
ggtcctgcattgccagcaagct

SEQ ID NO: 7469087 - DNA, 22 bp, Homo sapiens
ggtcctctcccaagagcgcatc

SEQ ID NO: 7469088 - DNA, 22 bp, Homo sapiens
ggtcctgaggggagctgaaggt

SEQ ID NO: 7469089 - DNA, 18 bp, Homo sapiens
ggtcctgaatgcctgcta

SEQ ID NO: 7469090 - DNA, 18 bp, Homo sapiens
ggtcctgaatgcctgcta

SEQ ID NO: 7469091 - DNA, 22 bp, Homo sapiens
ggtcctctgagcacgccaggca

SEQ ID NO: 7469092 - DNA, 22 bp, Homo sapiens
ggtcctctgagcacgccaggca

SEQ ID NO: 7469093 - DNA, 22 bp, Homo sapiens
ggtcctctccagcgccacagtg

SEQ ID NO: 7469094 - DNA, 19 bp, Homo sapiens
ggtcctcagcagagcatgc

SEQ ID NO: 7469095 - DNA, 22 bp, Homo sapiens
ggtcctcaatcccaacaaggca

SEQ ID NO: 7469096 - DNA, 18 bp, Homo sapiens
cagatgctaggcctccag

SEQ ID NO: 7469097 - DNA, 22 bp, Homo sapiens
ggtcctcaatcccaacaaggca

SEQ ID NO: 7469098 - DNA, 22 bp, Homo sapiens
ggggcagagtctggactgttgt

SEQ ID NO: 7469099 - DNA, 22 bp, Homo sapiens
ggggcagagtctggactgttgt

SEQ ID NO: 7469100 - DNA, 22 bp, Homo sapiens
ggggcagagtctggactgttgt

SEQ ID NO: 7469101 - DNA, 22 bp, Homo sapiens
ggggcagagtctggactgttgt

SEQ ID NO: 7469102 - DNA, 22 bp, Homo sapiens
ggggcagatggaacagagcaca

SEQ ID NO: 7469103 - DNA, 22 bp, Homo sapiens
ggggcagatggaacagagcaca

SEQ ID NO: 7469104 - DNA, 22 bp, Homo sapiens
ggggcagatggaacagagcaca

SEQ ID NO: 7469105 - DNA, 22 bp, Homo sapiens
ggggcagatggaacagagcaca

SEQ ID NO: 7469106 - DNA, 22 bp, Homo sapiens
ggggcagctaccggaagtaggg

SEQ ID NO: 7469107 - DNA, 22 bp, Homo sapiens
ggggcagctaccggaagtaggg

SEQ ID NO: 7469108 - DNA, 22 bp, Homo sapiens
ggggcagctaccggaagtaggg

SEQ ID NO: 7469109 - DNA, 22 bp, Homo sapiens
ggggcagatggaacagagcaca

SEQ ID NO: 7469110 - DNA, 22 bp, Homo sapiens
ggggcagcctccaggaaagctg

SEQ ID NO: 7469111 - DNA, 22 bp, Homo sapiens
ggggcagatggaacagagcaca

SEQ ID NO: 7469112 - DNA, 22 bp, Homo sapiens
ggggcagatggaacagagcaca

SEQ ID NO: 7469113 - DNA, 22 bp, Homo sapiens
ggggcagatggaacagagcaca

SEQ ID NO: 7469114 - DNA, 22 bp, Homo sapiens
ggggcagatggaacagagcaca

SEQ ID NO: 7469115 - DNA, 21 bp, Homo sapiens
ggggcctctccacacagccgg

SEQ ID NO: 7469116 - DNA, 22 bp, Homo sapiens
ggggcctctgcagtcacgctgg

SEQ ID NO: 7469117 - DNA, 22 bp, Homo sapiens
ggggcctctgcagtcacgctgg

SEQ ID NO: 7469118 - DNA, 22 bp, Homo sapiens
ggggcctctgcagtcacgctgg

SEQ ID NO: 7469119 - DNA, 21 bp, Homo sapiens
ggggcctctccacacagccgg

SEQ ID NO: 7469120 - DNA, 21 bp, Homo sapiens
ggggcctctccacacagccgg

SEQ ID NO: 7469121 - DNA, 22 bp, Homo sapiens
ggggcctcgccgccgcctctgc

SEQ ID NO: 7469122 - DNA, 21 bp, Homo sapiens
ggggcctctccacacagccgg

SEQ ID NO: 7469123 - DNA, 22 bp, Homo sapiens
ggggcctctgggaacccctgtg

SEQ ID NO: 7469124 - DNA, 23 bp, Homo sapiens
ggggcctgcaccggtctgcgcgg

SEQ ID NO: 7469125 - DNA, 23 bp, Homo sapiens
ggggcctgcaccggtctgcgcgg

SEQ ID NO: 7469126 - DNA, 23 bp, Homo sapiens
ggggcctgcaccggtctgcgcgg

SEQ ID NO: 7469127 - DNA, 23 bp, Homo sapiens
ggggcctgcaccggtctgcgcgg

SEQ ID NO: 7469128 - DNA, 23 bp, Homo sapiens
ggggcctgcaccggtctgcgcgg

SEQ ID NO: 7469129 - DNA, 21 bp, Homo sapiens
ggggcagagctaggccctgca

SEQ ID NO: 7469130 - DNA, 21 bp, Homo sapiens
ggggcagagctaggccctgca

SEQ ID NO: 7469131 - DNA, 21 bp, Homo sapiens
ggggcagagctaggccctgca

SEQ ID NO: 7469132 - DNA, 21 bp, Homo sapiens
ggggcagagctaggccctgca

SEQ ID NO: 7469133 - DNA, 21 bp, Homo sapiens
ggggcagagctaggccctgca

SEQ ID NO: 7469134 - DNA, 22 bp, Homo sapiens
ggggcagagagaaggaagcttg

SEQ ID NO: 7469135 - DNA, 22 bp, Homo sapiens
ggggcagagcatagctccaatt

SEQ ID NO: 7469136 - DNA, 22 bp, Homo sapiens
ggggcagagcatagctccaatt

SEQ ID NO: 7469137 - DNA, 21 bp, Homo sapiens
ggggcagagctaggccctgca

SEQ ID NO: 7469138 - DNA, 21 bp, Homo sapiens
ggggcagagctaggccctgca

SEQ ID NO: 7469139 - DNA, 22 bp, Homo sapiens
ggggcagagcatagctccaatt

SEQ ID NO: 7469140 - DNA, 22 bp, Homo sapiens
ggggcagagtagctggggtgtg

SEQ ID NO: 7469141 - DNA, 22 bp, Homo sapiens
ggggcagagtagctggggtgtg

SEQ ID NO: 7469142 - DNA, 22 bp, Homo sapiens
ggggcagagtagctggggtgtg

SEQ ID NO: 7469143 - DNA, 22 bp, Homo sapiens
ggggcagagtagctggggtgtg

SEQ ID NO: 7469144 - DNA, 22 bp, Homo sapiens
ggggcagagtagctggggtgtg

SEQ ID NO: 7469145 - DNA, 22 bp, Homo sapiens
ggggcagagtagctggggtgtg

SEQ ID NO: 7469146 - DNA, 22 bp, Homo sapiens
ggggcagagtagctggggtgtg

SEQ ID NO: 7469147 - DNA, 22 bp, Homo sapiens
ggggcagaagtagtgcccctga

SEQ ID NO: 7469148 - DNA, 22 bp, Homo sapiens
ggggaggaagctctcagttcca

SEQ ID NO: 7469149 - DNA, 22 bp, Homo sapiens
ggggcagaagtagtgcccctga

SEQ ID NO: 7469150 - DNA, 22 bp, Homo sapiens
ggggaggaagctctcagttcca

SEQ ID NO: 7469151 - DNA, 22 bp, Homo sapiens
ggggaggaagctctcagttcca

SEQ ID NO: 7469152 - DNA, 22 bp, Homo sapiens
ggggaggaagctctcagttcca

SEQ ID NO: 7469153 - DNA, 22 bp, Homo sapiens
ggggaggaagctctcagttcca

SEQ ID NO: 7469154 - DNA, 22 bp, Homo sapiens
ggggaggaagctctcagttcca

SEQ ID NO: 7469155 - DNA, 22 bp, Homo sapiens
ggggaggaagctctcagttcca

SEQ ID NO: 7469156 - DNA, 22 bp, Homo sapiens
ggggcagagagaaggaagcttg

SEQ ID NO: 7469157 - DNA, 22 bp, Homo sapiens
ggggcagagagaaggaagcttg

SEQ ID NO: 7469158 - DNA, 22 bp, Homo sapiens
ggggcagagagaaggaagcttg

SEQ ID NO: 7469159 - DNA, 22 bp, Homo sapiens
ggggcagagagaaggaagcttg

SEQ ID NO: 7469160 - DNA, 22 bp, Homo sapiens
ggggcagagagaaggaagcttg

SEQ ID NO: 7469161 - DNA, 22 bp, Homo sapiens
ggggcagagagaaggaagcttg

SEQ ID NO: 7469162 - DNA, 22 bp, Homo sapiens
ggggcagagaataaaaacctaa

SEQ ID NO: 7469163 - DNA, 22 bp, Homo sapiens
ggggcagaagtagtgcccctga

SEQ ID NO: 7469164 - DNA, 22 bp, Homo sapiens
ggggcagagaataaaaacctaa

SEQ ID NO: 7469165 - DNA, 22 bp, Homo sapiens
ggggccttggatctgtgccccg

SEQ ID NO: 7469166 - DNA, 22 bp, Homo sapiens
ggggccttttctgaatgtggaa

SEQ ID NO: 7469167 - DNA, 22 bp, Homo sapiens
ggggccttttctgaatgtggaa

SEQ ID NO: 7469168 - DNA, 22 bp, Homo sapiens
ggggccttggatctgtgccccg

SEQ ID NO: 7469169 - DNA, 22 bp, Homo sapiens
ggggccttttctgaatgtggaa

SEQ ID NO: 7469170 - DNA, 22 bp, Homo sapiens
ggggccttttctgaatgtggaa

SEQ ID NO: 7469171 - DNA, 22 bp, Homo sapiens
ggggtgagctgggcctgtgcct

SEQ ID NO: 7469172 - DNA, 22 bp, Homo sapiens
ggggccttttctgaatgtggaa

SEQ ID NO: 7469173 - DNA, 22 bp, Homo sapiens
ggggtgagtgctcagccccgga

SEQ ID NO: 7469174 - DNA, 22 bp, Homo sapiens
ggggtgagtgctcagccccgga

SEQ ID NO: 7469175 - DNA, 22 bp, Homo sapiens
ggggtgagtgctcagccccgga

SEQ ID NO: 7469176 - DNA, 22 bp, Homo sapiens
ggggtgaggtttatgttctggg

SEQ ID NO: 7469177 - DNA, 22 bp, Homo sapiens
ggggtgaggtttatgttctggg

SEQ ID NO: 7469178 - DNA, 22 bp, Homo sapiens
ggggtgagctgggcctgtgcct

SEQ ID NO: 7469179 - DNA, 22 bp, Homo sapiens
ggggcctgtagagcttcaggga

SEQ ID NO: 7469180 - DNA, 22 bp, Homo sapiens
ggggcctgtagagcttcaggga

SEQ ID NO: 7469181 - DNA, 22 bp, Homo sapiens
ggggcctgtagagcttcaggga

SEQ ID NO: 7469182 - DNA, 22 bp, Homo sapiens
ggggcctgtagagcttcaggga

SEQ ID NO: 7469183 - DNA, 22 bp, Homo sapiens
ggggcctgtagagcttcaggga

SEQ ID NO: 7469184 - DNA, 22 bp, Homo sapiens
ggggccttggatctgtgccccg

SEQ ID NO: 7469185 - DNA, 22 bp, Homo sapiens
ggggccttggatctgtgccccg

SEQ ID NO: 7469186 - DNA, 22 bp, Homo sapiens
ggggccttggatctgtgccccg

SEQ ID NO: 7469187 - DNA, 19 bp, Homo sapiens
ggggcctgtgatggtcaca

SEQ ID NO: 7469188 - DNA, 22 bp, Homo sapiens
ggggccttggatctgtgccccg

SEQ ID NO: 7469189 - DNA, 22 bp, Homo sapiens
ggggccttggatctgtgccccg

SEQ ID NO: 7469190 - DNA, 22 bp, Homo sapiens
ggggccttggatctgtgccccg

SEQ ID NO: 7469191 - DNA, 19 bp, Homo sapiens
ggggcctgtgatggtcaca

SEQ ID NO: 7469192 - DNA, 19 bp, Homo sapiens
ggggcctgtgatggtcaca

SEQ ID NO: 7469193 - DNA, 19 bp, Homo sapiens
ggggcctgtgatggtcaca

SEQ ID NO: 7469194 - DNA, 19 bp, Homo sapiens
ggggcctgtgatggtcaca

SEQ ID NO: 7469195 - DNA, 22 bp, Homo sapiens
gggtaaaggtcgccctcaaggt

SEQ ID NO: 7469196 - DNA, 22 bp, Homo sapiens
ggggttggtttaaatgcttgag

SEQ ID NO: 7469197 - DNA, 22 bp, Homo sapiens
gggtaaaggaattgggtttcct

SEQ ID NO: 7469198 - DNA, 20 bp, Homo sapiens
ggggttggctggcacaggga

SEQ ID NO: 7469199 - DNA, 22 bp, Homo sapiens
ggggttggtttaaatgcttgag

SEQ ID NO: 7469200 - DNA, 22 bp, Homo sapiens
ggggtgagtgctcagccccgga

SEQ ID NO: 7469201 - DNA, 20 bp, Homo sapiens
ggggttggctggcacaggga

SEQ ID NO: 7469202 - DNA, 20 bp, Homo sapiens
ggggttggctggcacaggga

SEQ ID NO: 7469203 - DNA, 20 bp, Homo sapiens
ggggttggctggcacaggga

SEQ ID NO: 7469204 - DNA, 20 bp, Homo sapiens
ggggttggctggcacaggga

SEQ ID NO: 7469205 - DNA, 22 bp, Homo sapiens
gggtaattggggccttgcagtg

SEQ ID NO: 7469206 - DNA, 22 bp, Homo sapiens
gggtaatggaggaggcagcccc

SEQ ID NO: 7469207 - DNA, 22 bp, Homo sapiens
gggtaatgggggcttatgcctc

SEQ ID NO: 7469208 - DNA, 22 bp, Homo sapiens
gggtaatgtgcactgaagggtg

SEQ ID NO: 7469209 - DNA, 22 bp, Homo sapiens
gggtaattggaaatattaatag

SEQ ID NO: 7469210 - DNA, 22 bp, Homo sapiens
gggtaattggggccttgcagtg

SEQ ID NO: 7469211 - DNA, 22 bp, Homo sapiens
gggtaataatggtacctacatc

SEQ ID NO: 7469212 - DNA, 22 bp, Homo sapiens
gggtaatgaacaggtggcagag

SEQ ID NO: 7469213 - DNA, 22 bp, Homo sapiens
gggtaatgaacaggtggcagag

SEQ ID NO: 7469214 - DNA, 21 bp, Homo sapiens
gggtaatgcagaatgttctta

SEQ ID NO: 7469215 - DNA, 21 bp, Homo sapiens
gggtaatgcagaatgttctta

SEQ ID NO: 7469216 - DNA, 22 bp, Homo sapiens
gggtaaggtcagccagaagttc

SEQ ID NO: 7469217 - DNA, 22 bp, Homo sapiens
gggtaaggtcagccagaagttc

SEQ ID NO: 7469218 - DNA, 22 bp, Homo sapiens
gggtaactgtctgtgaaataag

SEQ ID NO: 7469219 - DNA, 22 bp, Homo sapiens
gggtacagttcttccagtgtca

SEQ ID NO: 7469220 - DNA, 22 bp, Homo sapiens
gggtacagccgttggttgccgg

SEQ ID NO: 7469221 - DNA, 22 bp, Homo sapiens
gggtacagccgttggttgccgg

SEQ ID NO: 7469222 - DNA, 20 bp, Homo sapiens
gggtacagatatgcagtgaa

SEQ ID NO: 7469223 - DNA, 22 bp, Homo sapiens
gggtacagagagatgaggtaac

SEQ ID NO: 7469224 - DNA, 22 bp, Homo sapiens
gggtacaaagatttcataagat

SEQ ID NO: 7469225 - DNA, 22 bp, Homo sapiens
gggtacagaaactgaggcttag

SEQ ID NO: 7469226 - DNA, 22 bp, Homo sapiens
gggtacagaaactgaggcttag

SEQ ID NO: 7469227 - DNA, 22 bp, Homo sapiens
gggctggagttgggaagacaaa

SEQ ID NO: 7469228 - DNA, 22 bp, Homo sapiens
gggctggagttgggaagacaaa

SEQ ID NO: 7469229 - DNA, 22 bp, Homo sapiens
gggctggagttgggaagacaaa

SEQ ID NO: 7469230 - DNA, 22 bp, Homo sapiens
gggctggagttgggaagacaaa

SEQ ID NO: 7469231 - DNA, 22 bp, Homo sapiens
gggctggagttgggaagacaaa

SEQ ID NO: 7469232 - DNA, 22 bp, Homo sapiens
gggctggagttgggaagacaaa

SEQ ID NO: 7469233 - DNA, 21 bp, Homo sapiens
gggctggatattggaaagagg

SEQ ID NO: 7469234 - DNA, 21 bp, Homo sapiens
gggctggatattggaaagagg

SEQ ID NO: 7469235 - DNA, 21 bp, Homo sapiens
gggctggatattggaaagagg

SEQ ID NO: 7469236 - DNA, 20 bp, Homo sapiens
gggctggataattctttgct

SEQ ID NO: 7469237 - DNA, 20 bp, Homo sapiens
gggctggataattctttgct

SEQ ID NO: 7469238 - DNA, 22 bp, Homo sapiens
gggctgtaggagctggaatggg

SEQ ID NO: 7469239 - DNA, 22 bp, Homo sapiens
gggctgtaggagctggaatggg

SEQ ID NO: 7469240 - DNA, 22 bp, Homo sapiens
gggctgtaggagctggaatggg

SEQ ID NO: 7469241 - DNA, 22 bp, Homo sapiens
gggctgtaggagctggaatggg

SEQ ID NO: 7469242 - DNA, 22 bp, Homo sapiens
gggctgtaggagctggaatggg

SEQ ID NO: 7469243 - DNA, 22 bp, Homo sapiens
gggctggatctcacgtgagacc

SEQ ID NO: 7469244 - DNA, 22 bp, Homo sapiens
gggctggatctcacgtgagacc

SEQ ID NO: 7469245 - DNA, 21 bp, Homo sapiens
gggctggatattggaaagagg

SEQ ID NO: 7469246 - DNA, 22 bp, Homo sapiens
gggctggatctcacgtgagacc

SEQ ID NO: 7469247 - DNA, 22 bp, Homo sapiens
gggctgtgagagtggggctgct

SEQ ID NO: 7469248 - DNA, 18 bp, Homo sapiens
gggctgtgagatgggaag

SEQ ID NO: 7469249 - DNA, 22 bp, Homo sapiens
gggctgtccgcacatctggaat

SEQ ID NO: 7469250 - DNA, 22 bp, Homo sapiens
gggctgtcatgtgtcagtgacc

SEQ ID NO: 7469251 - DNA, 22 bp, Homo sapiens
gggctgtgagagtggggctgct

SEQ ID NO: 7469252 - DNA, 22 bp, Homo sapiens
gggctgtgagagtggggctgct

SEQ ID NO: 7469253 - DNA, 22 bp, Homo sapiens
gggctgtccgcacatctggaat

SEQ ID NO: 7469254 - DNA, 22 bp, Homo sapiens
gggctgtccgcacatctggaat

SEQ ID NO: 7469255 - DNA, 22 bp, Homo sapiens
gggctgtcacgcccctgcacct

SEQ ID NO: 7469256 - DNA, 22 bp, Homo sapiens
gggctgtcacgcccctgcacct

SEQ ID NO: 7469257 - DNA, 22 bp, Homo sapiens
gggctgtcacgcccctgcacct

SEQ ID NO: 7469258 - DNA, 22 bp, Homo sapiens
gggctgtaggagctggaatggg

SEQ ID NO: 7469259 - DNA, 22 bp, Homo sapiens
gggctgtaggagctggaatggg

SEQ ID NO: 7469260 - DNA, 22 bp, Homo sapiens
gggctgtaggagctggaatggg

SEQ ID NO: 7469261 - DNA, 22 bp, Homo sapiens
gggctgtgctgagtaggaggtg

SEQ ID NO: 7469262 - DNA, 22 bp, Homo sapiens
gggctgtgctgagtaggaggtg

SEQ ID NO: 7469263 - DNA, 20 bp, Homo sapiens
gggctgtgcctcctcgtggt

SEQ ID NO: 7469264 - DNA, 20 bp, Homo sapiens
gggctgtgcctcctcgtggt

SEQ ID NO: 7469265 - DNA, 22 bp, Homo sapiens
gggctgtgcctcaggtggggtc

SEQ ID NO: 7469266 - DNA, 22 bp, Homo sapiens
gggctgtgcctcaggtggggtc

SEQ ID NO: 7469267 - DNA, 22 bp, Homo sapiens
gggctgtgcctcaggtggggtc

SEQ ID NO: 7469268 - DNA, 22 bp, Homo sapiens
gggctgtgcctcaggtggggtc

SEQ ID NO: 7469269 - DNA, 22 bp, Homo sapiens
gggctgtgcctcaggtggggtc

SEQ ID NO: 7469270 - DNA, 22 bp, Homo sapiens
gggctgtgaggtgagaacttac

SEQ ID NO: 7469271 - DNA, 22 bp, Homo sapiens
gggctgtgaggtgagaacttac

SEQ ID NO: 7469272 - DNA, 22 bp, Homo sapiens
gggctgtgaggtgagaacttac

SEQ ID NO: 7469273 - DNA, 18 bp, Homo sapiens
gggctgtgagatgggaag

SEQ ID NO: 7469274 - DNA, 22 bp, Homo sapiens
gggctgtgggacccggcacttt

SEQ ID NO: 7469275 - DNA, 22 bp, Homo sapiens
gggctgtgggacccggcacttt

SEQ ID NO: 7469276 - DNA, 22 bp, Homo sapiens
gggctgtgggacccggcacttt

SEQ ID NO: 7469277 - DNA, 22 bp, Homo sapiens
gggctgtgtaatgtgctctttt

SEQ ID NO: 7469278 - DNA, 22 bp, Homo sapiens
gggctgtgtaatgtgctctttt

SEQ ID NO: 7469279 - DNA, 22 bp, Homo sapiens
gggctgtgtaatgtgctctttt

SEQ ID NO: 7469280 - DNA, 22 bp, Homo sapiens
gggctgtgtaatgtgctctttt

SEQ ID NO: 7469281 - DNA, 22 bp, Homo sapiens
gggctgtgtactatgaggaggg

SEQ ID NO: 7469282 - DNA, 22 bp, Homo sapiens
gggctgtgtactatgaggaggg

SEQ ID NO: 7469283 - DNA, 22 bp, Homo sapiens
gggctgtgtactatgaggaggg

SEQ ID NO: 7469284 - DNA, 22 bp, Homo sapiens
gggctgtggagccgcgagggct

SEQ ID NO: 7469285 - DNA, 22 bp, Homo sapiens
gggctgtggagccgcgagggct

SEQ ID NO: 7469286 - DNA, 22 bp, Homo sapiens
gggctgtggagccgcgagggct

SEQ ID NO: 7469287 - DNA, 22 bp, Homo sapiens
gggctgtggagccgcgagggct

SEQ ID NO: 7469288 - DNA, 22 bp, Homo sapiens
gggctgtggagccgcgagggct

SEQ ID NO: 7469289 - DNA, 21 bp, Homo sapiens
cagagccagactgctgaattt

SEQ ID NO: 7469290 - DNA, 22 bp, Homo sapiens
cagagccagagacctgctgtgc

SEQ ID NO: 7469291 - DNA, 22 bp, Homo sapiens
cagagccagagacctgctgtgc

SEQ ID NO: 7469292 - DNA, 22 bp, Homo sapiens
cagagccagagacctgctgtgc

SEQ ID NO: 7469293 - DNA, 22 bp, Homo sapiens
cagagccagagacctgctgtgc

SEQ ID NO: 7469294 - DNA, 22 bp, Homo sapiens
cagagccagaactagaccttgt

SEQ ID NO: 7469295 - DNA, 21 bp, Homo sapiens
cagagccagactgctgaattt

SEQ ID NO: 7469296 - DNA, 22 bp, Homo sapiens
cagagccacttggagatgagaa

SEQ ID NO: 7469297 - DNA, 22 bp, Homo sapiens
cagagccagaactagaccttgt

SEQ ID NO: 7469298 - DNA, 22 bp, Homo sapiens
cagagccagaactagaccttgt

SEQ ID NO: 7469299 - DNA, 22 bp, Homo sapiens
cagagccacttggagatgagaa

SEQ ID NO: 7469300 - DNA, 22 bp, Homo sapiens
cagagccactgtctgccaggca

SEQ ID NO: 7469301 - DNA, 22 bp, Homo sapiens
cagagccactgtctgccaggca

SEQ ID NO: 7469302 - DNA, 22 bp, Homo sapiens
cagagccacttggagatgagaa

SEQ ID NO: 7469303 - DNA, 22 bp, Homo sapiens
cagagccacttggagatgagaa

SEQ ID NO: 7469304 - DNA, 22 bp, Homo sapiens
cagagccactgtctgccaggca

SEQ ID NO: 7469305 - DNA, 22 bp, Homo sapiens
cagagccactgtctgccaggca

SEQ ID NO: 7469306 - DNA, 22 bp, Homo sapiens
cagagccactgtctgccaggca

SEQ ID NO: 7469307 - DNA, 22 bp, Homo sapiens
cagagccagagacctgctgtgc

SEQ ID NO: 7469308 - DNA, 22 bp, Homo sapiens
cagagccagcagtggggacagg

SEQ ID NO: 7469309 - DNA, 22 bp, Homo sapiens
cagagccagagacctgctgtgc

SEQ ID NO: 7469310 - DNA, 22 bp, Homo sapiens
cagagccagcccactgttcccg

SEQ ID NO: 7469311 - DNA, 22 bp, Homo sapiens
gggctgagtgggcctcttactt

SEQ ID NO: 7469312 - DNA, 22 bp, Homo sapiens
cagagccagcccactgttcccg

SEQ ID NO: 7469313 - DNA, 22 bp, Homo sapiens
cagagccagcccactgttcccg

SEQ ID NO: 7469314 - DNA, 22 bp, Homo sapiens
gggctgagtgggcctcttactt

SEQ ID NO: 7469315 - DNA, 22 bp, Homo sapiens
gggctgagtgggcctcttactt

SEQ ID NO: 7469316 - DNA, 22 bp, Homo sapiens
gggctgagtgggcctcttactt

SEQ ID NO: 7469317 - DNA, 22 bp, Homo sapiens
gggctggaggaccggcctcgga

SEQ ID NO: 7469318 - DNA, 22 bp, Homo sapiens
gggctggaggaccggcctcgga

SEQ ID NO: 7469319 - DNA, 22 bp, Homo sapiens
gggctggaggaccggcctcgga

SEQ ID NO: 7469320 - DNA, 22 bp, Homo sapiens
gggctggaggagatccagaggc

SEQ ID NO: 7469321 - DNA, 22 bp, Homo sapiens
gggctggaggagatccagaggc

SEQ ID NO: 7469322 - DNA, 22 bp, Homo sapiens
gggctggaggaccggcctcgga

SEQ ID NO: 7469323 - DNA, 22 bp, Homo sapiens
gggctggaggaccggcctcgga

SEQ ID NO: 7469324 - DNA, 19 bp, Homo sapiens
gggctggagggatagagcc

SEQ ID NO: 7469325 - DNA, 19 bp, Homo sapiens
gggctggagggatagagcc

SEQ ID NO: 7469326 - DNA, 19 bp, Homo sapiens
gggctggagggatagagcc

SEQ ID NO: 7469327 - DNA, 19 bp, Homo sapiens
gggctggagggatagagcc

SEQ ID NO: 7469328 - DNA, 22 bp, Homo sapiens
gggctggaggcctgcctggtta

SEQ ID NO: 7469329 - DNA, 22 bp, Homo sapiens
gggctggaggcctgcctggtta

SEQ ID NO: 7469330 - DNA, 22 bp, Homo sapiens
gggctggaggcctgcctggtta

SEQ ID NO: 7469331 - DNA, 21 bp, Homo sapiens
gggctggaggatgggaagccc

SEQ ID NO: 7469332 - DNA, 22 bp, Homo sapiens
gggctggaggcctgcctggtta

SEQ ID NO: 7469333 - DNA, 22 bp, Homo sapiens
gggctggaggcctgcctggtta

SEQ ID NO: 7469334 - DNA, 22 bp, Homo sapiens
gggctggaggcctgcctggtta

SEQ ID NO: 7469335 - DNA, 22 bp, Homo sapiens
gggctggaggcctgcctggtta

SEQ ID NO: 7469336 - DNA, 22 bp, Homo sapiens
gggctggaggagatccagaggc

SEQ ID NO: 7469337 - DNA, 22 bp, Homo sapiens
gggctggaggagatccagaggc

SEQ ID NO: 7469338 - DNA, 21 bp, Homo sapiens
gggctggaggatgggaagccc

SEQ ID NO: 7469339 - DNA, 21 bp, Homo sapiens
gggctggaggatgggaagccc

SEQ ID NO: 7469340 - DNA, 21 bp, Homo sapiens
gggctggaggatgggaagccc

SEQ ID NO: 7469341 - DNA, 21 bp, Homo sapiens
gggctggaggatgggaagccc

SEQ ID NO: 7469342 - DNA, 22 bp, Homo sapiens
gggctggaggagatccagaggc

SEQ ID NO: 7469343 - DNA, 22 bp, Homo sapiens
gggctggaggagatccagaggc

SEQ ID NO: 7469344 - DNA, 22 bp, Homo sapiens
gggctggaggagatccagaggc

SEQ ID NO: 7469345 - DNA, 22 bp, Homo sapiens
gggctggagtcttctgaaagcc

SEQ ID NO: 7469346 - DNA, 22 bp, Homo sapiens
gggctggagtcttctgaaagcc

SEQ ID NO: 7469347 - DNA, 22 bp, Homo sapiens
gggctggagtcttctgaaagcc

SEQ ID NO: 7469348 - DNA, 22 bp, Homo sapiens
gggctggagtcttctgaaagcc

SEQ ID NO: 7469349 - DNA, 22 bp, Homo sapiens
gggctggaggtgagcaggacag

SEQ ID NO: 7469350 - DNA, 22 bp, Homo sapiens
gggctggaggtgagcaggacag

SEQ ID NO: 7469351 - DNA, 22 bp, Homo sapiens
gggctggaggtgagcaggacag

SEQ ID NO: 7469352 - DNA, 19 bp, Homo sapiens
gggctggagggatagagcc

SEQ ID NO: 7469353 - DNA, 19 bp, Homo sapiens
gggctggagggatagagcc

SEQ ID NO: 7469354 - DNA, 22 bp, Homo sapiens
gggctggaggtgagcaggacag

SEQ ID NO: 7469355 - DNA, 19 bp, Homo sapiens
gggctggagggatagagcc

SEQ ID NO: 7469356 - DNA, 19 bp, Homo sapiens
gggctggagggatagagcc

SEQ ID NO: 7469357 - DNA, 22 bp, Homo sapiens
gggctggaggtgagcaggacag

SEQ ID NO: 7469358 - DNA, 22 bp, Homo sapiens
gggctggaggtgagcaggacag

SEQ ID NO: 7469359 - DNA, 22 bp, Homo sapiens
gggctggaggtgagcaggacag

SEQ ID NO: 7469360 - DNA, 22 bp, Homo sapiens
gggctggaggtgagcaggacag

SEQ ID NO: 7469361 - DNA, 22 bp, Homo sapiens
cagagcagaaacctgggtgatt

SEQ ID NO: 7469362 - DNA, 22 bp, Homo sapiens
cagagcagaaacctgggtgatt

SEQ ID NO: 7469363 - DNA, 22 bp, Homo sapiens
cagagcagaaacctgggtgatt

SEQ ID NO: 7469364 - DNA, 22 bp, Homo sapiens
cagagcagaaacctgggtgatt

SEQ ID NO: 7469365 - DNA, 22 bp, Homo sapiens
cagagcagaaacctgggtgatt

SEQ ID NO: 7469366 - DNA, 22 bp, Homo sapiens
cagagcagaaacctgggtgatt

SEQ ID NO: 7469367 - DNA, 22 bp, Homo sapiens
cagagcagaaacctgggtgatt

SEQ ID NO: 7469368 - DNA, 22 bp, Homo sapiens
cagagcagaaacctgggtgatt

SEQ ID NO: 7469369 - DNA, 22 bp, Homo sapiens
cagagcagaagcggtcctcaca

SEQ ID NO: 7469370 - DNA, 22 bp, Homo sapiens
cagagcagaagcggtcctcaca

SEQ ID NO: 7469371 - DNA, 22 bp, Homo sapiens
cagagcagaagcggtcctcaca

SEQ ID NO: 7469372 - DNA, 22 bp, Homo sapiens
cagagcagaagcggtcctcaca

SEQ ID NO: 7469373 - DNA, 22 bp, Homo sapiens
cagagcagaagcggtcctcaca

SEQ ID NO: 7469374 - DNA, 22 bp, Homo sapiens
cagagcagaagcggtcctcaca

SEQ ID NO: 7469375 - DNA, 22 bp, Homo sapiens
cagagcagaagcggtcctcaca

SEQ ID NO: 7469376 - DNA, 22 bp, Homo sapiens
cagagcagaagcggtcctcaca

SEQ ID NO: 7469377 - DNA, 22 bp, Homo sapiens
cagagaggaggctatatgcaaa

SEQ ID NO: 7469378 - DNA, 22 bp, Homo sapiens
cagagaggaggctatatgcaaa

SEQ ID NO: 7469379 - DNA, 22 bp, Homo sapiens
gggatgagagtagggtgtgaaa

SEQ ID NO: 7469380 - DNA, 22 bp, Homo sapiens
gggatgagagtagggtgtgaaa

SEQ ID NO: 7469381 - DNA, 22 bp, Homo sapiens
cagagaggaggctatatgcaaa

SEQ ID NO: 7469382 - DNA, 22 bp, Homo sapiens
cagagaggaggctatatgcaaa

SEQ ID NO: 7469383 - DNA, 22 bp, Homo sapiens
gggatgagagtagggtgtgaaa

SEQ ID NO: 7469384 - DNA, 22 bp, Homo sapiens
cagagaggaggctatatgcaaa

SEQ ID NO: 7469385 - DNA, 22 bp, Homo sapiens
cagagaggaggctatatgcaaa

SEQ ID NO: 7469386 - DNA, 22 bp, Homo sapiens
cagagaggaggctatatgcaaa

SEQ ID NO: 7469387 - DNA, 22 bp, Homo sapiens
cagagaggaggctatatgcaaa

SEQ ID NO: 7469388 - DNA, 22 bp, Homo sapiens
cagagaggaggctatatgcaaa

SEQ ID NO: 7469389 - DNA, 22 bp, Homo sapiens
cagagcacctgctcattgccag

SEQ ID NO: 7469390 - DNA, 22 bp, Homo sapiens
cagagcacctgctcattgccag

SEQ ID NO: 7469391 - DNA, 22 bp, Homo sapiens
cagagaggatggattccatagc

SEQ ID NO: 7469392 - DNA, 22 bp, Homo sapiens
cagagaggatggattccatagc

SEQ ID NO: 7469393 - DNA, 22 bp, Homo sapiens
cagagaggatggattccatagc

SEQ ID NO: 7469394 - DNA, 22 bp, Homo sapiens
cagagaggatggattccatagc

SEQ ID NO: 7469395 - DNA, 22 bp, Homo sapiens
cagagcacctgctcattgccag

SEQ ID NO: 7469396 - DNA, 22 bp, Homo sapiens
cagagcactgcttggaggattt

SEQ ID NO: 7469397 - DNA, 22 bp, Homo sapiens
cagagcactgcttggaggattt

SEQ ID NO: 7469398 - DNA, 22 bp, Homo sapiens
gggatgagagtagggtgtgaaa

SEQ ID NO: 7469399 - DNA, 22 bp, Homo sapiens
gggatgagagtagggtgtgaaa

SEQ ID NO: 7469400 - DNA, 22 bp, Homo sapiens
gggatgagagctgggacagaag

SEQ ID NO: 7469401 - DNA, 22 bp, Homo sapiens
gggatgagagctgggacagaag

SEQ ID NO: 7469402 - DNA, 22 bp, Homo sapiens
gggatgagagctgggacagaag

SEQ ID NO: 7469403 - DNA, 22 bp, Homo sapiens
gggatgagagctgggacagaag

SEQ ID NO: 7469404 - DNA, 22 bp, Homo sapiens
gggatgagagctgggacagaag

SEQ ID NO: 7469405 - DNA, 22 bp, Homo sapiens
gggatgagagctgggacagaag

SEQ ID NO: 7469406 - DNA, 22 bp, Homo sapiens
gggatgactttttgaaatggat

SEQ ID NO: 7469407 - DNA, 22 bp, Homo sapiens
gggatgacagctatggaactct

SEQ ID NO: 7469408 - DNA, 22 bp, Homo sapiens
gggatgactacttatgggaagt

SEQ ID NO: 7469409 - DNA, 22 bp, Homo sapiens
gggatgactacttatgggaagt

SEQ ID NO: 7469410 - DNA, 22 bp, Homo sapiens
gggatgagagctgggacagaag

SEQ ID NO: 7469411 - DNA, 22 bp, Homo sapiens
gggatgagagctgggacagaag

SEQ ID NO: 7469412 - DNA, 22 bp, Homo sapiens
gggatgacaaagtgtctgtccc

SEQ ID NO: 7469413 - DNA, 22 bp, Homo sapiens
gggatgacaattcaagggctgg

SEQ ID NO: 7469414 - DNA, 22 bp, Homo sapiens
gggatgacaattcaagggctgg

SEQ ID NO: 7469415 - DNA, 22 bp, Homo sapiens
gggatgacacaaacttcctaag

SEQ ID NO: 7469416 - DNA, 19 bp, Homo sapiens
gggatgacagcccagagcc

SEQ ID NO: 7469417 - DNA, 22 bp, Homo sapiens
gggatgacagctatggaactct

SEQ ID NO: 7469418 - DNA, 22 bp, Homo sapiens
gggatgaattgagtcagaaggg

SEQ ID NO: 7469419 - DNA, 22 bp, Homo sapiens
gggatgaattgagtcagaaggg

SEQ ID NO: 7469420 - DNA, 22 bp, Homo sapiens
gggatgaattgagtcagaaggg

SEQ ID NO: 7469421 - DNA, 20 bp, Homo sapiens
gggatcttccaggctctcct

SEQ ID NO: 7469422 - DNA, 22 bp, Homo sapiens
gggatcttgtttaatattgttt

SEQ ID NO: 7469423 - DNA, 22 bp, Homo sapiens
gggatctttctgatgctgtggc

SEQ ID NO: 7469424 - DNA, 22 bp, Homo sapiens
gggatctgggacaacaggtggt

SEQ ID NO: 7469425 - DNA, 22 bp, Homo sapiens
cagagacaacaagtttaactat

SEQ ID NO: 7469426 - DNA, 22 bp, Homo sapiens
cagagacaacaagtttaactat

SEQ ID NO: 7469427 - DNA, 22 bp, Homo sapiens
cagagacaacaagtttaactat

SEQ ID NO: 7469428 - DNA, 22 bp, Homo sapiens
cagagacaacctggtagagaaa

SEQ ID NO: 7469429 - DNA, 22 bp, Homo sapiens
cagagacaacctggtagagaaa

SEQ ID NO: 7469430 - DNA, 22 bp, Homo sapiens
cagagaagagtctggcctctct

SEQ ID NO: 7469431 - DNA, 22 bp, Homo sapiens
cagagaagagtctggcctctct

SEQ ID NO: 7469432 - DNA, 22 bp, Homo sapiens
cagagaattaattgtggctaag

SEQ ID NO: 7469433 - DNA, 22 bp, Homo sapiens
cagagacaacaagtttaactat

SEQ ID NO: 7469434 - DNA, 22 bp, Homo sapiens
cagagaattaattgtggctaag

SEQ ID NO: 7469435 - DNA, 22 bp, Homo sapiens
cagagaagaaagtgactataat

SEQ ID NO: 7469436 - DNA, 22 bp, Homo sapiens
cagagaagaaagtgactataat

SEQ ID NO: 7469437 - DNA, 22 bp, Homo sapiens
cagagaacttagctagttttcc

SEQ ID NO: 7469438 - DNA, 22 bp, Homo sapiens
cagagaagaaagtgactataat

SEQ ID NO: 7469439 - DNA, 22 bp, Homo sapiens
cagagaagaaagtgactataat

SEQ ID NO: 7469440 - DNA, 22 bp, Homo sapiens
cagagaagaaagtgactataat

SEQ ID NO: 7469441 - DNA, 22 bp, Homo sapiens
cagagaagagtctggcctctct

SEQ ID NO: 7469442 - DNA, 22 bp, Homo sapiens
cagagaagagtctggcctctct

SEQ ID NO: 7469443 - DNA, 22 bp, Homo sapiens
cagagaagagtctggcctctct

SEQ ID NO: 7469444 - DNA, 22 bp, Homo sapiens
cagagaagagtctggcctctct

SEQ ID NO: 7469445 - DNA, 22 bp, Homo sapiens
cagagaagagtctggcctctct

SEQ ID NO: 7469446 - DNA, 22 bp, Homo sapiens
cagagaagagtctggcctctct

SEQ ID NO: 7469447 - DNA, 22 bp, Homo sapiens
cagagaagagtctggcctctct

SEQ ID NO: 7469448 - DNA, 22 bp, Homo sapiens
cagagaagagtctggcctctct

SEQ ID NO: 7469449 - DNA, 22 bp, Homo sapiens
cagactgtgtctgaacctggtc

SEQ ID NO: 7469450 - DNA, 22 bp, Homo sapiens
cagactgtggcttcttggaggg

SEQ ID NO: 7469451 - DNA, 22 bp, Homo sapiens
cagactgtggcttcttggaggg

SEQ ID NO: 7469452 - DNA, 22 bp, Homo sapiens
cagactgtggcttcttggaggg

SEQ ID NO: 7469453 - DNA, 22 bp, Homo sapiens
cagactgtggcttcttggaggg

SEQ ID NO: 7469454 - DNA, 22 bp, Homo sapiens
cagagaactccagtggctggcg

SEQ ID NO: 7469455 - DNA, 22 bp, Homo sapiens
cagagaacttagctagttttcc

SEQ ID NO: 7469456 - DNA, 22 bp, Homo sapiens
cagacttgacggcagctgcttt

SEQ ID NO: 7469457 - DNA, 20 bp, Homo sapiens
gggaggcattggtccctcac

SEQ ID NO: 7469458 - DNA, 20 bp, Homo sapiens
gggaggcattggtccctcac

SEQ ID NO: 7469459 - DNA, 20 bp, Homo sapiens
gggaggcattggtccctcac

SEQ ID NO: 7469460 - DNA, 22 bp, Homo sapiens
gggaggcatgtgttatccactt

SEQ ID NO: 7469461 - DNA, 22 bp, Homo sapiens
gggaggcatgtgttatccactt

SEQ ID NO: 7469462 - DNA, 22 bp, Homo sapiens
gggaggcatgtgttatccactt

SEQ ID NO: 7469463 - DNA, 20 bp, Homo sapiens
gggaggcattggtccctcac

SEQ ID NO: 7469464 - DNA, 20 bp, Homo sapiens
gggaggcattggtccctcac

SEQ ID NO: 7469465 - DNA, 20 bp, Homo sapiens
gggaggcattggtccctcac

SEQ ID NO: 7469466 - DNA, 20 bp, Homo sapiens
gggaggcattggtccctcac

SEQ ID NO: 7469467 - DNA, 20 bp, Homo sapiens
gggaggcattggtccctcac

SEQ ID NO: 7469468 - DNA, 20 bp, Homo sapiens
gggaggcattggtccctcac

SEQ ID NO: 7469469 - DNA, 20 bp, Homo sapiens
gggaggcattggtccctcac

SEQ ID NO: 7469470 - DNA, 20 bp, Homo sapiens
gggaggcattggtccctcac

SEQ ID NO: 7469471 - DNA, 20 bp, Homo sapiens
gggaggcattggtccctcac

SEQ ID NO: 7469472 - DNA, 22 bp, Homo sapiens
cagactgtagagtttgagaagt

SEQ ID NO: 7469473 - DNA, 22 bp, Homo sapiens
cagactgtgagctccttgaggg

SEQ ID NO: 7469474 - DNA, 22 bp, Homo sapiens
cagactgtgagctccttgaggg

SEQ ID NO: 7469475 - DNA, 22 bp, Homo sapiens
cagagacacttaacaggaatgg

SEQ ID NO: 7469476 - DNA, 22 bp, Homo sapiens
cagagacacttaacaggaatgg

SEQ ID NO: 7469477 - DNA, 22 bp, Homo sapiens
gggatctgatttaggatgggag

SEQ ID NO: 7469478 - DNA, 22 bp, Homo sapiens
cagagacagaaaatggatctag

SEQ ID NO: 7469479 - DNA, 22 bp, Homo sapiens
cagagacagaaaatggatctag

SEQ ID NO: 7469480 - DNA, 22 bp, Homo sapiens
cagagacagaaaatggatctag

SEQ ID NO: 7469481 - DNA, 22 bp, Homo sapiens
cagagacacttaacaggaatgg

SEQ ID NO: 7469482 - DNA, 22 bp, Homo sapiens
cagagacacttaacaggaatgg

SEQ ID NO: 7469483 - DNA, 22 bp, Homo sapiens
cagagacacttaacaggaatgg

SEQ ID NO: 7469484 - DNA, 22 bp, Homo sapiens
cagagacacttaacaggaatgg

SEQ ID NO: 7469485 - DNA, 22 bp, Homo sapiens
cagagacacttaacaggaatgg

SEQ ID NO: 7469486 - DNA, 22 bp, Homo sapiens
cagagacacttaacaggaatgg

SEQ ID NO: 7469487 - DNA, 22 bp, Homo sapiens
cagagacacttaacaggaatgg

SEQ ID NO: 7469488 - DNA, 22 bp, Homo sapiens
cagagacaatgtctctgcttgt

SEQ ID NO: 7469489 - DNA, 22 bp, Homo sapiens
cagagacaatgtctctgcttgt

SEQ ID NO: 7469490 - DNA, 22 bp, Homo sapiens
cagagacaatgtctctgcttgt

SEQ ID NO: 7469491 - DNA, 22 bp, Homo sapiens
cagagacaccccagaaaataag

SEQ ID NO: 7469492 - DNA, 22 bp, Homo sapiens
cagagacaccccagaaaataag

SEQ ID NO: 7469493 - DNA, 22 bp, Homo sapiens
cagagacaccccagaaaataag

SEQ ID NO: 7469494 - DNA, 22 bp, Homo sapiens
cagagacaccccagaaaataag

SEQ ID NO: 7469495 - DNA, 22 bp, Homo sapiens
cagagacaatgtctctgcttgt

SEQ ID NO: 7469496 - DNA, 22 bp, Homo sapiens
cagagacaatgtctctgcttgt

SEQ ID NO: 7469497 - DNA, 22 bp, Homo sapiens
cagagacaatgtctctgcttgt

SEQ ID NO: 7469498 - DNA, 22 bp, Homo sapiens
cagagacaacctggtagagaaa

SEQ ID NO: 7469499 - DNA, 22 bp, Homo sapiens
cagagacaacctggtagagaaa

SEQ ID NO: 7469500 - DNA, 22 bp, Homo sapiens
cagagacaacctggtagagaaa

SEQ ID NO: 7469501 - DNA, 22 bp, Homo sapiens
cagagacaacctggtagagaaa

SEQ ID NO: 7469502 - DNA, 22 bp, Homo sapiens
cagagacaacctggtagagaaa

SEQ ID NO: 7469503 - DNA, 22 bp, Homo sapiens
gggcaggtacaagatgcttctt

SEQ ID NO: 7469504 - DNA, 22 bp, Homo sapiens
gggcaggtacaagatgcttctt

SEQ ID NO: 7469505 - DNA, 22 bp, Homo sapiens
gggcaggtacaagatgcttctt

SEQ ID NO: 7469506 - DNA, 22 bp, Homo sapiens
gggcaggtactgggtggtgagc

SEQ ID NO: 7469507 - DNA, 22 bp, Homo sapiens
gggcaggggtcagtggccccaa

SEQ ID NO: 7469508 - DNA, 22 bp, Homo sapiens
gggcaggggtcagtggccccaa

SEQ ID NO: 7469509 - DNA, 22 bp, Homo sapiens
gggcaggggtcagtggccccaa

SEQ ID NO: 7469510 - DNA, 22 bp, Homo sapiens
gggcaggtacaagatgcttctt

SEQ ID NO: 7469511 - DNA, 22 bp, Homo sapiens
gggcaggggtcagtggccccaa

SEQ ID NO: 7469512 - DNA, 22 bp, Homo sapiens
gggcaggggtcagtggccccaa

SEQ ID NO: 7469513 - DNA, 22 bp, Homo sapiens
gggcaggggtcagtggccccaa

SEQ ID NO: 7469514 - DNA, 22 bp, Homo sapiens
gggcaggggtcagtggccccaa

SEQ ID NO: 7469515 - DNA, 22 bp, Homo sapiens
cagagcaggcccactgccctcc

SEQ ID NO: 7469516 - DNA, 22 bp, Homo sapiens
cagagcaggcccactgccctcc

SEQ ID NO: 7469517 - DNA, 22 bp, Homo sapiens
gggcaggtactgggtggtgagc

SEQ ID NO: 7469518 - DNA, 22 bp, Homo sapiens
gggcaggtactgggtggtgagc

SEQ ID NO: 7469519 - DNA, 22 bp, Homo sapiens
cagagcaggggtttcccaggtt

SEQ ID NO: 7469520 - DNA, 22 bp, Homo sapiens
cagagcaggggtttcccaggtt

SEQ ID NO: 7469521 - DNA, 22 bp, Homo sapiens
cagagcaggggtttcccaggtt

SEQ ID NO: 7469522 - DNA, 22 bp, Homo sapiens
cagagcaggggtttcccaggtt

SEQ ID NO: 7469523 - DNA, 22 bp, Homo sapiens
cagagcaggggtttcccaggtt

SEQ ID NO: 7469524 - DNA, 22 bp, Homo sapiens
cagagcagtgaggagttgtgta

SEQ ID NO: 7469525 - DNA, 22 bp, Homo sapiens
cagagcagtgaggagttgtgta

SEQ ID NO: 7469526 - DNA, 22 bp, Homo sapiens
cagagcagtgaggagttgtgta

SEQ ID NO: 7469527 - DNA, 22 bp, Homo sapiens
cagagcagtgaggagttgtgta

SEQ ID NO: 7469528 - DNA, 22 bp, Homo sapiens
gggcaggggtagcattccaagt

SEQ ID NO: 7469529 - DNA, 22 bp, Homo sapiens
gggcaggggtagcattccaagt

SEQ ID NO: 7469530 - DNA, 22 bp, Homo sapiens
gggcaggggtagcattccaagt

SEQ ID NO: 7469531 - DNA, 18 bp, Homo sapiens
cagagcagaggtggagcg

SEQ ID NO: 7469532 - DNA, 22 bp, Homo sapiens
gggcaggggtcagtggccccaa

SEQ ID NO: 7469533 - DNA, 22 bp, Homo sapiens
gggcaggggtcagtggccccaa

SEQ ID NO: 7469534 - DNA, 22 bp, Homo sapiens
gggcaggggtcagtggccccaa

SEQ ID NO: 7469535 - DNA, 22 bp, Homo sapiens
gggcaggggtcagtggccccaa

SEQ ID NO: 7469536 - DNA, 22 bp, Homo sapiens
gggcaggggtagcattccaagt

SEQ ID NO: 7469537 - DNA, 22 bp, Homo sapiens
gggcaggggtagcattccaagt

SEQ ID NO: 7469538 - DNA, 22 bp, Homo sapiens
gggcaggggtcagtggccccaa

SEQ ID NO: 7469539 - DNA, 22 bp, Homo sapiens
cagagcagaagcggtcctcaca

SEQ ID NO: 7469540 - DNA, 22 bp, Homo sapiens
cagagcagaagcggtcctcaca

SEQ ID NO: 7469541 - DNA, 22 bp, Homo sapiens
cagagcagaaggtccaagcctg

SEQ ID NO: 7469542 - DNA, 22 bp, Homo sapiens
cagagcagaagcggtcctcaca

SEQ ID NO: 7469543 - DNA, 22 bp, Homo sapiens
cagagcagaagcggtcctcaca

SEQ ID NO: 7469544 - DNA, 22 bp, Homo sapiens
cagagcagaaggtccaagcctg

SEQ ID NO: 7469545 - DNA, 22 bp, Homo sapiens
cagagcagaaggtccaagcctg

SEQ ID NO: 7469546 - DNA, 22 bp, Homo sapiens
cagagcagaaggtccaagcctg

SEQ ID NO: 7469547 - DNA, 22 bp, Homo sapiens
cagagcagaaggtccaagcctg

SEQ ID NO: 7469548 - DNA, 22 bp, Homo sapiens
cagagcagaaggtccaagcctg

SEQ ID NO: 7469549 - DNA, 22 bp, Homo sapiens
cagagcagaaggtccaagcctg

SEQ ID NO: 7469550 - DNA, 18 bp, Homo sapiens
cagagcagaggtggagcg

SEQ ID NO: 7469551 - DNA, 18 bp, Homo sapiens
cagagcagaggtggagcg

SEQ ID NO: 7469552 - DNA, 18 bp, Homo sapiens
cagagcagaggtggagcg

SEQ ID NO: 7469553 - DNA, 18 bp, Homo sapiens
cagagcagaggtggagcg

SEQ ID NO: 7469554 - DNA, 18 bp, Homo sapiens
cagagcagaggtggagcg

SEQ ID NO: 7469555 - DNA, 22 bp, Homo sapiens
cagagcagacgttgagattaag

SEQ ID NO: 7469556 - DNA, 22 bp, Homo sapiens
cagagcagacgttgagattaag

SEQ ID NO: 7469557 - DNA, 22 bp, Homo sapiens
cagagcagacgttgagattaag

SEQ ID NO: 7469558 - DNA, 22 bp, Homo sapiens
cagagcagacgttgagattaag

SEQ ID NO: 7469559 - DNA, 22 bp, Homo sapiens
cagagcagacgttgagattaag

SEQ ID NO: 7469560 - DNA, 22 bp, Homo sapiens
cagagcagacgttgagattaag

SEQ ID NO: 7469561 - DNA, 20 bp, Homo sapiens
cagagccaagagcagcatct

SEQ ID NO: 7469562 - DNA, 22 bp, Homo sapiens
cagagccacagcctccagattt

SEQ ID NO: 7469563 - DNA, 22 bp, Homo sapiens
cagagccacagcctccagattt

SEQ ID NO: 7469564 - DNA, 20 bp, Homo sapiens
cagagccaagagcagcatct

SEQ ID NO: 7469565 - DNA, 22 bp, Homo sapiens
cagagccactgtctgccaggca

SEQ ID NO: 7469566 - DNA, 22 bp, Homo sapiens
cagagccacagcctccagattt

SEQ ID NO: 7469567 - DNA, 22 bp, Homo sapiens
cagagccacagcctccagattt

SEQ ID NO: 7469568 - DNA, 22 bp, Homo sapiens
cagagccactgcattttacagc

SEQ ID NO: 7469569 - DNA, 22 bp, Homo sapiens
cagagccactgcattttacagc

SEQ ID NO: 7469570 - DNA, 22 bp, Homo sapiens
cagagccaacgccacctgccca

SEQ ID NO: 7469571 - DNA, 22 bp, Homo sapiens
cagagccaacgccacctgccca

SEQ ID NO: 7469572 - DNA, 22 bp, Homo sapiens
cagagccaacgccacctgccca

SEQ ID NO: 7469573 - DNA, 20 bp, Homo sapiens
cagagccaagagcagcatct

SEQ ID NO: 7469574 - DNA, 20 bp, Homo sapiens
cagagccaagagcagcatct

SEQ ID NO: 7469575 - DNA, 20 bp, Homo sapiens
cagagccaagagcagcatct

SEQ ID NO: 7469576 - DNA, 22 bp, Homo sapiens
cagagccaaacctcagggcccg

SEQ ID NO: 7469577 - DNA, 22 bp, Homo sapiens
cagagccaaacctcagggcccg

SEQ ID NO: 7469578 - DNA, 22 bp, Homo sapiens
cagagccaaacctcagggcccg

SEQ ID NO: 7469579 - DNA, 22 bp, Homo sapiens
cagagccaaacctcagggcccg

SEQ ID NO: 7469580 - DNA, 22 bp, Homo sapiens
cagagccaaacctcagggcccg

SEQ ID NO: 7469581 - DNA, 22 bp, Homo sapiens
cagagcattgagggtctgccaa

SEQ ID NO: 7469582 - DNA, 22 bp, Homo sapiens
cagagccaaaaccgtaacagcc

SEQ ID NO: 7469583 - DNA, 22 bp, Homo sapiens
cagagccaaaaccgtaacagcc

SEQ ID NO: 7469584 - DNA, 22 bp, Homo sapiens
cagagcagtgaggagttgtgta

SEQ ID NO: 7469585 - DNA, 22 bp, Homo sapiens
cagagcagtgaggagttgtgta

SEQ ID NO: 7469586 - DNA, 22 bp, Homo sapiens
cagagcagtgaggagttgtgta

SEQ ID NO: 7469587 - DNA, 22 bp, Homo sapiens
cagagcagtgaggagttgtgta

SEQ ID NO: 7469588 - DNA, 22 bp, Homo sapiens
cagagcagtgaggagttgtgta

SEQ ID NO: 7469589 - DNA, 22 bp, Homo sapiens
cagagcagtgaggagttgtgta

SEQ ID NO: 7469590 - DNA, 20 bp, Homo sapiens
cagagcagtgcccaggcggc

SEQ ID NO: 7469591 - DNA, 20 bp, Homo sapiens
cagagcagtgcccaggcggc

SEQ ID NO: 7469592 - DNA, 20 bp, Homo sapiens
cagagcagtgcccaggcggc

SEQ ID NO: 7469593 - DNA, 20 bp, Homo sapiens
cagagcagtgcccaggcggc

SEQ ID NO: 7469594 - DNA, 20 bp, Homo sapiens
cagagcagtgcccaggcggc

SEQ ID NO: 7469595 - DNA, 20 bp, Homo sapiens
cagagcagtgcccaggcggc

SEQ ID NO: 7469596 - DNA, 20 bp, Homo sapiens
cagagcagtgcccaggcggc

SEQ ID NO: 7469597 - DNA, 20 bp, Homo sapiens
cagagcagtgcccaggcggc

SEQ ID NO: 7469598 - DNA, 22 bp, Homo sapiens
cagagcagtggagagtaggtct

SEQ ID NO: 7469599 - DNA, 22 bp, Homo sapiens
cagagcagtggagagtaggtct

SEQ ID NO: 7469600 - DNA, 22 bp, Homo sapiens
cagagcagtggagagtaggtct

SEQ ID NO: 7469601 - DNA, 22 bp, Homo sapiens
cagagcagtggagagtaggtct

SEQ ID NO: 7469602 - DNA, 20 bp, Homo sapiens
cagagcagtgcccaggcggc

SEQ ID NO: 7469603 - DNA, 20 bp, Homo sapiens
cagagcagtgcccaggcggc

SEQ ID NO: 7469604 - DNA, 20 bp, Homo sapiens
cagagcagtgcccaggcggc

SEQ ID NO: 7469605 - DNA, 20 bp, Homo sapiens
cagagcagtgcccaggcggc

SEQ ID NO: 7469606 - DNA, 22 bp, Homo sapiens
cagagcagtggagagtaggtct

SEQ ID NO: 7469607 - DNA, 22 bp, Homo sapiens
cagagcagtggggttggtcaga

SEQ ID NO: 7469608 - DNA, 22 bp, Homo sapiens
cagagcagtggggttggtcaga

SEQ ID NO: 7469609 - DNA, 22 bp, Homo sapiens
cagagcagtggggttggtcaga

SEQ ID NO: 7469610 - DNA, 22 bp, Homo sapiens
cagagcagtggggttggtcaga

SEQ ID NO: 7469611 - DNA, 19 bp, Homo sapiens
cagagcagtggttcctgaa

SEQ ID NO: 7469612 - DNA, 22 bp, Homo sapiens
cagagcagtggggttggtcaga

SEQ ID NO: 7469613 - DNA, 19 bp, Homo sapiens
cagagcagtggttcctgaa

SEQ ID NO: 7469614 - DNA, 19 bp, Homo sapiens
cagagcagtggttcctgaa

SEQ ID NO: 7469615 - DNA, 19 bp, Homo sapiens
cagagcagtggttcctgaa

SEQ ID NO: 7469616 - DNA, 22 bp, Homo sapiens
cagagcatgaataaaagttaca

SEQ ID NO: 7469617 - DNA, 22 bp, Homo sapiens
cagagcatcgcgcagagagcct

SEQ ID NO: 7469618 - DNA, 22 bp, Homo sapiens
cagagcatcgcgcagagagcct

SEQ ID NO: 7469619 - DNA, 19 bp, Homo sapiens
cagagcagtggttcctgaa

SEQ ID NO: 7469620 - DNA, 19 bp, Homo sapiens
cagagcagtggttcctgaa

SEQ ID NO: 7469621 - DNA, 19 bp, Homo sapiens
cagagcagtggttcctgaa

SEQ ID NO: 7469622 - DNA, 22 bp, Homo sapiens
cagagcataattgacatgaggt

SEQ ID NO: 7469623 - DNA, 22 bp, Homo sapiens
gggagctgatcaggtggattca

SEQ ID NO: 7469624 - DNA, 22 bp, Homo sapiens
gggagctgatcaggtggattca

SEQ ID NO: 7469625 - DNA, 22 bp, Homo sapiens
gggagccacagtagcagctact

SEQ ID NO: 7469626 - DNA, 22 bp, Homo sapiens
gggagccaaggagagaggcctt

SEQ ID NO: 7469627 - DNA, 22 bp, Homo sapiens
gggagccaaggagagaggcctt

SEQ ID NO: 7469628 - DNA, 22 bp, Homo sapiens
gggagctgatgatgtaagtccc

SEQ ID NO: 7469629 - DNA, 22 bp, Homo sapiens
gggagctgatcaggtggattca

SEQ ID NO: 7469630 - DNA, 22 bp, Homo sapiens
gggagctgatgatgtaagtccc

SEQ ID NO: 7469631 - DNA, 22 bp, Homo sapiens
gggagctgatcaggtggattca

SEQ ID NO: 7469632 - DNA, 22 bp, Homo sapiens
gggagctgcacacgccccggaa

SEQ ID NO: 7469633 - DNA, 22 bp, Homo sapiens
gggagctgcacacgccccggaa

SEQ ID NO: 7469634 - DNA, 22 bp, Homo sapiens
gggagctgatgatgtaagtccc

SEQ ID NO: 7469635 - DNA, 22 bp, Homo sapiens
gggagctgatgatgtaagtccc

SEQ ID NO: 7469636 - DNA, 22 bp, Homo sapiens
gggagctgccaccacccctggg

SEQ ID NO: 7469637 - DNA, 22 bp, Homo sapiens
gggagctgccaccacccctggg

SEQ ID NO: 7469638 - DNA, 22 bp, Homo sapiens
gggagctgccaccacccctggg

SEQ ID NO: 7469639 - DNA, 22 bp, Homo sapiens
gggagctgcacacgccccggaa

SEQ ID NO: 7469640 - DNA, 22 bp, Homo sapiens
gggagctgcacacgccccggaa

SEQ ID NO: 7469641 - DNA, 22 bp, Homo sapiens
gggagcatttattttccgttag

SEQ ID NO: 7469642 - DNA, 22 bp, Homo sapiens
gggagcataaactcagatttca

SEQ ID NO: 7469643 - DNA, 22 bp, Homo sapiens
gggagcataaactcagatttca

SEQ ID NO: 7469644 - DNA, 22 bp, Homo sapiens
gggagcatttattttccgttag

SEQ ID NO: 7469645 - DNA, 22 bp, Homo sapiens
gggagccaaggagagaggcctt

SEQ ID NO: 7469646 - DNA, 22 bp, Homo sapiens
gggagccaaggagagaggcctt

SEQ ID NO: 7469647 - DNA, 22 bp, Homo sapiens
gggagccaaggagagaggcctt

SEQ ID NO: 7469648 - DNA, 22 bp, Homo sapiens
cagacagaaggaaggccaacat

SEQ ID NO: 7469649 - DNA, 22 bp, Homo sapiens
gggagcagttaaaatgattcct

SEQ ID NO: 7469650 - DNA, 22 bp, Homo sapiens
cagacagaaggctccttgaggt

SEQ ID NO: 7469651 - DNA, 22 bp, Homo sapiens
cagacagaaggaaggccaacat

SEQ ID NO: 7469652 - DNA, 22 bp, Homo sapiens
cagacagaaggaaggccaacat

SEQ ID NO: 7469653 - DNA, 22 bp, Homo sapiens
cagacagaaggaaggccaacat

SEQ ID NO: 7469654 - DNA, 22 bp, Homo sapiens
cagacagaaggaaggccaacat

SEQ ID NO: 7469655 - DNA, 22 bp, Homo sapiens
cagacactgcagcagtctccca

SEQ ID NO: 7469656 - DNA, 22 bp, Homo sapiens
cagacactgcagcagtctccca

SEQ ID NO: 7469657 - DNA, 22 bp, Homo sapiens
cagacactgcagcagtctccca

SEQ ID NO: 7469658 - DNA, 22 bp, Homo sapiens
cagacacttattgagcaagtac

SEQ ID NO: 7469659 - DNA, 22 bp, Homo sapiens
cagacactgcagcagtctccca

SEQ ID NO: 7469660 - DNA, 18 bp, Homo sapiens
cagacactctgctctgca

SEQ ID NO: 7469661 - DNA, 18 bp, Homo sapiens
cagacactctgctctgca

SEQ ID NO: 7469662 - DNA, 22 bp, Homo sapiens
cagacagaaggaaggccaacat

SEQ ID NO: 7469663 - DNA, 22 bp, Homo sapiens
cagacacttattgagcaagtac

SEQ ID NO: 7469664 - DNA, 22 bp, Homo sapiens
cagacacttattgagcaagtac

SEQ ID NO: 7469665 - DNA, 22 bp, Homo sapiens
cagacacttattgagcaagtac

SEQ ID NO: 7469666 - DNA, 22 bp, Homo sapiens
cagacacttattgagcaagtac

SEQ ID NO: 7469667 - DNA, 22 bp, Homo sapiens
cagacacagcaattctgtgttg

SEQ ID NO: 7469668 - DNA, 22 bp, Homo sapiens
cagacactaggtgacagagtgc

SEQ ID NO: 7469669 - DNA, 22 bp, Homo sapiens
cagacactaggtgacagagtgc

SEQ ID NO: 7469670 - DNA, 22 bp, Homo sapiens
cagacacagcaattctgtgttg

SEQ ID NO: 7469671 - DNA, 22 bp, Homo sapiens
cagacactaggtgacagagtgc

SEQ ID NO: 7469672 - DNA, 22 bp, Homo sapiens
cagacactattgtgtataaatc

SEQ ID NO: 7469673 - DNA, 22 bp, Homo sapiens
cagacactattgtgtataaatc

SEQ ID NO: 7469674 - DNA, 22 bp, Homo sapiens
cagacactattgtgtataaatc

SEQ ID NO: 7469675 - DNA, 22 bp, Homo sapiens
cagacactattgtgtataaatc

SEQ ID NO: 7469676 - DNA, 22 bp, Homo sapiens
cagacactatgctaaggtacta

SEQ ID NO: 7469677 - DNA, 22 bp, Homo sapiens
cagacactatgctaaggtacta

SEQ ID NO: 7469678 - DNA, 18 bp, Homo sapiens
cagacactctgctctgca

SEQ ID NO: 7469679 - DNA, 18 bp, Homo sapiens
cagacactctgctctgca

SEQ ID NO: 7469680 - DNA, 22 bp, Homo sapiens
cagacactattgtgtataaatc

SEQ ID NO: 7469681 - DNA, 18 bp, Homo sapiens
cagacactctgctctgca

SEQ ID NO: 7469682 - DNA, 22 bp, Homo sapiens
cagacacagatatgcatatggc

SEQ ID NO: 7469683 - DNA, 22 bp, Homo sapiens
cagacacaccaggcccattctg

SEQ ID NO: 7469684 - DNA, 22 bp, Homo sapiens
cagacacaccaggcccattctg

SEQ ID NO: 7469685 - DNA, 22 bp, Homo sapiens
cagacacagatatgcatatggc

SEQ ID NO: 7469686 - DNA, 22 bp, Homo sapiens
cagacacaccaggcccattctg

SEQ ID NO: 7469687 - DNA, 22 bp, Homo sapiens
cagacacagatatgcatatggc

SEQ ID NO: 7469688 - DNA, 22 bp, Homo sapiens
cagacacagatatgcatatggc

SEQ ID NO: 7469689 - DNA, 22 bp, Homo sapiens
cagacacagatatgcatatggc

SEQ ID NO: 7469690 - DNA, 22 bp, Homo sapiens
cagacacagatatgcatatggc

SEQ ID NO: 7469691 - DNA, 22 bp, Homo sapiens
cagacacacaccctggcctagc

SEQ ID NO: 7469692 - DNA, 22 bp, Homo sapiens
cagacacacaccctggcctagc

SEQ ID NO: 7469693 - DNA, 22 bp, Homo sapiens
cagacacacaagcaatctaagt

SEQ ID NO: 7469694 - DNA, 22 bp, Homo sapiens
cagacacacaagcaatctaagt

SEQ ID NO: 7469695 - DNA, 22 bp, Homo sapiens
cagacacacaagcaatctaagt

SEQ ID NO: 7469696 - DNA, 22 bp, Homo sapiens
cagacacacaagcaatctaagt

SEQ ID NO: 7469697 - DNA, 22 bp, Homo sapiens
gggaggcagtgctggaggctgg

SEQ ID NO: 7469698 - DNA, 22 bp, Homo sapiens
gggaggcagtgctggaggctgg

SEQ ID NO: 7469699 - DNA, 22 bp, Homo sapiens
gggaggcagtgctggaggctgg

SEQ ID NO: 7469700 - DNA, 22 bp, Homo sapiens
gggaggcagtgctggaggctgg

SEQ ID NO: 7469701 - DNA, 22 bp, Homo sapiens
gggaggcagtgctggaggctgg

SEQ ID NO: 7469702 - DNA, 22 bp, Homo sapiens
gggaggcagtgctggaggctgg

SEQ ID NO: 7469703 - DNA, 22 bp, Homo sapiens
gggaggcagtgctggaggctgg

SEQ ID NO: 7469704 - DNA, 22 bp, Homo sapiens
gggaggcagtgctggaggctgg

SEQ ID NO: 7469705 - DNA, 22 bp, Homo sapiens
gggaggcagtgctggaggctgg

SEQ ID NO: 7469706 - DNA, 22 bp, Homo sapiens
gggaggcagtgctggaggctgg

SEQ ID NO: 7469707 - DNA, 22 bp, Homo sapiens
gggaggcagtgctggaggctgg

SEQ ID NO: 7469708 - DNA, 22 bp, Homo sapiens
gggaggcagtgctggaggctgg

SEQ ID NO: 7469709 - DNA, 22 bp, Homo sapiens
gggaggcatgtgttatccactt

SEQ ID NO: 7469710 - DNA, 22 bp, Homo sapiens
gggaggcatgtgttatccactt

SEQ ID NO: 7469711 - DNA, 22 bp, Homo sapiens
gggaggcatgtgttatccactt

SEQ ID NO: 7469712 - DNA, 22 bp, Homo sapiens
gggaggcatgtgttatccactt

SEQ ID NO: 7469713 - DNA, 22 bp, Homo sapiens
gggaggcatgtgttatccactt

SEQ ID NO: 7469714 - DNA, 22 bp, Homo sapiens
gggaggcagtgctggaggctgg

SEQ ID NO: 7469715 - DNA, 22 bp, Homo sapiens
gggaggcagtgctggaggctgg

SEQ ID NO: 7469716 - DNA, 22 bp, Homo sapiens
gggaggcagtgctggaggctgg

SEQ ID NO: 7469717 - DNA, 22 bp, Homo sapiens
gggaggcagtgctggaggctgg

SEQ ID NO: 7469718 - DNA, 22 bp, Homo sapiens
gggaggcagtgctggaggctgg

SEQ ID NO: 7469719 - DNA, 22 bp, Homo sapiens
gggaggcagtgctggaggctgg

SEQ ID NO: 7469720 - DNA, 22 bp, Homo sapiens
gggaggcagtgctggaggctgg

SEQ ID NO: 7469721 - DNA, 22 bp, Homo sapiens
gggaggcacgaggcgcgcagtg

SEQ ID NO: 7469722 - DNA, 22 bp, Homo sapiens
gggaggcacgaggcgcgcagtg

SEQ ID NO: 7469723 - DNA, 22 bp, Homo sapiens
gggaggcacgaggcgcgcagtg

SEQ ID NO: 7469724 - DNA, 22 bp, Homo sapiens
gggaggcacgaggcgcgcagtg

SEQ ID NO: 7469725 - DNA, 22 bp, Homo sapiens
gggaggcacgaggcgcgcagtg

SEQ ID NO: 7469726 - DNA, 22 bp, Homo sapiens
gggaggcacgaggcgcgcagtg

SEQ ID NO: 7469727 - DNA, 22 bp, Homo sapiens
gggaggcacgaggcgcgcagtg

SEQ ID NO: 7469728 - DNA, 22 bp, Homo sapiens
gggaggcacgaggcgcgcagtg

SEQ ID NO: 7469729 - DNA, 22 bp, Homo sapiens
gggaggcacgaggcgcgcagtg

SEQ ID NO: 7469730 - DNA, 22 bp, Homo sapiens
gggaggcacgaggcgcgcagtg

SEQ ID NO: 7469731 - DNA, 22 bp, Homo sapiens
gggaggcacgaggcgcgcagtg

SEQ ID NO: 7469732 - DNA, 22 bp, Homo sapiens
gggaggagggtgctggctaaac

SEQ ID NO: 7469733 - DNA, 22 bp, Homo sapiens
gggaggagtgaagattcacctg

SEQ ID NO: 7469734 - DNA, 22 bp, Homo sapiens
gggaggagggtgctggctaaac

SEQ ID NO: 7469735 - DNA, 22 bp, Homo sapiens
gggaggagtgaagattcacctg

SEQ ID NO: 7469736 - DNA, 22 bp, Homo sapiens
gggaggagggtgctggctaaac

SEQ ID NO: 7469737 - DNA, 22 bp, Homo sapiens
gggaggagtgaagattcacctg

SEQ ID NO: 7469738 - DNA, 22 bp, Homo sapiens
gggaggagtgaagattcacctg

SEQ ID NO: 7469739 - DNA, 22 bp, Homo sapiens
gggaggagtgaagattcacctg

SEQ ID NO: 7469740 - DNA, 22 bp, Homo sapiens
gggaggcacgaggcgcgcagtg

SEQ ID NO: 7469741 - DNA, 22 bp, Homo sapiens
gggaggagtgaagattcacctg

SEQ ID NO: 7469742 - DNA, 21 bp, Homo sapiens
gggagctggaaactgggtgac

SEQ ID NO: 7469743 - DNA, 21 bp, Homo sapiens
gggagctggaaactgggtgac

SEQ ID NO: 7469744 - DNA, 21 bp, Homo sapiens
gggagctggaaactgggtgac

SEQ ID NO: 7469745 - DNA, 21 bp, Homo sapiens
gggagctggaaactgggtgac

SEQ ID NO: 7469746 - DNA, 20 bp, Homo sapiens
gggagctggaattgtcttag

SEQ ID NO: 7469747 - DNA, 20 bp, Homo sapiens
gggagctggaattgtcttag

SEQ ID NO: 7469748 - DNA, 20 bp, Homo sapiens
gggagctggaattgtcttag

SEQ ID NO: 7469749 - DNA, 20 bp, Homo sapiens
gggagctggaattgtcttag

SEQ ID NO: 7469750 - DNA, 21 bp, Homo sapiens
gggagctggaaactgggtgac

SEQ ID NO: 7469751 - DNA, 21 bp, Homo sapiens
gggagctggaaactgggtgac

SEQ ID NO: 7469752 - DNA, 21 bp, Homo sapiens
gggagctggaaactgggtgac

SEQ ID NO: 7469753 - DNA, 22 bp, Homo sapiens
gggagctgccaccacccctggg

SEQ ID NO: 7469754 - DNA, 22 bp, Homo sapiens
gggagctgccaccacccctggg

SEQ ID NO: 7469755 - DNA, 22 bp, Homo sapiens
gggagctgccaccacccctggg

SEQ ID NO: 7469756 - DNA, 22 bp, Homo sapiens
gggagctgccttagaccggagg

SEQ ID NO: 7469757 - DNA, 22 bp, Homo sapiens
gggagctgccttagaccggagg

SEQ ID NO: 7469758 - DNA, 22 bp, Homo sapiens
gggagctgccttagaccggagg

SEQ ID NO: 7469759 - DNA, 22 bp, Homo sapiens
gggagctgccttagaccggagg

SEQ ID NO: 7469760 - DNA, 22 bp, Homo sapiens
gggagctgctgaacacaagggt

SEQ ID NO: 7469761 - DNA, 22 bp, Homo sapiens
gggagctgcggtcttgcgaaga

SEQ ID NO: 7469762 - DNA, 22 bp, Homo sapiens
gggagctgcggtcttgcgaaga

SEQ ID NO: 7469763 - DNA, 22 bp, Homo sapiens
gggagctgctgaacacaagggt

SEQ ID NO: 7469764 - DNA, 22 bp, Homo sapiens
gggagctgctgaacacaagggt

SEQ ID NO: 7469765 - DNA, 22 bp, Homo sapiens
gggagctgctgaacacaagggt

SEQ ID NO: 7469766 - DNA, 22 bp, Homo sapiens
gggagctgctgaacacaagggt

SEQ ID NO: 7469767 - DNA, 22 bp, Homo sapiens
gggagctgctgaacacaagggt

SEQ ID NO: 7469768 - DNA, 22 bp, Homo sapiens
gggagctgctgaacacaagggt

SEQ ID NO: 7469769 - DNA, 22 bp, Homo sapiens
gggagctgctgaacacaagggt

SEQ ID NO: 7469770 - DNA, 22 bp, Homo sapiens
cagaaacagagaaatattggct

SEQ ID NO: 7469771 - DNA, 22 bp, Homo sapiens
cagaaacagagaaatattggct

SEQ ID NO: 7469772 - DNA, 22 bp, Homo sapiens
cagaaacagagaaatattggct

SEQ ID NO: 7469773 - DNA, 22 bp, Homo sapiens
cagaaacagagaaatattggct

SEQ ID NO: 7469774 - DNA, 22 bp, Homo sapiens
cagaaacagagaaatattggct

SEQ ID NO: 7469775 - DNA, 22 bp, Homo sapiens
cagaaacaggcaacgtgtgcac

SEQ ID NO: 7469776 - DNA, 22 bp, Homo sapiens
cagaaacaggcaacgtgtgcac

SEQ ID NO: 7469777 - DNA, 22 bp, Homo sapiens
cagaaacaggcaacgtgtgcac

SEQ ID NO: 7469778 - DNA, 22 bp, Homo sapiens
cagaaacaggcaacgtgtgcac

SEQ ID NO: 7469779 - DNA, 22 bp, Homo sapiens
cagaaacaggcaacgtgtgcac

SEQ ID NO: 7469780 - DNA, 22 bp, Homo sapiens
cagaaacaggcaacgtgtgcac

SEQ ID NO: 7469781 - DNA, 22 bp, Homo sapiens
cagaaacagagaaatattggct

SEQ ID NO: 7469782 - DNA, 22 bp, Homo sapiens
cagaaacagagaaatattggct

SEQ ID NO: 7469783 - DNA, 22 bp, Homo sapiens
cagaaacagagaaatattggct

SEQ ID NO: 7469784 - DNA, 22 bp, Homo sapiens
cagaaacagacatgacgcagta

SEQ ID NO: 7469785 - DNA, 22 bp, Homo sapiens
cagaaacagacatgacgcagta

SEQ ID NO: 7469786 - DNA, 22 bp, Homo sapiens
cagaaacagacatgacgcagta

SEQ ID NO: 7469787 - DNA, 22 bp, Homo sapiens
cagaaacagacatgacgcagta

SEQ ID NO: 7469788 - DNA, 22 bp, Homo sapiens
cagaaacagacatgacgcagta

SEQ ID NO: 7469789 - DNA, 22 bp, Homo sapiens
cagaaacacttgtagagaagtt

SEQ ID NO: 7469790 - DNA, 22 bp, Homo sapiens
cagaaacagacatgacgcagta

SEQ ID NO: 7469791 - DNA, 22 bp, Homo sapiens
cagaaacagacatgacgcagta

SEQ ID NO: 7469792 - DNA, 22 bp, Homo sapiens
cagaataaaggtacaattgagt

SEQ ID NO: 7469793 - DNA, 22 bp, Homo sapiens
cagaataaaggtacaattgagt

SEQ ID NO: 7469794 - DNA, 22 bp, Homo sapiens
cagaataaaggtacaattgagt

SEQ ID NO: 7469795 - DNA, 22 bp, Homo sapiens
cagaatgttaccagttagtctg

SEQ ID NO: 7469796 - DNA, 22 bp, Homo sapiens
cagaataaaagtcccaaggcat

SEQ ID NO: 7469797 - DNA, 22 bp, Homo sapiens
cagaataaacagaaacgtagct

SEQ ID NO: 7469798 - DNA, 22 bp, Homo sapiens
cagaataaacagaaacgtagct

SEQ ID NO: 7469799 - DNA, 22 bp, Homo sapiens
cagaataaacagaaacgtagct

SEQ ID NO: 7469800 - DNA, 22 bp, Homo sapiens
cagaataaacagaaacgtagct

SEQ ID NO: 7469801 - DNA, 22 bp, Homo sapiens
cagaataaaggtacaattgagt

SEQ ID NO: 7469802 - DNA, 22 bp, Homo sapiens
cagaataaaggtacaattgagt

SEQ ID NO: 7469803 - DNA, 22 bp, Homo sapiens
cagaattgagagaggctgttct

SEQ ID NO: 7469804 - DNA, 22 bp, Homo sapiens
cagaatttaagtggattattct

SEQ ID NO: 7469805 - DNA, 22 bp, Homo sapiens
cagaatttaagtggattattct

SEQ ID NO: 7469806 - DNA, 22 bp, Homo sapiens
cagaatttaagtggattattct

SEQ ID NO: 7469807 - DNA, 22 bp, Homo sapiens
cagaatttaagtggattattct

SEQ ID NO: 7469808 - DNA, 22 bp, Homo sapiens
cagaattatagttgctttttaa

SEQ ID NO: 7469809 - DNA, 22 bp, Homo sapiens
cagaattcgaatgagcagaatc

SEQ ID NO: 7469810 - DNA, 22 bp, Homo sapiens
cagaattatagttgctttttaa

SEQ ID NO: 7469811 - DNA, 22 bp, Homo sapiens
cagaatttaagtggattattct

SEQ ID NO: 7469812 - DNA, 22 bp, Homo sapiens
cagaattcgaatgagcagaatc

SEQ ID NO: 7469813 - DNA, 22 bp, Homo sapiens
cagacaagaaagaatcaagcca

SEQ ID NO: 7469814 - DNA, 22 bp, Homo sapiens
cagacaagaaagaatcaagcca

SEQ ID NO: 7469815 - DNA, 22 bp, Homo sapiens
cagacaagaaagaatcaagcca

SEQ ID NO: 7469816 - DNA, 22 bp, Homo sapiens
cagacaaccaggtctttcagtt

SEQ ID NO: 7469817 - DNA, 22 bp, Homo sapiens
cagacaactggactaagatcac

SEQ ID NO: 7469818 - DNA, 22 bp, Homo sapiens
cagacaattaagtaattgaggt

SEQ ID NO: 7469819 - DNA, 22 bp, Homo sapiens
cagacaaggccatctttcattt

SEQ ID NO: 7469820 - DNA, 22 bp, Homo sapiens
cagacaaggccatctttcattt

SEQ ID NO: 7469821 - DNA, 22 bp, Homo sapiens
cagacacacaagcaatctaagt

SEQ ID NO: 7469822 - DNA, 22 bp, Homo sapiens
cagacacacaagcaatctaagt

SEQ ID NO: 7469823 - DNA, 22 bp, Homo sapiens
cagacaaagcggaaactgttta

SEQ ID NO: 7469824 - DNA, 22 bp, Homo sapiens
cagacaaagcggaaactgttta

SEQ ID NO: 7469825 - DNA, 22 bp, Homo sapiens
cagacaaagcggaaactgttta

SEQ ID NO: 7469826 - DNA, 22 bp, Homo sapiens
cagaatttttcactcaatcttc

SEQ ID NO: 7469827 - DNA, 22 bp, Homo sapiens
cagaatttttcgaatgtactgt

SEQ ID NO: 7469828 - DNA, 22 bp, Homo sapiens
cagacaaagcggaaactgttta

SEQ ID NO: 7469829 - DNA, 22 bp, Homo sapiens
cagacaaagcggaaactgttta

SEQ ID NO: 7469830 - DNA, 22 bp, Homo sapiens
cagacaaagcggaaactgttta

SEQ ID NO: 7469831 - DNA, 22 bp, Homo sapiens
cagaatttttcgaatgtactgt

SEQ ID NO: 7469832 - DNA, 22 bp, Homo sapiens
cagaatttcccacactgggact

SEQ ID NO: 7469833 - DNA, 22 bp, Homo sapiens
cagaatttcccacactgggact

SEQ ID NO: 7469834 - DNA, 22 bp, Homo sapiens
cagaatttgaagtaatattcca

SEQ ID NO: 7469835 - DNA, 22 bp, Homo sapiens
cagaatttcagtgatgttttct

SEQ ID NO: 7469836 - DNA, 22 bp, Homo sapiens
cagaatttcagtgatgttttct

SEQ ID NO: 7469837 - DNA, 22 bp, Homo sapiens
cagaatttttcactcaatcttc

SEQ ID NO: 7469838 - DNA, 22 bp, Homo sapiens
cagaatttttcactcaatcttc

SEQ ID NO: 7469839 - DNA, 22 bp, Homo sapiens
cagaatttgaagtaatattcca

SEQ ID NO: 7469840 - DNA, 22 bp, Homo sapiens
cagaatttgaagtaatattcca

SEQ ID NO: 7469841 - DNA, 22 bp, Homo sapiens
cagaatttgaagtaatattcca

SEQ ID NO: 7469842 - DNA, 22 bp, Homo sapiens
cagaatttagcacaatgtatgg

SEQ ID NO: 7469843 - DNA, 22 bp, Homo sapiens
cagaatttagaaaacaacataa

SEQ ID NO: 7469844 - DNA, 22 bp, Homo sapiens
cagaatttagaaaacaacataa

SEQ ID NO: 7469845 - DNA, 22 bp, Homo sapiens
cagaatttagaaaacaacataa

SEQ ID NO: 7469846 - DNA, 22 bp, Homo sapiens
cagaatttagaaaacaacataa

SEQ ID NO: 7469847 - DNA, 22 bp, Homo sapiens
cagaatttagaaaacaacataa

SEQ ID NO: 7469848 - DNA, 22 bp, Homo sapiens
cagaatttagcacaatgtatgg

SEQ ID NO: 7469849 - DNA, 22 bp, Homo sapiens
cagaatttagcacaatgtatgg

SEQ ID NO: 7469850 - DNA, 22 bp, Homo sapiens
cagaatttagcacaatgtatgg

SEQ ID NO: 7469851 - DNA, 22 bp, Homo sapiens
cagaatttagcacaatgtatgg

SEQ ID NO: 7469852 - DNA, 22 bp, Homo sapiens
cagaatttcagtgatgttttct

SEQ ID NO: 7469853 - DNA, 22 bp, Homo sapiens
cagaaaatagagtttctctgag

SEQ ID NO: 7469854 - DNA, 22 bp, Homo sapiens
cagaaaatagagtttctctgag

SEQ ID NO: 7469855 - DNA, 22 bp, Homo sapiens
cagaaaatagagtttctctgag

SEQ ID NO: 7469856 - DNA, 22 bp, Homo sapiens
cagaaaatagagtttctctgag

SEQ ID NO: 7469857 - DNA, 22 bp, Homo sapiens
ggctggcactgaggagagctct

SEQ ID NO: 7469858 - DNA, 22 bp, Homo sapiens
cagaaaataaagtttctacgca

SEQ ID NO: 7469859 - DNA, 22 bp, Homo sapiens
cagaaaatagagtttctctgag

SEQ ID NO: 7469860 - DNA, 22 bp, Homo sapiens
cagaaaatagagtttctctgag

SEQ ID NO: 7469861 - DNA, 22 bp, Homo sapiens
cagaaaatagagtttctctgag

SEQ ID NO: 7469862 - DNA, 22 bp, Homo sapiens
cagaaaatagagtttctctgag

SEQ ID NO: 7469863 - DNA, 22 bp, Homo sapiens
cagaaaatagagtttctctgag

SEQ ID NO: 7469864 - DNA, 22 bp, Homo sapiens
ggctggcactgaggagagctct

SEQ ID NO: 7469865 - DNA, 22 bp, Homo sapiens
ggctggcagaagtgtgctggct

SEQ ID NO: 7469866 - DNA, 22 bp, Homo sapiens
ggctggcactgaggagagctct

SEQ ID NO: 7469867 - DNA, 22 bp, Homo sapiens
ggctggcactgaggagagctct

SEQ ID NO: 7469868 - DNA, 22 bp, Homo sapiens
ggctggcactgaggagagctct

SEQ ID NO: 7469869 - DNA, 22 bp, Homo sapiens
ggctggcactgaggagagctct

SEQ ID NO: 7469870 - DNA, 22 bp, Homo sapiens
ggctggcactgaggagagctct

SEQ ID NO: 7469871 - DNA, 22 bp, Homo sapiens
cagaaacacttgtagagaagtt

SEQ ID NO: 7469872 - DNA, 22 bp, Homo sapiens
cagaaacacttgtagagaagtt

SEQ ID NO: 7469873 - DNA, 22 bp, Homo sapiens
cagaaacacttgtagagaagtt

SEQ ID NO: 7469874 - DNA, 22 bp, Homo sapiens
cagaaacacttgtagagaagtt

SEQ ID NO: 7469875 - DNA, 22 bp, Homo sapiens
cagaaacacttgtagagaagtt

SEQ ID NO: 7469876 - DNA, 22 bp, Homo sapiens
cagaaacacttgtagagaagtt

SEQ ID NO: 7469877 - DNA, 22 bp, Homo sapiens
cagaaacacttgtagagaagtt

SEQ ID NO: 7469878 - DNA, 22 bp, Homo sapiens
cagaaacacttgtagagaagtt

SEQ ID NO: 7469879 - DNA, 22 bp, Homo sapiens
cagaaacacttgtagagaagtt

SEQ ID NO: 7469880 - DNA, 22 bp, Homo sapiens
cagaaacacttgtagagaagtt

SEQ ID NO: 7469881 - DNA, 22 bp, Homo sapiens
cagaaacacttgtagagaagtt

SEQ ID NO: 7469882 - DNA, 22 bp, Homo sapiens
cagaaacacttgtagagaagtt

SEQ ID NO: 7469883 - DNA, 22 bp, Homo sapiens
cagaaacactgtatttagggaa

SEQ ID NO: 7469884 - DNA, 22 bp, Homo sapiens
cagaaacactgtatttagggaa

SEQ ID NO: 7469885 - DNA, 22 bp, Homo sapiens
cagaaacactgtatttagggaa

SEQ ID NO: 7469886 - DNA, 22 bp, Homo sapiens
cagaaacactgtatttagggaa

SEQ ID NO: 7469887 - DNA, 22 bp, Homo sapiens
cagaaacactgtatttagggaa

SEQ ID NO: 7469888 - DNA, 22 bp, Homo sapiens
cagaaacactgtatttagggaa

SEQ ID NO: 7469889 - DNA, 22 bp, Homo sapiens
cagaaacactgtatttagggaa

SEQ ID NO: 7469890 - DNA, 22 bp, Homo sapiens
cagaaaatagagtttctctgag

SEQ ID NO: 7469891 - DNA, 22 bp, Homo sapiens
cagaaaatagagtttctctgag

SEQ ID NO: 7469892 - DNA, 22 bp, Homo sapiens
ggctggcacaaagctccaaatc

SEQ ID NO: 7469893 - DNA, 22 bp, Homo sapiens
ggctggcacagagggctggtgt

SEQ ID NO: 7469894 - DNA, 22 bp, Homo sapiens
ggctggcaagtgtctgctcatg

SEQ ID NO: 7469895 - DNA, 22 bp, Homo sapiens
ggctggcaagtgtctgctcatg

SEQ ID NO: 7469896 - DNA, 22 bp, Homo sapiens
ggctggcacagagggctggtgt

SEQ ID NO: 7469897 - DNA, 22 bp, Homo sapiens
ggctggcacccttggggatagg

SEQ ID NO: 7469898 - DNA, 22 bp, Homo sapiens
ggctggcacagagggctggtgt

SEQ ID NO: 7469899 - DNA, 22 bp, Homo sapiens
ggctggcacagagggctggtgt

SEQ ID NO: 7469900 - DNA, 22 bp, Homo sapiens
ggctggcaagtgtctgctcatg

SEQ ID NO: 7469901 - DNA, 22 bp, Homo sapiens
ggctggcaagtgtctgctcatg

SEQ ID NO: 7469902 - DNA, 19 bp, Homo sapiens
ggctggcaagtgacagtgt

SEQ ID NO: 7469903 - DNA, 22 bp, Homo sapiens
ggctggcaagtcagtgctgatg

SEQ ID NO: 7469904 - DNA, 19 bp, Homo sapiens
ggctggcaagtgacagtgt

SEQ ID NO: 7469905 - DNA, 19 bp, Homo sapiens
ggctggcaagtgacagtgt

SEQ ID NO: 7469906 - DNA, 19 bp, Homo sapiens
ggctggcaagtgacagtgt

SEQ ID NO: 7469907 - DNA, 22 bp, Homo sapiens
ggctggcactctgtccagtgtc

SEQ ID NO: 7469908 - DNA, 22 bp, Homo sapiens
ggctggcactctgtccagtgtc

SEQ ID NO: 7469909 - DNA, 22 bp, Homo sapiens
ggctggcacgaagccctgctgg

SEQ ID NO: 7469910 - DNA, 22 bp, Homo sapiens
ggctggcactctgtccagtgtc

SEQ ID NO: 7469911 - DNA, 22 bp, Homo sapiens
ggctggcactctgtccagtgtc

SEQ ID NO: 7469912 - DNA, 22 bp, Homo sapiens
ggctggcacgaagccctgctgg

SEQ ID NO: 7469913 - DNA, 22 bp, Homo sapiens
ggctggcacgaagccctgctgg

SEQ ID NO: 7469914 - DNA, 22 bp, Homo sapiens
ggctggcactctgtccagtgtc

SEQ ID NO: 7469915 - DNA, 22 bp, Homo sapiens
ggctggcacgaagccctgctgg

SEQ ID NO: 7469916 - DNA, 22 bp, Homo sapiens
ggctggcacgaagccctgctgg

SEQ ID NO: 7469917 - DNA, 22 bp, Homo sapiens
ggctggcacctgccctccgctg

SEQ ID NO: 7469918 - DNA, 22 bp, Homo sapiens
ggctggcacctgccctccgctg

SEQ ID NO: 7469919 - DNA, 22 bp, Homo sapiens
ggctggcacgaagccctgctgg

SEQ ID NO: 7469920 - DNA, 22 bp, Homo sapiens
ggctggcacctgccctccgctg

SEQ ID NO: 7469921 - DNA, 22 bp, Homo sapiens
ggctggcacgaagccctgctgg

SEQ ID NO: 7469922 - DNA, 22 bp, Homo sapiens
ggctggcacgaagccctgctgg

SEQ ID NO: 7469923 - DNA, 22 bp, Homo sapiens
ggctggcacagagggctggtgt

SEQ ID NO: 7469924 - DNA, 22 bp, Homo sapiens
ggctggcacccttggggatagg

SEQ ID NO: 7469925 - DNA, 22 bp, Homo sapiens
ggctggcacccttggggatagg

SEQ ID NO: 7469926 - DNA, 22 bp, Homo sapiens
ggctggcacctgccctccgctg

SEQ ID NO: 7469927 - DNA, 22 bp, Homo sapiens
ggctggcacctgccctccgctg

SEQ ID NO: 7469928 - DNA, 22 bp, Homo sapiens
ggctggcacctgccctccgctg

SEQ ID NO: 7469929 - DNA, 22 bp, Homo sapiens
caatttccttcatagatgactg

SEQ ID NO: 7469930 - DNA, 22 bp, Homo sapiens
caatttccttcatagatgactg

SEQ ID NO: 7469931 - DNA, 22 bp, Homo sapiens
caatttccttcatagatgactg

SEQ ID NO: 7469932 - DNA, 22 bp, Homo sapiens
caatttctaacattccatggat

SEQ ID NO: 7469933 - DNA, 22 bp, Homo sapiens
ggaagagcctggggtgtcaggc

SEQ ID NO: 7469934 - DNA, 22 bp, Homo sapiens
ggaagagcctggggtgtcaggc

SEQ ID NO: 7469935 - DNA, 22 bp, Homo sapiens
caatttcattaatagatataga

SEQ ID NO: 7469936 - DNA, 22 bp, Homo sapiens
caatttcattaatagatataga

SEQ ID NO: 7469937 - DNA, 22 bp, Homo sapiens
caatttcattaatagatataga

SEQ ID NO: 7469938 - DNA, 22 bp, Homo sapiens
caatttcattaatagatataga

SEQ ID NO: 7469939 - DNA, 22 bp, Homo sapiens
caatttcattaatagatataga

SEQ ID NO: 7469940 - DNA, 22 bp, Homo sapiens
caatttcatggataaaagatgt

SEQ ID NO: 7469941 - DNA, 21 bp, Homo sapiens
caatttcatgggaagatggga

SEQ ID NO: 7469942 - DNA, 21 bp, Homo sapiens
caatttcatgggaagatggga

SEQ ID NO: 7469943 - DNA, 22 bp, Homo sapiens
caatttcatggataaaagatgt

SEQ ID NO: 7469944 - DNA, 22 bp, Homo sapiens
caatttcatgccatgtattgct

SEQ ID NO: 7469945 - DNA, 22 bp, Homo sapiens
caatttcatgccatgtattgct

SEQ ID NO: 7469946 - DNA, 22 bp, Homo sapiens
caatttcatgccatgtattgct

SEQ ID NO: 7469947 - DNA, 22 bp, Homo sapiens
caatttcatcttgtgcttcaat

SEQ ID NO: 7469948 - DNA, 22 bp, Homo sapiens
caatttcatcttgtgcttcaat

SEQ ID NO: 7469949 - DNA, 22 bp, Homo sapiens
caatttcatcttgtgcttcaat

SEQ ID NO: 7469950 - DNA, 18 bp, Homo sapiens
caatttcatccttaagcc

SEQ ID NO: 7469951 - DNA, 20 bp, Homo sapiens
caatttcatcatttcctgtg

SEQ ID NO: 7469952 - DNA, 18 bp, Homo sapiens
caatttcatccttaagcc

SEQ ID NO: 7469953 - DNA, 20 bp, Homo sapiens
caatttcatcatttcctgtg

SEQ ID NO: 7469954 - DNA, 18 bp, Homo sapiens
caatttcatccttaagcc

SEQ ID NO: 7469955 - DNA, 22 bp, Homo sapiens
caatttcaatacaaaatacatt

SEQ ID NO: 7469956 - DNA, 22 bp, Homo sapiens
caatttcaatacaaaatacatt

SEQ ID NO: 7469957 - DNA, 22 bp, Homo sapiens
caatttcaatacaaaatacatt

SEQ ID NO: 7469958 - DNA, 22 bp, Homo sapiens
caatttcaatacaaaatacatt

SEQ ID NO: 7469959 - DNA, 22 bp, Homo sapiens
caatttcaatacaaaatacatt

SEQ ID NO: 7469960 - DNA, 22 bp, Homo sapiens
caatttcaatacaaaatacatt

SEQ ID NO: 7469961 - DNA, 22 bp, Homo sapiens
caatttcactaataatatttac

SEQ ID NO: 7469962 - DNA, 22 bp, Homo sapiens
caatttcaatgaggccacaggg

SEQ ID NO: 7469963 - DNA, 18 bp, Homo sapiens
caatttcaatggtctgaa

SEQ ID NO: 7469964 - DNA, 22 bp, Homo sapiens
caatttcactaataatatttac

SEQ ID NO: 7469965 - DNA, 22 bp, Homo sapiens
caatttcagacctttccttgga

SEQ ID NO: 7469966 - DNA, 22 bp, Homo sapiens
caatttcactaataatatttac

SEQ ID NO: 7469967 - DNA, 22 bp, Homo sapiens
caatttcaggtggataggtttt

SEQ ID NO: 7469968 - DNA, 22 bp, Homo sapiens
caatttcaggtggataggtttt

SEQ ID NO: 7469969 - DNA, 23 bp, Homo sapiens
caatttcatatgattctacctaa

SEQ ID NO: 7469970 - DNA, 22 bp, Homo sapiens
caatttcagtctcagagagttc

SEQ ID NO: 7469971 - DNA, 22 bp, Homo sapiens
caatttcagtctcagagagttc

SEQ ID NO: 7469972 - DNA, 22 bp, Homo sapiens
caattcatgttaaacagaagca

SEQ ID NO: 7469973 - DNA, 22 bp, Homo sapiens
caatgttttgttgaatgaatag

SEQ ID NO: 7469974 - DNA, 22 bp, Homo sapiens
caatgttttgttgaatgaatag

SEQ ID NO: 7469975 - DNA, 22 bp, Homo sapiens
caatgttttgttgaatgaatag

SEQ ID NO: 7469976 - DNA, 22 bp, Homo sapiens
caatgttttgttgaatgaatag

SEQ ID NO: 7469977 - DNA, 22 bp, Homo sapiens
caatccatcaattacacaggct

SEQ ID NO: 7469978 - DNA, 21 bp, Homo sapiens
caatcagttggcatttgagca

SEQ ID NO: 7469979 - DNA, 21 bp, Homo sapiens
caatcagttggcatttgagca

SEQ ID NO: 7469980 - DNA, 22 bp, Homo sapiens
caatattcagtggaaaagccat

SEQ ID NO: 7469981 - DNA, 22 bp, Homo sapiens
caatcaatgctgctagttcctt

SEQ ID NO: 7469982 - DNA, 22 bp, Homo sapiens
caatatgcaagctattaagtat

SEQ ID NO: 7469983 - DNA, 22 bp, Homo sapiens
caatatcaggtccgcgtaagtc

SEQ ID NO: 7469984 - DNA, 19 bp, Homo sapiens
caatatatagtgagtggat

SEQ ID NO: 7469985 - DNA, 22 bp, Homo sapiens
caatcacaaagagacaagtgtc

SEQ ID NO: 7469986 - DNA, 22 bp, Homo sapiens
caatcacaaagagacaagtgtc

SEQ ID NO: 7469987 - DNA, 22 bp, Homo sapiens
caatcacaaagagacaagtgtc

SEQ ID NO: 7469988 - DNA, 22 bp, Homo sapiens
caatcacaaagagacaagtgtc

SEQ ID NO: 7469989 - DNA, 22 bp, Homo sapiens
caatcacaaagagacaagtgtc

SEQ ID NO: 7469990 - DNA, 22 bp, Homo sapiens
caatcactgggatattggtgtg

SEQ ID NO: 7469991 - DNA, 22 bp, Homo sapiens
caatcactgacctgcagatgca

SEQ ID NO: 7469992 - DNA, 22 bp, Homo sapiens
caatcacaaagagacaagtgtc

SEQ ID NO: 7469993 - DNA, 22 bp, Homo sapiens
caatcactccacaatatggttc

SEQ ID NO: 7469994 - DNA, 22 bp, Homo sapiens
caatcactctgcaacattcctg

SEQ ID NO: 7469995 - DNA, 22 bp, Homo sapiens
caatcactctgcaacattcctg

SEQ ID NO: 7469996 - DNA, 22 bp, Homo sapiens
caatcagatatgtgacatattt

SEQ ID NO: 7469997 - DNA, 21 bp, Homo sapiens
caatcacttttgcaccaagct

SEQ ID NO: 7469998 - DNA, 22 bp, Homo sapiens
caatcacaaagagacaagtgtc

SEQ ID NO: 7469999 - DNA, 22 bp, Homo sapiens
caatcagatatgtgacatattt

SEQ ID NO: 7470000 - DNA, 22 bp, Homo sapiens
caatcaggagaaagagcgtgtg

SEQ ID NO: 7470001 - DNA, 22 bp, Homo sapiens
caattgacaatgacagtgtcaa

SEQ ID NO: 7470002 - DNA, 22 bp, Homo sapiens
caattgcaatagagaaaagagt

SEQ ID NO: 7470003 - DNA, 22 bp, Homo sapiens
caattgacaatgacagtgtcaa

SEQ ID NO: 7470004 - DNA, 22 bp, Homo sapiens
caattgctttcttaccaagaga

SEQ ID NO: 7470005 - DNA, 22 bp, Homo sapiens
caattctttgtagaagctctcc

SEQ ID NO: 7470006 - DNA, 22 bp, Homo sapiens
caattgaacagatgagttaaat

SEQ ID NO: 7470007 - DNA, 22 bp, Homo sapiens
caattgaacagatgagttaaat

SEQ ID NO: 7470008 - DNA, 22 bp, Homo sapiens
caattgaacagatgagttaaat

SEQ ID NO: 7470009 - DNA, 22 bp, Homo sapiens
caattgtcagtgctgtttaaat

SEQ ID NO: 7470010 - DNA, 22 bp, Homo sapiens
caattgtattactgagcttata

SEQ ID NO: 7470011 - DNA, 22 bp, Homo sapiens
caattgtcgttgacatccttca

SEQ ID NO: 7470012 - DNA, 22 bp, Homo sapiens
caattgtcagtgctgtttaaat

SEQ ID NO: 7470013 - DNA, 22 bp, Homo sapiens
caattgtattactgagcttata

SEQ ID NO: 7470014 - DNA, 23 bp, Homo sapiens
caattgtataaagcaaatggttt

SEQ ID NO: 7470015 - DNA, 22 bp, Homo sapiens
caattgtatgtgagaaataaat

SEQ ID NO: 7470016 - DNA, 22 bp, Homo sapiens
caattgtatgtgagaaataaat

SEQ ID NO: 7470017 - DNA, 23 bp, Homo sapiens
caattgtataaagcaaatggttt

SEQ ID NO: 7470018 - DNA, 23 bp, Homo sapiens
caattgtataaagcaaatggttt

SEQ ID NO: 7470019 - DNA, 22 bp, Homo sapiens
caatttcaagattctgttcttt

SEQ ID NO: 7470020 - DNA, 22 bp, Homo sapiens
caattgtgaagacaacagctta

SEQ ID NO: 7470021 - DNA, 22 bp, Homo sapiens
caatttcaagattctgttcttt

SEQ ID NO: 7470022 - DNA, 22 bp, Homo sapiens
caatttcaatacaaaatacatt

SEQ ID NO: 7470023 - DNA, 22 bp, Homo sapiens
caatttcaagattctgttcttt

SEQ ID NO: 7470024 - DNA, 22 bp, Homo sapiens
caattcccagctgccgggctgc

SEQ ID NO: 7470025 - DNA, 22 bp, Homo sapiens
caattcccagctgccgggctgc

SEQ ID NO: 7470026 - DNA, 22 bp, Homo sapiens
caattcccagctgccgggctgc

SEQ ID NO: 7470027 - DNA, 22 bp, Homo sapiens
caattcattacattgcaaagac

SEQ ID NO: 7470028 - DNA, 22 bp, Homo sapiens
caattcatgttaaacagaagca

SEQ ID NO: 7470029 - DNA, 19 bp, Homo sapiens
caattctgcaacactgtcc

SEQ ID NO: 7470030 - DNA, 19 bp, Homo sapiens
caattctattatcattcca

SEQ ID NO: 7470031 - DNA, 19 bp, Homo sapiens
caattctattatcattcca

SEQ ID NO: 7470032 - DNA, 22 bp, Homo sapiens
caattcctctggttgcaaagct

SEQ ID NO: 7470033 - DNA, 22 bp, Homo sapiens
caattcctctggttgcaaagct

SEQ ID NO: 7470034 - DNA, 22 bp, Homo sapiens
caattcctctggttgcaaagct

SEQ ID NO: 7470035 - DNA, 22 bp, Homo sapiens
caattctttcagctgcatttgt

SEQ ID NO: 7470036 - DNA, 22 bp, Homo sapiens
caattctttcagctgcatttgt

SEQ ID NO: 7470037 - DNA, 22 bp, Homo sapiens
caattctttcagctgcatttgt

SEQ ID NO: 7470038 - DNA, 22 bp, Homo sapiens
caattctttcagctgcatttgt

SEQ ID NO: 7470039 - DNA, 22 bp, Homo sapiens
caattctttcagctgcatttgt

SEQ ID NO: 7470040 - DNA, 22 bp, Homo sapiens
caattctttgtagaagctctcc

SEQ ID NO: 7470041 - DNA, 22 bp, Homo sapiens
caattcttcctgttggatatgc

SEQ ID NO: 7470042 - DNA, 22 bp, Homo sapiens
caattcttcctgttggatatgc

SEQ ID NO: 7470043 - DNA, 22 bp, Homo sapiens
caattcttggagaagaagcata

SEQ ID NO: 7470044 - DNA, 19 bp, Homo sapiens
caattctgcaacactgtcc

SEQ ID NO: 7470045 - DNA, 19 bp, Homo sapiens
caattctgcaacactgtcc

SEQ ID NO: 7470046 - DNA, 22 bp, Homo sapiens
caatagtgtctgcttgtttcta

SEQ ID NO: 7470047 - DNA, 22 bp, Homo sapiens
caatagtatttattgaacacct

SEQ ID NO: 7470048 - DNA, 22 bp, Homo sapiens
caatagtgtctgcttgtttcta

SEQ ID NO: 7470049 - DNA, 22 bp, Homo sapiens
caatagtgtctgcttgtttcta

SEQ ID NO: 7470050 - DNA, 22 bp, Homo sapiens
caatagtgtctgcttgtttcta

SEQ ID NO: 7470051 - DNA, 22 bp, Homo sapiens
caatagttcggtcctgaaggcc

SEQ ID NO: 7470052 - DNA, 22 bp, Homo sapiens
caatatataatgagtactttcc

SEQ ID NO: 7470053 - DNA, 22 bp, Homo sapiens
caatatataatgagtactttcc

SEQ ID NO: 7470054 - DNA, 22 bp, Homo sapiens
caatatagagagaaaattatgt

SEQ ID NO: 7470055 - DNA, 22 bp, Homo sapiens
caatagtaaattacggaggaga

SEQ ID NO: 7470056 - DNA, 22 bp, Homo sapiens
caatagtatttattgaacacct

SEQ ID NO: 7470057 - DNA, 22 bp, Homo sapiens
caatagtaaattacggaggaga

SEQ ID NO: 7470058 - DNA, 22 bp, Homo sapiens
caatagcaggtctacagagaga

SEQ ID NO: 7470059 - DNA, 22 bp, Homo sapiens
caatagctatgtaacctgaaga

SEQ ID NO: 7470060 - DNA, 22 bp, Homo sapiens
caatagcaggtctacagagaga

SEQ ID NO: 7470061 - DNA, 22 bp, Homo sapiens
caatatataggaacaacttagg

SEQ ID NO: 7470062 - DNA, 22 bp, Homo sapiens
caatatataggaacaacttagg

SEQ ID NO: 7470063 - DNA, 22 bp, Homo sapiens
caatatataggaacaacttagg

SEQ ID NO: 7470064 - DNA, 22 bp, Homo sapiens
caatatataggaacaacttagg

SEQ ID NO: 7470065 - DNA, 22 bp, Homo sapiens
caatagtaaattacggaggaga

SEQ ID NO: 7470066 - DNA, 22 bp, Homo sapiens
caatatataatgagtactttcc

SEQ ID NO: 7470067 - DNA, 22 bp, Homo sapiens
caatatataatgagtactttcc

SEQ ID NO: 7470068 - DNA, 22 bp, Homo sapiens
caatatataatgagtactttcc

SEQ ID NO: 7470069 - DNA, 22 bp, Homo sapiens
caatatataggaacaacttagg

SEQ ID NO: 7470070 - DNA, 22 bp, Homo sapiens
caatatataggaacaacttagg

SEQ ID NO: 7470071 - DNA, 19 bp, Homo sapiens
caatatatagtgagtggat

SEQ ID NO: 7470072 - DNA, 19 bp, Homo sapiens
caatatatagtgagtggat

SEQ ID NO: 7470073 - DNA, 19 bp, Homo sapiens
caatatatagtgagtggat

SEQ ID NO: 7470074 - DNA, 22 bp, Homo sapiens
caatatataggaacaacttagg

SEQ ID NO: 7470075 - DNA, 22 bp, Homo sapiens
caatagaaaactcaatacttaa

SEQ ID NO: 7470076 - DNA, 22 bp, Homo sapiens
caatagaaaactcaatacttaa

SEQ ID NO: 7470077 - DNA, 22 bp, Homo sapiens
caatactttagtaaaatggccc

SEQ ID NO: 7470078 - DNA, 22 bp, Homo sapiens
caatacttccttgttagaggca

SEQ ID NO: 7470079 - DNA, 22 bp, Homo sapiens
caatagaaaactcaatacttaa

SEQ ID NO: 7470080 - DNA, 22 bp, Homo sapiens
caatagaaaactcaatacttaa

SEQ ID NO: 7470081 - DNA, 22 bp, Homo sapiens
caatagaaaactcaatacttaa

SEQ ID NO: 7470082 - DNA, 18 bp, Homo sapiens
caatagaaacagtaggaa

SEQ ID NO: 7470083 - DNA, 22 bp, Homo sapiens
caatagaaggcacagataggta

SEQ ID NO: 7470084 - DNA, 18 bp, Homo sapiens
caatagaaacagtaggaa

SEQ ID NO: 7470085 - DNA, 18 bp, Homo sapiens
caatagaaacagtaggaa

SEQ ID NO: 7470086 - DNA, 18 bp, Homo sapiens
caatagaaacagtaggaa

SEQ ID NO: 7470087 - DNA, 18 bp, Homo sapiens
caatagaaacagtaggaa

SEQ ID NO: 7470088 - DNA, 22 bp, Homo sapiens
caatagaaaactcaatacttaa

SEQ ID NO: 7470089 - DNA, 22 bp, Homo sapiens
caatagaaggcacagataggta

SEQ ID NO: 7470090 - DNA, 22 bp, Homo sapiens
caatagaaggcacagataggta

SEQ ID NO: 7470091 - DNA, 22 bp, Homo sapiens
caatagaaggcacagataggta

SEQ ID NO: 7470092 - DNA, 22 bp, Homo sapiens
caatagaaggcacagataggta

SEQ ID NO: 7470093 - DNA, 20 bp, Homo sapiens
caatagaatgtggagataag

SEQ ID NO: 7470094 - DNA, 20 bp, Homo sapiens
caatagaatgtggagataag

SEQ ID NO: 7470095 - DNA, 20 bp, Homo sapiens
caatagaatgtggagataag

SEQ ID NO: 7470096 - DNA, 20 bp, Homo sapiens
caatagaatgtggagataag

SEQ ID NO: 7470097 - DNA, 20 bp, Homo sapiens
caatagaatgtggagataag

SEQ ID NO: 7470098 - DNA, 20 bp, Homo sapiens
caatagaatgtggagataag

SEQ ID NO: 7470099 - DNA, 22 bp, Homo sapiens
caatagcagacctagaaagcaa

SEQ ID NO: 7470100 - DNA, 22 bp, Homo sapiens
caatagcagacctagaaagcaa

SEQ ID NO: 7470101 - DNA, 22 bp, Homo sapiens
caatagcagacctagaaagcaa

SEQ ID NO: 7470102 - DNA, 22 bp, Homo sapiens
caatagagacctggattctccc

SEQ ID NO: 7470103 - DNA, 22 bp, Homo sapiens
caatagataactgagatagact

SEQ ID NO: 7470104 - DNA, 22 bp, Homo sapiens
caatagcagacctagaaagcaa

SEQ ID NO: 7470105 - DNA, 22 bp, Homo sapiens
caatagcagacctagaaagcaa

SEQ ID NO: 7470106 - DNA, 22 bp, Homo sapiens
caatagcagcttctgaatgcaa

SEQ ID NO: 7470107 - DNA, 22 bp, Homo sapiens
caatagcagcttctgaatgcaa

SEQ ID NO: 7470108 - DNA, 22 bp, Homo sapiens
caatagcagcttctgaatgcaa

SEQ ID NO: 7470109 - DNA, 22 bp, Homo sapiens
caatagcaggtctacagagaga

SEQ ID NO: 7470110 - DNA, 22 bp, Homo sapiens
caatagcaggtctacagagaga

SEQ ID NO: 7470111 - DNA, 22 bp, Homo sapiens
caataaggtgaggctcaaggga

SEQ ID NO: 7470112 - DNA, 22 bp, Homo sapiens
caataaggatttgtggaccaca

SEQ ID NO: 7470113 - DNA, 22 bp, Homo sapiens
caataaggtgaggctcaaggga

SEQ ID NO: 7470114 - DNA, 22 bp, Homo sapiens
caataaggatttgtggaccaca

SEQ ID NO: 7470115 - DNA, 22 bp, Homo sapiens
caataagccaggtgtttgtgtt

SEQ ID NO: 7470116 - DNA, 22 bp, Homo sapiens
caataaggttttgactattgag

SEQ ID NO: 7470117 - DNA, 22 bp, Homo sapiens
caataagtaataggcatctaat

SEQ ID NO: 7470118 - DNA, 22 bp, Homo sapiens
caataagtaataggcatctaat

SEQ ID NO: 7470119 - DNA, 22 bp, Homo sapiens
caatactgcatctttgcccttt

SEQ ID NO: 7470120 - DNA, 22 bp, Homo sapiens
caatactgcatctttgcccttt

SEQ ID NO: 7470121 - DNA, 22 bp, Homo sapiens
caatactgcatctttgcccttt

SEQ ID NO: 7470122 - DNA, 22 bp, Homo sapiens
caatactgggcaggagagtaca

SEQ ID NO: 7470123 - DNA, 22 bp, Homo sapiens
caatactgggcaggagagtaca

SEQ ID NO: 7470124 - DNA, 22 bp, Homo sapiens
caataaggttttgactattgag

SEQ ID NO: 7470125 - DNA, 22 bp, Homo sapiens
caaggcttatcagccaggagcc

SEQ ID NO: 7470126 - DNA, 22 bp, Homo sapiens
caaggcttatcagccaggagcc

SEQ ID NO: 7470127 - DNA, 22 bp, Homo sapiens
caataagatgtattgagcagag

SEQ ID NO: 7470128 - DNA, 21 bp, Homo sapiens
caaggcttaaacattaatcta

SEQ ID NO: 7470129 - DNA, 22 bp, Homo sapiens
caaggcttaggtggctccctgt

SEQ ID NO: 7470130 - DNA, 22 bp, Homo sapiens
caaggcttagtcagagggtgct

SEQ ID NO: 7470131 - DNA, 22 bp, Homo sapiens
caaggcttagtcagagggtgct

SEQ ID NO: 7470132 - DNA, 22 bp, Homo sapiens
caaggctgtgttagctgccctc

SEQ ID NO: 7470133 - DNA, 22 bp, Homo sapiens
caaggctgtgttagctgccctc

SEQ ID NO: 7470134 - DNA, 22 bp, Homo sapiens
caaggctgtgttagctgccctc

SEQ ID NO: 7470135 - DNA, 22 bp, Homo sapiens
caaggctgtctccagcttccaa

SEQ ID NO: 7470136 - DNA, 22 bp, Homo sapiens
caaggctgtctccagcttccaa

SEQ ID NO: 7470137 - DNA, 22 bp, Homo sapiens
caaggctgtctccagcttccaa

SEQ ID NO: 7470138 - DNA, 22 bp, Homo sapiens
caaggctgtctccagcttccaa

SEQ ID NO: 7470139 - DNA, 22 bp, Homo sapiens
caaggctgtctccagcttccaa

SEQ ID NO: 7470140 - DNA, 22 bp, Homo sapiens
caaggctgtgcagggtccatat

SEQ ID NO: 7470141 - DNA, 22 bp, Homo sapiens
caaggctgtgcagggtccatat

SEQ ID NO: 7470142 - DNA, 22 bp, Homo sapiens
caaggctgtgcagggtccatat

SEQ ID NO: 7470143 - DNA, 22 bp, Homo sapiens
caaggctgtgcagggtccatat

SEQ ID NO: 7470144 - DNA, 22 bp, Homo sapiens
caaggctggagtgtaatggcat

SEQ ID NO: 7470145 - DNA, 22 bp, Homo sapiens
caaggctggagtgtaatggcat

SEQ ID NO: 7470146 - DNA, 22 bp, Homo sapiens
caaggctggctcacaataatga

SEQ ID NO: 7470147 - DNA, 22 bp, Homo sapiens
caaggctggctcacaataatga

SEQ ID NO: 7470148 - DNA, 22 bp, Homo sapiens
caaggctgctggcttctgagct

SEQ ID NO: 7470149 - DNA, 22 bp, Homo sapiens
caaggctgcttcagactagtga

SEQ ID NO: 7470150 - DNA, 22 bp, Homo sapiens
caaggctgctggcttctgagct

SEQ ID NO: 7470151 - DNA, 22 bp, Homo sapiens
caaggctgctgcgggtcgcacc

SEQ ID NO: 7470152 - DNA, 22 bp, Homo sapiens
caaggctgctggcttctgagct

SEQ ID NO: 7470153 - DNA, 22 bp, Homo sapiens
caaggctgctggcttctgagct

SEQ ID NO: 7470154 - DNA, 22 bp, Homo sapiens
caaggctgcttcagactagtga

SEQ ID NO: 7470155 - DNA, 22 bp, Homo sapiens
caaggctgcttcagactagtga

SEQ ID NO: 7470156 - DNA, 22 bp, Homo sapiens
caaggctgctggcttctgagct

SEQ ID NO: 7470157 - DNA, 22 bp, Homo sapiens
caaggctgctgcgggtcgcacc

SEQ ID NO: 7470158 - DNA, 22 bp, Homo sapiens
caaggctgctgcgggtcgcacc

SEQ ID NO: 7470159 - DNA, 22 bp, Homo sapiens
caaggctgctgcgggtcgcacc

SEQ ID NO: 7470160 - DNA, 22 bp, Homo sapiens
caaggctgctgcgggtcgcacc

SEQ ID NO: 7470161 - DNA, 22 bp, Homo sapiens
caaggctgctgcgggtcgcacc

SEQ ID NO: 7470162 - DNA, 22 bp, Homo sapiens
caaggctgctgcgggtcgcacc

SEQ ID NO: 7470163 - DNA, 22 bp, Homo sapiens
caaggctgcactgttgccatag

SEQ ID NO: 7470164 - DNA, 22 bp, Homo sapiens
caaggctgctgcgggtcgcacc

SEQ ID NO: 7470165 - DNA, 22 bp, Homo sapiens
caaggctgcaaaactacatggg

SEQ ID NO: 7470166 - DNA, 22 bp, Homo sapiens
caaggctgcaaaactacatggg

SEQ ID NO: 7470167 - DNA, 22 bp, Homo sapiens
caaggctgcaaaactacatggg

SEQ ID NO: 7470168 - DNA, 22 bp, Homo sapiens
caaggctgcaaaactacatggg

SEQ ID NO: 7470169 - DNA, 22 bp, Homo sapiens
caaggctgatcattttcccata

SEQ ID NO: 7470170 - DNA, 22 bp, Homo sapiens
caaggctgagaaattctgccct

SEQ ID NO: 7470171 - DNA, 22 bp, Homo sapiens
caaggctctggaccaaatccca

SEQ ID NO: 7470172 - DNA, 22 bp, Homo sapiens
caaggctctgcttctatcacat

SEQ ID NO: 7470173 - DNA, 22 bp, Homo sapiens
caaggctctgcttctatcacat

SEQ ID NO: 7470174 - DNA, 22 bp, Homo sapiens
gctggggaggcagcagagaaca

SEQ ID NO: 7470175 - DNA, 22 bp, Homo sapiens
gctggggaggcagcagagaaca

SEQ ID NO: 7470176 - DNA, 22 bp, Homo sapiens
gctggggaggcagcagagaaca

SEQ ID NO: 7470177 - DNA, 22 bp, Homo sapiens
gctggggagctagacctcagca

SEQ ID NO: 7470178 - DNA, 22 bp, Homo sapiens
gctggggagctagacctcagca

SEQ ID NO: 7470179 - DNA, 22 bp, Homo sapiens
gctggggagctagacctcagca

SEQ ID NO: 7470180 - DNA, 22 bp, Homo sapiens
gctggggagctagacctcagca

SEQ ID NO: 7470181 - DNA, 22 bp, Homo sapiens
gctggggagctagacctcagca

SEQ ID NO: 7470182 - DNA, 22 bp, Homo sapiens
gctggggagcaagagtagtgag

SEQ ID NO: 7470183 - DNA, 22 bp, Homo sapiens
gctggggagctagacctcagca

SEQ ID NO: 7470184 - DNA, 22 bp, Homo sapiens
caaggctaagctttggctttct

SEQ ID NO: 7470185 - DNA, 22 bp, Homo sapiens
caaggctaagctttggctttct

SEQ ID NO: 7470186 - DNA, 22 bp, Homo sapiens
caaggctaagctttggctttct

SEQ ID NO: 7470187 - DNA, 22 bp, Homo sapiens
caaggctaccctttcaccaaaa

SEQ ID NO: 7470188 - DNA, 22 bp, Homo sapiens
caaggctagaagtccaacatca

SEQ ID NO: 7470189 - DNA, 22 bp, Homo sapiens
caaggctagcaagcagtagtca

SEQ ID NO: 7470190 - DNA, 22 bp, Homo sapiens
caaggctagcaagcagtagtca

SEQ ID NO: 7470191 - DNA, 22 bp, Homo sapiens
caaggctataatgttgctggaa

SEQ ID NO: 7470192 - DNA, 22 bp, Homo sapiens
caaggctataatgttgctggaa

SEQ ID NO: 7470193 - DNA, 22 bp, Homo sapiens
ggaagctggtaattgttgggac

SEQ ID NO: 7470194 - DNA, 22 bp, Homo sapiens
ggaagctggggagctttggaga

SEQ ID NO: 7470195 - DNA, 22 bp, Homo sapiens
ggaagctgtgctctcaggcctc

SEQ ID NO: 7470196 - DNA, 22 bp, Homo sapiens
ggaagctgtgctctcaggcctc

SEQ ID NO: 7470197 - DNA, 22 bp, Homo sapiens
ggaagctgtgctctcaggcctc

SEQ ID NO: 7470198 - DNA, 22 bp, Homo sapiens
ggaagctggacaggctttgagt

SEQ ID NO: 7470199 - DNA, 22 bp, Homo sapiens
ggaagctggcatatgtaatcct

SEQ ID NO: 7470200 - DNA, 22 bp, Homo sapiens
ggaagctggacaggctttgagt

SEQ ID NO: 7470201 - DNA, 22 bp, Homo sapiens
ggaagctgggatctctctcccg

SEQ ID NO: 7470202 - DNA, 22 bp, Homo sapiens
ggaagctggctcttataaatat

SEQ ID NO: 7470203 - DNA, 22 bp, Homo sapiens
ggaagctgggatctctctcccg

SEQ ID NO: 7470204 - DNA, 22 bp, Homo sapiens
ggaagctggcatatgtaatcct

SEQ ID NO: 7470205 - DNA, 22 bp, Homo sapiens
ggaagctggcatatgtaatcct

SEQ ID NO: 7470206 - DNA, 22 bp, Homo sapiens
cacaaatgactgaaacgactgt

SEQ ID NO: 7470207 - DNA, 22 bp, Homo sapiens
cacaaatgactgaaacgactgt

SEQ ID NO: 7470208 - DNA, 19 bp, Homo sapiens
cacaaatgatgaggacctg

SEQ ID NO: 7470209 - DNA, 22 bp, Homo sapiens
cacaaatgactgaaacgactgt

SEQ ID NO: 7470210 - DNA, 22 bp, Homo sapiens
cacaaatgactgaaacgactgt

SEQ ID NO: 7470211 - DNA, 22 bp, Homo sapiens
cacaaataccagtttcctaaca

SEQ ID NO: 7470212 - DNA, 22 bp, Homo sapiens
cacaaatgactgaaacgactgt

SEQ ID NO: 7470213 - DNA, 22 bp, Homo sapiens
cacaaatccaatttaattctgg

SEQ ID NO: 7470214 - DNA, 22 bp, Homo sapiens
cacaaataccagtttcctaaca

SEQ ID NO: 7470215 - DNA, 22 bp, Homo sapiens
cacaaataccagtttcctaaca

SEQ ID NO: 7470216 - DNA, 22 bp, Homo sapiens
cacaaataccagtttcctaaca

SEQ ID NO: 7470217 - DNA, 22 bp, Homo sapiens
cacaaataccagtttcctaaca

SEQ ID NO: 7470218 - DNA, 22 bp, Homo sapiens
cacaaataccagtttcctaaca

SEQ ID NO: 7470219 - DNA, 22 bp, Homo sapiens
cacaaataccagtttcctaaca

SEQ ID NO: 7470220 - DNA, 22 bp, Homo sapiens
cacaaataccagtttcctaaca

SEQ ID NO: 7470221 - DNA, 22 bp, Homo sapiens
cacaaataccagtttcctaaca

SEQ ID NO: 7470222 - DNA, 20 bp, Homo sapiens
ggaagctgtgggtccccagg

SEQ ID NO: 7470223 - DNA, 22 bp, Homo sapiens
cacaaataccagtttcctaaca

SEQ ID NO: 7470224 - DNA, 22 bp, Homo sapiens
cacaaataccagtttcctaaca

SEQ ID NO: 7470225 - DNA, 22 bp, Homo sapiens
cacaaataccagtttcctaaca

SEQ ID NO: 7470226 - DNA, 22 bp, Homo sapiens
ggaagctgaatccagagacagg

SEQ ID NO: 7470227 - DNA, 22 bp, Homo sapiens
ggaagctgaatccagagacagg

SEQ ID NO: 7470228 - DNA, 22 bp, Homo sapiens
ggaagctgaatccagagacagg

SEQ ID NO: 7470229 - DNA, 22 bp, Homo sapiens
ggaagctgaatccagagacagg

SEQ ID NO: 7470230 - DNA, 22 bp, Homo sapiens
ggaagctgaacttagcaaggaa

SEQ ID NO: 7470231 - DNA, 22 bp, Homo sapiens
ggaagctgaggcccagtgaagg

SEQ ID NO: 7470232 - DNA, 22 bp, Homo sapiens
ggaagctgaatccagagacagg

SEQ ID NO: 7470233 - DNA, 22 bp, Homo sapiens
ggaagctgaggcccagtgaagg

SEQ ID NO: 7470234 - DNA, 22 bp, Homo sapiens
ggaagctgaggcccagtgaagg

SEQ ID NO: 7470235 - DNA, 22 bp, Homo sapiens
ggaagctggacaggctttgagt

SEQ ID NO: 7470236 - DNA, 22 bp, Homo sapiens
ggaagctgcttagctaatgtag

SEQ ID NO: 7470237 - DNA, 22 bp, Homo sapiens
ggaagctgccagtccaccagct

SEQ ID NO: 7470238 - DNA, 22 bp, Homo sapiens
ggaagctgccagtccaccagct

SEQ ID NO: 7470239 - DNA, 22 bp, Homo sapiens
ggaagctgccagtccaccagct

SEQ ID NO: 7470240 - DNA, 22 bp, Homo sapiens
ggaagctgcataactagcgtgg

SEQ ID NO: 7470241 - DNA, 22 bp, Homo sapiens
ggaagctgaacttagcaaggaa

SEQ ID NO: 7470242 - DNA, 22 bp, Homo sapiens
ggaagctgaacttagcaaggaa

SEQ ID NO: 7470243 - DNA, 22 bp, Homo sapiens
ggaagctgaacttagcaaggaa

SEQ ID NO: 7470244 - DNA, 22 bp, Homo sapiens
ggaagctgaacttagcaaggaa

SEQ ID NO: 7470245 - DNA, 22 bp, Homo sapiens
ggaagctgaacttagcaaggaa

SEQ ID NO: 7470246 - DNA, 22 bp, Homo sapiens
ggaagctgaacttagcaaggaa

SEQ ID NO: 7470247 - DNA, 22 bp, Homo sapiens
ggaagctccccaagcctgccct

SEQ ID NO: 7470248 - DNA, 22 bp, Homo sapiens
ggaagctccccaagcctgccct

SEQ ID NO: 7470249 - DNA, 22 bp, Homo sapiens
ggaagcggccctgagcgcaggg

SEQ ID NO: 7470250 - DNA, 22 bp, Homo sapiens
ggaagctaagataatttaagta

SEQ ID NO: 7470251 - DNA, 22 bp, Homo sapiens
ggaagaggaggagccaggcttt

SEQ ID NO: 7470252 - DNA, 22 bp, Homo sapiens
ggaagaggaggagccaggcttt

SEQ ID NO: 7470253 - DNA, 22 bp, Homo sapiens
ggaagcggccctgagcgcaggg

SEQ ID NO: 7470254 - DNA, 22 bp, Homo sapiens
ggaagcggccctgagcgcaggg

SEQ ID NO: 7470255 - DNA, 23 bp, Homo sapiens
ggaagctcacgtagtcctgcact

SEQ ID NO: 7470256 - DNA, 22 bp, Homo sapiens
ggaagcctaaagcccaggtctc

SEQ ID NO: 7470257 - DNA, 22 bp, Homo sapiens
ggaagaggaggagccaggcttt

SEQ ID NO: 7470258 - DNA, 22 bp, Homo sapiens
cacaaatggttgtagacattaa

SEQ ID NO: 7470259 - DNA, 22 bp, Homo sapiens
cacaaatggttgtagacattaa

SEQ ID NO: 7470260 - DNA, 22 bp, Homo sapiens
cacaaatggttgtagacattaa

SEQ ID NO: 7470261 - DNA, 22 bp, Homo sapiens
cacaaatggttgtagacattaa

SEQ ID NO: 7470262 - DNA, 22 bp, Homo sapiens
cacaaatggccgtgttcaaaga

SEQ ID NO: 7470263 - DNA, 22 bp, Homo sapiens
cacaaatggccgtgttcaaaga

SEQ ID NO: 7470264 - DNA, 22 bp, Homo sapiens
cacaaatggccgtgttcaaaga

SEQ ID NO: 7470265 - DNA, 19 bp, Homo sapiens
cacaaatgatgaggacctg

SEQ ID NO: 7470266 - DNA, 19 bp, Homo sapiens
cacaaatgatgaggacctg

SEQ ID NO: 7470267 - DNA, 22 bp, Homo sapiens
cacaaatggccgtgttcaaaga

SEQ ID NO: 7470268 - DNA, 22 bp, Homo sapiens
cacaaatggccgtgttcaaaga

SEQ ID NO: 7470269 - DNA, 22 bp, Homo sapiens
cacaaatgtagtagcttaaaac

SEQ ID NO: 7470270 - DNA, 22 bp, Homo sapiens
cacaaatgtgcagaaatgtgag

SEQ ID NO: 7470271 - DNA, 22 bp, Homo sapiens
cacaaatgtgcagaaatgtgag

SEQ ID NO: 7470272 - DNA, 22 bp, Homo sapiens
cacaaatgtagtagcttaaaac

SEQ ID NO: 7470273 - DNA, 22 bp, Homo sapiens
cacaaatgtagtagcttaaaac

SEQ ID NO: 7470274 - DNA, 22 bp, Homo sapiens
cacaaatggttgtagacattaa

SEQ ID NO: 7470275 - DNA, 22 bp, Homo sapiens
cacaaatgtagtagcttaaaac

SEQ ID NO: 7470276 - DNA, 22 bp, Homo sapiens
cacaaatgtagtagcttaaaac

SEQ ID NO: 7470277 - DNA, 22 bp, Homo sapiens
cacaaatgtgcagaaatgtgag

SEQ ID NO: 7470278 - DNA, 22 bp, Homo sapiens
cacaaatgtgcagaaatgtgag

SEQ ID NO: 7470279 - DNA, 22 bp, Homo sapiens
cacaaatgtgcagaaatgtgag

SEQ ID NO: 7470280 - DNA, 22 bp, Homo sapiens
cacaaatgtgcagaaatgtgag

SEQ ID NO: 7470281 - DNA, 23 bp, Homo sapiens
cacaactaatcagaatctctagg

SEQ ID NO: 7470282 - DNA, 22 bp, Homo sapiens
cacaaccatgcacagctaattt

SEQ ID NO: 7470283 - DNA, 22 bp, Homo sapiens
cacaaccatgcacagctaattt

SEQ ID NO: 7470284 - DNA, 20 bp, Homo sapiens
ggacaggaagacaacctacc

SEQ ID NO: 7470285 - DNA, 20 bp, Homo sapiens
ggacaggaagacaacctacc

SEQ ID NO: 7470286 - DNA, 22 bp, Homo sapiens
cacaacttagcagcttgaaaca

SEQ ID NO: 7470287 - DNA, 20 bp, Homo sapiens
ggacaggaagacaacctacc

SEQ ID NO: 7470288 - DNA, 19 bp, Homo sapiens
cacaacttcgcttgattcc

SEQ ID NO: 7470289 - DNA, 19 bp, Homo sapiens
cacaacttcgcttgattcc

SEQ ID NO: 7470290 - DNA, 18 bp, Homo sapiens
ggacaggagacatgggtg

SEQ ID NO: 7470291 - DNA, 20 bp, Homo sapiens
ggacaggaagacaacctacc

SEQ ID NO: 7470292 - DNA, 18 bp, Homo sapiens
ggacaggagacatgggtg

SEQ ID NO: 7470293 - DNA, 18 bp, Homo sapiens
ggacaggagacatgggtg

SEQ ID NO: 7470294 - DNA, 18 bp, Homo sapiens
ggacaggagacatgggtg

SEQ ID NO: 7470295 - DNA, 22 bp, Homo sapiens
ggacatggaagtatggagtgga

SEQ ID NO: 7470296 - DNA, 22 bp, Homo sapiens
cacaacttagcagcttgaaaca

SEQ ID NO: 7470297 - DNA, 20 bp, Homo sapiens
cacaactgtccacatgctcc

SEQ ID NO: 7470298 - DNA, 17 bp, Homo sapiens
cacaactggctgattga

SEQ ID NO: 7470299 - DNA, 22 bp, Homo sapiens
cacaactgccatctgagcagca

SEQ ID NO: 7470300 - DNA, 17 bp, Homo sapiens
cacaactggctgattga

SEQ ID NO: 7470301 - DNA, 22 bp, Homo sapiens
cacaactgccatctgagcagca

SEQ ID NO: 7470302 - DNA, 22 bp, Homo sapiens
cacaactgccatctgagcagca

SEQ ID NO: 7470303 - DNA, 17 bp, Homo sapiens
cacaactgaaaccacta

SEQ ID NO: 7470304 - DNA, 17 bp, Homo sapiens
cacaactgaaaccacta

SEQ ID NO: 7470305 - DNA, 20 bp, Homo sapiens
cacaactgagaaccctatgg

SEQ ID NO: 7470306 - DNA, 20 bp, Homo sapiens
cacaactgagaaccctatgg

SEQ ID NO: 7470307 - DNA, 22 bp, Homo sapiens
cacaactgccagccaggaaagg

SEQ ID NO: 7470308 - DNA, 22 bp, Homo sapiens
ggaccacagcacttggcttgag

SEQ ID NO: 7470309 - DNA, 22 bp, Homo sapiens
ggaccacagcacttggcttgag

SEQ ID NO: 7470310 - DNA, 22 bp, Homo sapiens
ggaccagagaagtgagcacctg

SEQ ID NO: 7470311 - DNA, 18 bp, Homo sapiens
ggaccacatcaacttgaa

SEQ ID NO: 7470312 - DNA, 22 bp, Homo sapiens
ggaccagagaagtgagcacctg

SEQ ID NO: 7470313 - DNA, 22 bp, Homo sapiens
ggacatttttcttcctacaatg

SEQ ID NO: 7470314 - DNA, 22 bp, Homo sapiens
ggaccacaatatttgtgaggtt

SEQ ID NO: 7470315 - DNA, 22 bp, Homo sapiens
ggaccaaatgctttttaattga

SEQ ID NO: 7470316 - DNA, 19 bp, Homo sapiens
ggacatttgagttgtttat

SEQ ID NO: 7470317 - DNA, 19 bp, Homo sapiens
ggacatttgagttgtttat

SEQ ID NO: 7470318 - DNA, 22 bp, Homo sapiens
ggacatttgcacctacctcagc

SEQ ID NO: 7470319 - DNA, 22 bp, Homo sapiens
ggacatttcataagaccattct

SEQ ID NO: 7470320 - DNA, 22 bp, Homo sapiens
ggacatttcataagaccattct

SEQ ID NO: 7470321 - DNA, 22 bp, Homo sapiens
ggacatttagaacagagtattt

SEQ ID NO: 7470322 - DNA, 22 bp, Homo sapiens
ggacatttagtttcattgggca

SEQ ID NO: 7470323 - DNA, 22 bp, Homo sapiens
ggacatggagctccatggaggc

SEQ ID NO: 7470324 - DNA, 22 bp, Homo sapiens
ggacatggagctccatggaggc

SEQ ID NO: 7470325 - DNA, 22 bp, Homo sapiens
ggacatggaagtatggagtgga

SEQ ID NO: 7470326 - DNA, 22 bp, Homo sapiens
ggacatggagcatgtagagaaa

SEQ ID NO: 7470327 - DNA, 22 bp, Homo sapiens
ggacatggagcatgtagagaaa

SEQ ID NO: 7470328 - DNA, 22 bp, Homo sapiens
ggacatggaagtatggagtgga

SEQ ID NO: 7470329 - DNA, 22 bp, Homo sapiens
ggacatggagctccatggaggc

SEQ ID NO: 7470330 - DNA, 22 bp, Homo sapiens
ggacatggagcatgtagagaaa

SEQ ID NO: 7470331 - DNA, 22 bp, Homo sapiens
ggacatggagcatgtagagaaa

SEQ ID NO: 7470332 - DNA, 22 bp, Homo sapiens
ggacatgtgcaacttctttgga

SEQ ID NO: 7470333 - DNA, 22 bp, Homo sapiens
ggacatgttccttttcatcttt

SEQ ID NO: 7470334 - DNA, 22 bp, Homo sapiens
ggacatttagaacagagtattt

SEQ ID NO: 7470335 - DNA, 22 bp, Homo sapiens
ggacatttagaacagagtattt

SEQ ID NO: 7470336 - DNA, 22 bp, Homo sapiens
ggacattatagcttccagattg

SEQ ID NO: 7470337 - DNA, 22 bp, Homo sapiens
ggacatttagaacagagtattt

SEQ ID NO: 7470338 - DNA, 22 bp, Homo sapiens
ggacattgaagctggaaaggga

SEQ ID NO: 7470339 - DNA, 22 bp, Homo sapiens
ggagaagggacagactcagctt

SEQ ID NO: 7470340 - DNA, 22 bp, Homo sapiens
ggagaagggcatggtagtttta

SEQ ID NO: 7470341 - DNA, 22 bp, Homo sapiens
ggagaagggcatggtagtttta

SEQ ID NO: 7470342 - DNA, 22 bp, Homo sapiens
ggagaagggccaattccatgta

SEQ ID NO: 7470343 - DNA, 22 bp, Homo sapiens
ggagaagggccaattccatgta

SEQ ID NO: 7470344 - DNA, 22 bp, Homo sapiens
ggagaagggccaattccatgta

SEQ ID NO: 7470345 - DNA, 22 bp, Homo sapiens
ggagaagggccaattccatgta

SEQ ID NO: 7470346 - DNA, 22 bp, Homo sapiens
ggagaagggccaattccatgta

SEQ ID NO: 7470347 - DNA, 22 bp, Homo sapiens
ggagaagggacagactcagctt

SEQ ID NO: 7470348 - DNA, 22 bp, Homo sapiens
ggagaagggacagactcagctt

SEQ ID NO: 7470349 - DNA, 22 bp, Homo sapiens
ggagaagggacagactcagctt

SEQ ID NO: 7470350 - DNA, 22 bp, Homo sapiens
ggagaagggacagactcagctt

SEQ ID NO: 7470351 - DNA, 22 bp, Homo sapiens
ggagaagggacagactcagctt

SEQ ID NO: 7470352 - DNA, 22 bp, Homo sapiens
ggagaagggacagactcagctt

SEQ ID NO: 7470353 - DNA, 22 bp, Homo sapiens
ggagaagggacagactcagctt

SEQ ID NO: 7470354 - DNA, 22 bp, Homo sapiens
ggagaagggacagactcagctt

SEQ ID NO: 7470355 - DNA, 22 bp, Homo sapiens
ggagaagggacagactcagctt

SEQ ID NO: 7470356 - DNA, 22 bp, Homo sapiens
ggagaagggacagactcagctt

SEQ ID NO: 7470357 - DNA, 22 bp, Homo sapiens
ggagaagggacagactcagctt

SEQ ID NO: 7470358 - DNA, 22 bp, Homo sapiens
ggagaagggacagactcagctt

SEQ ID NO: 7470359 - DNA, 22 bp, Homo sapiens
ggagaagggtatgtgtggcgga

SEQ ID NO: 7470360 - DNA, 22 bp, Homo sapiens
ggagaagggtatgtgtggcgga

SEQ ID NO: 7470361 - DNA, 22 bp, Homo sapiens
ggagaagggtatgtgtggcgga

SEQ ID NO: 7470362 - DNA, 22 bp, Homo sapiens
ggagaagggtatgtgtggcgga

SEQ ID NO: 7470363 - DNA, 22 bp, Homo sapiens
ggagaagggtatgtgtggcgga

SEQ ID NO: 7470364 - DNA, 22 bp, Homo sapiens
ggagaagggtatgtgtggcgga

SEQ ID NO: 7470365 - DNA, 22 bp, Homo sapiens
ggagaagggtatgtgtggcgga

SEQ ID NO: 7470366 - DNA, 22 bp, Homo sapiens
ggagaagggtatgtgtggcgga

SEQ ID NO: 7470367 - DNA, 22 bp, Homo sapiens
ggagaagggtatgtgtggcgga

SEQ ID NO: 7470368 - DNA, 22 bp, Homo sapiens
ggagaagggtatgtgtggcgga

SEQ ID NO: 7470369 - DNA, 22 bp, Homo sapiens
ggagaaggtgctggtcactgtg

SEQ ID NO: 7470370 - DNA, 22 bp, Homo sapiens
ggagaaggtgctggtcactgtg

SEQ ID NO: 7470371 - DNA, 22 bp, Homo sapiens
ggagaaggtgctggtcactgtg

SEQ ID NO: 7470372 - DNA, 22 bp, Homo sapiens
ggagaagggcatggtagtttta

SEQ ID NO: 7470373 - DNA, 22 bp, Homo sapiens
ggagaaggtgctggtcactgtg

SEQ ID NO: 7470374 - DNA, 22 bp, Homo sapiens
ggagaaggtgctggtcactgtg

SEQ ID NO: 7470375 - DNA, 22 bp, Homo sapiens
ggagaaggtgctggtcactgtg

SEQ ID NO: 7470376 - DNA, 22 bp, Homo sapiens
ggagaaggtgctggtcactgtg

SEQ ID NO: 7470377 - DNA, 22 bp, Homo sapiens
ggagaaggtgctggtcactgtg

SEQ ID NO: 7470378 - DNA, 22 bp, Homo sapiens
ggagaaggtgctggtcactgtg

SEQ ID NO: 7470379 - DNA, 22 bp, Homo sapiens
ggagaaggtgctggtcactgtg

SEQ ID NO: 7470380 - DNA, 22 bp, Homo sapiens
ggagagcattcttagtctgttt

SEQ ID NO: 7470381 - DNA, 22 bp, Homo sapiens
ggagagcattcttagtctgttt

SEQ ID NO: 7470382 - DNA, 20 bp, Homo sapiens
ggagagccacatagtctccc

SEQ ID NO: 7470383 - DNA, 22 bp, Homo sapiens
ggagagcattcttagtctgttt

SEQ ID NO: 7470384 - DNA, 22 bp, Homo sapiens
ggagagcattcttagtctgttt

SEQ ID NO: 7470385 - DNA, 22 bp, Homo sapiens
ggagagcattcttagtctgttt

SEQ ID NO: 7470386 - DNA, 22 bp, Homo sapiens
ggagagcattcttagtctgttt

SEQ ID NO: 7470387 - DNA, 22 bp, Homo sapiens
ggagagcagggtcctgagatac

SEQ ID NO: 7470388 - DNA, 22 bp, Homo sapiens
ggagagcagggtcctgagatac

SEQ ID NO: 7470389 - DNA, 22 bp, Homo sapiens
ggagagcagggtcctgagatac

SEQ ID NO: 7470390 - DNA, 22 bp, Homo sapiens
ggagagcagggtcctgagatac

SEQ ID NO: 7470391 - DNA, 22 bp, Homo sapiens
ggagagcagggtcctgagatac

SEQ ID NO: 7470392 - DNA, 22 bp, Homo sapiens
ggagagcagggaggctgctctg

SEQ ID NO: 7470393 - DNA, 22 bp, Homo sapiens
ggagagcagggaggctgctctg

SEQ ID NO: 7470394 - DNA, 22 bp, Homo sapiens
ggagagcagggaggctgctctg

SEQ ID NO: 7470395 - DNA, 22 bp, Homo sapiens
ggagagcagggtcctgagatac

SEQ ID NO: 7470396 - DNA, 22 bp, Homo sapiens
ggagagcagggaggctgctctg

SEQ ID NO: 7470397 - DNA, 20 bp, Homo sapiens
ggagagcagggaagacagta

SEQ ID NO: 7470398 - DNA, 20 bp, Homo sapiens
ggagagcagggaagacagta

SEQ ID NO: 7470399 - DNA, 22 bp, Homo sapiens
ggagagcagggaggctgctctg

SEQ ID NO: 7470400 - DNA, 20 bp, Homo sapiens
ggagagcagggaagacagta

SEQ ID NO: 7470401 - DNA, 22 bp, Homo sapiens
ggagagcagggaggctgctctg

SEQ ID NO: 7470402 - DNA, 22 bp, Homo sapiens
ggagagcagggaggctgctctg

SEQ ID NO: 7470403 - DNA, 22 bp, Homo sapiens
ggagagcagggaggctgctctg

SEQ ID NO: 7470404 - DNA, 22 bp, Homo sapiens
ggagagaggctggccgtgatga

SEQ ID NO: 7470405 - DNA, 22 bp, Homo sapiens
ggagagataggagtcctggact

SEQ ID NO: 7470406 - DNA, 22 bp, Homo sapiens
ggagagataggagtcctggact

SEQ ID NO: 7470407 - DNA, 22 bp, Homo sapiens
ggagagatggtaaccctggggc

SEQ ID NO: 7470408 - DNA, 20 bp, Homo sapiens
ggagagcagggaagacagta

SEQ ID NO: 7470409 - DNA, 20 bp, Homo sapiens
ggagagcagggaagacagta

SEQ ID NO: 7470410 - DNA, 22 bp, Homo sapiens
ggagagaggctggccgtgatga

SEQ ID NO: 7470411 - DNA, 22 bp, Homo sapiens
ggagagaggctggccgtgatga

SEQ ID NO: 7470412 - DNA, 22 bp, Homo sapiens
ggagagaggctggccgtgatga

SEQ ID NO: 7470413 - DNA, 22 bp, Homo sapiens
ggagagaggctggccgtgatga

SEQ ID NO: 7470414 - DNA, 22 bp, Homo sapiens
ggagagaggagcccactgctgt

SEQ ID NO: 7470415 - DNA, 22 bp, Homo sapiens
ggagagaggagcccactgctgt

SEQ ID NO: 7470416 - DNA, 22 bp, Homo sapiens
ggagagaggagcccactgctgt

SEQ ID NO: 7470417 - DNA, 22 bp, Homo sapiens
ggagagaggagcccactgctgt

SEQ ID NO: 7470418 - DNA, 22 bp, Homo sapiens
ggagaaggtgctggtcactgtg

SEQ ID NO: 7470419 - DNA, 22 bp, Homo sapiens
ggagaaggtggctcagcaaagg

SEQ ID NO: 7470420 - DNA, 22 bp, Homo sapiens
ggagaaggtggctcagcaaagg

SEQ ID NO: 7470421 - DNA, 22 bp, Homo sapiens
ggagaaggtggctcagcaaagg

SEQ ID NO: 7470422 - DNA, 22 bp, Homo sapiens
ggagaaggtggctcagcaaagg

SEQ ID NO: 7470423 - DNA, 22 bp, Homo sapiens
cacacagtgggaaaacctgaag

SEQ ID NO: 7470424 - DNA, 21 bp, Homo sapiens
cacacagtggagtgcccttgc

SEQ ID NO: 7470425 - DNA, 21 bp, Homo sapiens
cacacagtggagtgcccttgc

SEQ ID NO: 7470426 - DNA, 22 bp, Homo sapiens
ggactgggtaggagcccagggc

SEQ ID NO: 7470427 - DNA, 22 bp, Homo sapiens
cacacagtgggaaaacctgaag

SEQ ID NO: 7470428 - DNA, 22 bp, Homo sapiens
ggactgggtaggagcccagggc

SEQ ID NO: 7470429 - DNA, 22 bp, Homo sapiens
ggactgggtaggagcccagggc

SEQ ID NO: 7470430 - DNA, 22 bp, Homo sapiens
ggactgggtaggagcccagggc

SEQ ID NO: 7470431 - DNA, 22 bp, Homo sapiens
ggagaaggcacacccacctctg

SEQ ID NO: 7470432 - DNA, 22 bp, Homo sapiens
ggagaaggcgaagtcattcttt

SEQ ID NO: 7470433 - DNA, 22 bp, Homo sapiens
ggagaaggcgaagtcattcttt

SEQ ID NO: 7470434 - DNA, 22 bp, Homo sapiens
ggagaaggcacacccacctctg

SEQ ID NO: 7470435 - DNA, 22 bp, Homo sapiens
ggagaaggcacacccacctctg

SEQ ID NO: 7470436 - DNA, 22 bp, Homo sapiens
ggagaaggcacacccacctctg

SEQ ID NO: 7470437 - DNA, 22 bp, Homo sapiens
ggagaagggaactgagtttttg

SEQ ID NO: 7470438 - DNA, 22 bp, Homo sapiens
ggagaagggaactgagtttttg

SEQ ID NO: 7470439 - DNA, 22 bp, Homo sapiens
ggagaagggacagactcagctt

SEQ ID NO: 7470440 - DNA, 21 bp, Homo sapiens
cacacagtgatctatccacat

SEQ ID NO: 7470441 - DNA, 21 bp, Homo sapiens
cacacagtgatctatccacat

SEQ ID NO: 7470442 - DNA, 22 bp, Homo sapiens
cacacagtggagtattactcag

SEQ ID NO: 7470443 - DNA, 22 bp, Homo sapiens
cacacagtggagtattactcag

SEQ ID NO: 7470444 - DNA, 22 bp, Homo sapiens
cacacagtggagtattactcag

SEQ ID NO: 7470445 - DNA, 22 bp, Homo sapiens
cacacagtggagtattactcag

SEQ ID NO: 7470446 - DNA, 22 bp, Homo sapiens
cacacagtggagtattactcag

SEQ ID NO: 7470447 - DNA, 22 bp, Homo sapiens
cacacagtggagtattactcag

SEQ ID NO: 7470448 - DNA, 22 bp, Homo sapiens
cacacagtagtatgaggcaaaa

SEQ ID NO: 7470449 - DNA, 22 bp, Homo sapiens
cacacagtaggcactcattaat

SEQ ID NO: 7470450 - DNA, 22 bp, Homo sapiens
cacacagtagtatgaggcaaaa

SEQ ID NO: 7470451 - DNA, 22 bp, Homo sapiens
cacacagtagtatgaggcaaaa

SEQ ID NO: 7470452 - DNA, 22 bp, Homo sapiens
cacacagtaggcactcattaat

SEQ ID NO: 7470453 - DNA, 22 bp, Homo sapiens
cacacagtaggcactcattaat

SEQ ID NO: 7470454 - DNA, 22 bp, Homo sapiens
cacacaggtatatatatgtaca

SEQ ID NO: 7470455 - DNA, 22 bp, Homo sapiens
cacacagtaggcactcattaat

SEQ ID NO: 7470456 - DNA, 22 bp, Homo sapiens
cacacagtaggcactcattaat

SEQ ID NO: 7470457 - DNA, 22 bp, Homo sapiens
cacacagtaggcactcattaat

SEQ ID NO: 7470458 - DNA, 22 bp, Homo sapiens
cacacaggtaagcctctttcaa

SEQ ID NO: 7470459 - DNA, 22 bp, Homo sapiens
cacacaggtaagcctctttcaa

SEQ ID NO: 7470460 - DNA, 22 bp, Homo sapiens
cacacagggagaaagaaagcct

SEQ ID NO: 7470461 - DNA, 22 bp, Homo sapiens
cacacagggagaaagaaagcct

SEQ ID NO: 7470462 - DNA, 22 bp, Homo sapiens
cacacaggtaagcctctttcaa

SEQ ID NO: 7470463 - DNA, 22 bp, Homo sapiens
cacacaggtaagcctctttcaa

SEQ ID NO: 7470464 - DNA, 22 bp, Homo sapiens
cacacagggagaaagaaagcct

SEQ ID NO: 7470465 - DNA, 22 bp, Homo sapiens
cacacagggagaaagaaagcct

SEQ ID NO: 7470466 - DNA, 22 bp, Homo sapiens
cacacagggagaaagaaagcct

SEQ ID NO: 7470467 - DNA, 22 bp, Homo sapiens
cacacaggatgaagcagcagaa

SEQ ID NO: 7470468 - DNA, 22 bp, Homo sapiens
cacacaggatgaagcagcagaa

SEQ ID NO: 7470469 - DNA, 22 bp, Homo sapiens
cacacaggcaggatcccttccc

SEQ ID NO: 7470470 - DNA, 22 bp, Homo sapiens
cacacaggcaggatcccttccc

SEQ ID NO: 7470471 - DNA, 22 bp, Homo sapiens
cacacaggatgaagcagcagaa

SEQ ID NO: 7470472 - DNA, 22 bp, Homo sapiens
cacacaggatgaagcagcagaa

SEQ ID NO: 7470473 - DNA, 22 bp, Homo sapiens
cacacaggatgaagcagcagaa

SEQ ID NO: 7470474 - DNA, 22 bp, Homo sapiens
cacacaggatgaagcagcagaa

SEQ ID NO: 7470475 - DNA, 22 bp, Homo sapiens
cacacaggatgaagcagcagaa

SEQ ID NO: 7470476 - DNA, 22 bp, Homo sapiens
ggaccagagggatgacatttgg

SEQ ID NO: 7470477 - DNA, 22 bp, Homo sapiens
ggaccagagctcgggcttctca

SEQ ID NO: 7470478 - DNA, 22 bp, Homo sapiens
ggaccagatgaagagttggagg

SEQ ID NO: 7470479 - DNA, 22 bp, Homo sapiens
ggaccagatgaagagttggagg

SEQ ID NO: 7470480 - DNA, 22 bp, Homo sapiens
ggaccagcaatcaagaacctac

SEQ ID NO: 7470481 - DNA, 22 bp, Homo sapiens
ggaccagctatcaatgccaggg

SEQ ID NO: 7470482 - DNA, 22 bp, Homo sapiens
ggaccagagaagtgagcacctg

SEQ ID NO: 7470483 - DNA, 22 bp, Homo sapiens
ggaccagagaagtgagcacctg

SEQ ID NO: 7470484 - DNA, 22 bp, Homo sapiens
ggaccagagctcgggcttctca

SEQ ID NO: 7470485 - DNA, 22 bp, Homo sapiens
ggaccagagaagtgagcacctg

SEQ ID NO: 7470486 - DNA, 22 bp, Homo sapiens
ggaccagagaagtgagcacctg

SEQ ID NO: 7470487 - DNA, 22 bp, Homo sapiens
cacacaggatgaagcagcagaa

SEQ ID NO: 7470488 - DNA, 22 bp, Homo sapiens
cacacaggatgaagcagcagaa

SEQ ID NO: 7470489 - DNA, 22 bp, Homo sapiens
cacacaggatgaagcagcagaa

SEQ ID NO: 7470490 - DNA, 22 bp, Homo sapiens
cacacaggatgaagcagcagaa

SEQ ID NO: 7470491 - DNA, 22 bp, Homo sapiens
cacacaggatgaagcagcagaa

SEQ ID NO: 7470492 - DNA, 22 bp, Homo sapiens
ggaccagctatcaatgccaggg

SEQ ID NO: 7470493 - DNA, 22 bp, Homo sapiens
cacacaggagagtgctggaggt

SEQ ID NO: 7470494 - DNA, 20 bp, Homo sapiens
ggaccagctgtctgaggggc

SEQ ID NO: 7470495 - DNA, 23 bp, Homo sapiens
caagctgcagtttggttggtggg

SEQ ID NO: 7470496 - DNA, 22 bp, Homo sapiens
caagctgccaccagaagagcat

SEQ ID NO: 7470497 - DNA, 22 bp, Homo sapiens
caagctctttaaacttatgtca

SEQ ID NO: 7470498 - DNA, 22 bp, Homo sapiens
caagctctttaaacttatgtca

SEQ ID NO: 7470499 - DNA, 22 bp, Homo sapiens
caagctctgggatgcagacatc

SEQ ID NO: 7470500 - DNA, 22 bp, Homo sapiens
caagctctgcgggctccaagat

SEQ ID NO: 7470501 - DNA, 22 bp, Homo sapiens
caagctgaacactgtcttcaag

SEQ ID NO: 7470502 - DNA, 22 bp, Homo sapiens
caagctgaacactgtcttcaag

SEQ ID NO: 7470503 - DNA, 22 bp, Homo sapiens
caagctctgggatgcagacatc

SEQ ID NO: 7470504 - DNA, 22 bp, Homo sapiens
caagctgcagcgcctgcgccgg

SEQ ID NO: 7470505 - DNA, 22 bp, Homo sapiens
caagctgcagcgcctgcgccgg

SEQ ID NO: 7470506 - DNA, 22 bp, Homo sapiens
gctgggctcaccaggccactag

SEQ ID NO: 7470507 - DNA, 22 bp, Homo sapiens
gctgggctcagacctagtgaac

SEQ ID NO: 7470508 - DNA, 22 bp, Homo sapiens
gctgggctcagacctagtgaac

SEQ ID NO: 7470509 - DNA, 22 bp, Homo sapiens
gctgggctcagacctagtgaac

SEQ ID NO: 7470510 - DNA, 22 bp, Homo sapiens
gctgggcttgtggccagctggg

SEQ ID NO: 7470511 - DNA, 22 bp, Homo sapiens
gctgggcttgtggccagctggg

SEQ ID NO: 7470512 - DNA, 22 bp, Homo sapiens
gctgggcttggtttccctgctt

SEQ ID NO: 7470513 - DNA, 22 bp, Homo sapiens
gctgggcttggtttccctgctt

SEQ ID NO: 7470514 - DNA, 22 bp, Homo sapiens
gctgggcttgtggccagctggg

SEQ ID NO: 7470515 - DNA, 22 bp, Homo sapiens
gctgggcttgtggccagctggg

SEQ ID NO: 7470516 - DNA, 22 bp, Homo sapiens
caagctacttagaaagcacagt

SEQ ID NO: 7470517 - DNA, 22 bp, Homo sapiens
caagctccttacatccacaggg

SEQ ID NO: 7470518 - DNA, 22 bp, Homo sapiens
caagctccttacatccacaggg

SEQ ID NO: 7470519 - DNA, 22 bp, Homo sapiens
caagctctgcgggctccaagat

SEQ ID NO: 7470520 - DNA, 22 bp, Homo sapiens
caagctctgcgggctccaagat

SEQ ID NO: 7470521 - DNA, 22 bp, Homo sapiens
caagctctgggatagcagagag

SEQ ID NO: 7470522 - DNA, 22 bp, Homo sapiens
caagctctgggatagcagagag

SEQ ID NO: 7470523 - DNA, 22 bp, Homo sapiens
caagctctgcgggctccaagat

SEQ ID NO: 7470524 - DNA, 22 bp, Homo sapiens
caagctctgcgggctccaagat

SEQ ID NO: 7470525 - DNA, 22 bp, Homo sapiens
caagcgtggctgctctgatgga

SEQ ID NO: 7470526 - DNA, 22 bp, Homo sapiens
caagcgtggctgctctgatgga

SEQ ID NO: 7470527 - DNA, 22 bp, Homo sapiens
caagcgtggctgctctgatgga

SEQ ID NO: 7470528 - DNA, 22 bp, Homo sapiens
caagcgtggctgctctgatgga

SEQ ID NO: 7470529 - DNA, 22 bp, Homo sapiens
caagcgtggctgctctgatgga

SEQ ID NO: 7470530 - DNA, 22 bp, Homo sapiens
caagccttggaaatccattctg

SEQ ID NO: 7470531 - DNA, 22 bp, Homo sapiens
caagcccccggcaagtgtgtat

SEQ ID NO: 7470532 - DNA, 22 bp, Homo sapiens
caagccttggaaatccattctg

SEQ ID NO: 7470533 - DNA, 22 bp, Homo sapiens
gctggggagcaagagtagtgag

SEQ ID NO: 7470534 - DNA, 22 bp, Homo sapiens
gctggggagcaagagtagtgag

SEQ ID NO: 7470535 - DNA, 22 bp, Homo sapiens
gctggggagcaagagtagtgag

SEQ ID NO: 7470536 - DNA, 22 bp, Homo sapiens
gctggggagcaagagtagtgag

SEQ ID NO: 7470537 - DNA, 22 bp, Homo sapiens
gctggggagcaagagtagtgag

SEQ ID NO: 7470538 - DNA, 22 bp, Homo sapiens
gctggggagcaagagtagtgag

SEQ ID NO: 7470539 - DNA, 22 bp, Homo sapiens
gctggggagcaagagtagtgag

SEQ ID NO: 7470540 - DNA, 22 bp, Homo sapiens
gctggggagcaagagtagtgag

SEQ ID NO: 7470541 - DNA, 22 bp, Homo sapiens
gctggggactccccaccatagc

SEQ ID NO: 7470542 - DNA, 22 bp, Homo sapiens
gctggggagaattgggttatct

SEQ ID NO: 7470543 - DNA, 22 bp, Homo sapiens
gctggggagaattgggttatct

SEQ ID NO: 7470544 - DNA, 22 bp, Homo sapiens
gctggggagaattgggttatct

SEQ ID NO: 7470545 - DNA, 22 bp, Homo sapiens
gctggggagcaagagtagtgag

SEQ ID NO: 7470546 - DNA, 22 bp, Homo sapiens
gctggggactccccaccatagc

SEQ ID NO: 7470547 - DNA, 22 bp, Homo sapiens
gctggggaccagctgtctctga

SEQ ID NO: 7470548 - DNA, 22 bp, Homo sapiens
gctggggactccccaccatagc

SEQ ID NO: 7470549 - DNA, 22 bp, Homo sapiens
gctggggagaattgggttatct

SEQ ID NO: 7470550 - DNA, 22 bp, Homo sapiens
gctgggcttgtggccagctggg

SEQ ID NO: 7470551 - DNA, 22 bp, Homo sapiens
gctgggctcagacctagtgaac

SEQ ID NO: 7470552 - DNA, 20 bp, Homo sapiens
gctgggctttgactgacaca

SEQ ID NO: 7470553 - DNA, 20 bp, Homo sapiens
gctgggctttgactgacaca

SEQ ID NO: 7470554 - DNA, 22 bp, Homo sapiens
gctgggcttgtggccagctggg

SEQ ID NO: 7470555 - DNA, 20 bp, Homo sapiens
gctgggctttgactgacaca

SEQ ID NO: 7470556 - DNA, 19 bp, Homo sapiens
gctggggaatggatattga

SEQ ID NO: 7470557 - DNA, 19 bp, Homo sapiens
gctggggaatggatattga

SEQ ID NO: 7470558 - DNA, 20 bp, Homo sapiens
gctgggctttgactgacaca

SEQ ID NO: 7470559 - DNA, 22 bp, Homo sapiens
gctggggaccagctgtctctga

SEQ ID NO: 7470560 - DNA, 22 bp, Homo sapiens
gctggggaccagctgtctctga

SEQ ID NO: 7470561 - DNA, 22 bp, Homo sapiens
gctggggaccagctgtctctga

SEQ ID NO: 7470562 - DNA, 22 bp, Homo sapiens
gctggggaccagctgtctctga

SEQ ID NO: 7470563 - DNA, 22 bp, Homo sapiens
gctggggaccagctgtctctga

SEQ ID NO: 7470564 - DNA, 22 bp, Homo sapiens
gctggggaccagctgtctctga

SEQ ID NO: 7470565 - DNA, 17 bp, Homo sapiens
gctggctgacccatgcc

SEQ ID NO: 7470566 - DNA, 17 bp, Homo sapiens
gctggctgacccatgcc

SEQ ID NO: 7470567 - DNA, 17 bp, Homo sapiens
gctggctgacccatgcc

SEQ ID NO: 7470568 - DNA, 17 bp, Homo sapiens
gctggctgacccatgcc

SEQ ID NO: 7470569 - DNA, 17 bp, Homo sapiens
gctggctgacccatgcc

SEQ ID NO: 7470570 - DNA, 22 bp, Homo sapiens
gctggctgacagatttggggtg

SEQ ID NO: 7470571 - DNA, 22 bp, Homo sapiens
gctggctgacagatttggggtg

SEQ ID NO: 7470572 - DNA, 22 bp, Homo sapiens
gctggctgacagatttggggtg

SEQ ID NO: 7470573 - DNA, 22 bp, Homo sapiens
gctggctgacagatttggggtg

SEQ ID NO: 7470574 - DNA, 22 bp, Homo sapiens
gctggctgacagagatttaaaa

SEQ ID NO: 7470575 - DNA, 22 bp, Homo sapiens
gctggctgacagatttggggtg

SEQ ID NO: 7470576 - DNA, 22 bp, Homo sapiens
gctggctgacagatttggggtg

SEQ ID NO: 7470577 - DNA, 22 bp, Homo sapiens
gctggctgaatcttctgcaata

SEQ ID NO: 7470578 - DNA, 22 bp, Homo sapiens
gctggctgaatcttctgcaata

SEQ ID NO: 7470579 - DNA, 22 bp, Homo sapiens
gctggctgacagagatttaaaa

SEQ ID NO: 7470580 - DNA, 17 bp, Homo sapiens
gctggctgacccatgcc

SEQ ID NO: 7470581 - DNA, 17 bp, Homo sapiens
gctggctgacccatgcc

SEQ ID NO: 7470582 - DNA, 22 bp, Homo sapiens
gctggctgagatctgttttcct

SEQ ID NO: 7470583 - DNA, 17 bp, Homo sapiens
gctggctgacccatgcc

SEQ ID NO: 7470584 - DNA, 17 bp, Homo sapiens
gctggctgacccatgcc

SEQ ID NO: 7470585 - DNA, 17 bp, Homo sapiens
gctggctgacccatgcc

SEQ ID NO: 7470586 - DNA, 22 bp, Homo sapiens
gctggctgagatctgttttcct

SEQ ID NO: 7470587 - DNA, 22 bp, Homo sapiens
gctggctgagatctgttttcct

SEQ ID NO: 7470588 - DNA, 22 bp, Homo sapiens
gctggctgagcactggtttata

SEQ ID NO: 7470589 - DNA, 22 bp, Homo sapiens
gctggctgagcactggtttata

SEQ ID NO: 7470590 - DNA, 22 bp, Homo sapiens
gctggctgagatctgttttcct

SEQ ID NO: 7470591 - DNA, 22 bp, Homo sapiens
gctggctgagcactggtttata

SEQ ID NO: 7470592 - DNA, 22 bp, Homo sapiens
gctggctgagcactggtttata

SEQ ID NO: 7470593 - DNA, 22 bp, Homo sapiens
gctggcccagggtcacctagga

SEQ ID NO: 7470594 - DNA, 22 bp, Homo sapiens
gctggcccagggtcacctagga

SEQ ID NO: 7470595 - DNA, 22 bp, Homo sapiens
gctggcccagggtcacctagga

SEQ ID NO: 7470596 - DNA, 22 bp, Homo sapiens
gctggcccagcgtggggccgtg

SEQ ID NO: 7470597 - DNA, 22 bp, Homo sapiens
gctggctcttcagtggagatag

SEQ ID NO: 7470598 - DNA, 22 bp, Homo sapiens
gctggctctttttgccgggctc

SEQ ID NO: 7470599 - DNA, 22 bp, Homo sapiens
gctggctctttttgccgggctc

SEQ ID NO: 7470600 - DNA, 22 bp, Homo sapiens
gctggctctttttgccgggctc

SEQ ID NO: 7470601 - DNA, 22 bp, Homo sapiens
gctggctctttttgccgggctc

SEQ ID NO: 7470602 - DNA, 22 bp, Homo sapiens
gctggctgaatcttctgcaata

SEQ ID NO: 7470603 - DNA, 22 bp, Homo sapiens
gctggctgaatcttctgcaata

SEQ ID NO: 7470604 - DNA, 22 bp, Homo sapiens
gctggctgaatcttctgcaata

SEQ ID NO: 7470605 - DNA, 22 bp, Homo sapiens
gctggctgaatcttctgcaata

SEQ ID NO: 7470606 - DNA, 20 bp, Homo sapiens
gctggctgaactgaaagcaa

SEQ ID NO: 7470607 - DNA, 20 bp, Homo sapiens
gctggctgaactgaaagcaa

SEQ ID NO: 7470608 - DNA, 20 bp, Homo sapiens
gctggctgaactgaaagcaa

SEQ ID NO: 7470609 - DNA, 22 bp, Homo sapiens
gctggctctttttgccgggctc

SEQ ID NO: 7470610 - DNA, 20 bp, Homo sapiens
gctggctgaactgaaagcaa

SEQ ID NO: 7470611 - DNA, 20 bp, Homo sapiens
gctggctgaactgaaagcaa

SEQ ID NO: 7470612 - DNA, 20 bp, Homo sapiens
gctggctgaactgaaagcaa

SEQ ID NO: 7470613 - DNA, 22 bp, Homo sapiens
gctggctctttttgccgggctc

SEQ ID NO: 7470614 - DNA, 22 bp, Homo sapiens
gctggctgagttctgtcgtctg

SEQ ID NO: 7470615 - DNA, 22 bp, Homo sapiens
gctggctgagttctgtcgtctg

SEQ ID NO: 7470616 - DNA, 22 bp, Homo sapiens
gctggctgaggtctagctcttt

SEQ ID NO: 7470617 - DNA, 22 bp, Homo sapiens
gctggctgagttctgtcgtctg

SEQ ID NO: 7470618 - DNA, 22 bp, Homo sapiens
gctggctgaggtctagctcttt

SEQ ID NO: 7470619 - DNA, 22 bp, Homo sapiens
gctggctgaggtctagctcttt

SEQ ID NO: 7470620 - DNA, 22 bp, Homo sapiens
gctggctgagttctgtcgtctg

SEQ ID NO: 7470621 - DNA, 22 bp, Homo sapiens
gctggctgagttctgtcgtctg

SEQ ID NO: 7470622 - DNA, 22 bp, Homo sapiens
gctggctgagttctgtcgtctg

SEQ ID NO: 7470623 - DNA, 22 bp, Homo sapiens
gctggctgaggtctagctcttt

SEQ ID NO: 7470624 - DNA, 22 bp, Homo sapiens
gctggctgaggtctagctcttt

SEQ ID NO: 7470625 - DNA, 22 bp, Homo sapiens
gctggctgaggtctagctcttt

SEQ ID NO: 7470626 - DNA, 22 bp, Homo sapiens
gctggctgagcactggtttata

SEQ ID NO: 7470627 - DNA, 22 bp, Homo sapiens
gctggctgaggtctagctcttt

SEQ ID NO: 7470628 - DNA, 22 bp, Homo sapiens
gctggctgaggtctagctcttt

SEQ ID NO: 7470629 - DNA, 22 bp, Homo sapiens
gctggctgaggtctagctcttt

SEQ ID NO: 7470630 - DNA, 22 bp, Homo sapiens
gctggctgaggtctagctcttt

SEQ ID NO: 7470631 - DNA, 22 bp, Homo sapiens
gctggctgaggtctagctcttt

SEQ ID NO: 7470632 - DNA, 22 bp, Homo sapiens
caagccattctcctgcctcagc

SEQ ID NO: 7470633 - DNA, 22 bp, Homo sapiens
caagcccactgctcagagccaa

SEQ ID NO: 7470634 - DNA, 22 bp, Homo sapiens
caagcccactgctcagagccaa

SEQ ID NO: 7470635 - DNA, 22 bp, Homo sapiens
gctggctgagttctgtcgtctg

SEQ ID NO: 7470636 - DNA, 22 bp, Homo sapiens
caagcccaggattccccagtta

SEQ ID NO: 7470637 - DNA, 22 bp, Homo sapiens
caagcccagatcctgcgtgtct

SEQ ID NO: 7470638 - DNA, 22 bp, Homo sapiens
caagcccagatcctgcgtgtct

SEQ ID NO: 7470639 - DNA, 22 bp, Homo sapiens
caagcccagatcctgcgtgtct

SEQ ID NO: 7470640 - DNA, 22 bp, Homo sapiens
caagcccactgctcagagccaa

SEQ ID NO: 7470641 - DNA, 22 bp, Homo sapiens
caagcccactgctcagagccaa

SEQ ID NO: 7470642 - DNA, 22 bp, Homo sapiens
caagcctcagaatcttctccat

SEQ ID NO: 7470643 - DNA, 22 bp, Homo sapiens
caagcctgtctcaccagtgcta

SEQ ID NO: 7470644 - DNA, 22 bp, Homo sapiens
caagcccttccgggaacagttg

SEQ ID NO: 7470645 - DNA, 22 bp, Homo sapiens
caagccgacacacttccctttg

SEQ ID NO: 7470646 - DNA, 22 bp, Homo sapiens
caagccctgttaggggtctcta

SEQ ID NO: 7470647 - DNA, 22 bp, Homo sapiens
caagccctgttaggggtctcta

SEQ ID NO: 7470648 - DNA, 22 bp, Homo sapiens
caagcccaggattccccagtta

SEQ ID NO: 7470649 - DNA, 22 bp, Homo sapiens
caagcccaggattccccagtta

SEQ ID NO: 7470650 - DNA, 18 bp, Homo sapiens
gctgcctgcattcctcac

SEQ ID NO: 7470651 - DNA, 18 bp, Homo sapiens
gctgcctgcattcctcac

SEQ ID NO: 7470652 - DNA, 22 bp, Homo sapiens
gctgcctgcagtgttttcccag

SEQ ID NO: 7470653 - DNA, 22 bp, Homo sapiens
gctgcctgcacagagctgcttt

SEQ ID NO: 7470654 - DNA, 22 bp, Homo sapiens
gctgcctgcacagagctgcttt

SEQ ID NO: 7470655 - DNA, 21 bp, Homo sapiens
gctgcctgcccctcgggggct

SEQ ID NO: 7470656 - DNA, 21 bp, Homo sapiens
gctgcctgcccctcgggggct

SEQ ID NO: 7470657 - DNA, 22 bp, Homo sapiens
gctgcctgccctgggtcatctg

SEQ ID NO: 7470658 - DNA, 22 bp, Homo sapiens
gctgcctgccctgggtcatctg

SEQ ID NO: 7470659 - DNA, 22 bp, Homo sapiens
gctgcctgccctgggtcatctg

SEQ ID NO: 7470660 - DNA, 22 bp, Homo sapiens
gctgcctgccctgggtcatctg

SEQ ID NO: 7470661 - DNA, 22 bp, Homo sapiens
gctgcctgccctgggtcatctg

SEQ ID NO: 7470662 - DNA, 18 bp, Homo sapiens
gctgcctgcattcctcac

SEQ ID NO: 7470663 - DNA, 21 bp, Homo sapiens
gctgcctgcccctcgggggct

SEQ ID NO: 7470664 - DNA, 21 bp, Homo sapiens
gctgcctgcccctcgggggct

SEQ ID NO: 7470665 - DNA, 21 bp, Homo sapiens
gctgcctgcccctcgggggct

SEQ ID NO: 7470666 - DNA, 18 bp, Homo sapiens
gctgcctgcattcctcac

SEQ ID NO: 7470667 - DNA, 18 bp, Homo sapiens
gctgcctgcattcctcac

SEQ ID NO: 7470668 - DNA, 22 bp, Homo sapiens
gctgcctgccttgcctggagga

SEQ ID NO: 7470669 - DNA, 22 bp, Homo sapiens
gctgcctgccttgcctggagga

SEQ ID NO: 7470670 - DNA, 22 bp, Homo sapiens
gctgcctgccttgcctggagga

SEQ ID NO: 7470671 - DNA, 22 bp, Homo sapiens
gctgcctgccttgcctggagga

SEQ ID NO: 7470672 - DNA, 22 bp, Homo sapiens
gctgcctgccttgcctggagga

SEQ ID NO: 7470673 - DNA, 22 bp, Homo sapiens
gctgcctgccttgcctggagga

SEQ ID NO: 7470674 - DNA, 22 bp, Homo sapiens
gctgctggccccacatgctcca

SEQ ID NO: 7470675 - DNA, 22 bp, Homo sapiens
gctgctggcgctgggcgtccgg

SEQ ID NO: 7470676 - DNA, 22 bp, Homo sapiens
gctgctggcgctgggcgtccgg

SEQ ID NO: 7470677 - DNA, 22 bp, Homo sapiens
gctgctggcgctgggcgtccgg

SEQ ID NO: 7470678 - DNA, 22 bp, Homo sapiens
gctgctggccgcccagcttctc

SEQ ID NO: 7470679 - DNA, 22 bp, Homo sapiens
gctgcctgcctagttccacagt

SEQ ID NO: 7470680 - DNA, 22 bp, Homo sapiens
gctgcctgcctagttccacagt

SEQ ID NO: 7470681 - DNA, 22 bp, Homo sapiens
gctgcctgcctagttccacagt

SEQ ID NO: 7470682 - DNA, 22 bp, Homo sapiens
gctgcctgcctagttccacagt

SEQ ID NO: 7470683 - DNA, 22 bp, Homo sapiens
gctgcctgcctagttccacagt

SEQ ID NO: 7470684 - DNA, 22 bp, Homo sapiens
gctgcctgccctgggtcatctg

SEQ ID NO: 7470685 - DNA, 22 bp, Homo sapiens
gctgcctgccttgcctggagga

SEQ ID NO: 7470686 - DNA, 22 bp, Homo sapiens
gctgcctgcctgcatttaatcc

SEQ ID NO: 7470687 - DNA, 22 bp, Homo sapiens
gctgcctgcctagttccacagt

SEQ ID NO: 7470688 - DNA, 22 bp, Homo sapiens
gctgcctgcctagttccacagt

SEQ ID NO: 7470689 - DNA, 22 bp, Homo sapiens
gctgctttctgaaggtgcactg

SEQ ID NO: 7470690 - DNA, 22 bp, Homo sapiens
gctgctttctgttaggaattgg

SEQ ID NO: 7470691 - DNA, 22 bp, Homo sapiens
gctgctggcgctgggcgtccgg

SEQ ID NO: 7470692 - DNA, 22 bp, Homo sapiens
gctgctttgacagtgggaacag

SEQ ID NO: 7470693 - DNA, 22 bp, Homo sapiens
gctgctttgaaagaggagcttt

SEQ ID NO: 7470694 - DNA, 22 bp, Homo sapiens
gctgctttgacagtgggaacag

SEQ ID NO: 7470695 - DNA, 22 bp, Homo sapiens
gctgctttgtctgtaaaatgga

SEQ ID NO: 7470696 - DNA, 22 bp, Homo sapiens
gctgctttgtctgtaaaatgga

SEQ ID NO: 7470697 - DNA, 22 bp, Homo sapiens
gctgctttggaaagcatggaaa

SEQ ID NO: 7470698 - DNA, 22 bp, Homo sapiens
gctgctttgcagtagagtaata

SEQ ID NO: 7470699 - DNA, 22 bp, Homo sapiens
gctgctttgtctgtaaaatgga

SEQ ID NO: 7470700 - DNA, 22 bp, Homo sapiens
gctgcttttcacagagacaaga

SEQ ID NO: 7470701 - DNA, 22 bp, Homo sapiens
gctgcttttcacagagacaaga

SEQ ID NO: 7470702 - DNA, 22 bp, Homo sapiens
gctggaaaaggaggcaaaatat

SEQ ID NO: 7470703 - DNA, 22 bp, Homo sapiens
gctgctttttggatttggcaca

SEQ ID NO: 7470704 - DNA, 22 bp, Homo sapiens
gctggaaatcaaagaagtggat

SEQ ID NO: 7470705 - DNA, 22 bp, Homo sapiens
gctggaaatcaaagaagtggat

SEQ ID NO: 7470706 - DNA, 22 bp, Homo sapiens
gctggaaatcatattttgttgt

SEQ ID NO: 7470707 - DNA, 22 bp, Homo sapiens
gctggaaatgaatggagaggtg

SEQ ID NO: 7470708 - DNA, 22 bp, Homo sapiens
gctggaaatgattaaatggtga

SEQ ID NO: 7470709 - DNA, 20 bp, Homo sapiens
gctggaagggctagagggct

SEQ ID NO: 7470710 - DNA, 20 bp, Homo sapiens
gctggaagggctagagggct

SEQ ID NO: 7470711 - DNA, 20 bp, Homo sapiens
gctggaagggctagagggct

SEQ ID NO: 7470712 - DNA, 22 bp, Homo sapiens
gctggaaggctaggctcagttg

SEQ ID NO: 7470713 - DNA, 22 bp, Homo sapiens
gctggaaggctaggctcagttg

SEQ ID NO: 7470714 - DNA, 22 bp, Homo sapiens
gctggaagggaggcccagccgg

SEQ ID NO: 7470715 - DNA, 22 bp, Homo sapiens
gctggaagaatgagtgcctcgt

SEQ ID NO: 7470716 - DNA, 22 bp, Homo sapiens
caagaatatatatggagtggag

SEQ ID NO: 7470717 - DNA, 22 bp, Homo sapiens
caagaatcaacattatttagtg

SEQ ID NO: 7470718 - DNA, 22 bp, Homo sapiens
caagaatcagacctgtcagggt

SEQ ID NO: 7470719 - DNA, 22 bp, Homo sapiens
caagaatatatatggagtggag

SEQ ID NO: 7470720 - DNA, 22 bp, Homo sapiens
caagaatataaatactttcaaa

SEQ ID NO: 7470721 - DNA, 22 bp, Homo sapiens
caagaatataaatactttcaaa

SEQ ID NO: 7470722 - DNA, 22 bp, Homo sapiens
caagaatataaatactttcaaa

SEQ ID NO: 7470723 - DNA, 22 bp, Homo sapiens
caagaatagctacctcccatat

SEQ ID NO: 7470724 - DNA, 22 bp, Homo sapiens
caagaatagctacctcccatat

SEQ ID NO: 7470725 - DNA, 22 bp, Homo sapiens
caagaatataaatactttcaaa

SEQ ID NO: 7470726 - DNA, 22 bp, Homo sapiens
caagaatataaatactttcaaa

SEQ ID NO: 7470727 - DNA, 22 bp, Homo sapiens
caagaatataaatactttcaaa

SEQ ID NO: 7470728 - DNA, 22 bp, Homo sapiens
caagaatagctacctcccatat

SEQ ID NO: 7470729 - DNA, 22 bp, Homo sapiens
caagaatagctacctcccatat

SEQ ID NO: 7470730 - DNA, 22 bp, Homo sapiens
caagaataaccagacaatagca

SEQ ID NO: 7470731 - DNA, 22 bp, Homo sapiens
caagaataaccagacaatagca

SEQ ID NO: 7470732 - DNA, 22 bp, Homo sapiens
caagaataaccagacaatagca

SEQ ID NO: 7470733 - DNA, 22 bp, Homo sapiens
caagaataaccagacaatagca

SEQ ID NO: 7470734 - DNA, 22 bp, Homo sapiens
caagaataaccagacaatagca

SEQ ID NO: 7470735 - DNA, 22 bp, Homo sapiens
caagaataaaatacatgttgat

SEQ ID NO: 7470736 - DNA, 22 bp, Homo sapiens
caagaataaaatacatgttgat

SEQ ID NO: 7470737 - DNA, 22 bp, Homo sapiens
caagaataaaatacatgttgat

SEQ ID NO: 7470738 - DNA, 22 bp, Homo sapiens
gctggcccagcgtggggccgtg

SEQ ID NO: 7470739 - DNA, 22 bp, Homo sapiens
gctggcccagcgtggggccgtg

SEQ ID NO: 7470740 - DNA, 22 bp, Homo sapiens
gctggcccagcgtggggccgtg

SEQ ID NO: 7470741 - DNA, 22 bp, Homo sapiens
caagacaagatctaagcatgct

SEQ ID NO: 7470742 - DNA, 22 bp, Homo sapiens
caagacaagatctaagcatgct

SEQ ID NO: 7470743 - DNA, 22 bp, Homo sapiens
caagacaagatctaagcatgct

SEQ ID NO: 7470744 - DNA, 19 bp, Homo sapiens
caagacaaagcccatcttc

SEQ ID NO: 7470745 - DNA, 22 bp, Homo sapiens
caagaattgtacaaactgggtg

SEQ ID NO: 7470746 - DNA, 22 bp, Homo sapiens
caagaattgtacaaactgggtg

SEQ ID NO: 7470747 - DNA, 19 bp, Homo sapiens
caagacaaagcccatcttc

SEQ ID NO: 7470748 - DNA, 19 bp, Homo sapiens
caagacaaagcccatcttc

SEQ ID NO: 7470749 - DNA, 22 bp, Homo sapiens
caagaatcctgttcttgaagat

SEQ ID NO: 7470750 - DNA, 18 bp, Homo sapiens
caagaatctctaaagaag

SEQ ID NO: 7470751 - DNA, 22 bp, Homo sapiens
caagaatcttgcagcttagact

SEQ ID NO: 7470752 - DNA, 22 bp, Homo sapiens
caagaatgaattcaatgtgtgg

SEQ ID NO: 7470753 - DNA, 22 bp, Homo sapiens
caagaatgaattcaatgtgtgg

SEQ ID NO: 7470754 - DNA, 22 bp, Homo sapiens
caagaatgaattcaatgtgtgg

SEQ ID NO: 7470755 - DNA, 22 bp, Homo sapiens
caagaattaagaattttgatgt

SEQ ID NO: 7470756 - DNA, 22 bp, Homo sapiens
caagaattaagaattttgatgt

SEQ ID NO: 7470757 - DNA, 22 bp, Homo sapiens
gctggaattggacccagggctc

SEQ ID NO: 7470758 - DNA, 22 bp, Homo sapiens
gctggaattggacccagggctc

SEQ ID NO: 7470759 - DNA, 22 bp, Homo sapiens
gctggaattagataacattttg

SEQ ID NO: 7470760 - DNA, 20 bp, Homo sapiens
gctggaagggctagagggct

SEQ ID NO: 7470761 - DNA, 20 bp, Homo sapiens
gctggaagggctagagggct

SEQ ID NO: 7470762 - DNA, 22 bp, Homo sapiens
gctggacaggccacatggagga

SEQ ID NO: 7470763 - DNA, 22 bp, Homo sapiens
gctggacaggccacatggagga

SEQ ID NO: 7470764 - DNA, 22 bp, Homo sapiens
gctggacatccatcctgtagaa

SEQ ID NO: 7470765 - DNA, 22 bp, Homo sapiens
gctggacaggccacatggagga

SEQ ID NO: 7470766 - DNA, 22 bp, Homo sapiens
gctggaccaggtgtgcacaggc

SEQ ID NO: 7470767 - DNA, 22 bp, Homo sapiens
gctggactcaggggactcaggg

SEQ ID NO: 7470768 - DNA, 22 bp, Homo sapiens
gctggactagaagcagggctca

SEQ ID NO: 7470769 - DNA, 22 bp, Homo sapiens
gctggactcaggggactcaggg

SEQ ID NO: 7470770 - DNA, 22 bp, Homo sapiens
gctggacttcatgcattcctgt

SEQ ID NO: 7470771 - DNA, 22 bp, Homo sapiens
gctggacttcatgcattcctgt

SEQ ID NO: 7470772 - DNA, 22 bp, Homo sapiens
gctggacttagaggtggaaaag

SEQ ID NO: 7470773 - DNA, 22 bp, Homo sapiens
gctggactcaggggactcaggg

SEQ ID NO: 7470774 - DNA, 22 bp, Homo sapiens
gctggacccggcccctcacctc

SEQ ID NO: 7470775 - DNA, 22 bp, Homo sapiens
gctggactagaagcagggctca

SEQ ID NO: 7470776 - DNA, 22 bp, Homo sapiens
gctggacccggcccctcacctc

SEQ ID NO: 7470777 - DNA, 22 bp, Homo sapiens
gctggagaaacaggaggaggaa

SEQ ID NO: 7470778 - DNA, 22 bp, Homo sapiens
gctggagaaacaggaggaggaa

SEQ ID NO: 7470779 - DNA, 22 bp, Homo sapiens
gctggacttcatgcattcctgt

SEQ ID NO: 7470780 - DNA, 22 bp, Homo sapiens
gctggagaaacaggaggaggaa

SEQ ID NO: 7470781 - DNA, 22 bp, Homo sapiens
gctggagaaacaggaggaggaa

SEQ ID NO: 7470782 - DNA, 22 bp, Homo sapiens
caagaagcaaggtcagggccca

SEQ ID NO: 7470783 - DNA, 22 bp, Homo sapiens
caagaagcccttcctgggtgga

SEQ ID NO: 7470784 - DNA, 22 bp, Homo sapiens
caagaagccgagctacaggctc

SEQ ID NO: 7470785 - DNA, 22 bp, Homo sapiens
caagaagctttccctgcttgca

SEQ ID NO: 7470786 - DNA, 22 bp, Homo sapiens
caagaagctttccctgcttgca

SEQ ID NO: 7470787 - DNA, 22 bp, Homo sapiens
caagaaggctatatgggccagg

SEQ ID NO: 7470788 - DNA, 22 bp, Homo sapiens
caagaaggctatatgggccagg

SEQ ID NO: 7470789 - DNA, 22 bp, Homo sapiens
caagaaggctatatgggccagg

SEQ ID NO: 7470790 - DNA, 22 bp, Homo sapiens
caagaaggctatatgggccagg

SEQ ID NO: 7470791 - DNA, 22 bp, Homo sapiens
caagaaggctatatgggccagg

SEQ ID NO: 7470792 - DNA, 22 bp, Homo sapiens
caagaaggcatccccagtccct

SEQ ID NO: 7470793 - DNA, 22 bp, Homo sapiens
caagaaggcatccccagtccct

SEQ ID NO: 7470794 - DNA, 22 bp, Homo sapiens
caagaagtgtcagctttttaaa

SEQ ID NO: 7470795 - DNA, 22 bp, Homo sapiens
caagaagtgtcagctttttaaa

SEQ ID NO: 7470796 - DNA, 22 bp, Homo sapiens
caagaagttgacagccaggtga

SEQ ID NO: 7470797 - DNA, 22 bp, Homo sapiens
caagaataaaatacatgttgat

SEQ ID NO: 7470798 - DNA, 22 bp, Homo sapiens
caagaagttgacagccaggtga

SEQ ID NO: 7470799 - DNA, 22 bp, Homo sapiens
caagaagttgacagccaggtga

SEQ ID NO: 7470800 - DNA, 22 bp, Homo sapiens
caagaagtcatttagcctctca

SEQ ID NO: 7470801 - DNA, 22 bp, Homo sapiens
caagaagtcatttagcctctca

SEQ ID NO: 7470802 - DNA, 22 bp, Homo sapiens
caagaagtcatttagcctctca

SEQ ID NO: 7470803 - DNA, 22 bp, Homo sapiens
caagaagtgtcagctttttaaa

SEQ ID NO: 7470804 - DNA, 22 bp, Homo sapiens
caacactgacaatggactgatt

SEQ ID NO: 7470805 - DNA, 22 bp, Homo sapiens
caacaccttgatcttggacttc

SEQ ID NO: 7470806 - DNA, 22 bp, Homo sapiens
caacaccttgatcttggacttc

SEQ ID NO: 7470807 - DNA, 22 bp, Homo sapiens
caacaccttgatcttggacttc

SEQ ID NO: 7470808 - DNA, 22 bp, Homo sapiens
caactactggtgctcaggaaat

SEQ ID NO: 7470809 - DNA, 22 bp, Homo sapiens
caactagttttaatgttcatgg

SEQ ID NO: 7470810 - DNA, 22 bp, Homo sapiens
caactatagatcaaatgagttt

SEQ ID NO: 7470811 - DNA, 22 bp, Homo sapiens
caactatagatcaaatgagttt

SEQ ID NO: 7470812 - DNA, 22 bp, Homo sapiens
caactatagatcaaatgagttt

SEQ ID NO: 7470813 - DNA, 22 bp, Homo sapiens
caactacatccacactttgtta

SEQ ID NO: 7470814 - DNA, 22 bp, Homo sapiens
caactacatccacactttgtta

SEQ ID NO: 7470815 - DNA, 22 bp, Homo sapiens
caacactgacaatggactgatt

SEQ ID NO: 7470816 - DNA, 22 bp, Homo sapiens
caactttagcaatgttagtata

SEQ ID NO: 7470817 - DNA, 22 bp, Homo sapiens
caactttagcaatgttagtata

SEQ ID NO: 7470818 - DNA, 22 bp, Homo sapiens
caactttagcaatgttagtata

SEQ ID NO: 7470819 - DNA, 22 bp, Homo sapiens
caactttagaccccaagtagct

SEQ ID NO: 7470820 - DNA, 22 bp, Homo sapiens
caactatatagaaattgattgt

SEQ ID NO: 7470821 - DNA, 22 bp, Homo sapiens
caactatagatcaaatgagttt

SEQ ID NO: 7470822 - DNA, 22 bp, Homo sapiens
caactatagggagagtggttaa

SEQ ID NO: 7470823 - DNA, 22 bp, Homo sapiens
caacaatatgctgagtttttca

SEQ ID NO: 7470824 - DNA, 22 bp, Homo sapiens
caacaatttcccagtttcccat

SEQ ID NO: 7470825 - DNA, 22 bp, Homo sapiens
caacaatttcccagtttcccat

SEQ ID NO: 7470826 - DNA, 22 bp, Homo sapiens
caacaatgaatgtttgagtgcc

SEQ ID NO: 7470827 - DNA, 22 bp, Homo sapiens
caacacaggggttatgccatgg

SEQ ID NO: 7470828 - DNA, 22 bp, Homo sapiens
caacacaggggttatgccatgg

SEQ ID NO: 7470829 - DNA, 22 bp, Homo sapiens
caacacaggttctgcaaaggaa

SEQ ID NO: 7470830 - DNA, 22 bp, Homo sapiens
caacacaggttctgcaaaggaa

SEQ ID NO: 7470831 - DNA, 22 bp, Homo sapiens
caacacaggttctgcaaaggaa

SEQ ID NO: 7470832 - DNA, 22 bp, Homo sapiens
caacacaggggttatgccatgg

SEQ ID NO: 7470833 - DNA, 22 bp, Homo sapiens
caacacaggttctgcaaaggaa

SEQ ID NO: 7470834 - DNA, 22 bp, Homo sapiens
caacacaggttctgcaaaggaa

SEQ ID NO: 7470835 - DNA, 22 bp, Homo sapiens
caacacaggggttatgccatgg

SEQ ID NO: 7470836 - DNA, 22 bp, Homo sapiens
caacacattgaagctatgatga

SEQ ID NO: 7470837 - DNA, 22 bp, Homo sapiens
caacacattgaagctatgatga

SEQ ID NO: 7470838 - DNA, 22 bp, Homo sapiens
caacacattgaagctatgatga

SEQ ID NO: 7470839 - DNA, 22 bp, Homo sapiens
caacacattgaagctatgatga

SEQ ID NO: 7470840 - DNA, 22 bp, Homo sapiens
caacaagcgctcagagcaaagc

SEQ ID NO: 7470841 - DNA, 22 bp, Homo sapiens
caacaacatgggattcatttct

SEQ ID NO: 7470842 - DNA, 22 bp, Homo sapiens
caacaagcgctcagagcaaagc

SEQ ID NO: 7470843 - DNA, 22 bp, Homo sapiens
caacaacatgggattcatttct

SEQ ID NO: 7470844 - DNA, 22 bp, Homo sapiens
caaattttgtgtgttctctagt

SEQ ID NO: 7470845 - DNA, 22 bp, Homo sapiens
caaattttgtgtgttctctagt

SEQ ID NO: 7470846 - DNA, 22 bp, Homo sapiens
caaattttgtgtgttctctagt

SEQ ID NO: 7470847 - DNA, 22 bp, Homo sapiens
caaattttgtgtgttctctagt

SEQ ID NO: 7470848 - DNA, 22 bp, Homo sapiens
caacaagtgttcgtaaagtgcc

SEQ ID NO: 7470849 - DNA, 22 bp, Homo sapiens
caacaagtgggtactttacagg

SEQ ID NO: 7470850 - DNA, 22 bp, Homo sapiens
caacaagggacagtgttctaaa

SEQ ID NO: 7470851 - DNA, 22 bp, Homo sapiens
caacaatatgccagactcaatt

SEQ ID NO: 7470852 - DNA, 22 bp, Homo sapiens
caacaatatgctgagtttttca

SEQ ID NO: 7470853 - DNA, 22 bp, Homo sapiens
caacaatatgccagactcaatt

SEQ ID NO: 7470854 - DNA, 22 bp, Homo sapiens
caacaatatgctgagtttttca

SEQ ID NO: 7470855 - DNA, 22 bp, Homo sapiens
caacaatatgctgagtttttca

SEQ ID NO: 7470856 - DNA, 22 bp, Homo sapiens
gctgccctgtccggctctcctg

SEQ ID NO: 7470857 - DNA, 22 bp, Homo sapiens
gctgccctgtctgcagcaggac

SEQ ID NO: 7470858 - DNA, 22 bp, Homo sapiens
gctgccctgtctgcagcaggac

SEQ ID NO: 7470859 - DNA, 22 bp, Homo sapiens
gctgccctgtctgcagcaggac

SEQ ID NO: 7470860 - DNA, 22 bp, Homo sapiens
gctgccctgtctgcagcaggac

SEQ ID NO: 7470861 - DNA, 22 bp, Homo sapiens
gctgccctgtccggctctcctg

SEQ ID NO: 7470862 - DNA, 22 bp, Homo sapiens
gctgccctgtccggctctcctg

SEQ ID NO: 7470863 - DNA, 22 bp, Homo sapiens
gctgccctgtccggctctcctg

SEQ ID NO: 7470864 - DNA, 22 bp, Homo sapiens
gctgccctgtccggctctcctg

SEQ ID NO: 7470865 - DNA, 22 bp, Homo sapiens
caaattttgtgtgttctctagt

SEQ ID NO: 7470866 - DNA, 22 bp, Homo sapiens
caaattttgtgtgttctctagt

SEQ ID NO: 7470867 - DNA, 22 bp, Homo sapiens
caaattttgtgtgttctctagt

SEQ ID NO: 7470868 - DNA, 22 bp, Homo sapiens
caaattttgtgtgttctctagt

SEQ ID NO: 7470869 - DNA, 22 bp, Homo sapiens
caaattttgtgtgttctctagt

SEQ ID NO: 7470870 - DNA, 22 bp, Homo sapiens
gctgccctgtctgcagcaggac

SEQ ID NO: 7470871 - DNA, 22 bp, Homo sapiens
gctgccctgtctgcagcaggac

SEQ ID NO: 7470872 - DNA, 22 bp, Homo sapiens
gctgccctgtctgcagcaggac

SEQ ID NO: 7470873 - DNA, 22 bp, Homo sapiens
caaatttaggtaacagtctgta

SEQ ID NO: 7470874 - DNA, 22 bp, Homo sapiens
caagaaattctgttcagatagc

SEQ ID NO: 7470875 - DNA, 22 bp, Homo sapiens
caagaaattctgttcagatagc

SEQ ID NO: 7470876 - DNA, 22 bp, Homo sapiens
caagaaattctgttcagatagc

SEQ ID NO: 7470877 - DNA, 22 bp, Homo sapiens
caagaaattctgttcagatagc

SEQ ID NO: 7470878 - DNA, 22 bp, Homo sapiens
caagaaattctgttcagatagc

SEQ ID NO: 7470879 - DNA, 22 bp, Homo sapiens
caagaaattctgttcagatagc

SEQ ID NO: 7470880 - DNA, 22 bp, Homo sapiens
caagaaattctgttcagatagc

SEQ ID NO: 7470881 - DNA, 22 bp, Homo sapiens
caagaaattctgttcagatagc

SEQ ID NO: 7470882 - DNA, 22 bp, Homo sapiens
caagaaatgtttactgagcatc

SEQ ID NO: 7470883 - DNA, 22 bp, Homo sapiens
caagaaatggggaggggagttg

SEQ ID NO: 7470884 - DNA, 22 bp, Homo sapiens
caagaaatggggaggggagttg

SEQ ID NO: 7470885 - DNA, 22 bp, Homo sapiens
caagaaatgggatttgactgcc

SEQ ID NO: 7470886 - DNA, 22 bp, Homo sapiens
caagaaatgtttactgagcatc

SEQ ID NO: 7470887 - DNA, 22 bp, Homo sapiens
caagaaatgtttactgagcatc

SEQ ID NO: 7470888 - DNA, 22 bp, Homo sapiens
caagaaatctagaagtcagtgg

SEQ ID NO: 7470889 - DNA, 22 bp, Homo sapiens
caagaaatgggatttgactgcc

SEQ ID NO: 7470890 - DNA, 22 bp, Homo sapiens
caagaaatgggatttgactgcc

SEQ ID NO: 7470891 - DNA, 22 bp, Homo sapiens
caagaaatgggatttgactgcc

SEQ ID NO: 7470892 - DNA, 22 bp, Homo sapiens
caagaaatgggatttgactgcc

SEQ ID NO: 7470893 - DNA, 22 bp, Homo sapiens
caagaaatctagaagtcagtgg

SEQ ID NO: 7470894 - DNA, 22 bp, Homo sapiens
caagaaactttattctgccata

SEQ ID NO: 7470895 - DNA, 22 bp, Homo sapiens
caagaaactttattctgccata

SEQ ID NO: 7470896 - DNA, 22 bp, Homo sapiens
caactttctgttaaatgttagt

SEQ ID NO: 7470897 - DNA, 22 bp, Homo sapiens
caactttggccccttcctagct

SEQ ID NO: 7470898 - DNA, 22 bp, Homo sapiens
caactttctgttaaatgttagt

SEQ ID NO: 7470899 - DNA, 22 bp, Homo sapiens
caacttttctgtgaatttaagt

SEQ ID NO: 7470900 - DNA, 22 bp, Homo sapiens
caactttgtgtgacctagatag

SEQ ID NO: 7470901 - DNA, 22 bp, Homo sapiens
caactttgtgtgacctagatag

SEQ ID NO: 7470902 - DNA, 22 bp, Homo sapiens
caactttctccaagtacaagaa

SEQ ID NO: 7470903 - DNA, 22 bp, Homo sapiens
caactttctccaagtacaagaa

SEQ ID NO: 7470904 - DNA, 22 bp, Homo sapiens
caactttatgattggtttgtca

SEQ ID NO: 7470905 - DNA, 22 bp, Homo sapiens
caactttatgattggtttgtca

SEQ ID NO: 7470906 - DNA, 22 bp, Homo sapiens
caactttcacactccacatgct

SEQ ID NO: 7470907 - DNA, 22 bp, Homo sapiens
caactttcacactccacatgct

SEQ ID NO: 7470908 - DNA, 22 bp, Homo sapiens
caactttcacactccacatgct

SEQ ID NO: 7470909 - DNA, 23 bp, Homo sapiens
caacttttggctacatgcttagc

SEQ ID NO: 7470910 - DNA, 22 bp, Homo sapiens
caagaaacaccaatgactgctg

SEQ ID NO: 7470911 - DNA, 23 bp, Homo sapiens
caacttttggctacatgcttagc

SEQ ID NO: 7470912 - DNA, 22 bp, Homo sapiens
caagaaacaccaatgactgctg

SEQ ID NO: 7470913 - DNA, 22 bp, Homo sapiens
caagaaacaccaatgactgctg

SEQ ID NO: 7470914 - DNA, 23 bp, Homo sapiens
caacttttggctacatgcttagc

SEQ ID NO: 7470915 - DNA, 22 bp, Homo sapiens
caacttttgacacgtgtgctaa

SEQ ID NO: 7470916 - DNA, 22 bp, Homo sapiens
caacttttctgtgaatttaagt

SEQ ID NO: 7470917 - DNA, 22 bp, Homo sapiens
caacttttctgtgaatttaagt

SEQ ID NO: 7470918 - DNA, 22 bp, Homo sapiens
gctgcctgcacagagctgcttt

SEQ ID NO: 7470919 - DNA, 22 bp, Homo sapiens
gctgcctgcacagagctgcttt

SEQ ID NO: 7470920 - DNA, 22 bp, Homo sapiens
gctgcctgcacagagctgcttt

SEQ ID NO: 7470921 - DNA, 22 bp, Homo sapiens
gctgcctgcacagagctgcttt

SEQ ID NO: 7470922 - DNA, 22 bp, Homo sapiens
gctgcctgcacagagctgcttt

SEQ ID NO: 7470923 - DNA, 22 bp, Homo sapiens
gctgcctgcacagagctgcttt

SEQ ID NO: 7470924 - DNA, 22 bp, Homo sapiens
gctgcctgcacagagctgcttt

SEQ ID NO: 7470925 - DNA, 17 bp, Homo sapiens
gctgcctgcaactgact

SEQ ID NO: 7470926 - DNA, 17 bp, Homo sapiens
gctgcctgcaactgact

SEQ ID NO: 7470927 - DNA, 17 bp, Homo sapiens
gctgcctgcaactgact

SEQ ID NO: 7470928 - DNA, 22 bp, Homo sapiens
gctgcctgatttacatagtgaa

SEQ ID NO: 7470929 - DNA, 22 bp, Homo sapiens
gctgcctgatttacatagtgaa

SEQ ID NO: 7470930 - DNA, 22 bp, Homo sapiens
gctgcctgatttacatagtgaa

SEQ ID NO: 7470931 - DNA, 22 bp, Homo sapiens
gctgcctgatgtccagcaggac

SEQ ID NO: 7470932 - DNA, 22 bp, Homo sapiens
gctgcctgatgtccagcaggac

SEQ ID NO: 7470933 - DNA, 22 bp, Homo sapiens
gctgcctgatgtccagcaggac

SEQ ID NO: 7470934 - DNA, 22 bp, Homo sapiens
gctgcctgatgtccagcaggac

SEQ ID NO: 7470935 - DNA, 22 bp, Homo sapiens
gctgcctgatgtccagcaggac

SEQ ID NO: 7470936 - DNA, 22 bp, Homo sapiens
gctgcctgatgtccagcaggac

SEQ ID NO: 7470937 - DNA, 22 bp, Homo sapiens
caagaacattgtgatcacttca

SEQ ID NO: 7470938 - DNA, 22 bp, Homo sapiens
caagaacattgtgatcacttca

SEQ ID NO: 7470939 - DNA, 22 bp, Homo sapiens
caagaacattgtgatcacttca

SEQ ID NO: 7470940 - DNA, 22 bp, Homo sapiens
caagaacattgtgatcacttca

SEQ ID NO: 7470941 - DNA, 22 bp, Homo sapiens
caagaaccgcaattacttttgc

SEQ ID NO: 7470942 - DNA, 22 bp, Homo sapiens
caagaaccgcaattacttttgc

SEQ ID NO: 7470943 - DNA, 22 bp, Homo sapiens
caagaacattgtgatcacttca

SEQ ID NO: 7470944 - DNA, 22 bp, Homo sapiens
caagaaatttcttaagaactaa

SEQ ID NO: 7470945 - DNA, 22 bp, Homo sapiens
caagaacagtttgccaaattgg

SEQ ID NO: 7470946 - DNA, 22 bp, Homo sapiens
caagaacagtttgccaaattgg

SEQ ID NO: 7470947 - DNA, 22 bp, Homo sapiens
caagaacagtttgccaaattgg

SEQ ID NO: 7470948 - DNA, 22 bp, Homo sapiens
caagaaatttcttaagaactaa

SEQ ID NO: 7470949 - DNA, 22 bp, Homo sapiens
caagaaatttcttaagaactaa

SEQ ID NO: 7470950 - DNA, 22 bp, Homo sapiens
caagaaattctgttcagatagc

SEQ ID NO: 7470951 - DNA, 22 bp, Homo sapiens
caagaaattctgttcagatagc

SEQ ID NO: 7470952 - DNA, 22 bp, Homo sapiens
caagaaatttcttaagaactaa

SEQ ID NO: 7470953 - DNA, 22 bp, Homo sapiens
caagaaatttcttaagaactaa

SEQ ID NO: 7470954 - DNA, 22 bp, Homo sapiens
caagaaatttcttaagaactaa

SEQ ID NO: 7470955 - DNA, 22 bp, Homo sapiens
caagaaatttcttaagaactaa

SEQ ID NO: 7470956 - DNA, 22 bp, Homo sapiens
caagaaatttcttaagaactaa

SEQ ID NO: 7470957 - DNA, 22 bp, Homo sapiens
gctgccctgcctcagactcctc

SEQ ID NO: 7470958 - DNA, 22 bp, Homo sapiens
gctgccctgcctcagactcctc

SEQ ID NO: 7470959 - DNA, 22 bp, Homo sapiens
gctgccctgcatctgtgccttc

SEQ ID NO: 7470960 - DNA, 22 bp, Homo sapiens
gctgccctgcctcagactcctc

SEQ ID NO: 7470961 - DNA, 22 bp, Homo sapiens
gctgccctgcctcagactcctc

SEQ ID NO: 7470962 - DNA, 22 bp, Homo sapiens
gctgccctgcctcagactcctc

SEQ ID NO: 7470963 - DNA, 21 bp, Homo sapiens
gctgccctggctcagcattca

SEQ ID NO: 7470964 - DNA, 21 bp, Homo sapiens
gctgccctggctcagcattca

SEQ ID NO: 7470965 - DNA, 21 bp, Homo sapiens
gctgccctggctcagcattca

SEQ ID NO: 7470966 - DNA, 22 bp, Homo sapiens
gctgccctgtccggctctcctg

SEQ ID NO: 7470967 - DNA, 21 bp, Homo sapiens
gctgccctggctcagcattca

SEQ ID NO: 7470968 - DNA, 21 bp, Homo sapiens
gctgccctggctcagcattca

SEQ ID NO: 7470969 - DNA, 22 bp, Homo sapiens
gctgccctgactccagcagcct

SEQ ID NO: 7470970 - DNA, 22 bp, Homo sapiens
gctgccctgactccagcagcct

SEQ ID NO: 7470971 - DNA, 22 bp, Homo sapiens
gctgccctgactccagcagcct

SEQ ID NO: 7470972 - DNA, 22 bp, Homo sapiens
gctgccctgactccagcagcct

SEQ ID NO: 7470973 - DNA, 22 bp, Homo sapiens
gctgccctgactccagcagcct

SEQ ID NO: 7470974 - DNA, 22 bp, Homo sapiens
gctgccctgactccagcagcct

SEQ ID NO: 7470975 - DNA, 22 bp, Homo sapiens
gctgccctgcatctgtgccttc

SEQ ID NO: 7470976 - DNA, 22 bp, Homo sapiens
gctgccctgcatctgtgccttc

SEQ ID NO: 7470977 - DNA, 22 bp, Homo sapiens
gctgccctgcatctgtgccttc

SEQ ID NO: 7470978 - DNA, 22 bp, Homo sapiens
gctgccctcccagggcaagctt

SEQ ID NO: 7470979 - DNA, 22 bp, Homo sapiens
gctgccctcccagggcaagctt

SEQ ID NO: 7470980 - DNA, 22 bp, Homo sapiens
gctgccctctctggccccacac

SEQ ID NO: 7470981 - DNA, 22 bp, Homo sapiens
gctgccctctctggccccacac

SEQ ID NO: 7470982 - DNA, 22 bp, Homo sapiens
gctgccctctgtgacccggccc

SEQ ID NO: 7470983 - DNA, 22 bp, Homo sapiens
gctgccctctgtgacccggccc

SEQ ID NO: 7470984 - DNA, 22 bp, Homo sapiens
gctgccctctgtgacccggccc

SEQ ID NO: 7470985 - DNA, 22 bp, Homo sapiens
gctgccctctgtgacccggccc

SEQ ID NO: 7470986 - DNA, 22 bp, Homo sapiens
gctgccctgacaagctactccc

SEQ ID NO: 7470987 - DNA, 22 bp, Homo sapiens
gctgccctgactccagcagcct

SEQ ID NO: 7470988 - DNA, 22 bp, Homo sapiens
gctgccctgacaagctactccc

SEQ ID NO: 7470989 - DNA, 22 bp, Homo sapiens
gctgccctctgtgtttgtcctt

SEQ ID NO: 7470990 - DNA, 22 bp, Homo sapiens
gctgccctctgtgtttgtcctt

SEQ ID NO: 7470991 - DNA, 22 bp, Homo sapiens
gctgccctctgtgtttgtcctt

SEQ ID NO: 7470992 - DNA, 22 bp, Homo sapiens
gctgccctgacaagctactccc

SEQ ID NO: 7470993 - DNA, 22 bp, Homo sapiens
gctgccctgacaagctactccc

SEQ ID NO: 7470994 - DNA, 22 bp, Homo sapiens
gctgccctgacaagctactccc

SEQ ID NO: 7470995 - DNA, 22 bp, Homo sapiens
gctgccctgacaagctactccc

SEQ ID NO: 7470996 - DNA, 22 bp, Homo sapiens
gctgccctgacaagctactccc

SEQ ID NO: 7470997 - DNA, 22 bp, Homo sapiens
gctgccacgatctctgctgtag

SEQ ID NO: 7470998 - DNA, 22 bp, Homo sapiens
gctgccacgatctctgctgtag

SEQ ID NO: 7470999 - DNA, 17 bp, Homo sapiens
gctgccacctttggagc

SEQ ID NO: 7471000 - DNA, 22 bp, Homo sapiens
gctgccacgaggtttccttatc

SEQ ID NO: 7471001 - DNA, 22 bp, Homo sapiens
caaagtgctggaattacaggtg

SEQ ID NO: 7471002 - DNA, 22 bp, Homo sapiens
caaagtgctggaattacaggtg

SEQ ID NO: 7471003 - DNA, 17 bp, Homo sapiens
gctgccacctttggagc

SEQ ID NO: 7471004 - DNA, 22 bp, Homo sapiens
caaagtgctaggattataggtg

SEQ ID NO: 7471005 - DNA, 22 bp, Homo sapiens
caaagtgctaggattataggtg

SEQ ID NO: 7471006 - DNA, 22 bp, Homo sapiens
caaagtgctaggattataggtg

SEQ ID NO: 7471007 - DNA, 22 bp, Homo sapiens
caaagtgctaggattacaggcg

SEQ ID NO: 7471008 - DNA, 22 bp, Homo sapiens
caaagtgctaggattacaggcg

SEQ ID NO: 7471009 - DNA, 22 bp, Homo sapiens
caaagtgctaggattacaggcg

SEQ ID NO: 7471010 - DNA, 22 bp, Homo sapiens
caaagtgctaggattacaggcg

SEQ ID NO: 7471011 - DNA, 22 bp, Homo sapiens
gctgccctcccagggcaagctt

SEQ ID NO: 7471012 - DNA, 22 bp, Homo sapiens
gctgccctccagttcccacagt

SEQ ID NO: 7471013 - DNA, 18 bp, Homo sapiens
gctgccctagctcccctc

SEQ ID NO: 7471014 - DNA, 22 bp, Homo sapiens
gctgccctccagttcccacagt

SEQ ID NO: 7471015 - DNA, 22 bp, Homo sapiens
gctgccctccagttcccacagt

SEQ ID NO: 7471016 - DNA, 22 bp, Homo sapiens
gctgccctccagttcccacagt

SEQ ID NO: 7471017 - DNA, 22 bp, Homo sapiens
gctgccacgatctctgctgtag

SEQ ID NO: 7471018 - DNA, 22 bp, Homo sapiens
gctgccacgatctctgctgtag

SEQ ID NO: 7471019 - DNA, 22 bp, Homo sapiens
caaagtgagagaatggcagaaa

SEQ ID NO: 7471020 - DNA, 22 bp, Homo sapiens
caaagtgagagaatggcagaaa

SEQ ID NO: 7471021 - DNA, 22 bp, Homo sapiens
caaagtgagagaatggcagaaa

SEQ ID NO: 7471022 - DNA, 22 bp, Homo sapiens
caaagtgagagaatggcagaaa

SEQ ID NO: 7471023 - DNA, 22 bp, Homo sapiens
caaagtgagagaatggcagaaa

SEQ ID NO: 7471024 - DNA, 22 bp, Homo sapiens
caaagtgcagaaggaactgggt

SEQ ID NO: 7471025 - DNA, 22 bp, Homo sapiens
caaagtgcctgtaccactttgc

SEQ ID NO: 7471026 - DNA, 22 bp, Homo sapiens
caaagtgcagaaggaactgggt

SEQ ID NO: 7471027 - DNA, 22 bp, Homo sapiens
caaagtgagttataaacatctt

SEQ ID NO: 7471028 - DNA, 22 bp, Homo sapiens
caaagtgcagaaggaactgggt

SEQ ID NO: 7471029 - DNA, 22 bp, Homo sapiens
caaagtgcctgtaccactttgc

SEQ ID NO: 7471030 - DNA, 22 bp, Homo sapiens
caaagtgctaggattacaggcc

SEQ ID NO: 7471031 - DNA, 22 bp, Homo sapiens
caaagtgctaggattacaggcc

SEQ ID NO: 7471032 - DNA, 22 bp, Homo sapiens
caaagtgcctgtaccactttgc

SEQ ID NO: 7471033 - DNA, 22 bp, Homo sapiens
caaagtgctaggattacaggcc

SEQ ID NO: 7471034 - DNA, 22 bp, Homo sapiens
caaagtgctaggattacaggcc

SEQ ID NO: 7471035 - DNA, 22 bp, Homo sapiens
caaagtgctaggattacaggcc

SEQ ID NO: 7471036 - DNA, 22 bp, Homo sapiens
caaagtgctaggattacaggcc

SEQ ID NO: 7471037 - DNA, 22 bp, Homo sapiens
caaagtgctaggattacaggcg

SEQ ID NO: 7471038 - DNA, 22 bp, Homo sapiens
caaagtgctaggattacaggcg

SEQ ID NO: 7471039 - DNA, 22 bp, Homo sapiens
caaagtcttctcattatgtctt

SEQ ID NO: 7471040 - DNA, 22 bp, Homo sapiens
caaagtcttctcattatgtctt

SEQ ID NO: 7471041 - DNA, 22 bp, Homo sapiens
caaagtcttctcattatgtctt

SEQ ID NO: 7471042 - DNA, 22 bp, Homo sapiens
caaagtcttggtgatcaacttt

SEQ ID NO: 7471043 - DNA, 22 bp, Homo sapiens
caaagtcttggtgatcaacttt

SEQ ID NO: 7471044 - DNA, 22 bp, Homo sapiens
caaagtcttcagttgattctga

SEQ ID NO: 7471045 - DNA, 22 bp, Homo sapiens
caaagtcctagaacagtgcttg

SEQ ID NO: 7471046 - DNA, 22 bp, Homo sapiens
caaagtcttcagttgattctga

SEQ ID NO: 7471047 - DNA, 22 bp, Homo sapiens
caaagtcttcagttgattctga

SEQ ID NO: 7471048 - DNA, 22 bp, Homo sapiens
caaagtcctagaacagtgcttg

SEQ ID NO: 7471049 - DNA, 22 bp, Homo sapiens
caaagtcccagctgcttagaga

SEQ ID NO: 7471050 - DNA, 22 bp, Homo sapiens
caaagtcatggggatgcaggtc

SEQ ID NO: 7471051 - DNA, 22 bp, Homo sapiens
caaagtcatggggatgcaggtc

SEQ ID NO: 7471052 - DNA, 22 bp, Homo sapiens
caaagtcatggggatgcaggtc

SEQ ID NO: 7471053 - DNA, 22 bp, Homo sapiens
caaagtcatggggatgcaggtc

SEQ ID NO: 7471054 - DNA, 22 bp, Homo sapiens
caaagtcataaaacttgtaagt

SEQ ID NO: 7471055 - DNA, 22 bp, Homo sapiens
caaagtcataaaacttgtaagt

SEQ ID NO: 7471056 - DNA, 22 bp, Homo sapiens
caaagtcatggggatgcaggtc

SEQ ID NO: 7471057 - DNA, 22 bp, Homo sapiens
caaagtcataaaacttgtaagt

SEQ ID NO: 7471058 - DNA, 22 bp, Homo sapiens
caaagtcataaaacttgtaagt

SEQ ID NO: 7471059 - DNA, 22 bp, Homo sapiens
caaagtcagggaagagtggctg

SEQ ID NO: 7471060 - DNA, 22 bp, Homo sapiens
caaagtcagggaagagtggctg

SEQ ID NO: 7471061 - DNA, 22 bp, Homo sapiens
caaagtcagggaagagtggctg

SEQ ID NO: 7471062 - DNA, 22 bp, Homo sapiens
caaagtcagccagctagtaggt

SEQ ID NO: 7471063 - DNA, 22 bp, Homo sapiens
caaagtcagctgccagtcccaa

SEQ ID NO: 7471064 - DNA, 23 bp, Homo sapiens
gctctggagctgggcctggcagg

SEQ ID NO: 7471065 - DNA, 23 bp, Homo sapiens
gctctggagctgggcctggcagg

SEQ ID NO: 7471066 - DNA, 23 bp, Homo sapiens
gctctggagctgggcctggcagg

SEQ ID NO: 7471067 - DNA, 22 bp, Homo sapiens
gctctggaggctggaagaccat

SEQ ID NO: 7471068 - DNA, 22 bp, Homo sapiens
gctctggatccggctgggtctg

SEQ ID NO: 7471069 - DNA, 22 bp, Homo sapiens
gctctggatccggctgggtctg

SEQ ID NO: 7471070 - DNA, 22 bp, Homo sapiens
caaagtcagctgccagtcccaa

SEQ ID NO: 7471071 - DNA, 22 bp, Homo sapiens
caaagtcagccagctagtaggt

SEQ ID NO: 7471072 - DNA, 22 bp, Homo sapiens
caaagtcagccagctagtaggt

SEQ ID NO: 7471073 - DNA, 22 bp, Homo sapiens
caaagtcagccagctagtaggt

SEQ ID NO: 7471074 - DNA, 22 bp, Homo sapiens
caaagtatgaaccagtttctct

SEQ ID NO: 7471075 - DNA, 17 bp, Homo sapiens
gctctggcacaggattg

SEQ ID NO: 7471076 - DNA, 17 bp, Homo sapiens
gctctggcacaggattg

SEQ ID NO: 7471077 - DNA, 17 bp, Homo sapiens
gctctggcacaggattg

SEQ ID NO: 7471078 - DNA, 22 bp, Homo sapiens
gctctggatccggctgggtctg

SEQ ID NO: 7471079 - DNA, 22 bp, Homo sapiens
gctctgcttgcatcatgactgc

SEQ ID NO: 7471080 - DNA, 22 bp, Homo sapiens
gctctgcttgcatcatgactgc

SEQ ID NO: 7471081 - DNA, 22 bp, Homo sapiens
gctctgctttctggggggatcc

SEQ ID NO: 7471082 - DNA, 22 bp, Homo sapiens
gctctgctttctggggggatcc

SEQ ID NO: 7471083 - DNA, 22 bp, Homo sapiens
gctctgctgtgtttgttcagca

SEQ ID NO: 7471084 - DNA, 22 bp, Homo sapiens
gctctgctgtgtttgttcagca

SEQ ID NO: 7471085 - DNA, 22 bp, Homo sapiens
gctctgcttgcatcatgactgc

SEQ ID NO: 7471086 - DNA, 22 bp, Homo sapiens
gctctgcttgcatcatgactgc

SEQ ID NO: 7471087 - DNA, 22 bp, Homo sapiens
gctctggaccctgccagcctta

SEQ ID NO: 7471088 - DNA, 22 bp, Homo sapiens
gctctggaagcatctgagagga

SEQ ID NO: 7471089 - DNA, 22 bp, Homo sapiens
gctctggaagcatctgagagga

SEQ ID NO: 7471090 - DNA, 22 bp, Homo sapiens
gctctggaagcatctgagagga

SEQ ID NO: 7471091 - DNA, 22 bp, Homo sapiens
gctctggaagcatctgagagga

SEQ ID NO: 7471092 - DNA, 22 bp, Homo sapiens
gctctggaagcatctgagagga

SEQ ID NO: 7471093 - DNA, 22 bp, Homo sapiens
gctctggaacctgccaggatgc

SEQ ID NO: 7471094 - DNA, 22 bp, Homo sapiens
gctctggaacctgccaggatgc

SEQ ID NO: 7471095 - DNA, 23 bp, Homo sapiens
gctctggagctgggcctggcagg

SEQ ID NO: 7471096 - DNA, 22 bp, Homo sapiens
gctctggagcactggaaacact

SEQ ID NO: 7471097 - DNA, 22 bp, Homo sapiens
gctctggagcactggaaacact

SEQ ID NO: 7471098 - DNA, 22 bp, Homo sapiens
gctctggagcactggaaacact

SEQ ID NO: 7471099 - DNA, 22 bp, Homo sapiens
gctctggagatggagccttgag

SEQ ID NO: 7471100 - DNA, 22 bp, Homo sapiens
gctctggagatggagccttgag

SEQ ID NO: 7471101 - DNA, 22 bp, Homo sapiens
gctctggagatggagccttgag

SEQ ID NO: 7471102 - DNA, 22 bp, Homo sapiens
gctctggactggggcctgagaa

SEQ ID NO: 7471103 - DNA, 22 bp, Homo sapiens
gctctggagagccataggccct

SEQ ID NO: 7471104 - DNA, 22 bp, Homo sapiens
gctctggagagccataggccct

SEQ ID NO: 7471105 - DNA, 22 bp, Homo sapiens
gctctggagatggagccttgag

SEQ ID NO: 7471106 - DNA, 22 bp, Homo sapiens
gctctggaccctggagtggctg

SEQ ID NO: 7471107 - DNA, 22 bp, Homo sapiens
gctctggaccctgccagcctta

SEQ ID NO: 7471108 - DNA, 22 bp, Homo sapiens
gctctggactggggcctgagaa

SEQ ID NO: 7471109 - DNA, 22 bp, Homo sapiens
gctctggactggggcctgagaa

SEQ ID NO: 7471110 - DNA, 22 bp, Homo sapiens
gctctggactggggcctgagaa

SEQ ID NO: 7471111 - DNA, 22 bp, Homo sapiens
gctctggaccctggagtggctg

SEQ ID NO: 7471112 - DNA, 22 bp, Homo sapiens
gctctggactggggcctgagaa

SEQ ID NO: 7471113 - DNA, 22 bp, Homo sapiens
gctctggactggggcctgagaa

SEQ ID NO: 7471114 - DNA, 22 bp, Homo sapiens
ggcaagtaatacaggattattt

SEQ ID NO: 7471115 - DNA, 22 bp, Homo sapiens
ggcaagggttgaagataaggta

SEQ ID NO: 7471116 - DNA, 22 bp, Homo sapiens
ggcaagggttgaagataaggta

SEQ ID NO: 7471117 - DNA, 22 bp, Homo sapiens
ggcaagggttgaagataaggta

SEQ ID NO: 7471118 - DNA, 22 bp, Homo sapiens
ggcaagggttgaagataaggta

SEQ ID NO: 7471119 - DNA, 22 bp, Homo sapiens
ggcaagggttgaagataaggta

SEQ ID NO: 7471120 - DNA, 22 bp, Homo sapiens
ggcaaggtactctagagcacat

SEQ ID NO: 7471121 - DNA, 22 bp, Homo sapiens
ggcaagtgatcctggagcaccg

SEQ ID NO: 7471122 - DNA, 22 bp, Homo sapiens
ggcaagtgatcctggagcaccg

SEQ ID NO: 7471123 - DNA, 22 bp, Homo sapiens
ggcaagtatttgtgcatctaca

SEQ ID NO: 7471124 - DNA, 22 bp, Homo sapiens
ggcaagtgatcctggagcaccg

SEQ ID NO: 7471125 - DNA, 22 bp, Homo sapiens
ggcaagtgatcctggagcaccg

SEQ ID NO: 7471126 - DNA, 22 bp, Homo sapiens
ggcaagtgcttccccaaccaca

SEQ ID NO: 7471127 - DNA, 22 bp, Homo sapiens
ggcaagtggaggtgttcatcag

SEQ ID NO: 7471128 - DNA, 22 bp, Homo sapiens
ggcaagtggaggtgttcatcag

SEQ ID NO: 7471129 - DNA, 22 bp, Homo sapiens
ggcaagtggaggtgttcatcag

SEQ ID NO: 7471130 - DNA, 22 bp, Homo sapiens
ggcaagtggtagaacatctgag

SEQ ID NO: 7471131 - DNA, 22 bp, Homo sapiens
ggcaaggggtcaggctgagaca

SEQ ID NO: 7471132 - DNA, 22 bp, Homo sapiens
ggcaaggggtcaggctgagaca

SEQ ID NO: 7471133 - DNA, 22 bp, Homo sapiens
ggcaaggggtcaggctgagaca

SEQ ID NO: 7471134 - DNA, 22 bp, Homo sapiens
ggcaaggggtcaggctgagaca

SEQ ID NO: 7471135 - DNA, 22 bp, Homo sapiens
ggcaaggggtcaggctgagaca

SEQ ID NO: 7471136 - DNA, 22 bp, Homo sapiens
ggcaaggggtcaggctgagaca

SEQ ID NO: 7471137 - DNA, 22 bp, Homo sapiens
ggcaaggggtcaggctgagaca

SEQ ID NO: 7471138 - DNA, 22 bp, Homo sapiens
ggcaaggggtcaggctgagaca

SEQ ID NO: 7471139 - DNA, 22 bp, Homo sapiens
ggcaaggggtcaggctgagaca

SEQ ID NO: 7471140 - DNA, 22 bp, Homo sapiens
cacagtgcatgatgggcagaag

SEQ ID NO: 7471141 - DNA, 22 bp, Homo sapiens
cacagtgcatgatgggcagaag

SEQ ID NO: 7471142 - DNA, 22 bp, Homo sapiens
cacagtgcatgatgggcagaag

SEQ ID NO: 7471143 - DNA, 22 bp, Homo sapiens
cacagtgcatgatgggcagaag

SEQ ID NO: 7471144 - DNA, 22 bp, Homo sapiens
ggcaaggggtcaggctgagaca

SEQ ID NO: 7471145 - DNA, 22 bp, Homo sapiens
ggcaaggggtcaggctgagaca

SEQ ID NO: 7471146 - DNA, 22 bp, Homo sapiens
ggcaaggggtcaggctgagaca

SEQ ID NO: 7471147 - DNA, 22 bp, Homo sapiens
ggcaagggacggccgtgagaca

SEQ ID NO: 7471148 - DNA, 22 bp, Homo sapiens
cacagtgcgaaagaaacccagc

SEQ ID NO: 7471149 - DNA, 22 bp, Homo sapiens
cacagtgcgaaagaaacccagc

SEQ ID NO: 7471150 - DNA, 22 bp, Homo sapiens
cacagtgcatgatgggcagaag

SEQ ID NO: 7471151 - DNA, 19 bp, Homo sapiens
cacagtgcagccatttctc

SEQ ID NO: 7471152 - DNA, 22 bp, Homo sapiens
cacagtgcactaagctccgggg

SEQ ID NO: 7471153 - DNA, 19 bp, Homo sapiens
cacagtgcagccatttctc

SEQ ID NO: 7471154 - DNA, 19 bp, Homo sapiens
cacagtgcagccatttctc

SEQ ID NO: 7471155 - DNA, 22 bp, Homo sapiens
cacagtgcactaagctccgggg

SEQ ID NO: 7471156 - DNA, 22 bp, Homo sapiens
cacagtgcactaagctccgggg

SEQ ID NO: 7471157 - DNA, 22 bp, Homo sapiens
cacagtgcaatcggccacaaat

SEQ ID NO: 7471158 - DNA, 22 bp, Homo sapiens
cacagtgcaatcggccacaaat

SEQ ID NO: 7471159 - DNA, 22 bp, Homo sapiens
cacagtgactggcacctagtat

SEQ ID NO: 7471160 - DNA, 22 bp, Homo sapiens
cacagtgactggcacctagtat

SEQ ID NO: 7471161 - DNA, 18 bp, Homo sapiens
cacagtgacttctgatac

SEQ ID NO: 7471162 - DNA, 22 bp, Homo sapiens
cacagtgactggcacctagtat

SEQ ID NO: 7471163 - DNA, 18 bp, Homo sapiens
cacagtgacttctgatac

SEQ ID NO: 7471164 - DNA, 22 bp, Homo sapiens
cacagtgagctgggcatcagtt

SEQ ID NO: 7471165 - DNA, 22 bp, Homo sapiens
cacagtgagctgggcatcagtt

SEQ ID NO: 7471166 - DNA, 22 bp, Homo sapiens
cacagtgagctgggcatcagtt

SEQ ID NO: 7471167 - DNA, 22 bp, Homo sapiens
cacagtgagctgggcatcagtt

SEQ ID NO: 7471168 - DNA, 22 bp, Homo sapiens
cacagtgagctgggcatcagtt

SEQ ID NO: 7471169 - DNA, 22 bp, Homo sapiens
cacagtgagtatttagtaccta

SEQ ID NO: 7471170 - DNA, 22 bp, Homo sapiens
cacagtgattgatttttacttt

SEQ ID NO: 7471171 - DNA, 22 bp, Homo sapiens
cacagtgagtatttagtaccta

SEQ ID NO: 7471172 - DNA, 22 bp, Homo sapiens
cacagtgattgatttttacttt

SEQ ID NO: 7471173 - DNA, 22 bp, Homo sapiens
cacagtgattgatttttacttt

SEQ ID NO: 7471174 - DNA, 22 bp, Homo sapiens
cacagtgacagctatacagaga

SEQ ID NO: 7471175 - DNA, 22 bp, Homo sapiens
cacagtgacagctatacagaga

SEQ ID NO: 7471176 - DNA, 22 bp, Homo sapiens
cacagtgaatttcaagtgttgt

SEQ ID NO: 7471177 - DNA, 22 bp, Homo sapiens
cacagtgaatttcaagtgttgt

SEQ ID NO: 7471178 - DNA, 22 bp, Homo sapiens
cacagtgaatttcaagtgttgt

SEQ ID NO: 7471179 - DNA, 22 bp, Homo sapiens
cacagtgaatttcaagtgttgt

SEQ ID NO: 7471180 - DNA, 22 bp, Homo sapiens
cacagtgaatttcaagtgttgt

SEQ ID NO: 7471181 - DNA, 22 bp, Homo sapiens
cacagtgacattagtgagaaaa

SEQ ID NO: 7471182 - DNA, 22 bp, Homo sapiens
cacagtgacattagtgagaaaa

SEQ ID NO: 7471183 - DNA, 22 bp, Homo sapiens
cacagtgacattagtgagaaaa

SEQ ID NO: 7471184 - DNA, 22 bp, Homo sapiens
cacagtgacattagtgagaaaa

SEQ ID NO: 7471185 - DNA, 22 bp, Homo sapiens
cacagtgacagctatacagaga

SEQ ID NO: 7471186 - DNA, 22 bp, Homo sapiens
cacagtgacagctatacagaga

SEQ ID NO: 7471187 - DNA, 22 bp, Homo sapiens
cacagtgacagctatacagaga

SEQ ID NO: 7471188 - DNA, 22 bp, Homo sapiens
cacagtgacagctatacagaga

SEQ ID NO: 7471189 - DNA, 22 bp, Homo sapiens
cacagtgacattagtgagaaaa

SEQ ID NO: 7471190 - DNA, 22 bp, Homo sapiens
cacagtgacctctttaaaaggg

SEQ ID NO: 7471191 - DNA, 22 bp, Homo sapiens
cacagtgacctctttaaaaggg

SEQ ID NO: 7471192 - DNA, 22 bp, Homo sapiens
cacagtgacctctttaaaaggg

SEQ ID NO: 7471193 - DNA, 22 bp, Homo sapiens
cacagtgactggcacatagtaa

SEQ ID NO: 7471194 - DNA, 22 bp, Homo sapiens
cacagtgactggcacatagtaa

SEQ ID NO: 7471195 - DNA, 22 bp, Homo sapiens
cacagtgactggcacatagtaa

SEQ ID NO: 7471196 - DNA, 22 bp, Homo sapiens
cacagtgactggcacatagtaa

SEQ ID NO: 7471197 - DNA, 22 bp, Homo sapiens
cacagtgactggcacatagtaa

SEQ ID NO: 7471198 - DNA, 22 bp, Homo sapiens
cacagtgactggcacatagtaa

SEQ ID NO: 7471199 - DNA, 22 bp, Homo sapiens
cacagtgactggcacatagtaa

SEQ ID NO: 7471200 - DNA, 22 bp, Homo sapiens
cacagtgaacattctgtcaggg

SEQ ID NO: 7471201 - DNA, 22 bp, Homo sapiens
cacagtgaacattctgtcaggg

SEQ ID NO: 7471202 - DNA, 22 bp, Homo sapiens
cacagtgaacattctgtcaggg

SEQ ID NO: 7471203 - DNA, 22 bp, Homo sapiens
cacagtgaacattctgtcaggg

SEQ ID NO: 7471204 - DNA, 22 bp, Homo sapiens
cacagtcttatcccaaccacca

SEQ ID NO: 7471205 - DNA, 22 bp, Homo sapiens
cacagtcttatcccaaccacca

SEQ ID NO: 7471206 - DNA, 22 bp, Homo sapiens
cacagtcttatcccaaccacca

SEQ ID NO: 7471207 - DNA, 22 bp, Homo sapiens
cacagtctcctctcttagcctg

SEQ ID NO: 7471208 - DNA, 22 bp, Homo sapiens
cacagtctctgttgctgggacc

SEQ ID NO: 7471209 - DNA, 22 bp, Homo sapiens
cacagtgaagcatgcagacatc

SEQ ID NO: 7471210 - DNA, 22 bp, Homo sapiens
cacagtgaagcatgcagacatc

SEQ ID NO: 7471211 - DNA, 22 bp, Homo sapiens
cacagtgaagcatgcagacatc

SEQ ID NO: 7471212 - DNA, 22 bp, Homo sapiens
cacagtgaagcatgcagacatc

SEQ ID NO: 7471213 - DNA, 22 bp, Homo sapiens
cacagtgaattacatagacgtg

SEQ ID NO: 7471214 - DNA, 22 bp, Homo sapiens
cacagtgaattacatagacgtg

SEQ ID NO: 7471215 - DNA, 22 bp, Homo sapiens
cacagtgaattacatagacgtg

SEQ ID NO: 7471216 - DNA, 22 bp, Homo sapiens
cacagtgaattacatagacgtg

SEQ ID NO: 7471217 - DNA, 22 bp, Homo sapiens
cacagtgaatttcaagtgttgt

SEQ ID NO: 7471218 - DNA, 22 bp, Homo sapiens
cacagtctctgttgctgggacc

SEQ ID NO: 7471219 - DNA, 22 bp, Homo sapiens
cacagtctcctctcttagcctg

SEQ ID NO: 7471220 - DNA, 22 bp, Homo sapiens
cacagtctcctctcttagcctg

SEQ ID NO: 7471221 - DNA, 22 bp, Homo sapiens
cacagtctcctctcttagcctg

SEQ ID NO: 7471222 - DNA, 22 bp, Homo sapiens
cacagtcctgccagagggcctt

SEQ ID NO: 7471223 - DNA, 22 bp, Homo sapiens
cacagtcctgccagagggcctt

SEQ ID NO: 7471224 - DNA, 22 bp, Homo sapiens
cacagtcctgccagagggcctt

SEQ ID NO: 7471225 - DNA, 22 bp, Homo sapiens
cacagtaaggtatcccagtgaa

SEQ ID NO: 7471226 - DNA, 22 bp, Homo sapiens
cacagtacccagcactactgag

SEQ ID NO: 7471227 - DNA, 22 bp, Homo sapiens
cacagtacccagcactactgag

SEQ ID NO: 7471228 - DNA, 22 bp, Homo sapiens
cacagtaaggtatcccagtgaa

SEQ ID NO: 7471229 - DNA, 22 bp, Homo sapiens
cacagtaagaaatgaagaggta

SEQ ID NO: 7471230 - DNA, 22 bp, Homo sapiens
cacagtaactggcgtgtagtaa

SEQ ID NO: 7471231 - DNA, 22 bp, Homo sapiens
cacagtaactcctgacccctcg

SEQ ID NO: 7471232 - DNA, 22 bp, Homo sapiens
cacagtaactggcgtgtagtaa

SEQ ID NO: 7471233 - DNA, 22 bp, Homo sapiens
cacagtaaccccaggactggga

SEQ ID NO: 7471234 - DNA, 22 bp, Homo sapiens
cacaggtttgacaaggataaaa

SEQ ID NO: 7471235 - DNA, 22 bp, Homo sapiens
cacaggtttgacaaggataaaa

SEQ ID NO: 7471236 - DNA, 22 bp, Homo sapiens
cacaggtttcaaggataagatg

SEQ ID NO: 7471237 - DNA, 22 bp, Homo sapiens
cacaggtttcaaggataagatg

SEQ ID NO: 7471238 - DNA, 22 bp, Homo sapiens
cacaggttcacctcaggtaggt

SEQ ID NO: 7471239 - DNA, 22 bp, Homo sapiens
cacaggttagcagcttgaaact

SEQ ID NO: 7471240 - DNA, 22 bp, Homo sapiens
cacaggttaggtattatactat

SEQ ID NO: 7471241 - DNA, 22 bp, Homo sapiens
cacaggttaggtattatactat

SEQ ID NO: 7471242 - DNA, 21 bp, Homo sapiens
cacaggtgggtcagtgaggcc

SEQ ID NO: 7471243 - DNA, 21 bp, Homo sapiens
cacaggtgggtcagtgaggcc

SEQ ID NO: 7471244 - DNA, 22 bp, Homo sapiens
cacaggtggcttctttcatctt

SEQ ID NO: 7471245 - DNA, 22 bp, Homo sapiens
cacaggtggcttctttcatctt

SEQ ID NO: 7471246 - DNA, 22 bp, Homo sapiens
cacaggtgctcctcggggagct

SEQ ID NO: 7471247 - DNA, 17 bp, Homo sapiens
cacaggtgtggtttgag

SEQ ID NO: 7471248 - DNA, 17 bp, Homo sapiens
cacaggtgtggtttgag

SEQ ID NO: 7471249 - DNA, 22 bp, Homo sapiens
cacaggtgtctctagtagcgtt

SEQ ID NO: 7471250 - DNA, 22 bp, Homo sapiens
cacaggtgtatgaatatgtcca

SEQ ID NO: 7471251 - DNA, 22 bp, Homo sapiens
cacaggtgtctctagtagcgtt

SEQ ID NO: 7471252 - DNA, 22 bp, Homo sapiens
cacaggtgtccaatacctgctt

SEQ ID NO: 7471253 - DNA, 22 bp, Homo sapiens
cacaggtgtccaatacctgctt

SEQ ID NO: 7471254 - DNA, 21 bp, Homo sapiens
cacaggtgggtcagtgaggcc

SEQ ID NO: 7471255 - DNA, 22 bp, Homo sapiens
cacaggtgttcttgcagtgaaa

SEQ ID NO: 7471256 - DNA, 22 bp, Homo sapiens
cacaggtgtgtgccttatcaaa

SEQ ID NO: 7471257 - DNA, 22 bp, Homo sapiens
cacaggtgtgtcctggtcttgt

SEQ ID NO: 7471258 - DNA, 22 bp, Homo sapiens
cacaggtgtgtgccttatcaaa

SEQ ID NO: 7471259 - DNA, 22 bp, Homo sapiens
cacaggtgtgtcctggtcttgt

SEQ ID NO: 7471260 - DNA, 22 bp, Homo sapiens
cacaggtgtgtcctggtcttgt

SEQ ID NO: 7471261 - DNA, 23 bp, Homo sapiens
cacaggtgtttcatcttctcagt

SEQ ID NO: 7471262 - DNA, 23 bp, Homo sapiens
cacaggtgtttcatcttctcagt

SEQ ID NO: 7471263 - DNA, 23 bp, Homo sapiens
cacaggtgtttcatcttctcagt

SEQ ID NO: 7471264 - DNA, 22 bp, Homo sapiens
cacaggtgttcttgcagtgaaa

SEQ ID NO: 7471265 - DNA, 22 bp, Homo sapiens
cacaggtgttcttgcagtgaaa

SEQ ID NO: 7471266 - DNA, 23 bp, Homo sapiens
cacaggtgtttcatcttctcagt

SEQ ID NO: 7471267 - DNA, 23 bp, Homo sapiens
cacaggtgtttcatcttctcagt

SEQ ID NO: 7471268 - DNA, 22 bp, Homo sapiens
cacaggttagcagcttgaaact

SEQ ID NO: 7471269 - DNA, 22 bp, Homo sapiens
cacaggttagcagcttgaaact

SEQ ID NO: 7471270 - DNA, 22 bp, Homo sapiens
cacaggtgtttgttatactcag

SEQ ID NO: 7471271 - DNA, 22 bp, Homo sapiens
cacaggtgtttgttatactcag

SEQ ID NO: 7471272 - DNA, 22 bp, Homo sapiens
cacagggcaggtactctcagag

SEQ ID NO: 7471273 - DNA, 22 bp, Homo sapiens
cacagggcaggtactctcagag

SEQ ID NO: 7471274 - DNA, 22 bp, Homo sapiens
cacagggctttgatggctgagt

SEQ ID NO: 7471275 - DNA, 22 bp, Homo sapiens
cacaggggcaaactgtagggga

SEQ ID NO: 7471276 - DNA, 22 bp, Homo sapiens
cacaggggcaaactgtagggga

SEQ ID NO: 7471277 - DNA, 22 bp, Homo sapiens
cacaggggcaaactgtagggga

SEQ ID NO: 7471278 - DNA, 22 bp, Homo sapiens
cacagggctttgatggctgagt

SEQ ID NO: 7471279 - DNA, 22 bp, Homo sapiens
cacagggctttgatggctgagt

SEQ ID NO: 7471280 - DNA, 22 bp, Homo sapiens
cacagggctttgatggctgagt

SEQ ID NO: 7471281 - DNA, 22 bp, Homo sapiens
cacaggtaatagcctaggctat

SEQ ID NO: 7471282 - DNA, 22 bp, Homo sapiens
cacaggtaatagcctaggctat

SEQ ID NO: 7471283 - DNA, 22 bp, Homo sapiens
cacaggtaatagcctaggctat

SEQ ID NO: 7471284 - DNA, 22 bp, Homo sapiens
cacagggttgttctgaggattc

SEQ ID NO: 7471285 - DNA, 22 bp, Homo sapiens
cacagggttgttctgaggattc

SEQ ID NO: 7471286 - DNA, 22 bp, Homo sapiens
cacaggggcaaactgtagggga

SEQ ID NO: 7471287 - DNA, 22 bp, Homo sapiens
cacaggggcaaactgtagggga

SEQ ID NO: 7471288 - DNA, 22 bp, Homo sapiens
cacaggggcaaactgtagggga

SEQ ID NO: 7471289 - DNA, 22 bp, Homo sapiens
cacaggggcaaactgtagggga

SEQ ID NO: 7471290 - DNA, 22 bp, Homo sapiens
cacaggggcaaactgtagggga

SEQ ID NO: 7471291 - DNA, 22 bp, Homo sapiens
cacaggtatatgtgtatatact

SEQ ID NO: 7471292 - DNA, 22 bp, Homo sapiens
cacaggtagatgccatgcagca

SEQ ID NO: 7471293 - DNA, 22 bp, Homo sapiens
cacaggtagatgccatgcagca

SEQ ID NO: 7471294 - DNA, 22 bp, Homo sapiens
cacaggtagaattttagggaaa

SEQ ID NO: 7471295 - DNA, 22 bp, Homo sapiens
cacaggtaatagcctaggctat

SEQ ID NO: 7471296 - DNA, 22 bp, Homo sapiens
cacaggtccttcctgccctggg

SEQ ID NO: 7471297 - DNA, 22 bp, Homo sapiens
cacaggtgccatctcttcatgg

SEQ ID NO: 7471298 - DNA, 22 bp, Homo sapiens
cacaggtgccatctcttcatgg

SEQ ID NO: 7471299 - DNA, 22 bp, Homo sapiens
cacaggtgctcctcggggagct

SEQ ID NO: 7471300 - DNA, 22 bp, Homo sapiens
cacaggtccttcctgccctggg

SEQ ID NO: 7471301 - DNA, 22 bp, Homo sapiens
cacaggtgcaagaagttgcagt

SEQ ID NO: 7471302 - DNA, 22 bp, Homo sapiens
cacaggtgcaagaagttgcagt

SEQ ID NO: 7471303 - DNA, 20 bp, Homo sapiens
cacaggccttgtgagcagac

SEQ ID NO: 7471304 - DNA, 20 bp, Homo sapiens
cacaggccttgtgagcagac

SEQ ID NO: 7471305 - DNA, 20 bp, Homo sapiens
cacaggccttgtgagcagac

SEQ ID NO: 7471306 - DNA, 20 bp, Homo sapiens
cacaggccttgtgagcagac

SEQ ID NO: 7471307 - DNA, 20 bp, Homo sapiens
cacaggccttgtgagcagac

SEQ ID NO: 7471308 - DNA, 20 bp, Homo sapiens
cacaggccttgtgagcagac

SEQ ID NO: 7471309 - DNA, 22 bp, Homo sapiens
cacaggcctggggttgagcggg

SEQ ID NO: 7471310 - DNA, 22 bp, Homo sapiens
cacaggcctggggttgagcggg

SEQ ID NO: 7471311 - DNA, 22 bp, Homo sapiens
cacaggcctgtctctttctaac

SEQ ID NO: 7471312 - DNA, 22 bp, Homo sapiens
cacaggcctgtctctttctaac

SEQ ID NO: 7471313 - DNA, 22 bp, Homo sapiens
cacaggcctggggttgagcggg

SEQ ID NO: 7471314 - DNA, 22 bp, Homo sapiens
cacagggcaggtactctcagag

SEQ ID NO: 7471315 - DNA, 22 bp, Homo sapiens
cacagggcaggtactctcagag

SEQ ID NO: 7471316 - DNA, 22 bp, Homo sapiens
cacagggcaggtactctcagag

SEQ ID NO: 7471317 - DNA, 22 bp, Homo sapiens
cacagggcaggtactctcagag

SEQ ID NO: 7471318 - DNA, 22 bp, Homo sapiens
cacagggcaggtactctcagag

SEQ ID NO: 7471319 - DNA, 20 bp, Homo sapiens
cacaggccttgtgagcagac

SEQ ID NO: 7471320 - DNA, 20 bp, Homo sapiens
cacaggccttgtgagcagac

SEQ ID NO: 7471321 - DNA, 20 bp, Homo sapiens
cacaggccttgtgagcagac

SEQ ID NO: 7471322 - DNA, 20 bp, Homo sapiens
cacaggccttgtgagcagac

SEQ ID NO: 7471323 - DNA, 22 bp, Homo sapiens
cacaggccagtaagactgtgtt

SEQ ID NO: 7471324 - DNA, 22 bp, Homo sapiens
cacaggccagtaagactgtgtt

SEQ ID NO: 7471325 - DNA, 22 bp, Homo sapiens
cacaggccagtaagactgtgtt

SEQ ID NO: 7471326 - DNA, 22 bp, Homo sapiens
cacaggccagtaagactgtgtt

SEQ ID NO: 7471327 - DNA, 20 bp, Homo sapiens
cacaggccccaagacctgta

SEQ ID NO: 7471328 - DNA, 20 bp, Homo sapiens
cacaggccccaagacctgta

SEQ ID NO: 7471329 - DNA, 20 bp, Homo sapiens
cacaggccccaagacctgta

SEQ ID NO: 7471330 - DNA, 20 bp, Homo sapiens
cacaggccccaagacctgta

SEQ ID NO: 7471331 - DNA, 20 bp, Homo sapiens
cacaggccccaagacctgta

SEQ ID NO: 7471332 - DNA, 20 bp, Homo sapiens
cacaggccccaagacctgta

SEQ ID NO: 7471333 - DNA, 20 bp, Homo sapiens
cacaggccccaagacctgta

SEQ ID NO: 7471334 - DNA, 20 bp, Homo sapiens
cacaggccccaagacctgta

SEQ ID NO: 7471335 - DNA, 20 bp, Homo sapiens
cacaggccccaagacctgta

SEQ ID NO: 7471336 - DNA, 20 bp, Homo sapiens
cacaggccccaagacctgta

SEQ ID NO: 7471337 - DNA, 22 bp, Homo sapiens
cacaggccaataccctctctct

SEQ ID NO: 7471338 - DNA, 18 bp, Homo sapiens
cacaggcaggtgataggt

SEQ ID NO: 7471339 - DNA, 22 bp, Homo sapiens
cacaggccaataccctctctct

SEQ ID NO: 7471340 - DNA, 18 bp, Homo sapiens
cacaggcaggtgataggt

SEQ ID NO: 7471341 - DNA, 22 bp, Homo sapiens
cacaggccagtaagactgtgtt

SEQ ID NO: 7471342 - DNA, 22 bp, Homo sapiens
cacaggccagtaagactgtgtt

SEQ ID NO: 7471343 - DNA, 22 bp, Homo sapiens
cacaggccagtaagactgtgtt

SEQ ID NO: 7471344 - DNA, 22 bp, Homo sapiens
cacaggccagtaagactgtgtt

SEQ ID NO: 7471345 - DNA, 22 bp, Homo sapiens
cacaggccagtaagactgtgtt

SEQ ID NO: 7471346 - DNA, 22 bp, Homo sapiens
cacaggccaataccctctctct

SEQ ID NO: 7471347 - DNA, 22 bp, Homo sapiens
cacaggcacccctgactgctca

SEQ ID NO: 7471348 - DNA, 22 bp, Homo sapiens
cacaggcacccctgactgctca

SEQ ID NO: 7471349 - DNA, 22 bp, Homo sapiens
cacaggcacccctgactgctca

SEQ ID NO: 7471350 - DNA, 22 bp, Homo sapiens
cacaggagttaacataattaag

SEQ ID NO: 7471351 - DNA, 22 bp, Homo sapiens
cacaggatacattgtctatatc

SEQ ID NO: 7471352 - DNA, 22 bp, Homo sapiens
cacaggcacgcctctggccagg

SEQ ID NO: 7471353 - DNA, 22 bp, Homo sapiens
cacaggcacgcctctggccagg

SEQ ID NO: 7471354 - DNA, 22 bp, Homo sapiens
cacaggcacgcctctggccagg

SEQ ID NO: 7471355 - DNA, 22 bp, Homo sapiens
cacaggcacgcctctggccagg

SEQ ID NO: 7471356 - DNA, 22 bp, Homo sapiens
cacaggcacccctgactgctca

SEQ ID NO: 7471357 - DNA, 22 bp, Homo sapiens
cacaggcacccctgactgctca

SEQ ID NO: 7471358 - DNA, 22 bp, Homo sapiens
cacaggcacgcctctggccagg

SEQ ID NO: 7471359 - DNA, 22 bp, Homo sapiens
cacaggcacgcctctggccagg

SEQ ID NO: 7471360 - DNA, 22 bp, Homo sapiens
cacaggcacgcctctggccagg

SEQ ID NO: 7471361 - DNA, 22 bp, Homo sapiens
cacaggcacgcctctggccagg

SEQ ID NO: 7471362 - DNA, 22 bp, Homo sapiens
cacaggcacgcctctggccagg

SEQ ID NO: 7471363 - DNA, 22 bp, Homo sapiens
cacaggcacgcctctggccagg

SEQ ID NO: 7471364 - DNA, 23 bp, Homo sapiens
cacaggcagaaatcaagacggta

SEQ ID NO: 7471365 - DNA, 23 bp, Homo sapiens
cacaggcagaaatcaagacggta

SEQ ID NO: 7471366 - DNA, 23 bp, Homo sapiens
cacaggcagaaatcaagacggta

SEQ ID NO: 7471367 - DNA, 23 bp, Homo sapiens
cacaggcagaaatcaagacggta

SEQ ID NO: 7471368 - DNA, 23 bp, Homo sapiens
cacaggcagaaatcaagacggta

SEQ ID NO: 7471369 - DNA, 23 bp, Homo sapiens
cacaggcagaaatcaagacggta

SEQ ID NO: 7471370 - DNA, 22 bp, Homo sapiens
cacaggcagccttgtagaagaa

SEQ ID NO: 7471371 - DNA, 22 bp, Homo sapiens
cacaggcagccttgtagaagaa

SEQ ID NO: 7471372 - DNA, 22 bp, Homo sapiens
cacaggcagccttgtagaagaa

SEQ ID NO: 7471373 - DNA, 22 bp, Homo sapiens
cacaggcagccttgtagaagaa

SEQ ID NO: 7471374 - DNA, 22 bp, Homo sapiens
cacaggcagccttgtagaagaa

SEQ ID NO: 7471375 - DNA, 22 bp, Homo sapiens
cacaggcagccttgtagaagaa

SEQ ID NO: 7471376 - DNA, 18 bp, Homo sapiens
cacaggcaggtgataggt

SEQ ID NO: 7471377 - DNA, 18 bp, Homo sapiens
cacaggcaggtgataggt

SEQ ID NO: 7471378 - DNA, 18 bp, Homo sapiens
cacaggcaggtgataggt

SEQ ID NO: 7471379 - DNA, 18 bp, Homo sapiens
cacaggcaggtgataggt

SEQ ID NO: 7471380 - DNA, 22 bp, Homo sapiens
cacaggcaggaggttctccagt

SEQ ID NO: 7471381 - DNA, 22 bp, Homo sapiens
cacaggcaggaggttctccagt

SEQ ID NO: 7471382 - DNA, 22 bp, Homo sapiens
cacaggcaggaggttctccagt

SEQ ID NO: 7471383 - DNA, 22 bp, Homo sapiens
cacaggcaggaggttctccagt

SEQ ID NO: 7471384 - DNA, 22 bp, Homo sapiens
cacaggagtgctgctattgttg

SEQ ID NO: 7471385 - DNA, 22 bp, Homo sapiens
cacaggagtgctgctattgttg

SEQ ID NO: 7471386 - DNA, 22 bp, Homo sapiens
cacaggaggttaggaagtggtc

SEQ ID NO: 7471387 - DNA, 22 bp, Homo sapiens
cacaggagtgctgctattgttg

SEQ ID NO: 7471388 - DNA, 22 bp, Homo sapiens
cacaggagtgctgctattgttg

SEQ ID NO: 7471389 - DNA, 22 bp, Homo sapiens
cacaggagttaacataattaag

SEQ ID NO: 7471390 - DNA, 22 bp, Homo sapiens
cacaggagttaacataattaag

SEQ ID NO: 7471391 - DNA, 22 bp, Homo sapiens
cacaggagtgctgctattgttg

SEQ ID NO: 7471392 - DNA, 22 bp, Homo sapiens
cacaggagtgctgctattgttg

SEQ ID NO: 7471393 - DNA, 22 bp, Homo sapiens
cacaggaggttaggaagtggtc

SEQ ID NO: 7471394 - DNA, 22 bp, Homo sapiens
cacaggaggttaggaagtggtc

SEQ ID NO: 7471395 - DNA, 22 bp, Homo sapiens
cacaggaggttaggaagtggtc

SEQ ID NO: 7471396 - DNA, 22 bp, Homo sapiens
cacaggaggttaggaagtggtc

SEQ ID NO: 7471397 - DNA, 22 bp, Homo sapiens
cacaggaggttaggaagtggtc

SEQ ID NO: 7471398 - DNA, 18 bp, Homo sapiens
cacaggagccacactcac

SEQ ID NO: 7471399 - DNA, 18 bp, Homo sapiens
cacaggagccacactcac

SEQ ID NO: 7471400 - DNA, 18 bp, Homo sapiens
cacaggagccacactcac

SEQ ID NO: 7471401 - DNA, 22 bp, Homo sapiens
ggagagcctgtgcagccgggtt

SEQ ID NO: 7471402 - DNA, 22 bp, Homo sapiens
ggagagcctgtgcagccgggtt

SEQ ID NO: 7471403 - DNA, 22 bp, Homo sapiens
ggagagcctccacggcttctgt

SEQ ID NO: 7471404 - DNA, 20 bp, Homo sapiens
ggagagccacatagtctccc

SEQ ID NO: 7471405 - DNA, 22 bp, Homo sapiens
ggagagcctccacggcttctgt

SEQ ID NO: 7471406 - DNA, 20 bp, Homo sapiens
ggagagccacatagtctccc

SEQ ID NO: 7471407 - DNA, 20 bp, Homo sapiens
ggagagccacatagtctccc

SEQ ID NO: 7471408 - DNA, 22 bp, Homo sapiens
ggagagcctccacggcttctgt

SEQ ID NO: 7471409 - DNA, 22 bp, Homo sapiens
ggagagcctgtgcagccgggtt

SEQ ID NO: 7471410 - DNA, 22 bp, Homo sapiens
ggagagctagtgcctgccagta

SEQ ID NO: 7471411 - DNA, 22 bp, Homo sapiens
ggagagctagtgcctgccagta

SEQ ID NO: 7471412 - DNA, 22 bp, Homo sapiens
ggagagctagtgcctgccagta

SEQ ID NO: 7471413 - DNA, 22 bp, Homo sapiens
ggagagctgaagcatggacagg

SEQ ID NO: 7471414 - DNA, 22 bp, Homo sapiens
ggagagctgaagcatggacagg

SEQ ID NO: 7471415 - DNA, 22 bp, Homo sapiens
ggagagctgaagcatggacagg

SEQ ID NO: 7471416 - DNA, 22 bp, Homo sapiens
cacaggagattgatctattggt

SEQ ID NO: 7471417 - DNA, 18 bp, Homo sapiens
cacaggagccacactcac

SEQ ID NO: 7471418 - DNA, 18 bp, Homo sapiens
cacaggagccacactcac

SEQ ID NO: 7471419 - DNA, 23 bp, Homo sapiens
ggagagctcctcgtgactcactg

SEQ ID NO: 7471420 - DNA, 22 bp, Homo sapiens
ggagagctagtgcctgccagta

SEQ ID NO: 7471421 - DNA, 22 bp, Homo sapiens
ggagagctagtgcctgccagta

SEQ ID NO: 7471422 - DNA, 23 bp, Homo sapiens
ggagagctcctcgtgactcactg

SEQ ID NO: 7471423 - DNA, 22 bp, Homo sapiens
ggagagctctgggtctccgaca

SEQ ID NO: 7471424 - DNA, 22 bp, Homo sapiens
cacatgaaggctggggtcgtga

SEQ ID NO: 7471425 - DNA, 22 bp, Homo sapiens
cacatgaaggctggggtcgtga

SEQ ID NO: 7471426 - DNA, 22 bp, Homo sapiens
cacatgaagattcaactggatg

SEQ ID NO: 7471427 - DNA, 22 bp, Homo sapiens
cacatgaagattcaactggatg

SEQ ID NO: 7471428 - DNA, 22 bp, Homo sapiens
cacatgaagattcaactggatg

SEQ ID NO: 7471429 - DNA, 22 bp, Homo sapiens
cacatgaaggctggggtcgtga

SEQ ID NO: 7471430 - DNA, 22 bp, Homo sapiens
cacatgaaggctggggtcgtga

SEQ ID NO: 7471431 - DNA, 22 bp, Homo sapiens
cacatgaattgatgccaagtgc

SEQ ID NO: 7471432 - DNA, 22 bp, Homo sapiens
cacatgaattgatgccaagtgc

SEQ ID NO: 7471433 - DNA, 22 bp, Homo sapiens
cacatgaattgatgccaagtgc

SEQ ID NO: 7471434 - DNA, 22 bp, Homo sapiens
cacatgaaggctggggtcgtga

SEQ ID NO: 7471435 - DNA, 22 bp, Homo sapiens
cacatgaaggctggggtcgtga

SEQ ID NO: 7471436 - DNA, 22 bp, Homo sapiens
cacatgaattcacatgtatttt

SEQ ID NO: 7471437 - DNA, 22 bp, Homo sapiens
cacatgaattcacatgtatttt

SEQ ID NO: 7471438 - DNA, 22 bp, Homo sapiens
cacatgagagcccccaagagca

SEQ ID NO: 7471439 - DNA, 22 bp, Homo sapiens
cacatgagacaattaaagactt

SEQ ID NO: 7471440 - DNA, 22 bp, Homo sapiens
cacatgagagcccccaagagca

SEQ ID NO: 7471441 - DNA, 22 bp, Homo sapiens
cacatgactctggctacccaga

SEQ ID NO: 7471442 - DNA, 22 bp, Homo sapiens
cacatgagacaattaaagactt

SEQ ID NO: 7471443 - DNA, 22 bp, Homo sapiens
cacatgagacaattaaagactt

SEQ ID NO: 7471444 - DNA, 22 bp, Homo sapiens
cacatgagtcctgccaggtatg

SEQ ID NO: 7471445 - DNA, 22 bp, Homo sapiens
cacatgaggtggagatgaatga

SEQ ID NO: 7471446 - DNA, 22 bp, Homo sapiens
cacatgaggtggagatgaatga

SEQ ID NO: 7471447 - DNA, 22 bp, Homo sapiens
cacatgaggtgacttccaagct

SEQ ID NO: 7471448 - DNA, 22 bp, Homo sapiens
cacatgaggtgacttccaagct

SEQ ID NO: 7471449 - DNA, 19 bp, Homo sapiens
cacatgagggctgagggac

SEQ ID NO: 7471450 - DNA, 22 bp, Homo sapiens
cacatgagagcccccaagagca

SEQ ID NO: 7471451 - DNA, 19 bp, Homo sapiens
cacatgagggctgagggac

SEQ ID NO: 7471452 - DNA, 19 bp, Homo sapiens
cacatgagggctgagggac

SEQ ID NO: 7471453 - DNA, 22 bp, Homo sapiens
ggcaattttcatgaattattga

SEQ ID NO: 7471454 - DNA, 22 bp, Homo sapiens
ggcaattttaggcatgaatgaa

SEQ ID NO: 7471455 - DNA, 22 bp, Homo sapiens
ggcaatttggtcatttgtattg

SEQ ID NO: 7471456 - DNA, 22 bp, Homo sapiens
ggcaatttgcagtttgtcttat

SEQ ID NO: 7471457 - DNA, 22 bp, Homo sapiens
ggcaatttgcagtttgtcttat

SEQ ID NO: 7471458 - DNA, 21 bp, Homo sapiens
ggcaattaggcttctgagtat

SEQ ID NO: 7471459 - DNA, 22 bp, Homo sapiens
ggcaatttcatgtggtttaaac

SEQ ID NO: 7471460 - DNA, 22 bp, Homo sapiens
ggcaattacgtattagtcatgt

SEQ ID NO: 7471461 - DNA, 22 bp, Homo sapiens
ggcaatgtttcgatgggagctg

SEQ ID NO: 7471462 - DNA, 22 bp, Homo sapiens
ggcacaaaggaataaagagaac

SEQ ID NO: 7471463 - DNA, 22 bp, Homo sapiens
cacatatatgaaatgaggaatt

SEQ ID NO: 7471464 - DNA, 16 bp, Homo sapiens
cacatatatttatatg

SEQ ID NO: 7471465 - DNA, 16 bp, Homo sapiens
cacatatatttatatg

SEQ ID NO: 7471466 - DNA, 22 bp, Homo sapiens
cacatatatgggcccctgaggg

SEQ ID NO: 7471467 - DNA, 22 bp, Homo sapiens
cacatatatgggcccctgaggg

SEQ ID NO: 7471468 - DNA, 22 bp, Homo sapiens
cacatatatgggcccctgaggg

SEQ ID NO: 7471469 - DNA, 22 bp, Homo sapiens
cacatgaagattcaactggatg

SEQ ID NO: 7471470 - DNA, 16 bp, Homo sapiens
cacatatatttatatg

SEQ ID NO: 7471471 - DNA, 16 bp, Homo sapiens
cacatatatttatatg

SEQ ID NO: 7471472 - DNA, 16 bp, Homo sapiens
cacatatatttatatg

SEQ ID NO: 7471473 - DNA, 22 bp, Homo sapiens
ggcaatatggaagctacagaga

SEQ ID NO: 7471474 - DNA, 22 bp, Homo sapiens
ggcaatcattggcattctctgg

SEQ ID NO: 7471475 - DNA, 22 bp, Homo sapiens
ggcaatatttatataggcaagg

SEQ ID NO: 7471476 - DNA, 22 bp, Homo sapiens
ggcaatatggtgaaaccccatc

SEQ ID NO: 7471477 - DNA, 22 bp, Homo sapiens
ggcaatgtctcttgcttccagg

SEQ ID NO: 7471478 - DNA, 22 bp, Homo sapiens
ggcaatgaagtgaagagattaa

SEQ ID NO: 7471479 - DNA, 20 bp, Homo sapiens
ggcaatgccagatgacagga

SEQ ID NO: 7471480 - DNA, 22 bp, Homo sapiens
ggcaatgtagattctgtagatt

SEQ ID NO: 7471481 - DNA, 22 bp, Homo sapiens
ggcaatgtagattctgtagatt

SEQ ID NO: 7471482 - DNA, 22 bp, Homo sapiens
ggcaagtgtgagaagggactgg

SEQ ID NO: 7471483 - DNA, 22 bp, Homo sapiens
ggcaagtgtgagaagggactgg

SEQ ID NO: 7471484 - DNA, 22 bp, Homo sapiens
ggcaagtgtgagaagggactgg

SEQ ID NO: 7471485 - DNA, 22 bp, Homo sapiens
ggcaagtgtgagaagggactgg

SEQ ID NO: 7471486 - DNA, 22 bp, Homo sapiens
ggcaagttgctattctttaatg

SEQ ID NO: 7471487 - DNA, 22 bp, Homo sapiens
ggcaatagttgtgggttcttta

SEQ ID NO: 7471488 - DNA, 22 bp, Homo sapiens
ggcagatgacagaccagtatgt

SEQ ID NO: 7471489 - DNA, 18 bp, Homo sapiens
ggcagatgacaggagaga

SEQ ID NO: 7471490 - DNA, 22 bp, Homo sapiens
ggcagatgacagaccagtatgt

SEQ ID NO: 7471491 - DNA, 22 bp, Homo sapiens
ggcagagttggtggagtcagtt

SEQ ID NO: 7471492 - DNA, 22 bp, Homo sapiens
ggcagagttggtggagtcagtt

SEQ ID NO: 7471493 - DNA, 22 bp, Homo sapiens
ggcagagttggtggagtcagtt

SEQ ID NO: 7471494 - DNA, 22 bp, Homo sapiens
ggcagagttggtggagtcagtt

SEQ ID NO: 7471495 - DNA, 22 bp, Homo sapiens
ggcagagttggtggagtcagtt

SEQ ID NO: 7471496 - DNA, 22 bp, Homo sapiens
ggcagagtgctctgggcagggg

SEQ ID NO: 7471497 - DNA, 22 bp, Homo sapiens
ggcagagttggtggagtcagtt

SEQ ID NO: 7471498 - DNA, 22 bp, Homo sapiens
ggcagagtggagtgcggcctcc

SEQ ID NO: 7471499 - DNA, 22 bp, Homo sapiens
ggcagagtggagtgcggcctcc

SEQ ID NO: 7471500 - DNA, 22 bp, Homo sapiens
ggcagatggaagaggctgggtc

SEQ ID NO: 7471501 - DNA, 22 bp, Homo sapiens
ggcagatgctggcttctgctgt

SEQ ID NO: 7471502 - DNA, 22 bp, Homo sapiens
ggcagatgctggcttctgctgt

SEQ ID NO: 7471503 - DNA, 22 bp, Homo sapiens
ggcagatggaagaggctgggtc

SEQ ID NO: 7471504 - DNA, 22 bp, Homo sapiens
ggcagatggaagaggctgggtc

SEQ ID NO: 7471505 - DNA, 22 bp, Homo sapiens
ggcagatggaagaggctgggtc

SEQ ID NO: 7471506 - DNA, 22 bp, Homo sapiens
ggcagatggaagaggctgggtc

SEQ ID NO: 7471507 - DNA, 20 bp, Homo sapiens
cacatgctgtgtgtttctct

SEQ ID NO: 7471508 - DNA, 20 bp, Homo sapiens
cacatgctgtgtgtttctct

SEQ ID NO: 7471509 - DNA, 22 bp, Homo sapiens
cacatgctccatacagaatggg

SEQ ID NO: 7471510 - DNA, 22 bp, Homo sapiens
cacatgctccatacagaatggg

SEQ ID NO: 7471511 - DNA, 22 bp, Homo sapiens
cacatgctccatacagaatggg

SEQ ID NO: 7471512 - DNA, 18 bp, Homo sapiens
ggcagatgacaggagaga

SEQ ID NO: 7471513 - DNA, 18 bp, Homo sapiens
ggcagatgacaggagaga

SEQ ID NO: 7471514 - DNA, 18 bp, Homo sapiens
ggcagatgacaggagaga

SEQ ID NO: 7471515 - DNA, 18 bp, Homo sapiens
ggcagatgacaggagaga

SEQ ID NO: 7471516 - DNA, 18 bp, Homo sapiens
ggcagatgacaggagaga

SEQ ID NO: 7471517 - DNA, 18 bp, Homo sapiens
ggcagatgacaggagaga

SEQ ID NO: 7471518 - DNA, 20 bp, Homo sapiens
ggcagatgcagagctatgca

SEQ ID NO: 7471519 - DNA, 20 bp, Homo sapiens
ggcagatgcagagctatgca

SEQ ID NO: 7471520 - DNA, 20 bp, Homo sapiens
ggcagatgcagagctatgca

SEQ ID NO: 7471521 - DNA, 22 bp, Homo sapiens
ggcagaggtgacagtgtctttt

SEQ ID NO: 7471522 - DNA, 22 bp, Homo sapiens
ggcagaggtgacagtgtctttt

SEQ ID NO: 7471523 - DNA, 22 bp, Homo sapiens
ggcagaggtgacagtgtctttt

SEQ ID NO: 7471524 - DNA, 22 bp, Homo sapiens
ggcagaggtgacagtgtctttt

SEQ ID NO: 7471525 - DNA, 22 bp, Homo sapiens
cacatgcaggagccaatgtaca

SEQ ID NO: 7471526 - DNA, 22 bp, Homo sapiens
cacatgcaggagccaatgtaca

SEQ ID NO: 7471527 - DNA, 22 bp, Homo sapiens
cacatgcaggagccaatgtaca

SEQ ID NO: 7471528 - DNA, 22 bp, Homo sapiens
cacatgcaggagccaatgtaca

SEQ ID NO: 7471529 - DNA, 22 bp, Homo sapiens
ggcagaggtgacagtgtctttt

SEQ ID NO: 7471530 - DNA, 22 bp, Homo sapiens
ggcagagtcagaggtggttctg

SEQ ID NO: 7471531 - DNA, 22 bp, Homo sapiens
ggcagagtgctctgggcagggg

SEQ ID NO: 7471532 - DNA, 22 bp, Homo sapiens
ggcagaggtgacagtgtctttt

SEQ ID NO: 7471533 - DNA, 22 bp, Homo sapiens
ggcagagtcagaggtggttctg

SEQ ID NO: 7471534 - DNA, 22 bp, Homo sapiens
ggcagaggtgacagtgtctttt

SEQ ID NO: 7471535 - DNA, 22 bp, Homo sapiens
cacatgcaagtcctcagttcta

SEQ ID NO: 7471536 - DNA, 22 bp, Homo sapiens
cacatgcaagtcctcagttcta

SEQ ID NO: 7471537 - DNA, 22 bp, Homo sapiens
cacatgcaagtcctcagttcta

SEQ ID NO: 7471538 - DNA, 22 bp, Homo sapiens
cacatgcaagtcctcagttcta

SEQ ID NO: 7471539 - DNA, 22 bp, Homo sapiens
cacatgcaagtcctcagttcta

SEQ ID NO: 7471540 - DNA, 22 bp, Homo sapiens
cacatgcaccagaaatcaacat

SEQ ID NO: 7471541 - DNA, 22 bp, Homo sapiens
cacatgcaccagaaatcaacat

SEQ ID NO: 7471542 - DNA, 22 bp, Homo sapiens
cacatgcaccagaaatcaacat

SEQ ID NO: 7471543 - DNA, 22 bp, Homo sapiens
cacatgcaccagaaatcaacat

SEQ ID NO: 7471544 - DNA, 22 bp, Homo sapiens
cacatgcaccagaaatcaacat

SEQ ID NO: 7471545 - DNA, 22 bp, Homo sapiens
cacatgcaccagaaatcaacat

SEQ ID NO: 7471546 - DNA, 22 bp, Homo sapiens
cacatgagtgtaggaagaggga

SEQ ID NO: 7471547 - DNA, 22 bp, Homo sapiens
cacatgagtgagaacatgcagt

SEQ ID NO: 7471548 - DNA, 22 bp, Homo sapiens
cacatgagtgagaacatgcagt

SEQ ID NO: 7471549 - DNA, 22 bp, Homo sapiens
cacatgagtgagaacatgcagt

SEQ ID NO: 7471550 - DNA, 22 bp, Homo sapiens
cacatgagtcctgccaggtatg

SEQ ID NO: 7471551 - DNA, 22 bp, Homo sapiens
cacatgagtcctgccaggtatg

SEQ ID NO: 7471552 - DNA, 22 bp, Homo sapiens
cacatgagtgagaacatgcagt

SEQ ID NO: 7471553 - DNA, 22 bp, Homo sapiens
cacatgagtgtaggaagaggga

SEQ ID NO: 7471554 - DNA, 22 bp, Homo sapiens
cacatgatggtggaagccatag

SEQ ID NO: 7471555 - DNA, 22 bp, Homo sapiens
cacatgatggtggaagccatag

SEQ ID NO: 7471556 - DNA, 22 bp, Homo sapiens
cacatgatggtggaagccatag

SEQ ID NO: 7471557 - DNA, 22 bp, Homo sapiens
cacattcatcagtgttgtactg

SEQ ID NO: 7471558 - DNA, 22 bp, Homo sapiens
cacattcaggtggcatgttaga

SEQ ID NO: 7471559 - DNA, 22 bp, Homo sapiens
cacattcaggtggcatgttaga

SEQ ID NO: 7471560 - DNA, 22 bp, Homo sapiens
cacattcaggtggcatgttaga

SEQ ID NO: 7471561 - DNA, 22 bp, Homo sapiens
cacattcagggcagaccactca

SEQ ID NO: 7471562 - DNA, 22 bp, Homo sapiens
cacattcaggtggcatgttaga

SEQ ID NO: 7471563 - DNA, 22 bp, Homo sapiens
cacattcaggtggcatgttaga

SEQ ID NO: 7471564 - DNA, 22 bp, Homo sapiens
cacattcagggaacattggagg

SEQ ID NO: 7471565 - DNA, 22 bp, Homo sapiens
cacattcagggaacattggagg

SEQ ID NO: 7471566 - DNA, 22 bp, Homo sapiens
cacattcagggaacattggagg

SEQ ID NO: 7471567 - DNA, 22 bp, Homo sapiens
cacattcagggcagaccactca

SEQ ID NO: 7471568 - DNA, 22 bp, Homo sapiens
cacattcagggcagaccactca

SEQ ID NO: 7471569 - DNA, 22 bp, Homo sapiens
cacattcaggtggcatgttaga

SEQ ID NO: 7471570 - DNA, 22 bp, Homo sapiens
cacattcatggagtttgcctgt

SEQ ID NO: 7471571 - DNA, 22 bp, Homo sapiens
cacattcatggagtttgcctgt

SEQ ID NO: 7471572 - DNA, 22 bp, Homo sapiens
cacattcatggagtttgcctgt

SEQ ID NO: 7471573 - DNA, 22 bp, Homo sapiens
cacattcatggagtttgcctgt

SEQ ID NO: 7471574 - DNA, 22 bp, Homo sapiens
cacattcatcagtgttgtactg

SEQ ID NO: 7471575 - DNA, 22 bp, Homo sapiens
cacattcatcagtgttgtactg

SEQ ID NO: 7471576 - DNA, 22 bp, Homo sapiens
cacattcatggagtttgcctgt

SEQ ID NO: 7471577 - DNA, 22 bp, Homo sapiens
cacattccccagagctggggct

SEQ ID NO: 7471578 - DNA, 22 bp, Homo sapiens
cacattccccagagctggggct

SEQ ID NO: 7471579 - DNA, 21 bp, Homo sapiens
cacattccatgggtctattta

SEQ ID NO: 7471580 - DNA, 22 bp, Homo sapiens
cacattcctgagcttcgacctg

SEQ ID NO: 7471581 - DNA, 22 bp, Homo sapiens
caccactggaggtcttggcttt

SEQ ID NO: 7471582 - DNA, 22 bp, Homo sapiens
caccactgcttcctgccatctg

SEQ ID NO: 7471583 - DNA, 22 bp, Homo sapiens
cacattctgtccttgaactgca

SEQ ID NO: 7471584 - DNA, 22 bp, Homo sapiens
cacattctgtccttgaactgca

SEQ ID NO: 7471585 - DNA, 22 bp, Homo sapiens
cacattctgtccttgaactgca

SEQ ID NO: 7471586 - DNA, 22 bp, Homo sapiens
cacattccttacattcatagag

SEQ ID NO: 7471587 - DNA, 22 bp, Homo sapiens
cacattcctggtgctcagcagc

SEQ ID NO: 7471588 - DNA, 22 bp, Homo sapiens
cacattcctgagcttcgacctg

SEQ ID NO: 7471589 - DNA, 22 bp, Homo sapiens
cacattcatcagtgttgtactg

SEQ ID NO: 7471590 - DNA, 22 bp, Homo sapiens
cacattcctggtgctcagcagc

SEQ ID NO: 7471591 - DNA, 22 bp, Homo sapiens
caccactgtatccctagcactt

SEQ ID NO: 7471592 - DNA, 22 bp, Homo sapiens
caccactggaggtcttggcttt

SEQ ID NO: 7471593 - DNA, 22 bp, Homo sapiens
caccactgtatccctagcactt

SEQ ID NO: 7471594 - DNA, 22 bp, Homo sapiens
caccagctacagactactgtgt

SEQ ID NO: 7471595 - DNA, 22 bp, Homo sapiens
caccactggaggtcttggcttt

SEQ ID NO: 7471596 - DNA, 22 bp, Homo sapiens
caccactggaggtcttggcttt

SEQ ID NO: 7471597 - DNA, 22 bp, Homo sapiens
caccagctccaccagggcaggt

SEQ ID NO: 7471598 - DNA, 22 bp, Homo sapiens
caccagctactccagggccgtg

SEQ ID NO: 7471599 - DNA, 22 bp, Homo sapiens
caccagctactcgggtttcctg

SEQ ID NO: 7471600 - DNA, 22 bp, Homo sapiens
caccagctactccagggccgtg

SEQ ID NO: 7471601 - DNA, 22 bp, Homo sapiens
caccagctactccagggccgtg

SEQ ID NO: 7471602 - DNA, 22 bp, Homo sapiens
caccagctccaccagggcaggt

SEQ ID NO: 7471603 - DNA, 22 bp, Homo sapiens
caccagctccaccagggcaggt

SEQ ID NO: 7471604 - DNA, 22 bp, Homo sapiens
caccagctccaccagggcaggt

SEQ ID NO: 7471605 - DNA, 22 bp, Homo sapiens
caccagctctccaccaggtttc

SEQ ID NO: 7471606 - DNA, 22 bp, Homo sapiens
caccagctccaccagggcaggt

SEQ ID NO: 7471607 - DNA, 22 bp, Homo sapiens
caccagcttacagtctcacccc

SEQ ID NO: 7471608 - DNA, 22 bp, Homo sapiens
caccagcttacagtctcacccc

SEQ ID NO: 7471609 - DNA, 22 bp, Homo sapiens
caccagcttacagtctcacccc

SEQ ID NO: 7471610 - DNA, 22 bp, Homo sapiens
caccagctgcaacaccatctcc

SEQ ID NO: 7471611 - DNA, 22 bp, Homo sapiens
caccagctgcaacaccatctcc

SEQ ID NO: 7471612 - DNA, 22 bp, Homo sapiens
caccagctctccaccaggtttc

SEQ ID NO: 7471613 - DNA, 22 bp, Homo sapiens
caccagcttgggctgtggaaat

SEQ ID NO: 7471614 - DNA, 22 bp, Homo sapiens
caccagcttgggctgtggaaat

SEQ ID NO: 7471615 - DNA, 22 bp, Homo sapiens
caccagcttgcagtcttaaccc

SEQ ID NO: 7471616 - DNA, 22 bp, Homo sapiens
caccagcttcccatcgcgggtc

SEQ ID NO: 7471617 - DNA, 22 bp, Homo sapiens
caccagcttctcattgcgggtc

SEQ ID NO: 7471618 - DNA, 22 bp, Homo sapiens
caccagcttctcattgcgggtc

SEQ ID NO: 7471619 - DNA, 22 bp, Homo sapiens
caccagcttcccatcgcgggtc

SEQ ID NO: 7471620 - DNA, 22 bp, Homo sapiens
caccagctgcaacaccatctcc

SEQ ID NO: 7471621 - DNA, 22 bp, Homo sapiens
caccagcttacagtctcacccc

SEQ ID NO: 7471622 - DNA, 22 bp, Homo sapiens
caccaggagccatcaggagtcc

SEQ ID NO: 7471623 - DNA, 22 bp, Homo sapiens
caccaggagccatcaggagtcc

SEQ ID NO: 7471624 - DNA, 22 bp, Homo sapiens
caccaggagccatcaggagtcc

SEQ ID NO: 7471625 - DNA, 22 bp, Homo sapiens
caccaggagccatcaggagtcc

SEQ ID NO: 7471626 - DNA, 22 bp, Homo sapiens
caccaggagccatcaggagtcc

SEQ ID NO: 7471627 - DNA, 22 bp, Homo sapiens
caccaggagcatctaggaggcg

SEQ ID NO: 7471628 - DNA, 22 bp, Homo sapiens
caccaggagcatctaggaggcg

SEQ ID NO: 7471629 - DNA, 22 bp, Homo sapiens
caccaggagcatctaggaggcg

SEQ ID NO: 7471630 - DNA, 22 bp, Homo sapiens
caccaggagcatctaggaggcg

SEQ ID NO: 7471631 - DNA, 22 bp, Homo sapiens
caccagctttgcccactgccca

SEQ ID NO: 7471632 - DNA, 22 bp, Homo sapiens
caccaggaagctgcaatttgag

SEQ ID NO: 7471633 - DNA, 22 bp, Homo sapiens
caccaggaagtattcaaagggt

SEQ ID NO: 7471634 - DNA, 22 bp, Homo sapiens
caccagctttgcccactgccca

SEQ ID NO: 7471635 - DNA, 22 bp, Homo sapiens
caccaggaagtggtggcctggg

SEQ ID NO: 7471636 - DNA, 22 bp, Homo sapiens
caccaggaagtattcaaagggt

SEQ ID NO: 7471637 - DNA, 20 bp, Homo sapiens
caccaggaccattggctatg

SEQ ID NO: 7471638 - DNA, 22 bp, Homo sapiens
caccaggaccccacggtgggtt

SEQ ID NO: 7471639 - DNA, 22 bp, Homo sapiens
caccaggaccccacggtgggtt

SEQ ID NO: 7471640 - DNA, 22 bp, Homo sapiens
cacatgtgcagttacatgaatt

SEQ ID NO: 7471641 - DNA, 22 bp, Homo sapiens
cacatgtgggaaatggtgctta

SEQ ID NO: 7471642 - DNA, 22 bp, Homo sapiens
cacatgtgcagttacatgaatt

SEQ ID NO: 7471643 - DNA, 22 bp, Homo sapiens
cacatgtgggaaatggtgctta

SEQ ID NO: 7471644 - DNA, 22 bp, Homo sapiens
cacatgcttagatttcagtgga

SEQ ID NO: 7471645 - DNA, 22 bp, Homo sapiens
cacatgcttagatttcagtgga

SEQ ID NO: 7471646 - DNA, 22 bp, Homo sapiens
cacatgcttagatttcagtgga

SEQ ID NO: 7471647 - DNA, 20 bp, Homo sapiens
cacatgctgtgtgtttctct

SEQ ID NO: 7471648 - DNA, 22 bp, Homo sapiens
cacatgtgcaaatactgaggct

SEQ ID NO: 7471649 - DNA, 22 bp, Homo sapiens
cacatgtgcaaatactgaggct

SEQ ID NO: 7471650 - DNA, 17 bp, Homo sapiens
cacatgttcttagagcc

SEQ ID NO: 7471651 - DNA, 17 bp, Homo sapiens
cacatgttcttagagcc

SEQ ID NO: 7471652 - DNA, 22 bp, Homo sapiens
cacatgttcttaacttctgttt

SEQ ID NO: 7471653 - DNA, 17 bp, Homo sapiens
cacatgttcttagagcc

SEQ ID NO: 7471654 - DNA, 22 bp, Homo sapiens
cacatgttcttgaagccaactc

SEQ ID NO: 7471655 - DNA, 22 bp, Homo sapiens
cacatgttcttgaagccaactc

SEQ ID NO: 7471656 - DNA, 22 bp, Homo sapiens
cacatgttcttgaagccaactc

SEQ ID NO: 7471657 - DNA, 22 bp, Homo sapiens
cacatgtttgctacatttttct

SEQ ID NO: 7471658 - DNA, 22 bp, Homo sapiens
cacatgtttgctacatttttct

SEQ ID NO: 7471659 - DNA, 22 bp, Homo sapiens
cacatgtttgctacatttttct

SEQ ID NO: 7471660 - DNA, 22 bp, Homo sapiens
cacatgtttcaggccatatttg

SEQ ID NO: 7471661 - DNA, 22 bp, Homo sapiens
cacatgtttcaggccatatttg

SEQ ID NO: 7471662 - DNA, 22 bp, Homo sapiens
cacatgtttcaggccatatttg

SEQ ID NO: 7471663 - DNA, 22 bp, Homo sapiens
cacatgtttcaggccatatttg

SEQ ID NO: 7471664 - DNA, 22 bp, Homo sapiens
cacatgtttcaggccatatttg

SEQ ID NO: 7471665 - DNA, 22 bp, Homo sapiens
cacatgttaatgaaaggttttt

SEQ ID NO: 7471666 - DNA, 22 bp, Homo sapiens
cacatgttaatgaaaggttttt

SEQ ID NO: 7471667 - DNA, 22 bp, Homo sapiens
cacatgtgtgctgaggactgtg

SEQ ID NO: 7471668 - DNA, 22 bp, Homo sapiens
cacatgtgtgctgaggactgtg

SEQ ID NO: 7471669 - DNA, 22 bp, Homo sapiens
cacatgtgtgctgaggactgtg

SEQ ID NO: 7471670 - DNA, 22 bp, Homo sapiens
cacattaagaataatgagacta

SEQ ID NO: 7471671 - DNA, 22 bp, Homo sapiens
cacattaagaataatgagacta

SEQ ID NO: 7471672 - DNA, 20 bp, Homo sapiens
cacattaaggaaaacaactg

SEQ ID NO: 7471673 - DNA, 20 bp, Homo sapiens
cacattaaggaaaacaactg

SEQ ID NO: 7471674 - DNA, 20 bp, Homo sapiens
cacattaaggaaaacaactg

SEQ ID NO: 7471675 - DNA, 22 bp, Homo sapiens
cacattaagaataatgagacta

SEQ ID NO: 7471676 - DNA, 22 bp, Homo sapiens
cacattaaaatcctaacttcca

SEQ ID NO: 7471677 - DNA, 22 bp, Homo sapiens
cacattaaaatcctaacttcca

SEQ ID NO: 7471678 - DNA, 22 bp, Homo sapiens
cacattaaaatcctaacttcca

SEQ ID NO: 7471679 - DNA, 22 bp, Homo sapiens
cacattaaaatcctaacttcca

SEQ ID NO: 7471680 - DNA, 22 bp, Homo sapiens
cacattaaaatcctaacttcca

SEQ ID NO: 7471681 - DNA, 22 bp, Homo sapiens
cacattaaaatcctaacttcca

SEQ ID NO: 7471682 - DNA, 22 bp, Homo sapiens
cacattaaaatcctaacttcca

SEQ ID NO: 7471683 - DNA, 22 bp, Homo sapiens
cacattaaaatcctaacttcca

SEQ ID NO: 7471684 - DNA, 22 bp, Homo sapiens
cacatgtttttggccatcatgg

SEQ ID NO: 7471685 - DNA, 22 bp, Homo sapiens
cacatgtttggcatgtcaccaa

SEQ ID NO: 7471686 - DNA, 22 bp, Homo sapiens
cacatgtttttggccatcatgg

SEQ ID NO: 7471687 - DNA, 22 bp, Homo sapiens
cacatgtttttggccatcatgg

SEQ ID NO: 7471688 - DNA, 22 bp, Homo sapiens
cacatgtttggcatgtcaccaa

SEQ ID NO: 7471689 - DNA, 22 bp, Homo sapiens
cacatgtttgctacatttttct

SEQ ID NO: 7471690 - DNA, 22 bp, Homo sapiens
cacatgtttggcatgtcaccaa

SEQ ID NO: 7471691 - DNA, 22 bp, Homo sapiens
cacattcaattacacagatagg

SEQ ID NO: 7471692 - DNA, 22 bp, Homo sapiens
cacattcaattacacagatagg

SEQ ID NO: 7471693 - DNA, 22 bp, Homo sapiens
cacattcaattacacagatagg

SEQ ID NO: 7471694 - DNA, 22 bp, Homo sapiens
cacattcacatttttccctcta

SEQ ID NO: 7471695 - DNA, 22 bp, Homo sapiens
cacattcacatttttccctcta

SEQ ID NO: 7471696 - DNA, 22 bp, Homo sapiens
cacattcaattacacagatagg

SEQ ID NO: 7471697 - DNA, 22 bp, Homo sapiens
cacattcaattacacagatagg

SEQ ID NO: 7471698 - DNA, 22 bp, Homo sapiens
cacattatgctactaccaaatg

SEQ ID NO: 7471699 - DNA, 20 bp, Homo sapiens
cacattaaggaaaacaactg

SEQ ID NO: 7471700 - DNA, 22 bp, Homo sapiens
cacattatgctactaccaaatg

SEQ ID NO: 7471701 - DNA, 22 bp, Homo sapiens
cacattcaattacacagatagg

SEQ ID NO: 7471702 - DNA, 22 bp, Homo sapiens
cacattcaattacacagatagg

SEQ ID NO: 7471703 - DNA, 22 bp, Homo sapiens
cacattcagctcattaatggtc

SEQ ID NO: 7471704 - DNA, 22 bp, Homo sapiens
cacattcaggattttccatgtc

SEQ ID NO: 7471705 - DNA, 22 bp, Homo sapiens
cacattcagctcattaatggtc

SEQ ID NO: 7471706 - DNA, 22 bp, Homo sapiens
cacattcaggattttccatgtc

SEQ ID NO: 7471707 - DNA, 22 bp, Homo sapiens
cacattcaggattttccatgtc

SEQ ID NO: 7471708 - DNA, 22 bp, Homo sapiens
cacattcacatttttccctcta

SEQ ID NO: 7471709 - DNA, 22 bp, Homo sapiens
cacattcacatttttccctcta

SEQ ID NO: 7471710 - DNA, 22 bp, Homo sapiens
cacattcacttctctgtccacc

SEQ ID NO: 7471711 - DNA, 22 bp, Homo sapiens
cacattcacttctctgtccacc

SEQ ID NO: 7471712 - DNA, 22 bp, Homo sapiens
cacattcacttctctgtccacc

SEQ ID NO: 7471713 - DNA, 22 bp, Homo sapiens
cacattcacttctctgtccacc

SEQ ID NO: 7471714 - DNA, 22 bp, Homo sapiens
cacattcacttctctgtccacc

SEQ ID NO: 7471715 - DNA, 20 bp, Homo sapiens
caccaggcgctctgagaaca

SEQ ID NO: 7471716 - DNA, 20 bp, Homo sapiens
caccaggcgctctgagaaca

SEQ ID NO: 7471717 - DNA, 22 bp, Homo sapiens
caccaggctgaaccagagggga

SEQ ID NO: 7471718 - DNA, 20 bp, Homo sapiens
caccaggcgctctgagaaca

SEQ ID NO: 7471719 - DNA, 22 bp, Homo sapiens
caccaggcacatagtaggcact

SEQ ID NO: 7471720 - DNA, 22 bp, Homo sapiens
caccaggcacatagtaggcact

SEQ ID NO: 7471721 - DNA, 22 bp, Homo sapiens
caccaggcacagctctcctgct

SEQ ID NO: 7471722 - DNA, 22 bp, Homo sapiens
caccaggcacatagtaggcact

SEQ ID NO: 7471723 - DNA, 22 bp, Homo sapiens
caccaggcacatagtaggcact

SEQ ID NO: 7471724 - DNA, 22 bp, Homo sapiens
caccaggatgggcaggtaggtc

SEQ ID NO: 7471725 - DNA, 22 bp, Homo sapiens
caccaggataaaacctctagat

SEQ ID NO: 7471726 - DNA, 22 bp, Homo sapiens
caccaggagtgagaatgaaggg

SEQ ID NO: 7471727 - DNA, 22 bp, Homo sapiens
caccaggagtgagaatgaaggg

SEQ ID NO: 7471728 - DNA, 22 bp, Homo sapiens
caccaggaggacaggcccctac

SEQ ID NO: 7471729 - DNA, 22 bp, Homo sapiens
caccaggatgggcaggtaggtc

SEQ ID NO: 7471730 - DNA, 22 bp, Homo sapiens
caccaggatgggcaggtaggtc

SEQ ID NO: 7471731 - DNA, 22 bp, Homo sapiens
caccaggctgcccaggacaggg

SEQ ID NO: 7471732 - DNA, 22 bp, Homo sapiens
caccaggctgcccaggacaggg

SEQ ID NO: 7471733 - DNA, 22 bp, Homo sapiens
caccaggctgcccaggacaggg

SEQ ID NO: 7471734 - DNA, 22 bp, Homo sapiens
caccaggctgcccaggacaggg

SEQ ID NO: 7471735 - DNA, 22 bp, Homo sapiens
caccaggctgcccaggacaggg

SEQ ID NO: 7471736 - DNA, 22 bp, Homo sapiens
caccaggctgcccaggacaggg

SEQ ID NO: 7471737 - DNA, 22 bp, Homo sapiens
caccaggctgcccaggacaggg

SEQ ID NO: 7471738 - DNA, 22 bp, Homo sapiens
caccaggctgcccaggacaggg

SEQ ID NO: 7471739 - DNA, 22 bp, Homo sapiens
caccaggctgcccaggacaggg

SEQ ID NO: 7471740 - DNA, 22 bp, Homo sapiens
caccaggctggagtgcagaggt

SEQ ID NO: 7471741 - DNA, 22 bp, Homo sapiens
caccaggctgcccaggacaggg

SEQ ID NO: 7471742 - DNA, 22 bp, Homo sapiens
caccaggctgagcctctcatct

SEQ ID NO: 7471743 - DNA, 22 bp, Homo sapiens
caccaggctgagcctctcatct

SEQ ID NO: 7471744 - DNA, 22 bp, Homo sapiens
caccaggctgaaccagagggga

SEQ ID NO: 7471745 - DNA, 22 bp, Homo sapiens
caccaggctgaaccagagggga

SEQ ID NO: 7471746 - DNA, 22 bp, Homo sapiens
caccaggctgaaccagagggga

SEQ ID NO: 7471747 - DNA, 22 bp, Homo sapiens
caccaggctgaaccagagggga

SEQ ID NO: 7471748 - DNA, 22 bp, Homo sapiens
caccaggctgaaccagagggga

SEQ ID NO: 7471749 - DNA, 22 bp, Homo sapiens
cacctgcctgcaggggctccac

SEQ ID NO: 7471750 - DNA, 22 bp, Homo sapiens
cacctgcctgcaggggctccac

SEQ ID NO: 7471751 - DNA, 22 bp, Homo sapiens
cacctgcctgcaggggctccac

SEQ ID NO: 7471752 - DNA, 22 bp, Homo sapiens
cacctgcctgcaggggctccac

SEQ ID NO: 7471753 - DNA, 22 bp, Homo sapiens
cacctgcctgctagagcctgac

SEQ ID NO: 7471754 - DNA, 22 bp, Homo sapiens
cacctgcctgctagagcctgac

SEQ ID NO: 7471755 - DNA, 22 bp, Homo sapiens
cacctgcctgctagagcctgac

SEQ ID NO: 7471756 - DNA, 22 bp, Homo sapiens
cacctgccccagtcttggagct

SEQ ID NO: 7471757 - DNA, 22 bp, Homo sapiens
cacctgccccagtcttggagct

SEQ ID NO: 7471758 - DNA, 22 bp, Homo sapiens
cacctgccccagtcttggagct

SEQ ID NO: 7471759 - DNA, 22 bp, Homo sapiens
cacctgccccagtcttggagct

SEQ ID NO: 7471760 - DNA, 22 bp, Homo sapiens
cacctgcccagcacctgggatc

SEQ ID NO: 7471761 - DNA, 22 bp, Homo sapiens
cacctgccccagtcttggagct

SEQ ID NO: 7471762 - DNA, 22 bp, Homo sapiens
cacctgccctttcttgctccac

SEQ ID NO: 7471763 - DNA, 22 bp, Homo sapiens
cacctgcctgcaggggctccac

SEQ ID NO: 7471764 - DNA, 22 bp, Homo sapiens
cacctgcctcatttgtccctgc

SEQ ID NO: 7471765 - DNA, 22 bp, Homo sapiens
cacctgcctcatttgtccctgc

SEQ ID NO: 7471766 - DNA, 22 bp, Homo sapiens
cacctgccaaatggggatgctg

SEQ ID NO: 7471767 - DNA, 22 bp, Homo sapiens
caccctgtacaaatggacatct

SEQ ID NO: 7471768 - DNA, 22 bp, Homo sapiens
cacctgcccagcacctgggatc

SEQ ID NO: 7471769 - DNA, 22 bp, Homo sapiens
cacctgcccagcacctgggatc

SEQ ID NO: 7471770 - DNA, 22 bp, Homo sapiens
caccctgggagtggaagtcagt

SEQ ID NO: 7471771 - DNA, 22 bp, Homo sapiens
caccctgggctgggcctgttaa

SEQ ID NO: 7471772 - DNA, 22 bp, Homo sapiens
caccctgggctgggcctgttaa

SEQ ID NO: 7471773 - DNA, 22 bp, Homo sapiens
caccctgggctgggcctgttaa

SEQ ID NO: 7471774 - DNA, 22 bp, Homo sapiens
caccctgggctgggcctgttaa

SEQ ID NO: 7471775 - DNA, 22 bp, Homo sapiens
caccaggctggagtgcagaggt

SEQ ID NO: 7471776 - DNA, 22 bp, Homo sapiens
caccaggctggagtgcagaggt

SEQ ID NO: 7471777 - DNA, 22 bp, Homo sapiens
caccctgggagtggaagtcagt

SEQ ID NO: 7471778 - DNA, 22 bp, Homo sapiens
caccctgggagtggaagtcagt

SEQ ID NO: 7471779 - DNA, 22 bp, Homo sapiens
caccaggctggagtgcagaggt

SEQ ID NO: 7471780 - DNA, 22 bp, Homo sapiens
caccaggctggagtgcagaggt

SEQ ID NO: 7471781 - DNA, 22 bp, Homo sapiens
caccaggctggagtgcagaggt

SEQ ID NO: 7471782 - DNA, 22 bp, Homo sapiens
caccaggctggagtgcagaggt

SEQ ID NO: 7471783 - DNA, 22 bp, Homo sapiens
caccaggctggagtgcagaggt

SEQ ID NO: 7471784 - DNA, 22 bp, Homo sapiens
caccaggctggagtgcagaggt

SEQ ID NO: 7471785 - DNA, 22 bp, Homo sapiens
caccaggctggagtgcagaggt

SEQ ID NO: 7471786 - DNA, 20 bp, Homo sapiens
caccaggcgctctgagaaca

SEQ ID NO: 7471787 - DNA, 22 bp, Homo sapiens
cacctggcccagctccagtgct

SEQ ID NO: 7471788 - DNA, 22 bp, Homo sapiens
cacctggcccagctccagtgct

SEQ ID NO: 7471789 - DNA, 22 bp, Homo sapiens
cacctggcagctgttggccacg

SEQ ID NO: 7471790 - DNA, 22 bp, Homo sapiens
cacctggcagctgttggccacg

SEQ ID NO: 7471791 - DNA, 22 bp, Homo sapiens
cacctggcccagctccagtgct

SEQ ID NO: 7471792 - DNA, 22 bp, Homo sapiens
cacctggcccagctccagtgct

SEQ ID NO: 7471793 - DNA, 20 bp, Homo sapiens
cacctggatatgacccagct

SEQ ID NO: 7471794 - DNA, 20 bp, Homo sapiens
cacctggatatgacccagct

SEQ ID NO: 7471795 - DNA, 22 bp, Homo sapiens
cacctggagtagcaaggtaatt

SEQ ID NO: 7471796 - DNA, 22 bp, Homo sapiens
cacctggatatgtttcagcttg

SEQ ID NO: 7471797 - DNA, 22 bp, Homo sapiens
cacctggatgccacaaagccac

SEQ ID NO: 7471798 - DNA, 22 bp, Homo sapiens
cacctgctccctcagttccagc

SEQ ID NO: 7471799 - DNA, 22 bp, Homo sapiens
cacctgctgagctgctgggggt

SEQ ID NO: 7471800 - DNA, 22 bp, Homo sapiens
cacctgcctggtccttagggct

SEQ ID NO: 7471801 - DNA, 22 bp, Homo sapiens
cacctgcctggtccttagggct

SEQ ID NO: 7471802 - DNA, 22 bp, Homo sapiens
cacctgcctggtccttagggct

SEQ ID NO: 7471803 - DNA, 22 bp, Homo sapiens
cacctgcctgcaggggctccac

SEQ ID NO: 7471804 - DNA, 22 bp, Homo sapiens
cacctgcctggtccttagggct

SEQ ID NO: 7471805 - DNA, 22 bp, Homo sapiens
cacctggctgtgaagcctgggt

SEQ ID NO: 7471806 - DNA, 22 bp, Homo sapiens
cacctggctgtgaagcctgggt

SEQ ID NO: 7471807 - DNA, 22 bp, Homo sapiens
cacctggctggaagtgctccgg

SEQ ID NO: 7471808 - DNA, 22 bp, Homo sapiens
cacctggctgtgaagcctgggt

SEQ ID NO: 7471809 - DNA, 23 bp, Homo sapiens
cacctggcttgagttggtgggtc

SEQ ID NO: 7471810 - DNA, 23 bp, Homo sapiens
cacctggcttgagttggtgggtc

SEQ ID NO: 7471811 - DNA, 22 bp, Homo sapiens
cacctgggctaaactatgcagg

SEQ ID NO: 7471812 - DNA, 22 bp, Homo sapiens
cacctgggctttctctggaact

SEQ ID NO: 7471813 - DNA, 22 bp, Homo sapiens
cacctgggctttctctggaact

SEQ ID NO: 7471814 - DNA, 22 bp, Homo sapiens
cacctgggctttctctggaact

SEQ ID NO: 7471815 - DNA, 22 bp, Homo sapiens
cacctgggctaaactatgcagg

SEQ ID NO: 7471816 - DNA, 22 bp, Homo sapiens
cacctggctggaagtgctccgg

SEQ ID NO: 7471817 - DNA, 22 bp, Homo sapiens
cacctggctggaagtgctccgg

SEQ ID NO: 7471818 - DNA, 20 bp, Homo sapiens
cacctggctgactgtctcca

SEQ ID NO: 7471819 - DNA, 22 bp, Homo sapiens
cacctggctgtgaagcctgggt

SEQ ID NO: 7471820 - DNA, 22 bp, Homo sapiens
cacctggctggaagtgctccgg

SEQ ID NO: 7471821 - DNA, 22 bp, Homo sapiens
cacctggctggaagtgctccgg

SEQ ID NO: 7471822 - DNA, 22 bp, Homo sapiens
cacctggctggaagtgctccgg

SEQ ID NO: 7471823 - DNA, 20 bp, Homo sapiens
cacctggctgactgtctcca

SEQ ID NO: 7471824 - DNA, 22 bp, Homo sapiens
cacctggcctacagggaccagc

SEQ ID NO: 7471825 - DNA, 20 bp, Homo sapiens
cacctggctgactgtctcca

SEQ ID NO: 7471826 - DNA, 20 bp, Homo sapiens
cacctggctgactgtctcca

SEQ ID NO: 7471827 - DNA, 20 bp, Homo sapiens
cacctggctgactgtctcca

SEQ ID NO: 7471828 - DNA, 22 bp, Homo sapiens
cacctggcagctgttggccacg

SEQ ID NO: 7471829 - DNA, 22 bp, Homo sapiens
ggccagggaggagaggcccctg

SEQ ID NO: 7471830 - DNA, 22 bp, Homo sapiens
ggccaggctggttccttgacct

SEQ ID NO: 7471831 - DNA, 22 bp, Homo sapiens
ggccagggaggagaggcccctg

SEQ ID NO: 7471832 - DNA, 22 bp, Homo sapiens
ggccagggaggagaggcccctg

SEQ ID NO: 7471833 - DNA, 22 bp, Homo sapiens
ggccagggaggagaggcccctg

SEQ ID NO: 7471834 - DNA, 22 bp, Homo sapiens
ggccagggaggagaggcccctg

SEQ ID NO: 7471835 - DNA, 22 bp, Homo sapiens
ggccagggaggagaggcccctg

SEQ ID NO: 7471836 - DNA, 22 bp, Homo sapiens
ggccaggctggttccttgacct

SEQ ID NO: 7471837 - DNA, 22 bp, Homo sapiens
ggccaggctggttccttgacct

SEQ ID NO: 7471838 - DNA, 22 bp, Homo sapiens
ggccaggctggttccttgacct

SEQ ID NO: 7471839 - DNA, 22 bp, Homo sapiens
ggccaggctggttccttgacct

SEQ ID NO: 7471840 - DNA, 22 bp, Homo sapiens
ggccaggctggtctcagacttc

SEQ ID NO: 7471841 - DNA, 22 bp, Homo sapiens
ggccaggctggtctcagacttc

SEQ ID NO: 7471842 - DNA, 22 bp, Homo sapiens
ggccaggctggtctcagacttc

SEQ ID NO: 7471843 - DNA, 22 bp, Homo sapiens
ggccaggctgctgggaccccgc

SEQ ID NO: 7471844 - DNA, 22 bp, Homo sapiens
ggccaggctggtctcagacttc

SEQ ID NO: 7471845 - DNA, 22 bp, Homo sapiens
ggccaggctgccctgggagcag

SEQ ID NO: 7471846 - DNA, 22 bp, Homo sapiens
ggccaggctgccctgggagcag

SEQ ID NO: 7471847 - DNA, 22 bp, Homo sapiens
ggccaggctgccctgggagcag

SEQ ID NO: 7471848 - DNA, 22 bp, Homo sapiens
ggccaggctgccctgggagcag

SEQ ID NO: 7471849 - DNA, 22 bp, Homo sapiens
cacctgggctttctctgggact

SEQ ID NO: 7471850 - DNA, 22 bp, Homo sapiens
cacctgggctttctctgggact

SEQ ID NO: 7471851 - DNA, 22 bp, Homo sapiens
ggccaggctgccctgggagcag

SEQ ID NO: 7471852 - DNA, 22 bp, Homo sapiens
ggccaggctgccctgggagcag

SEQ ID NO: 7471853 - DNA, 22 bp, Homo sapiens
ggccaggctgctgggaccccgc

SEQ ID NO: 7471854 - DNA, 22 bp, Homo sapiens
ggccaggctgctgggaccccgc

SEQ ID NO: 7471855 - DNA, 22 bp, Homo sapiens
ggccaggctgctgggaccccgc

SEQ ID NO: 7471856 - DNA, 22 bp, Homo sapiens
ggccaggctgctgggaccccgc

SEQ ID NO: 7471857 - DNA, 22 bp, Homo sapiens
ggccaggctggtctcagacttc

SEQ ID NO: 7471858 - DNA, 22 bp, Homo sapiens
ggccaggctgctgggaccccgc

SEQ ID NO: 7471859 - DNA, 22 bp, Homo sapiens
cactatttttcacttaggctta

SEQ ID NO: 7471860 - DNA, 22 bp, Homo sapiens
cactatttttcacttaggctta

SEQ ID NO: 7471861 - DNA, 22 bp, Homo sapiens
cactatttgctttgggctagag

SEQ ID NO: 7471862 - DNA, 22 bp, Homo sapiens
cactatttgctttgggctagag

SEQ ID NO: 7471863 - DNA, 22 bp, Homo sapiens
cactatttcctggattttgacg

SEQ ID NO: 7471864 - DNA, 22 bp, Homo sapiens
cactatttcctggattttgacg

SEQ ID NO: 7471865 - DNA, 22 bp, Homo sapiens
cactattttctcttcagatggc

SEQ ID NO: 7471866 - DNA, 22 bp, Homo sapiens
cactattttctcttcagatggc

SEQ ID NO: 7471867 - DNA, 22 bp, Homo sapiens
cactatttttcacttaggctta

SEQ ID NO: 7471868 - DNA, 22 bp, Homo sapiens
cactcaggctgtgtcaggagga

SEQ ID NO: 7471869 - DNA, 22 bp, Homo sapiens
cactcaggctgtgtcaggagga

SEQ ID NO: 7471870 - DNA, 22 bp, Homo sapiens
cactcagcccacccatgtttgt

SEQ ID NO: 7471871 - DNA, 22 bp, Homo sapiens
cactcagctgagccctcagccc

SEQ ID NO: 7471872 - DNA, 22 bp, Homo sapiens
cactcagaggtttgattgctca

SEQ ID NO: 7471873 - DNA, 22 bp, Homo sapiens
cactcagaggtttgattgctca

SEQ ID NO: 7471874 - DNA, 22 bp, Homo sapiens
cactcagaacatctccctgatg

SEQ ID NO: 7471875 - DNA, 22 bp, Homo sapiens
cactcatattggaacaagcttg

SEQ ID NO: 7471876 - DNA, 21 bp, Homo sapiens
cactcagtacctgcccgctgc

SEQ ID NO: 7471877 - DNA, 21 bp, Homo sapiens
cactcagggtatgtgccaggc

SEQ ID NO: 7471878 - DNA, 22 bp, Homo sapiens
cactcatattggaacaagcttg

SEQ ID NO: 7471879 - DNA, 22 bp, Homo sapiens
cactcatattggaacaagcttg

SEQ ID NO: 7471880 - DNA, 22 bp, Homo sapiens
cactccaagacctactttctct

SEQ ID NO: 7471881 - DNA, 22 bp, Homo sapiens
cactccaagacctactttctct

SEQ ID NO: 7471882 - DNA, 22 bp, Homo sapiens
cactcagggtacaatggagggc

SEQ ID NO: 7471883 - DNA, 21 bp, Homo sapiens
cactcagggtatgtgccaggc

SEQ ID NO: 7471884 - DNA, 21 bp, Homo sapiens
cactccacttagaacagggtt

SEQ ID NO: 7471885 - DNA, 21 bp, Homo sapiens
cactccacttagaacagggtt

SEQ ID NO: 7471886 - DNA, 21 bp, Homo sapiens
cactccacttagaacagggtt

SEQ ID NO: 7471887 - DNA, 21 bp, Homo sapiens
cactccacttagaacagggtt

SEQ ID NO: 7471888 - DNA, 21 bp, Homo sapiens
cactccacttagaacagggtt

SEQ ID NO: 7471889 - DNA, 21 bp, Homo sapiens
cactccacttagaacagggtt

SEQ ID NO: 7471890 - DNA, 21 bp, Homo sapiens
cactccacttagaacagggtt

SEQ ID NO: 7471891 - DNA, 21 bp, Homo sapiens
cactccacttagaacagggtt

SEQ ID NO: 7471892 - DNA, 21 bp, Homo sapiens
cactccacttagaacagggtt

SEQ ID NO: 7471893 - DNA, 22 bp, Homo sapiens
ggccagggccaaggctttccca

SEQ ID NO: 7471894 - DNA, 22 bp, Homo sapiens
cacgccagccggacactgggcc

SEQ ID NO: 7471895 - DNA, 22 bp, Homo sapiens
ggccagggccaaggctttccca

SEQ ID NO: 7471896 - DNA, 22 bp, Homo sapiens
ggccagggaggagaggcccctg

SEQ ID NO: 7471897 - DNA, 23 bp, Homo sapiens
cacggcagcctccgagggtgctg

SEQ ID NO: 7471898 - DNA, 23 bp, Homo sapiens
cacggcagcctccgagggtgctg

SEQ ID NO: 7471899 - DNA, 22 bp, Homo sapiens
cacgctatatttatgcataggt

SEQ ID NO: 7471900 - DNA, 22 bp, Homo sapiens
cacgctggtcattgtagtccag

SEQ ID NO: 7471901 - DNA, 22 bp, Homo sapiens
cactataatcctgttttagaac

SEQ ID NO: 7471902 - DNA, 22 bp, Homo sapiens
cactagtggccccatgtggttg

SEQ ID NO: 7471903 - DNA, 22 bp, Homo sapiens
cactagtggccccatgtggttg

SEQ ID NO: 7471904 - DNA, 22 bp, Homo sapiens
cactagtggccccatgtggttg

SEQ ID NO: 7471905 - DNA, 19 bp, Homo sapiens
cactagtctagatgggatg

SEQ ID NO: 7471906 - DNA, 22 bp, Homo sapiens
cactaggctggagtgcagtggc

SEQ ID NO: 7471907 - DNA, 22 bp, Homo sapiens
cactagtaattcttgtgctgga

SEQ ID NO: 7471908 - DNA, 17 bp, Homo sapiens
cactagtagtctctggc

SEQ ID NO: 7471909 - DNA, 17 bp, Homo sapiens
cactagtagtctctggc

SEQ ID NO: 7471910 - DNA, 22 bp, Homo sapiens
cactatttatacttcctgatcc

SEQ ID NO: 7471911 - DNA, 21 bp, Homo sapiens
cactatttatatatgccagct

SEQ ID NO: 7471912 - DNA, 22 bp, Homo sapiens
cactatttatacttcctgatcc

SEQ ID NO: 7471913 - DNA, 22 bp, Homo sapiens
cactatgtgcattgttttctcc

SEQ ID NO: 7471914 - DNA, 22 bp, Homo sapiens
cactatgtgcattgttttctcc

SEQ ID NO: 7471915 - DNA, 22 bp, Homo sapiens
cactatgcttacatgcttatat

SEQ ID NO: 7471916 - DNA, 22 bp, Homo sapiens
cactatttcctggattttgacg

SEQ ID NO: 7471917 - DNA, 22 bp, Homo sapiens
cactatttcctggattttgacg

SEQ ID NO: 7471918 - DNA, 22 bp, Homo sapiens
cactatttcctggattttgacg

SEQ ID NO: 7471919 - DNA, 21 bp, Homo sapiens
cactatttatatatgccagct

SEQ ID NO: 7471920 - DNA, 22 bp, Homo sapiens
cactatttcagtgattctgcag

SEQ ID NO: 7471921 - DNA, 22 bp, Homo sapiens
cactatttcagtgattctgcag

SEQ ID NO: 7471922 - DNA, 22 bp, Homo sapiens
cactatttcagtgattctgcag

SEQ ID NO: 7471923 - DNA, 22 bp, Homo sapiens
cactatatgcctttgaaataca

SEQ ID NO: 7471924 - DNA, 22 bp, Homo sapiens
cactatatgcctttgaaataca

SEQ ID NO: 7471925 - DNA, 22 bp, Homo sapiens
cactatatgcctttgaaataca

SEQ ID NO: 7471926 - DNA, 22 bp, Homo sapiens
cactatcttgtagggcatggca

SEQ ID NO: 7471927 - DNA, 22 bp, Homo sapiens
cactatcttgtagggcatggca

SEQ ID NO: 7471928 - DNA, 22 bp, Homo sapiens
cactatgcagtgagaaaatggc

SEQ ID NO: 7471929 - DNA, 22 bp, Homo sapiens
cactatctactattgtggttat

SEQ ID NO: 7471930 - DNA, 22 bp, Homo sapiens
cactagttttgcattgctgaaa

SEQ ID NO: 7471931 - DNA, 22 bp, Homo sapiens
cactataatcctgttttagaac

SEQ ID NO: 7471932 - DNA, 22 bp, Homo sapiens
cactatatctctttcatctttt

SEQ ID NO: 7471933 - DNA, 22 bp, Homo sapiens
cactatatctgttcttgtttat

SEQ ID NO: 7471934 - DNA, 22 bp, Homo sapiens
cactatatctgttcttgtttat

SEQ ID NO: 7471935 - DNA, 22 bp, Homo sapiens
cactatatctctttcatctttt

SEQ ID NO: 7471936 - DNA, 22 bp, Homo sapiens
cactatatctctttcatctttt

SEQ ID NO: 7471937 - DNA, 22 bp, Homo sapiens
cactgcactccagcctgggaga

SEQ ID NO: 7471938 - DNA, 22 bp, Homo sapiens
cactgcactccagcctgggaga

SEQ ID NO: 7471939 - DNA, 22 bp, Homo sapiens
cactgcactccagcctgggaga

SEQ ID NO: 7471940 - DNA, 22 bp, Homo sapiens
cactgcactccagcctgggaga

SEQ ID NO: 7471941 - DNA, 22 bp, Homo sapiens
cactgcactccagcctgggaga

SEQ ID NO: 7471942 - DNA, 22 bp, Homo sapiens
cactgcactccagcctgggaga

SEQ ID NO: 7471943 - DNA, 22 bp, Homo sapiens
cactgcactccagcctgggaga

SEQ ID NO: 7471944 - DNA, 22 bp, Homo sapiens
cactgcactccagcctgggaga

SEQ ID NO: 7471945 - DNA, 22 bp, Homo sapiens
cactgcactccagcctgggaga

SEQ ID NO: 7471946 - DNA, 22 bp, Homo sapiens
cactgcactccagcctgggaga

SEQ ID NO: 7471947 - DNA, 22 bp, Homo sapiens
cactgcactccagcctgggaga

SEQ ID NO: 7471948 - DNA, 22 bp, Homo sapiens
cactgcactccagcctgggaga

SEQ ID NO: 7471949 - DNA, 22 bp, Homo sapiens
cactgcactccagcctgggaga

SEQ ID NO: 7471950 - DNA, 22 bp, Homo sapiens
cactgcactccagcctgggaga

SEQ ID NO: 7471951 - DNA, 22 bp, Homo sapiens
cactgcactccagcctgggaga

SEQ ID NO: 7471952 - DNA, 22 bp, Homo sapiens
cactgcaacctccacctcctgg

SEQ ID NO: 7471953 - DNA, 22 bp, Homo sapiens
cactgcaacctccacctcctgg

SEQ ID NO: 7471954 - DNA, 22 bp, Homo sapiens
cactgcaacctccacctcctgg

SEQ ID NO: 7471955 - DNA, 22 bp, Homo sapiens
cactgcactccagcctgcgcaa

SEQ ID NO: 7471956 - DNA, 22 bp, Homo sapiens
cactgcactccagcctgggaga

SEQ ID NO: 7471957 - DNA, 22 bp, Homo sapiens
cactgcactccagcctgggaga

SEQ ID NO: 7471958 - DNA, 22 bp, Homo sapiens
cactgcactccagcctgggaga

SEQ ID NO: 7471959 - DNA, 22 bp, Homo sapiens
cactgcactccagcctgggaga

SEQ ID NO: 7471960 - DNA, 22 bp, Homo sapiens
cactgcactccagcctgggaga

SEQ ID NO: 7471961 - DNA, 22 bp, Homo sapiens
cactgcaacctccacctcctgg

SEQ ID NO: 7471962 - DNA, 22 bp, Homo sapiens
cactctgacacatgaacttgat

SEQ ID NO: 7471963 - DNA, 21 bp, Homo sapiens
cactctcccaatccttgctga

SEQ ID NO: 7471964 - DNA, 22 bp, Homo sapiens
cactctcagcataatgaatgtg

SEQ ID NO: 7471965 - DNA, 22 bp, Homo sapiens
cactctcagcataatgaatgtg

SEQ ID NO: 7471966 - DNA, 22 bp, Homo sapiens
cactctcactgagctcatgcca

SEQ ID NO: 7471967 - DNA, 22 bp, Homo sapiens
cactctcactgagctcatgcca

SEQ ID NO: 7471968 - DNA, 23 bp, Homo sapiens
cactcctgtttctaagccagcat

SEQ ID NO: 7471969 - DNA, 22 bp, Homo sapiens
cactcctgttccactaaatgag

SEQ ID NO: 7471970 - DNA, 22 bp, Homo sapiens
cactcctgttccactaaatgag

SEQ ID NO: 7471971 - DNA, 22 bp, Homo sapiens
cactcccttcaggagcctagga

SEQ ID NO: 7471972 - DNA, 23 bp, Homo sapiens
cactcctgtttctaagccagcat

SEQ ID NO: 7471973 - DNA, 20 bp, Homo sapiens
cactctaaccatatttcctc

SEQ ID NO: 7471974 - DNA, 22 bp, Homo sapiens
cactctaacctccatcttccat

SEQ ID NO: 7471975 - DNA, 22 bp, Homo sapiens
cactctaacctccatcttccat

SEQ ID NO: 7471976 - DNA, 22 bp, Homo sapiens
cactctcacatgccctgtcagt

SEQ ID NO: 7471977 - DNA, 22 bp, Homo sapiens
cactcccttcaggagcctagga

SEQ ID NO: 7471978 - DNA, 22 bp, Homo sapiens
cactcccttcaggagcctagga

SEQ ID NO: 7471979 - DNA, 22 bp, Homo sapiens
cactcctataattaaagatgca

SEQ ID NO: 7471980 - DNA, 22 bp, Homo sapiens
cactccctctagttgcattctg

SEQ ID NO: 7471981 - DNA, 22 bp, Homo sapiens
cactccagtctgggaacaaagc

SEQ ID NO: 7471982 - DNA, 22 bp, Homo sapiens
cactccctctagttgcattctg

SEQ ID NO: 7471983 - DNA, 22 bp, Homo sapiens
cactccaggtcccagttcctgg

SEQ ID NO: 7471984 - DNA, 22 bp, Homo sapiens
cactccaggtcccagttcctgg

SEQ ID NO: 7471985 - DNA, 22 bp, Homo sapiens
cactccagcctcagtgacagag

SEQ ID NO: 7471986 - DNA, 22 bp, Homo sapiens
cactccagcctcagtgacagag

SEQ ID NO: 7471987 - DNA, 22 bp, Homo sapiens
cactccagcctcagtgacagag

SEQ ID NO: 7471988 - DNA, 22 bp, Homo sapiens
cactccagatcacaccccttgg

SEQ ID NO: 7471989 - DNA, 22 bp, Homo sapiens
cactccagcctcagtgacagag

SEQ ID NO: 7471990 - DNA, 21 bp, Homo sapiens
cactccacttagaacagggtt

SEQ ID NO: 7471991 - DNA, 21 bp, Homo sapiens
cactccacttagaacagggtt

SEQ ID NO: 7471992 - DNA, 22 bp, Homo sapiens
cactccagccatttgtccccag

SEQ ID NO: 7471993 - DNA, 22 bp, Homo sapiens
cacttcaatctctgcctccatc

SEQ ID NO: 7471994 - DNA, 22 bp, Homo sapiens
cacttcaatctctgcctccatc

SEQ ID NO: 7471995 - DNA, 22 bp, Homo sapiens
cacttcaattaacttcagcatt

SEQ ID NO: 7471996 - DNA, 22 bp, Homo sapiens
cacttcaattaacttcagcatt

SEQ ID NO: 7471997 - DNA, 19 bp, Homo sapiens
cacttcacatggtgaaagc

SEQ ID NO: 7471998 - DNA, 22 bp, Homo sapiens
cacttcaaggaatatctagaaa

SEQ ID NO: 7471999 - DNA, 22 bp, Homo sapiens
cacttcaaggaatatctagaaa

SEQ ID NO: 7472000 - DNA, 19 bp, Homo sapiens
cacttcaatcctttatcaa

SEQ ID NO: 7472001 - DNA, 22 bp, Homo sapiens
cacttcaaggaatatctagaaa

SEQ ID NO: 7472002 - DNA, 19 bp, Homo sapiens
cacttcaatcctttatcaa

SEQ ID NO: 7472003 - DNA, 22 bp, Homo sapiens
cacttcattgggaccagggctg

SEQ ID NO: 7472004 - DNA, 22 bp, Homo sapiens
cacttcattgggaccagggctg

SEQ ID NO: 7472005 - DNA, 22 bp, Homo sapiens
cacttcattgggaccagggctg

SEQ ID NO: 7472006 - DNA, 22 bp, Homo sapiens
cacttcattgggaccagggctg

SEQ ID NO: 7472007 - DNA, 22 bp, Homo sapiens
cacttccagagtctgggctggg

SEQ ID NO: 7472008 - DNA, 22 bp, Homo sapiens
cacttccagagtctgggctggg

SEQ ID NO: 7472009 - DNA, 22 bp, Homo sapiens
cacttccagagtctgggctggg

SEQ ID NO: 7472010 - DNA, 22 bp, Homo sapiens
cacttcagctacaatcacatga

SEQ ID NO: 7472011 - DNA, 22 bp, Homo sapiens
cacttcaccactaggctatact

SEQ ID NO: 7472012 - DNA, 22 bp, Homo sapiens
cacttcacttggatgccttttc

SEQ ID NO: 7472013 - DNA, 22 bp, Homo sapiens
cacttcattgggaccagggctg

SEQ ID NO: 7472014 - DNA, 22 bp, Homo sapiens
cacttcattgggaccagggctg

SEQ ID NO: 7472015 - DNA, 22 bp, Homo sapiens
cacttcaggttctggcagggcg

SEQ ID NO: 7472016 - DNA, 22 bp, Homo sapiens
cacttcaaataagctcttctca

SEQ ID NO: 7472017 - DNA, 22 bp, Homo sapiens
cacttcaaatatggcttcatga

SEQ ID NO: 7472018 - DNA, 22 bp, Homo sapiens
cacttcaaatatggcttcatga

SEQ ID NO: 7472019 - DNA, 22 bp, Homo sapiens
cacttcaaataagctcttctca

SEQ ID NO: 7472020 - DNA, 22 bp, Homo sapiens
cacttcaagagcaagggtgcca

SEQ ID NO: 7472021 - DNA, 22 bp, Homo sapiens
cacttcaagagcaagggtgcca

SEQ ID NO: 7472022 - DNA, 22 bp, Homo sapiens
cacttcaacctctgagtcctgg

SEQ ID NO: 7472023 - DNA, 22 bp, Homo sapiens
cacttcaacctctgagtcctgg

SEQ ID NO: 7472024 - DNA, 22 bp, Homo sapiens
cacttcaacagttatttcttag

SEQ ID NO: 7472025 - DNA, 22 bp, Homo sapiens
cacttcaacagttatttcttag

SEQ ID NO: 7472026 - DNA, 22 bp, Homo sapiens
cacttcaacctctgagtcctgg

SEQ ID NO: 7472027 - DNA, 22 bp, Homo sapiens
cacttatactttggatgtggat

SEQ ID NO: 7472028 - DNA, 22 bp, Homo sapiens
cacttagatactagatcacaaa

SEQ ID NO: 7472029 - DNA, 22 bp, Homo sapiens
cacttaagcagttaatttatct

SEQ ID NO: 7472030 - DNA, 22 bp, Homo sapiens
cacttaaatgttcctacagcag

SEQ ID NO: 7472031 - DNA, 22 bp, Homo sapiens
cacttaactgtgtgccaagtac

SEQ ID NO: 7472032 - DNA, 20 bp, Homo sapiens
ggctctgcttgtgagcagcc

SEQ ID NO: 7472033 - DNA, 22 bp, Homo sapiens
ggctctggaaagtgtccttgat

SEQ ID NO: 7472034 - DNA, 22 bp, Homo sapiens
ggctctggaaagtgtccttgat

SEQ ID NO: 7472035 - DNA, 22 bp, Homo sapiens
ggctctggaaagtgtccttgat

SEQ ID NO: 7472036 - DNA, 20 bp, Homo sapiens
ggctctgcttgtgagcagcc

SEQ ID NO: 7472037 - DNA, 20 bp, Homo sapiens
ggctctgcttgtgagcagcc

SEQ ID NO: 7472038 - DNA, 22 bp, Homo sapiens
ggctctggaaagtgtccttgat

SEQ ID NO: 7472039 - DNA, 20 bp, Homo sapiens
ggctctgcttgtgagcagcc

SEQ ID NO: 7472040 - DNA, 20 bp, Homo sapiens
ggctctgcttgtgagcagcc

SEQ ID NO: 7472041 - DNA, 20 bp, Homo sapiens
ggctctgcttgtgagcagcc

SEQ ID NO: 7472042 - DNA, 22 bp, Homo sapiens
ggctctggaaagtgtccttgat

SEQ ID NO: 7472043 - DNA, 22 bp, Homo sapiens
ggctctggaaagtgtccttgat

SEQ ID NO: 7472044 - DNA, 22 bp, Homo sapiens
ggctctggaaagtgtccttgat

SEQ ID NO: 7472045 - DNA, 20 bp, Homo sapiens
ggctctggaatctggtgggc

SEQ ID NO: 7472046 - DNA, 20 bp, Homo sapiens
ggctctggaatctggtgggc

SEQ ID NO: 7472047 - DNA, 20 bp, Homo sapiens
ggctctggaatctggtgggc

SEQ ID NO: 7472048 - DNA, 20 bp, Homo sapiens
ggctctggaatctggtgggc

SEQ ID NO: 7472049 - DNA, 20 bp, Homo sapiens
ggctctggaatctggtgggc

SEQ ID NO: 7472050 - DNA, 20 bp, Homo sapiens
ggctctggaatctggtgggc

SEQ ID NO: 7472051 - DNA, 22 bp, Homo sapiens
cactgtggcaacctgtgcccaa

SEQ ID NO: 7472052 - DNA, 20 bp, Homo sapiens
ggctctggaatctggtgggc

SEQ ID NO: 7472053 - DNA, 22 bp, Homo sapiens
cacttaaatctgttgagaaaaa

SEQ ID NO: 7472054 - DNA, 22 bp, Homo sapiens
cacttaaatgttcctacagcag

SEQ ID NO: 7472055 - DNA, 22 bp, Homo sapiens
cacttaaatctgttgagaaaaa

SEQ ID NO: 7472056 - DNA, 22 bp, Homo sapiens
cacttaaatctgttgagaaaaa

SEQ ID NO: 7472057 - DNA, 22 bp, Homo sapiens
cactgtggcttaccaaagctaa

SEQ ID NO: 7472058 - DNA, 22 bp, Homo sapiens
cacttaaagtcttagcttacag

SEQ ID NO: 7472059 - DNA, 22 bp, Homo sapiens
cactgtggcaacctgtgcccaa

SEQ ID NO: 7472060 - DNA, 22 bp, Homo sapiens
cactgtggcttaccaaagctaa

SEQ ID NO: 7472061 - DNA, 22 bp, Homo sapiens
cacttgttggtggtgaaatcac

SEQ ID NO: 7472062 - DNA, 22 bp, Homo sapiens
cacttgttggtggtgaaatcac

SEQ ID NO: 7472063 - DNA, 22 bp, Homo sapiens
cacttgttggtggtgaaatcac

SEQ ID NO: 7472064 - DNA, 21 bp, Homo sapiens
cactttaaaaatatctttata

SEQ ID NO: 7472065 - DNA, 21 bp, Homo sapiens
cactttaaaaatatctttata

SEQ ID NO: 7472066 - DNA, 21 bp, Homo sapiens
cactttaaaaatatctttata

SEQ ID NO: 7472067 - DNA, 21 bp, Homo sapiens
cactttaaaaatatctttata

SEQ ID NO: 7472068 - DNA, 22 bp, Homo sapiens
cacttgttggtggtgaaatcac

SEQ ID NO: 7472069 - DNA, 22 bp, Homo sapiens
cacttgtagaggcattattcca

SEQ ID NO: 7472070 - DNA, 22 bp, Homo sapiens
cacttggtttgggagtacataa

SEQ ID NO: 7472071 - DNA, 22 bp, Homo sapiens
cacttgttggtggtgaaatcac

SEQ ID NO: 7472072 - DNA, 22 bp, Homo sapiens
cacttgttggtggtgaaatcac

SEQ ID NO: 7472073 - DNA, 22 bp, Homo sapiens
cacttgttggtggtgaaatcac

SEQ ID NO: 7472074 - DNA, 22 bp, Homo sapiens
cacttgttggtggtgaaatcac

SEQ ID NO: 7472075 - DNA, 22 bp, Homo sapiens
cacttggtgagaaaagcacagg

SEQ ID NO: 7472076 - DNA, 22 bp, Homo sapiens
cacttgggattaggggctaggt

SEQ ID NO: 7472077 - DNA, 22 bp, Homo sapiens
cacttgggattaggggctaggt

SEQ ID NO: 7472078 - DNA, 22 bp, Homo sapiens
cacttgggagcattgcacatgt

SEQ ID NO: 7472079 - DNA, 22 bp, Homo sapiens
cacttgggattaggggctaggt

SEQ ID NO: 7472080 - DNA, 17 bp, Homo sapiens
ggctgctgtgctggtgc

SEQ ID NO: 7472081 - DNA, 20 bp, Homo sapiens
ggctgctgtgggcagagagg

SEQ ID NO: 7472082 - DNA, 22 bp, Homo sapiens
ggctggcaaaaaccttctctga

SEQ ID NO: 7472083 - DNA, 22 bp, Homo sapiens
ggctggcaagtcagtgctgatg

SEQ ID NO: 7472084 - DNA, 22 bp, Homo sapiens
ggctggcaagtcagtgctgatg

SEQ ID NO: 7472085 - DNA, 22 bp, Homo sapiens
ggctggcaagtcagtgctgatg

SEQ ID NO: 7472086 - DNA, 22 bp, Homo sapiens
ggctggatttttggaaggagag

SEQ ID NO: 7472087 - DNA, 22 bp, Homo sapiens
ggctggatttttggaaggagag

SEQ ID NO: 7472088 - DNA, 22 bp, Homo sapiens
ggctggcaaaaaccttctctga

SEQ ID NO: 7472089 - DNA, 21 bp, Homo sapiens
cactttaaaaatatctttata

SEQ ID NO: 7472090 - DNA, 22 bp, Homo sapiens
cactttaaaactgacagccctt

SEQ ID NO: 7472091 - DNA, 22 bp, Homo sapiens
cactttaactcacatttcagct

SEQ ID NO: 7472092 - DNA, 17 bp, Homo sapiens
ggctgctgtgctggtgc

SEQ ID NO: 7472093 - DNA, 17 bp, Homo sapiens
ggctgctgtgctggtgc

SEQ ID NO: 7472094 - DNA, 22 bp, Homo sapiens
cactttaactcacatttcagct

SEQ ID NO: 7472095 - DNA, 17 bp, Homo sapiens
ggctgctgtgctggtgc

SEQ ID NO: 7472096 - DNA, 17 bp, Homo sapiens
ggctgctgtgctggtgc

SEQ ID NO: 7472097 - DNA, 23 bp, Homo sapiens
cacttcccctgtggcgagcctgc

SEQ ID NO: 7472098 - DNA, 23 bp, Homo sapiens
cacttcccctgtggcgagcctgc

SEQ ID NO: 7472099 - DNA, 22 bp, Homo sapiens
cacttctctgataatctcagtt

SEQ ID NO: 7472100 - DNA, 22 bp, Homo sapiens
cacttgaaaatcagaggaaatt

SEQ ID NO: 7472101 - DNA, 22 bp, Homo sapiens
cacttgaaagtaatggttgtgc

SEQ ID NO: 7472102 - DNA, 22 bp, Homo sapiens
cacttgaaagtaatggttgtgc

SEQ ID NO: 7472103 - DNA, 22 bp, Homo sapiens
cacttgaacccgggaggctgag

SEQ ID NO: 7472104 - DNA, 22 bp, Homo sapiens
cacttgaacccgggaggctgag

SEQ ID NO: 7472105 - DNA, 22 bp, Homo sapiens
cacttgaacccgggaggctgag

SEQ ID NO: 7472106 - DNA, 22 bp, Homo sapiens
cacttgaaatattaggggtgat

SEQ ID NO: 7472107 - DNA, 22 bp, Homo sapiens
cacttgaactgtttgaatgaga

SEQ ID NO: 7472108 - DNA, 22 bp, Homo sapiens
cacttctgttgccttgtgcaat

SEQ ID NO: 7472109 - DNA, 22 bp, Homo sapiens
cacttgaactgtttgaatgaga

SEQ ID NO: 7472110 - DNA, 22 bp, Homo sapiens
cacttgaactgtttgaatgaga

SEQ ID NO: 7472111 - DNA, 22 bp, Homo sapiens
cacttgaagtgaattgctcacc

SEQ ID NO: 7472112 - DNA, 22 bp, Homo sapiens
cacttgaagtgaattgctcacc

SEQ ID NO: 7472113 - DNA, 22 bp, Homo sapiens
cacttgaagtttgggggactct

SEQ ID NO: 7472114 - DNA, 22 bp, Homo sapiens
cacttgcttaccggagaggtgc

SEQ ID NO: 7472115 - DNA, 17 bp, Homo sapiens
cacttgctggtctacct

SEQ ID NO: 7472116 - DNA, 22 bp, Homo sapiens
cacttggaggaaggcctattca

SEQ ID NO: 7472117 - DNA, 22 bp, Homo sapiens
cacttgggacaaagcttctgct

SEQ ID NO: 7472118 - DNA, 22 bp, Homo sapiens
cacttggaggccccctgtgccc

SEQ ID NO: 7472119 - DNA, 22 bp, Homo sapiens
cacttgcctacccttagaacgt

SEQ ID NO: 7472120 - DNA, 22 bp, Homo sapiens
cacttgatggaagagcagaaga

SEQ ID NO: 7472121 - DNA, 22 bp, Homo sapiens
cacttgagttcttaatagtcag

SEQ ID NO: 7472122 - DNA, 22 bp, Homo sapiens
cacttgagttcttaatagtcag

SEQ ID NO: 7472123 - DNA, 21 bp, Homo sapiens
cacttgaatggtgttttacaa

SEQ ID NO: 7472124 - DNA, 21 bp, Homo sapiens
cacttgaatggtgttttacaa

SEQ ID NO: 7472125 - DNA, 22 bp, Homo sapiens
cacttgaatgaaagagactcct

SEQ ID NO: 7472126 - DNA, 22 bp, Homo sapiens
cacttgaagtgaattgctcacc

SEQ ID NO: 7472127 - DNA, 22 bp, Homo sapiens
cacttgaatgagaatttcctgg

SEQ ID NO: 7472128 - DNA, 22 bp, Homo sapiens
cacttgaatggcattgttcctt

SEQ ID NO: 7472129 - DNA, 22 bp, Homo sapiens
cacttgaatggcattgttcctt

SEQ ID NO: 7472130 - DNA, 22 bp, Homo sapiens
cactgtaagatgagctttttta

SEQ ID NO: 7472131 - DNA, 22 bp, Homo sapiens
cactgtaatagcattataagtg

SEQ ID NO: 7472132 - DNA, 22 bp, Homo sapiens
cactgtaatagcattataagtg

SEQ ID NO: 7472133 - DNA, 22 bp, Homo sapiens
cactgtaacctccacctcctgg

SEQ ID NO: 7472134 - DNA, 22 bp, Homo sapiens
cactgtaacctccacctcctgg

SEQ ID NO: 7472135 - DNA, 22 bp, Homo sapiens
cactgtaacctccacctcctgg

SEQ ID NO: 7472136 - DNA, 22 bp, Homo sapiens
cactgtaaagcgtcacagggac

SEQ ID NO: 7472137 - DNA, 22 bp, Homo sapiens
cactggttggctgagatccata

SEQ ID NO: 7472138 - DNA, 22 bp, Homo sapiens
cactgtactgggttgaaggacg

SEQ ID NO: 7472139 - DNA, 22 bp, Homo sapiens
cactgtacccatttaaataaat

SEQ ID NO: 7472140 - DNA, 22 bp, Homo sapiens
cactgtacccatttaaataaat

SEQ ID NO: 7472141 - DNA, 22 bp, Homo sapiens
cactgtacagcattaacaaggc

SEQ ID NO: 7472142 - DNA, 22 bp, Homo sapiens
cactgtacagcattaacaaggc

SEQ ID NO: 7472143 - DNA, 22 bp, Homo sapiens
cactgtacccatttaaataaat

SEQ ID NO: 7472144 - DNA, 22 bp, Homo sapiens
cactgtaatagcattataagtg

SEQ ID NO: 7472145 - DNA, 22 bp, Homo sapiens
cactgtaacctccacctcctgg

SEQ ID NO: 7472146 - DNA, 22 bp, Homo sapiens
cactgtaatggaattttcttta

SEQ ID NO: 7472147 - DNA, 22 bp, Homo sapiens
cactgtacagcattaacaaggc

SEQ ID NO: 7472148 - DNA, 22 bp, Homo sapiens
cactgggcaattctgagcctaa

SEQ ID NO: 7472149 - DNA, 22 bp, Homo sapiens
cactgggcaattctgagcctaa

SEQ ID NO: 7472150 - DNA, 22 bp, Homo sapiens
cactgggagtcgtaagacacgg

SEQ ID NO: 7472151 - DNA, 22 bp, Homo sapiens
cactggtgccagagaacagaat

SEQ ID NO: 7472152 - DNA, 22 bp, Homo sapiens
cactggtgccagagaacagaat

SEQ ID NO: 7472153 - DNA, 22 bp, Homo sapiens
cactggtgatgaggcagttagg

SEQ ID NO: 7472154 - DNA, 22 bp, Homo sapiens
cactggttgcctctttctgttc

SEQ ID NO: 7472155 - DNA, 22 bp, Homo sapiens
cactggtgtctgagcagggtga

SEQ ID NO: 7472156 - DNA, 22 bp, Homo sapiens
cactggtgtctgagcagggtga

SEQ ID NO: 7472157 - DNA, 22 bp, Homo sapiens
cactggtgtctgagcagggtga

SEQ ID NO: 7472158 - DNA, 22 bp, Homo sapiens
cactggtgtattagagctagaa

SEQ ID NO: 7472159 - DNA, 22 bp, Homo sapiens
cactggtgtacaggaggtaaaa

SEQ ID NO: 7472160 - DNA, 22 bp, Homo sapiens
cactggtgccagagaacagaat

SEQ ID NO: 7472161 - DNA, 22 bp, Homo sapiens
cactgtcacgttctgaaactgt

SEQ ID NO: 7472162 - DNA, 22 bp, Homo sapiens
cactgtattattaggaatgaca

SEQ ID NO: 7472163 - DNA, 22 bp, Homo sapiens
cactgtcacgttctgaaactgt

SEQ ID NO: 7472164 - DNA, 22 bp, Homo sapiens
cactgtattattaggaatgaca

SEQ ID NO: 7472165 - DNA, 22 bp, Homo sapiens
cactgtatcttttccaaagtct

SEQ ID NO: 7472166 - DNA, 22 bp, Homo sapiens
cactgtattattaggaatgaca

SEQ ID NO: 7472167 - DNA, 22 bp, Homo sapiens
cactgtccaatagatacataat

SEQ ID NO: 7472168 - DNA, 22 bp, Homo sapiens
cactgtcacgttctgaaactgt

SEQ ID NO: 7472169 - DNA, 22 bp, Homo sapiens
ggctctgctggattgaggccag

SEQ ID NO: 7472170 - DNA, 22 bp, Homo sapiens
ggctctgctggattgaggccag

SEQ ID NO: 7472171 - DNA, 22 bp, Homo sapiens
ggctctgctggattgaggccag

SEQ ID NO: 7472172 - DNA, 22 bp, Homo sapiens
ggctctgctggattgaggccag

SEQ ID NO: 7472173 - DNA, 22 bp, Homo sapiens
cactgtactgtgaataaggagg

SEQ ID NO: 7472174 - DNA, 22 bp, Homo sapiens
cactgtactgggttgaaggacg

SEQ ID NO: 7472175 - DNA, 22 bp, Homo sapiens
cactgtactgtgaataaggagg

SEQ ID NO: 7472176 - DNA, 22 bp, Homo sapiens
cactgtactgtgaataaggagg

SEQ ID NO: 7472177 - DNA, 22 bp, Homo sapiens
cactgtactgggttgaaggacg

SEQ ID NO: 7472178 - DNA, 22 bp, Homo sapiens
cactgtactgtgaataaggagg

SEQ ID NO: 7472179 - DNA, 22 bp, Homo sapiens
cactgtactgtgaataaggagg

SEQ ID NO: 7472180 - DNA, 21 bp, Homo sapiens
cactgtatagcaggagaaaac

SEQ ID NO: 7472181 - DNA, 22 bp, Homo sapiens
ggctctgcttcagaaggctcat

SEQ ID NO: 7472182 - DNA, 22 bp, Homo sapiens
ggctctgctggtaagatgcctc

SEQ ID NO: 7472183 - DNA, 22 bp, Homo sapiens
ggctctgctggtaagatgcctc

SEQ ID NO: 7472184 - DNA, 22 bp, Homo sapiens
ggctctgctggtaagatgcctc

SEQ ID NO: 7472185 - DNA, 22 bp, Homo sapiens
ggctctgcttcagaaggctcat

SEQ ID NO: 7472186 - DNA, 22 bp, Homo sapiens
ggctctgcttcagaaggctcat

SEQ ID NO: 7472187 - DNA, 22 bp, Homo sapiens
ggctctgcttcagaaggctcat

SEQ ID NO: 7472188 - DNA, 22 bp, Homo sapiens
ggctctgctggattgaggccag

SEQ ID NO: 7472189 - DNA, 22 bp, Homo sapiens
ggctctgctggattgaggccag

SEQ ID NO: 7472190 - DNA, 22 bp, Homo sapiens
ggctctgctggattgaggccag

SEQ ID NO: 7472191 - DNA, 22 bp, Homo sapiens
ggctctgctggtaagatgcctc

SEQ ID NO: 7472192 - DNA, 22 bp, Homo sapiens
ggctctgctggtaagatgcctc

SEQ ID NO: 7472193 - DNA, 22 bp, Homo sapiens
ggctctgctggtaagatgcctc

SEQ ID NO: 7472194 - DNA, 22 bp, Homo sapiens
ggctctgcttcctggaattgtg

SEQ ID NO: 7472195 - DNA, 22 bp, Homo sapiens
ggctctgcttcctggaattgtg

SEQ ID NO: 7472196 - DNA, 22 bp, Homo sapiens
ggctctgcttcctggaattgtg

SEQ ID NO: 7472197 - DNA, 22 bp, Homo sapiens
ggctctgcttcagaaggctcat

SEQ ID NO: 7472198 - DNA, 22 bp, Homo sapiens
ggctctgcttcctggaattgtg

SEQ ID NO: 7472199 - DNA, 22 bp, Homo sapiens
ggctctgcttcagaaggctcat

SEQ ID NO: 7472200 - DNA, 22 bp, Homo sapiens
ggctctgcttcagaaggctcat

SEQ ID NO: 7472201 - DNA, 22 bp, Homo sapiens
ggctctgcttctcacctgttcc

SEQ ID NO: 7472202 - DNA, 22 bp, Homo sapiens
ggctctgcttctcacctgttcc

SEQ ID NO: 7472203 - DNA, 22 bp, Homo sapiens
ggctctgcttctcacctgttcc

SEQ ID NO: 7472204 - DNA, 22 bp, Homo sapiens
ggctctgcttctcacctgttcc

SEQ ID NO: 7472205 - DNA, 22 bp, Homo sapiens
ggctctgcttgaggccagcctg

SEQ ID NO: 7472206 - DNA, 22 bp, Homo sapiens
ggctctgcttgaggccagcctg

SEQ ID NO: 7472207 - DNA, 22 bp, Homo sapiens
ggctctgcttgaggccagcctg

SEQ ID NO: 7472208 - DNA, 22 bp, Homo sapiens
ggctctgcttgaggccagcctg

SEQ ID NO: 7472209 - DNA, 22 bp, Homo sapiens
cactgcactccagcctgggtca

SEQ ID NO: 7472210 - DNA, 22 bp, Homo sapiens
cactgcactccagcctgggtca

SEQ ID NO: 7472211 - DNA, 22 bp, Homo sapiens
cactgcactccagcctgggtca

SEQ ID NO: 7472212 - DNA, 22 bp, Homo sapiens
cactgcactccagcctgggtca

SEQ ID NO: 7472213 - DNA, 22 bp, Homo sapiens
cactgcactccagcctgggtca

SEQ ID NO: 7472214 - DNA, 22 bp, Homo sapiens
cactgcactccagcctgggtga

SEQ ID NO: 7472215 - DNA, 22 bp, Homo sapiens
cactgcactccagcctgggtca

SEQ ID NO: 7472216 - DNA, 22 bp, Homo sapiens
cactgcactccagcctgggtga

SEQ ID NO: 7472217 - DNA, 22 bp, Homo sapiens
cactgcactccagcctgggtca

SEQ ID NO: 7472218 - DNA, 22 bp, Homo sapiens
cactgcactccagcctgggtca

SEQ ID NO: 7472219 - DNA, 22 bp, Homo sapiens
cactgcactccagcctgggtca

SEQ ID NO: 7472220 - DNA, 22 bp, Homo sapiens
cactgcactccagcctgggtca

SEQ ID NO: 7472221 - DNA, 22 bp, Homo sapiens
cactgcactccagcctgggtca

SEQ ID NO: 7472222 - DNA, 22 bp, Homo sapiens
cactgcactccagcctgggtca

SEQ ID NO: 7472223 - DNA, 22 bp, Homo sapiens
cactgcactccagcctgggtca

SEQ ID NO: 7472224 - DNA, 22 bp, Homo sapiens
cactgcactccagcctgggtca

SEQ ID NO: 7472225 - DNA, 22 bp, Homo sapiens
cactgcactccagcctgggtca

SEQ ID NO: 7472226 - DNA, 22 bp, Homo sapiens
cactgcactccagcctgggtca

SEQ ID NO: 7472227 - DNA, 22 bp, Homo sapiens
cactgcactccagcctgggtca

SEQ ID NO: 7472228 - DNA, 22 bp, Homo sapiens
cactgcactccagcctgggtca

SEQ ID NO: 7472229 - DNA, 22 bp, Homo sapiens
cactgcactccagcctgggtca

SEQ ID NO: 7472230 - DNA, 22 bp, Homo sapiens
cactgcactccagcctgggtca

SEQ ID NO: 7472231 - DNA, 22 bp, Homo sapiens
cactgcactccagcctgggtca

SEQ ID NO: 7472232 - DNA, 22 bp, Homo sapiens
cactgcactccagcctgggtca

SEQ ID NO: 7472233 - DNA, 22 bp, Homo sapiens
cactgcactccagcctgggcaa

SEQ ID NO: 7472234 - DNA, 22 bp, Homo sapiens
cactgcactccagcctgggcaa

SEQ ID NO: 7472235 - DNA, 22 bp, Homo sapiens
cactgcactccagcctgggcaa

SEQ ID NO: 7472236 - DNA, 22 bp, Homo sapiens
cactgcactccagcctgggtca

SEQ ID NO: 7472237 - DNA, 22 bp, Homo sapiens
cactgcactccagcctgggaga

SEQ ID NO: 7472238 - DNA, 22 bp, Homo sapiens
cactgcactccagcctgggaga

SEQ ID NO: 7472239 - DNA, 22 bp, Homo sapiens
cactgcactccagcctgggaga

SEQ ID NO: 7472240 - DNA, 22 bp, Homo sapiens
cactgcactccagcctgggcaa

SEQ ID NO: 7472241 - DNA, 22 bp, Homo sapiens
cactgcactccagcctgggcaa

SEQ ID NO: 7472242 - DNA, 22 bp, Homo sapiens
cactgcactccagcctgggaga

SEQ ID NO: 7472243 - DNA, 22 bp, Homo sapiens
cactgcactccagcttgggtga

SEQ ID NO: 7472244 - DNA, 22 bp, Homo sapiens
cactgcactccagcttgggcaa

SEQ ID NO: 7472245 - DNA, 22 bp, Homo sapiens
cactgcactccagcttgggtga

SEQ ID NO: 7472246 - DNA, 22 bp, Homo sapiens
cactgcactccagcttgggtga

SEQ ID NO: 7472247 - DNA, 22 bp, Homo sapiens
cactgcactccagcttgggcaa

SEQ ID NO: 7472248 - DNA, 22 bp, Homo sapiens
cactgcactccagcctgggtga

SEQ ID NO: 7472249 - DNA, 22 bp, Homo sapiens
cactgcactccagctgggtgac

SEQ ID NO: 7472250 - DNA, 22 bp, Homo sapiens
cactgcactccagcctgggtga

SEQ ID NO: 7472251 - DNA, 22 bp, Homo sapiens
cactgcactccagcctgggtga

SEQ ID NO: 7472252 - DNA, 22 bp, Homo sapiens
cactgcactccagcctgggtga

SEQ ID NO: 7472253 - DNA, 22 bp, Homo sapiens
cactgcactccagcctgggtga

SEQ ID NO: 7472254 - DNA, 22 bp, Homo sapiens
cactgcactccagcttgggtga

SEQ ID NO: 7472255 - DNA, 22 bp, Homo sapiens
cactgcactccagcttgggtga

SEQ ID NO: 7472256 - DNA, 22 bp, Homo sapiens
cactgcactccagcttgggtga

SEQ ID NO: 7472257 - DNA, 22 bp, Homo sapiens
cactgcactccagcttgggtga

SEQ ID NO: 7472258 - DNA, 22 bp, Homo sapiens
cactgcactccagcttgggtga

SEQ ID NO: 7472259 - DNA, 22 bp, Homo sapiens
cactgggagcagctccaacatt

SEQ ID NO: 7472260 - DNA, 22 bp, Homo sapiens
cactgcactccagcttgggtga

SEQ ID NO: 7472261 - DNA, 22 bp, Homo sapiens
cactgcactccagcctgggtga

SEQ ID NO: 7472262 - DNA, 22 bp, Homo sapiens
cactgcactccagcctgggtga

SEQ ID NO: 7472263 - DNA, 22 bp, Homo sapiens
cactgcactccagcctgggtga

SEQ ID NO: 7472264 - DNA, 22 bp, Homo sapiens
cactgcactccagcctgggtga

SEQ ID NO: 7472265 - DNA, 22 bp, Homo sapiens
cactgcactccagcctgggtga

SEQ ID NO: 7472266 - DNA, 22 bp, Homo sapiens
cactgcactccagcctgggtga

SEQ ID NO: 7472267 - DNA, 22 bp, Homo sapiens
cactgcactccagcctgggtga

SEQ ID NO: 7472268 - DNA, 22 bp, Homo sapiens
cactgcactccagcctgggtga

SEQ ID NO: 7472269 - DNA, 22 bp, Homo sapiens
cactgcactccagcctgggtga

SEQ ID NO: 7472270 - DNA, 22 bp, Homo sapiens
cactgcactccagcctgggtga

SEQ ID NO: 7472271 - DNA, 22 bp, Homo sapiens
cactgcactccagcctgggtga

SEQ ID NO: 7472272 - DNA, 22 bp, Homo sapiens
cactgcactccagcctgggtga

SEQ ID NO: 7472273 - DNA, 22 bp, Homo sapiens
cactgcactccagcctgggtga

SEQ ID NO: 7472274 - DNA, 22 bp, Homo sapiens
cactgcactccagcctgggtga

SEQ ID NO: 7472275 - DNA, 22 bp, Homo sapiens
cactgcactccagcctgggtga

SEQ ID NO: 7472276 - DNA, 22 bp, Homo sapiens
cactgcactccagcctgggtga

SEQ ID NO: 7472277 - DNA, 22 bp, Homo sapiens
atggccgcctgtccttcccgcc

SEQ ID NO: 7472278 - DNA, 22 bp, Homo sapiens
atggccgcctgtccttcccgcc

SEQ ID NO: 7472279 - DNA, 21 bp, Homo sapiens
atggctcaggccatcaatgga

SEQ ID NO: 7472280 - DNA, 21 bp, Homo sapiens
atggctcaggccatcaatgga

SEQ ID NO: 7472281 - DNA, 21 bp, Homo sapiens
atggctcaggccatcaatgga

SEQ ID NO: 7472282 - DNA, 21 bp, Homo sapiens
atggctcaggccatcaatgga

SEQ ID NO: 7472283 - DNA, 22 bp, Homo sapiens
atggctcatttatcttgcagcc

SEQ ID NO: 7472284 - DNA, 22 bp, Homo sapiens
atggctcatttatcttgcagcc

SEQ ID NO: 7472285 - DNA, 22 bp, Homo sapiens
atggctcatttatcttgcagcc

SEQ ID NO: 7472286 - DNA, 22 bp, Homo sapiens
atggctccaagatggagagcca

SEQ ID NO: 7472287 - DNA, 22 bp, Homo sapiens
atggctccaagatggagagcca

SEQ ID NO: 7472288 - DNA, 22 bp, Homo sapiens
atggctccagctggtagagatt

SEQ ID NO: 7472289 - DNA, 22 bp, Homo sapiens
atggctctatctagaattctgg

SEQ ID NO: 7472290 - DNA, 22 bp, Homo sapiens
atggctctaggttgggcagttt

SEQ ID NO: 7472291 - DNA, 22 bp, Homo sapiens
atggctctaggttgggcagttt

SEQ ID NO: 7472292 - DNA, 22 bp, Homo sapiens
atggctctaggttgggcagttt

SEQ ID NO: 7472293 - DNA, 22 bp, Homo sapiens
atggctctagaatacccctcag

SEQ ID NO: 7472294 - DNA, 22 bp, Homo sapiens
atggcagagaacaaagcaacaa

SEQ ID NO: 7472295 - DNA, 22 bp, Homo sapiens
atggcagagaacaaagcaacaa

SEQ ID NO: 7472296 - DNA, 22 bp, Homo sapiens
atggcagagaaagcgagccaca

SEQ ID NO: 7472297 - DNA, 22 bp, Homo sapiens
atggcagagaaagcgagccaca

SEQ ID NO: 7472298 - DNA, 22 bp, Homo sapiens
atggcagacgaggcagcagggg

SEQ ID NO: 7472299 - DNA, 22 bp, Homo sapiens
atggccctttattccttcttcc

SEQ ID NO: 7472300 - DNA, 22 bp, Homo sapiens
atggcagagggattgaacagct

SEQ ID NO: 7472301 - DNA, 22 bp, Homo sapiens
atggccctttattccttcttcc

SEQ ID NO: 7472302 - DNA, 22 bp, Homo sapiens
atggccctttattccttcttcc

SEQ ID NO: 7472303 - DNA, 22 bp, Homo sapiens
atggccctgtttatggtaaggc

SEQ ID NO: 7472304 - DNA, 22 bp, Homo sapiens
atggcagagaacaaagcaacaa

SEQ ID NO: 7472305 - DNA, 22 bp, Homo sapiens
atggcagagggattgaacagct

SEQ ID NO: 7472306 - DNA, 22 bp, Homo sapiens
atggcagacgaggcagcagggg

SEQ ID NO: 7472307 - DNA, 22 bp, Homo sapiens
atggcagacgaggcagcagggg

SEQ ID NO: 7472308 - DNA, 22 bp, Homo sapiens
atggcagacgaggcagcagggg

SEQ ID NO: 7472309 - DNA, 22 bp, Homo sapiens
atggcagacgaggcagcagggg

SEQ ID NO: 7472310 - DNA, 22 bp, Homo sapiens
atggcagacctgggctggagaa

SEQ ID NO: 7472311 - DNA, 22 bp, Homo sapiens
atggcagacctgggctggagaa

SEQ ID NO: 7472312 - DNA, 22 bp, Homo sapiens
atggcagacctgggctggagaa

SEQ ID NO: 7472313 - DNA, 22 bp, Homo sapiens
atggctgaggctggaggtggca

SEQ ID NO: 7472314 - DNA, 21 bp, Homo sapiens
atggctgatgatattgaacat

SEQ ID NO: 7472315 - DNA, 22 bp, Homo sapiens
atggctgcagagacctgaagaa

SEQ ID NO: 7472316 - DNA, 22 bp, Homo sapiens
atggctgaggctggaggtggca

SEQ ID NO: 7472317 - DNA, 22 bp, Homo sapiens
atggctgagatgggctccaggc

SEQ ID NO: 7472318 - DNA, 22 bp, Homo sapiens
atggctgaggctggaggtggca

SEQ ID NO: 7472319 - DNA, 22 bp, Homo sapiens
atggctgagatgggctccaggc

SEQ ID NO: 7472320 - DNA, 22 bp, Homo sapiens
atggctctttattctgctgcat

SEQ ID NO: 7472321 - DNA, 22 bp, Homo sapiens
atggctgagatgggctccaggc

SEQ ID NO: 7472322 - DNA, 22 bp, Homo sapiens
atggctcttgaattgatactct

SEQ ID NO: 7472323 - DNA, 22 bp, Homo sapiens
gagcacagattgatttaaaata

SEQ ID NO: 7472324 - DNA, 22 bp, Homo sapiens
atggctgcatcatcctggttga

SEQ ID NO: 7472325 - DNA, 22 bp, Homo sapiens
atggctgcatcatcctggttga

SEQ ID NO: 7472326 - DNA, 22 bp, Homo sapiens
atggctgcagtccgtgccctgg

SEQ ID NO: 7472327 - DNA, 22 bp, Homo sapiens
atggctgcagccggccctgcgc

SEQ ID NO: 7472328 - DNA, 22 bp, Homo sapiens
atggctgcagtccgtgccctgg

SEQ ID NO: 7472329 - DNA, 22 bp, Homo sapiens
atggctgcagccggccctgcgc

SEQ ID NO: 7472330 - DNA, 22 bp, Homo sapiens
atggctgcagccggccctgcgc

SEQ ID NO: 7472331 - DNA, 22 bp, Homo sapiens
atggctgcagccggccctgcgc

SEQ ID NO: 7472332 - DNA, 22 bp, Homo sapiens
atggctgcagagacctgaagaa

SEQ ID NO: 7472333 - DNA, 22 bp, Homo sapiens
atggctgcagagacctgaagaa

SEQ ID NO: 7472334 - DNA, 22 bp, Homo sapiens
atggctgcagagacctgaagaa

SEQ ID NO: 7472335 - DNA, 19 bp, Homo sapiens
atggctctgatttaatgtg

SEQ ID NO: 7472336 - DNA, 20 bp, Homo sapiens
atggctctgattctgagccc

SEQ ID NO: 7472337 - DNA, 20 bp, Homo sapiens
atggctctgattctgagccc

SEQ ID NO: 7472338 - DNA, 19 bp, Homo sapiens
atggctctgatttaatgtg

SEQ ID NO: 7472339 - DNA, 22 bp, Homo sapiens
atggctctgctgggcaaagcaa

SEQ ID NO: 7472340 - DNA, 22 bp, Homo sapiens
atggctctgctgggcaaagcaa

SEQ ID NO: 7472341 - DNA, 19 bp, Homo sapiens
atggctctgggatcactgc

SEQ ID NO: 7472342 - DNA, 19 bp, Homo sapiens
atggctctgggatcactgc

SEQ ID NO: 7472343 - DNA, 20 bp, Homo sapiens
atggctctgtttggcagtga

SEQ ID NO: 7472344 - DNA, 20 bp, Homo sapiens
atggctctgtttggcagtga

SEQ ID NO: 7472345 - DNA, 20 bp, Homo sapiens
atggctctgtttggcagtga

SEQ ID NO: 7472346 - DNA, 20 bp, Homo sapiens
atggctctgattctgagccc

SEQ ID NO: 7472347 - DNA, 22 bp, Homo sapiens
atggctctgagaacctgagcta

SEQ ID NO: 7472348 - DNA, 22 bp, Homo sapiens
atggctctgagaacctgagcta

SEQ ID NO: 7472349 - DNA, 22 bp, Homo sapiens
atggctctgagaacctgagcta

SEQ ID NO: 7472350 - DNA, 22 bp, Homo sapiens
atggctctgagaacctgagcta

SEQ ID NO: 7472351 - DNA, 22 bp, Homo sapiens
atggctctcttgacctaggcac

SEQ ID NO: 7472352 - DNA, 22 bp, Homo sapiens
atggctctcttgacctaggcac

SEQ ID NO: 7472353 - DNA, 22 bp, Homo sapiens
atggctctctccttactgctgc

SEQ ID NO: 7472354 - DNA, 22 bp, Homo sapiens
atggctctctagggcccaggtt

SEQ ID NO: 7472355 - DNA, 22 bp, Homo sapiens
atggctctctagggcccaggtt

SEQ ID NO: 7472356 - DNA, 22 bp, Homo sapiens
atggctctctccttactgctgc

SEQ ID NO: 7472357 - DNA, 22 bp, Homo sapiens
atggctctcttgacctaggcac

SEQ ID NO: 7472358 - DNA, 22 bp, Homo sapiens
atgggagtgtgcttgaggagtt

SEQ ID NO: 7472359 - DNA, 22 bp, Homo sapiens
atgggagtggaggaaaaaagtt

SEQ ID NO: 7472360 - DNA, 22 bp, Homo sapiens
atgggagtgtgcttgaggagtt

SEQ ID NO: 7472361 - DNA, 22 bp, Homo sapiens
atgggagtgtgcttgaggagtt

SEQ ID NO: 7472362 - DNA, 22 bp, Homo sapiens
atgggagggtggaaaggctctg

SEQ ID NO: 7472363 - DNA, 22 bp, Homo sapiens
atgggagggtggaaaggctctg

SEQ ID NO: 7472364 - DNA, 22 bp, Homo sapiens
atgggagggtggaaaggctctg

SEQ ID NO: 7472365 - DNA, 22 bp, Homo sapiens
atgggagggtggaaaggctctg

SEQ ID NO: 7472366 - DNA, 22 bp, Homo sapiens
atgggagggtggaaaggctctg

SEQ ID NO: 7472367 - DNA, 22 bp, Homo sapiens
atgggagggtggaaaggctctg

SEQ ID NO: 7472368 - DNA, 22 bp, Homo sapiens
atgggagggtggaaaggctctg

SEQ ID NO: 7472369 - DNA, 22 bp, Homo sapiens
atgggagggtggaaaggctctg

SEQ ID NO: 7472370 - DNA, 22 bp, Homo sapiens
atgggagggtggaaaggctctg

SEQ ID NO: 7472371 - DNA, 22 bp, Homo sapiens
atgggagggtggaaaggctctg

SEQ ID NO: 7472372 - DNA, 22 bp, Homo sapiens
atgggagccatcgcatttgctg

SEQ ID NO: 7472373 - DNA, 22 bp, Homo sapiens
atgggagagggtaggaattact

SEQ ID NO: 7472374 - DNA, 22 bp, Homo sapiens
atgggagagggtaggaattact

SEQ ID NO: 7472375 - DNA, 22 bp, Homo sapiens
gagcacagggaatagacagata

SEQ ID NO: 7472376 - DNA, 22 bp, Homo sapiens
gagcacagggaatagacagata

SEQ ID NO: 7472377 - DNA, 22 bp, Homo sapiens
gagcacagggaatagacagata

SEQ ID NO: 7472378 - DNA, 22 bp, Homo sapiens
gagcacagggaatagacagata

SEQ ID NO: 7472379 - DNA, 22 bp, Homo sapiens
atgggaggaagagaagatgtct

SEQ ID NO: 7472380 - DNA, 22 bp, Homo sapiens
atgggaggaagagaagatgtct

SEQ ID NO: 7472381 - DNA, 22 bp, Homo sapiens
atgggaggaagagaagatgtct

SEQ ID NO: 7472382 - DNA, 22 bp, Homo sapiens
atgggagccatcgcatttgctg

SEQ ID NO: 7472383 - DNA, 22 bp, Homo sapiens
atgggaggaagagaagatgtct

SEQ ID NO: 7472384 - DNA, 22 bp, Homo sapiens
atgggaggaagagaagatgtct

SEQ ID NO: 7472385 - DNA, 22 bp, Homo sapiens
gagcacaggctttggtggacac

SEQ ID NO: 7472386 - DNA, 22 bp, Homo sapiens
gagcacaggctttggtggacac

SEQ ID NO: 7472387 - DNA, 22 bp, Homo sapiens
gagcacagggaatagacagata

SEQ ID NO: 7472388 - DNA, 22 bp, Homo sapiens
gagcacagggaatagacagata

SEQ ID NO: 7472389 - DNA, 22 bp, Homo sapiens
gagcacaggctttggtggacac

SEQ ID NO: 7472390 - DNA, 22 bp, Homo sapiens
gagcacaggctttggtggacac

SEQ ID NO: 7472391 - DNA, 22 bp, Homo sapiens
gagcacaggctttggtggacac

SEQ ID NO: 7472392 - DNA, 19 bp, Homo sapiens
gagcacagcggcatttggt

SEQ ID NO: 7472393 - DNA, 19 bp, Homo sapiens
gagcacagcggcatttggt

SEQ ID NO: 7472394 - DNA, 19 bp, Homo sapiens
gagcacagcggcatttggt

SEQ ID NO: 7472395 - DNA, 22 bp, Homo sapiens
gagcacagctggaggtagcatt

SEQ ID NO: 7472396 - DNA, 22 bp, Homo sapiens
gagcacagctggaggtagcatt

SEQ ID NO: 7472397 - DNA, 22 bp, Homo sapiens
gagcacagctggaggtagcatt

SEQ ID NO: 7472398 - DNA, 19 bp, Homo sapiens
gagcacagcggcatttggt

SEQ ID NO: 7472399 - DNA, 22 bp, Homo sapiens
gagcacagcgcagtttgtaatt

SEQ ID NO: 7472400 - DNA, 22 bp, Homo sapiens
gagcacagcgcagtttgtaatt

SEQ ID NO: 7472401 - DNA, 19 bp, Homo sapiens
gagcacagcggcatttggt

SEQ ID NO: 7472402 - DNA, 19 bp, Homo sapiens
gagcacagcggcatttggt

SEQ ID NO: 7472403 - DNA, 19 bp, Homo sapiens
gagcacagcggcatttggt

SEQ ID NO: 7472404 - DNA, 22 bp, Homo sapiens
gagcacagcagggctctgggtg

SEQ ID NO: 7472405 - DNA, 22 bp, Homo sapiens
gagcacagcagggctctgggtg

SEQ ID NO: 7472406 - DNA, 22 bp, Homo sapiens
gagcacagcagggctctgggtg

SEQ ID NO: 7472407 - DNA, 22 bp, Homo sapiens
gagcacagcagggctctgggtg

SEQ ID NO: 7472408 - DNA, 22 bp, Homo sapiens
gagcacagcagggctctgggtg

SEQ ID NO: 7472409 - DNA, 22 bp, Homo sapiens
gagcacagccaaagtaagaagg

SEQ ID NO: 7472410 - DNA, 22 bp, Homo sapiens
gagcacagccaaagtaagaagg

SEQ ID NO: 7472411 - DNA, 22 bp, Homo sapiens
gagcacagccaaagtaagaagg

SEQ ID NO: 7472412 - DNA, 22 bp, Homo sapiens
gagcacagcagggctctgggtg

SEQ ID NO: 7472413 - DNA, 22 bp, Homo sapiens
gagcacagccaaagtaagaagg

SEQ ID NO: 7472414 - DNA, 22 bp, Homo sapiens
gagcacaggctgctgtgaactg

SEQ ID NO: 7472415 - DNA, 22 bp, Homo sapiens
gagcacaggctgctgtgaactg

SEQ ID NO: 7472416 - DNA, 22 bp, Homo sapiens
gagcacagctgtcttgcaagct

SEQ ID NO: 7472417 - DNA, 22 bp, Homo sapiens
gagcacagctgtcttgcaagct

SEQ ID NO: 7472418 - DNA, 22 bp, Homo sapiens
gagcacaggctttggtggacac

SEQ ID NO: 7472419 - DNA, 22 bp, Homo sapiens
gagcacaggctgctgtgaactg

SEQ ID NO: 7472420 - DNA, 22 bp, Homo sapiens
gagcacaggctgctgtgaactg

SEQ ID NO: 7472421 - DNA, 22 bp, Homo sapiens
gagcacaggctgctgtgaactg

SEQ ID NO: 7472422 - DNA, 22 bp, Homo sapiens
gagcacaggctgctgtgaactg

SEQ ID NO: 7472423 - DNA, 22 bp, Homo sapiens
gagcacagctgtcttgcaagct

SEQ ID NO: 7472424 - DNA, 22 bp, Homo sapiens
gagcacagctgtcttgcaagct

SEQ ID NO: 7472425 - DNA, 22 bp, Homo sapiens
gagcacagctgtcttgcaagct

SEQ ID NO: 7472426 - DNA, 22 bp, Homo sapiens
gagcacagctggaggtagcatt

SEQ ID NO: 7472427 - DNA, 22 bp, Homo sapiens
gagcacagctggaggtagcatt

SEQ ID NO: 7472428 - DNA, 22 bp, Homo sapiens
gagcacagctggaggtagcatt

SEQ ID NO: 7472429 - DNA, 22 bp, Homo sapiens
gagcacagctggaggtagcatt

SEQ ID NO: 7472430 - DNA, 22 bp, Homo sapiens
gagcacagctggaggtagcatt

SEQ ID NO: 7472431 - DNA, 22 bp, Homo sapiens
gagcacagctggaggtagcatt

SEQ ID NO: 7472432 - DNA, 22 bp, Homo sapiens
gagcacagctggaggtagcatt

SEQ ID NO: 7472433 - DNA, 22 bp, Homo sapiens
gagctgcagagctcgaaggaac

SEQ ID NO: 7472434 - DNA, 22 bp, Homo sapiens
gagctgcagacttgatacagga

SEQ ID NO: 7472435 - DNA, 22 bp, Homo sapiens
gagctgcagacttgatacagga

SEQ ID NO: 7472436 - DNA, 22 bp, Homo sapiens
gagctgcagacatagataagcg

SEQ ID NO: 7472437 - DNA, 22 bp, Homo sapiens
gagctgcagacatagataagcg

SEQ ID NO: 7472438 - DNA, 22 bp, Homo sapiens
gagctgcagacatagataagcg

SEQ ID NO: 7472439 - DNA, 22 bp, Homo sapiens
gagctgcactgggggtggaatg

SEQ ID NO: 7472440 - DNA, 22 bp, Homo sapiens
gagctgcagaaggggttttcct

SEQ ID NO: 7472441 - DNA, 22 bp, Homo sapiens
gagctgcacatctgaggctaat

SEQ ID NO: 7472442 - DNA, 21 bp, Homo sapiens
gagctgcaccttgacctgttt

SEQ ID NO: 7472443 - DNA, 22 bp, Homo sapiens
gagctgcacgcagcatccaaga

SEQ ID NO: 7472444 - DNA, 21 bp, Homo sapiens
gagctgcaccttgacctgttt

SEQ ID NO: 7472445 - DNA, 22 bp, Homo sapiens
gagctgcacatctgaggctaat

SEQ ID NO: 7472446 - DNA, 22 bp, Homo sapiens
gagctgagttacctccagatca

SEQ ID NO: 7472447 - DNA, 20 bp, Homo sapiens
gagctgagtgtggtcatggg

SEQ ID NO: 7472448 - DNA, 22 bp, Homo sapiens
gagctctgtgaatgtggggagg

SEQ ID NO: 7472449 - DNA, 22 bp, Homo sapiens
gagctctgtgaatgtggggagg

SEQ ID NO: 7472450 - DNA, 20 bp, Homo sapiens
gagccctctgcactagcgcc

SEQ ID NO: 7472451 - DNA, 19 bp, Homo sapiens
gagccctctccatggccac

SEQ ID NO: 7472452 - DNA, 22 bp, Homo sapiens
gagccctctctgtaggcaagta

SEQ ID NO: 7472453 - DNA, 17 bp, Homo sapiens
gagctctgtggcacaag

SEQ ID NO: 7472454 - DNA, 22 bp, Homo sapiens
gagctctgtgtagcctgagggt

SEQ ID NO: 7472455 - DNA, 17 bp, Homo sapiens
gagctctgtggcacaag

SEQ ID NO: 7472456 - DNA, 17 bp, Homo sapiens
gagctctgtggcacaag

SEQ ID NO: 7472457 - DNA, 22 bp, Homo sapiens
gagctgagtgtcctaggcatgg

SEQ ID NO: 7472458 - DNA, 20 bp, Homo sapiens
gagctgagtgtggtcatggg

SEQ ID NO: 7472459 - DNA, 20 bp, Homo sapiens
gagctgagtgtggtcatggg

SEQ ID NO: 7472460 - DNA, 22 bp, Homo sapiens
gagctgagtgtcctaggcatgg

SEQ ID NO: 7472461 - DNA, 20 bp, Homo sapiens
gagctgagtgtggtcatggg

SEQ ID NO: 7472462 - DNA, 22 bp, Homo sapiens
gagctgccagacatgggaatga

SEQ ID NO: 7472463 - DNA, 22 bp, Homo sapiens
gagctgccagacatgggaatga

SEQ ID NO: 7472464 - DNA, 22 bp, Homo sapiens
gagctgccagacatgggaatga

SEQ ID NO: 7472465 - DNA, 22 bp, Homo sapiens
gagctgccagacatgggaatga

SEQ ID NO: 7472466 - DNA, 22 bp, Homo sapiens
gagctgccagtgtatgaattct

SEQ ID NO: 7472467 - DNA, 22 bp, Homo sapiens
gagctgccaagattacaatcag

SEQ ID NO: 7472468 - DNA, 22 bp, Homo sapiens
gagctgccaagattacaatcag

SEQ ID NO: 7472469 - DNA, 22 bp, Homo sapiens
gagctgcatgcaactcgaaaat

SEQ ID NO: 7472470 - DNA, 22 bp, Homo sapiens
gagctgcatgcaactcgaaaat

SEQ ID NO: 7472471 - DNA, 22 bp, Homo sapiens
gagctgcatagctgggatcctc

SEQ ID NO: 7472472 - DNA, 22 bp, Homo sapiens
gagctgcatgcaactgtttaaa

SEQ ID NO: 7472473 - DNA, 22 bp, Homo sapiens
gagctgccaagattacaatcag

SEQ ID NO: 7472474 - DNA, 22 bp, Homo sapiens
gagctgcatgcggaaacctgtt

SEQ ID NO: 7472475 - DNA, 22 bp, Homo sapiens
gagctgcagcggctgacgcaac

SEQ ID NO: 7472476 - DNA, 22 bp, Homo sapiens
gagctgcagagtaacctttgca

SEQ ID NO: 7472477 - DNA, 22 bp, Homo sapiens
gagctgcagcggctgacgcaac

SEQ ID NO: 7472478 - DNA, 22 bp, Homo sapiens
gagctgccagtgtatgaattct

SEQ ID NO: 7472479 - DNA, 18 bp, Homo sapiens
gagctgccatatttagtt

SEQ ID NO: 7472480 - DNA, 22 bp, Homo sapiens
gagctgccagacatgggaatga

SEQ ID NO: 7472481 - DNA, 22 bp, Homo sapiens
gagctgccctgagctttgcatg

SEQ ID NO: 7472482 - DNA, 22 bp, Homo sapiens
gagctgccctgagctttgcatg

SEQ ID NO: 7472483 - DNA, 22 bp, Homo sapiens
gagctgccctgagctttgcatg

SEQ ID NO: 7472484 - DNA, 22 bp, Homo sapiens
gagctgccggcccacagtacta

SEQ ID NO: 7472485 - DNA, 22 bp, Homo sapiens
gagctgccctgagctttgcatg

SEQ ID NO: 7472486 - DNA, 22 bp, Homo sapiens
gagctgccctgagctttgcatg

SEQ ID NO: 7472487 - DNA, 22 bp, Homo sapiens
atgggcagagtggggacaggaa

SEQ ID NO: 7472488 - DNA, 22 bp, Homo sapiens
atgggcagagtggggacaggaa

SEQ ID NO: 7472489 - DNA, 22 bp, Homo sapiens
atgggcagagtggggacaggaa

SEQ ID NO: 7472490 - DNA, 21 bp, Homo sapiens
atgggcagaggcagagaggct

SEQ ID NO: 7472491 - DNA, 21 bp, Homo sapiens
atgggcagaggcagagaggct

SEQ ID NO: 7472492 - DNA, 21 bp, Homo sapiens
atgggcagaggcagagaggct

SEQ ID NO: 7472493 - DNA, 21 bp, Homo sapiens
atgggcagaggcagagaggct

SEQ ID NO: 7472494 - DNA, 21 bp, Homo sapiens
atgggcagaggcagagaggct

SEQ ID NO: 7472495 - DNA, 22 bp, Homo sapiens
gagcccagtctgctcctgcgcc

SEQ ID NO: 7472496 - DNA, 22 bp, Homo sapiens
gagcccagtctgctcctgcgcc

SEQ ID NO: 7472497 - DNA, 21 bp, Homo sapiens
atgggcagaggcagagaggct

SEQ ID NO: 7472498 - DNA, 21 bp, Homo sapiens
atgggcagaggcagagaggct

SEQ ID NO: 7472499 - DNA, 21 bp, Homo sapiens
atgggcagaggcagagaggct

SEQ ID NO: 7472500 - DNA, 21 bp, Homo sapiens
atgggcagaggcagagaggct

SEQ ID NO: 7472501 - DNA, 22 bp, Homo sapiens
gagccccaccctagacattctg

SEQ ID NO: 7472502 - DNA, 22 bp, Homo sapiens
gagccccaccctagacattctg

SEQ ID NO: 7472503 - DNA, 22 bp, Homo sapiens
gagccccaccctagacattctg

SEQ ID NO: 7472504 - DNA, 22 bp, Homo sapiens
gagcccatcctcgaggggctgc

SEQ ID NO: 7472505 - DNA, 22 bp, Homo sapiens
gagcccatcctcgaggggctgc

SEQ ID NO: 7472506 - DNA, 22 bp, Homo sapiens
gagcccagtctgctcctgcgcc

SEQ ID NO: 7472507 - DNA, 21 bp, Homo sapiens
atgggcagaggcagagaggct

SEQ ID NO: 7472508 - DNA, 21 bp, Homo sapiens
atgggcagaggcagagaggct

SEQ ID NO: 7472509 - DNA, 22 bp, Homo sapiens
atgggcagagctggtgggaggc

SEQ ID NO: 7472510 - DNA, 22 bp, Homo sapiens
atgggcagagctggtgggaggc

SEQ ID NO: 7472511 - DNA, 22 bp, Homo sapiens
atgggcagagctggtgggaggc

SEQ ID NO: 7472512 - DNA, 22 bp, Homo sapiens
atgggcagagctggtgggaggc

SEQ ID NO: 7472513 - DNA, 22 bp, Homo sapiens
atgggcagagctggtgggaggc

SEQ ID NO: 7472514 - DNA, 22 bp, Homo sapiens
atgggcagagctggtgggaggc

SEQ ID NO: 7472515 - DNA, 22 bp, Homo sapiens
atgggcagagctggtgggaggc

SEQ ID NO: 7472516 - DNA, 22 bp, Homo sapiens
atgggcagacagggagctcacg

SEQ ID NO: 7472517 - DNA, 22 bp, Homo sapiens
atgggcagacagggagctcacg

SEQ ID NO: 7472518 - DNA, 22 bp, Homo sapiens
atgggcagacagggagctcacg

SEQ ID NO: 7472519 - DNA, 22 bp, Homo sapiens
atgggcagacagggagctcacg

SEQ ID NO: 7472520 - DNA, 22 bp, Homo sapiens
atgggcagacagggagctcacg

SEQ ID NO: 7472521 - DNA, 22 bp, Homo sapiens
atgggcagacagggagctcacg

SEQ ID NO: 7472522 - DNA, 22 bp, Homo sapiens
atgggcagacagggagctcacg

SEQ ID NO: 7472523 - DNA, 22 bp, Homo sapiens
atgggcagacagggagctcacg

SEQ ID NO: 7472524 - DNA, 22 bp, Homo sapiens
atgggcagacagggagctcacg

SEQ ID NO: 7472525 - DNA, 22 bp, Homo sapiens
atgggcagacagggagctcacg

SEQ ID NO: 7472526 - DNA, 22 bp, Homo sapiens
atgggcaaggggtaaggacact

SEQ ID NO: 7472527 - DNA, 22 bp, Homo sapiens
atgggcaacagcagtcacaatg

SEQ ID NO: 7472528 - DNA, 22 bp, Homo sapiens
atgggcaacagcagtcacaatg

SEQ ID NO: 7472529 - DNA, 22 bp, Homo sapiens
atgggatcttgccctgagggct

SEQ ID NO: 7472530 - DNA, 22 bp, Homo sapiens
atgggatgaacttgatctgctt

SEQ ID NO: 7472531 - DNA, 22 bp, Homo sapiens
atgggatgaacttgatctgctt

SEQ ID NO: 7472532 - DNA, 22 bp, Homo sapiens
atgggatgatcacctgagctca

SEQ ID NO: 7472533 - DNA, 22 bp, Homo sapiens
atgggatgcatggctgtggcca

SEQ ID NO: 7472534 - DNA, 22 bp, Homo sapiens
gagccccaggacagctctagtt

SEQ ID NO: 7472535 - DNA, 22 bp, Homo sapiens
gagccccagccctgcttctata

SEQ ID NO: 7472536 - DNA, 22 bp, Homo sapiens
gagccccaggacagctctagtt

SEQ ID NO: 7472537 - DNA, 22 bp, Homo sapiens
gagccccaggacagctctagtt

SEQ ID NO: 7472538 - DNA, 22 bp, Homo sapiens
gagccccagccctgcttctata

SEQ ID NO: 7472539 - DNA, 22 bp, Homo sapiens
gagccccagccctgcttctata

SEQ ID NO: 7472540 - DNA, 22 bp, Homo sapiens
gagcccgagcgcgtacccggcg

SEQ ID NO: 7472541 - DNA, 22 bp, Homo sapiens
gagcccgagcgcgtacccggcg

SEQ ID NO: 7472542 - DNA, 22 bp, Homo sapiens
gagccctcaatgaatctgcatt

SEQ ID NO: 7472543 - DNA, 22 bp, Homo sapiens
gagccctcaatgaatctgcatt

SEQ ID NO: 7472544 - DNA, 22 bp, Homo sapiens
gagcccgagcgcgtacccggcg

SEQ ID NO: 7472545 - DNA, 22 bp, Homo sapiens
gagccccttctgcagtcaggtt

SEQ ID NO: 7472546 - DNA, 22 bp, Homo sapiens
gagccccaggacagctctagtt

SEQ ID NO: 7472547 - DNA, 22 bp, Homo sapiens
gagccccttctgcagtcaggtt

SEQ ID NO: 7472548 - DNA, 22 bp, Homo sapiens
gagccctcgggcgagcccgcgc

SEQ ID NO: 7472549 - DNA, 22 bp, Homo sapiens
gagccctcgggcgagcccgcgc

SEQ ID NO: 7472550 - DNA, 22 bp, Homo sapiens
gagccctcgggcgagcccgcgc

SEQ ID NO: 7472551 - DNA, 22 bp, Homo sapiens
gagccctccatggagccaggca

SEQ ID NO: 7472552 - DNA, 22 bp, Homo sapiens
gagccctccatggagccaggca

SEQ ID NO: 7472553 - DNA, 22 bp, Homo sapiens
gagccctccatggagccaggca

SEQ ID NO: 7472554 - DNA, 19 bp, Homo sapiens
gagccctctccatggccac

SEQ ID NO: 7472555 - DNA, 19 bp, Homo sapiens
gagccctctccatggccac

SEQ ID NO: 7472556 - DNA, 22 bp, Homo sapiens
gagccctctctgtaggcaagta

SEQ ID NO: 7472557 - DNA, 22 bp, Homo sapiens
gagccctctctgtaggcaagta

SEQ ID NO: 7472558 - DNA, 22 bp, Homo sapiens
gagccctccatggagccaggca

SEQ ID NO: 7472559 - DNA, 22 bp, Homo sapiens
gagccctcattgaatctgcatt

SEQ ID NO: 7472560 - DNA, 22 bp, Homo sapiens
gagccctcattgaatctgcatt

SEQ ID NO: 7472561 - DNA, 22 bp, Homo sapiens
gagccctcattgaatctgcatt

SEQ ID NO: 7472562 - DNA, 22 bp, Homo sapiens
gagccctcattgaatctgcatt

SEQ ID NO: 7472563 - DNA, 22 bp, Homo sapiens
gagccctcaatgaatctgcatt

SEQ ID NO: 7472564 - DNA, 22 bp, Homo sapiens
gagccctcaatgaatctgcatt

SEQ ID NO: 7472565 - DNA, 22 bp, Homo sapiens
gagccctcaccgcctgaccagg

SEQ ID NO: 7472566 - DNA, 22 bp, Homo sapiens
gagccctcaccgcctgaccagg

SEQ ID NO: 7472567 - DNA, 22 bp, Homo sapiens
gagccctcaccgcctgaccagg

SEQ ID NO: 7472568 - DNA, 22 bp, Homo sapiens
gagccctcaccgcctgaccagg

SEQ ID NO: 7472569 - DNA, 22 bp, Homo sapiens
gagaagtttggagtgaaggttt

SEQ ID NO: 7472570 - DNA, 22 bp, Homo sapiens
gagaagtttggagtgaaggttt

SEQ ID NO: 7472571 - DNA, 17 bp, Homo sapiens
gagaagttttgctaccg

SEQ ID NO: 7472572 - DNA, 17 bp, Homo sapiens
gagaagttttgctaccg

SEQ ID NO: 7472573 - DNA, 22 bp, Homo sapiens
gagaagtttcttcctaggtttg

SEQ ID NO: 7472574 - DNA, 22 bp, Homo sapiens
gagaagtttcttcctaggtttg

SEQ ID NO: 7472575 - DNA, 22 bp, Homo sapiens
gagaagtttggagtgaaggttt

SEQ ID NO: 7472576 - DNA, 22 bp, Homo sapiens
gagaataaatctaaagtttctt

SEQ ID NO: 7472577 - DNA, 22 bp, Homo sapiens
gagaataaatctaaagtttctt

SEQ ID NO: 7472578 - DNA, 22 bp, Homo sapiens
gagaatacaaccagaagctgag

SEQ ID NO: 7472579 - DNA, 22 bp, Homo sapiens
gagaataaatctaaagtttctt

SEQ ID NO: 7472580 - DNA, 22 bp, Homo sapiens
gagaagtttttcttattacatg

SEQ ID NO: 7472581 - DNA, 22 bp, Homo sapiens
gagaagttctaattggctcttt

SEQ ID NO: 7472582 - DNA, 22 bp, Homo sapiens
gagaagttgtaggagaattttg

SEQ ID NO: 7472583 - DNA, 22 bp, Homo sapiens
gagaagttgtgtggatttaaag

SEQ ID NO: 7472584 - DNA, 22 bp, Homo sapiens
gagaagttgtaggagaattttg

SEQ ID NO: 7472585 - DNA, 22 bp, Homo sapiens
gagaagttgtaggagaattttg

SEQ ID NO: 7472586 - DNA, 22 bp, Homo sapiens
gagaagtttctggtttgcatag

SEQ ID NO: 7472587 - DNA, 22 bp, Homo sapiens
gagaagtttctggtttgcatag

SEQ ID NO: 7472588 - DNA, 22 bp, Homo sapiens
gagaagtttctggtttgcatag

SEQ ID NO: 7472589 - DNA, 22 bp, Homo sapiens
gagaagttgtgtggatttaaag

SEQ ID NO: 7472590 - DNA, 22 bp, Homo sapiens
gagaagttgtgtggatttaaag

SEQ ID NO: 7472591 - DNA, 22 bp, Homo sapiens
gagaagtttaatcattagacca

SEQ ID NO: 7472592 - DNA, 22 bp, Homo sapiens
gagaaggggtgatgtgggtaat

SEQ ID NO: 7472593 - DNA, 22 bp, Homo sapiens
gagaaggtggacctgaaggagc

SEQ ID NO: 7472594 - DNA, 22 bp, Homo sapiens
gagaaggggtgatgtgggtaat

SEQ ID NO: 7472595 - DNA, 22 bp, Homo sapiens
gagaaggggtgatgtgggtaat

SEQ ID NO: 7472596 - DNA, 22 bp, Homo sapiens
gagaacaggctctggagtcaga

SEQ ID NO: 7472597 - DNA, 22 bp, Homo sapiens
gagaacaggctctggagtcaga

SEQ ID NO: 7472598 - DNA, 22 bp, Homo sapiens
gagaacaggctctggagtcaga

SEQ ID NO: 7472599 - DNA, 22 bp, Homo sapiens
gagaacaggctctggagtcaga

SEQ ID NO: 7472600 - DNA, 22 bp, Homo sapiens
gagaaggggtgatgtgggtaat

SEQ ID NO: 7472601 - DNA, 22 bp, Homo sapiens
gagaaggggtgatgtgggtaat

SEQ ID NO: 7472602 - DNA, 22 bp, Homo sapiens
gagaacaggctctggagtcaga

SEQ ID NO: 7472603 - DNA, 22 bp, Homo sapiens
gagaagtcatttgaccacctag

SEQ ID NO: 7472604 - DNA, 22 bp, Homo sapiens
gagaagttagctctgtttaggt

SEQ ID NO: 7472605 - DNA, 22 bp, Homo sapiens
gagaagttagctctgtttaggt

SEQ ID NO: 7472606 - DNA, 18 bp, Homo sapiens
gagaagtgcatacattat

SEQ ID NO: 7472607 - DNA, 22 bp, Homo sapiens
gagaagttcattactctgccca

SEQ ID NO: 7472608 - DNA, 22 bp, Homo sapiens
gagaagttcattactctgccca

SEQ ID NO: 7472609 - DNA, 22 bp, Homo sapiens
gagaaggtggatttcgtatccc

SEQ ID NO: 7472610 - DNA, 22 bp, Homo sapiens
atgcttaacttcctagtctata

SEQ ID NO: 7472611 - DNA, 23 bp, Homo sapiens
gagaacagccacagagagctgtg

SEQ ID NO: 7472612 - DNA, 23 bp, Homo sapiens
gagaacagccacagagagctgtg

SEQ ID NO: 7472613 - DNA, 23 bp, Homo sapiens
gagaacagccacagagagctgtg

SEQ ID NO: 7472614 - DNA, 22 bp, Homo sapiens
atgcttaacttcctagtctata

SEQ ID NO: 7472615 - DNA, 22 bp, Homo sapiens
atgctgttattctaatgtgtga

SEQ ID NO: 7472616 - DNA, 22 bp, Homo sapiens
atgcttaactctgtacatagtt

SEQ ID NO: 7472617 - DNA, 22 bp, Homo sapiens
atgcttaactctgtacatagtt

SEQ ID NO: 7472618 - DNA, 22 bp, Homo sapiens
atgcttaactctgtacatagtt

SEQ ID NO: 7472619 - DNA, 22 bp, Homo sapiens
atgctgtgtttgagaacctagg

SEQ ID NO: 7472620 - DNA, 22 bp, Homo sapiens
atgctgtgtttgagaacctagg

SEQ ID NO: 7472621 - DNA, 22 bp, Homo sapiens
atgctgtgtggtcaagttaatt

SEQ ID NO: 7472622 - DNA, 22 bp, Homo sapiens
atgctgttaagataatgggttc

SEQ ID NO: 7472623 - DNA, 22 bp, Homo sapiens
atgctgtgttttaaatggaaat

SEQ ID NO: 7472624 - DNA, 22 bp, Homo sapiens
atgctgtgtctagcaggaacac

SEQ ID NO: 7472625 - DNA, 22 bp, Homo sapiens
atgctgtgtcctagtgaaagaa

SEQ ID NO: 7472626 - DNA, 22 bp, Homo sapiens
atgctgtgtcctagtgaaagaa

SEQ ID NO: 7472627 - DNA, 22 bp, Homo sapiens
atgctgtgtcaggaatttgata

SEQ ID NO: 7472628 - DNA, 16 bp, Homo sapiens
atgctgctattagagg

SEQ ID NO: 7472629 - DNA, 22 bp, Homo sapiens
atgctggattgagagcaagggg

SEQ ID NO: 7472630 - DNA, 22 bp, Homo sapiens
atgctggattgagagcaagggg

SEQ ID NO: 7472631 - DNA, 22 bp, Homo sapiens
atgctggcagccgagtgctcca

SEQ ID NO: 7472632 - DNA, 22 bp, Homo sapiens
atgctggcagccgagtgctcca

SEQ ID NO: 7472633 - DNA, 22 bp, Homo sapiens
atgctggcagccgagtgctcca

SEQ ID NO: 7472634 - DNA, 22 bp, Homo sapiens
atgctggcagccgagtgctcca

SEQ ID NO: 7472635 - DNA, 22 bp, Homo sapiens
atgctggcagccgagtgctcca

SEQ ID NO: 7472636 - DNA, 22 bp, Homo sapiens
atgctggcagccgagtgctcca

SEQ ID NO: 7472637 - DNA, 22 bp, Homo sapiens
atgctgggaaactgaaaggaat

SEQ ID NO: 7472638 - DNA, 22 bp, Homo sapiens
atgctgggaaactgaaaggaat

SEQ ID NO: 7472639 - DNA, 22 bp, Homo sapiens
atgctgggaaactgaaaggaat

SEQ ID NO: 7472640 - DNA, 22 bp, Homo sapiens
atgctgggaagacaaggtggag

SEQ ID NO: 7472641 - DNA, 22 bp, Homo sapiens
atgctgggaagacaaggtggag

SEQ ID NO: 7472642 - DNA, 22 bp, Homo sapiens
atgctgggaagacaaggtggag

SEQ ID NO: 7472643 - DNA, 22 bp, Homo sapiens
atgctgggaagacaaggtggag

SEQ ID NO: 7472644 - DNA, 22 bp, Homo sapiens
atgctgggaagtcctaaccaca

SEQ ID NO: 7472645 - DNA, 22 bp, Homo sapiens
atgctgggaagtcctaaccaca

SEQ ID NO: 7472646 - DNA, 22 bp, Homo sapiens
atgctgggaagacaaggtggag

SEQ ID NO: 7472647 - DNA, 22 bp, Homo sapiens
atgctgggacgtacttgttcat

SEQ ID NO: 7472648 - DNA, 22 bp, Homo sapiens
atgctgggaagtcctaaccaca

SEQ ID NO: 7472649 - DNA, 22 bp, Homo sapiens
atgctgtccctgcccttcaccc

SEQ ID NO: 7472650 - DNA, 22 bp, Homo sapiens
atgctgtccctgcccttcaccc

SEQ ID NO: 7472651 - DNA, 22 bp, Homo sapiens
atgctgtcgaaaccaaacatct

SEQ ID NO: 7472652 - DNA, 22 bp, Homo sapiens
atgctgtcagtattatgtgcag

SEQ ID NO: 7472653 - DNA, 22 bp, Homo sapiens
atgctgtatacatatgaaatta

SEQ ID NO: 7472654 - DNA, 22 bp, Homo sapiens
atgctgtatacatatgaaatta

SEQ ID NO: 7472655 - DNA, 22 bp, Homo sapiens
atgctgtagatcttagcctcta

SEQ ID NO: 7472656 - DNA, 22 bp, Homo sapiens
atgctgtccactcttggtgttt

SEQ ID NO: 7472657 - DNA, 22 bp, Homo sapiens
atgctgtccactcttggtgttt

SEQ ID NO: 7472658 - DNA, 22 bp, Homo sapiens
atgctgtcagtattatgtgcag

SEQ ID NO: 7472659 - DNA, 22 bp, Homo sapiens
atgctggtaagttgcaaatgtt

SEQ ID NO: 7472660 - DNA, 22 bp, Homo sapiens
atgctggtctcattgggttagg

SEQ ID NO: 7472661 - DNA, 22 bp, Homo sapiens
atgctggtctgcagagttggga

SEQ ID NO: 7472662 - DNA, 22 bp, Homo sapiens
atgctgggagtgaagcccctgg

SEQ ID NO: 7472663 - DNA, 22 bp, Homo sapiens
atgctggggcctcagaccagaa

SEQ ID NO: 7472664 - DNA, 22 bp, Homo sapiens
atgctggggcctcagaccagaa

SEQ ID NO: 7472665 - DNA, 22 bp, Homo sapiens
atgctggggcctcagaccagaa

SEQ ID NO: 7472666 - DNA, 22 bp, Homo sapiens
atgctggttgctaagcagcgat

SEQ ID NO: 7472667 - DNA, 22 bp, Homo sapiens
atgctggtctgcagagttggga

SEQ ID NO: 7472668 - DNA, 22 bp, Homo sapiens
atgctggtggttgatggcagga

SEQ ID NO: 7472669 - DNA, 22 bp, Homo sapiens
atgctggtggttgatggcagga

SEQ ID NO: 7472670 - DNA, 22 bp, Homo sapiens
atgctggtgctagaaactggaa

SEQ ID NO: 7472671 - DNA, 22 bp, Homo sapiens
atgctgtgaaaaagaaggctga

SEQ ID NO: 7472672 - DNA, 22 bp, Homo sapiens
atgctgtctctgctatccaaag

SEQ ID NO: 7472673 - DNA, 22 bp, Homo sapiens
atgctgtgaaaaagaaggctga

SEQ ID NO: 7472674 - DNA, 22 bp, Homo sapiens
atgctgtgcctggaaagcggct

SEQ ID NO: 7472675 - DNA, 22 bp, Homo sapiens
atgctgtgattgtagaaatatt

SEQ ID NO: 7472676 - DNA, 22 bp, Homo sapiens
atgctgtgcctggaaagcggct

SEQ ID NO: 7472677 - DNA, 22 bp, Homo sapiens
atgctgtgtcaccttaggattt

SEQ ID NO: 7472678 - DNA, 22 bp, Homo sapiens
atgctgtgtattttactctttc

SEQ ID NO: 7472679 - DNA, 22 bp, Homo sapiens
atgctgtgctggctaaccatgg

SEQ ID NO: 7472680 - DNA, 22 bp, Homo sapiens
atggatctgtatccaaaaatac

SEQ ID NO: 7472681 - DNA, 22 bp, Homo sapiens
atggatctcagccaaccagtgt

SEQ ID NO: 7472682 - DNA, 22 bp, Homo sapiens
atggatcccactattttaagac

SEQ ID NO: 7472683 - DNA, 22 bp, Homo sapiens
atggatctcagccaaccagtgt

SEQ ID NO: 7472684 - DNA, 22 bp, Homo sapiens
atggatagtggtgaaggctgta

SEQ ID NO: 7472685 - DNA, 22 bp, Homo sapiens
atggatattggccaaactcatt

SEQ ID NO: 7472686 - DNA, 22 bp, Homo sapiens
atggagggtgtcagagagcgaa

SEQ ID NO: 7472687 - DNA, 22 bp, Homo sapiens
atggataatggtgatagttgca

SEQ ID NO: 7472688 - DNA, 22 bp, Homo sapiens
atggataatgtctctgtttccc

SEQ ID NO: 7472689 - DNA, 22 bp, Homo sapiens
atggaggtctgtgactcccaaa

SEQ ID NO: 7472690 - DNA, 22 bp, Homo sapiens
atggaggtctgtgactcccaaa

SEQ ID NO: 7472691 - DNA, 22 bp, Homo sapiens
gagacagtgaggaaggctaggt

SEQ ID NO: 7472692 - DNA, 22 bp, Homo sapiens
gagacagtgcaggaaatctaaa

SEQ ID NO: 7472693 - DNA, 22 bp, Homo sapiens
atggagggtgtcagagagcgaa

SEQ ID NO: 7472694 - DNA, 22 bp, Homo sapiens
gagacaggcagctagtgggtca

SEQ ID NO: 7472695 - DNA, 22 bp, Homo sapiens
gagacaggcagctagtgggtca

SEQ ID NO: 7472696 - DNA, 22 bp, Homo sapiens
gagacaggccaggtggtactta

SEQ ID NO: 7472697 - DNA, 22 bp, Homo sapiens
gagacaggccaggtggtactta

SEQ ID NO: 7472698 - DNA, 22 bp, Homo sapiens
gagacaggccaggtggtactta

SEQ ID NO: 7472699 - DNA, 22 bp, Homo sapiens
gagacaggccaggtggtactta

SEQ ID NO: 7472700 - DNA, 22 bp, Homo sapiens
gagacaggccaggtggtactta

SEQ ID NO: 7472701 - DNA, 22 bp, Homo sapiens
gagacaggcagctagtgggtca

SEQ ID NO: 7472702 - DNA, 22 bp, Homo sapiens
gagacaggcagctagtgggtca

SEQ ID NO: 7472703 - DNA, 22 bp, Homo sapiens
gagacaggcagctagtgggtca

SEQ ID NO: 7472704 - DNA, 22 bp, Homo sapiens
gagacaggcagctagtgggtca

SEQ ID NO: 7472705 - DNA, 22 bp, Homo sapiens
gagacaggcagctagtgggtca

SEQ ID NO: 7472706 - DNA, 22 bp, Homo sapiens
gagacaggcagctagtgggtca

SEQ ID NO: 7472707 - DNA, 22 bp, Homo sapiens
gagacaggcagctagtgggtca

SEQ ID NO: 7472708 - DNA, 22 bp, Homo sapiens
gagacaggcagctagtgggtca

SEQ ID NO: 7472709 - DNA, 22 bp, Homo sapiens
gagacagcttaattggtggtca

SEQ ID NO: 7472710 - DNA, 22 bp, Homo sapiens
gagacagcttaattggtggtca

SEQ ID NO: 7472711 - DNA, 22 bp, Homo sapiens
gagacagcctactccagtctca

SEQ ID NO: 7472712 - DNA, 21 bp, Homo sapiens
gagacagcccagtgccagggc

SEQ ID NO: 7472713 - DNA, 21 bp, Homo sapiens
gagacagcccagtgccagggc

SEQ ID NO: 7472714 - DNA, 22 bp, Homo sapiens
gagacagcctactccagtctca

SEQ ID NO: 7472715 - DNA, 22 bp, Homo sapiens
gagacaggatttaaccaaagct

SEQ ID NO: 7472716 - DNA, 22 bp, Homo sapiens
gagacaggatttaaccaaagct

SEQ ID NO: 7472717 - DNA, 22 bp, Homo sapiens
gagacaggatttaaccaaagct

SEQ ID NO: 7472718 - DNA, 22 bp, Homo sapiens
gagacaggatttaaccaaagct

SEQ ID NO: 7472719 - DNA, 22 bp, Homo sapiens
gagacaggatttaaccaaagct

SEQ ID NO: 7472720 - DNA, 22 bp, Homo sapiens
gagacagcagggccagggcctg

SEQ ID NO: 7472721 - DNA, 21 bp, Homo sapiens
gagacagcccagtgccagggc

SEQ ID NO: 7472722 - DNA, 22 bp, Homo sapiens
gagacagcagggccagggcctg

SEQ ID NO: 7472723 - DNA, 22 bp, Homo sapiens
gagacagcagggccagggcctg

SEQ ID NO: 7472724 - DNA, 22 bp, Homo sapiens
gagacagcagggccagggcctg

SEQ ID NO: 7472725 - DNA, 22 bp, Homo sapiens
gagacagcagggccagggcctg

SEQ ID NO: 7472726 - DNA, 22 bp, Homo sapiens
gagacagcacaggccactggga

SEQ ID NO: 7472727 - DNA, 22 bp, Homo sapiens
gagacagcacaggccactggga

SEQ ID NO: 7472728 - DNA, 17 bp, Homo sapiens
gagacagcaggagcccc

SEQ ID NO: 7472729 - DNA, 17 bp, Homo sapiens
gagacagcaggagcccc

SEQ ID NO: 7472730 - DNA, 17 bp, Homo sapiens
gagacagcaggagcccc

SEQ ID NO: 7472731 - DNA, 17 bp, Homo sapiens
gagacagcaggagcccc

SEQ ID NO: 7472732 - DNA, 20 bp, Homo sapiens
gagacagcaaaagcctctcc

SEQ ID NO: 7472733 - DNA, 22 bp, Homo sapiens
gagaatctcaggcacccagaag

SEQ ID NO: 7472734 - DNA, 20 bp, Homo sapiens
gagacagcaaaagcctctcc

SEQ ID NO: 7472735 - DNA, 22 bp, Homo sapiens
gagaatcatttacagaatgatt

SEQ ID NO: 7472736 - DNA, 22 bp, Homo sapiens
gagaatcatttacagaatgatt

SEQ ID NO: 7472737 - DNA, 22 bp, Homo sapiens
gagaatcatggcaacagaatga

SEQ ID NO: 7472738 - DNA, 22 bp, Homo sapiens
gagaatcatttacagaatgatt

SEQ ID NO: 7472739 - DNA, 22 bp, Homo sapiens
gagaatcatttacagaatgatt

SEQ ID NO: 7472740 - DNA, 22 bp, Homo sapiens
gagaatatttttagctttcctc

SEQ ID NO: 7472741 - DNA, 22 bp, Homo sapiens
gagaatcatggcaacagaatga

SEQ ID NO: 7472742 - DNA, 22 bp, Homo sapiens
gagaatcatggcaacagaatga

SEQ ID NO: 7472743 - DNA, 22 bp, Homo sapiens
gagaataaatctaaagtttctt

SEQ ID NO: 7472744 - DNA, 22 bp, Homo sapiens
gagaatatattgaagtagttcc

SEQ ID NO: 7472745 - DNA, 22 bp, Homo sapiens
gagaatatattgaagtagttcc

SEQ ID NO: 7472746 - DNA, 22 bp, Homo sapiens
gagaatatcttggcagtctctg

SEQ ID NO: 7472747 - DNA, 21 bp, Homo sapiens
gagaatcaggaaggattgatg

SEQ ID NO: 7472748 - DNA, 21 bp, Homo sapiens
gagaatcaggaaggattgatg

SEQ ID NO: 7472749 - DNA, 22 bp, Homo sapiens
atggcagaatatctgcatcgca

SEQ ID NO: 7472750 - DNA, 22 bp, Homo sapiens
atggcagaatatctgcatcgca

SEQ ID NO: 7472751 - DNA, 22 bp, Homo sapiens
atggcagaattaggatttcaag

SEQ ID NO: 7472752 - DNA, 22 bp, Homo sapiens
atggcagacacaggcaggcaga

SEQ ID NO: 7472753 - DNA, 22 bp, Homo sapiens
atggcagacacaggcaggcaga

SEQ ID NO: 7472754 - DNA, 22 bp, Homo sapiens
atggcagaattaggatttcaag

SEQ ID NO: 7472755 - DNA, 22 bp, Homo sapiens
atggcagaattaggatttcaag

SEQ ID NO: 7472756 - DNA, 22 bp, Homo sapiens
atggcagacacaggcaggcaga

SEQ ID NO: 7472757 - DNA, 22 bp, Homo sapiens
atggcagacacaggcaggcaga

SEQ ID NO: 7472758 - DNA, 22 bp, Homo sapiens
atggcagacacaggcaggcaga

SEQ ID NO: 7472759 - DNA, 22 bp, Homo sapiens
atggcagacctcctggccacaa

SEQ ID NO: 7472760 - DNA, 22 bp, Homo sapiens
atggcagacctgggctggagaa

SEQ ID NO: 7472761 - DNA, 22 bp, Homo sapiens
atggcagacctgggctggagaa

SEQ ID NO: 7472762 - DNA, 22 bp, Homo sapiens
atggcagacctgggctggagaa

SEQ ID NO: 7472763 - DNA, 22 bp, Homo sapiens
atggcagaagtcaagatgagtt

SEQ ID NO: 7472764 - DNA, 22 bp, Homo sapiens
atggcagaagtcaagatgagtt

SEQ ID NO: 7472765 - DNA, 22 bp, Homo sapiens
atggcagaaaggcatgtgggcc

SEQ ID NO: 7472766 - DNA, 22 bp, Homo sapiens
atggcagaaaggcatgtgggcc

SEQ ID NO: 7472767 - DNA, 22 bp, Homo sapiens
atggcagaaagaatagaggcta

SEQ ID NO: 7472768 - DNA, 22 bp, Homo sapiens
atggcagaaaggcatgtgggcc

SEQ ID NO: 7472769 - DNA, 22 bp, Homo sapiens
atggcagaaaggcatgtgggcc

SEQ ID NO: 7472770 - DNA, 22 bp, Homo sapiens
atggcagaaagaatagaggcta

SEQ ID NO: 7472771 - DNA, 22 bp, Homo sapiens
atggcaccttccccagagctca

SEQ ID NO: 7472772 - DNA, 22 bp, Homo sapiens
atggcaccaaatatgtctcatt

SEQ ID NO: 7472773 - DNA, 23 bp, Homo sapiens
atggcacatgggacagtaagtag

SEQ ID NO: 7472774 - DNA, 23 bp, Homo sapiens
atggcacatgggacagtaagtag

SEQ ID NO: 7472775 - DNA, 22 bp, Homo sapiens
atggcacagtgggaaatgacct

SEQ ID NO: 7472776 - DNA, 22 bp, Homo sapiens
atggcacatgaccttgatggat

SEQ ID NO: 7472777 - DNA, 22 bp, Homo sapiens
atggcaccttccccagagctca

SEQ ID NO: 7472778 - DNA, 22 bp, Homo sapiens
atggcactaagagggagctgga

SEQ ID NO: 7472779 - DNA, 22 bp, Homo sapiens
atggcactaagagggagctgga

SEQ ID NO: 7472780 - DNA, 22 bp, Homo sapiens
atggcactgacctcccttgtaa

SEQ ID NO: 7472781 - DNA, 22 bp, Homo sapiens
atggcacagatgttctgattat

SEQ ID NO: 7472782 - DNA, 22 bp, Homo sapiens
atggcacagtgggaaatgacct

SEQ ID NO: 7472783 - DNA, 18 bp, Homo sapiens
atggcacagtctttccct

SEQ ID NO: 7472784 - DNA, 22 bp, Homo sapiens
atggcacaggagaggagggctg

SEQ ID NO: 7472785 - DNA, 22 bp, Homo sapiens
atggcaattgtaaatggaaaga

SEQ ID NO: 7472786 - DNA, 22 bp, Homo sapiens
atggcacacaggtctgcaaggg

SEQ ID NO: 7472787 - DNA, 22 bp, Homo sapiens
atggcacacaggtctgcaaggg

SEQ ID NO: 7472788 - DNA, 22 bp, Homo sapiens
atggcacagatgttctgattat

SEQ ID NO: 7472789 - DNA, 22 bp, Homo sapiens
atggcacagatgttctgattat

SEQ ID NO: 7472790 - DNA, 22 bp, Homo sapiens
atggcaagcaagctgaagagat

SEQ ID NO: 7472791 - DNA, 22 bp, Homo sapiens
atggcaagcaagctgaagagat

SEQ ID NO: 7472792 - DNA, 22 bp, Homo sapiens
atggcaagcaagctgaagagat

SEQ ID NO: 7472793 - DNA, 22 bp, Homo sapiens
atggcaatgtggcttatttgga

SEQ ID NO: 7472794 - DNA, 22 bp, Homo sapiens
atggcaagcaagctgaagagat

SEQ ID NO: 7472795 - DNA, 22 bp, Homo sapiens
atggcaaaaactgcagttacct

SEQ ID NO: 7472796 - DNA, 22 bp, Homo sapiens
atggcaaaaactgcagttacct

SEQ ID NO: 7472797 - DNA, 22 bp, Homo sapiens
atggcaaaaattaacagatcaa

SEQ ID NO: 7472798 - DNA, 22 bp, Homo sapiens
atggcaaaaattaacagatcaa

SEQ ID NO: 7472799 - DNA, 21 bp, Homo sapiens
atggatttaaacaggccacaa

SEQ ID NO: 7472800 - DNA, 22 bp, Homo sapiens
atggatttggatgagattactt

SEQ ID NO: 7472801 - DNA, 22 bp, Homo sapiens
atggatttggatgagattactt

SEQ ID NO: 7472802 - DNA, 22 bp, Homo sapiens
atggatgggatattgcttgcca

SEQ ID NO: 7472803 - DNA, 22 bp, Homo sapiens
atggattggatttttatggacc

SEQ ID NO: 7472804 - DNA, 22 bp, Homo sapiens
atggattcattaatgacttctc

SEQ ID NO: 7472805 - DNA, 22 bp, Homo sapiens
atggatgaaggcgaggatgagg

SEQ ID NO: 7472806 - DNA, 22 bp, Homo sapiens
atggatcttccctcatttctga

SEQ ID NO: 7472807 - DNA, 19 bp, Homo sapiens
atggatgcctcatgcctca

SEQ ID NO: 7472808 - DNA, 22 bp, Homo sapiens
atggatgagtccttgagacaca

SEQ ID NO: 7472809 - DNA, 22 bp, Homo sapiens
atggatggcctgagcacagctg

SEQ ID NO: 7472810 - DNA, 22 bp, Homo sapiens
atggatggaaaagttgaggaga

SEQ ID NO: 7472811 - DNA, 22 bp, Homo sapiens
atggatggaaaagttgaggaga

SEQ ID NO: 7472812 - DNA, 22 bp, Homo sapiens
atggatggaactctgctgtggt

SEQ ID NO: 7472813 - DNA, 22 bp, Homo sapiens
gaggttccccattgtactggct

SEQ ID NO: 7472814 - DNA, 22 bp, Homo sapiens
gaggttccccattgtactggct

SEQ ID NO: 7472815 - DNA, 22 bp, Homo sapiens
gaggttccagacagcttaggga

SEQ ID NO: 7472816 - DNA, 22 bp, Homo sapiens
gaggttccccattgtactggct

SEQ ID NO: 7472817 - DNA, 22 bp, Homo sapiens
gaggttgccatgcatcctggtt

SEQ ID NO: 7472818 - DNA, 22 bp, Homo sapiens
gaggttccccattgtactggct

SEQ ID NO: 7472819 - DNA, 22 bp, Homo sapiens
gaggttctgggggtctgcctgg

SEQ ID NO: 7472820 - DNA, 22 bp, Homo sapiens
gaggttcacttcctggatcctt

SEQ ID NO: 7472821 - DNA, 22 bp, Homo sapiens
gaggttcagtcctgctctgtca

SEQ ID NO: 7472822 - DNA, 22 bp, Homo sapiens
gaggttcattcagctctgtcac

SEQ ID NO: 7472823 - DNA, 22 bp, Homo sapiens
gaggttccagacagcttaggga

SEQ ID NO: 7472824 - DNA, 22 bp, Homo sapiens
gaggttgggaagtccaagctgg

SEQ ID NO: 7472825 - DNA, 22 bp, Homo sapiens
gaggttgggaagtccaagctgg

SEQ ID NO: 7472826 - DNA, 22 bp, Homo sapiens
gaggttgggaagtccaagctgg

SEQ ID NO: 7472827 - DNA, 22 bp, Homo sapiens
gaggttgggaagtccaagctgg

SEQ ID NO: 7472828 - DNA, 22 bp, Homo sapiens
gaggttggagggctggcctgca

SEQ ID NO: 7472829 - DNA, 22 bp, Homo sapiens
gaggttggagggctggcctgca

SEQ ID NO: 7472830 - DNA, 22 bp, Homo sapiens
gaggttggcgccctgcctggcc

SEQ ID NO: 7472831 - DNA, 22 bp, Homo sapiens
gaggttgggatgagggatacag

SEQ ID NO: 7472832 - DNA, 22 bp, Homo sapiens
gagtgcagtatcttctgtgtcc

SEQ ID NO: 7472833 - DNA, 21 bp, Homo sapiens
gagtgcaggtctgatgccatc

SEQ ID NO: 7472834 - DNA, 22 bp, Homo sapiens
gagtgcagtatcttctgtgtcc

SEQ ID NO: 7472835 - DNA, 21 bp, Homo sapiens
gagtgcaggtctgatgccatc

SEQ ID NO: 7472836 - DNA, 22 bp, Homo sapiens
gagtgcagtatcttctgtgtcc

SEQ ID NO: 7472837 - DNA, 22 bp, Homo sapiens
gagtgcagtatcttctgtgtcc

SEQ ID NO: 7472838 - DNA, 22 bp, Homo sapiens
gagtgcagtatcttctgtgtcc

SEQ ID NO: 7472839 - DNA, 22 bp, Homo sapiens
gagtgggcaccgtgggcacact

SEQ ID NO: 7472840 - DNA, 22 bp, Homo sapiens
gagtgggcaccgtgggcacact

SEQ ID NO: 7472841 - DNA, 22 bp, Homo sapiens
gagtgcagtatgagaggctgct

SEQ ID NO: 7472842 - DNA, 22 bp, Homo sapiens
atgttataaatagagacactgg

SEQ ID NO: 7472843 - DNA, 22 bp, Homo sapiens
atgttatagttataaaatgagg

SEQ ID NO: 7472844 - DNA, 22 bp, Homo sapiens
atgttatagttataaaatgagg

SEQ ID NO: 7472845 - DNA, 22 bp, Homo sapiens
atgttataaatagagacactgg

SEQ ID NO: 7472846 - DNA, 22 bp, Homo sapiens
atgttatagttataaaatgagg

SEQ ID NO: 7472847 - DNA, 22 bp, Homo sapiens
atgttatagttataaaatgagg

SEQ ID NO: 7472848 - DNA, 22 bp, Homo sapiens
atgttagtgtcactttgtacaa

SEQ ID NO: 7472849 - DNA, 22 bp, Homo sapiens
atgttagtgatagtaaatagtg

SEQ ID NO: 7472850 - DNA, 22 bp, Homo sapiens
atgttataaatagagacactgg

SEQ ID NO: 7472851 - DNA, 23 bp, Homo sapiens
gaggtgtgaattctgggtgctgc

SEQ ID NO: 7472852 - DNA, 22 bp, Homo sapiens
gaggtgtgaggaatgaatgggg

SEQ ID NO: 7472853 - DNA, 22 bp, Homo sapiens
atgttatgtaacacttgtttct

SEQ ID NO: 7472854 - DNA, 22 bp, Homo sapiens
atgttatgtccctcttactcag

SEQ ID NO: 7472855 - DNA, 22 bp, Homo sapiens
gaggtgtgaggaatgaatgggg

SEQ ID NO: 7472856 - DNA, 22 bp, Homo sapiens
atgttatcttcggaagcaagtg

SEQ ID NO: 7472857 - DNA, 22 bp, Homo sapiens
atgttatggctcaaacatttgg

SEQ ID NO: 7472858 - DNA, 22 bp, Homo sapiens
atgttatgacaagcatgacaga

SEQ ID NO: 7472859 - DNA, 22 bp, Homo sapiens
atgttatggctcaaacatttgg

SEQ ID NO: 7472860 - DNA, 22 bp, Homo sapiens
gaggtgtgatgcagagtggtgg

SEQ ID NO: 7472861 - DNA, 22 bp, Homo sapiens
gaggtgtgatgcagagtggtgg

SEQ ID NO: 7472862 - DNA, 22 bp, Homo sapiens
gaggtgtgatgcagagtggtgg

SEQ ID NO: 7472863 - DNA, 22 bp, Homo sapiens
gaggtgtgaggaatgaatgggg

SEQ ID NO: 7472864 - DNA, 22 bp, Homo sapiens
gaggtgtgcacagcgtgctgac

SEQ ID NO: 7472865 - DNA, 22 bp, Homo sapiens
gaggtgtgcacagcgtgctgac

SEQ ID NO: 7472866 - DNA, 22 bp, Homo sapiens
gaggtgtggtcctcagccccca

SEQ ID NO: 7472867 - DNA, 22 bp, Homo sapiens
gaggtgtgctgcggcccggtgc

SEQ ID NO: 7472868 - DNA, 22 bp, Homo sapiens
gaggttcacaggctatcacagt

SEQ ID NO: 7472869 - DNA, 22 bp, Homo sapiens
gaggttagtgatttgtcattga

SEQ ID NO: 7472870 - DNA, 22 bp, Homo sapiens
gaggttatgttcatatcttagt

SEQ ID NO: 7472871 - DNA, 22 bp, Homo sapiens
gaggttatgttcatatcttagt

SEQ ID NO: 7472872 - DNA, 22 bp, Homo sapiens
gaggttagcagtatcttctagt

SEQ ID NO: 7472873 - DNA, 22 bp, Homo sapiens
gaggtgtggtcctcagccccca

SEQ ID NO: 7472874 - DNA, 22 bp, Homo sapiens
gaggtgtggtcctcagccccca

SEQ ID NO: 7472875 - DNA, 22 bp, Homo sapiens
gaggtgtgttacagattgtcat

SEQ ID NO: 7472876 - DNA, 22 bp, Homo sapiens
gaggtgtgttacagattgtcat

SEQ ID NO: 7472877 - DNA, 22 bp, Homo sapiens
atgttaggcaatctttcttgtt

SEQ ID NO: 7472878 - DNA, 22 bp, Homo sapiens
atgttagcattgagcacttact

SEQ ID NO: 7472879 - DNA, 22 bp, Homo sapiens
atgttacttagaataattctgg

SEQ ID NO: 7472880 - DNA, 22 bp, Homo sapiens
atgttacttagaataattctgg

SEQ ID NO: 7472881 - DNA, 22 bp, Homo sapiens
atgttagaaggaatgttaaaag

SEQ ID NO: 7472882 - DNA, 22 bp, Homo sapiens
atgttactgtgatcatgatact

SEQ ID NO: 7472883 - DNA, 22 bp, Homo sapiens
atgttactgtgatcatgatact

SEQ ID NO: 7472884 - DNA, 23 bp, Homo sapiens
atgttacttaacctctctgtgcc

SEQ ID NO: 7472885 - DNA, 22 bp, Homo sapiens
atgttactgtgatcatgatact

SEQ ID NO: 7472886 - DNA, 22 bp, Homo sapiens
atgttacatagtccttatttgt

SEQ ID NO: 7472887 - DNA, 22 bp, Homo sapiens
atgttacagttgagtaaattaa

SEQ ID NO: 7472888 - DNA, 22 bp, Homo sapiens
atgttacagttgagtaaattaa

SEQ ID NO: 7472889 - DNA, 22 bp, Homo sapiens
atgttacagggagagaaggcca

SEQ ID NO: 7472890 - DNA, 22 bp, Homo sapiens
atgttacagggagagaaggcca

SEQ ID NO: 7472891 - DNA, 22 bp, Homo sapiens
atgttacagagaaagtggaagc

SEQ ID NO: 7472892 - DNA, 16 bp, Homo sapiens
atgttacagaagtaat

SEQ ID NO: 7472893 - DNA, 22 bp, Homo sapiens
atgttacagcagcccgaatgga

SEQ ID NO: 7472894 - DNA, 22 bp, Homo sapiens
atgttacagaaagcaaagatga

SEQ ID NO: 7472895 - DNA, 22 bp, Homo sapiens
atgttacagaaagcaaagatga

SEQ ID NO: 7472896 - DNA, 22 bp, Homo sapiens
atgttacagaaagcaaagatga

SEQ ID NO: 7472897 - DNA, 16 bp, Homo sapiens
atgttacagaagtaat

SEQ ID NO: 7472898 - DNA, 22 bp, Homo sapiens
atgttacagagaaagtggaagc

SEQ ID NO: 7472899 - DNA, 22 bp, Homo sapiens
atgttacagagaaagtggaagc

SEQ ID NO: 7472900 - DNA, 22 bp, Homo sapiens
atgttacagagaaagtggaagc

SEQ ID NO: 7472901 - DNA, 22 bp, Homo sapiens
atgttacatagtccttatttgt

SEQ ID NO: 7472902 - DNA, 22 bp, Homo sapiens
atgttacatgaaacggcctact

SEQ ID NO: 7472903 - DNA, 22 bp, Homo sapiens
atgttacatgaaacggcctact

SEQ ID NO: 7472904 - DNA, 22 bp, Homo sapiens
atgttacatgaaacggcctact

SEQ ID NO: 7472905 - DNA, 22 bp, Homo sapiens
atgttacattgagaggtggttg

SEQ ID NO: 7472906 - DNA, 22 bp, Homo sapiens
atgttacattgagaggtggttg

SEQ ID NO: 7472907 - DNA, 22 bp, Homo sapiens
atgttacattgagaggtggttg

SEQ ID NO: 7472908 - DNA, 22 bp, Homo sapiens
atgttacagttgagtaaattaa

SEQ ID NO: 7472909 - DNA, 22 bp, Homo sapiens
atgttacagttgagtaaattaa

SEQ ID NO: 7472910 - DNA, 22 bp, Homo sapiens
atgttacagttgagtaaattaa

SEQ ID NO: 7472911 - DNA, 22 bp, Homo sapiens
atgttacagttgagtaaattaa

SEQ ID NO: 7472912 - DNA, 22 bp, Homo sapiens
atgttacatagtccttatttgt

SEQ ID NO: 7472913 - DNA, 22 bp, Homo sapiens
atgttacatagtccttatttgt

SEQ ID NO: 7472914 - DNA, 22 bp, Homo sapiens
atgttacatagtccttatttgt

SEQ ID NO: 7472915 - DNA, 22 bp, Homo sapiens
atgtggctagtgcagatgaata

SEQ ID NO: 7472916 - DNA, 22 bp, Homo sapiens
atgtggctagtgcaactgagaa

SEQ ID NO: 7472917 - DNA, 22 bp, Homo sapiens
atgtggccttaatgacagcagc

SEQ ID NO: 7472918 - DNA, 22 bp, Homo sapiens
atgtggctagtggctatgatct

SEQ ID NO: 7472919 - DNA, 18 bp, Homo sapiens
atgtggctagtgctactg

SEQ ID NO: 7472920 - DNA, 22 bp, Homo sapiens
atgtggctagtggacacagtat

SEQ ID NO: 7472921 - DNA, 22 bp, Homo sapiens
atgtggctagtggacacagtat

SEQ ID NO: 7472922 - DNA, 22 bp, Homo sapiens
atgtggctcacatagctggaaa

SEQ ID NO: 7472923 - DNA, 22 bp, Homo sapiens
atgtggctcattgtttgcttac

SEQ ID NO: 7472924 - DNA, 21 bp, Homo sapiens
atgtggctcccttcctcagga

SEQ ID NO: 7472925 - DNA, 23 bp, Homo sapiens
atgttaaacataactgaagagcc

SEQ ID NO: 7472926 - DNA, 23 bp, Homo sapiens
atgttaaacataactgaagagcc

SEQ ID NO: 7472927 - DNA, 22 bp, Homo sapiens
atgtggctggtagttgacaact

SEQ ID NO: 7472928 - DNA, 22 bp, Homo sapiens
atgtggctgatcgcagagctct

SEQ ID NO: 7472929 - DNA, 22 bp, Homo sapiens
atgtggctgccacctgcctgaa

SEQ ID NO: 7472930 - DNA, 22 bp, Homo sapiens
atgtggctgccacctgcctgaa

SEQ ID NO: 7472931 - DNA, 22 bp, Homo sapiens
atgtggctgatcgcagagctct

SEQ ID NO: 7472932 - DNA, 22 bp, Homo sapiens
atgtggctccttactcatcagc

SEQ ID NO: 7472933 - DNA, 22 bp, Homo sapiens
atgtggctccttactcatcagc

SEQ ID NO: 7472934 - DNA, 21 bp, Homo sapiens
atgtggctcccttcctcagga

SEQ ID NO: 7472935 - DNA, 22 bp, Homo sapiens
atgtggctccttactcatcagc

SEQ ID NO: 7472936 - DNA, 22 bp, Homo sapiens
atgtcatctcttaaaaattgca

SEQ ID NO: 7472937 - DNA, 22 bp, Homo sapiens
atgtcatattactaatgctggc

SEQ ID NO: 7472938 - DNA, 22 bp, Homo sapiens
atgtgaggtagataggatgcag

SEQ ID NO: 7472939 - DNA, 22 bp, Homo sapiens
atgtgaggtagataggatgcag

SEQ ID NO: 7472940 - DNA, 22 bp, Homo sapiens
atgtgaggtagataggatgcag

SEQ ID NO: 7472941 - DNA, 22 bp, Homo sapiens
atgtcagtttcattttaagtca

SEQ ID NO: 7472942 - DNA, 22 bp, Homo sapiens
atgtcagtttcattttaagtca

SEQ ID NO: 7472943 - DNA, 22 bp, Homo sapiens
atgtcatattactaatgctggc

SEQ ID NO: 7472944 - DNA, 22 bp, Homo sapiens
atgtcatattactaatgctggc

SEQ ID NO: 7472945 - DNA, 22 bp, Homo sapiens
atgtcatattactaatgctggc

SEQ ID NO: 7472946 - DNA, 22 bp, Homo sapiens
atgtcatattactaatgctggc

SEQ ID NO: 7472947 - DNA, 21 bp, Homo sapiens
atgtcaggcacttatgaggaa

SEQ ID NO: 7472948 - DNA, 20 bp, Homo sapiens
atgtcaggaagggagtcagg

SEQ ID NO: 7472949 - DNA, 22 bp, Homo sapiens
atgtcagtctttctgtctcaga

SEQ ID NO: 7472950 - DNA, 20 bp, Homo sapiens
atgtcaggaagggagtcagg

SEQ ID NO: 7472951 - DNA, 20 bp, Homo sapiens
atgtcaggaagggagtcagg

SEQ ID NO: 7472952 - DNA, 21 bp, Homo sapiens
atgtcaggcacttatgaggaa

SEQ ID NO: 7472953 - DNA, 22 bp, Homo sapiens
atgtcaggaccctactgcattg

SEQ ID NO: 7472954 - DNA, 22 bp, Homo sapiens
atgtcataaatatactgttcct

SEQ ID NO: 7472955 - DNA, 22 bp, Homo sapiens
atgtgaggtatctaggtcttcg

SEQ ID NO: 7472956 - DNA, 22 bp, Homo sapiens
atgtgaggtatctaggtcttcg

SEQ ID NO: 7472957 - DNA, 22 bp, Homo sapiens
atgtgaggttaacctactgtta

SEQ ID NO: 7472958 - DNA, 22 bp, Homo sapiens
atgtgccatctactgtcccaag

SEQ ID NO: 7472959 - DNA, 22 bp, Homo sapiens
atgtgccagtgccaggtctcta

SEQ ID NO: 7472960 - DNA, 22 bp, Homo sapiens
atgtgccaacgtgcaggtttgt

SEQ ID NO: 7472961 - DNA, 22 bp, Homo sapiens
atgtgcgtgtgtacatatatat

SEQ ID NO: 7472962 - DNA, 22 bp, Homo sapiens
atgtgccttcatcctccctgtc

SEQ ID NO: 7472963 - DNA, 22 bp, Homo sapiens
atgtgcctgtgtttggagttaa

SEQ ID NO: 7472964 - DNA, 22 bp, Homo sapiens
atgtgccttcatcctccctgtc

SEQ ID NO: 7472965 - DNA, 22 bp, Homo sapiens
atgtgccctttctgctttgcag

SEQ ID NO: 7472966 - DNA, 22 bp, Homo sapiens
atgtgccctcttagagtctctg

SEQ ID NO: 7472967 - DNA, 22 bp, Homo sapiens
atgtgccctttctgctttgcag

SEQ ID NO: 7472968 - DNA, 22 bp, Homo sapiens
atgtgccctcttagagtctctg

SEQ ID NO: 7472969 - DNA, 22 bp, Homo sapiens
atgtcagattcctaaatatctt

SEQ ID NO: 7472970 - DNA, 22 bp, Homo sapiens
atgtcagattcctaaatatctt

SEQ ID NO: 7472971 - DNA, 22 bp, Homo sapiens
atgtcagatgtttatctgattt

SEQ ID NO: 7472972 - DNA, 22 bp, Homo sapiens
atgtcagatgtttatctgattt

SEQ ID NO: 7472973 - DNA, 22 bp, Homo sapiens
atgtcagatgtttatctgattt

SEQ ID NO: 7472974 - DNA, 22 bp, Homo sapiens
atgtcagatcctcagaaagtct

SEQ ID NO: 7472975 - DNA, 22 bp, Homo sapiens
atgtcagatcctcagaaagtct

SEQ ID NO: 7472976 - DNA, 22 bp, Homo sapiens
atgtcagatcctcagaaagtct

SEQ ID NO: 7472977 - DNA, 22 bp, Homo sapiens
atgtcagaatctacattctact

SEQ ID NO: 7472978 - DNA, 22 bp, Homo sapiens
atgtcagaatctacattctact

SEQ ID NO: 7472979 - DNA, 22 bp, Homo sapiens
atgtcagagcttccacaatagt

SEQ ID NO: 7472980 - DNA, 22 bp, Homo sapiens
atgtcagaagaacaatgagata

SEQ ID NO: 7472981 - DNA, 22 bp, Homo sapiens
atgtcagaagaacaatgagata

SEQ ID NO: 7472982 - DNA, 22 bp, Homo sapiens
atgtcacttttgagactaggtt

SEQ ID NO: 7472983 - DNA, 22 bp, Homo sapiens
atgtcagaatctacattctact

SEQ ID NO: 7472984 - DNA, 22 bp, Homo sapiens
atgtcagaagctggatgacagc

SEQ ID NO: 7472985 - DNA, 19 bp, Homo sapiens
atgtcactcatgttccctg

SEQ ID NO: 7472986 - DNA, 22 bp, Homo sapiens
gaggctgaacaggttctcatga

SEQ ID NO: 7472987 - DNA, 19 bp, Homo sapiens
atgtcactcatgttccctg

SEQ ID NO: 7472988 - DNA, 22 bp, Homo sapiens
atgtcactccagggacacaggt

SEQ ID NO: 7472989 - DNA, 22 bp, Homo sapiens
atgtcactccagggacacaggt

SEQ ID NO: 7472990 - DNA, 22 bp, Homo sapiens
atgtcactccagggacacaggt

SEQ ID NO: 7472991 - DNA, 22 bp, Homo sapiens
gaggctgaacaggttctcatga

SEQ ID NO: 7472992 - DNA, 22 bp, Homo sapiens
gaggctcttttctgctgtgtct

SEQ ID NO: 7472993 - DNA, 22 bp, Homo sapiens
gaggctcttttctgctgtgtct

SEQ ID NO: 7472994 - DNA, 22 bp, Homo sapiens
gaggctcttttctgctgtgtct

SEQ ID NO: 7472995 - DNA, 22 bp, Homo sapiens
gaggctcttttctgctgtgtct

SEQ ID NO: 7472996 - DNA, 22 bp, Homo sapiens
gaggctcttttctgctgtgtct

SEQ ID NO: 7472997 - DNA, 22 bp, Homo sapiens
gaggctcttttctgctgtgtct

SEQ ID NO: 7472998 - DNA, 22 bp, Homo sapiens
atgtcactgtttaccagctcca

SEQ ID NO: 7472999 - DNA, 22 bp, Homo sapiens
atgtcactgtttaccagctcca

SEQ ID NO: 7473000 - DNA, 22 bp, Homo sapiens
atgtcactgttgttattgttat

SEQ ID NO: 7473001 - DNA, 22 bp, Homo sapiens
atgtcactccagggacacaggt

SEQ ID NO: 7473002 - DNA, 22 bp, Homo sapiens
atgtcactgtgaggcagctgtc

SEQ ID NO: 7473003 - DNA, 22 bp, Homo sapiens
atgtcactgtgaggcagctgtc

SEQ ID NO: 7473004 - DNA, 22 bp, Homo sapiens
atgtcacttttctccctgctgg

SEQ ID NO: 7473005 - DNA, 22 bp, Homo sapiens
atgtcacttttctccctgctgg

SEQ ID NO: 7473006 - DNA, 22 bp, Homo sapiens
atgtcactgtgaggcagctgtc

SEQ ID NO: 7473007 - DNA, 22 bp, Homo sapiens
atgtcacttttctccctgctgg

SEQ ID NO: 7473008 - DNA, 22 bp, Homo sapiens
atgtcacttttgagactaggtt

SEQ ID NO: 7473009 - DNA, 22 bp, Homo sapiens
atgtcacttttctccctgctgg

SEQ ID NO: 7473010 - DNA, 22 bp, Homo sapiens
atgtgcttgaagcctcagagaa

SEQ ID NO: 7473011 - DNA, 22 bp, Homo sapiens
atgtgcttgaagcctcagagaa

SEQ ID NO: 7473012 - DNA, 22 bp, Homo sapiens
atgtgcttgaagcctcagagaa

SEQ ID NO: 7473013 - DNA, 22 bp, Homo sapiens
atgtgcttgactactctctatt

SEQ ID NO: 7473014 - DNA, 22 bp, Homo sapiens
atgtgcttgagggaaatcagtt

SEQ ID NO: 7473015 - DNA, 22 bp, Homo sapiens
atgtgcttgagggaaatcagtt

SEQ ID NO: 7473016 - DNA, 22 bp, Homo sapiens
atgtgcttggacattctaggaa

SEQ ID NO: 7473017 - DNA, 22 bp, Homo sapiens
atgtgcttggaaaagcagtggt

SEQ ID NO: 7473018 - DNA, 22 bp, Homo sapiens
atgtgcttggaaaagcagtggt

SEQ ID NO: 7473019 - DNA, 22 bp, Homo sapiens
atgtgcttggaaaagcagtggt

SEQ ID NO: 7473020 - DNA, 22 bp, Homo sapiens
atgtgcttgcagatgagcctca

SEQ ID NO: 7473021 - DNA, 22 bp, Homo sapiens
atgtgctttaaagaagccagct

SEQ ID NO: 7473022 - DNA, 22 bp, Homo sapiens
atgtgcttgtaatgttaaatgt

SEQ ID NO: 7473023 - DNA, 22 bp, Homo sapiens
atgtgcttgtaatgttaaatgt

SEQ ID NO: 7473024 - DNA, 22 bp, Homo sapiens
atgtgcttgtaatgttaaatgt

SEQ ID NO: 7473025 - DNA, 19 bp, Homo sapiens
atgtgcttgggccatgcta

SEQ ID NO: 7473026 - DNA, 19 bp, Homo sapiens
atgtgcttgggccatgcta

SEQ ID NO: 7473027 - DNA, 22 bp, Homo sapiens
atgtgcttggacattctaggaa

SEQ ID NO: 7473028 - DNA, 19 bp, Homo sapiens
atgtgcttgggccatgcta

SEQ ID NO: 7473029 - DNA, 22 bp, Homo sapiens
atgtgctttaggtttgtttaca

SEQ ID NO: 7473030 - DNA, 22 bp, Homo sapiens
atgtgctttaggtttgtttaca

SEQ ID NO: 7473031 - DNA, 22 bp, Homo sapiens
atgtgctttattaagtaaaaat

SEQ ID NO: 7473032 - DNA, 22 bp, Homo sapiens
atgtgctttattaagtaaaaat

SEQ ID NO: 7473033 - DNA, 22 bp, Homo sapiens
atgtgctttattaagtaaaaat

SEQ ID NO: 7473034 - DNA, 22 bp, Homo sapiens
atgtgcttcaggatgtcagtgt

SEQ ID NO: 7473035 - DNA, 22 bp, Homo sapiens
atgtgcttcaggatgtcagtgt

SEQ ID NO: 7473036 - DNA, 22 bp, Homo sapiens
atgtgcttcaggatgtcagtgt

SEQ ID NO: 7473037 - DNA, 22 bp, Homo sapiens
atgtgctgtaatccattgaagg

SEQ ID NO: 7473038 - DNA, 22 bp, Homo sapiens
atgtgcttatggtctctggttg

SEQ ID NO: 7473039 - DNA, 22 bp, Homo sapiens
atgtgcttatggtctctggttg

SEQ ID NO: 7473040 - DNA, 22 bp, Homo sapiens
atgtgcttcataatcttctcat

SEQ ID NO: 7473041 - DNA, 22 bp, Homo sapiens
atgtgcttcattctacatgaca

SEQ ID NO: 7473042 - DNA, 22 bp, Homo sapiens
atgtgcttcgccagggcgttgc

SEQ ID NO: 7473043 - DNA, 22 bp, Homo sapiens
atgtgcttcattctacatgaca

SEQ ID NO: 7473044 - DNA, 22 bp, Homo sapiens
atgtgcttcattctacatgaca

SEQ ID NO: 7473045 - DNA, 22 bp, Homo sapiens
atgtgctggctaactggatggg

SEQ ID NO: 7473046 - DNA, 20 bp, Homo sapiens
atgtgctgggcaatatgtta

SEQ ID NO: 7473047 - DNA, 22 bp, Homo sapiens
atgtgctggctaactggatggg

SEQ ID NO: 7473048 - DNA, 22 bp, Homo sapiens
atgtgctggctaactggatggg

SEQ ID NO: 7473049 - DNA, 22 bp, Homo sapiens
atgtgctgtaatccattgaagg

SEQ ID NO: 7473050 - DNA, 22 bp, Homo sapiens
atgtgctgagtgtgtatataca

SEQ ID NO: 7473051 - DNA, 22 bp, Homo sapiens
atgtgctgaaataaatgtggga

SEQ ID NO: 7473052 - DNA, 22 bp, Homo sapiens
atgtgctgagtgtgtatataca

SEQ ID NO: 7473053 - DNA, 22 bp, Homo sapiens
atgtgctgaaataaatgtggga

SEQ ID NO: 7473054 - DNA, 18 bp, Homo sapiens
atgtgctcatggggaaag

SEQ ID NO: 7473055 - DNA, 22 bp, Homo sapiens
atgtggcaccgatctttagcca

SEQ ID NO: 7473056 - DNA, 22 bp, Homo sapiens
atgtggcacagcacagtaagag

SEQ ID NO: 7473057 - DNA, 22 bp, Homo sapiens
atgtggcaatggttagcactgt

SEQ ID NO: 7473058 - DNA, 22 bp, Homo sapiens
atgtggcaatggttagcactgt

SEQ ID NO: 7473059 - DNA, 22 bp, Homo sapiens
atgtggcattcttggtcatttc

SEQ ID NO: 7473060 - DNA, 22 bp, Homo sapiens
atgtggcaccgatctttagcca

SEQ ID NO: 7473061 - DNA, 22 bp, Homo sapiens
atgtggcagtgggaggtgaatt

SEQ ID NO: 7473062 - DNA, 22 bp, Homo sapiens
atgtggcaccgatctttagcca

SEQ ID NO: 7473063 - DNA, 22 bp, Homo sapiens
atgtggcaccgatctttagcca

SEQ ID NO: 7473064 - DNA, 22 bp, Homo sapiens
atgtggcagtgggaggtgaatt

SEQ ID NO: 7473065 - DNA, 22 bp, Homo sapiens
atgtggcctagtatagaaatga

SEQ ID NO: 7473066 - DNA, 22 bp, Homo sapiens
atgtggcctagtatagaaatga

SEQ ID NO: 7473067 - DNA, 22 bp, Homo sapiens
atgtggcccagcggtcaggctg

SEQ ID NO: 7473068 - DNA, 22 bp, Homo sapiens
atgtggcccagcggtcaggctg

SEQ ID NO: 7473069 - DNA, 22 bp, Homo sapiens
atgtggcattcttggtcatttc

SEQ ID NO: 7473070 - DNA, 22 bp, Homo sapiens
atgtggcattcttggtcatttc

SEQ ID NO: 7473071 - DNA, 22 bp, Homo sapiens
atgtggccagtcatgtagtaac

SEQ ID NO: 7473072 - DNA, 22 bp, Homo sapiens
atgtggccagtcatgtagtaac

SEQ ID NO: 7473073 - DNA, 22 bp, Homo sapiens
atgtgctttccaatgctgtagg

SEQ ID NO: 7473074 - DNA, 22 bp, Homo sapiens
atgtgctttaggtttgtttaca

SEQ ID NO: 7473075 - DNA, 22 bp, Homo sapiens
atgtgctttctttccaaggggc

SEQ ID NO: 7473076 - DNA, 22 bp, Homo sapiens
atgtgctttctttgtttcataa

SEQ ID NO: 7473077 - DNA, 22 bp, Homo sapiens
atgtgctttctttgtttcataa

SEQ ID NO: 7473078 - DNA, 22 bp, Homo sapiens
atgtgctttctttgtttcataa

SEQ ID NO: 7473079 - DNA, 22 bp, Homo sapiens
atgtgctttctttccaaggggc

SEQ ID NO: 7473080 - DNA, 22 bp, Homo sapiens
atgtgctttgctggaaatgtca

SEQ ID NO: 7473081 - DNA, 22 bp, Homo sapiens
atgtggaatgaacaaaggaggc

SEQ ID NO: 7473082 - DNA, 22 bp, Homo sapiens
atgtgctttgctggaaatgtca

SEQ ID NO: 7473083 - DNA, 22 bp, Homo sapiens
atgtggagaggaagtgcaaact

SEQ ID NO: 7473084 - DNA, 22 bp, Homo sapiens
atgtggaggaaatgagtgtaca

SEQ ID NO: 7473085 - DNA, 20 bp, Homo sapiens
atgtggataagggcagaatc

SEQ ID NO: 7473086 - DNA, 22 bp, Homo sapiens
atgtggatctgttattctagat

SEQ ID NO: 7473087 - DNA, 22 bp, Homo sapiens
atgtggatttgggagtgatcag

SEQ ID NO: 7473088 - DNA, 22 bp, Homo sapiens
atgtggatgtttatatgaagaa

SEQ ID NO: 7473089 - DNA, 22 bp, Homo sapiens
gaggcctgggttggaggtgcat

SEQ ID NO: 7473090 - DNA, 22 bp, Homo sapiens
gaggcctgggttggaggtgcat

SEQ ID NO: 7473091 - DNA, 22 bp, Homo sapiens
atgtatttctatgtagtgaaga

SEQ ID NO: 7473092 - DNA, 22 bp, Homo sapiens
atgtatttctatgtagtgaaga

SEQ ID NO: 7473093 - DNA, 22 bp, Homo sapiens
atgtatttctatgtagtgaaga

SEQ ID NO: 7473094 - DNA, 22 bp, Homo sapiens
atgtatttctatgtagtgaaga

SEQ ID NO: 7473095 - DNA, 22 bp, Homo sapiens
atgtatttctatgtagtgaaga

SEQ ID NO: 7473096 - DNA, 22 bp, Homo sapiens
gaggctccagcgacacctaggc

SEQ ID NO: 7473097 - DNA, 22 bp, Homo sapiens
gaggctccagcgacacctaggc

SEQ ID NO: 7473098 - DNA, 22 bp, Homo sapiens
gaggctccatggaggagtatgg

SEQ ID NO: 7473099 - DNA, 22 bp, Homo sapiens
gaggcctgggttggaggtgcat

SEQ ID NO: 7473100 - DNA, 22 bp, Homo sapiens
gaggcctgggttggaggtgcat

SEQ ID NO: 7473101 - DNA, 22 bp, Homo sapiens
gaggcctgggttggaggtgcat

SEQ ID NO: 7473102 - DNA, 22 bp, Homo sapiens
gaggcctgggttggaggtgcat

SEQ ID NO: 7473103 - DNA, 22 bp, Homo sapiens
gaggcctgggttggaggtgcat

SEQ ID NO: 7473104 - DNA, 22 bp, Homo sapiens
atgtatttctatgtagtgaaga

SEQ ID NO: 7473105 - DNA, 22 bp, Homo sapiens
atgtatttctatgtagtgaaga

SEQ ID NO: 7473106 - DNA, 22 bp, Homo sapiens
atgtatttctatgtagtgaaga

SEQ ID NO: 7473107 - DNA, 22 bp, Homo sapiens
atgtatttctatgtagtgaaga

SEQ ID NO: 7473108 - DNA, 22 bp, Homo sapiens
atgtatttactgagaaggaaac

SEQ ID NO: 7473109 - DNA, 22 bp, Homo sapiens
atgtatttactgagaaggaaac

SEQ ID NO: 7473110 - DNA, 22 bp, Homo sapiens
atgtatttactgagaaggaaac

SEQ ID NO: 7473111 - DNA, 22 bp, Homo sapiens
atgtatttactgagaaggaaac

SEQ ID NO: 7473112 - DNA, 22 bp, Homo sapiens
atgtatttactgagaaggaaac

SEQ ID NO: 7473113 - DNA, 23 bp, Homo sapiens
atgtatttaaatttcagtgatga

SEQ ID NO: 7473114 - DNA, 23 bp, Homo sapiens
atgtatttaaatttcagtgatga

SEQ ID NO: 7473115 - DNA, 23 bp, Homo sapiens
atgtatttaaatttcagtgatga

SEQ ID NO: 7473116 - DNA, 23 bp, Homo sapiens
atgtatttaaatttcagtgatga

SEQ ID NO: 7473117 - DNA, 23 bp, Homo sapiens
atgtatttaaatttcagtgatga

SEQ ID NO: 7473118 - DNA, 23 bp, Homo sapiens
atgtatttaaatttcagtgatga

SEQ ID NO: 7473119 - DNA, 23 bp, Homo sapiens
atgtatttaaatttcagtgatga

SEQ ID NO: 7473120 - DNA, 23 bp, Homo sapiens
atgtatttaaatttcagtgatga

SEQ ID NO: 7473121 - DNA, 22 bp, Homo sapiens
atgtattgaccatactactaaa

SEQ ID NO: 7473122 - DNA, 22 bp, Homo sapiens
atgtattgtctcttttccttaa

SEQ ID NO: 7473123 - DNA, 23 bp, Homo sapiens
atgtatttaaatttcagtgatga

SEQ ID NO: 7473124 - DNA, 23 bp, Homo sapiens
atgtatttaaatttcagtgatga

SEQ ID NO: 7473125 - DNA, 22 bp, Homo sapiens
gaggctccccatgaggccccag

SEQ ID NO: 7473126 - DNA, 22 bp, Homo sapiens
gaggctccccatgaggccccag

SEQ ID NO: 7473127 - DNA, 22 bp, Homo sapiens
gaggctcccaaggggctaggcc

SEQ ID NO: 7473128 - DNA, 22 bp, Homo sapiens
gaggctcccaaggggctaggcc

SEQ ID NO: 7473129 - DNA, 22 bp, Homo sapiens
gaggctccctcaactctgggtg

SEQ ID NO: 7473130 - DNA, 22 bp, Homo sapiens
gaggctccctcaactctgggtg

SEQ ID NO: 7473131 - DNA, 22 bp, Homo sapiens
gaggctccctcaactctgggtg

SEQ ID NO: 7473132 - DNA, 22 bp, Homo sapiens
gaggctccgtgctgctgccctg

SEQ ID NO: 7473133 - DNA, 22 bp, Homo sapiens
gaggctccgtgctgctgccctg

SEQ ID NO: 7473134 - DNA, 22 bp, Homo sapiens
gaggctccgtgctgctgccctg

SEQ ID NO: 7473135 - DNA, 22 bp, Homo sapiens
gaggctcctcattcagtatgct

SEQ ID NO: 7473136 - DNA, 22 bp, Homo sapiens
gaggctccctttaggtccagat

SEQ ID NO: 7473137 - DNA, 22 bp, Homo sapiens
gaggctccctttaggtccagat

SEQ ID NO: 7473138 - DNA, 22 bp, Homo sapiens
gaggctccctttaggtccagat

SEQ ID NO: 7473139 - DNA, 22 bp, Homo sapiens
gaggctcctcattcagtatgct

SEQ ID NO: 7473140 - DNA, 22 bp, Homo sapiens
gaggctccttgaaagggggact

SEQ ID NO: 7473141 - DNA, 22 bp, Homo sapiens
gaggctctggagtaggtacaca

SEQ ID NO: 7473142 - DNA, 20 bp, Homo sapiens
gaggctctgggcatggcgcc

SEQ ID NO: 7473143 - DNA, 22 bp, Homo sapiens
gaggctcttcaataggtcaatg

SEQ ID NO: 7473144 - DNA, 22 bp, Homo sapiens
gaggctcttcaataggtcaatg

SEQ ID NO: 7473145 - DNA, 22 bp, Homo sapiens
gaggctctttaaatcttttgga

SEQ ID NO: 7473146 - DNA, 22 bp, Homo sapiens
gaggctctttctttggacttca

SEQ ID NO: 7473147 - DNA, 22 bp, Homo sapiens
gaggctctttctttggacttca

SEQ ID NO: 7473148 - DNA, 20 bp, Homo sapiens
gaggctctgggcatggcgcc

SEQ ID NO: 7473149 - DNA, 20 bp, Homo sapiens
gaggctctgggcatggcgcc

SEQ ID NO: 7473150 - DNA, 22 bp, Homo sapiens
gaggctctgtgatgtgccaggc

SEQ ID NO: 7473151 - DNA, 22 bp, Homo sapiens
gaggctctgtgatgtgccaggc

SEQ ID NO: 7473152 - DNA, 22 bp, Homo sapiens
gaggctctgtgatgtgccaggc

SEQ ID NO: 7473153 - DNA, 22 bp, Homo sapiens
atgtatgtataacacccagcta

SEQ ID NO: 7473154 - DNA, 22 bp, Homo sapiens
atgtatgtataacacccagcta

SEQ ID NO: 7473155 - DNA, 22 bp, Homo sapiens
atgtatgtatacaccccacata

SEQ ID NO: 7473156 - DNA, 22 bp, Homo sapiens
atgtatgtatacaccccacata

SEQ ID NO: 7473157 - DNA, 22 bp, Homo sapiens
atgtatgtagtgtacatataca

SEQ ID NO: 7473158 - DNA, 22 bp, Homo sapiens
atgtatgtagtgtacatataca

SEQ ID NO: 7473159 - DNA, 22 bp, Homo sapiens
atgtatgtagtgtacatataca

SEQ ID NO: 7473160 - DNA, 22 bp, Homo sapiens
atgtatgtatgtacttttgtat

SEQ ID NO: 7473161 - DNA, 22 bp, Homo sapiens
atgtatgtatgtacttttgtat

SEQ ID NO: 7473162 - DNA, 22 bp, Homo sapiens
atgtatgtctaaaacggggagg

SEQ ID NO: 7473163 - DNA, 22 bp, Homo sapiens
atgtatgtctaaaacggggagg

SEQ ID NO: 7473164 - DNA, 22 bp, Homo sapiens
atgtatgtatgctgtgcttgca

SEQ ID NO: 7473165 - DNA, 22 bp, Homo sapiens
atgtatgtatgctgtgcttgca

SEQ ID NO: 7473166 - DNA, 18 bp, Homo sapiens
atgtatgtacatatttat

SEQ ID NO: 7473167 - DNA, 18 bp, Homo sapiens
atgtatgtacatatttat

SEQ ID NO: 7473168 - DNA, 22 bp, Homo sapiens
atgtatgtaaatttcagtcctt

SEQ ID NO: 7473169 - DNA, 18 bp, Homo sapiens
atgtatgtacatatttat

SEQ ID NO: 7473170 - DNA, 22 bp, Homo sapiens
atgtatgtaggatgggccagtg

SEQ ID NO: 7473171 - DNA, 18 bp, Homo sapiens
atgtatgtacatatttat

SEQ ID NO: 7473172 - DNA, 22 bp, Homo sapiens
atgtatgtagtgtacatataca

SEQ ID NO: 7473173 - DNA, 22 bp, Homo sapiens
atgtatgtagtgtacatataca

SEQ ID NO: 7473174 - DNA, 22 bp, Homo sapiens
atgtatgtagtgtacatataca

SEQ ID NO: 7473175 - DNA, 22 bp, Homo sapiens
atgtatgtagtgtacatataca

SEQ ID NO: 7473176 - DNA, 22 bp, Homo sapiens
atgtatgtaaatttcagtcctt

SEQ ID NO: 7473177 - DNA, 22 bp, Homo sapiens
atgtatgctttgattttagatg

SEQ ID NO: 7473178 - DNA, 22 bp, Homo sapiens
atgtatggaaagaagtggatgg

SEQ ID NO: 7473179 - DNA, 22 bp, Homo sapiens
atgtatcagataaagcatgtgg

SEQ ID NO: 7473180 - DNA, 22 bp, Homo sapiens
atgtatggggtgtatgggatca

SEQ ID NO: 7473181 - DNA, 20 bp, Homo sapiens
atgtatgcaaatgtcttcca

SEQ ID NO: 7473182 - DNA, 22 bp, Homo sapiens
atgtatgcatagtgagtaaatg

SEQ ID NO: 7473183 - DNA, 22 bp, Homo sapiens
atgtatgcatgctacagttttc

SEQ ID NO: 7473184 - DNA, 22 bp, Homo sapiens
atgtatgcatgtatgtatcgct

SEQ ID NO: 7473185 - DNA, 22 bp, Homo sapiens
atgtatcagaaatagcattggc

SEQ ID NO: 7473186 - DNA, 22 bp, Homo sapiens
atgtatcagataaagcatgtgg

SEQ ID NO: 7473187 - DNA, 22 bp, Homo sapiens
atgtatcagaaatagcattggc

SEQ ID NO: 7473188 - DNA, 22 bp, Homo sapiens
atgtatcacagcaatgtagtca

SEQ ID NO: 7473189 - DNA, 22 bp, Homo sapiens
atgtatcacagcaatgtagtca

SEQ ID NO: 7473190 - DNA, 22 bp, Homo sapiens
atgtatcaattatctgtctgca

SEQ ID NO: 7473191 - DNA, 22 bp, Homo sapiens
atgtatcacagcaatgtagtca

SEQ ID NO: 7473192 - DNA, 22 bp, Homo sapiens
atgtatcacagcaatgtagtca

SEQ ID NO: 7473193 - DNA, 22 bp, Homo sapiens
atgtatcacagcaatgtagtca

SEQ ID NO: 7473194 - DNA, 22 bp, Homo sapiens
atgtatcacagcaatgtagtca

SEQ ID NO: 7473195 - DNA, 22 bp, Homo sapiens
atgtatcacagcaatgtagtca

SEQ ID NO: 7473196 - DNA, 22 bp, Homo sapiens
atgtatcatgcagggtccatga

SEQ ID NO: 7473197 - DNA, 22 bp, Homo sapiens
atgtatcagataaagcatgtgg

SEQ ID NO: 7473198 - DNA, 22 bp, Homo sapiens
atgtatccttatacacatttat

SEQ ID NO: 7473199 - DNA, 22 bp, Homo sapiens
atgtatcagataaagcatgtgg

SEQ ID NO: 7473200 - DNA, 22 bp, Homo sapiens
atgtatcagaaatagcattggc

SEQ ID NO: 7473201 - DNA, 22 bp, Homo sapiens
atgtatcagataaagcatgtgg

SEQ ID NO: 7473202 - DNA, 23 bp, Homo sapiens
atgtatctcatccaaggaagctc

SEQ ID NO: 7473203 - DNA, 23 bp, Homo sapiens
atgtatctcatccaaggaagctc

SEQ ID NO: 7473204 - DNA, 22 bp, Homo sapiens
atgtattcaagccacatacatt

SEQ ID NO: 7473205 - DNA, 22 bp, Homo sapiens
atgtattcaagccacatacatt

SEQ ID NO: 7473206 - DNA, 22 bp, Homo sapiens
atgtattcaagccacatacatt

SEQ ID NO: 7473207 - DNA, 22 bp, Homo sapiens
atgtattcaagccacatacatt

SEQ ID NO: 7473208 - DNA, 22 bp, Homo sapiens
atgtattcaagccacatacatt

SEQ ID NO: 7473209 - DNA, 22 bp, Homo sapiens
atgtattatggttttccttaag

SEQ ID NO: 7473210 - DNA, 22 bp, Homo sapiens
atgtatgttttcagttgtatta

SEQ ID NO: 7473211 - DNA, 22 bp, Homo sapiens
atgtatgtttttgcagatacat

SEQ ID NO: 7473212 - DNA, 22 bp, Homo sapiens
atgtatgttttcagttgtatta

SEQ ID NO: 7473213 - DNA, 22 bp, Homo sapiens
atgtatgtttttgcagatacat

SEQ ID NO: 7473214 - DNA, 22 bp, Homo sapiens
atgtatgttttcagttgtatta

SEQ ID NO: 7473215 - DNA, 23 bp, Homo sapiens
atgtatgtttctgcatcttcaac

SEQ ID NO: 7473216 - DNA, 23 bp, Homo sapiens
atgtatgtttctgcatcttcaac

SEQ ID NO: 7473217 - DNA, 23 bp, Homo sapiens
atgtatgtttctgcatcttcaac

SEQ ID NO: 7473218 - DNA, 22 bp, Homo sapiens
atgtatgtttctatatatgaca

SEQ ID NO: 7473219 - DNA, 22 bp, Homo sapiens
atgtatgtttctatatatgaca

SEQ ID NO: 7473220 - DNA, 22 bp, Homo sapiens
atgtatgtttctatatatgaca

SEQ ID NO: 7473221 - DNA, 22 bp, Homo sapiens
atgtatgtttctatatatgaca

SEQ ID NO: 7473222 - DNA, 22 bp, Homo sapiens
atgtatgttcaagcaatgatta

SEQ ID NO: 7473223 - DNA, 22 bp, Homo sapiens
atgtatgttcaagcaatgatta

SEQ ID NO: 7473224 - DNA, 22 bp, Homo sapiens
atgtatgtttcatatcttcatt

SEQ ID NO: 7473225 - DNA, 22 bp, Homo sapiens
atgtatgtttcatatcttcatt

SEQ ID NO: 7473226 - DNA, 22 bp, Homo sapiens
atgtatgtttcatatcttcatt

SEQ ID NO: 7473227 - DNA, 22 bp, Homo sapiens
atgtatgttagtgtattatcta

SEQ ID NO: 7473228 - DNA, 22 bp, Homo sapiens
atgtatgttcaagcaatgatta

SEQ ID NO: 7473229 - DNA, 22 bp, Homo sapiens
atgtatgttcaagcaatgatta

SEQ ID NO: 7473230 - DNA, 22 bp, Homo sapiens
atgtatgttcaagcaatgatta

SEQ ID NO: 7473231 - DNA, 22 bp, Homo sapiens
atgtatgttagtgtattatcta

SEQ ID NO: 7473232 - DNA, 22 bp, Homo sapiens
atgtatgttagtgtattatcta

SEQ ID NO: 7473233 - DNA, 22 bp, Homo sapiens
atgtatgttagtgtattatcta

SEQ ID NO: 7473234 - DNA, 22 bp, Homo sapiens
atgtatgttagacaagcctaca

SEQ ID NO: 7473235 - DNA, 22 bp, Homo sapiens
atgtatgttagtgtattatcta

SEQ ID NO: 7473236 - DNA, 22 bp, Homo sapiens
atgtatgttagtgtattatcta

SEQ ID NO: 7473237 - DNA, 22 bp, Homo sapiens
atgtatgttagtgtattatcta

SEQ ID NO: 7473238 - DNA, 22 bp, Homo sapiens
atgtatgttagacaagcctaca

SEQ ID NO: 7473239 - DNA, 22 bp, Homo sapiens
atgtatgtgttgcaattatgtt

SEQ ID NO: 7473240 - DNA, 22 bp, Homo sapiens
atgtatgtgttgcaattatgtt

SEQ ID NO: 7473241 - DNA, 22 bp, Homo sapiens
atgtatgtgttgcaattatgtt

SEQ ID NO: 7473242 - DNA, 22 bp, Homo sapiens
atgtatgtgtgcaggcatgcgt

SEQ ID NO: 7473243 - DNA, 22 bp, Homo sapiens
atgtatgtgcacgcatgtacat

SEQ ID NO: 7473244 - DNA, 22 bp, Homo sapiens
atgtatgtctgatgcacatgca

SEQ ID NO: 7473245 - DNA, 22 bp, Homo sapiens
atgtatgtctgatgcacatgca

SEQ ID NO: 7473246 - DNA, 22 bp, Homo sapiens
atgtatgtctgatgcacatgca

SEQ ID NO: 7473247 - DNA, 22 bp, Homo sapiens
atgtatgtctgcatacacatac

SEQ ID NO: 7473248 - DNA, 22 bp, Homo sapiens
atgtatgtctgcatacacatac

SEQ ID NO: 7473249 - DNA, 22 bp, Homo sapiens
atgtatgtctgcatacacatac

SEQ ID NO: 7473250 - DNA, 22 bp, Homo sapiens
atgtatgtgcacgcatgtacat

SEQ ID NO: 7473251 - DNA, 22 bp, Homo sapiens
atgtatgtgagctttgagatca

SEQ ID NO: 7473252 - DNA, 22 bp, Homo sapiens
atgtatgtgagctttgagatca

SEQ ID NO: 7473253 - DNA, 22 bp, Homo sapiens
atgtatgtctgcatacacatac

SEQ ID NO: 7473254 - DNA, 22 bp, Homo sapiens
atgtatgtctgcatacacatac

SEQ ID NO: 7473255 - DNA, 22 bp, Homo sapiens
atgtatgtctgcatacacatac

SEQ ID NO: 7473256 - DNA, 22 bp, Homo sapiens
atgtatgtctgcatacacatac

SEQ ID NO: 7473257 - DNA, 22 bp, Homo sapiens
gaggagctgtcaccgtgactca

SEQ ID NO: 7473258 - DNA, 22 bp, Homo sapiens
gaggagctgtcaccgtgactca

SEQ ID NO: 7473259 - DNA, 22 bp, Homo sapiens
gaggagctgtcaccgtgactca

SEQ ID NO: 7473260 - DNA, 22 bp, Homo sapiens
gaggagggagctggaagctctt

SEQ ID NO: 7473261 - DNA, 22 bp, Homo sapiens
gaggagggagctggaagctctt

SEQ ID NO: 7473262 - DNA, 22 bp, Homo sapiens
gaggagggagctggaagctctt

SEQ ID NO: 7473263 - DNA, 22 bp, Homo sapiens
gaggagggagctggaagctctt

SEQ ID NO: 7473264 - DNA, 22 bp, Homo sapiens
gaggagggagctggaagctctt

SEQ ID NO: 7473265 - DNA, 22 bp, Homo sapiens
gaggagggcagttcctctttta

SEQ ID NO: 7473266 - DNA, 22 bp, Homo sapiens
gaggagggcagttcctctttta

SEQ ID NO: 7473267 - DNA, 22 bp, Homo sapiens
gaggagggcagttcctctttta

SEQ ID NO: 7473268 - DNA, 22 bp, Homo sapiens
gaggagggcagttcctctttta

SEQ ID NO: 7473269 - DNA, 22 bp, Homo sapiens
gaggagggcagttcctctttta

SEQ ID NO: 7473270 - DNA, 22 bp, Homo sapiens
gaggagggagctggaagctctt

SEQ ID NO: 7473271 - DNA, 22 bp, Homo sapiens
gaggagggcctggtgtcccttc

SEQ ID NO: 7473272 - DNA, 22 bp, Homo sapiens
gaggagggcctggtgtcccttc

SEQ ID NO: 7473273 - DNA, 22 bp, Homo sapiens
gaggagggcctggtgtcccttc

SEQ ID NO: 7473274 - DNA, 22 bp, Homo sapiens
gaggagggcctggtgtcccttc

SEQ ID NO: 7473275 - DNA, 22 bp, Homo sapiens
gaggagggcctggtgtcccttc

SEQ ID NO: 7473276 - DNA, 22 bp, Homo sapiens
gaggagggcctggtgtcccttc

SEQ ID NO: 7473277 - DNA, 22 bp, Homo sapiens
gaggagggcctggtgtcccttc

SEQ ID NO: 7473278 - DNA, 22 bp, Homo sapiens
gaggagggcctggtgtcccttc

SEQ ID NO: 7473279 - DNA, 22 bp, Homo sapiens
gaggagggctttgttgatgtta

SEQ ID NO: 7473280 - DNA, 22 bp, Homo sapiens
gaggagggctttgttgatgtta

SEQ ID NO: 7473281 - DNA, 22 bp, Homo sapiens
gaggagggctttgttgatgtta

SEQ ID NO: 7473282 - DNA, 22 bp, Homo sapiens
gaggagggctttgttgatgtta

SEQ ID NO: 7473283 - DNA, 22 bp, Homo sapiens
gaggagggctttgttgatgtta

SEQ ID NO: 7473284 - DNA, 22 bp, Homo sapiens
gaggaggggacagtacttgtgc

SEQ ID NO: 7473285 - DNA, 22 bp, Homo sapiens
gaggaggggacagtacttgtgc

SEQ ID NO: 7473286 - DNA, 22 bp, Homo sapiens
gaggagggctttgttgatgtta

SEQ ID NO: 7473287 - DNA, 22 bp, Homo sapiens
gaggaggggacagtacttgtgc

SEQ ID NO: 7473288 - DNA, 22 bp, Homo sapiens
atgggcagctgcagcagtggtg

SEQ ID NO: 7473289 - DNA, 22 bp, Homo sapiens
atgggcagctgcagcagtggtg

SEQ ID NO: 7473290 - DNA, 22 bp, Homo sapiens
atgggcagcagctgtcattttc

SEQ ID NO: 7473291 - DNA, 22 bp, Homo sapiens
atgggcagcagctgtcattttc

SEQ ID NO: 7473292 - DNA, 22 bp, Homo sapiens
atgggcagcagctgtcattttc

SEQ ID NO: 7473293 - DNA, 22 bp, Homo sapiens
atgggcagctgcagcagtggtg

SEQ ID NO: 7473294 - DNA, 22 bp, Homo sapiens
atgggcagctgcagcagtggtg

SEQ ID NO: 7473295 - DNA, 22 bp, Homo sapiens
atgggcagctgcagcagtggtg

SEQ ID NO: 7473296 - DNA, 22 bp, Homo sapiens
atgggcagctgcagcagtggtg

SEQ ID NO: 7473297 - DNA, 22 bp, Homo sapiens
atgggcagctgcagcagtggtg

SEQ ID NO: 7473298 - DNA, 22 bp, Homo sapiens
atgggcagctgcagcagtggtg

SEQ ID NO: 7473299 - DNA, 22 bp, Homo sapiens
atgggcagcagctgccattcat

SEQ ID NO: 7473300 - DNA, 22 bp, Homo sapiens
atgggcagagtggggacaggaa

SEQ ID NO: 7473301 - DNA, 22 bp, Homo sapiens
atgggcagcagctgccattcat

SEQ ID NO: 7473302 - DNA, 22 bp, Homo sapiens
atgggcagcagctgccattcat

SEQ ID NO: 7473303 - DNA, 22 bp, Homo sapiens
atgggcagagtggggacaggaa

SEQ ID NO: 7473304 - DNA, 22 bp, Homo sapiens
atgggcagagtggggacaggaa

SEQ ID NO: 7473305 - DNA, 22 bp, Homo sapiens
atgggcagagtggggacaggaa

SEQ ID NO: 7473306 - DNA, 22 bp, Homo sapiens
atgggcagagtggggacaggaa

SEQ ID NO: 7473307 - DNA, 22 bp, Homo sapiens
atgggcagagtggggacaggaa

SEQ ID NO: 7473308 - DNA, 22 bp, Homo sapiens
atgggcaggcaaggtggcgagt

SEQ ID NO: 7473309 - DNA, 22 bp, Homo sapiens
atgggcaggcaaggtggcgagt

SEQ ID NO: 7473310 - DNA, 22 bp, Homo sapiens
atgggcaggcaaggtggcgagt

SEQ ID NO: 7473311 - DNA, 22 bp, Homo sapiens
atgggcagctgcagcagtggtg

SEQ ID NO: 7473312 - DNA, 22 bp, Homo sapiens
atgggcaggcaaggtggcgagt

SEQ ID NO: 7473313 - DNA, 22 bp, Homo sapiens
atgggcagctgcagcagtggtg

SEQ ID NO: 7473314 - DNA, 22 bp, Homo sapiens
atgggcagctgcagcagtggtg

SEQ ID NO: 7473315 - DNA, 22 bp, Homo sapiens
atgggcagctgcagcagtggtg

SEQ ID NO: 7473316 - DNA, 22 bp, Homo sapiens
atgggcaggcactggctctcag

SEQ ID NO: 7473317 - DNA, 22 bp, Homo sapiens
atgggcaggcactggctctcag

SEQ ID NO: 7473318 - DNA, 22 bp, Homo sapiens
atgggcaggcactggctctcag

SEQ ID NO: 7473319 - DNA, 22 bp, Homo sapiens
atgggcaggcactggctctcag

SEQ ID NO: 7473320 - DNA, 22 bp, Homo sapiens
gaggagctgggtcagggagaca

SEQ ID NO: 7473321 - DNA, 22 bp, Homo sapiens
atgggcaggcctctcatttctg

SEQ ID NO: 7473322 - DNA, 22 bp, Homo sapiens
atgggcaggcctctcatttctg

SEQ ID NO: 7473323 - DNA, 22 bp, Homo sapiens
gaggcacagtcccgaggcaagg

SEQ ID NO: 7473324 - DNA, 22 bp, Homo sapiens
gaggcacagtcccgaggcaagg

SEQ ID NO: 7473325 - DNA, 22 bp, Homo sapiens
gaggcacagtcccgaggcaagg

SEQ ID NO: 7473326 - DNA, 22 bp, Homo sapiens
gaggcacagtcccgaggcaagg

SEQ ID NO: 7473327 - DNA, 22 bp, Homo sapiens
gaggcacagtcccgaggcaagg

SEQ ID NO: 7473328 - DNA, 22 bp, Homo sapiens
gaggcacagtcccgaggcaagg

SEQ ID NO: 7473329 - DNA, 22 bp, Homo sapiens
gaggcacagtgtttggtcagtg

SEQ ID NO: 7473330 - DNA, 22 bp, Homo sapiens
gaggcacagtgtttggtcagtg

SEQ ID NO: 7473331 - DNA, 22 bp, Homo sapiens
gaggcacagtgtttggtcagtg

SEQ ID NO: 7473332 - DNA, 18 bp, Homo sapiens
gaggcacatagttggggc

SEQ ID NO: 7473333 - DNA, 22 bp, Homo sapiens
gaggcacagttcttcctccaga

SEQ ID NO: 7473334 - DNA, 22 bp, Homo sapiens
gaggcacagttcttcctccaga

SEQ ID NO: 7473335 - DNA, 18 bp, Homo sapiens
gaggcacatagttggggc

SEQ ID NO: 7473336 - DNA, 18 bp, Homo sapiens
gaggcacatagttggggc

SEQ ID NO: 7473337 - DNA, 18 bp, Homo sapiens
gaggcacatagttggggc

SEQ ID NO: 7473338 - DNA, 22 bp, Homo sapiens
gaggcacagtgtttggtcagtg

SEQ ID NO: 7473339 - DNA, 22 bp, Homo sapiens
gaggcacagtgtttggtcagtg

SEQ ID NO: 7473340 - DNA, 22 bp, Homo sapiens
gaggcacagtgtttggtcagtg

SEQ ID NO: 7473341 - DNA, 22 bp, Homo sapiens
atgtatcaactgcaggcaagtt

SEQ ID NO: 7473342 - DNA, 22 bp, Homo sapiens
atgtatcaacaaattgtacagt

SEQ ID NO: 7473343 - DNA, 22 bp, Homo sapiens
atgtatcaagggaaagagagta

SEQ ID NO: 7473344 - DNA, 22 bp, Homo sapiens
atgtatcaattatctgtctgca

SEQ ID NO: 7473345 - DNA, 22 bp, Homo sapiens
atgtatcaactgcaggcaagtt

SEQ ID NO: 7473346 - DNA, 22 bp, Homo sapiens
atgtatcaactgcaggcaagtt

SEQ ID NO: 7473347 - DNA, 22 bp, Homo sapiens
atgtagcttgtcccacatcata

SEQ ID NO: 7473348 - DNA, 22 bp, Homo sapiens
atgtagcttcctaggagtgatt

SEQ ID NO: 7473349 - DNA, 22 bp, Homo sapiens
atgtatcaacaaattgtacagt

SEQ ID NO: 7473350 - DNA, 20 bp, Homo sapiens
atgtatattactggctgtga

SEQ ID NO: 7473351 - DNA, 22 bp, Homo sapiens
gaggcacatatatacagagccc

SEQ ID NO: 7473352 - DNA, 22 bp, Homo sapiens
gaggcacatatatacagagccc

SEQ ID NO: 7473353 - DNA, 22 bp, Homo sapiens
gaggcacatatatacagagccc

SEQ ID NO: 7473354 - DNA, 22 bp, Homo sapiens
gaggcacatatatacagagccc

SEQ ID NO: 7473355 - DNA, 22 bp, Homo sapiens
gaggcacatatatacagagccc

SEQ ID NO: 7473356 - DNA, 21 bp, Homo sapiens
atgtagcttacaagataaagg

SEQ ID NO: 7473357 - DNA, 22 bp, Homo sapiens
atgtagctggggaggttgagtc

SEQ ID NO: 7473358 - DNA, 22 bp, Homo sapiens
gaggcacatatatacagagccc

SEQ ID NO: 7473359 - DNA, 22 bp, Homo sapiens
gaggcacatatatacagagccc

SEQ ID NO: 7473360 - DNA, 22 bp, Homo sapiens
gaggcacaatacatgtctcaag

SEQ ID NO: 7473361 - DNA, 23 bp, Homo sapiens
gaggagggtcgtgctgtgttcct

SEQ ID NO: 7473362 - DNA, 23 bp, Homo sapiens
gaggagggtcgtgctgtgttcct

SEQ ID NO: 7473363 - DNA, 23 bp, Homo sapiens
gaggagggtcgtgctgtgttcct

SEQ ID NO: 7473364 - DNA, 23 bp, Homo sapiens
gaggagggtcgtgctgtgttcct

SEQ ID NO: 7473365 - DNA, 23 bp, Homo sapiens
gaggagggtcgtgctgtgttcct

SEQ ID NO: 7473366 - DNA, 23 bp, Homo sapiens
gaggagggtcgtgctgtgttcct

SEQ ID NO: 7473367 - DNA, 22 bp, Homo sapiens
gaggaggggcacttgtctccta

SEQ ID NO: 7473368 - DNA, 22 bp, Homo sapiens
gaggaggggcacttgtctccta

SEQ ID NO: 7473369 - DNA, 22 bp, Homo sapiens
gaggaggggcacttgtctccta

SEQ ID NO: 7473370 - DNA, 22 bp, Homo sapiens
gaggaggggcacttgtctccta

SEQ ID NO: 7473371 - DNA, 22 bp, Homo sapiens
gaggaggggcacttgtctccta

SEQ ID NO: 7473372 - DNA, 22 bp, Homo sapiens
gaggaggggcacttgtctccta

SEQ ID NO: 7473373 - DNA, 22 bp, Homo sapiens
gaggaggggcacttgtctccta

SEQ ID NO: 7473374 - DNA, 22 bp, Homo sapiens
gaggaggggacagtacttgtgc

SEQ ID NO: 7473375 - DNA, 22 bp, Homo sapiens
gaggaggggacagtacttgtgc

SEQ ID NO: 7473376 - DNA, 22 bp, Homo sapiens
gaggaggggcacttgtctccta

SEQ ID NO: 7473377 - DNA, 22 bp, Homo sapiens
gaggcacagagccctaggagct

SEQ ID NO: 7473378 - DNA, 22 bp, Homo sapiens
gaggcacagagccctaggagct

SEQ ID NO: 7473379 - DNA, 22 bp, Homo sapiens
gaggcacaccagggagtcttgt

SEQ ID NO: 7473380 - DNA, 23 bp, Homo sapiens
gaggagggtctgacaagtgtagc

SEQ ID NO: 7473381 - DNA, 22 bp, Homo sapiens
gaggcacaatacatgtctcaag

SEQ ID NO: 7473382 - DNA, 22 bp, Homo sapiens
gaggcacagagccctaggagct

SEQ ID NO: 7473383 - DNA, 22 bp, Homo sapiens
gaggcacagagccctaggagct

SEQ ID NO: 7473384 - DNA, 22 bp, Homo sapiens
gaggcacagagccctaggagct

SEQ ID NO: 7473385 - DNA, 22 bp, Homo sapiens
gaggcacagagccctaggagct

SEQ ID NO: 7473386 - DNA, 22 bp, Homo sapiens
gaggcacagagccctaggagct

SEQ ID NO: 7473387 - DNA, 22 bp, Homo sapiens
gaggcacagagccctaggagct

SEQ ID NO: 7473388 - DNA, 22 bp, Homo sapiens
gaggcacagagccctaggagct

SEQ ID NO: 7473389 - DNA, 22 bp, Homo sapiens
gaggcacagagccctaggagct

SEQ ID NO: 7473390 - DNA, 22 bp, Homo sapiens
gaggcacagagccctaggagct

SEQ ID NO: 7473391 - DNA, 22 bp, Homo sapiens
gaggcacagagtaggtgcacac

SEQ ID NO: 7473392 - DNA, 22 bp, Homo sapiens
gaggcacagagtaggtgcacac

SEQ ID NO: 7473393 - DNA, 22 bp, Homo sapiens
gaggcacagagtaggtgcacac

SEQ ID NO: 7473394 - DNA, 22 bp, Homo sapiens
gaggcacagagtaggtgcacac

SEQ ID NO: 7473395 - DNA, 22 bp, Homo sapiens
gaggcacagagtaggtgcacac

SEQ ID NO: 7473396 - DNA, 22 bp, Homo sapiens
atgagattttaaaacttcactt

SEQ ID NO: 7473397 - DNA, 22 bp, Homo sapiens
atgagatgtgtctaatggaacc

SEQ ID NO: 7473398 - DNA, 22 bp, Homo sapiens
atgagatgtgtctaatggaacc

SEQ ID NO: 7473399 - DNA, 22 bp, Homo sapiens
atgagatgttcaggagtctgag

SEQ ID NO: 7473400 - DNA, 22 bp, Homo sapiens
atgagcaaccttctcctccagc

SEQ ID NO: 7473401 - DNA, 22 bp, Homo sapiens
atgagattttaaaacttcactt

SEQ ID NO: 7473402 - DNA, 22 bp, Homo sapiens
atgagattttatagtgtcttga

SEQ ID NO: 7473403 - DNA, 22 bp, Homo sapiens
atgagcaagagctatgtacaga

SEQ ID NO: 7473404 - DNA, 22 bp, Homo sapiens
atgagcaaccttctcctccagc

SEQ ID NO: 7473405 - DNA, 22 bp, Homo sapiens
atgagattttatagtgtcttga

SEQ ID NO: 7473406 - DNA, 22 bp, Homo sapiens
atgagcaagagctatgtacaga

SEQ ID NO: 7473407 - DNA, 22 bp, Homo sapiens
atgagcaagccagttccagagt

SEQ ID NO: 7473408 - DNA, 22 bp, Homo sapiens
atgagcaagccagttccagagt

SEQ ID NO: 7473409 - DNA, 22 bp, Homo sapiens
atgagcaattaggaagaaaaca

SEQ ID NO: 7473410 - DNA, 22 bp, Homo sapiens
atgagcaattaaattgcaccag

SEQ ID NO: 7473411 - DNA, 22 bp, Homo sapiens
atgagataggaacaaacttaca

SEQ ID NO: 7473412 - DNA, 22 bp, Homo sapiens
atgagcaagagctatgtacaga

SEQ ID NO: 7473413 - DNA, 22 bp, Homo sapiens
atgagcagatatggattttaga

SEQ ID NO: 7473414 - DNA, 22 bp, Homo sapiens
atgagcagatgctcctgcctct

SEQ ID NO: 7473415 - DNA, 22 bp, Homo sapiens
atgagcagatatggattttaga

SEQ ID NO: 7473416 - DNA, 22 bp, Homo sapiens
atgagcaggaagagcacaaaga

SEQ ID NO: 7473417 - DNA, 22 bp, Homo sapiens
atgagcagatgctcctgcctct

SEQ ID NO: 7473418 - DNA, 22 bp, Homo sapiens
atgagaggtttcgtcagaggaa

SEQ ID NO: 7473419 - DNA, 22 bp, Homo sapiens
atgagaggtttcgtcagaggaa

SEQ ID NO: 7473420 - DNA, 22 bp, Homo sapiens
atgagaggtttcgtcagaggaa

SEQ ID NO: 7473421 - DNA, 22 bp, Homo sapiens
atgagaggtttcgtcagaggaa

SEQ ID NO: 7473422 - DNA, 22 bp, Homo sapiens
atgagaggtttcgtcagaggaa

SEQ ID NO: 7473423 - DNA, 18 bp, Homo sapiens
atgagaggtgtcagaaga

SEQ ID NO: 7473424 - DNA, 22 bp, Homo sapiens
atgagagctctatgatctgttt

SEQ ID NO: 7473425 - DNA, 22 bp, Homo sapiens
atgagagctctatatatagtaa

SEQ ID NO: 7473426 - DNA, 22 bp, Homo sapiens
atgagaggtttcgtcagaggaa

SEQ ID NO: 7473427 - DNA, 18 bp, Homo sapiens
atgagaggtgtcagaaga

SEQ ID NO: 7473428 - DNA, 18 bp, Homo sapiens
atgagaggtgtcagaaga

SEQ ID NO: 7473429 - DNA, 18 bp, Homo sapiens
atgagaggtgtcagaaga

SEQ ID NO: 7473430 - DNA, 21 bp, Homo sapiens
atgagagtaatgctataaatt

SEQ ID NO: 7473431 - DNA, 22 bp, Homo sapiens
atgagagtactagaaacttcct

SEQ ID NO: 7473432 - DNA, 21 bp, Homo sapiens
atgagagtaatgctataaatt

SEQ ID NO: 7473433 - DNA, 22 bp, Homo sapiens
atgagagtctcagagtctcttc

SEQ ID NO: 7473434 - DNA, 22 bp, Homo sapiens
atgagataattcatgtggaatg

SEQ ID NO: 7473435 - DNA, 22 bp, Homo sapiens
atgagatgtgtctaatggaacc

SEQ ID NO: 7473436 - DNA, 22 bp, Homo sapiens
atgagatgtgtctaatggaacc

SEQ ID NO: 7473437 - DNA, 22 bp, Homo sapiens
atgagatagactatgtcataca

SEQ ID NO: 7473438 - DNA, 22 bp, Homo sapiens
atgagaatggtgattctgcaga

SEQ ID NO: 7473439 - DNA, 22 bp, Homo sapiens
atgagaatgcattcatgttttg

SEQ ID NO: 7473440 - DNA, 22 bp, Homo sapiens
atgagacacatgtgacttcttt

SEQ ID NO: 7473441 - DNA, 22 bp, Homo sapiens
atgagacacatgtgacttcttt

SEQ ID NO: 7473442 - DNA, 22 bp, Homo sapiens
atgagaatatgatttactattg

SEQ ID NO: 7473443 - DNA, 22 bp, Homo sapiens
atgagaatatgatttactattg

SEQ ID NO: 7473444 - DNA, 22 bp, Homo sapiens
atgagaataaaggtgatttcga

SEQ ID NO: 7473445 - DNA, 22 bp, Homo sapiens
atgagaataaaggtgatttcga

SEQ ID NO: 7473446 - DNA, 22 bp, Homo sapiens
atgagaatatgatttactattg

SEQ ID NO: 7473447 - DNA, 22 bp, Homo sapiens
atgagaatatgatttactattg

SEQ ID NO: 7473448 - DNA, 22 bp, Homo sapiens
atgagaaggacataaattatag

SEQ ID NO: 7473449 - DNA, 22 bp, Homo sapiens
atgagaaggacataaattatag

SEQ ID NO: 7473450 - DNA, 22 bp, Homo sapiens
atgagagccaccatgcttctgt

SEQ ID NO: 7473451 - DNA, 22 bp, Homo sapiens
atgagacattgcaagtccagaa

SEQ ID NO: 7473452 - DNA, 22 bp, Homo sapiens
atgagacatgacttcaggcctt

SEQ ID NO: 7473453 - DNA, 22 bp, Homo sapiens
atgagaaagttaatcatcatga

SEQ ID NO: 7473454 - DNA, 22 bp, Homo sapiens
atgagaaagttaatcatcatga

SEQ ID NO: 7473455 - DNA, 22 bp, Homo sapiens
atgacattgaatatgttaacta

SEQ ID NO: 7473456 - DNA, 22 bp, Homo sapiens
atgacattgaatatgttaacta

SEQ ID NO: 7473457 - DNA, 22 bp, Homo sapiens
atgagaaagagttgtatctaga

SEQ ID NO: 7473458 - DNA, 22 bp, Homo sapiens
atgagaaagagttgtatctaga

SEQ ID NO: 7473459 - DNA, 22 bp, Homo sapiens
atgagaaatttattacaagcta

SEQ ID NO: 7473460 - DNA, 22 bp, Homo sapiens
atgagaaatttattacaagcta

SEQ ID NO: 7473461 - DNA, 22 bp, Homo sapiens
atgagaaatttattacaagcta

SEQ ID NO: 7473462 - DNA, 22 bp, Homo sapiens
atgagaaagttaatcatcatga

SEQ ID NO: 7473463 - DNA, 22 bp, Homo sapiens
atgagaaagttaatcatcatga

SEQ ID NO: 7473464 - DNA, 22 bp, Homo sapiens
atgagaaagttaatcatcatga

SEQ ID NO: 7473465 - DNA, 22 bp, Homo sapiens
ctttttcattggctttaggaca

SEQ ID NO: 7473466 - DNA, 22 bp, Homo sapiens
ctttttcattggctttaggaca

SEQ ID NO: 7473467 - DNA, 22 bp, Homo sapiens
ctttttcattggctttaggaca

SEQ ID NO: 7473468 - DNA, 19 bp, Homo sapiens
ctttttcaccttctagaag

SEQ ID NO: 7473469 - DNA, 19 bp, Homo sapiens
ctttttcaccttctagaag

SEQ ID NO: 7473470 - DNA, 22 bp, Homo sapiens
ctttttcactgtgtcctcacac

SEQ ID NO: 7473471 - DNA, 22 bp, Homo sapiens
ctttttcactgtgtcctcacac

SEQ ID NO: 7473472 - DNA, 22 bp, Homo sapiens
ctttttcactgtgtcctcacac

SEQ ID NO: 7473473 - DNA, 19 bp, Homo sapiens
ctttttcaccttctagaag

SEQ ID NO: 7473474 - DNA, 19 bp, Homo sapiens
ctttttcaccttctagaag

SEQ ID NO: 7473475 - DNA, 19 bp, Homo sapiens
ctttttcaccttctagaag

SEQ ID NO: 7473476 - DNA, 19 bp, Homo sapiens
ctttttcaccttctagaag

SEQ ID NO: 7473477 - DNA, 19 bp, Homo sapiens
ctttttcaccttctagaag

SEQ ID NO: 7473478 - DNA, 22 bp, Homo sapiens
ctttttcaagtcaaagagggta

SEQ ID NO: 7473479 - DNA, 19 bp, Homo sapiens
ctttttcaccttctagaag

SEQ ID NO: 7473480 - DNA, 22 bp, Homo sapiens
ctttttcattggctttaggaca

SEQ ID NO: 7473481 - DNA, 22 bp, Homo sapiens
ctttttcattggctttaggaca

SEQ ID NO: 7473482 - DNA, 22 bp, Homo sapiens
ctttttccagcttcagggtggg

SEQ ID NO: 7473483 - DNA, 22 bp, Homo sapiens
ctttttccagcttcagggtggg

SEQ ID NO: 7473484 - DNA, 22 bp, Homo sapiens
ctttttcattggctttaggaca

SEQ ID NO: 7473485 - DNA, 22 bp, Homo sapiens
atgacatgattgccatttgata

SEQ ID NO: 7473486 - DNA, 22 bp, Homo sapiens
atgacatggtgcagacagtgtc

SEQ ID NO: 7473487 - DNA, 22 bp, Homo sapiens
ctttttatctcttaatgatgtt

SEQ ID NO: 7473488 - DNA, 22 bp, Homo sapiens
ctttttatctcttaatgatgtt

SEQ ID NO: 7473489 - DNA, 22 bp, Homo sapiens
ctttttatctcttaatgatgtt

SEQ ID NO: 7473490 - DNA, 22 bp, Homo sapiens
ctttttatctcttaatgatgtt

SEQ ID NO: 7473491 - DNA, 22 bp, Homo sapiens
ctttttatctcttaatgatgtt

SEQ ID NO: 7473492 - DNA, 19 bp, Homo sapiens
ctttttcaccttctagaag

SEQ ID NO: 7473493 - DNA, 19 bp, Homo sapiens
ctttttcaccttctagaag

SEQ ID NO: 7473494 - DNA, 22 bp, Homo sapiens
ctttttatctcttaatgatgtt

SEQ ID NO: 7473495 - DNA, 22 bp, Homo sapiens
ctttttcaagtcaaagagggta

SEQ ID NO: 7473496 - DNA, 22 bp, Homo sapiens
ctttttatctcttaatgatgtt

SEQ ID NO: 7473497 - DNA, 22 bp, Homo sapiens
ctttttatctcttaatgatgtt

SEQ ID NO: 7473498 - DNA, 22 bp, Homo sapiens
ctttttatagctatgtcctatg

SEQ ID NO: 7473499 - DNA, 22 bp, Homo sapiens
ctttttatctcttaatgatgtt

SEQ ID NO: 7473500 - DNA, 22 bp, Homo sapiens
ctttttatctcttaatgatgtt

SEQ ID NO: 7473501 - DNA, 22 bp, Homo sapiens
ctttttatagctatgtcctatg

SEQ ID NO: 7473502 - DNA, 22 bp, Homo sapiens
ctttttatagctatgtcctatg

SEQ ID NO: 7473503 - DNA, 22 bp, Homo sapiens
ctttttatagctatgtcctatg

SEQ ID NO: 7473504 - DNA, 22 bp, Homo sapiens
ctttttatagctatgtcctatg

SEQ ID NO: 7473505 - DNA, 22 bp, Homo sapiens
atgacagaggattgtaaagagg

SEQ ID NO: 7473506 - DNA, 22 bp, Homo sapiens
atgacagaggattgtaaagagg

SEQ ID NO: 7473507 - DNA, 22 bp, Homo sapiens
atgacagaggattgtaaagagg

SEQ ID NO: 7473508 - DNA, 19 bp, Homo sapiens
atgacagagttgataagtg

SEQ ID NO: 7473509 - DNA, 19 bp, Homo sapiens
atgacagagttgataagtg

SEQ ID NO: 7473510 - DNA, 19 bp, Homo sapiens
atgacagagttgataagtg

SEQ ID NO: 7473511 - DNA, 19 bp, Homo sapiens
atgacagagttgataagtg

SEQ ID NO: 7473512 - DNA, 22 bp, Homo sapiens
cttttgttgcccttgtcgcagg

SEQ ID NO: 7473513 - DNA, 22 bp, Homo sapiens
atgacagatagtcttcatttgc

SEQ ID NO: 7473514 - DNA, 22 bp, Homo sapiens
atgacagatagtcttcatttgc

SEQ ID NO: 7473515 - DNA, 22 bp, Homo sapiens
atgacagaccctctaaagacaa

SEQ ID NO: 7473516 - DNA, 22 bp, Homo sapiens
atgacagaccctctaaagacaa

SEQ ID NO: 7473517 - DNA, 22 bp, Homo sapiens
atgacagaggagtgcaggtgat

SEQ ID NO: 7473518 - DNA, 22 bp, Homo sapiens
atgacagaggagtgcaggtgat

SEQ ID NO: 7473519 - DNA, 22 bp, Homo sapiens
atgacagaggagtgcaggtgat

SEQ ID NO: 7473520 - DNA, 22 bp, Homo sapiens
ctttttatagctatgtcctatg

SEQ ID NO: 7473521 - DNA, 22 bp, Homo sapiens
ctttttatagctatgtcctatg

SEQ ID NO: 7473522 - DNA, 22 bp, Homo sapiens
ctttttatagctatgtcctatg

SEQ ID NO: 7473523 - DNA, 22 bp, Homo sapiens
ctttttataccgtgccagttga

SEQ ID NO: 7473524 - DNA, 22 bp, Homo sapiens
ctttttataccgtgccagttga

SEQ ID NO: 7473525 - DNA, 22 bp, Homo sapiens
ctttttataccgtgccagttga

SEQ ID NO: 7473526 - DNA, 22 bp, Homo sapiens
ctttttataccgtgccagttga

SEQ ID NO: 7473527 - DNA, 22 bp, Homo sapiens
ctttttataccgtgccagttga

SEQ ID NO: 7473528 - DNA, 22 bp, Homo sapiens
ctttttactctgttgtctcagc

SEQ ID NO: 7473529 - DNA, 22 bp, Homo sapiens
ctttttactctgttgtctcagc

SEQ ID NO: 7473530 - DNA, 21 bp, Homo sapiens
ctttttactcgttcatatgca

SEQ ID NO: 7473531 - DNA, 18 bp, Homo sapiens
cttttgttttccctcctc

SEQ ID NO: 7473532 - DNA, 22 bp, Homo sapiens
ctttttacaaagcctgtcttct

SEQ ID NO: 7473533 - DNA, 18 bp, Homo sapiens
cttttgttttccctcctc

SEQ ID NO: 7473534 - DNA, 18 bp, Homo sapiens
cttttgttttccctcctc

SEQ ID NO: 7473535 - DNA, 22 bp, Homo sapiens
cttttgttgcccttgtcgcagg

SEQ ID NO: 7473536 - DNA, 22 bp, Homo sapiens
cttttgttgcccttgtcgcagg

SEQ ID NO: 7473537 - DNA, 22 bp, Homo sapiens
ctttgggatttcatgagagcta

SEQ ID NO: 7473538 - DNA, 22 bp, Homo sapiens
ctttgggatttcatgagagcta

SEQ ID NO: 7473539 - DNA, 22 bp, Homo sapiens
ctttggtaaatgtcaaaaagtt

SEQ ID NO: 7473540 - DNA, 22 bp, Homo sapiens
ctttgggatttcatgagagcta

SEQ ID NO: 7473541 - DNA, 22 bp, Homo sapiens
ctttgggcactgaagtatgggt

SEQ ID NO: 7473542 - DNA, 22 bp, Homo sapiens
ctttgggtattctcccttgggg

SEQ ID NO: 7473543 - DNA, 22 bp, Homo sapiens
atgaattgtaaattccttgaaa

SEQ ID NO: 7473544 - DNA, 22 bp, Homo sapiens
ctttggtctccgtcatcaatca

SEQ ID NO: 7473545 - DNA, 22 bp, Homo sapiens
ctttggtctccgtcatcaatca

SEQ ID NO: 7473546 - DNA, 22 bp, Homo sapiens
atgaatttttctaagcttttgt

SEQ ID NO: 7473547 - DNA, 22 bp, Homo sapiens
atgaattgtccgatgttgtgca

SEQ ID NO: 7473548 - DNA, 22 bp, Homo sapiens
ctttggtccagaagtggcctct

SEQ ID NO: 7473549 - DNA, 22 bp, Homo sapiens
ctttggtatcttactagtattt

SEQ ID NO: 7473550 - DNA, 21 bp, Homo sapiens
ctttggtatttcactcacata

SEQ ID NO: 7473551 - DNA, 22 bp, Homo sapiens
ctttggcttgcactattacact

SEQ ID NO: 7473552 - DNA, 22 bp, Homo sapiens
ctttggcttgccctggcagtac

SEQ ID NO: 7473553 - DNA, 22 bp, Homo sapiens
ctttggcttgccctggcagtac

SEQ ID NO: 7473554 - DNA, 22 bp, Homo sapiens
ctttggcttgccctggcagtac

SEQ ID NO: 7473555 - DNA, 22 bp, Homo sapiens
ctttggcttgccctggcagtac

SEQ ID NO: 7473556 - DNA, 22 bp, Homo sapiens
ctttggcttttagatatccatt

SEQ ID NO: 7473557 - DNA, 22 bp, Homo sapiens
ctttggcttgccctggcagtac

SEQ ID NO: 7473558 - DNA, 22 bp, Homo sapiens
ctttggctgacgaggaggaggc

SEQ ID NO: 7473559 - DNA, 22 bp, Homo sapiens
ctttggcttgccctggcagtac

SEQ ID NO: 7473560 - DNA, 22 bp, Homo sapiens
ctttggcttttagatatccatt

SEQ ID NO: 7473561 - DNA, 22 bp, Homo sapiens
ctttggctgggcaaagggaggt

SEQ ID NO: 7473562 - DNA, 22 bp, Homo sapiens
ctttggctgacgaggaggaggc

SEQ ID NO: 7473563 - DNA, 22 bp, Homo sapiens
ctttggctgcattcgagttgct

SEQ ID NO: 7473564 - DNA, 22 bp, Homo sapiens
ctttggctgacgaggaggaggc

SEQ ID NO: 7473565 - DNA, 22 bp, Homo sapiens
ctttggctgtcctcttggctgg

SEQ ID NO: 7473566 - DNA, 22 bp, Homo sapiens
ctttggctggcaccccagcggg

SEQ ID NO: 7473567 - DNA, 22 bp, Homo sapiens
ctttggctgggcaaagggaggt

SEQ ID NO: 7473568 - DNA, 22 bp, Homo sapiens
ctttggctgggcaaagggaggt

SEQ ID NO: 7473569 - DNA, 22 bp, Homo sapiens
ctttggctgtcctcttggctgg

SEQ ID NO: 7473570 - DNA, 22 bp, Homo sapiens
atgaatttttctaagcttttgt

SEQ ID NO: 7473571 - DNA, 22 bp, Homo sapiens
atgacaaaagaagacatgaggt

SEQ ID NO: 7473572 - DNA, 22 bp, Homo sapiens
atgacaatggacatagttaaaa

SEQ ID NO: 7473573 - DNA, 22 bp, Homo sapiens
atgacacaagagcagaagccat

SEQ ID NO: 7473574 - DNA, 22 bp, Homo sapiens
atgacaatggacatagttaaaa

SEQ ID NO: 7473575 - DNA, 22 bp, Homo sapiens
atgacacaagagcagaagccat

SEQ ID NO: 7473576 - DNA, 22 bp, Homo sapiens
atgacacaagcagaggctctaa

SEQ ID NO: 7473577 - DNA, 22 bp, Homo sapiens
atgacacaagcagaggctctaa

SEQ ID NO: 7473578 - DNA, 22 bp, Homo sapiens
atgacacaattttagagctgaa

SEQ ID NO: 7473579 - DNA, 22 bp, Homo sapiens
atgacacaattttagagctgaa

SEQ ID NO: 7473580 - DNA, 22 bp, Homo sapiens
atgacacaattttagagctgaa

SEQ ID NO: 7473581 - DNA, 22 bp, Homo sapiens
atgacacataaaacaaggactg

SEQ ID NO: 7473582 - DNA, 22 bp, Homo sapiens
atgacaccatattagcctagag

SEQ ID NO: 7473583 - DNA, 22 bp, Homo sapiens
atgacacatttgtgctgttgaa

SEQ ID NO: 7473584 - DNA, 22 bp, Homo sapiens
atgacacatttgtgctgttgaa

SEQ ID NO: 7473585 - DNA, 22 bp, Homo sapiens
atgacacataaaacaaggactg

SEQ ID NO: 7473586 - DNA, 22 bp, Homo sapiens
atgacacataaaacaaggactg

SEQ ID NO: 7473587 - DNA, 22 bp, Homo sapiens
atgacacataaaacaaggactg

SEQ ID NO: 7473588 - DNA, 22 bp, Homo sapiens
atgacactgtcctagtaaggaa

SEQ ID NO: 7473589 - DNA, 23 bp, Homo sapiens
atgacactcctgtgcgcaccctg

SEQ ID NO: 7473590 - DNA, 22 bp, Homo sapiens
atgacactcgaaaaattgatgc

SEQ ID NO: 7473591 - DNA, 23 bp, Homo sapiens
atgacactcctgtgcgcaccctg

SEQ ID NO: 7473592 - DNA, 23 bp, Homo sapiens
atgacactcctgtgcgcaccctg

SEQ ID NO: 7473593 - DNA, 23 bp, Homo sapiens
atgacactcctgtgcgcaccctg

SEQ ID NO: 7473594 - DNA, 22 bp, Homo sapiens
atgacacccccacagcattgtt

SEQ ID NO: 7473595 - DNA, 22 bp, Homo sapiens
atgacacccccacagcattgtt

SEQ ID NO: 7473596 - DNA, 22 bp, Homo sapiens
atgacaccatattagcctagag

SEQ ID NO: 7473597 - DNA, 22 bp, Homo sapiens
atgacacccaaaaccagtgcag

SEQ ID NO: 7473598 - DNA, 22 bp, Homo sapiens
atgacagaccctctaaagacaa

SEQ ID NO: 7473599 - DNA, 22 bp, Homo sapiens
atgacagacagaagggattttt

SEQ ID NO: 7473600 - DNA, 22 bp, Homo sapiens
atgacactgtcctagtaaggaa

SEQ ID NO: 7473601 - DNA, 22 bp, Homo sapiens
atgacacttggtgatactttgt

SEQ ID NO: 7473602 - DNA, 22 bp, Homo sapiens
atgacagaaggcctccctgaca

SEQ ID NO: 7473603 - DNA, 22 bp, Homo sapiens
ctttgctagtgtttcagtagac

SEQ ID NO: 7473604 - DNA, 20 bp, Homo sapiens
ctttgcctattctctgcctg

SEQ ID NO: 7473605 - DNA, 22 bp, Homo sapiens
ctttgcctcctagagcacgttc

SEQ ID NO: 7473606 - DNA, 22 bp, Homo sapiens
ctttgcttctccaacctgctca

SEQ ID NO: 7473607 - DNA, 22 bp, Homo sapiens
ctttgcttactggtgtctgcat

SEQ ID NO: 7473608 - DNA, 22 bp, Homo sapiens
ctttgcttactggtgtctgcat

SEQ ID NO: 7473609 - DNA, 22 bp, Homo sapiens
ctttgcttactggtgtctgcat

SEQ ID NO: 7473610 - DNA, 22 bp, Homo sapiens
ctttgctgagctggttgttcaa

SEQ ID NO: 7473611 - DNA, 22 bp, Homo sapiens
ctttgctgagctggttgttcaa

SEQ ID NO: 7473612 - DNA, 22 bp, Homo sapiens
ctttgctgccagaacccagcag

SEQ ID NO: 7473613 - DNA, 22 bp, Homo sapiens
ctttgctgccagaacccagcag

SEQ ID NO: 7473614 - DNA, 22 bp, Homo sapiens
ctttgctgttataatgatagct

SEQ ID NO: 7473615 - DNA, 22 bp, Homo sapiens
ctttgctgttataatgatagct

SEQ ID NO: 7473616 - DNA, 23 bp, Homo sapiens
ctttgccacccagagcctgacag

SEQ ID NO: 7473617 - DNA, 22 bp, Homo sapiens
ctttgccatgttgcctgcagaa

SEQ ID NO: 7473618 - DNA, 20 bp, Homo sapiens
ctttgcctattctctgcctg

SEQ ID NO: 7473619 - DNA, 23 bp, Homo sapiens
ctttgccacccagagcctgacag

SEQ ID NO: 7473620 - DNA, 19 bp, Homo sapiens
ctttgccactgataggagt

SEQ ID NO: 7473621 - DNA, 22 bp, Homo sapiens
ctttcaaaacgctctgtatgca

SEQ ID NO: 7473622 - DNA, 22 bp, Homo sapiens
ctttcaaaacgctctgtatgca

SEQ ID NO: 7473623 - DNA, 22 bp, Homo sapiens
ctttcaaaacgctctgtatgca

SEQ ID NO: 7473624 - DNA, 22 bp, Homo sapiens
ctttcaaaacgctctgtatgca

SEQ ID NO: 7473625 - DNA, 22 bp, Homo sapiens
ctttctttcgaagacgtgatta

SEQ ID NO: 7473626 - DNA, 22 bp, Homo sapiens
ctttctttcgaagacgtgatta

SEQ ID NO: 7473627 - DNA, 22 bp, Homo sapiens
ctttctttcgaagacgtgatta

SEQ ID NO: 7473628 - DNA, 22 bp, Homo sapiens
ctttctttcgaagacgtgatta

SEQ ID NO: 7473629 - DNA, 22 bp, Homo sapiens
ctttctttcgaagacgtgatta

SEQ ID NO: 7473630 - DNA, 22 bp, Homo sapiens
ctttctttcgaagacgtgatta

SEQ ID NO: 7473631 - DNA, 22 bp, Homo sapiens
ctttggaaagtaagcagctaga

SEQ ID NO: 7473632 - DNA, 22 bp, Homo sapiens
ctttggaaagtaagcagctaga

SEQ ID NO: 7473633 - DNA, 22 bp, Homo sapiens
ctttggaaagtggttcaggtga

SEQ ID NO: 7473634 - DNA, 22 bp, Homo sapiens
ctttggaaagtggttcaggtga

SEQ ID NO: 7473635 - DNA, 22 bp, Homo sapiens
ctttggaaagtaagcagctaga

SEQ ID NO: 7473636 - DNA, 22 bp, Homo sapiens
ctttggaaagtaagcagctaga

SEQ ID NO: 7473637 - DNA, 22 bp, Homo sapiens
ctttggaaagtaagcagctaga

SEQ ID NO: 7473638 - DNA, 22 bp, Homo sapiens
ctttggaaaagcataccaagga

SEQ ID NO: 7473639 - DNA, 22 bp, Homo sapiens
ctttggaaagtggttcaggtga

SEQ ID NO: 7473640 - DNA, 22 bp, Homo sapiens
ctttggctaacaaatcagcttg

SEQ ID NO: 7473641 - DNA, 22 bp, Homo sapiens
ctttggctgacaggtttctggt

SEQ ID NO: 7473642 - DNA, 22 bp, Homo sapiens
ctttggctctttagaattccct

SEQ ID NO: 7473643 - DNA, 22 bp, Homo sapiens
ctttggctgacaggtttctggt

SEQ ID NO: 7473644 - DNA, 22 bp, Homo sapiens
ctttggctgacaggtttctggt

SEQ ID NO: 7473645 - DNA, 22 bp, Homo sapiens
ctttggctcatggttttatcca

SEQ ID NO: 7473646 - DNA, 22 bp, Homo sapiens
ctttggctaacaaatcagcttg

SEQ ID NO: 7473647 - DNA, 22 bp, Homo sapiens
ctttggctacaagcgctgcaat

SEQ ID NO: 7473648 - DNA, 22 bp, Homo sapiens
ctttggctacaagcgctgcaat

SEQ ID NO: 7473649 - DNA, 22 bp, Homo sapiens
ctttggctacaagcgctgcaat

SEQ ID NO: 7473650 - DNA, 22 bp, Homo sapiens
ctttggaaaagcataccaagga

SEQ ID NO: 7473651 - DNA, 22 bp, Homo sapiens
ctttggaaaagcataccaagga

SEQ ID NO: 7473652 - DNA, 22 bp, Homo sapiens
ctttggaaaagcataccaagga

SEQ ID NO: 7473653 - DNA, 22 bp, Homo sapiens
ctttggaaaaatacctggcata

SEQ ID NO: 7473654 - DNA, 22 bp, Homo sapiens
ctttggaaaaatacctggcata

SEQ ID NO: 7473655 - DNA, 22 bp, Homo sapiens
ctttggaaaaagtgactggctc

SEQ ID NO: 7473656 - DNA, 22 bp, Homo sapiens
ctttggaaaaatacctggcata

SEQ ID NO: 7473657 - DNA, 22 bp, Homo sapiens
ctttggaaaaatacctggcata

SEQ ID NO: 7473658 - DNA, 22 bp, Homo sapiens
ctttggaaaaatacctggcata

SEQ ID NO: 7473659 - DNA, 22 bp, Homo sapiens
ctttggaaaaatacctggcata

SEQ ID NO: 7473660 - DNA, 22 bp, Homo sapiens
ctttggaaaaatacctggcata

SEQ ID NO: 7473661 - DNA, 22 bp, Homo sapiens
ctttgctttactcccactgtgt

SEQ ID NO: 7473662 - DNA, 22 bp, Homo sapiens
ctttggaaaaagtgactggctc

SEQ ID NO: 7473663 - DNA, 22 bp, Homo sapiens
ctttggaaaaagtgactggctc

SEQ ID NO: 7473664 - DNA, 22 bp, Homo sapiens
ctttgctttactcccactgtgt

SEQ ID NO: 7473665 - DNA, 19 bp, Homo sapiens
ctttgcttgtttctgtgtc

SEQ ID NO: 7473666 - DNA, 22 bp, Homo sapiens
ctttgcttgacactgtgattgt

SEQ ID NO: 7473667 - DNA, 22 bp, Homo sapiens
ctttgcttgacactgtgattgt

SEQ ID NO: 7473668 - DNA, 22 bp, Homo sapiens
ctttgcttgacactgtgattgt

SEQ ID NO: 7473669 - DNA, 22 bp, Homo sapiens
ctttgcttctccaacctgctca

SEQ ID NO: 7473670 - DNA, 22 bp, Homo sapiens
ctttgcttctccaacctgctca

SEQ ID NO: 7473671 - DNA, 22 bp, Homo sapiens
ctttgcttctccaacctgctca

SEQ ID NO: 7473672 - DNA, 22 bp, Homo sapiens
ctttattctgcaaattgccttg

SEQ ID NO: 7473673 - DNA, 22 bp, Homo sapiens
ctttattcctacaagattttct

SEQ ID NO: 7473674 - DNA, 22 bp, Homo sapiens
ctttattctgcaaattgccttg

SEQ ID NO: 7473675 - DNA, 22 bp, Homo sapiens
ctttattctgcaaattgccttg

SEQ ID NO: 7473676 - DNA, 22 bp, Homo sapiens
ctttattcctacaagattttct

SEQ ID NO: 7473677 - DNA, 22 bp, Homo sapiens
ctttattcctacaagattttct

SEQ ID NO: 7473678 - DNA, 22 bp, Homo sapiens
ctttattcctacaagattttct

SEQ ID NO: 7473679 - DNA, 22 bp, Homo sapiens
ctttattcctacaagattttct

SEQ ID NO: 7473680 - DNA, 22 bp, Homo sapiens
ctttattcctacaagattttct

SEQ ID NO: 7473681 - DNA, 22 bp, Homo sapiens
ctttattagatgtagactttct

SEQ ID NO: 7473682 - DNA, 22 bp, Homo sapiens
ctttattagatgtagactttct

SEQ ID NO: 7473683 - DNA, 22 bp, Homo sapiens
ctttattagatgtagactttct

SEQ ID NO: 7473684 - DNA, 22 bp, Homo sapiens
ctttattagatgtagactttct

SEQ ID NO: 7473685 - DNA, 22 bp, Homo sapiens
ctttattagatgtagactttct

SEQ ID NO: 7473686 - DNA, 22 bp, Homo sapiens
ctttattgtccttcttaggtgg

SEQ ID NO: 7473687 - DNA, 22 bp, Homo sapiens
ctttattgtccttcttaggtgg

SEQ ID NO: 7473688 - DNA, 22 bp, Homo sapiens
ctttattgtccttcttaggtgg

SEQ ID NO: 7473689 - DNA, 22 bp, Homo sapiens
ctttattgtccttcttaggtgg

SEQ ID NO: 7473690 - DNA, 22 bp, Homo sapiens
ctttattgtccttcttaggtgg

SEQ ID NO: 7473691 - DNA, 22 bp, Homo sapiens
ctttattgtccttcttaggtgg

SEQ ID NO: 7473692 - DNA, 22 bp, Homo sapiens
ctttcaaaacgctctgtatgca

SEQ ID NO: 7473693 - DNA, 22 bp, Homo sapiens
ctttcaaaacgctctgtatgca

SEQ ID NO: 7473694 - DNA, 22 bp, Homo sapiens
ctttattgtccttcttaggtgg

SEQ ID NO: 7473695 - DNA, 22 bp, Homo sapiens
ctttattgtccttcttaggtgg

SEQ ID NO: 7473696 - DNA, 22 bp, Homo sapiens
ctttattgtccttcttaggtgg

SEQ ID NO: 7473697 - DNA, 22 bp, Homo sapiens
ctttattgtccttcttaggtgg

SEQ ID NO: 7473698 - DNA, 22 bp, Homo sapiens
ctttattgtccttcttaggtgg

SEQ ID NO: 7473699 - DNA, 22 bp, Homo sapiens
ctttattgtccttcttaggtgg

SEQ ID NO: 7473700 - DNA, 22 bp, Homo sapiens
ctttattgtccttcttaggtgg

SEQ ID NO: 7473701 - DNA, 22 bp, Homo sapiens
ctttattctgcaaattgccttg

SEQ ID NO: 7473702 - DNA, 22 bp, Homo sapiens
ctttattctgcaaattgccttg

SEQ ID NO: 7473703 - DNA, 22 bp, Homo sapiens
ctttattctgcaaattgccttg

SEQ ID NO: 7473704 - DNA, 22 bp, Homo sapiens
ctttagaaatctggatgtattt

SEQ ID NO: 7473705 - DNA, 22 bp, Homo sapiens
ctttagaaatctggatgtattt

SEQ ID NO: 7473706 - DNA, 22 bp, Homo sapiens
ctttagaaatctggatgtattt

SEQ ID NO: 7473707 - DNA, 22 bp, Homo sapiens
ctttagaaatctggatgtattt

SEQ ID NO: 7473708 - DNA, 22 bp, Homo sapiens
ctttagaaatctggatgtattt

SEQ ID NO: 7473709 - DNA, 22 bp, Homo sapiens
ctttatgtgtactttccatttt

SEQ ID NO: 7473710 - DNA, 22 bp, Homo sapiens
ctttatgtgtactttccatttt

SEQ ID NO: 7473711 - DNA, 22 bp, Homo sapiens
ctttacttgctttgttacaaaa

SEQ ID NO: 7473712 - DNA, 22 bp, Homo sapiens
ctttacttgctttgttacaaaa

SEQ ID NO: 7473713 - DNA, 22 bp, Homo sapiens
ctttacttgctttgttacaaaa

SEQ ID NO: 7473714 - DNA, 22 bp, Homo sapiens
ctttacttgctttgttacaaaa

SEQ ID NO: 7473715 - DNA, 22 bp, Homo sapiens
ctttacttgctttgttacaaaa

SEQ ID NO: 7473716 - DNA, 22 bp, Homo sapiens
ctttattagatgtagactttct

SEQ ID NO: 7473717 - DNA, 22 bp, Homo sapiens
ctttattagatgtagactttct

SEQ ID NO: 7473718 - DNA, 22 bp, Homo sapiens
ctttattagatgtagactttct

SEQ ID NO: 7473719 - DNA, 22 bp, Homo sapiens
ctttattagatgtagactttct

SEQ ID NO: 7473720 - DNA, 22 bp, Homo sapiens
ctttattagatgtagactttct

SEQ ID NO: 7473721 - DNA, 22 bp, Homo sapiens
ctttatgttggggtgtcttagt

SEQ ID NO: 7473722 - DNA, 22 bp, Homo sapiens
ctttatgttcagtacaatgctt

SEQ ID NO: 7473723 - DNA, 22 bp, Homo sapiens
ctttatgttcagtacaatgctt

SEQ ID NO: 7473724 - DNA, 22 bp, Homo sapiens
ctttatgttggggtgtcttagt

SEQ ID NO: 7473725 - DNA, 22 bp, Homo sapiens
ctttatgttggggtgtcttagt

SEQ ID NO: 7473726 - DNA, 22 bp, Homo sapiens
ctttactgttcttctgtgggaa

SEQ ID NO: 7473727 - DNA, 22 bp, Homo sapiens
ctttactgaagtgaagacctgg

SEQ ID NO: 7473728 - DNA, 22 bp, Homo sapiens
ctttactgtttggtgctctatt

SEQ ID NO: 7473729 - DNA, 22 bp, Homo sapiens
ctttactgtttggtgctctatt

SEQ ID NO: 7473730 - DNA, 22 bp, Homo sapiens
ctttacttctcaaaataaagca

SEQ ID NO: 7473731 - DNA, 22 bp, Homo sapiens
ctttacttctcaaaataaagca

SEQ ID NO: 7473732 - DNA, 22 bp, Homo sapiens
ctttacttctcaaaataaagca

SEQ ID NO: 7473733 - DNA, 22 bp, Homo sapiens
ctttacttctcaaaataaagca

SEQ ID NO: 7473734 - DNA, 22 bp, Homo sapiens
ctttacttctcaaaataaagca

SEQ ID NO: 7473735 - DNA, 22 bp, Homo sapiens
ctttacattaatttctactgat

SEQ ID NO: 7473736 - DNA, 22 bp, Homo sapiens
ctttacattaatttctactgat

SEQ ID NO: 7473737 - DNA, 22 bp, Homo sapiens
ctttaccagattccattgcaag

SEQ ID NO: 7473738 - DNA, 22 bp, Homo sapiens
ctttaccagattccattgcaag

SEQ ID NO: 7473739 - DNA, 22 bp, Homo sapiens
ctttactatcaggaataaacaa

SEQ ID NO: 7473740 - DNA, 22 bp, Homo sapiens
ctttactatcaggaataaacaa

SEQ ID NO: 7473741 - DNA, 22 bp, Homo sapiens
ctttactatcaggaataaacaa

SEQ ID NO: 7473742 - DNA, 22 bp, Homo sapiens
ctttacataaggataaacctgg

SEQ ID NO: 7473743 - DNA, 22 bp, Homo sapiens
ctttacataaggataaacctgg

SEQ ID NO: 7473744 - DNA, 22 bp, Homo sapiens
ctttacataaggataaacctgg

SEQ ID NO: 7473745 - DNA, 22 bp, Homo sapiens
ctttacagcttagtggtatgga

SEQ ID NO: 7473746 - DNA, 22 bp, Homo sapiens
ctttacagataggaactactca

SEQ ID NO: 7473747 - DNA, 22 bp, Homo sapiens
ctttacagatggataattgttt

SEQ ID NO: 7473748 - DNA, 22 bp, Homo sapiens
ctttacagatggataattgttt

SEQ ID NO: 7473749 - DNA, 17 bp, Homo sapiens
cttgttttccactggga

SEQ ID NO: 7473750 - DNA, 17 bp, Homo sapiens
cttgttttccactggga

SEQ ID NO: 7473751 - DNA, 17 bp, Homo sapiens
cttgttttccactggga

SEQ ID NO: 7473752 - DNA, 17 bp, Homo sapiens
cttgttttccactggga

SEQ ID NO: 7473753 - DNA, 22 bp, Homo sapiens
ctttacacaatgattttcttta

SEQ ID NO: 7473754 - DNA, 22 bp, Homo sapiens
cttgttttctaaaacatcattt

SEQ ID NO: 7473755 - DNA, 22 bp, Homo sapiens
cttgttttctaaaacatcattt

SEQ ID NO: 7473756 - DNA, 22 bp, Homo sapiens
cttgttttctaaaacatcattt

SEQ ID NO: 7473757 - DNA, 22 bp, Homo sapiens
ctttacagaataagaatactgg

SEQ ID NO: 7473758 - DNA, 22 bp, Homo sapiens
ctttacagaataagaatactgg

SEQ ID NO: 7473759 - DNA, 22 bp, Homo sapiens
ctttacagataggaactactca

SEQ ID NO: 7473760 - DNA, 22 bp, Homo sapiens
ctttacagataggaactactca

SEQ ID NO: 7473761 - DNA, 22 bp, Homo sapiens
ctttacaccaagcagatctttc

SEQ ID NO: 7473762 - DNA, 22 bp, Homo sapiens
ctttacagaaagagaactctgg

SEQ ID NO: 7473763 - DNA, 22 bp, Homo sapiens
atctttggacggtcccaactga

SEQ ID NO: 7473764 - DNA, 22 bp, Homo sapiens
atctttggaaagccaagcacag

SEQ ID NO: 7473765 - DNA, 22 bp, Homo sapiens
atctttggacggtcccaactga

SEQ ID NO: 7473766 - DNA, 22 bp, Homo sapiens
atctttggaaagccaagcacag

SEQ ID NO: 7473767 - DNA, 22 bp, Homo sapiens
atctttggaaagccaagcacag

SEQ ID NO: 7473768 - DNA, 22 bp, Homo sapiens
atctttgctattgtaaatcacg

SEQ ID NO: 7473769 - DNA, 22 bp, Homo sapiens
atctttgctattgtaaatcacg

SEQ ID NO: 7473770 - DNA, 22 bp, Homo sapiens
atctttgctattgtaaatcacg

SEQ ID NO: 7473771 - DNA, 22 bp, Homo sapiens
atctttgctattgtaaatcacg

SEQ ID NO: 7473772 - DNA, 22 bp, Homo sapiens
atctttgatctttattgctaag

SEQ ID NO: 7473773 - DNA, 22 bp, Homo sapiens
atctttgatctttattgctaag

SEQ ID NO: 7473774 - DNA, 22 bp, Homo sapiens
atctttgatgactaatgctttg

SEQ ID NO: 7473775 - DNA, 22 bp, Homo sapiens
atctttgaatcaatgaatcagt

SEQ ID NO: 7473776 - DNA, 22 bp, Homo sapiens
atctttgaagaggacttgaagt

SEQ ID NO: 7473777 - DNA, 22 bp, Homo sapiens
atctttgactgccattcttgac

SEQ ID NO: 7473778 - DNA, 22 bp, Homo sapiens
atctttgaatcaatgaatcagt

SEQ ID NO: 7473779 - DNA, 22 bp, Homo sapiens
atctttgaatcaatgaatcagt

SEQ ID NO: 7473780 - DNA, 22 bp, Homo sapiens
atctttggatcgctcccccttc

SEQ ID NO: 7473781 - DNA, 22 bp, Homo sapiens
atctttggatcgctcccccttc

SEQ ID NO: 7473782 - DNA, 22 bp, Homo sapiens
atctttggccacttgtgctgca

SEQ ID NO: 7473783 - DNA, 22 bp, Homo sapiens
atctttggccacttgtgctgca

SEQ ID NO: 7473784 - DNA, 22 bp, Homo sapiens
atctttggatcgctcccccttc

SEQ ID NO: 7473785 - DNA, 20 bp, Homo sapiens
atctttggctcagaagcctt

SEQ ID NO: 7473786 - DNA, 20 bp, Homo sapiens
atctttggctcagaagcctt

SEQ ID NO: 7473787 - DNA, 20 bp, Homo sapiens
atctttggctcagaagcctt

SEQ ID NO: 7473788 - DNA, 22 bp, Homo sapiens
atctttggccacttgtgctgca

SEQ ID NO: 7473789 - DNA, 22 bp, Homo sapiens
atctttgggatcctgatttact

SEQ ID NO: 7473790 - DNA, 22 bp, Homo sapiens
atctttgggatatttgtgatta

SEQ ID NO: 7473791 - DNA, 22 bp, Homo sapiens
atctttgggatatttgtgatta

SEQ ID NO: 7473792 - DNA, 20 bp, Homo sapiens
atctttggctcagaagcctt

SEQ ID NO: 7473793 - DNA, 22 bp, Homo sapiens
cttgtttgattattgcctgagg

SEQ ID NO: 7473794 - DNA, 22 bp, Homo sapiens
cttgttttaaactgttgtggct

SEQ ID NO: 7473795 - DNA, 22 bp, Homo sapiens
cttgttttaaactgttgtggct

SEQ ID NO: 7473796 - DNA, 22 bp, Homo sapiens
atctttcagtttcataccaatt

SEQ ID NO: 7473797 - DNA, 22 bp, Homo sapiens
atctttcagtttcataccaatt

SEQ ID NO: 7473798 - DNA, 22 bp, Homo sapiens
atctttcagtttcataccaatt

SEQ ID NO: 7473799 - DNA, 22 bp, Homo sapiens
atctttcagtttcataccaatt

SEQ ID NO: 7473800 - DNA, 22 bp, Homo sapiens
atctttcatctctattatttga

SEQ ID NO: 7473801 - DNA, 22 bp, Homo sapiens
atctttcaatcaggaaaaatct

SEQ ID NO: 7473802 - DNA, 22 bp, Homo sapiens
atctttcaatcaggaaaaatct

SEQ ID NO: 7473803 - DNA, 22 bp, Homo sapiens
atctttcaatcaggaaaaatct

SEQ ID NO: 7473804 - DNA, 22 bp, Homo sapiens
atctttcactttttgtggatga

SEQ ID NO: 7473805 - DNA, 22 bp, Homo sapiens
atctttcagagctccatcaggg

SEQ ID NO: 7473806 - DNA, 22 bp, Homo sapiens
cttctccttatatgtcccgttc

SEQ ID NO: 7473807 - DNA, 19 bp, Homo sapiens
atcttgggaaatggtaact

SEQ ID NO: 7473808 - DNA, 19 bp, Homo sapiens
atcttgggaaatggtaact

SEQ ID NO: 7473809 - DNA, 22 bp, Homo sapiens
cttctcctgtaagaagatcaaa

SEQ ID NO: 7473810 - DNA, 22 bp, Homo sapiens
cttctcctgtaagaagatcaaa

SEQ ID NO: 7473811 - DNA, 22 bp, Homo sapiens
cttctcctgtaagaagatcaaa

SEQ ID NO: 7473812 - DNA, 22 bp, Homo sapiens
cttctcctgtaagaagatcaaa

SEQ ID NO: 7473813 - DNA, 20 bp, Homo sapiens
atcttgggacagggcacatg

SEQ ID NO: 7473814 - DNA, 20 bp, Homo sapiens
atcttgggacagggcacatg

SEQ ID NO: 7473815 - DNA, 20 bp, Homo sapiens
atcttgggacagggcacatg

SEQ ID NO: 7473816 - DNA, 22 bp, Homo sapiens
atcttgggaattttccaggagt

SEQ ID NO: 7473817 - DNA, 22 bp, Homo sapiens
atcttgggaattttccaggagt

SEQ ID NO: 7473818 - DNA, 22 bp, Homo sapiens
atcttgggaattttccaggagt

SEQ ID NO: 7473819 - DNA, 22 bp, Homo sapiens
atcttgggaattttccaggagt

SEQ ID NO: 7473820 - DNA, 21 bp, Homo sapiens
atctttattacgcagagaaga

SEQ ID NO: 7473821 - DNA, 20 bp, Homo sapiens
atcttgggacagggcacatg

SEQ ID NO: 7473822 - DNA, 22 bp, Homo sapiens
atcttgggacatgtgctctggg

SEQ ID NO: 7473823 - DNA, 21 bp, Homo sapiens
atctttattacgcagagaaga

SEQ ID NO: 7473824 - DNA, 21 bp, Homo sapiens
atctttattacgcagagaaga

SEQ ID NO: 7473825 - DNA, 21 bp, Homo sapiens
atctttattacgcagagaaga

SEQ ID NO: 7473826 - DNA, 22 bp, Homo sapiens
atctttatttattgagcactta

SEQ ID NO: 7473827 - DNA, 22 bp, Homo sapiens
atctttatttattgagcactta

SEQ ID NO: 7473828 - DNA, 22 bp, Homo sapiens
atctttctccatatacatcttt

SEQ ID NO: 7473829 - DNA, 22 bp, Homo sapiens
atctttctccatatacatcttt

SEQ ID NO: 7473830 - DNA, 22 bp, Homo sapiens
atctttctccatatacatcttt

SEQ ID NO: 7473831 - DNA, 22 bp, Homo sapiens
atctttctccatatacatcttt

SEQ ID NO: 7473832 - DNA, 22 bp, Homo sapiens
atctttctctgcactatacaat

SEQ ID NO: 7473833 - DNA, 22 bp, Homo sapiens
atctttctctgcactatacaat

SEQ ID NO: 7473834 - DNA, 22 bp, Homo sapiens
atctttctccatatacatcttt

SEQ ID NO: 7473835 - DNA, 22 bp, Homo sapiens
atctttctctgcactatacaat

SEQ ID NO: 7473836 - DNA, 22 bp, Homo sapiens
atctttctctgcactatacaat

SEQ ID NO: 7473837 - DNA, 22 bp, Homo sapiens
atctttctctgcactatacaat

SEQ ID NO: 7473838 - DNA, 22 bp, Homo sapiens
atctttcttatttgaagaaaga

SEQ ID NO: 7473839 - DNA, 22 bp, Homo sapiens
atctttcttatttgaagaaaga

SEQ ID NO: 7473840 - DNA, 22 bp, Homo sapiens
atctttcttatttgaagaaaga

SEQ ID NO: 7473841 - DNA, 22 bp, Homo sapiens
atctttcttatttgaagaaaga

SEQ ID NO: 7473842 - DNA, 22 bp, Homo sapiens
atctttcttatttgaagaaaga

SEQ ID NO: 7473843 - DNA, 22 bp, Homo sapiens
atctttcttatttgaagaaaga

SEQ ID NO: 7473844 - DNA, 22 bp, Homo sapiens
atctttgaagaggacttgaagt

SEQ ID NO: 7473845 - DNA, 22 bp, Homo sapiens
atctttctatggtactttctcc

SEQ ID NO: 7473846 - DNA, 22 bp, Homo sapiens
atctttctatggtactttctcc

SEQ ID NO: 7473847 - DNA, 22 bp, Homo sapiens
atctttctatggtactttctcc

SEQ ID NO: 7473848 - DNA, 22 bp, Homo sapiens
atctttctatttctaaaaacta

SEQ ID NO: 7473849 - DNA, 22 bp, Homo sapiens
atctttctatttctaaaaacta

SEQ ID NO: 7473850 - DNA, 22 bp, Homo sapiens
atctttctatttctaaaaacta

SEQ ID NO: 7473851 - DNA, 18 bp, Homo sapiens
atctttccatagcatgtt

SEQ ID NO: 7473852 - DNA, 18 bp, Homo sapiens
atctttccatagcatgtt

SEQ ID NO: 7473853 - DNA, 22 bp, Homo sapiens
atctttcatctctattatttga

SEQ ID NO: 7473854 - DNA, 18 bp, Homo sapiens
atctttccatagcatgtt

SEQ ID NO: 7473855 - DNA, 22 bp, Homo sapiens
atctttcctgttttcagacagc

SEQ ID NO: 7473856 - DNA, 22 bp, Homo sapiens
atctttctatggtactttctcc

SEQ ID NO: 7473857 - DNA, 22 bp, Homo sapiens
atctttctatggtactttctcc

SEQ ID NO: 7473858 - DNA, 18 bp, Homo sapiens
atctttccatagcatgtt

SEQ ID NO: 7473859 - DNA, 22 bp, Homo sapiens
atctttctatggtactttctcc

SEQ ID NO: 7473860 - DNA, 22 bp, Homo sapiens
atctttctatggtactttctcc

SEQ ID NO: 7473861 - DNA, 22 bp, Homo sapiens
atctttctatggtactttctcc

SEQ ID NO: 7473862 - DNA, 22 bp, Homo sapiens
cttctcctgtaagaagatcaaa

SEQ ID NO: 7473863 - DNA, 22 bp, Homo sapiens
cttctcctctgagtcctgggag

SEQ ID NO: 7473864 - DNA, 22 bp, Homo sapiens
cttctcctctgagtcctgggag

SEQ ID NO: 7473865 - DNA, 22 bp, Homo sapiens
cttctcctctgagtcctgggag

SEQ ID NO: 7473866 - DNA, 22 bp, Homo sapiens
cttctcctctgagtcctgggag

SEQ ID NO: 7473867 - DNA, 22 bp, Homo sapiens
cttctcctctgagtcctgggag

SEQ ID NO: 7473868 - DNA, 22 bp, Homo sapiens
cttctccctgggggctctttat

SEQ ID NO: 7473869 - DNA, 22 bp, Homo sapiens
cttctccctgggggctctttat

SEQ ID NO: 7473870 - DNA, 22 bp, Homo sapiens
cttctccctggcttctgcacac

SEQ ID NO: 7473871 - DNA, 22 bp, Homo sapiens
cttctccctgggggctctttat

SEQ ID NO: 7473872 - DNA, 22 bp, Homo sapiens
cttctcctaaggtcagaattgc

SEQ ID NO: 7473873 - DNA, 22 bp, Homo sapiens
cttctccctggcttctgcacac

SEQ ID NO: 7473874 - DNA, 22 bp, Homo sapiens
cttctcctaaggtcagaattgc

SEQ ID NO: 7473875 - DNA, 22 bp, Homo sapiens
cttctcctaaggtcagaattgc

SEQ ID NO: 7473876 - DNA, 22 bp, Homo sapiens
cttctccctggcttctgcacac

SEQ ID NO: 7473877 - DNA, 22 bp, Homo sapiens
cttctccctggcttctgcacac

SEQ ID NO: 7473878 - DNA, 22 bp, Homo sapiens
cttctccctggcttctgcacac

SEQ ID NO: 7473879 - DNA, 22 bp, Homo sapiens
cttctcccgaagccggttctgc

SEQ ID NO: 7473880 - DNA, 22 bp, Homo sapiens
cttctccctggcttctgcacac

SEQ ID NO: 7473881 - DNA, 22 bp, Homo sapiens
cttctccctggcttctgcacac

SEQ ID NO: 7473882 - DNA, 18 bp, Homo sapiens
cttctcccatcttggcca

SEQ ID NO: 7473883 - DNA, 22 bp, Homo sapiens
cttctccccagaaaagatttct

SEQ ID NO: 7473884 - DNA, 22 bp, Homo sapiens
cttctccccagaaaagatttct

SEQ ID NO: 7473885 - DNA, 18 bp, Homo sapiens
cttctcccatcttggcca

SEQ ID NO: 7473886 - DNA, 18 bp, Homo sapiens
cttctcccatcttggcca

SEQ ID NO: 7473887 - DNA, 19 bp, Homo sapiens
cttctccagcttctagaag

SEQ ID NO: 7473888 - DNA, 19 bp, Homo sapiens
cttctccagcttctagaag

SEQ ID NO: 7473889 - DNA, 22 bp, Homo sapiens
cttctcccaagtatgcagtttg

SEQ ID NO: 7473890 - DNA, 22 bp, Homo sapiens
atctggaatccttgtggacaat

SEQ ID NO: 7473891 - DNA, 22 bp, Homo sapiens
atctggaatgtctcattgggaa

SEQ ID NO: 7473892 - DNA, 22 bp, Homo sapiens
atctggaatccttgtggacaat

SEQ ID NO: 7473893 - DNA, 22 bp, Homo sapiens
atctggaatagcatggggttga

SEQ ID NO: 7473894 - DNA, 22 bp, Homo sapiens
atctggaatagcatggggttga

SEQ ID NO: 7473895 - DNA, 22 bp, Homo sapiens
atctggaatccttgtggacaat

SEQ ID NO: 7473896 - DNA, 22 bp, Homo sapiens
atctggaagttaagcttggtgc

SEQ ID NO: 7473897 - DNA, 22 bp, Homo sapiens
atctggaagtctccgaaggcag

SEQ ID NO: 7473898 - DNA, 22 bp, Homo sapiens
atctggaagtaggagagtgggc

SEQ ID NO: 7473899 - DNA, 17 bp, Homo sapiens
atctggaagctagctga

SEQ ID NO: 7473900 - DNA, 22 bp, Homo sapiens
atctggaagtaggagagtgggc

SEQ ID NO: 7473901 - DNA, 22 bp, Homo sapiens
atctggaagtcagaggtttgca

SEQ ID NO: 7473902 - DNA, 22 bp, Homo sapiens
atctggaagtcagaggtttgca

SEQ ID NO: 7473903 - DNA, 22 bp, Homo sapiens
atctggaattaagagaaagtga

SEQ ID NO: 7473904 - DNA, 22 bp, Homo sapiens
atctggaattgaagaggtttga

SEQ ID NO: 7473905 - DNA, 22 bp, Homo sapiens
atctggaattaagagaaagtga

SEQ ID NO: 7473906 - DNA, 22 bp, Homo sapiens
atctggaattaagagaaagtga

SEQ ID NO: 7473907 - DNA, 22 bp, Homo sapiens
atctggaattaagagaaagtga

SEQ ID NO: 7473908 - DNA, 22 bp, Homo sapiens
atctggaattaagagaaagtga

SEQ ID NO: 7473909 - DNA, 22 bp, Homo sapiens
atctggaattaagagaaagtga

SEQ ID NO: 7473910 - DNA, 22 bp, Homo sapiens
atctggactagagcagaatggg

SEQ ID NO: 7473911 - DNA, 22 bp, Homo sapiens
atctggactggacatagtcttt

SEQ ID NO: 7473912 - DNA, 22 bp, Homo sapiens
atctggactggacatagtcttt

SEQ ID NO: 7473913 - DNA, 22 bp, Homo sapiens
atctggactggacatagtcttt

SEQ ID NO: 7473914 - DNA, 22 bp, Homo sapiens
atctggagaaaccgccaaggga

SEQ ID NO: 7473915 - DNA, 22 bp, Homo sapiens
atctggagaaaccgccaaggga

SEQ ID NO: 7473916 - DNA, 22 bp, Homo sapiens
atctggagaataaatgtccaag

SEQ ID NO: 7473917 - DNA, 22 bp, Homo sapiens
atctggagaataaatgtccaag

SEQ ID NO: 7473918 - DNA, 22 bp, Homo sapiens
cttctccagccacgcccactcc

SEQ ID NO: 7473919 - DNA, 22 bp, Homo sapiens
cttctccagccacgcccactcc

SEQ ID NO: 7473920 - DNA, 19 bp, Homo sapiens
cttctccagcttctagaag

SEQ ID NO: 7473921 - DNA, 19 bp, Homo sapiens
cttctccagcttctagaag

SEQ ID NO: 7473922 - DNA, 22 bp, Homo sapiens
cttctccagccacgcccactcc

SEQ ID NO: 7473923 - DNA, 22 bp, Homo sapiens
atgcaggagaccaattggatgg

SEQ ID NO: 7473924 - DNA, 22 bp, Homo sapiens
atgcaggagaccaattggatgg

SEQ ID NO: 7473925 - DNA, 22 bp, Homo sapiens
atgcaggagagcatgtttaaga

SEQ ID NO: 7473926 - DNA, 22 bp, Homo sapiens
atgcaggagagcatgtttaaga

SEQ ID NO: 7473927 - DNA, 22 bp, Homo sapiens
gaaggcaacaccaggatgcact

SEQ ID NO: 7473928 - DNA, 22 bp, Homo sapiens
atgcaggagccctcttgagggc

SEQ ID NO: 7473929 - DNA, 22 bp, Homo sapiens
atgcaggagagcatgtttaaga

SEQ ID NO: 7473930 - DNA, 22 bp, Homo sapiens
atgcaggagccctcttgagggc

SEQ ID NO: 7473931 - DNA, 22 bp, Homo sapiens
atgcaggagccctcttgagggc

SEQ ID NO: 7473932 - DNA, 22 bp, Homo sapiens
atgcaggaggactaaagggatg

SEQ ID NO: 7473933 - DNA, 22 bp, Homo sapiens
atgcaggagttcgaggctgtat

SEQ ID NO: 7473934 - DNA, 22 bp, Homo sapiens
atgcaggagttcgaggctgtat

SEQ ID NO: 7473935 - DNA, 22 bp, Homo sapiens
atgcaggagttcgaggctgtat

SEQ ID NO: 7473936 - DNA, 22 bp, Homo sapiens
atgcaggagttcgaggctgtat

SEQ ID NO: 7473937 - DNA, 22 bp, Homo sapiens
gaaggatttcctatcagttttc

SEQ ID NO: 7473938 - DNA, 22 bp, Homo sapiens
gaaggatttgagattatcctag

SEQ ID NO: 7473939 - DNA, 22 bp, Homo sapiens
gaaggaggtgtcagttggactg

SEQ ID NO: 7473940 - DNA, 22 bp, Homo sapiens
gaaggaggtgtcagttggactg

SEQ ID NO: 7473941 - DNA, 22 bp, Homo sapiens
gaaggaggtgtcagttggactg

SEQ ID NO: 7473942 - DNA, 22 bp, Homo sapiens
gaaggaggtgtcagttggactg

SEQ ID NO: 7473943 - DNA, 22 bp, Homo sapiens
gaaggaggtgtcagttggactg

SEQ ID NO: 7473944 - DNA, 22 bp, Homo sapiens
gaaggaggtctgcattctacag

SEQ ID NO: 7473945 - DNA, 22 bp, Homo sapiens
gaaggaggtctgcattctacag

SEQ ID NO: 7473946 - DNA, 22 bp, Homo sapiens
gaaggaggtctgcattctacag

SEQ ID NO: 7473947 - DNA, 22 bp, Homo sapiens
gaaggaggtctgcattctacag

SEQ ID NO: 7473948 - DNA, 22 bp, Homo sapiens
gaaggagggtgcggatctgagc

SEQ ID NO: 7473949 - DNA, 22 bp, Homo sapiens
gaaggagggagcggcgcggatt

SEQ ID NO: 7473950 - DNA, 22 bp, Homo sapiens
gaaggagggagcggcgcggatt

SEQ ID NO: 7473951 - DNA, 22 bp, Homo sapiens
gaaggagggagcggcgcggatt

SEQ ID NO: 7473952 - DNA, 22 bp, Homo sapiens
gaaggagggagcggcgcggatt

SEQ ID NO: 7473953 - DNA, 22 bp, Homo sapiens
gaaggagggagcggcgcggatt

SEQ ID NO: 7473954 - DNA, 22 bp, Homo sapiens
gaaggagggagcggcgcggatt

SEQ ID NO: 7473955 - DNA, 22 bp, Homo sapiens
gaaggagggtgcggatctgagc

SEQ ID NO: 7473956 - DNA, 22 bp, Homo sapiens
gaaggagggtgcggatctgagc

SEQ ID NO: 7473957 - DNA, 22 bp, Homo sapiens
gaaggagggtgcggatctgagc

SEQ ID NO: 7473958 - DNA, 22 bp, Homo sapiens
gaaggaggtctgatacaatatg

SEQ ID NO: 7473959 - DNA, 22 bp, Homo sapiens
gaaggagggtgcggatctgagc

SEQ ID NO: 7473960 - DNA, 22 bp, Homo sapiens
atgcagtggcagctcctggtgt

SEQ ID NO: 7473961 - DNA, 22 bp, Homo sapiens
atgcagtggcttcagtgtcagt

SEQ ID NO: 7473962 - DNA, 22 bp, Homo sapiens
atgcagtggcttcagtgtcagt

SEQ ID NO: 7473963 - DNA, 22 bp, Homo sapiens
atgcagtggcagctcctggtgt

SEQ ID NO: 7473964 - DNA, 22 bp, Homo sapiens
atgcagtggcagctcctggtgt

SEQ ID NO: 7473965 - DNA, 20 bp, Homo sapiens
atgcagtcttgtggcaacta

SEQ ID NO: 7473966 - DNA, 22 bp, Homo sapiens
atgcagtctaagcatgtaaggg

SEQ ID NO: 7473967 - DNA, 22 bp, Homo sapiens
atgcagtctaagcatgtaaggg

SEQ ID NO: 7473968 - DNA, 22 bp, Homo sapiens
atgcagtgtttggaagcttaag

SEQ ID NO: 7473969 - DNA, 22 bp, Homo sapiens
atgcagttagcagtagctcccc

SEQ ID NO: 7473970 - DNA, 22 bp, Homo sapiens
atgcagttagcactacagaaga

SEQ ID NO: 7473971 - DNA, 22 bp, Homo sapiens
atgcagttagtatacttccagt

SEQ ID NO: 7473972 - DNA, 22 bp, Homo sapiens
atgcagttaggtaatagtctca

SEQ ID NO: 7473973 - DNA, 22 bp, Homo sapiens
atgcagttccacaggcgcatgg

SEQ ID NO: 7473974 - DNA, 22 bp, Homo sapiens
atgcagttatgtgagggcatga

SEQ ID NO: 7473975 - DNA, 22 bp, Homo sapiens
atgcagttatgtgagggcatga

SEQ ID NO: 7473976 - DNA, 22 bp, Homo sapiens
atgcagtacatacaaacactga

SEQ ID NO: 7473977 - DNA, 22 bp, Homo sapiens
atgcagtactgatacatgccac

SEQ ID NO: 7473978 - DNA, 22 bp, Homo sapiens
atgcagtataaatcatttctgg

SEQ ID NO: 7473979 - DNA, 22 bp, Homo sapiens
atgcagtagataggcactttta

SEQ ID NO: 7473980 - DNA, 22 bp, Homo sapiens
atgcagtccacaggccacagtg

SEQ ID NO: 7473981 - DNA, 22 bp, Homo sapiens
atgcagtccaagctctagagtt

SEQ ID NO: 7473982 - DNA, 22 bp, Homo sapiens
atgcagtcatggaatgctctca

SEQ ID NO: 7473983 - DNA, 23 bp, Homo sapiens
atgcagtatatgtcagtagttta

SEQ ID NO: 7473984 - DNA, 22 bp, Homo sapiens
atgcagtaaatgttctagtttg

SEQ ID NO: 7473985 - DNA, 22 bp, Homo sapiens
atgcagtacatacaaacactga

SEQ ID NO: 7473986 - DNA, 22 bp, Homo sapiens
atgcagtacagataattctaca

SEQ ID NO: 7473987 - DNA, 22 bp, Homo sapiens
atgcagtaaatgttaagaaaaa

SEQ ID NO: 7473988 - DNA, 22 bp, Homo sapiens
atgcagtaaatgttaagaaaaa

SEQ ID NO: 7473989 - DNA, 22 bp, Homo sapiens
atgcaggaggactaaagggatg

SEQ ID NO: 7473990 - DNA, 22 bp, Homo sapiens
atgcagtaaatgttaagaaaaa

SEQ ID NO: 7473991 - DNA, 22 bp, Homo sapiens
atgcagtaaaataggaggtaat

SEQ ID NO: 7473992 - DNA, 22 bp, Homo sapiens
atgcaggttgtatctgaagcca

SEQ ID NO: 7473993 - DNA, 22 bp, Homo sapiens
atgcagtaaaataggaggtaat

SEQ ID NO: 7473994 - DNA, 22 bp, Homo sapiens
gaagcgtgcaggtccgtatact

SEQ ID NO: 7473995 - DNA, 22 bp, Homo sapiens
gaagctaaaagagatgtggttt

SEQ ID NO: 7473996 - DNA, 22 bp, Homo sapiens
gaagctaaaccacagctaagaa

SEQ ID NO: 7473997 - DNA, 22 bp, Homo sapiens
gaagccttgaactgcaaacccc

SEQ ID NO: 7473998 - DNA, 22 bp, Homo sapiens
gaagcctttcgtgcacctcacc

SEQ ID NO: 7473999 - DNA, 22 bp, Homo sapiens
gaagcctgtggataggggcatc

SEQ ID NO: 7474000 - DNA, 22 bp, Homo sapiens
gaagccttatcagtcacttata

SEQ ID NO: 7474001 - DNA, 22 bp, Homo sapiens
gaagccttatcagtcacttata

SEQ ID NO: 7474002 - DNA, 22 bp, Homo sapiens
gaagccttgaactgcaaacccc

SEQ ID NO: 7474003 - DNA, 22 bp, Homo sapiens
gaagccttgaactgcaaacccc

SEQ ID NO: 7474004 - DNA, 22 bp, Homo sapiens
gaagccttgaactgcaaacccc

SEQ ID NO: 7474005 - DNA, 22 bp, Homo sapiens
gaagccttgaactgcaaacccc

SEQ ID NO: 7474006 - DNA, 22 bp, Homo sapiens
gaagccttgaactgcaaacccc

SEQ ID NO: 7474007 - DNA, 22 bp, Homo sapiens
gaagccttgaactgcaaacccc

SEQ ID NO: 7474008 - DNA, 22 bp, Homo sapiens
gaagcagcaaatctgcagtatc

SEQ ID NO: 7474009 - DNA, 22 bp, Homo sapiens
gaagcagcaaatctgcagtatc

SEQ ID NO: 7474010 - DNA, 22 bp, Homo sapiens
gaagcagcaagtataggacagg

SEQ ID NO: 7474011 - DNA, 22 bp, Homo sapiens
gaagcagcagctggggacagtt

SEQ ID NO: 7474012 - DNA, 22 bp, Homo sapiens
gaagcagcaagtataggacagg

SEQ ID NO: 7474013 - DNA, 22 bp, Homo sapiens
gaagcctgacactggccatcag

SEQ ID NO: 7474014 - DNA, 22 bp, Homo sapiens
gaagcctgacactggccatcag

SEQ ID NO: 7474015 - DNA, 22 bp, Homo sapiens
gaagcctgacactggccatcag

SEQ ID NO: 7474016 - DNA, 22 bp, Homo sapiens
gaagcctgctgtgcagccaaat

SEQ ID NO: 7474017 - DNA, 22 bp, Homo sapiens
gaagcctgctgtgcagccaaat

SEQ ID NO: 7474018 - DNA, 22 bp, Homo sapiens
gaagcctggtccagagctccca

SEQ ID NO: 7474019 - DNA, 22 bp, Homo sapiens
gaagcctggtccagagctccca

SEQ ID NO: 7474020 - DNA, 22 bp, Homo sapiens
gaagcctggtccagagctccca

SEQ ID NO: 7474021 - DNA, 22 bp, Homo sapiens
gaagcctggtccagagctccca

SEQ ID NO: 7474022 - DNA, 22 bp, Homo sapiens
gaagcctggagaccagatgttg

SEQ ID NO: 7474023 - DNA, 22 bp, Homo sapiens
gaagcctgggagggctgggcta

SEQ ID NO: 7474024 - DNA, 22 bp, Homo sapiens
gaagcctgggagggctgggcta

SEQ ID NO: 7474025 - DNA, 22 bp, Homo sapiens
gaagcctggtccagagctccca

SEQ ID NO: 7474026 - DNA, 22 bp, Homo sapiens
gaagcctggttcgctggccacc

SEQ ID NO: 7474027 - DNA, 22 bp, Homo sapiens
gaagcctggttcgctggccacc

SEQ ID NO: 7474028 - DNA, 22 bp, Homo sapiens
gaagcctggttcgctggccacc

SEQ ID NO: 7474029 - DNA, 22 bp, Homo sapiens
gaagcctgtcacttcccttgct

SEQ ID NO: 7474030 - DNA, 22 bp, Homo sapiens
gaagcctgtcacttcccttgct

SEQ ID NO: 7474031 - DNA, 22 bp, Homo sapiens
gaagcctgtcatgtgacgctga

SEQ ID NO: 7474032 - DNA, 22 bp, Homo sapiens
gaagcctgtggataggggcatc

SEQ ID NO: 7474033 - DNA, 22 bp, Homo sapiens
gaagctgcaataattgttttga

SEQ ID NO: 7474034 - DNA, 22 bp, Homo sapiens
gaagctgatgaggaccagattg

SEQ ID NO: 7474035 - DNA, 22 bp, Homo sapiens
gaagctgcgtgtagccatactt

SEQ ID NO: 7474036 - DNA, 22 bp, Homo sapiens
gaagctgcgtgtagccatactt

SEQ ID NO: 7474037 - DNA, 22 bp, Homo sapiens
gaagctggagaatgggtctagg

SEQ ID NO: 7474038 - DNA, 22 bp, Homo sapiens
gaagctggagaatgggtctagg

SEQ ID NO: 7474039 - DNA, 22 bp, Homo sapiens
gaagctgatgaggaccagattg

SEQ ID NO: 7474040 - DNA, 22 bp, Homo sapiens
gaagctgatgaggaccagattg

SEQ ID NO: 7474041 - DNA, 22 bp, Homo sapiens
gaagctgagtggactctggcca

SEQ ID NO: 7474042 - DNA, 22 bp, Homo sapiens
gaagctgagctgaggcatgttg

SEQ ID NO: 7474043 - DNA, 22 bp, Homo sapiens
gaagctccgtactatgactttt

SEQ ID NO: 7474044 - DNA, 22 bp, Homo sapiens
gaagctaggctggggttcagga

SEQ ID NO: 7474045 - DNA, 22 bp, Homo sapiens
gaagctctaaggtcattgcatt

SEQ ID NO: 7474046 - DNA, 22 bp, Homo sapiens
gaagctccgtactatgactttt

SEQ ID NO: 7474047 - DNA, 22 bp, Homo sapiens
gaagctctggacagtgaagaag

SEQ ID NO: 7474048 - DNA, 22 bp, Homo sapiens
gaagctctggacagtgaagaag

SEQ ID NO: 7474049 - DNA, 22 bp, Homo sapiens
gaagctctaaggtcattgcatt

SEQ ID NO: 7474050 - DNA, 22 bp, Homo sapiens
gaagctctcaaactctcccctt

SEQ ID NO: 7474051 - DNA, 22 bp, Homo sapiens
gaagctctcaacaatggggagt

SEQ ID NO: 7474052 - DNA, 22 bp, Homo sapiens
gaagctctggacagtgaagaag

SEQ ID NO: 7474053 - DNA, 22 bp, Homo sapiens
gaagctggggtgctgagggcaa

SEQ ID NO: 7474054 - DNA, 22 bp, Homo sapiens
gaagctggggtgctgagggcaa

SEQ ID NO: 7474055 - DNA, 22 bp, Homo sapiens
gaagctggagaatgggtctagg

SEQ ID NO: 7474056 - DNA, 22 bp, Homo sapiens
gaaggagctactaataagaggg

SEQ ID NO: 7474057 - DNA, 22 bp, Homo sapiens
gaaggagctactaataagaggg

SEQ ID NO: 7474058 - DNA, 22 bp, Homo sapiens
gaagctgtgctgggggatctgt

SEQ ID NO: 7474059 - DNA, 22 bp, Homo sapiens
gaagctgggtcgctgggatcct

SEQ ID NO: 7474060 - DNA, 22 bp, Homo sapiens
gaagctgggtcgctgggatcct

SEQ ID NO: 7474061 - DNA, 22 bp, Homo sapiens
gaagctgggtcgctgggatcct

SEQ ID NO: 7474062 - DNA, 22 bp, Homo sapiens
gaaggaggcgttagccctagga

SEQ ID NO: 7474063 - DNA, 22 bp, Homo sapiens
gaaggaggcgttagccctagga

SEQ ID NO: 7474064 - DNA, 22 bp, Homo sapiens
gaaggaggctccccaaagtctg

SEQ ID NO: 7474065 - DNA, 22 bp, Homo sapiens
gaaggaggctccccaaagtctg

SEQ ID NO: 7474066 - DNA, 22 bp, Homo sapiens
gaaggaggctccccaaagtctg

SEQ ID NO: 7474067 - DNA, 22 bp, Homo sapiens
gaaggaggcgttagccctagga

SEQ ID NO: 7474068 - DNA, 22 bp, Homo sapiens
gaaggaggcgttagccctagga

SEQ ID NO: 7474069 - DNA, 22 bp, Homo sapiens
gaaggaggcgttagccctagga

SEQ ID NO: 7474070 - DNA, 22 bp, Homo sapiens
gaaggaggcgttagccctagga

SEQ ID NO: 7474071 - DNA, 22 bp, Homo sapiens
gaaggaggcgttagccctagga

SEQ ID NO: 7474072 - DNA, 22 bp, Homo sapiens
gaaggaggcgttagccctagga

SEQ ID NO: 7474073 - DNA, 22 bp, Homo sapiens
gaaggaggcgttagccctagga

SEQ ID NO: 7474074 - DNA, 22 bp, Homo sapiens
gaaggaggcgttagccctagga

SEQ ID NO: 7474075 - DNA, 22 bp, Homo sapiens
gaagagcatatgaagagcatat

SEQ ID NO: 7474076 - DNA, 22 bp, Homo sapiens
gaagagcatttgcccaggctgt

SEQ ID NO: 7474077 - DNA, 22 bp, Homo sapiens
gaagagcatttgcccaggctgt

SEQ ID NO: 7474078 - DNA, 22 bp, Homo sapiens
gaagagcatttgcccaggctgt

SEQ ID NO: 7474079 - DNA, 22 bp, Homo sapiens
gaagagcatatgaagagcatat

SEQ ID NO: 7474080 - DNA, 22 bp, Homo sapiens
gaagagatgacaaaggagcatg

SEQ ID NO: 7474081 - DNA, 22 bp, Homo sapiens
gaagagcatatgaagagcatat

SEQ ID NO: 7474082 - DNA, 22 bp, Homo sapiens
gaagagcatatgaagagcatat

SEQ ID NO: 7474083 - DNA, 22 bp, Homo sapiens
gaagagcatatgaagagcatat

SEQ ID NO: 7474084 - DNA, 22 bp, Homo sapiens
gaagagcatatgaagagcatat

SEQ ID NO: 7474085 - DNA, 21 bp, Homo sapiens
gaagagagtcctcatcctgag

SEQ ID NO: 7474086 - DNA, 21 bp, Homo sapiens
gaagagagtcctcatcctgag

SEQ ID NO: 7474087 - DNA, 22 bp, Homo sapiens
gaagagatgacaaaggagcatg

SEQ ID NO: 7474088 - DNA, 21 bp, Homo sapiens
gaagagagtcctcatcctgag

SEQ ID NO: 7474089 - DNA, 22 bp, Homo sapiens
gaagagatgacaaaggagcatg

SEQ ID NO: 7474090 - DNA, 22 bp, Homo sapiens
gaagagatgacaaaggagcatg

SEQ ID NO: 7474091 - DNA, 22 bp, Homo sapiens
gaagagatgacaaaggagcatg

SEQ ID NO: 7474092 - DNA, 22 bp, Homo sapiens
gaagagatgacaaaggagcatg

SEQ ID NO: 7474093 - DNA, 22 bp, Homo sapiens
gaagagctaaaggcacaggctt

SEQ ID NO: 7474094 - DNA, 22 bp, Homo sapiens
atgatggaggccgtgatggacg

SEQ ID NO: 7474095 - DNA, 22 bp, Homo sapiens
gaagagctaaaggcacaggctt

SEQ ID NO: 7474096 - DNA, 22 bp, Homo sapiens
gaagagccaggtgtcgctgtgg

SEQ ID NO: 7474097 - DNA, 22 bp, Homo sapiens
atgatggatgtcacagtctgta

SEQ ID NO: 7474098 - DNA, 22 bp, Homo sapiens
atgatggatatgtaaagtgttg

SEQ ID NO: 7474099 - DNA, 22 bp, Homo sapiens
atgatggatatgtaaagtgttg

SEQ ID NO: 7474100 - DNA, 22 bp, Homo sapiens
atgatggaggtgtcctggattt

SEQ ID NO: 7474101 - DNA, 22 bp, Homo sapiens
atgatgtaaaataagttgtgag

SEQ ID NO: 7474102 - DNA, 22 bp, Homo sapiens
atgatgtaaaataagttgtgag

SEQ ID NO: 7474103 - DNA, 22 bp, Homo sapiens
atgatggtgggtaatgtgtaaa

SEQ ID NO: 7474104 - DNA, 22 bp, Homo sapiens
atgatggtgaggttgagcacag

SEQ ID NO: 7474105 - DNA, 19 bp, Homo sapiens
atgatggtcccattcacct

SEQ ID NO: 7474106 - DNA, 22 bp, Homo sapiens
atgatggtaaattcagtatccg

SEQ ID NO: 7474107 - DNA, 22 bp, Homo sapiens
atgatggtaaattcagtatccg

SEQ ID NO: 7474108 - DNA, 22 bp, Homo sapiens
atgatggctaggctggttttga

SEQ ID NO: 7474109 - DNA, 22 bp, Homo sapiens
atgatggctaggctggttttga

SEQ ID NO: 7474110 - DNA, 22 bp, Homo sapiens
atgatggctaggctggttttga

SEQ ID NO: 7474111 - DNA, 19 bp, Homo sapiens
atgatggattaacggaagt

SEQ ID NO: 7474112 - DNA, 22 bp, Homo sapiens
atgatggctaggctggttttga

SEQ ID NO: 7474113 - DNA, 22 bp, Homo sapiens
atgatgtaagggtaattgtcta

SEQ ID NO: 7474114 - DNA, 22 bp, Homo sapiens
atgatgtaagggtaattgtcta

SEQ ID NO: 7474115 - DNA, 22 bp, Homo sapiens
atgatgtaacataaagatgtct

SEQ ID NO: 7474116 - DNA, 22 bp, Homo sapiens
atgatgtaacataaagatgtct

SEQ ID NO: 7474117 - DNA, 22 bp, Homo sapiens
atgatgtaaatagagcctaggt

SEQ ID NO: 7474118 - DNA, 22 bp, Homo sapiens
atgatgtaatggaaagaacaga

SEQ ID NO: 7474119 - DNA, 22 bp, Homo sapiens
atgatgtacagaaagttggcgg

SEQ ID NO: 7474120 - DNA, 22 bp, Homo sapiens
atgatgtaagggtaattgtcta

SEQ ID NO: 7474121 - DNA, 22 bp, Homo sapiens
atgatgtagtgacttggcagag

SEQ ID NO: 7474122 - DNA, 22 bp, Homo sapiens
atgatgtatgactgtgttcaaa

SEQ ID NO: 7474123 - DNA, 22 bp, Homo sapiens
atgatgtagacaaaaatatgct

SEQ ID NO: 7474124 - DNA, 20 bp, Homo sapiens
atgatgtcagtggcggaggt

SEQ ID NO: 7474125 - DNA, 22 bp, Homo sapiens
atgatgtatgactgtgttcaaa

SEQ ID NO: 7474126 - DNA, 22 bp, Homo sapiens
atgatgtcactcttctgcctaa

SEQ ID NO: 7474127 - DNA, 22 bp, Homo sapiens
atgatgtagacaaaaatatgct

SEQ ID NO: 7474128 - DNA, 22 bp, Homo sapiens
atgatgtactagttaaatatta

SEQ ID NO: 7474129 - DNA, 22 bp, Homo sapiens
atgatgtaccactttctcagtt

SEQ ID NO: 7474130 - DNA, 22 bp, Homo sapiens
atgatgtactagttaaatatta

SEQ ID NO: 7474131 - DNA, 17 bp, Homo sapiens
atgattacatctttcct

SEQ ID NO: 7474132 - DNA, 23 bp, Homo sapiens
gaagcagatgtctgagtaggcag

SEQ ID NO: 7474133 - DNA, 22 bp, Homo sapiens
atgatgttgataaattacttta

SEQ ID NO: 7474134 - DNA, 22 bp, Homo sapiens
atgatgtcatagtgtcagcagt

SEQ ID NO: 7474135 - DNA, 22 bp, Homo sapiens
atgatgtcattcttgtttgctc

SEQ ID NO: 7474136 - DNA, 22 bp, Homo sapiens
atgatgttaccagtacttagag

SEQ ID NO: 7474137 - DNA, 22 bp, Homo sapiens
atgatgtctggaggcatgctgt

SEQ ID NO: 7474138 - DNA, 22 bp, Homo sapiens
atgatgtgtgctgatcaagctt

SEQ ID NO: 7474139 - DNA, 22 bp, Homo sapiens
gaagagaaggtgtaggccatcc

SEQ ID NO: 7474140 - DNA, 22 bp, Homo sapiens
gaagagagaacattacataaac

SEQ ID NO: 7474141 - DNA, 22 bp, Homo sapiens
gaagagagaacattacataaac

SEQ ID NO: 7474142 - DNA, 22 bp, Homo sapiens
gaagaaatgtgttcaaggtagg

SEQ ID NO: 7474143 - DNA, 22 bp, Homo sapiens
gaagaaatgtgttcaaggtagg

SEQ ID NO: 7474144 - DNA, 22 bp, Homo sapiens
gaagagaaggtgtaggccatcc

SEQ ID NO: 7474145 - DNA, 22 bp, Homo sapiens
gaagaaatgtgttcaaggtagg

SEQ ID NO: 7474146 - DNA, 22 bp, Homo sapiens
gaagaaagggaattaacttgag

SEQ ID NO: 7474147 - DNA, 22 bp, Homo sapiens
gaagaaagggaattaacttgag

SEQ ID NO: 7474148 - DNA, 22 bp, Homo sapiens
gaagaaagggaattaacttgag

SEQ ID NO: 7474149 - DNA, 22 bp, Homo sapiens
gaagaaatgtgttcaaggtagg

SEQ ID NO: 7474150 - DNA, 22 bp, Homo sapiens
gaagaaatgtgttcaaggtagg

SEQ ID NO: 7474151 - DNA, 22 bp, Homo sapiens
gaagaaatgtgttcaaggtagg

SEQ ID NO: 7474152 - DNA, 22 bp, Homo sapiens
gaagaaagggaattaacttgag

SEQ ID NO: 7474153 - DNA, 22 bp, Homo sapiens
gaagagagagccctggggtccg

SEQ ID NO: 7474154 - DNA, 22 bp, Homo sapiens
gaagagagagccctggggtccg

SEQ ID NO: 7474155 - DNA, 22 bp, Homo sapiens
gaagagagagccctggggtccg

SEQ ID NO: 7474156 - DNA, 22 bp, Homo sapiens
gaagagagaacattacataaac

SEQ ID NO: 7474157 - DNA, 22 bp, Homo sapiens
gaagagagagccctggggtccg

SEQ ID NO: 7474158 - DNA, 22 bp, Homo sapiens
gaagagagagccctggggtccg

SEQ ID NO: 7474159 - DNA, 22 bp, Homo sapiens
gaagagagagccctggggtccg

SEQ ID NO: 7474160 - DNA, 22 bp, Homo sapiens
gaagagagaacattacataaac

SEQ ID NO: 7474161 - DNA, 22 bp, Homo sapiens
gaagagagagccctggggtccg

SEQ ID NO: 7474162 - DNA, 22 bp, Homo sapiens
gaagagagccgcgggacatcag

SEQ ID NO: 7474163 - DNA, 22 bp, Homo sapiens
gaagagagcagcaaactggagt

SEQ ID NO: 7474164 - DNA, 22 bp, Homo sapiens
gaagagagccgcgggacatcag

SEQ ID NO: 7474165 - DNA, 22 bp, Homo sapiens
gaagagagccgcgggacatcag

SEQ ID NO: 7474166 - DNA, 22 bp, Homo sapiens
gaagagagccgcgggacatcag

SEQ ID NO: 7474167 - DNA, 22 bp, Homo sapiens
gaagagagccgcgggacatcag

SEQ ID NO: 7474168 - DNA, 22 bp, Homo sapiens
gaagagagccgcgggacatcag

SEQ ID NO: 7474169 - DNA, 22 bp, Homo sapiens
gaagagagccgcgggacatcag

SEQ ID NO: 7474170 - DNA, 21 bp, Homo sapiens
gaagagagtcctcatcctgag

SEQ ID NO: 7474171 - DNA, 21 bp, Homo sapiens
gaagagagtcctcatcctgag

SEQ ID NO: 7474172 - DNA, 21 bp, Homo sapiens
gaagagagtcctcatcctgag

SEQ ID NO: 7474173 - DNA, 22 bp, Homo sapiens
gaagagagagccctggggtccg

SEQ ID NO: 7474174 - DNA, 22 bp, Homo sapiens
gaagagagagtggggttctgcg

SEQ ID NO: 7474175 - DNA, 22 bp, Homo sapiens
gaagagagagtggggttctgcg

SEQ ID NO: 7474176 - DNA, 22 bp, Homo sapiens
gaagagagagtggggttctgcg

SEQ ID NO: 7474177 - DNA, 22 bp, Homo sapiens
gaagagagcagcaaactggagt

SEQ ID NO: 7474178 - DNA, 22 bp, Homo sapiens
gaagagagcagcaaactggagt

SEQ ID NO: 7474179 - DNA, 22 bp, Homo sapiens
gaagagagcagcaaactggagt

SEQ ID NO: 7474180 - DNA, 22 bp, Homo sapiens
atgagcatatgggaggagtact

SEQ ID NO: 7474181 - DNA, 22 bp, Homo sapiens
atgagcagtttttaagtagcaa

SEQ ID NO: 7474182 - DNA, 22 bp, Homo sapiens
atgagcagtttttaagtagcaa

SEQ ID NO: 7474183 - DNA, 22 bp, Homo sapiens
atgagcatctgacatttaaaac

SEQ ID NO: 7474184 - DNA, 22 bp, Homo sapiens
atgagcatctgacatttaaaac

SEQ ID NO: 7474185 - DNA, 22 bp, Homo sapiens
atgagcatctgacatttaaaac

SEQ ID NO: 7474186 - DNA, 22 bp, Homo sapiens
atgagcaggtttaagagaggcc

SEQ ID NO: 7474187 - DNA, 22 bp, Homo sapiens
atgagcaggtttaagagaggcc

SEQ ID NO: 7474188 - DNA, 19 bp, Homo sapiens
atgagcaggcaagacaagc

SEQ ID NO: 7474189 - DNA, 19 bp, Homo sapiens
atgagcaggcaagacaagc

SEQ ID NO: 7474190 - DNA, 19 bp, Homo sapiens
atgagcaggcaagacaagc

SEQ ID NO: 7474191 - DNA, 19 bp, Homo sapiens
atgagcaggcaagacaagc

SEQ ID NO: 7474192 - DNA, 22 bp, Homo sapiens
atgagcagtaggttcatggctg

SEQ ID NO: 7474193 - DNA, 22 bp, Homo sapiens
atgagcaggtttaagagaggcc

SEQ ID NO: 7474194 - DNA, 22 bp, Homo sapiens
atgagcaggtttaagagaggcc

SEQ ID NO: 7474195 - DNA, 22 bp, Homo sapiens
atgagcagtttttaagtagcaa

SEQ ID NO: 7474196 - DNA, 22 bp, Homo sapiens
atgagcagtaggttcatggctg

SEQ ID NO: 7474197 - DNA, 22 bp, Homo sapiens
atgagctgggccatccagtgat

SEQ ID NO: 7474198 - DNA, 22 bp, Homo sapiens
atgagctgggccatccagtgat

SEQ ID NO: 7474199 - DNA, 22 bp, Homo sapiens
gaagaaagggaattaacttgag

SEQ ID NO: 7474200 - DNA, 22 bp, Homo sapiens
atgagctgtaaggtggcttcct

SEQ ID NO: 7474201 - DNA, 22 bp, Homo sapiens
atgagcatccagaacagtgcct

SEQ ID NO: 7474202 - DNA, 22 bp, Homo sapiens
atgagccctggaggcatttttt

SEQ ID NO: 7474203 - DNA, 22 bp, Homo sapiens
atgagctaagcagaaagcacac

SEQ ID NO: 7474204 - DNA, 22 bp, Homo sapiens
atgagctagaaaaccatgtgga

SEQ ID NO: 7474205 - DNA, 22 bp, Homo sapiens
atgagctagaaaaccatgtgga

SEQ ID NO: 7474206 - DNA, 22 bp, Homo sapiens
atgagctagaaaaccatgtgga

SEQ ID NO: 7474207 - DNA, 22 bp, Homo sapiens
atgagctagaaaaccatgtgga

SEQ ID NO: 7474208 - DNA, 22 bp, Homo sapiens
atgagctcatccgagtcacact

SEQ ID NO: 7474209 - DNA, 22 bp, Homo sapiens
atgagctgagtttgtaagtctt

SEQ ID NO: 7474210 - DNA, 22 bp, Homo sapiens
atgagctcatccgagtcacact

SEQ ID NO: 7474211 - DNA, 22 bp, Homo sapiens
gaattttaataaaggtttatca

SEQ ID NO: 7474212 - DNA, 22 bp, Homo sapiens
gaattttaataaaggtttatca

SEQ ID NO: 7474213 - DNA, 22 bp, Homo sapiens
gaattttaataaaggtttatca

SEQ ID NO: 7474214 - DNA, 22 bp, Homo sapiens
gaattttaataaaggtttatca

SEQ ID NO: 7474215 - DNA, 22 bp, Homo sapiens
gaatttgtcccttgatataaaa

SEQ ID NO: 7474216 - DNA, 22 bp, Homo sapiens
gaatttgtcccttgatataaaa

SEQ ID NO: 7474217 - DNA, 22 bp, Homo sapiens
gaatttgtgctcaggaagatta

SEQ ID NO: 7474218 - DNA, 22 bp, Homo sapiens
gaatttgtgctcaggaagatta

SEQ ID NO: 7474219 - DNA, 22 bp, Homo sapiens
gaattttaagtgttcgcctctt

SEQ ID NO: 7474220 - DNA, 22 bp, Homo sapiens
gaattttaagtgttcgcctctt

SEQ ID NO: 7474221 - DNA, 22 bp, Homo sapiens
gaattttagaatatgtgggctt

SEQ ID NO: 7474222 - DNA, 22 bp, Homo sapiens
atgcctggactgtatcccagat

SEQ ID NO: 7474223 - DNA, 22 bp, Homo sapiens
atgcctggactgtatcccagat

SEQ ID NO: 7474224 - DNA, 22 bp, Homo sapiens
atgcctggactgtatcccagat

SEQ ID NO: 7474225 - DNA, 19 bp, Homo sapiens
gaattttaggacttcagca

SEQ ID NO: 7474226 - DNA, 19 bp, Homo sapiens
gaattttaggacttcagca

SEQ ID NO: 7474227 - DNA, 19 bp, Homo sapiens
gaattttaggacttcagca

SEQ ID NO: 7474228 - DNA, 19 bp, Homo sapiens
gaattttaggacttcagca

SEQ ID NO: 7474229 - DNA, 22 bp, Homo sapiens
gaatttggatctttgatagagt

SEQ ID NO: 7474230 - DNA, 22 bp, Homo sapiens
gaatttgctttcgtgacagggt

SEQ ID NO: 7474231 - DNA, 22 bp, Homo sapiens
gaatttggatctttgatagagt

SEQ ID NO: 7474232 - DNA, 22 bp, Homo sapiens
gaatttggatctttgatagagt

SEQ ID NO: 7474233 - DNA, 22 bp, Homo sapiens
gaatttggatctttgatagagt

SEQ ID NO: 7474234 - DNA, 22 bp, Homo sapiens
gaatttcatttgtttcctacca

SEQ ID NO: 7474235 - DNA, 22 bp, Homo sapiens
gaatttcctctaaacccctgag

SEQ ID NO: 7474236 - DNA, 22 bp, Homo sapiens
gaatttcctctaaacccctgag

SEQ ID NO: 7474237 - DNA, 22 bp, Homo sapiens
gaatttcattgctctgctgtgt

SEQ ID NO: 7474238 - DNA, 22 bp, Homo sapiens
gaatttcagggtctggtaggaa

SEQ ID NO: 7474239 - DNA, 22 bp, Homo sapiens
gaatttcaggacaactggaagg

SEQ ID NO: 7474240 - DNA, 22 bp, Homo sapiens
atgctacagagtttgaatatgt

SEQ ID NO: 7474241 - DNA, 22 bp, Homo sapiens
atgctacagcatctctcatcag

SEQ ID NO: 7474242 - DNA, 22 bp, Homo sapiens
atgctacagcatctctcatcag

SEQ ID NO: 7474243 - DNA, 22 bp, Homo sapiens
atgctacagagataggttgggt

SEQ ID NO: 7474244 - DNA, 22 bp, Homo sapiens
atgctacaacattatctggggt

SEQ ID NO: 7474245 - DNA, 22 bp, Homo sapiens
atgctacactatttgctgagca

SEQ ID NO: 7474246 - DNA, 23 bp, Homo sapiens
atgctacaccaacacaggggaat

SEQ ID NO: 7474247 - DNA, 22 bp, Homo sapiens
atgctaaggcccaggagaaaat

SEQ ID NO: 7474248 - DNA, 22 bp, Homo sapiens
atgctaaggcccaggagaaaat

SEQ ID NO: 7474249 - DNA, 22 bp, Homo sapiens
atgctaaggcccaggagaaaat

SEQ ID NO: 7474250 - DNA, 22 bp, Homo sapiens
atgctaaattcagacagggtta

SEQ ID NO: 7474251 - DNA, 22 bp, Homo sapiens
atgctaaggcccaggagaaaat

SEQ ID NO: 7474252 - DNA, 22 bp, Homo sapiens
atgctaaatgttaatgttacct

SEQ ID NO: 7474253 - DNA, 22 bp, Homo sapiens
atgctaaatgttaatgttacct

SEQ ID NO: 7474254 - DNA, 22 bp, Homo sapiens
atgctaaactatgatcattttc

SEQ ID NO: 7474255 - DNA, 22 bp, Homo sapiens
atgctaaactatgatcattttc

SEQ ID NO: 7474256 - DNA, 22 bp, Homo sapiens
atgctaaactatgatcattttc

SEQ ID NO: 7474257 - DNA, 22 bp, Homo sapiens
atgcctggatttgggactcaaa

SEQ ID NO: 7474258 - DNA, 22 bp, Homo sapiens
atgcctggatttgggactcaaa

SEQ ID NO: 7474259 - DNA, 22 bp, Homo sapiens
atgcctggtatgaagcaaggaa

SEQ ID NO: 7474260 - DNA, 22 bp, Homo sapiens
atgcctggatttgggactcaaa

SEQ ID NO: 7474261 - DNA, 22 bp, Homo sapiens
atgcctggatttgggactcaaa

SEQ ID NO: 7474262 - DNA, 22 bp, Homo sapiens
atgctaaagctttgctttcatt

SEQ ID NO: 7474263 - DNA, 22 bp, Homo sapiens
atgctaaaggggtaggcctcct

SEQ ID NO: 7474264 - DNA, 22 bp, Homo sapiens
atgctaaatccagaagcagtca

SEQ ID NO: 7474265 - DNA, 22 bp, Homo sapiens
atgctaaataactggtttgact

SEQ ID NO: 7474266 - DNA, 22 bp, Homo sapiens
atgctaaatgctgggggtacat

SEQ ID NO: 7474267 - DNA, 22 bp, Homo sapiens
atgctaaatggccagtaccaaa

SEQ ID NO: 7474268 - DNA, 22 bp, Homo sapiens
gacagcttagtgaaaatgtaaa

SEQ ID NO: 7474269 - DNA, 22 bp, Homo sapiens
gacagcttagtgaaaatgtaaa

SEQ ID NO: 7474270 - DNA, 22 bp, Homo sapiens
atgctatagaaatatttaaatt

SEQ ID NO: 7474271 - DNA, 22 bp, Homo sapiens
gacagcttaggaagtttctatt

SEQ ID NO: 7474272 - DNA, 22 bp, Homo sapiens
gacagcttcgaggaggtgagct

SEQ ID NO: 7474273 - DNA, 22 bp, Homo sapiens
gacagcttcgaggaggtgagct

SEQ ID NO: 7474274 - DNA, 22 bp, Homo sapiens
gacagcttagtgaaaatgtaaa

SEQ ID NO: 7474275 - DNA, 22 bp, Homo sapiens
gacagcttagtgaaaatgtaaa

SEQ ID NO: 7474276 - DNA, 22 bp, Homo sapiens
gacagcttcgaggaggtgagct

SEQ ID NO: 7474277 - DNA, 22 bp, Homo sapiens
atgctatagaaatatttaaatt

SEQ ID NO: 7474278 - DNA, 22 bp, Homo sapiens
atgctatagaaatatttaaatt

SEQ ID NO: 7474279 - DNA, 22 bp, Homo sapiens
atgctatagaaatatttaaatt

SEQ ID NO: 7474280 - DNA, 22 bp, Homo sapiens
atgctatagaaatatttaaatt

SEQ ID NO: 7474281 - DNA, 22 bp, Homo sapiens
atgctatgtaactggcagatag

SEQ ID NO: 7474282 - DNA, 22 bp, Homo sapiens
atgctatactcaaagaaattca

SEQ ID NO: 7474283 - DNA, 22 bp, Homo sapiens
atgctatactcaaagaaattca

SEQ ID NO: 7474284 - DNA, 22 bp, Homo sapiens
atgctatacatatgacatcaca

SEQ ID NO: 7474285 - DNA, 22 bp, Homo sapiens
atgctatagaaatatttaaatt

SEQ ID NO: 7474286 - DNA, 22 bp, Homo sapiens
atgctatactcaaagaaattca

SEQ ID NO: 7474287 - DNA, 22 bp, Homo sapiens
atgctatactcaaagaaattca

SEQ ID NO: 7474288 - DNA, 22 bp, Homo sapiens
atgctatactcaaagaaattca

SEQ ID NO: 7474289 - DNA, 22 bp, Homo sapiens
atgctacattttggtttataaa

SEQ ID NO: 7474290 - DNA, 22 bp, Homo sapiens
atgctacatagatacaaaaatg

SEQ ID NO: 7474291 - DNA, 22 bp, Homo sapiens
atgctacattttggtttataaa

SEQ ID NO: 7474292 - DNA, 22 bp, Homo sapiens
atgctactatccttctgcttaa

SEQ ID NO: 7474293 - DNA, 22 bp, Homo sapiens
atgctataaactctaggtcatt

SEQ ID NO: 7474294 - DNA, 22 bp, Homo sapiens
atgctataaactctaggtcatt

SEQ ID NO: 7474295 - DNA, 22 bp, Homo sapiens
atgctacagccctctttgcata

SEQ ID NO: 7474296 - DNA, 22 bp, Homo sapiens
atgctacagcatctctcatcag

SEQ ID NO: 7474297 - DNA, 22 bp, Homo sapiens
atgctacagccctctttgcata

SEQ ID NO: 7474298 - DNA, 22 bp, Homo sapiens
atgctacaggagccccacttag

SEQ ID NO: 7474299 - DNA, 22 bp, Homo sapiens
atgctacaggattctccttatc

SEQ ID NO: 7474300 - DNA, 22 bp, Homo sapiens
atgctacatagatacaaaaatg

SEQ ID NO: 7474301 - DNA, 18 bp, Homo sapiens
atgctacaggcaggtgtc

SEQ ID NO: 7474302 - DNA, 20 bp, Homo sapiens
gacagcttggggtgtcacct

SEQ ID NO: 7474303 - DNA, 22 bp, Homo sapiens
gacagcttgcctggtactgcaa

SEQ ID NO: 7474304 - DNA, 22 bp, Homo sapiens
gacaggaaacaagaaggcagga

SEQ ID NO: 7474305 - DNA, 22 bp, Homo sapiens
gacaggaaaggggtctgttttc

SEQ ID NO: 7474306 - DNA, 22 bp, Homo sapiens
gacaggaaacaagaaggcagga

SEQ ID NO: 7474307 - DNA, 22 bp, Homo sapiens
gacaggaaacaagaaggcagga

SEQ ID NO: 7474308 - DNA, 22 bp, Homo sapiens
gacaggaaacaagaaggcagga

SEQ ID NO: 7474309 - DNA, 22 bp, Homo sapiens
gacagcttctagaaatggtcac

SEQ ID NO: 7474310 - DNA, 22 bp, Homo sapiens
gacagcttctagaaatggtcac

SEQ ID NO: 7474311 - DNA, 22 bp, Homo sapiens
gacagcttctagaaatggtcac

SEQ ID NO: 7474312 - DNA, 22 bp, Homo sapiens
gacagcttctagaggaattggt

SEQ ID NO: 7474313 - DNA, 22 bp, Homo sapiens
gacagcttctagaggaattggt

SEQ ID NO: 7474314 - DNA, 22 bp, Homo sapiens
gacagcttctatgtgacgagca

SEQ ID NO: 7474315 - DNA, 22 bp, Homo sapiens
gacagcttcttgggccgggcct

SEQ ID NO: 7474316 - DNA, 22 bp, Homo sapiens
gacagcttctatgtgacgagca

SEQ ID NO: 7474317 - DNA, 22 bp, Homo sapiens
gacagcttgcctggtactgcaa

SEQ ID NO: 7474318 - DNA, 16 bp, Homo sapiens
atgctgctattagagg

SEQ ID NO: 7474319 - DNA, 16 bp, Homo sapiens
atgctgctattagagg

SEQ ID NO: 7474320 - DNA, 16 bp, Homo sapiens
atgctgctattagagg

SEQ ID NO: 7474321 - DNA, 22 bp, Homo sapiens
atgctcttgaggctaaagacat

SEQ ID NO: 7474322 - DNA, 16 bp, Homo sapiens
atgctgctattagagg

SEQ ID NO: 7474323 - DNA, 16 bp, Homo sapiens
atgctgctattagagg

SEQ ID NO: 7474324 - DNA, 16 bp, Homo sapiens
atgctgctattagagg

SEQ ID NO: 7474325 - DNA, 22 bp, Homo sapiens
atgctgcctcctcttcagccgc

SEQ ID NO: 7474326 - DNA, 23 bp, Homo sapiens
atgctctgggctgtgggacctgc

SEQ ID NO: 7474327 - DNA, 22 bp, Homo sapiens
atgctctgggcttttgaagtgg

SEQ ID NO: 7474328 - DNA, 22 bp, Homo sapiens
atgctcttgaggctaaagacat

SEQ ID NO: 7474329 - DNA, 22 bp, Homo sapiens
atgctcttgaggctaaagacat

SEQ ID NO: 7474330 - DNA, 22 bp, Homo sapiens
atgctctgggcaggagccctgg

SEQ ID NO: 7474331 - DNA, 22 bp, Homo sapiens
gacaggaaaggggtctgttttc

SEQ ID NO: 7474332 - DNA, 22 bp, Homo sapiens
gacaggaaaggggtctgttttc

SEQ ID NO: 7474333 - DNA, 23 bp, Homo sapiens
atgctctgggctgtgggacctgc

SEQ ID NO: 7474334 - DNA, 23 bp, Homo sapiens
atgctctgggctgtgggacctgc

SEQ ID NO: 7474335 - DNA, 22 bp, Homo sapiens
gacaggaaaggggtctgttttc

SEQ ID NO: 7474336 - DNA, 22 bp, Homo sapiens
gaagtcattgagttttaaacag

SEQ ID NO: 7474337 - DNA, 19 bp, Homo sapiens
gaagtcattctgaaattct

SEQ ID NO: 7474338 - DNA, 22 bp, Homo sapiens
gaagtcatgctcccatcttgct

SEQ ID NO: 7474339 - DNA, 22 bp, Homo sapiens
gaagtccaagatcaaggcccca

SEQ ID NO: 7474340 - DNA, 22 bp, Homo sapiens
gaagtccaagatcaaggcccca

SEQ ID NO: 7474341 - DNA, 22 bp, Homo sapiens
gaagtccagatcaagtcaccag

SEQ ID NO: 7474342 - DNA, 22 bp, Homo sapiens
gaagtccaagatcaaggcccca

SEQ ID NO: 7474343 - DNA, 22 bp, Homo sapiens
gaagtccagatcaagtcaccag

SEQ ID NO: 7474344 - DNA, 22 bp, Homo sapiens
gaagtcatgaggcacagtcctg

SEQ ID NO: 7474345 - DNA, 22 bp, Homo sapiens
gaagtcatctggcactcttcta

SEQ ID NO: 7474346 - DNA, 22 bp, Homo sapiens
gaagtcatccactatgggggag

SEQ ID NO: 7474347 - DNA, 22 bp, Homo sapiens
gaagtcatctggcactcttcta

SEQ ID NO: 7474348 - DNA, 20 bp, Homo sapiens
gaagtcatatgaagcagctt

SEQ ID NO: 7474349 - DNA, 22 bp, Homo sapiens
gaagtcagctccccaggtcccc

SEQ ID NO: 7474350 - DNA, 22 bp, Homo sapiens
gaagtcagtcatctcctgtctc

SEQ ID NO: 7474351 - DNA, 22 bp, Homo sapiens
gaagtcagtcatctcctgtctc

SEQ ID NO: 7474352 - DNA, 23 bp, Homo sapiens
gaagtcagccctacagagagcag

SEQ ID NO: 7474353 - DNA, 23 bp, Homo sapiens
gaagtcagccctacagagagcag

SEQ ID NO: 7474354 - DNA, 23 bp, Homo sapiens
gaagtcagccctacagagagcag

SEQ ID NO: 7474355 - DNA, 22 bp, Homo sapiens
gaagtctggctgacgagagtta

SEQ ID NO: 7474356 - DNA, 22 bp, Homo sapiens
gaagtctgctgctcaggagttt

SEQ ID NO: 7474357 - DNA, 22 bp, Homo sapiens
gaagtctgacaggtctgaatca

SEQ ID NO: 7474358 - DNA, 22 bp, Homo sapiens
gaagtctgcctgccttctctgt

SEQ ID NO: 7474359 - DNA, 22 bp, Homo sapiens
atgcatttgtaaaatataatcg

SEQ ID NO: 7474360 - DNA, 22 bp, Homo sapiens
atgcatttgtaaaatataatcg

SEQ ID NO: 7474361 - DNA, 22 bp, Homo sapiens
gaagtctcatagttaaaattct

SEQ ID NO: 7474362 - DNA, 22 bp, Homo sapiens
gaagtcgtgatgcctcacatga

SEQ ID NO: 7474363 - DNA, 22 bp, Homo sapiens
gaagtctcacagacagatcaga

SEQ ID NO: 7474364 - DNA, 22 bp, Homo sapiens
gaagtctcacagacagatcaga

SEQ ID NO: 7474365 - DNA, 22 bp, Homo sapiens
gaagtctgacaggtctgaatca

SEQ ID NO: 7474366 - DNA, 22 bp, Homo sapiens
gaagtctgagtgggggccaggc

SEQ ID NO: 7474367 - DNA, 22 bp, Homo sapiens
gaagtctgagtgggggccaggc

SEQ ID NO: 7474368 - DNA, 22 bp, Homo sapiens
gaagtctgagtgggggccaggc

SEQ ID NO: 7474369 - DNA, 22 bp, Homo sapiens
gaagtattactctgaatgtatt

SEQ ID NO: 7474370 - DNA, 22 bp, Homo sapiens
gaagtattactctgaatgtatt

SEQ ID NO: 7474371 - DNA, 22 bp, Homo sapiens
gaagtataggagacaaacaaga

SEQ ID NO: 7474372 - DNA, 22 bp, Homo sapiens
gaagtataggagacaaacaaga

SEQ ID NO: 7474373 - DNA, 22 bp, Homo sapiens
gaagtatataaatcctttcaga

SEQ ID NO: 7474374 - DNA, 22 bp, Homo sapiens
gaagtatataaatcctttcaga

SEQ ID NO: 7474375 - DNA, 22 bp, Homo sapiens
gaagtatatgtctttaatctat

SEQ ID NO: 7474376 - DNA, 22 bp, Homo sapiens
gaagtattatagcatattagcc

SEQ ID NO: 7474377 - DNA, 22 bp, Homo sapiens
gaagtatttctgagttgcccag

SEQ ID NO: 7474378 - DNA, 22 bp, Homo sapiens
gaagtatatgtctttaatctat

SEQ ID NO: 7474379 - DNA, 22 bp, Homo sapiens
gaagtattatagcatattagcc

SEQ ID NO: 7474380 - DNA, 22 bp, Homo sapiens
gaagtatttctgagttgcccag

SEQ ID NO: 7474381 - DNA, 22 bp, Homo sapiens
gaagtcagaaaagaattaggga

SEQ ID NO: 7474382 - DNA, 22 bp, Homo sapiens
gaagtatagcagatgttattta

SEQ ID NO: 7474383 - DNA, 22 bp, Homo sapiens
gaagtatagcagatgttattta

SEQ ID NO: 7474384 - DNA, 22 bp, Homo sapiens
gaagtagattcgttgcatcttg

SEQ ID NO: 7474385 - DNA, 22 bp, Homo sapiens
gaagtagattcgttgcatcttg

SEQ ID NO: 7474386 - DNA, 22 bp, Homo sapiens
gaagtacagttttatctagcca

SEQ ID NO: 7474387 - DNA, 22 bp, Homo sapiens
gaagtacagttttatctagcca

SEQ ID NO: 7474388 - DNA, 22 bp, Homo sapiens
gaagtacattctgatagggaag

SEQ ID NO: 7474389 - DNA, 22 bp, Homo sapiens
gaagtacattctgatagggaag

SEQ ID NO: 7474390 - DNA, 22 bp, Homo sapiens
gaagtacattctgatagggaag

SEQ ID NO: 7474391 - DNA, 22 bp, Homo sapiens
gaagtagaaaactcagtttcaa

SEQ ID NO: 7474392 - DNA, 22 bp, Homo sapiens
gaagtacactactccttgagtc

SEQ ID NO: 7474393 - DNA, 22 bp, Homo sapiens
gaagtacaggggttcttaggta

SEQ ID NO: 7474394 - DNA, 22 bp, Homo sapiens
gaagtacaggttgtgagagaat

SEQ ID NO: 7474395 - DNA, 22 bp, Homo sapiens
gaagtacagaaaggggcccctt

SEQ ID NO: 7474396 - DNA, 21 bp, Homo sapiens
gaagtacaccaggaaggccac

SEQ ID NO: 7474397 - DNA, 22 bp, Homo sapiens
atgcataaagaaagctatctgg

SEQ ID NO: 7474398 - DNA, 21 bp, Homo sapiens
gaagtacaccaggaaggccac

SEQ ID NO: 7474399 - DNA, 22 bp, Homo sapiens
gaagtacacgtgtaagcttttc

SEQ ID NO: 7474400 - DNA, 22 bp, Homo sapiens
atgcagtttaaggcacaattag

SEQ ID NO: 7474401 - DNA, 22 bp, Homo sapiens
atgcagtttatctccaaatcat

SEQ ID NO: 7474402 - DNA, 18 bp, Homo sapiens
atgcagttggtactctca

SEQ ID NO: 7474403 - DNA, 22 bp, Homo sapiens
atgcagttgcaatggaggactc

SEQ ID NO: 7474404 - DNA, 22 bp, Homo sapiens
atgcagttccacaggcgcatgg

SEQ ID NO: 7474405 - DNA, 22 bp, Homo sapiens
atgcagttatgtgagggcatga

SEQ ID NO: 7474406 - DNA, 22 bp, Homo sapiens
atgcagttccacaggcgcatgg

SEQ ID NO: 7474407 - DNA, 22 bp, Homo sapiens
atgcagttgcaatggaggactc

SEQ ID NO: 7474408 - DNA, 22 bp, Homo sapiens
atgcagttttcaaagactattc

SEQ ID NO: 7474409 - DNA, 22 bp, Homo sapiens
atgcagttttcaaagactattc

SEQ ID NO: 7474410 - DNA, 22 bp, Homo sapiens
atgcagttttaggggaagggtt

SEQ ID NO: 7474411 - DNA, 22 bp, Homo sapiens
atgcagttttaggggaagggtt

SEQ ID NO: 7474412 - DNA, 22 bp, Homo sapiens
atgcagttttaaatcatttcag

SEQ ID NO: 7474413 - DNA, 22 bp, Homo sapiens
atgcagtttgcttcgcagcagt

SEQ ID NO: 7474414 - DNA, 22 bp, Homo sapiens
atgcagtttgcttcgcagcagt

SEQ ID NO: 7474415 - DNA, 22 bp, Homo sapiens
atgcagtttatctccaaatcat

SEQ ID NO: 7474416 - DNA, 22 bp, Homo sapiens
gaatttcaagcagtgcaatgtt

SEQ ID NO: 7474417 - DNA, 22 bp, Homo sapiens
gaatttcacaaggtgaggataa

SEQ ID NO: 7474418 - DNA, 22 bp, Homo sapiens
gaatttcagaggtaacatcatc

SEQ ID NO: 7474419 - DNA, 22 bp, Homo sapiens
gaatttcagaggtaacatcatc

SEQ ID NO: 7474420 - DNA, 22 bp, Homo sapiens
gaatttcagaggtaacatcatc

SEQ ID NO: 7474421 - DNA, 22 bp, Homo sapiens
gaatttcagatcagagaccatt

SEQ ID NO: 7474422 - DNA, 22 bp, Homo sapiens
gaatttcaagcagtgcaatgtt

SEQ ID NO: 7474423 - DNA, 22 bp, Homo sapiens
gaatttcaaagaggttaagagg

SEQ ID NO: 7474424 - DNA, 19 bp, Homo sapiens
gaatttatctcttcagtcc

SEQ ID NO: 7474425 - DNA, 22 bp, Homo sapiens
gaatttcaaagaggttaagagg

SEQ ID NO: 7474426 - DNA, 22 bp, Homo sapiens
atgccactgcacttcagcctgg

SEQ ID NO: 7474427 - DNA, 22 bp, Homo sapiens
atgccactgcacttcagcctgg

SEQ ID NO: 7474428 - DNA, 22 bp, Homo sapiens
atgccactgcacttcagcctgg

SEQ ID NO: 7474429 - DNA, 22 bp, Homo sapiens
atgccactgcacttcagcctgg

SEQ ID NO: 7474430 - DNA, 22 bp, Homo sapiens
atgccactgcacttcagcctgg

SEQ ID NO: 7474431 - DNA, 22 bp, Homo sapiens
atgccactgcactccagcctgg

SEQ ID NO: 7474432 - DNA, 22 bp, Homo sapiens
atgccactgcactccagcctgg

SEQ ID NO: 7474433 - DNA, 22 bp, Homo sapiens
atgccactgcactccagcctgg

SEQ ID NO: 7474434 - DNA, 22 bp, Homo sapiens
atgccactgcacttcagcctgg

SEQ ID NO: 7474435 - DNA, 22 bp, Homo sapiens
atgccactgcacttcagcttgg

SEQ ID NO: 7474436 - DNA, 22 bp, Homo sapiens
atgccactgcacttcagcttgg

SEQ ID NO: 7474437 - DNA, 22 bp, Homo sapiens
atgccactgcacttcagcttgg

SEQ ID NO: 7474438 - DNA, 22 bp, Homo sapiens
atgccactgcacttcagcttgg

SEQ ID NO: 7474439 - DNA, 19 bp, Homo sapiens
gaatttatctcttcagtcc

SEQ ID NO: 7474440 - DNA, 19 bp, Homo sapiens
gaatttatctcttcagtcc

SEQ ID NO: 7474441 - DNA, 22 bp, Homo sapiens
gaatttatctacgttaagtatg

SEQ ID NO: 7474442 - DNA, 22 bp, Homo sapiens
atgccactgcacttcagcctgg

SEQ ID NO: 7474443 - DNA, 22 bp, Homo sapiens
atgccactgcacttcagcctgg

SEQ ID NO: 7474444 - DNA, 22 bp, Homo sapiens
atgccactgcacttcagcctgg

SEQ ID NO: 7474445 - DNA, 22 bp, Homo sapiens
atgccactgcacttcagcctgg

SEQ ID NO: 7474446 - DNA, 22 bp, Homo sapiens
atgcatttgtaaaatataatcg

SEQ ID NO: 7474447 - DNA, 22 bp, Homo sapiens
atgcatttgtaaaatataatcg

SEQ ID NO: 7474448 - DNA, 22 bp, Homo sapiens
atgcatttgtaaaatataatcg

SEQ ID NO: 7474449 - DNA, 22 bp, Homo sapiens
atgccactgcactccagcctag

SEQ ID NO: 7474450 - DNA, 22 bp, Homo sapiens
atgccactgcactccagcctag

SEQ ID NO: 7474451 - DNA, 22 bp, Homo sapiens
atgccactgcactccagcctag

SEQ ID NO: 7474452 - DNA, 22 bp, Homo sapiens
atgccactgcactccagcctag

SEQ ID NO: 7474453 - DNA, 22 bp, Homo sapiens
atgccactgcactccagcctag

SEQ ID NO: 7474454 - DNA, 22 bp, Homo sapiens
atgccactgcactccagcctag

SEQ ID NO: 7474455 - DNA, 22 bp, Homo sapiens
atgccactgcactccagcctag

SEQ ID NO: 7474456 - DNA, 22 bp, Homo sapiens
atgccactgcactccagcctag

SEQ ID NO: 7474457 - DNA, 22 bp, Homo sapiens
atgccactgcactccagcctag

SEQ ID NO: 7474458 - DNA, 22 bp, Homo sapiens
atgccactgcactccagcctag

SEQ ID NO: 7474459 - DNA, 22 bp, Homo sapiens
atgccactgcactccagcctag

SEQ ID NO: 7474460 - DNA, 22 bp, Homo sapiens
atgccactgcactccagcctag

SEQ ID NO: 7474461 - DNA, 22 bp, Homo sapiens
atgccactgcactccagcctag

SEQ ID NO: 7474462 - DNA, 22 bp, Homo sapiens
atgccactgcactccagcctag

SEQ ID NO: 7474463 - DNA, 22 bp, Homo sapiens
atgccactgcactccagcctag

SEQ ID NO: 7474464 - DNA, 22 bp, Homo sapiens
atgccactgcactccagcctgg

SEQ ID NO: 7474465 - DNA, 22 bp, Homo sapiens
atgccactgcactccagcctag

SEQ ID NO: 7474466 - DNA, 22 bp, Homo sapiens
atgccactgcactccagcctgg

SEQ ID NO: 7474467 - DNA, 22 bp, Homo sapiens
atgccactgcactccagcctgg

SEQ ID NO: 7474468 - DNA, 22 bp, Homo sapiens
atgccactgcactccagcctgg

SEQ ID NO: 7474469 - DNA, 22 bp, Homo sapiens
atgccactgcactccagcctgg

SEQ ID NO: 7474470 - DNA, 22 bp, Homo sapiens
atgccactgcactccagcctgg

SEQ ID NO: 7474471 - DNA, 22 bp, Homo sapiens
atgccactgcactccagcctgg

SEQ ID NO: 7474472 - DNA, 22 bp, Homo sapiens
atgccactgcactccagcctgg

SEQ ID NO: 7474473 - DNA, 22 bp, Homo sapiens
atgccactgcactccagcctgg

SEQ ID NO: 7474474 - DNA, 22 bp, Homo sapiens
atgccactgcactccagcctgg

SEQ ID NO: 7474475 - DNA, 22 bp, Homo sapiens
atgccactgcactccagcctgg

SEQ ID NO: 7474476 - DNA, 22 bp, Homo sapiens
atgccactgcactccagcctgg

SEQ ID NO: 7474477 - DNA, 22 bp, Homo sapiens
atgccactgcactccagcctgg

SEQ ID NO: 7474478 - DNA, 22 bp, Homo sapiens
atgccactgcactccagcctgg

SEQ ID NO: 7474479 - DNA, 22 bp, Homo sapiens
atgccactgcactccagcctgg

SEQ ID NO: 7474480 - DNA, 22 bp, Homo sapiens
caaaagcaaagtccctgaatgt

SEQ ID NO: 7474481 - DNA, 20 bp, Homo sapiens
caaaagcaatgaagttatga

SEQ ID NO: 7474482 - DNA, 20 bp, Homo sapiens
caaaagcaatgaagttatga

SEQ ID NO: 7474483 - DNA, 20 bp, Homo sapiens
caaaagcaatgaagttatga

SEQ ID NO: 7474484 - DNA, 22 bp, Homo sapiens
caaaagcaaagtccctgaatgt

SEQ ID NO: 7474485 - DNA, 22 bp, Homo sapiens
caaaagcaaagtccctgaatgt

SEQ ID NO: 7474486 - DNA, 22 bp, Homo sapiens
caaaagcaaagtccctgaatgt

SEQ ID NO: 7474487 - DNA, 20 bp, Homo sapiens
caaaagcaatgaagttatga

SEQ ID NO: 7474488 - DNA, 20 bp, Homo sapiens
caaaagcaatgaagttatga

SEQ ID NO: 7474489 - DNA, 20 bp, Homo sapiens
caaaagcaatgaagttatga

SEQ ID NO: 7474490 - DNA, 20 bp, Homo sapiens
caaaagcaatgaagttatga

SEQ ID NO: 7474491 - DNA, 20 bp, Homo sapiens
caaaagcaatgaagttatga

SEQ ID NO: 7474492 - DNA, 22 bp, Homo sapiens
caaaagcagcaagtttatatgt

SEQ ID NO: 7474493 - DNA, 22 bp, Homo sapiens
caaaagcagcaagtttatatgt

SEQ ID NO: 7474494 - DNA, 22 bp, Homo sapiens
caaaagcagcaagtttatatgt

SEQ ID NO: 7474495 - DNA, 22 bp, Homo sapiens
caaaagcagcaagtttatatgt

SEQ ID NO: 7474496 - DNA, 22 bp, Homo sapiens
caaaagcagcaagtttatatgt

SEQ ID NO: 7474497 - DNA, 22 bp, Homo sapiens
caaaagcagcaagtttatatgt

SEQ ID NO: 7474498 - DNA, 22 bp, Homo sapiens
caaaagcagcaagtttatatgt

SEQ ID NO: 7474499 - DNA, 20 bp, Homo sapiens
caaaagcaatgaagttatga

SEQ ID NO: 7474500 - DNA, 20 bp, Homo sapiens
caaaagcaatgaagttatga

SEQ ID NO: 7474501 - DNA, 20 bp, Homo sapiens
caaaagcaatgaagttatga

SEQ ID NO: 7474502 - DNA, 20 bp, Homo sapiens
caaaagcaatgaagttatga

SEQ ID NO: 7474503 - DNA, 20 bp, Homo sapiens
caaaagcaatgaagttatga

SEQ ID NO: 7474504 - DNA, 20 bp, Homo sapiens
caaaagcaatgaagttatga

SEQ ID NO: 7474505 - DNA, 20 bp, Homo sapiens
caaaagcaatgaagttatga

SEQ ID NO: 7474506 - DNA, 21 bp, Homo sapiens
caaaagagactgattcttgga

SEQ ID NO: 7474507 - DNA, 21 bp, Homo sapiens
caaaagagactgattcttgga

SEQ ID NO: 7474508 - DNA, 22 bp, Homo sapiens
caaaagatacttgcatctaact

SEQ ID NO: 7474509 - DNA, 22 bp, Homo sapiens
caaaagatacttgcatctaact

SEQ ID NO: 7474510 - DNA, 22 bp, Homo sapiens
caaaagaagctcttggggctag

SEQ ID NO: 7474511 - DNA, 22 bp, Homo sapiens
caaaagaagctcttggggctag

SEQ ID NO: 7474512 - DNA, 22 bp, Homo sapiens
caaaagaagctcttggggctag

SEQ ID NO: 7474513 - DNA, 22 bp, Homo sapiens
caaaagatacttgcatctaact

SEQ ID NO: 7474514 - DNA, 22 bp, Homo sapiens
caaaagatacttgcatctaact

SEQ ID NO: 7474515 - DNA, 22 bp, Homo sapiens
caaaagcaaagtccctgaatgt

SEQ ID NO: 7474516 - DNA, 22 bp, Homo sapiens
caaaagatacttgcatctaact

SEQ ID NO: 7474517 - DNA, 22 bp, Homo sapiens
caaaagatacttgcatctaact

SEQ ID NO: 7474518 - DNA, 22 bp, Homo sapiens
caaaagatacttgcatctaact

SEQ ID NO: 7474519 - DNA, 22 bp, Homo sapiens
caaaagatacttgcatctaact

SEQ ID NO: 7474520 - DNA, 22 bp, Homo sapiens
gctcagagaagcggtttcgcct

SEQ ID NO: 7474521 - DNA, 22 bp, Homo sapiens
gctcagagaagttaaggaattt

SEQ ID NO: 7474522 - DNA, 22 bp, Homo sapiens
gctcagagaagttaaggaattt

SEQ ID NO: 7474523 - DNA, 22 bp, Homo sapiens
gctcagagaagttaaggaattt

SEQ ID NO: 7474524 - DNA, 22 bp, Homo sapiens
gctcagagaatcagcagacacc

SEQ ID NO: 7474525 - DNA, 22 bp, Homo sapiens
gctcagagaagttgtgcctggc

SEQ ID NO: 7474526 - DNA, 22 bp, Homo sapiens
gctcagagaagttgtgcctggc

SEQ ID NO: 7474527 - DNA, 22 bp, Homo sapiens
gctcagagaatttactgctgcc

SEQ ID NO: 7474528 - DNA, 22 bp, Homo sapiens
gctcagagaatcagcagacacc

SEQ ID NO: 7474529 - DNA, 22 bp, Homo sapiens
gctcagagaatcagcagacacc

SEQ ID NO: 7474530 - DNA, 22 bp, Homo sapiens
gctcagagaatcagcagacacc

SEQ ID NO: 7474531 - DNA, 22 bp, Homo sapiens
gctcagagaatcagcagacacc

SEQ ID NO: 7474532 - DNA, 22 bp, Homo sapiens
gctcagagaatcagcagacacc

SEQ ID NO: 7474533 - DNA, 22 bp, Homo sapiens
gctcagagaatttactgctgcc

SEQ ID NO: 7474534 - DNA, 22 bp, Homo sapiens
gctcagagaatttactgctgcc

SEQ ID NO: 7474535 - DNA, 22 bp, Homo sapiens
gctcagagagaggctcaccatt

SEQ ID NO: 7474536 - DNA, 22 bp, Homo sapiens
gctcagagagaggctcaccatt

SEQ ID NO: 7474537 - DNA, 19 bp, Homo sapiens
gctcagagacacctgttgc

SEQ ID NO: 7474538 - DNA, 22 bp, Homo sapiens
gctcagagagaggatatgttat

SEQ ID NO: 7474539 - DNA, 22 bp, Homo sapiens
gctcagagaatttactgctgcc

SEQ ID NO: 7474540 - DNA, 19 bp, Homo sapiens
gctcagagacacctgttgc

SEQ ID NO: 7474541 - DNA, 19 bp, Homo sapiens
gctcagagacacctgttgc

SEQ ID NO: 7474542 - DNA, 19 bp, Homo sapiens
gctcagagacacctgttgc

SEQ ID NO: 7474543 - DNA, 22 bp, Homo sapiens
gctcagagaatttactgctgcc

SEQ ID NO: 7474544 - DNA, 22 bp, Homo sapiens
caaaagaagctcttggggctag

SEQ ID NO: 7474545 - DNA, 22 bp, Homo sapiens
caaaagaagctcttggggctag

SEQ ID NO: 7474546 - DNA, 22 bp, Homo sapiens
gctcagagagtttcacaagttt

SEQ ID NO: 7474547 - DNA, 22 bp, Homo sapiens
gctcagagagaggctcaccatt

SEQ ID NO: 7474548 - DNA, 22 bp, Homo sapiens
gctcagagagaggctcaccatt

SEQ ID NO: 7474549 - DNA, 22 bp, Homo sapiens
gctcagagagattaaataattt

SEQ ID NO: 7474550 - DNA, 22 bp, Homo sapiens
gctcagagagaggctcaccatt

SEQ ID NO: 7474551 - DNA, 21 bp, Homo sapiens
gctcagagagggtaattaacc

SEQ ID NO: 7474552 - DNA, 22 bp, Homo sapiens
gctcagagagtttcacaagttt

SEQ ID NO: 7474553 - DNA, 22 bp, Homo sapiens
gctcagagagtttcacaagttt

SEQ ID NO: 7474554 - DNA, 22 bp, Homo sapiens
gccttctccctaaccaaatcct

SEQ ID NO: 7474555 - DNA, 18 bp, Homo sapiens
gccttcggtctgatttga

SEQ ID NO: 7474556 - DNA, 22 bp, Homo sapiens
attttgaatcaccttggaagaa

SEQ ID NO: 7474557 - DNA, 17 bp, Homo sapiens
gccttctctgccctcac

SEQ ID NO: 7474558 - DNA, 22 bp, Homo sapiens
gccttccttttaccaccagcca

SEQ ID NO: 7474559 - DNA, 22 bp, Homo sapiens
gccttccttttaccaccagcca

SEQ ID NO: 7474560 - DNA, 22 bp, Homo sapiens
gccttccttttaccaccagcca

SEQ ID NO: 7474561 - DNA, 22 bp, Homo sapiens
gccttccttttaccaccagcca

SEQ ID NO: 7474562 - DNA, 22 bp, Homo sapiens
gccttccttttaccaccagcca

SEQ ID NO: 7474563 - DNA, 22 bp, Homo sapiens
gccttccttttaccaccagcca

SEQ ID NO: 7474564 - DNA, 17 bp, Homo sapiens
gccttccttcctccaca

SEQ ID NO: 7474565 - DNA, 17 bp, Homo sapiens
gccttccttcctccaca

SEQ ID NO: 7474566 - DNA, 17 bp, Homo sapiens
gccttccttcctccaca

SEQ ID NO: 7474567 - DNA, 17 bp, Homo sapiens
gccttccttcctccaca

SEQ ID NO: 7474568 - DNA, 22 bp, Homo sapiens
attttgatgctatctaatgaat

SEQ ID NO: 7474569 - DNA, 22 bp, Homo sapiens
attttgatgctatctaatgaat

SEQ ID NO: 7474570 - DNA, 22 bp, Homo sapiens
attttgatgctatctaatgaat

SEQ ID NO: 7474571 - DNA, 22 bp, Homo sapiens
attttgatgctatctaatgaat

SEQ ID NO: 7474572 - DNA, 22 bp, Homo sapiens
attttgataatcatgttagaga

SEQ ID NO: 7474573 - DNA, 22 bp, Homo sapiens
attttgataatcatgttagaga

SEQ ID NO: 7474574 - DNA, 22 bp, Homo sapiens
attttgataatcatgttagaga

SEQ ID NO: 7474575 - DNA, 22 bp, Homo sapiens
attttgataatcatgttagaga

SEQ ID NO: 7474576 - DNA, 22 bp, Homo sapiens
attttgataatcatgttagaga

SEQ ID NO: 7474577 - DNA, 22 bp, Homo sapiens
attttgataatcatgttagaga

SEQ ID NO: 7474578 - DNA, 22 bp, Homo sapiens
attttgataatcatgttagaga

SEQ ID NO: 7474579 - DNA, 22 bp, Homo sapiens
attttgataatcatgttagaga

SEQ ID NO: 7474580 - DNA, 22 bp, Homo sapiens
attttgactgcattacagaaca

SEQ ID NO: 7474581 - DNA, 22 bp, Homo sapiens
attttgactgcattacagaaca

SEQ ID NO: 7474582 - DNA, 22 bp, Homo sapiens
attttgcacactatgcagcttt

SEQ ID NO: 7474583 - DNA, 22 bp, Homo sapiens
attttgcacactatgcagcttt

SEQ ID NO: 7474584 - DNA, 22 bp, Homo sapiens
attttgatgtatctttgtagct

SEQ ID NO: 7474585 - DNA, 22 bp, Homo sapiens
attttgcacactatgcagcttt

SEQ ID NO: 7474586 - DNA, 22 bp, Homo sapiens
attttgcacactatgcagcttt

SEQ ID NO: 7474587 - DNA, 22 bp, Homo sapiens
attttgcacactatgcagcttt

SEQ ID NO: 7474588 - DNA, 22 bp, Homo sapiens
attttgcacactatgcagcttt

SEQ ID NO: 7474589 - DNA, 22 bp, Homo sapiens
attttgatgtatctttgtagct

SEQ ID NO: 7474590 - DNA, 22 bp, Homo sapiens
attttgctgtggtacattagga

SEQ ID NO: 7474591 - DNA, 22 bp, Homo sapiens
attttgctgtggtacattagga

SEQ ID NO: 7474592 - DNA, 22 bp, Homo sapiens
attttgctggtctgaattactt

SEQ ID NO: 7474593 - DNA, 22 bp, Homo sapiens
attttgctgtggtacattagga

SEQ ID NO: 7474594 - DNA, 22 bp, Homo sapiens
attttgctgtggtacattagga

SEQ ID NO: 7474595 - DNA, 22 bp, Homo sapiens
attttgctgctatgccttgcaa

SEQ ID NO: 7474596 - DNA, 22 bp, Homo sapiens
attttgctgctatgccttgcaa

SEQ ID NO: 7474597 - DNA, 22 bp, Homo sapiens
attttgctgctatgccttgcaa

SEQ ID NO: 7474598 - DNA, 22 bp, Homo sapiens
attttgctacagttggtggaaa

SEQ ID NO: 7474599 - DNA, 22 bp, Homo sapiens
attttgcacactatgcagcttt

SEQ ID NO: 7474600 - DNA, 22 bp, Homo sapiens
gctcaaatcccagcgggctcct

SEQ ID NO: 7474601 - DNA, 22 bp, Homo sapiens
gctcaaatgtcatggggagcct

SEQ ID NO: 7474602 - DNA, 22 bp, Homo sapiens
gctcaaatgtcatggggagcct

SEQ ID NO: 7474603 - DNA, 22 bp, Homo sapiens
gctcagactgcacaccctggtc

SEQ ID NO: 7474604 - DNA, 22 bp, Homo sapiens
gctcaaatttcagactcatgaa

SEQ ID NO: 7474605 - DNA, 22 bp, Homo sapiens
gctcagactgcacaccctggtc

SEQ ID NO: 7474606 - DNA, 22 bp, Homo sapiens
gctcagactgcacaccctggtc

SEQ ID NO: 7474607 - DNA, 22 bp, Homo sapiens
gctcagacttgttttacaggct

SEQ ID NO: 7474608 - DNA, 22 bp, Homo sapiens
gctcagagaaaactggggcttg

SEQ ID NO: 7474609 - DNA, 22 bp, Homo sapiens
gctcagagaaaactggggcttg

SEQ ID NO: 7474610 - DNA, 22 bp, Homo sapiens
gctcagagaaaactggggcttg

SEQ ID NO: 7474611 - DNA, 22 bp, Homo sapiens
gctcagagaaaactggggcttg

SEQ ID NO: 7474612 - DNA, 22 bp, Homo sapiens
gctcagagaaaactggggcttg

SEQ ID NO: 7474613 - DNA, 22 bp, Homo sapiens
gctcagagaaattataggaatt

SEQ ID NO: 7474614 - DNA, 22 bp, Homo sapiens
gctcagagaaattataggaatt

SEQ ID NO: 7474615 - DNA, 22 bp, Homo sapiens
gctcagagaaaactggggcttg

SEQ ID NO: 7474616 - DNA, 22 bp, Homo sapiens
gctcagagaaagattagtccct

SEQ ID NO: 7474617 - DNA, 22 bp, Homo sapiens
gctcagagaaattataggaatt

SEQ ID NO: 7474618 - DNA, 22 bp, Homo sapiens
caaagaagagatttacagagct

SEQ ID NO: 7474619 - DNA, 22 bp, Homo sapiens
gctccccaggctggtcccctcg

SEQ ID NO: 7474620 - DNA, 22 bp, Homo sapiens
gctccccaggctggtcccctcg

SEQ ID NO: 7474621 - DNA, 22 bp, Homo sapiens
caaagaagagatttacagagct

SEQ ID NO: 7474622 - DNA, 22 bp, Homo sapiens
caaagaatcactcatctttagc

SEQ ID NO: 7474623 - DNA, 22 bp, Homo sapiens
caaagaatcactcatctttagc

SEQ ID NO: 7474624 - DNA, 22 bp, Homo sapiens
caaagaatcactcatctttagc

SEQ ID NO: 7474625 - DNA, 22 bp, Homo sapiens
caaagaatcactcatctttagc

SEQ ID NO: 7474626 - DNA, 22 bp, Homo sapiens
caaagaatcactcatctttagc

SEQ ID NO: 7474627 - DNA, 22 bp, Homo sapiens
caaagaaggaactataatccca

SEQ ID NO: 7474628 - DNA, 22 bp, Homo sapiens
caaagaatagtgagaagatgta

SEQ ID NO: 7474629 - DNA, 22 bp, Homo sapiens
caaagaatagtgagaagatgta

SEQ ID NO: 7474630 - DNA, 22 bp, Homo sapiens
caaagaatagcatggcatttgt

SEQ ID NO: 7474631 - DNA, 22 bp, Homo sapiens
caaagacacgggaaacaacgtt

SEQ ID NO: 7474632 - DNA, 22 bp, Homo sapiens
caaagacacgggaaacaacgtt

SEQ ID NO: 7474633 - DNA, 22 bp, Homo sapiens
caaagacacgggaaacaacgtt

SEQ ID NO: 7474634 - DNA, 22 bp, Homo sapiens
caaagacacgggaaacaacgtt

SEQ ID NO: 7474635 - DNA, 22 bp, Homo sapiens
caaagacacgggaaacaacgtt

SEQ ID NO: 7474636 - DNA, 22 bp, Homo sapiens
caaagacacgggaaacaacgtt

SEQ ID NO: 7474637 - DNA, 22 bp, Homo sapiens
caaagacacgggaaacaacgtt

SEQ ID NO: 7474638 - DNA, 22 bp, Homo sapiens
caaagaatgagtgagtacataa

SEQ ID NO: 7474639 - DNA, 22 bp, Homo sapiens
caaagaatgagtgagtacataa

SEQ ID NO: 7474640 - DNA, 22 bp, Homo sapiens
caaagaatgagtgagtacataa

SEQ ID NO: 7474641 - DNA, 22 bp, Homo sapiens
caaagaatgagtgagtacataa

SEQ ID NO: 7474642 - DNA, 22 bp, Homo sapiens
caaagaatgagtgagtacataa

SEQ ID NO: 7474643 - DNA, 22 bp, Homo sapiens
caaagaatcactcatctttagc

SEQ ID NO: 7474644 - DNA, 22 bp, Homo sapiens
caaagaatcactcatctttagc

SEQ ID NO: 7474645 - DNA, 20 bp, Homo sapiens
caaagacatgctaggggtgg

SEQ ID NO: 7474646 - DNA, 20 bp, Homo sapiens
caaagacatgctaggggtgg

SEQ ID NO: 7474647 - DNA, 22 bp, Homo sapiens
caaagacacgggaaacaacgtt

SEQ ID NO: 7474648 - DNA, 22 bp, Homo sapiens
caaagacacgggaaacaacgtt

SEQ ID NO: 7474649 - DNA, 20 bp, Homo sapiens
caaagacatgctaggggtgg

SEQ ID NO: 7474650 - DNA, 20 bp, Homo sapiens
caaagacatgctaggggtgg

SEQ ID NO: 7474651 - DNA, 20 bp, Homo sapiens
caaagacatgctaggggtgg

SEQ ID NO: 7474652 - DNA, 22 bp, Homo sapiens
caaagactgcataacacatgaa

SEQ ID NO: 7474653 - DNA, 22 bp, Homo sapiens
caaagaccatgtggcctgaaaa

SEQ ID NO: 7474654 - DNA, 22 bp, Homo sapiens
caaagaccatgtggcctgaaaa

SEQ ID NO: 7474655 - DNA, 22 bp, Homo sapiens
caaagagctgttcagtgtcgct

SEQ ID NO: 7474656 - DNA, 22 bp, Homo sapiens
caaagactgcataacacatgaa

SEQ ID NO: 7474657 - DNA, 22 bp, Homo sapiens
caaagactgcataacacatgaa

SEQ ID NO: 7474658 - DNA, 22 bp, Homo sapiens
gctctgagagtgggtgattctg

SEQ ID NO: 7474659 - DNA, 22 bp, Homo sapiens
caaagaggttttgagggcagct

SEQ ID NO: 7474660 - DNA, 22 bp, Homo sapiens
caaagaggtgagaggagccttt

SEQ ID NO: 7474661 - DNA, 22 bp, Homo sapiens
caaagaggtgagaggagccttt

SEQ ID NO: 7474662 - DNA, 22 bp, Homo sapiens
caaagaggtgagaggagccttt

SEQ ID NO: 7474663 - DNA, 22 bp, Homo sapiens
caaagaggtgagaggagccttt

SEQ ID NO: 7474664 - DNA, 22 bp, Homo sapiens
gctctgctgggtgggcagttat

SEQ ID NO: 7474665 - DNA, 22 bp, Homo sapiens
gctctgctgtcttcttgcaggc

SEQ ID NO: 7474666 - DNA, 22 bp, Homo sapiens
gctctgctgtcttcttgcaggc

SEQ ID NO: 7474667 - DNA, 22 bp, Homo sapiens
gctctgctgtcttcttgcaggc

SEQ ID NO: 7474668 - DNA, 22 bp, Homo sapiens
gctctgctgtcttcttgcaggc

SEQ ID NO: 7474669 - DNA, 22 bp, Homo sapiens
gctctgctgtggaatcctctcc

SEQ ID NO: 7474670 - DNA, 22 bp, Homo sapiens
gctctgctgtggaatcctctcc

SEQ ID NO: 7474671 - DNA, 22 bp, Homo sapiens
gctctgctgtggaatcctctcc

SEQ ID NO: 7474672 - DNA, 22 bp, Homo sapiens
gctctgctgtggaatcctctcc

SEQ ID NO: 7474673 - DNA, 22 bp, Homo sapiens
gctctgctgtggaatcctctcc

SEQ ID NO: 7474674 - DNA, 22 bp, Homo sapiens
gctctgctgtgtttgttcagca

SEQ ID NO: 7474675 - DNA, 22 bp, Homo sapiens
gctctgagataaacgttgccct

SEQ ID NO: 7474676 - DNA, 22 bp, Homo sapiens
caaagaggttttgagggcagct

SEQ ID NO: 7474677 - DNA, 22 bp, Homo sapiens
gctctgagagtgggtgattctg

SEQ ID NO: 7474678 - DNA, 22 bp, Homo sapiens
gctctgagatcattcactgtaa

SEQ ID NO: 7474679 - DNA, 22 bp, Homo sapiens
gctctgagatcattcactgtaa

SEQ ID NO: 7474680 - DNA, 22 bp, Homo sapiens
gctctgagatcattcactgtaa

SEQ ID NO: 7474681 - DNA, 22 bp, Homo sapiens
gctctgagattgagcctttggt

SEQ ID NO: 7474682 - DNA, 22 bp, Homo sapiens
gctctgagattgagcctttggt

SEQ ID NO: 7474683 - DNA, 22 bp, Homo sapiens
caaagaggttttgagggcagct

SEQ ID NO: 7474684 - DNA, 22 bp, Homo sapiens
gctctgctggagggaaagagaa

SEQ ID NO: 7474685 - DNA, 22 bp, Homo sapiens
gctctgctgggtgggcagttat

SEQ ID NO: 7474686 - DNA, 22 bp, Homo sapiens
gctctgctgggtgggcagttat

SEQ ID NO: 7474687 - DNA, 22 bp, Homo sapiens
caaaagcagcaagtttatatgt

SEQ ID NO: 7474688 - DNA, 22 bp, Homo sapiens
caaaagcagcaagtttatatgt

SEQ ID NO: 7474689 - DNA, 22 bp, Homo sapiens
caaaagcagcaagtttatatgt

SEQ ID NO: 7474690 - DNA, 22 bp, Homo sapiens
caaaagcagcaagtttatatgt

SEQ ID NO: 7474691 - DNA, 22 bp, Homo sapiens
caaaagcagcaagtttatatgt

SEQ ID NO: 7474692 - DNA, 22 bp, Homo sapiens
caaaagcagttctatctgagtt

SEQ ID NO: 7474693 - DNA, 22 bp, Homo sapiens
caaaagcagttctatctgagtt

SEQ ID NO: 7474694 - DNA, 22 bp, Homo sapiens
caaaagcagttctatctgagtt

SEQ ID NO: 7474695 - DNA, 22 bp, Homo sapiens
caaaagcagttctatctgagtt

SEQ ID NO: 7474696 - DNA, 22 bp, Homo sapiens
gctccagggaacagaatgtact

SEQ ID NO: 7474697 - DNA, 22 bp, Homo sapiens
caaaagcagttctatctgagtt

SEQ ID NO: 7474698 - DNA, 22 bp, Homo sapiens
gctccagggaacagaatgtact

SEQ ID NO: 7474699 - DNA, 22 bp, Homo sapiens
gctccagggacccaagagaaaa

SEQ ID NO: 7474700 - DNA, 22 bp, Homo sapiens
gctccagggacccaagagaaaa

SEQ ID NO: 7474701 - DNA, 22 bp, Homo sapiens
gctcccaggatgaggagccagg

SEQ ID NO: 7474702 - DNA, 22 bp, Homo sapiens
gctccagggacccaagagaaaa

SEQ ID NO: 7474703 - DNA, 22 bp, Homo sapiens
gctcccaggatgaggagccagg

SEQ ID NO: 7474704 - DNA, 22 bp, Homo sapiens
gctcccagggacactggccact

SEQ ID NO: 7474705 - DNA, 22 bp, Homo sapiens
gctcccagggacactggccact

SEQ ID NO: 7474706 - DNA, 22 bp, Homo sapiens
gctcccagggacactggccact

SEQ ID NO: 7474707 - DNA, 22 bp, Homo sapiens
gctcccagggacactggccact

SEQ ID NO: 7474708 - DNA, 22 bp, Homo sapiens
gctcccaggcatggaggtaatt

SEQ ID NO: 7474709 - DNA, 22 bp, Homo sapiens
gctcccaggcatggaggtaatt

SEQ ID NO: 7474710 - DNA, 22 bp, Homo sapiens
gctcccaggcatggaggtaatt

SEQ ID NO: 7474711 - DNA, 22 bp, Homo sapiens
gctcccaggcatggaggtaatt

SEQ ID NO: 7474712 - DNA, 22 bp, Homo sapiens
gctcccagggaccgcagggcag

SEQ ID NO: 7474713 - DNA, 22 bp, Homo sapiens
gctcccagggaccgcagggcag

SEQ ID NO: 7474714 - DNA, 22 bp, Homo sapiens
gctcccagggaccgcagggcag

SEQ ID NO: 7474715 - DNA, 22 bp, Homo sapiens
gctcccagggaccgcagggcag

SEQ ID NO: 7474716 - DNA, 22 bp, Homo sapiens
gctcccagggaccgcagggcag

SEQ ID NO: 7474717 - DNA, 22 bp, Homo sapiens
gctcccagggaccgcagggcag

SEQ ID NO: 7474718 - DNA, 22 bp, Homo sapiens
gctcccagggaccgcagggcag

SEQ ID NO: 7474719 - DNA, 22 bp, Homo sapiens
gctcccagggacactggccact

SEQ ID NO: 7474720 - DNA, 22 bp, Homo sapiens
gctcccagggacactggccact

SEQ ID NO: 7474721 - DNA, 22 bp, Homo sapiens
gctcccagtctgatggaggaga

SEQ ID NO: 7474722 - DNA, 22 bp, Homo sapiens
gctcccaggttcttgggccttg

SEQ ID NO: 7474723 - DNA, 22 bp, Homo sapiens
gctcccagtctgatggaggaga

SEQ ID NO: 7474724 - DNA, 22 bp, Homo sapiens
gctcccagtctgatggaggaga

SEQ ID NO: 7474725 - DNA, 22 bp, Homo sapiens
gctcccagtctgatggaggaga

SEQ ID NO: 7474726 - DNA, 22 bp, Homo sapiens
gctcccagtctgatggaggaga

SEQ ID NO: 7474727 - DNA, 22 bp, Homo sapiens
gctcccagtctgatggaggaga

SEQ ID NO: 7474728 - DNA, 22 bp, Homo sapiens
gctcccaggttcttgggccttg

SEQ ID NO: 7474729 - DNA, 22 bp, Homo sapiens
gctcccaggttcttgggccttg

SEQ ID NO: 7474730 - DNA, 22 bp, Homo sapiens
gctcccaggttcttgggccttg

SEQ ID NO: 7474731 - DNA, 22 bp, Homo sapiens
gctcccaggttcttgggccttg

SEQ ID NO: 7474732 - DNA, 22 bp, Homo sapiens
gctcccaggttcttgggccttg

SEQ ID NO: 7474733 - DNA, 22 bp, Homo sapiens
gctcccaggttcttgggccttg

SEQ ID NO: 7474734 - DNA, 22 bp, Homo sapiens
gctcccagggaccgcagggcag

SEQ ID NO: 7474735 - DNA, 22 bp, Homo sapiens
gctcccagggaccgcagggcag

SEQ ID NO: 7474736 - DNA, 22 bp, Homo sapiens
gctcccagggcagcgcagaaga

SEQ ID NO: 7474737 - DNA, 22 bp, Homo sapiens
gctcccagggcagcgcagaaga

SEQ ID NO: 7474738 - DNA, 22 bp, Homo sapiens
gctcccagggcagcgcagaaga

SEQ ID NO: 7474739 - DNA, 22 bp, Homo sapiens
gctcccagggcagcgcagaaga

SEQ ID NO: 7474740 - DNA, 22 bp, Homo sapiens
gctccccaaaagctccaggaaa

SEQ ID NO: 7474741 - DNA, 22 bp, Homo sapiens
gctccccaaaagctccaggaaa

SEQ ID NO: 7474742 - DNA, 22 bp, Homo sapiens
gctccccaaaagctccaggaaa

SEQ ID NO: 7474743 - DNA, 22 bp, Homo sapiens
gctcccagttcccaaagtgacc

SEQ ID NO: 7474744 - DNA, 22 bp, Homo sapiens
gctcccagttcccaaagtgacc

SEQ ID NO: 7474745 - DNA, 22 bp, Homo sapiens
gctcccagtctgatggaggaga

SEQ ID NO: 7474746 - DNA, 22 bp, Homo sapiens
gctcccagtctgatggaggaga

SEQ ID NO: 7474747 - DNA, 22 bp, Homo sapiens
gctcccagtctgatggaggaga

SEQ ID NO: 7474748 - DNA, 22 bp, Homo sapiens
gctcccagtctgatggaggaga

SEQ ID NO: 7474749 - DNA, 22 bp, Homo sapiens
gctcccagtctgatggaggaga

SEQ ID NO: 7474750 - DNA, 22 bp, Homo sapiens
gctccccaaaagctccaggaaa

SEQ ID NO: 7474751 - DNA, 22 bp, Homo sapiens
gctccccagcttagccctggct

SEQ ID NO: 7474752 - DNA, 22 bp, Homo sapiens
gctccccagcttagccctggct

SEQ ID NO: 7474753 - DNA, 22 bp, Homo sapiens
gctccccagcttagccctggct

SEQ ID NO: 7474754 - DNA, 22 bp, Homo sapiens
gctccccaaaagctccaggaaa

SEQ ID NO: 7474755 - DNA, 22 bp, Homo sapiens
gctccccagcttagccctggct

SEQ ID NO: 7474756 - DNA, 22 bp, Homo sapiens
gctccccagcttagccctggct

SEQ ID NO: 7474757 - DNA, 22 bp, Homo sapiens
gctccccaggctggtcccctcg

SEQ ID NO: 7474758 - DNA, 22 bp, Homo sapiens
gctccccaggctggtcccctcg

SEQ ID NO: 7474759 - DNA, 22 bp, Homo sapiens
gctccccaggctggtcccctcg

SEQ ID NO: 7474760 - DNA, 22 bp, Homo sapiens
gctccccagcttagccctggct

SEQ ID NO: 7474761 - DNA, 22 bp, Homo sapiens
atttggaatgtgtttgatcacc

SEQ ID NO: 7474762 - DNA, 22 bp, Homo sapiens
atttcttcctctgtcagtaact

SEQ ID NO: 7474763 - DNA, 22 bp, Homo sapiens
atttggaattcgagtaattcca

SEQ ID NO: 7474764 - DNA, 22 bp, Homo sapiens
atttggaattcgagtaattcca

SEQ ID NO: 7474765 - DNA, 22 bp, Homo sapiens
atttggaattcgagtaattcca

SEQ ID NO: 7474766 - DNA, 22 bp, Homo sapiens
atttggcttctctaatactata

SEQ ID NO: 7474767 - DNA, 22 bp, Homo sapiens
atttggaattctatttcagtag

SEQ ID NO: 7474768 - DNA, 22 bp, Homo sapiens
atttggaattctatttcagtag

SEQ ID NO: 7474769 - DNA, 22 bp, Homo sapiens
atttggaattcgagtaattcca

SEQ ID NO: 7474770 - DNA, 22 bp, Homo sapiens
atttggaattctatttcagtag

SEQ ID NO: 7474771 - DNA, 22 bp, Homo sapiens
atttcttcctctgtcagtaact

SEQ ID NO: 7474772 - DNA, 22 bp, Homo sapiens
atttcttcctctgtcagtaact

SEQ ID NO: 7474773 - DNA, 22 bp, Homo sapiens
atttcttcctctgtcagtaact

SEQ ID NO: 7474774 - DNA, 22 bp, Homo sapiens
atttcttcctctgtcagtaact

SEQ ID NO: 7474775 - DNA, 22 bp, Homo sapiens
atttcttcctctgtcagtaact

SEQ ID NO: 7474776 - DNA, 22 bp, Homo sapiens
atttcttcctctgtcagtaact

SEQ ID NO: 7474777 - DNA, 22 bp, Homo sapiens
atttcttcctctgtcagtaact

SEQ ID NO: 7474778 - DNA, 22 bp, Homo sapiens
atttcttccattgcctcttcaa

SEQ ID NO: 7474779 - DNA, 22 bp, Homo sapiens
atttcttcctctgtcagtaact

SEQ ID NO: 7474780 - DNA, 22 bp, Homo sapiens
atttcttcctctgtcagtaact

SEQ ID NO: 7474781 - DNA, 22 bp, Homo sapiens
atttggggctcaccagggctga

SEQ ID NO: 7474782 - DNA, 22 bp, Homo sapiens
atttggtagtcctgataagatt

SEQ ID NO: 7474783 - DNA, 22 bp, Homo sapiens
atttggtagtcctgataagatt

SEQ ID NO: 7474784 - DNA, 22 bp, Homo sapiens
atttggtagtcctgataagatt

SEQ ID NO: 7474785 - DNA, 22 bp, Homo sapiens
atttggggctcaccagggctga

SEQ ID NO: 7474786 - DNA, 22 bp, Homo sapiens
atttggcttggcaacaactttc

SEQ ID NO: 7474787 - DNA, 22 bp, Homo sapiens
atttggtcactaggaaaatcaa

SEQ ID NO: 7474788 - DNA, 21 bp, Homo sapiens
atttggtcaaggacaactctg

SEQ ID NO: 7474789 - DNA, 22 bp, Homo sapiens
atttggtagtgattgaaattat

SEQ ID NO: 7474790 - DNA, 22 bp, Homo sapiens
atttggtagtgattgaaattat

SEQ ID NO: 7474791 - DNA, 22 bp, Homo sapiens
atttgtaatttcttatctgtgt

SEQ ID NO: 7474792 - DNA, 22 bp, Homo sapiens
atttgtaatttcttatctgtgt

SEQ ID NO: 7474793 - DNA, 22 bp, Homo sapiens
atttgtaatttcttatctgtgt

SEQ ID NO: 7474794 - DNA, 22 bp, Homo sapiens
atttgtacaaatttatgttagt

SEQ ID NO: 7474795 - DNA, 22 bp, Homo sapiens
atttgtacaaatttatgttagt

SEQ ID NO: 7474796 - DNA, 22 bp, Homo sapiens
atttgtacaaatttatgttagt

SEQ ID NO: 7474797 - DNA, 22 bp, Homo sapiens
atttgtacaaatttatgttagt

SEQ ID NO: 7474798 - DNA, 22 bp, Homo sapiens
atttgtacaaatttatgttagt

SEQ ID NO: 7474799 - DNA, 22 bp, Homo sapiens
atttgtaatttcttatctgtgt

SEQ ID NO: 7474800 - DNA, 22 bp, Homo sapiens
atttgtaatttcttatctgtgt

SEQ ID NO: 7474801 - DNA, 22 bp, Homo sapiens
atttgtaatttcttatctgtgt

SEQ ID NO: 7474802 - DNA, 22 bp, Homo sapiens
atttgtaagctagagccatgat

SEQ ID NO: 7474803 - DNA, 22 bp, Homo sapiens
atttgtaatttcttatctgtgt

SEQ ID NO: 7474804 - DNA, 22 bp, Homo sapiens
atttgtaagctagagccatgat

SEQ ID NO: 7474805 - DNA, 22 bp, Homo sapiens
atttgtaagctagagccatgat

SEQ ID NO: 7474806 - DNA, 22 bp, Homo sapiens
atttgtaagctagagccatgat

SEQ ID NO: 7474807 - DNA, 22 bp, Homo sapiens
atttgtaagctagagccatgat

SEQ ID NO: 7474808 - DNA, 22 bp, Homo sapiens
atttgtaagctagagccatgat

SEQ ID NO: 7474809 - DNA, 22 bp, Homo sapiens
atttgtaacacgtgacaggttg

SEQ ID NO: 7474810 - DNA, 22 bp, Homo sapiens
atttgtaacacgtgacaggttg

SEQ ID NO: 7474811 - DNA, 17 bp, Homo sapiens
atttgtaactagctctt

SEQ ID NO: 7474812 - DNA, 17 bp, Homo sapiens
atttgtaactagctctt

SEQ ID NO: 7474813 - DNA, 17 bp, Homo sapiens
atttgtaactagctctt

SEQ ID NO: 7474814 - DNA, 22 bp, Homo sapiens
atttgtaaagtgcttaaaagta

SEQ ID NO: 7474815 - DNA, 22 bp, Homo sapiens
atttggtttcaggattctcagg

SEQ ID NO: 7474816 - DNA, 22 bp, Homo sapiens
atttggttcccaagctacgtgt

SEQ ID NO: 7474817 - DNA, 22 bp, Homo sapiens
atttggttatggtcatggacac

SEQ ID NO: 7474818 - DNA, 22 bp, Homo sapiens
atttgtaaagtgcttaaaagta

SEQ ID NO: 7474819 - DNA, 22 bp, Homo sapiens
atttgtaaagtgcttaaaagta

SEQ ID NO: 7474820 - DNA, 22 bp, Homo sapiens
atttgtaaagtgcttaaaagta

SEQ ID NO: 7474821 - DNA, 22 bp, Homo sapiens
atttgtaaagtgcttaaaagta

SEQ ID NO: 7474822 - DNA, 22 bp, Homo sapiens
atttggttatggtcatggacac

SEQ ID NO: 7474823 - DNA, 22 bp, Homo sapiens
atttggtgttgtttggagccta

SEQ ID NO: 7474824 - DNA, 23 bp, Homo sapiens
atttggtgttggttctgccaccc

SEQ ID NO: 7474825 - DNA, 22 bp, Homo sapiens
atttggtgaggtagccattgtt

SEQ ID NO: 7474826 - DNA, 22 bp, Homo sapiens
atttggtggttccttttccgaa

SEQ ID NO: 7474827 - DNA, 22 bp, Homo sapiens
atttggtgttcatcttttagtg

SEQ ID NO: 7474828 - DNA, 22 bp, Homo sapiens
atttggtgcctgggaaatctct

SEQ ID NO: 7474829 - DNA, 22 bp, Homo sapiens
atttgtctagtggtattcacgt

SEQ ID NO: 7474830 - DNA, 22 bp, Homo sapiens
atttgtctctctgggtttactt

SEQ ID NO: 7474831 - DNA, 22 bp, Homo sapiens
atttgtctctctgggtttactt

SEQ ID NO: 7474832 - DNA, 22 bp, Homo sapiens
atttgtctctgcactttactca

SEQ ID NO: 7474833 - DNA, 22 bp, Homo sapiens
atttgtctctgcactttactca

SEQ ID NO: 7474834 - DNA, 22 bp, Homo sapiens
attttagatttaagaataaggt

SEQ ID NO: 7474835 - DNA, 22 bp, Homo sapiens
attttagatttaagaataaggt

SEQ ID NO: 7474836 - DNA, 22 bp, Homo sapiens
attttagagctccaagtacagc

SEQ ID NO: 7474837 - DNA, 22 bp, Homo sapiens
attttagatttaagaataaggt

SEQ ID NO: 7474838 - DNA, 22 bp, Homo sapiens
attttcagcccccactcgtggc

SEQ ID NO: 7474839 - DNA, 22 bp, Homo sapiens
attttcagcccccactcgtggc

SEQ ID NO: 7474840 - DNA, 22 bp, Homo sapiens
attttcagtctggctggaccca

SEQ ID NO: 7474841 - DNA, 22 bp, Homo sapiens
attttcagtgatcatagcacac

SEQ ID NO: 7474842 - DNA, 22 bp, Homo sapiens
attttcagtgatcatagcacac

SEQ ID NO: 7474843 - DNA, 22 bp, Homo sapiens
attttcagtgatcatagcacac

SEQ ID NO: 7474844 - DNA, 22 bp, Homo sapiens
attttcagtgatcatagcacac

SEQ ID NO: 7474845 - DNA, 22 bp, Homo sapiens
atttgtcatatataatactctt

SEQ ID NO: 7474846 - DNA, 22 bp, Homo sapiens
atttgtcatgtatgtaaagttg

SEQ ID NO: 7474847 - DNA, 22 bp, Homo sapiens
atttgtcatgtatgtaaagttg

SEQ ID NO: 7474848 - DNA, 22 bp, Homo sapiens
atttgtcatgtatgtaaagttg

SEQ ID NO: 7474849 - DNA, 22 bp, Homo sapiens
atttgtcatatataatactctt

SEQ ID NO: 7474850 - DNA, 22 bp, Homo sapiens
atttgtctaatgagtgtgtact

SEQ ID NO: 7474851 - DNA, 22 bp, Homo sapiens
atttgtctaatgagtgtgtact

SEQ ID NO: 7474852 - DNA, 22 bp, Homo sapiens
atttgtcatgtatgtaaagttg

SEQ ID NO: 7474853 - DNA, 22 bp, Homo sapiens
atttgtctaatgagtgtgtact

SEQ ID NO: 7474854 - DNA, 22 bp, Homo sapiens
atttgtctagtggtattcacgt

SEQ ID NO: 7474855 - DNA, 22 bp, Homo sapiens
atttgtctagtggtattcacgt

SEQ ID NO: 7474856 - DNA, 22 bp, Homo sapiens
atttgtcacacatagtttatcc

SEQ ID NO: 7474857 - DNA, 22 bp, Homo sapiens
atttgtcacacatagtttatcc

SEQ ID NO: 7474858 - DNA, 22 bp, Homo sapiens
atttgtcactgagagagttaga

SEQ ID NO: 7474859 - DNA, 22 bp, Homo sapiens
atttgtcactgagagagttaga

SEQ ID NO: 7474860 - DNA, 22 bp, Homo sapiens
atttgtcactgagagagttaga

SEQ ID NO: 7474861 - DNA, 22 bp, Homo sapiens
atttgtcactgagagagttaga

SEQ ID NO: 7474862 - DNA, 22 bp, Homo sapiens
atttgtcactgagagagttaga

SEQ ID NO: 7474863 - DNA, 22 bp, Homo sapiens
atttgtcagtggaagtgattca

SEQ ID NO: 7474864 - DNA, 22 bp, Homo sapiens
atttgtcagtggaagtgattca

SEQ ID NO: 7474865 - DNA, 22 bp, Homo sapiens
atttgtcagtggaagtgattca

SEQ ID NO: 7474866 - DNA, 22 bp, Homo sapiens
atttgtcagtggaagtgattca

SEQ ID NO: 7474867 - DNA, 22 bp, Homo sapiens
atttgtatcaatctcaatatat

SEQ ID NO: 7474868 - DNA, 22 bp, Homo sapiens
atttgtatcaatctcaatatat

SEQ ID NO: 7474869 - DNA, 22 bp, Homo sapiens
atttgtatcaatctcaatatat

SEQ ID NO: 7474870 - DNA, 22 bp, Homo sapiens
atttgtatcaatctcaatatat

SEQ ID NO: 7474871 - DNA, 22 bp, Homo sapiens
atttgtatcaatctcaatatat

SEQ ID NO: 7474872 - DNA, 22 bp, Homo sapiens
atttgtatcaatctcaatatat

SEQ ID NO: 7474873 - DNA, 22 bp, Homo sapiens
atttgtaccatactgtttatta

SEQ ID NO: 7474874 - DNA, 22 bp, Homo sapiens
atttgtaccatctggtatacag

SEQ ID NO: 7474875 - DNA, 22 bp, Homo sapiens
atttgtactcaggaattctgct

SEQ ID NO: 7474876 - DNA, 22 bp, Homo sapiens
atttgtaccatctggtatacag

SEQ ID NO: 7474877 - DNA, 22 bp, Homo sapiens
atttgtagtgaagtgaaaataa

SEQ ID NO: 7474878 - DNA, 22 bp, Homo sapiens
atttgtagtgaagtgaaaataa

SEQ ID NO: 7474879 - DNA, 22 bp, Homo sapiens
atttgtagtgaagtgaaaataa

SEQ ID NO: 7474880 - DNA, 22 bp, Homo sapiens
atttgtcaaaacacagagaaca

SEQ ID NO: 7474881 - DNA, 22 bp, Homo sapiens
atttgtcaaaacacagagaaca

SEQ ID NO: 7474882 - DNA, 22 bp, Homo sapiens
atttgtcaaaacacagagaaca

SEQ ID NO: 7474883 - DNA, 22 bp, Homo sapiens
atttgtcaaaacacagagaaca

SEQ ID NO: 7474884 - DNA, 22 bp, Homo sapiens
atttgtcaacaggcatttaggt

SEQ ID NO: 7474885 - DNA, 22 bp, Homo sapiens
atttgtcaacaggcatttaggt

SEQ ID NO: 7474886 - DNA, 22 bp, Homo sapiens
atttgtcaacaggcatttaggt

SEQ ID NO: 7474887 - DNA, 22 bp, Homo sapiens
atttgtcaaaacacagagaaca

SEQ ID NO: 7474888 - DNA, 22 bp, Homo sapiens
atttgtcaataagatgaacata

SEQ ID NO: 7474889 - DNA, 22 bp, Homo sapiens
atttgtcaataagatgaacata

SEQ ID NO: 7474890 - DNA, 22 bp, Homo sapiens
atttgtcaataagatgaacata

SEQ ID NO: 7474891 - DNA, 22 bp, Homo sapiens
atttgtatcttctaatattatc

SEQ ID NO: 7474892 - DNA, 22 bp, Homo sapiens
atttgtatcttctaatattatc

SEQ ID NO: 7474893 - DNA, 22 bp, Homo sapiens
atttgtatcttctaatattatc

SEQ ID NO: 7474894 - DNA, 22 bp, Homo sapiens
atttgtatcttctaatattatc

SEQ ID NO: 7474895 - DNA, 22 bp, Homo sapiens
atttgtatcttctaatattatc

SEQ ID NO: 7474896 - DNA, 22 bp, Homo sapiens
atttgtatcttctaatattatc

SEQ ID NO: 7474897 - DNA, 22 bp, Homo sapiens
atttgtatcttctaatattatc

SEQ ID NO: 7474898 - DNA, 22 bp, Homo sapiens
atttgtatcttctaatattatc

SEQ ID NO: 7474899 - DNA, 22 bp, Homo sapiens
atttgtatcttctaatattatc

SEQ ID NO: 7474900 - DNA, 22 bp, Homo sapiens
atttgtatcttctaatattatc

SEQ ID NO: 7474901 - DNA, 22 bp, Homo sapiens
attttctagatagatgatgcat

SEQ ID NO: 7474902 - DNA, 22 bp, Homo sapiens
attttctaagcctgtcagactt

SEQ ID NO: 7474903 - DNA, 22 bp, Homo sapiens
gcctgtgctgttccctctgcca

SEQ ID NO: 7474904 - DNA, 22 bp, Homo sapiens
gcctgtgctgttccctctgcca

SEQ ID NO: 7474905 - DNA, 22 bp, Homo sapiens
attttctaagcctgtcagactt

SEQ ID NO: 7474906 - DNA, 22 bp, Homo sapiens
attttctaagcctgtcagactt

SEQ ID NO: 7474907 - DNA, 22 bp, Homo sapiens
attttctaagcctgtcagactt

SEQ ID NO: 7474908 - DNA, 22 bp, Homo sapiens
attttctaagcctgtcagactt

SEQ ID NO: 7474909 - DNA, 22 bp, Homo sapiens
attttctaagcctgtcagactt

SEQ ID NO: 7474910 - DNA, 22 bp, Homo sapiens
attttccttctaagaggaaggt

SEQ ID NO: 7474911 - DNA, 22 bp, Homo sapiens
attttccttctaagaggaaggt

SEQ ID NO: 7474912 - DNA, 22 bp, Homo sapiens
attttccttgtgggttagcgaa

SEQ ID NO: 7474913 - DNA, 22 bp, Homo sapiens
attttccttgtgggttagcgaa

SEQ ID NO: 7474914 - DNA, 22 bp, Homo sapiens
attttccttgtgggttagcgaa

SEQ ID NO: 7474915 - DNA, 22 bp, Homo sapiens
attttccttgtgggttagcgaa

SEQ ID NO: 7474916 - DNA, 22 bp, Homo sapiens
attttccttgtgggttagcgaa

SEQ ID NO: 7474917 - DNA, 22 bp, Homo sapiens
gcctgtgcttaactgacgtgag

SEQ ID NO: 7474918 - DNA, 22 bp, Homo sapiens
gcctgtgcttaactgacgtgag

SEQ ID NO: 7474919 - DNA, 22 bp, Homo sapiens
gcctgtgctgttccctctgcca

SEQ ID NO: 7474920 - DNA, 22 bp, Homo sapiens
gcctgtgcttaactgacgtgag

SEQ ID NO: 7474921 - DNA, 22 bp, Homo sapiens
gccttccagaatacacatagca

SEQ ID NO: 7474922 - DNA, 22 bp, Homo sapiens
gccttccagaatacacatagca

SEQ ID NO: 7474923 - DNA, 22 bp, Homo sapiens
gccttccagaatacacatagca

SEQ ID NO: 7474924 - DNA, 17 bp, Homo sapiens
gccttccagcatgtggg

SEQ ID NO: 7474925 - DNA, 17 bp, Homo sapiens
gccttccagcatgtggg

SEQ ID NO: 7474926 - DNA, 17 bp, Homo sapiens
gccttccagcatgtggg

SEQ ID NO: 7474927 - DNA, 17 bp, Homo sapiens
gccttccagcatgtggg

SEQ ID NO: 7474928 - DNA, 22 bp, Homo sapiens
attttcctctggtttccccaga

SEQ ID NO: 7474929 - DNA, 22 bp, Homo sapiens
attttcctctggtttccccaga

SEQ ID NO: 7474930 - DNA, 22 bp, Homo sapiens
attttccttctaagaggaaggt

SEQ ID NO: 7474931 - DNA, 22 bp, Homo sapiens
attttcctctggtttccccaga

SEQ ID NO: 7474932 - DNA, 22 bp, Homo sapiens
attttccttctaagaggaaggt

SEQ ID NO: 7474933 - DNA, 22 bp, Homo sapiens
attttccttctaagaggaaggt

SEQ ID NO: 7474934 - DNA, 22 bp, Homo sapiens
attttccttctaagaggaaggt

SEQ ID NO: 7474935 - DNA, 22 bp, Homo sapiens
attttcctccatgtgagcagtt

SEQ ID NO: 7474936 - DNA, 22 bp, Homo sapiens
attttcctccatgtgagcagtt

SEQ ID NO: 7474937 - DNA, 22 bp, Homo sapiens
attttcctccatgtgagcagtt

SEQ ID NO: 7474938 - DNA, 22 bp, Homo sapiens
attttcctccatgtgagcagtt

SEQ ID NO: 7474939 - DNA, 22 bp, Homo sapiens
attttcctccatgtgagcagtt

SEQ ID NO: 7474940 - DNA, 22 bp, Homo sapiens
attttcctccatgtgagcagtt

SEQ ID NO: 7474941 - DNA, 22 bp, Homo sapiens
attttcctctggtttccccaga

SEQ ID NO: 7474942 - DNA, 22 bp, Homo sapiens
attttcctctggtttccccaga

SEQ ID NO: 7474943 - DNA, 22 bp, Homo sapiens
attttcctagtcatgtgcttct

SEQ ID NO: 7474944 - DNA, 22 bp, Homo sapiens
attttcctagtcatgtgcttct

SEQ ID NO: 7474945 - DNA, 22 bp, Homo sapiens
attttcctagtcatgtgcttct

SEQ ID NO: 7474946 - DNA, 22 bp, Homo sapiens
attttcctagtcatgtgcttct

SEQ ID NO: 7474947 - DNA, 22 bp, Homo sapiens
attttcctagtcatgtgcttct

SEQ ID NO: 7474948 - DNA, 22 bp, Homo sapiens
attttcctagtcatgtgcttct

SEQ ID NO: 7474949 - DNA, 22 bp, Homo sapiens
attttcctcaagcctctggaag

SEQ ID NO: 7474950 - DNA, 22 bp, Homo sapiens
attttcctccatgtgagcagtt

SEQ ID NO: 7474951 - DNA, 22 bp, Homo sapiens
attttcctcaagcctctggaag

SEQ ID NO: 7474952 - DNA, 22 bp, Homo sapiens
attttcctcaagcctctggaag

SEQ ID NO: 7474953 - DNA, 22 bp, Homo sapiens
attttcctcaagcctctggaag

SEQ ID NO: 7474954 - DNA, 22 bp, Homo sapiens
attttcctcaagcctctggaag

SEQ ID NO: 7474955 - DNA, 22 bp, Homo sapiens
attttcctcaagcctctggaag

SEQ ID NO: 7474956 - DNA, 22 bp, Homo sapiens
gccttcccaagacgcctgagtt

SEQ ID NO: 7474957 - DNA, 22 bp, Homo sapiens
gccttcccaagacgcctgagtt

SEQ ID NO: 7474958 - DNA, 22 bp, Homo sapiens
gccttcccaagacgcctgagtt

SEQ ID NO: 7474959 - DNA, 22 bp, Homo sapiens
gccttcccaagacgcctgagtt

SEQ ID NO: 7474960 - DNA, 22 bp, Homo sapiens
gccttcccaagacgcctgagtt

SEQ ID NO: 7474961 - DNA, 22 bp, Homo sapiens
gccttcccaagacgcctgagtt

SEQ ID NO: 7474962 - DNA, 20 bp, Homo sapiens
gccttccagttcagtggcac

SEQ ID NO: 7474963 - DNA, 22 bp, Homo sapiens
gccttccaggcagggggagcag

SEQ ID NO: 7474964 - DNA, 20 bp, Homo sapiens
gccttccagttcagtggcac

SEQ ID NO: 7474965 - DNA, 20 bp, Homo sapiens
gccttccagttcagtggcac

SEQ ID NO: 7474966 - DNA, 19 bp, Homo sapiens
gccttcccaccacccgtcc

SEQ ID NO: 7474967 - DNA, 19 bp, Homo sapiens
gccttcccaccacccgtcc

SEQ ID NO: 7474968 - DNA, 19 bp, Homo sapiens
gccttcccaccacccgtcc

SEQ ID NO: 7474969 - DNA, 19 bp, Homo sapiens
gccttcccaccacccgtcc

SEQ ID NO: 7474970 - DNA, 22 bp, Homo sapiens
gccttcccaccctgcgaggctg

SEQ ID NO: 7474971 - DNA, 22 bp, Homo sapiens
gccttccctctcatcctgctgg

SEQ ID NO: 7474972 - DNA, 22 bp, Homo sapiens
gccttcccaccctgcgaggctg

SEQ ID NO: 7474973 - DNA, 22 bp, Homo sapiens
gccttcccaccctgcgaggctg

SEQ ID NO: 7474974 - DNA, 22 bp, Homo sapiens
gccttcccaccctgcgaggctg

SEQ ID NO: 7474975 - DNA, 22 bp, Homo sapiens
gccttccctctcatcctgctgg

SEQ ID NO: 7474976 - DNA, 22 bp, Homo sapiens
gccttccctctcatcctgctgg

SEQ ID NO: 7474977 - DNA, 22 bp, Homo sapiens
gccttccctggctaggcaagca

SEQ ID NO: 7474978 - DNA, 22 bp, Homo sapiens
gccttccctggctaggcaagca

SEQ ID NO: 7474979 - DNA, 22 bp, Homo sapiens
gccttcctgcagctctgagcgt

SEQ ID NO: 7474980 - DNA, 22 bp, Homo sapiens
gccttcctgcagctctgagcgt

SEQ ID NO: 7474981 - DNA, 22 bp, Homo sapiens
gccttcctgcagctctgagcgt

SEQ ID NO: 7474982 - DNA, 22 bp, Homo sapiens
gccttccctggctaggcaagca

SEQ ID NO: 7474983 - DNA, 22 bp, Homo sapiens
gccttccctggctaggcaagca

SEQ ID NO: 7474984 - DNA, 22 bp, Homo sapiens
gccttcctgcagctctgagcgt

SEQ ID NO: 7474985 - DNA, 22 bp, Homo sapiens
gccttcctgcagctctgagcgt

SEQ ID NO: 7474986 - DNA, 17 bp, Homo sapiens
gccttccttcctccaca

SEQ ID NO: 7474987 - DNA, 17 bp, Homo sapiens
gccttccttcctccaca

SEQ ID NO: 7474988 - DNA, 17 bp, Homo sapiens
gccttccttcctccaca

SEQ ID NO: 7474989 - DNA, 17 bp, Homo sapiens
gccttccttcctccaca

SEQ ID NO: 7474990 - DNA, 22 bp, Homo sapiens
gccttccttacacctgctcagc

SEQ ID NO: 7474991 - DNA, 22 bp, Homo sapiens
gccttccttacacctgctcagc

SEQ ID NO: 7474992 - DNA, 22 bp, Homo sapiens
gccttccttacacctgctcagc

SEQ ID NO: 7474993 - DNA, 22 bp, Homo sapiens
gccttccttacacctgctcagc

SEQ ID NO: 7474994 - DNA, 22 bp, Homo sapiens
gccttcctgcagctctgagcgt

SEQ ID NO: 7474995 - DNA, 22 bp, Homo sapiens
gccttccttacacctgctcagc

SEQ ID NO: 7474996 - DNA, 22 bp, Homo sapiens
gccttccttacacctgctcagc

SEQ ID NO: 7474997 - DNA, 22 bp, Homo sapiens
gccttccttacacctgctcagc

SEQ ID NO: 7474998 - DNA, 21 bp, Homo sapiens
attttcattaattcagtgtgg

SEQ ID NO: 7474999 - DNA, 21 bp, Homo sapiens
attttcatttccaggggagga

SEQ ID NO: 7475000 - DNA, 21 bp, Homo sapiens
attttcatttccaggggagga

SEQ ID NO: 7475001 - DNA, 21 bp, Homo sapiens
attttcatttccaggggagga

SEQ ID NO: 7475002 - DNA, 21 bp, Homo sapiens
attttcatttccaggggagga

SEQ ID NO: 7475003 - DNA, 22 bp, Homo sapiens
attttcattttgcagggtgaga

SEQ ID NO: 7475004 - DNA, 22 bp, Homo sapiens
attttcattttgcagggtgaga

SEQ ID NO: 7475005 - DNA, 21 bp, Homo sapiens
attttcatttccaggggagga

SEQ ID NO: 7475006 - DNA, 22 bp, Homo sapiens
attttcattttgcagggtgaga

SEQ ID NO: 7475007 - DNA, 22 bp, Homo sapiens
attttcattttgcagggtgaga

SEQ ID NO: 7475008 - DNA, 22 bp, Homo sapiens
attttcattttgcagggtgaga

SEQ ID NO: 7475009 - DNA, 21 bp, Homo sapiens
attttcattaattcagtgtgg

SEQ ID NO: 7475010 - DNA, 21 bp, Homo sapiens
attttcattaattcagtgtgg

SEQ ID NO: 7475011 - DNA, 21 bp, Homo sapiens
attttcattaattcagtgtgg

SEQ ID NO: 7475012 - DNA, 21 bp, Homo sapiens
attttcattaattcagtgtgg

SEQ ID NO: 7475013 - DNA, 21 bp, Homo sapiens
attttcattaattcagtgtgg

SEQ ID NO: 7475014 - DNA, 21 bp, Homo sapiens
attttcattaattcagtgtgg

SEQ ID NO: 7475015 - DNA, 21 bp, Homo sapiens
attttcattaattcagtgtgg

SEQ ID NO: 7475016 - DNA, 21 bp, Homo sapiens
attttcattaattcagtgtgg

SEQ ID NO: 7475017 - DNA, 21 bp, Homo sapiens
attttcattaattcagtgtgg

SEQ ID NO: 7475018 - DNA, 21 bp, Homo sapiens
attttcattaattcagtgtgg

SEQ ID NO: 7475019 - DNA, 22 bp, Homo sapiens
attttccaaaataattgttact

SEQ ID NO: 7475020 - DNA, 22 bp, Homo sapiens
attttccaaaataattgttact

SEQ ID NO: 7475021 - DNA, 22 bp, Homo sapiens
attttccaaaataattgttact

SEQ ID NO: 7475022 - DNA, 22 bp, Homo sapiens
attttccaaaataattgttact

SEQ ID NO: 7475023 - DNA, 22 bp, Homo sapiens
attttccaaaataattgttact

SEQ ID NO: 7475024 - DNA, 22 bp, Homo sapiens
attttccaaaataattgttact

SEQ ID NO: 7475025 - DNA, 22 bp, Homo sapiens
attttcattttgcagggtgaga

SEQ ID NO: 7475026 - DNA, 22 bp, Homo sapiens
attttcattttgcagggtgaga

SEQ ID NO: 7475027 - DNA, 22 bp, Homo sapiens
attttccaaaataattgttact

SEQ ID NO: 7475028 - DNA, 22 bp, Homo sapiens
attttccaaaataattgttact

SEQ ID NO: 7475029 - DNA, 22 bp, Homo sapiens
attttccaaaataattgttact

SEQ ID NO: 7475030 - DNA, 22 bp, Homo sapiens
attttccagcctttctagaact

SEQ ID NO: 7475031 - DNA, 22 bp, Homo sapiens
attttccagcctttctagaact

SEQ ID NO: 7475032 - DNA, 22 bp, Homo sapiens
attttccagcctttctagaact

SEQ ID NO: 7475033 - DNA, 22 bp, Homo sapiens
attttccagcctttctagaact

SEQ ID NO: 7475034 - DNA, 22 bp, Homo sapiens
attttccagcctttctagaact

SEQ ID NO: 7475035 - DNA, 22 bp, Homo sapiens
attttccagcctttctagaact

SEQ ID NO: 7475036 - DNA, 22 bp, Homo sapiens
attttccatctccacaccaggg

SEQ ID NO: 7475037 - DNA, 22 bp, Homo sapiens
attttccatctccacaccaggg

SEQ ID NO: 7475038 - DNA, 22 bp, Homo sapiens
attttccatctccacaccaggg

SEQ ID NO: 7475039 - DNA, 22 bp, Homo sapiens
attttccatctccacaccaggg

SEQ ID NO: 7475040 - DNA, 22 bp, Homo sapiens
attttcccttctaaagggctga

SEQ ID NO: 7475041 - DNA, 22 bp, Homo sapiens
attttcatggcttctgctcagt

SEQ ID NO: 7475042 - DNA, 22 bp, Homo sapiens
attttcatggcttctgctcagt

SEQ ID NO: 7475043 - DNA, 22 bp, Homo sapiens
attttcatggcttctgctcagt

SEQ ID NO: 7475044 - DNA, 22 bp, Homo sapiens
attttcatggcttctgctcagt

SEQ ID NO: 7475045 - DNA, 22 bp, Homo sapiens
attttcatggcttctgctcagt

SEQ ID NO: 7475046 - DNA, 22 bp, Homo sapiens
attttcatggcttctgctcagt

SEQ ID NO: 7475047 - DNA, 22 bp, Homo sapiens
attttcatggcttctgctcagt

SEQ ID NO: 7475048 - DNA, 22 bp, Homo sapiens
attttcatggcttctgctcagt

SEQ ID NO: 7475049 - DNA, 21 bp, Homo sapiens
attttcattaattcagtgtgg

SEQ ID NO: 7475050 - DNA, 22 bp, Homo sapiens
attttcatggcttctgctcagt

SEQ ID NO: 7475051 - DNA, 22 bp, Homo sapiens
attttcatggcttctgctcagt

SEQ ID NO: 7475052 - DNA, 22 bp, Homo sapiens
attttcatggcttctgctcagt

SEQ ID NO: 7475053 - DNA, 22 bp, Homo sapiens
attttcatgactaccttaaata

SEQ ID NO: 7475054 - DNA, 22 bp, Homo sapiens
attttcatgactaccttaaata

SEQ ID NO: 7475055 - DNA, 22 bp, Homo sapiens
attttcatgactaccttaaata

SEQ ID NO: 7475056 - DNA, 22 bp, Homo sapiens
attttcatgactaccttaaata

SEQ ID NO: 7475057 - DNA, 22 bp, Homo sapiens
attttcatgactaccttaaata

SEQ ID NO: 7475058 - DNA, 22 bp, Homo sapiens
attttcatgactaccttaaata

SEQ ID NO: 7475059 - DNA, 22 bp, Homo sapiens
attttcatggcttctgctcagt

SEQ ID NO: 7475060 - DNA, 22 bp, Homo sapiens
attttcatgactaccttaaata

SEQ ID NO: 7475061 - DNA, 22 bp, Homo sapiens
attttcatgactaccttaaata

SEQ ID NO: 7475062 - DNA, 22 bp, Homo sapiens
attttcatgactaccttaaata

SEQ ID NO: 7475063 - DNA, 22 bp, Homo sapiens
attttcatgactaccttaaata

SEQ ID NO: 7475064 - DNA, 22 bp, Homo sapiens
attttcatcgctaggttggcct

SEQ ID NO: 7475065 - DNA, 22 bp, Homo sapiens
attttcatcgctaggttggcct

SEQ ID NO: 7475066 - DNA, 22 bp, Homo sapiens
attttcatcgctaggttggcct

SEQ ID NO: 7475067 - DNA, 22 bp, Homo sapiens
attttcatcatgggtttaacat

SEQ ID NO: 7475068 - DNA, 22 bp, Homo sapiens
attttcatcatgggtttaacat

SEQ ID NO: 7475069 - DNA, 22 bp, Homo sapiens
attttcatcatgggtttaacat

SEQ ID NO: 7475070 - DNA, 22 bp, Homo sapiens
attttcagttgaaaaagttggt

SEQ ID NO: 7475071 - DNA, 22 bp, Homo sapiens
attttcatcatgggtttaacat

SEQ ID NO: 7475072 - DNA, 22 bp, Homo sapiens
attttcatcatgggtttaacat

SEQ ID NO: 7475073 - DNA, 22 bp, Homo sapiens
attttcatcatgggtttaacat

SEQ ID NO: 7475074 - DNA, 22 bp, Homo sapiens
attttcagttgaaaaagttggt

SEQ ID NO: 7475075 - DNA, 22 bp, Homo sapiens
attttcagtgtaaatgttttat

SEQ ID NO: 7475076 - DNA, 22 bp, Homo sapiens
attttcagtgatcatagcacac

SEQ ID NO: 7475077 - DNA, 22 bp, Homo sapiens
atttatgagctgaaccatgaaa

SEQ ID NO: 7475078 - DNA, 22 bp, Homo sapiens
atttatgactggtgaatagaac

SEQ ID NO: 7475079 - DNA, 22 bp, Homo sapiens
atttatgactggtgaatagaac

SEQ ID NO: 7475080 - DNA, 22 bp, Homo sapiens
atttatgacaaccaaagagtga

SEQ ID NO: 7475081 - DNA, 22 bp, Homo sapiens
atttatgatagctgcattaaag

SEQ ID NO: 7475082 - DNA, 22 bp, Homo sapiens
atttatgagctgaaccatgaaa

SEQ ID NO: 7475083 - DNA, 22 bp, Homo sapiens
atttatgagctgaaccatgaaa

SEQ ID NO: 7475084 - DNA, 22 bp, Homo sapiens
atttatgattagcctattgttg

SEQ ID NO: 7475085 - DNA, 22 bp, Homo sapiens
atttatgattagcctattgttg

SEQ ID NO: 7475086 - DNA, 22 bp, Homo sapiens
atttatgatagctgcattaaag

SEQ ID NO: 7475087 - DNA, 22 bp, Homo sapiens
atttatgattagcctattgttg

SEQ ID NO: 7475088 - DNA, 20 bp, Homo sapiens
atttatgtatagcttgttgt

SEQ ID NO: 7475089 - DNA, 22 bp, Homo sapiens
atttatgattagcctattgttg

SEQ ID NO: 7475090 - DNA, 20 bp, Homo sapiens
atttatgtatagcttgttgt

SEQ ID NO: 7475091 - DNA, 22 bp, Homo sapiens
atttatgtatctgtgtagatca

SEQ ID NO: 7475092 - DNA, 22 bp, Homo sapiens
atttatgtatctgtgtagatca

SEQ ID NO: 7475093 - DNA, 22 bp, Homo sapiens
atttatgtatctgtgtagatca

SEQ ID NO: 7475094 - DNA, 22 bp, Homo sapiens
atttatgtatctgtgtagatca

SEQ ID NO: 7475095 - DNA, 20 bp, Homo sapiens
atttatgtatagcttgttgt

SEQ ID NO: 7475096 - DNA, 22 bp, Homo sapiens
atttatgtatctgtgtagatca

SEQ ID NO: 7475097 - DNA, 22 bp, Homo sapiens
atttatgtatctgtgtagatca

SEQ ID NO: 7475098 - DNA, 22 bp, Homo sapiens
atttatgtatctgtgtagatca

SEQ ID NO: 7475099 - DNA, 22 bp, Homo sapiens
atttattaagcatctgctatgt

SEQ ID NO: 7475100 - DNA, 22 bp, Homo sapiens
atttattaagcatctgctatgt

SEQ ID NO: 7475101 - DNA, 22 bp, Homo sapiens
atttattaagcatctgctatgt

SEQ ID NO: 7475102 - DNA, 22 bp, Homo sapiens
atttattaagcatctgctatgt

SEQ ID NO: 7475103 - DNA, 22 bp, Homo sapiens
atttattaagcatctgctatgt

SEQ ID NO: 7475104 - DNA, 22 bp, Homo sapiens
atttattaagcatctgctatgt

SEQ ID NO: 7475105 - DNA, 22 bp, Homo sapiens
atttattaagcatctgctatgt

SEQ ID NO: 7475106 - DNA, 22 bp, Homo sapiens
atttattaagcatctgctatgt

SEQ ID NO: 7475107 - DNA, 22 bp, Homo sapiens
atttattaagcatctgctatgt

SEQ ID NO: 7475108 - DNA, 22 bp, Homo sapiens
gccatcatatcccctgtgacct

SEQ ID NO: 7475109 - DNA, 22 bp, Homo sapiens
gccatcatatcccctgtgacct

SEQ ID NO: 7475110 - DNA, 22 bp, Homo sapiens
gccatcatatcccctgtgacct

SEQ ID NO: 7475111 - DNA, 22 bp, Homo sapiens
gccatcatatcccctgtgacct

SEQ ID NO: 7475112 - DNA, 22 bp, Homo sapiens
gccaggtggctgagcagctgca

SEQ ID NO: 7475113 - DNA, 22 bp, Homo sapiens
gccaggtggctgagcagctgca

SEQ ID NO: 7475114 - DNA, 22 bp, Homo sapiens
gccaggtggctgagcagctgca

SEQ ID NO: 7475115 - DNA, 22 bp, Homo sapiens
gccaggtggctgagcagctgca

SEQ ID NO: 7475116 - DNA, 22 bp, Homo sapiens
gccaggtggctgagcagctgca

SEQ ID NO: 7475117 - DNA, 22 bp, Homo sapiens
gccaggtggctgagcagctgca

SEQ ID NO: 7475118 - DNA, 22 bp, Homo sapiens
gccatcatatcccctgtgacct

SEQ ID NO: 7475119 - DNA, 22 bp, Homo sapiens
gccatcatatcccctgtgacct

SEQ ID NO: 7475120 - DNA, 22 bp, Homo sapiens
gccatcatatcccctgtgacct

SEQ ID NO: 7475121 - DNA, 22 bp, Homo sapiens
gccatcatatcccctgtgacct

SEQ ID NO: 7475122 - DNA, 22 bp, Homo sapiens
gccatcatatcccctgtgacct

SEQ ID NO: 7475123 - DNA, 22 bp, Homo sapiens
gccatcatatcccctgtgacct

SEQ ID NO: 7475124 - DNA, 22 bp, Homo sapiens
atttattaagcatctgctatgt

SEQ ID NO: 7475125 - DNA, 22 bp, Homo sapiens
atttattacctcggagtttctg

SEQ ID NO: 7475126 - DNA, 22 bp, Homo sapiens
atttattacctcggagtttctg

SEQ ID NO: 7475127 - DNA, 22 bp, Homo sapiens
atttattacctcggagtttctg

SEQ ID NO: 7475128 - DNA, 22 bp, Homo sapiens
atttattacctcggagtttctg

SEQ ID NO: 7475129 - DNA, 22 bp, Homo sapiens
atttattacctcggagtttctg

SEQ ID NO: 7475130 - DNA, 22 bp, Homo sapiens
atttattacctcggagtttctg

SEQ ID NO: 7475131 - DNA, 22 bp, Homo sapiens
atttattacctcggagtttctg

SEQ ID NO: 7475132 - DNA, 22 bp, Homo sapiens
atttattacctcggagtttctg

SEQ ID NO: 7475133 - DNA, 22 bp, Homo sapiens
atttattacctcggagtttctg

SEQ ID NO: 7475134 - DNA, 22 bp, Homo sapiens
atttattacctcggagtttctg

SEQ ID NO: 7475135 - DNA, 22 bp, Homo sapiens
atttattacctcggagtttctg

SEQ ID NO: 7475136 - DNA, 22 bp, Homo sapiens
atttattatgggatttggcaca

SEQ ID NO: 7475137 - DNA, 22 bp, Homo sapiens
atttattatgggatttggcaca

SEQ ID NO: 7475138 - DNA, 22 bp, Homo sapiens
atttattatgggatttggcaca

SEQ ID NO: 7475139 - DNA, 22 bp, Homo sapiens
atttattatgggatttggcaca

SEQ ID NO: 7475140 - DNA, 22 bp, Homo sapiens
atttattatgggatttggcaca

SEQ ID NO: 7475141 - DNA, 22 bp, Homo sapiens
atttattatgggatttggcaca

SEQ ID NO: 7475142 - DNA, 22 bp, Homo sapiens
atttattatgggatttggcaca

SEQ ID NO: 7475143 - DNA, 22 bp, Homo sapiens
atttattatgggatttggcaca

SEQ ID NO: 7475144 - DNA, 22 bp, Homo sapiens
atttattatgggatttggcaca

SEQ ID NO: 7475145 - DNA, 22 bp, Homo sapiens
gccagctggagactggcagggg

SEQ ID NO: 7475146 - DNA, 22 bp, Homo sapiens
gccagctggagactggcagggg

SEQ ID NO: 7475147 - DNA, 22 bp, Homo sapiens
gccagctggagactggcagggg

SEQ ID NO: 7475148 - DNA, 22 bp, Homo sapiens
gccagctggagactggcagggg

SEQ ID NO: 7475149 - DNA, 22 bp, Homo sapiens
gccagctggagactggcagggg

SEQ ID NO: 7475150 - DNA, 22 bp, Homo sapiens
gccagctggagactggcagggg

SEQ ID NO: 7475151 - DNA, 22 bp, Homo sapiens
gccagctgcttctccagaattt

SEQ ID NO: 7475152 - DNA, 22 bp, Homo sapiens
gccagctggaaatctgcttgaa

SEQ ID NO: 7475153 - DNA, 22 bp, Homo sapiens
gccagctggaaatctgcttgaa

SEQ ID NO: 7475154 - DNA, 22 bp, Homo sapiens
gccagctggaaatctgcttgaa

SEQ ID NO: 7475155 - DNA, 22 bp, Homo sapiens
gccagctggaaatctgcttgaa

SEQ ID NO: 7475156 - DNA, 22 bp, Homo sapiens
gccagctgcttctccagaattt

SEQ ID NO: 7475157 - DNA, 22 bp, Homo sapiens
gccagctgcttctccagaattt

SEQ ID NO: 7475158 - DNA, 22 bp, Homo sapiens
gccagctgcttctccagaattt

SEQ ID NO: 7475159 - DNA, 22 bp, Homo sapiens
gccagctgcttctccagaattt

SEQ ID NO: 7475160 - DNA, 22 bp, Homo sapiens
gccagctgcttctccagaattt

SEQ ID NO: 7475161 - DNA, 22 bp, Homo sapiens
atttagtttaggaaaagtaggt

SEQ ID NO: 7475162 - DNA, 22 bp, Homo sapiens
atttagtttaggaaaagtaggt

SEQ ID NO: 7475163 - DNA, 22 bp, Homo sapiens
atttagaagttggagggcaaga

SEQ ID NO: 7475164 - DNA, 22 bp, Homo sapiens
atttagtttaggaaaagtaggt

SEQ ID NO: 7475165 - DNA, 22 bp, Homo sapiens
atttataacgtgcagccagggt

SEQ ID NO: 7475166 - DNA, 22 bp, Homo sapiens
atttagtttaggaaaagtaggt

SEQ ID NO: 7475167 - DNA, 22 bp, Homo sapiens
atttataacgtgcagccagggt

SEQ ID NO: 7475168 - DNA, 22 bp, Homo sapiens
atttataacgtgcagccagggt

SEQ ID NO: 7475169 - DNA, 22 bp, Homo sapiens
atttataacgtgcagccagggt

SEQ ID NO: 7475170 - DNA, 22 bp, Homo sapiens
gccagctggagtgagagtgggc

SEQ ID NO: 7475171 - DNA, 22 bp, Homo sapiens
gccagctggagtgagagtgggc

SEQ ID NO: 7475172 - DNA, 22 bp, Homo sapiens
gccagctggagtgagagtgggc

SEQ ID NO: 7475173 - DNA, 22 bp, Homo sapiens
gccagctggagtgagagtgggc

SEQ ID NO: 7475174 - DNA, 22 bp, Homo sapiens
gccagctggagtgagagtgggc

SEQ ID NO: 7475175 - DNA, 21 bp, Homo sapiens
atttagaaggaaattttgcaa

SEQ ID NO: 7475176 - DNA, 22 bp, Homo sapiens
atttagaagttggagggcaaga

SEQ ID NO: 7475177 - DNA, 21 bp, Homo sapiens
atttagaaggaaattttgcaa

SEQ ID NO: 7475178 - DNA, 21 bp, Homo sapiens
atttagaaggaaattttgcaa

SEQ ID NO: 7475179 - DNA, 21 bp, Homo sapiens
atttagaaggaaattttgcaa

SEQ ID NO: 7475180 - DNA, 22 bp, Homo sapiens
atttatgacagaagatatgctg

SEQ ID NO: 7475181 - DNA, 22 bp, Homo sapiens
atttatgacagaagatatgctg

SEQ ID NO: 7475182 - DNA, 22 bp, Homo sapiens
atttatgactggtgaatagaac

SEQ ID NO: 7475183 - DNA, 22 bp, Homo sapiens
atttatgactggtgaatagaac

SEQ ID NO: 7475184 - DNA, 22 bp, Homo sapiens
atttatgacgtgttcggtcaat

SEQ ID NO: 7475185 - DNA, 22 bp, Homo sapiens
atttatctctggaaactaagca

SEQ ID NO: 7475186 - DNA, 22 bp, Homo sapiens
atttatctctggaaactaagca

SEQ ID NO: 7475187 - DNA, 22 bp, Homo sapiens
atttatctctggaaactaagca

SEQ ID NO: 7475188 - DNA, 22 bp, Homo sapiens
atttatctctggaaactaagca

SEQ ID NO: 7475189 - DNA, 18 bp, Homo sapiens
atttatcctttgtattac

SEQ ID NO: 7475190 - DNA, 22 bp, Homo sapiens
atttatgacaaccaaagagtga

SEQ ID NO: 7475191 - DNA, 22 bp, Homo sapiens
atttatgacaaccaaagagtga

SEQ ID NO: 7475192 - DNA, 22 bp, Homo sapiens
atttatgacaaccaaagagtga

SEQ ID NO: 7475193 - DNA, 22 bp, Homo sapiens
atttatcatcagaccttttaaa

SEQ ID NO: 7475194 - DNA, 18 bp, Homo sapiens
atttatcctttgtattac

SEQ ID NO: 7475195 - DNA, 22 bp, Homo sapiens
atttatcatcagaccttttaaa

SEQ ID NO: 7475196 - DNA, 22 bp, Homo sapiens
atttatcaccagttagctgact

SEQ ID NO: 7475197 - DNA, 22 bp, Homo sapiens
atttatcaccagttagctgact

SEQ ID NO: 7475198 - DNA, 22 bp, Homo sapiens
atttatcaccagttagctgact

SEQ ID NO: 7475199 - DNA, 22 bp, Homo sapiens
atttatcaccagttagctgact

SEQ ID NO: 7475200 - DNA, 22 bp, Homo sapiens
atttatcaccagttagctgact

SEQ ID NO: 7475201 - DNA, 22 bp, Homo sapiens
atttatcaccagttagctgact

SEQ ID NO: 7475202 - DNA, 22 bp, Homo sapiens
atttatattttgggagctcctg

SEQ ID NO: 7475203 - DNA, 22 bp, Homo sapiens
atttatagggcattgaaaactg

SEQ ID NO: 7475204 - DNA, 22 bp, Homo sapiens
atttatagggcattgaaaactg

SEQ ID NO: 7475205 - DNA, 22 bp, Homo sapiens
atttatattttgggagctcctg

SEQ ID NO: 7475206 - DNA, 22 bp, Homo sapiens
atttatcaacatgtaccattgg

SEQ ID NO: 7475207 - DNA, 22 bp, Homo sapiens
gccagctgccaagttgtgagat

SEQ ID NO: 7475208 - DNA, 22 bp, Homo sapiens
gccagctgccaagttgtgagat

SEQ ID NO: 7475209 - DNA, 22 bp, Homo sapiens
gccagctgccaagttgtgagat

SEQ ID NO: 7475210 - DNA, 22 bp, Homo sapiens
gccagctgccaagttgtgagat

SEQ ID NO: 7475211 - DNA, 22 bp, Homo sapiens
gccagctgccctctgctggtcc

SEQ ID NO: 7475212 - DNA, 22 bp, Homo sapiens
gccagctgccctctgctggtcc

SEQ ID NO: 7475213 - DNA, 22 bp, Homo sapiens
gccagctgccctctgctggtcc

SEQ ID NO: 7475214 - DNA, 22 bp, Homo sapiens
gccagctgccctctgctggtcc

SEQ ID NO: 7475215 - DNA, 22 bp, Homo sapiens
gccagctgctggaacagcgcga

SEQ ID NO: 7475216 - DNA, 22 bp, Homo sapiens
gccagctgctggaacagcgcga

SEQ ID NO: 7475217 - DNA, 22 bp, Homo sapiens
gccagctgctggaacagcgcga

SEQ ID NO: 7475218 - DNA, 22 bp, Homo sapiens
gccagctgctggaacagcgcga

SEQ ID NO: 7475219 - DNA, 22 bp, Homo sapiens
gccagctgctggaacagcgcga

SEQ ID NO: 7475220 - DNA, 22 bp, Homo sapiens
gccagctgctggaacagcgcga

SEQ ID NO: 7475221 - DNA, 22 bp, Homo sapiens
gccagctgctcgcgtagggtag

SEQ ID NO: 7475222 - DNA, 22 bp, Homo sapiens
gccagctgctcgcgtagggtag

SEQ ID NO: 7475223 - DNA, 20 bp, Homo sapiens
gccagctgcccttccaccct

SEQ ID NO: 7475224 - DNA, 20 bp, Homo sapiens
gccagctgcccttccaccct

SEQ ID NO: 7475225 - DNA, 20 bp, Homo sapiens
gccagctgcccttccaccct

SEQ ID NO: 7475226 - DNA, 22 bp, Homo sapiens
gccagctgcatctcctgggctg

SEQ ID NO: 7475227 - DNA, 22 bp, Homo sapiens
gccagctgcatctcctgggctg

SEQ ID NO: 7475228 - DNA, 22 bp, Homo sapiens
gccagctgcatctcctgggctg

SEQ ID NO: 7475229 - DNA, 21 bp, Homo sapiens
gccagctgcagggcttccttg

SEQ ID NO: 7475230 - DNA, 21 bp, Homo sapiens
gccagctgcagggcttccttg

SEQ ID NO: 7475231 - DNA, 21 bp, Homo sapiens
gccagctgcagggcttccttg

SEQ ID NO: 7475232 - DNA, 21 bp, Homo sapiens
gccagctgcagggcttccttg

SEQ ID NO: 7475233 - DNA, 21 bp, Homo sapiens
gccagctgcagggcttccttg

SEQ ID NO: 7475234 - DNA, 22 bp, Homo sapiens
gccagccagtttgctgatggct

SEQ ID NO: 7475235 - DNA, 22 bp, Homo sapiens
gccagccagtttgctgatggct

SEQ ID NO: 7475236 - DNA, 22 bp, Homo sapiens
gccagccagtttgctgatggct

SEQ ID NO: 7475237 - DNA, 22 bp, Homo sapiens
gccagccagtttgctgatggct

SEQ ID NO: 7475238 - DNA, 22 bp, Homo sapiens
gccagccataggccagcactgg

SEQ ID NO: 7475239 - DNA, 22 bp, Homo sapiens
gccagccataggccagcactgg

SEQ ID NO: 7475240 - DNA, 22 bp, Homo sapiens
gccagccataggccagcactgg

SEQ ID NO: 7475241 - DNA, 18 bp, Homo sapiens
gccagctgcacggccctc

SEQ ID NO: 7475242 - DNA, 22 bp, Homo sapiens
gccagccataggccagcactgg

SEQ ID NO: 7475243 - DNA, 22 bp, Homo sapiens
gccagccagggaagggagagac

SEQ ID NO: 7475244 - DNA, 22 bp, Homo sapiens
gccagccagggaagggagagac

SEQ ID NO: 7475245 - DNA, 22 bp, Homo sapiens
gccagccagggaagggagagac

SEQ ID NO: 7475246 - DNA, 22 bp, Homo sapiens
gccagccagtttgctgatggct

SEQ ID NO: 7475247 - DNA, 18 bp, Homo sapiens
gccagccaggcgttgctc

SEQ ID NO: 7475248 - DNA, 22 bp, Homo sapiens
gccagccaggaagaaagtaaga

SEQ ID NO: 7475249 - DNA, 18 bp, Homo sapiens
gccagccaggcgttgctc

SEQ ID NO: 7475250 - DNA, 22 bp, Homo sapiens
gccagccagagtggctgtgtgt

SEQ ID NO: 7475251 - DNA, 22 bp, Homo sapiens
gccagccaggaagaaagtaaga

SEQ ID NO: 7475252 - DNA, 22 bp, Homo sapiens
gccagccagagaggcatggtta

SEQ ID NO: 7475253 - DNA, 22 bp, Homo sapiens
gccagccagagaggcatggtta

SEQ ID NO: 7475254 - DNA, 22 bp, Homo sapiens
gccagccagagaggcatggtta

SEQ ID NO: 7475255 - DNA, 22 bp, Homo sapiens
gccagccagagaggcatggtta

SEQ ID NO: 7475256 - DNA, 22 bp, Homo sapiens
gccagccagagtggctgtgtgt

SEQ ID NO: 7475257 - DNA, 22 bp, Homo sapiens
gccagccagagtccatctgaga

SEQ ID NO: 7475258 - DNA, 22 bp, Homo sapiens
gccagccagagaggcatggtta

SEQ ID NO: 7475259 - DNA, 22 bp, Homo sapiens
gccagccagagaggcatggtta

SEQ ID NO: 7475260 - DNA, 23 bp, Homo sapiens
gccagccagaatttctccactgt

SEQ ID NO: 7475261 - DNA, 23 bp, Homo sapiens
gccagccagaatttctccactgt

SEQ ID NO: 7475262 - DNA, 22 bp, Homo sapiens
gccagccagaaacgtcacactg

SEQ ID NO: 7475263 - DNA, 22 bp, Homo sapiens
gccagccagaaacgtcacactg

SEQ ID NO: 7475264 - DNA, 23 bp, Homo sapiens
gccagccagaatttctccactgt

SEQ ID NO: 7475265 - DNA, 22 bp, Homo sapiens
gccagccacttcccagactggc

SEQ ID NO: 7475266 - DNA, 22 bp, Homo sapiens
gccagccagaaacgtcacactg

SEQ ID NO: 7475267 - DNA, 22 bp, Homo sapiens
gccagccacttcccagactggc

SEQ ID NO: 7475268 - DNA, 22 bp, Homo sapiens
gccagccacttcccagactggc

SEQ ID NO: 7475269 - DNA, 22 bp, Homo sapiens
gccagccacttcagctatggct

SEQ ID NO: 7475270 - DNA, 22 bp, Homo sapiens
gccagccacttcagctatggct

SEQ ID NO: 7475271 - DNA, 22 bp, Homo sapiens
gccagccacgttagactggccc

SEQ ID NO: 7475272 - DNA, 22 bp, Homo sapiens
gccagccacttcagctatggct

SEQ ID NO: 7475273 - DNA, 22 bp, Homo sapiens
gccagccacttcagctatggct

SEQ ID NO: 7475274 - DNA, 22 bp, Homo sapiens
gccagccacttcagctatggct

SEQ ID NO: 7475275 - DNA, 22 bp, Homo sapiens
gccagccacttcccagactggc

SEQ ID NO: 7475276 - DNA, 22 bp, Homo sapiens
gccagccacttcccagactggc

SEQ ID NO: 7475277 - DNA, 22 bp, Homo sapiens
gccagccacttcccagactggc

SEQ ID NO: 7475278 - DNA, 22 bp, Homo sapiens
gccagccacttcccagactggc

SEQ ID NO: 7475279 - DNA, 22 bp, Homo sapiens
attgtactacaccatagtactg

SEQ ID NO: 7475280 - DNA, 22 bp, Homo sapiens
attgtactacaccatagtactg

SEQ ID NO: 7475281 - DNA, 22 bp, Homo sapiens
attgtactagaaattgtattca

SEQ ID NO: 7475282 - DNA, 22 bp, Homo sapiens
attgtactacaccatagtactg

SEQ ID NO: 7475283 - DNA, 19 bp, Homo sapiens
attgtacattgagtttggc

SEQ ID NO: 7475284 - DNA, 22 bp, Homo sapiens
attgtactacaccatagtactg

SEQ ID NO: 7475285 - DNA, 22 bp, Homo sapiens
attgtacatgcagtgagtcatc

SEQ ID NO: 7475286 - DNA, 22 bp, Homo sapiens
attgtacatgcagtgagtcatc

SEQ ID NO: 7475287 - DNA, 19 bp, Homo sapiens
attgtacattgagtttggc

SEQ ID NO: 7475288 - DNA, 19 bp, Homo sapiens
attgtacattgagtttggc

SEQ ID NO: 7475289 - DNA, 19 bp, Homo sapiens
attgtacattgagtttggc

SEQ ID NO: 7475290 - DNA, 19 bp, Homo sapiens
attgtacattgagtttggc

SEQ ID NO: 7475291 - DNA, 20 bp, Homo sapiens
attgtacttcagtgtgaagc

SEQ ID NO: 7475292 - DNA, 20 bp, Homo sapiens
attgtacttctgttgatggt

SEQ ID NO: 7475293 - DNA, 22 bp, Homo sapiens
attgtacttttattacatgtag

SEQ ID NO: 7475294 - DNA, 22 bp, Homo sapiens
attgtactctagcctctgggca

SEQ ID NO: 7475295 - DNA, 22 bp, Homo sapiens
attgtactggtaaagaagtggg

SEQ ID NO: 7475296 - DNA, 22 bp, Homo sapiens
attgtactggtaaagaagtggg

SEQ ID NO: 7475297 - DNA, 22 bp, Homo sapiens
attgtactccctctcctgcccg

SEQ ID NO: 7475298 - DNA, 22 bp, Homo sapiens
attgtactccagcctgggtgac

SEQ ID NO: 7475299 - DNA, 22 bp, Homo sapiens
attgtactcacaaaacatgagt

SEQ ID NO: 7475300 - DNA, 22 bp, Homo sapiens
attgtactagaaattgtattca

SEQ ID NO: 7475301 - DNA, 22 bp, Homo sapiens
attgtactcacaaaacatgagt

SEQ ID NO: 7475302 - DNA, 22 bp, Homo sapiens
gccagaggttcaacaactgtct

SEQ ID NO: 7475303 - DNA, 22 bp, Homo sapiens
gccagagtcttctgaccctgtg

SEQ ID NO: 7475304 - DNA, 22 bp, Homo sapiens
gccagagtcttctgaccctgtg

SEQ ID NO: 7475305 - DNA, 22 bp, Homo sapiens
gccagagttgaggcagtttatt

SEQ ID NO: 7475306 - DNA, 22 bp, Homo sapiens
gccagagttgaggcagtttatt

SEQ ID NO: 7475307 - DNA, 22 bp, Homo sapiens
gccagagtgccatcagtgccat

SEQ ID NO: 7475308 - DNA, 20 bp, Homo sapiens
gccagagttatgatgagagg

SEQ ID NO: 7475309 - DNA, 20 bp, Homo sapiens
gccagagttatgatgagagg

SEQ ID NO: 7475310 - DNA, 22 bp, Homo sapiens
gccagccaagattgagaaggta

SEQ ID NO: 7475311 - DNA, 22 bp, Homo sapiens
gccagccaagattgagaaggta

SEQ ID NO: 7475312 - DNA, 22 bp, Homo sapiens
gccagccaagattgagaaggta

SEQ ID NO: 7475313 - DNA, 22 bp, Homo sapiens
gccagccacaagggaggcttgt

SEQ ID NO: 7475314 - DNA, 22 bp, Homo sapiens
gccagccacgttagactggccc

SEQ ID NO: 7475315 - DNA, 22 bp, Homo sapiens
gccagccacgttagactggccc

SEQ ID NO: 7475316 - DNA, 22 bp, Homo sapiens
gccagccacgttagactggccc

SEQ ID NO: 7475317 - DNA, 22 bp, Homo sapiens
gccagccacaagggaggcttgt

SEQ ID NO: 7475318 - DNA, 22 bp, Homo sapiens
gccagccacaagggaggcttgt

SEQ ID NO: 7475319 - DNA, 22 bp, Homo sapiens
attgtacagacatgggaaacaa

SEQ ID NO: 7475320 - DNA, 22 bp, Homo sapiens
attgtacagacatgggaaacaa

SEQ ID NO: 7475321 - DNA, 22 bp, Homo sapiens
attgtacactagtggcagcagt

SEQ ID NO: 7475322 - DNA, 22 bp, Homo sapiens
attgtacagacatgggaaacaa

SEQ ID NO: 7475323 - DNA, 22 bp, Homo sapiens
attgtacagacatgggaaacaa

SEQ ID NO: 7475324 - DNA, 22 bp, Homo sapiens
gcatggcatttgaaggtagaag

SEQ ID NO: 7475325 - DNA, 22 bp, Homo sapiens
gcatggcatttgaaggtagaag

SEQ ID NO: 7475326 - DNA, 22 bp, Homo sapiens
attgtacagatgaacctcactc

SEQ ID NO: 7475327 - DNA, 22 bp, Homo sapiens
attgtacagatgaacctcactc

SEQ ID NO: 7475328 - DNA, 22 bp, Homo sapiens
attgtacagatgaacctcactc

SEQ ID NO: 7475329 - DNA, 22 bp, Homo sapiens
attgtacagatgaacctcactc

SEQ ID NO: 7475330 - DNA, 22 bp, Homo sapiens
attgtacagatgaacctcactc

SEQ ID NO: 7475331 - DNA, 22 bp, Homo sapiens
attgtacagatgaggtaagtga

SEQ ID NO: 7475332 - DNA, 22 bp, Homo sapiens
attgtacagatgaggtaagtga

SEQ ID NO: 7475333 - DNA, 22 bp, Homo sapiens
attgtacagatgaggtaagtga

SEQ ID NO: 7475334 - DNA, 22 bp, Homo sapiens
attgtacagatgaggtaagtga

SEQ ID NO: 7475335 - DNA, 20 bp, Homo sapiens
gcatggcatgtagtgaagtg

SEQ ID NO: 7475336 - DNA, 22 bp, Homo sapiens
gcatggcattaacaagatggaa

SEQ ID NO: 7475337 - DNA, 20 bp, Homo sapiens
gcatggcatgtagtgaagtg

SEQ ID NO: 7475338 - DNA, 22 bp, Homo sapiens
gcatggcagtgaggatggtgct

SEQ ID NO: 7475339 - DNA, 22 bp, Homo sapiens
gcatggcatttgaaggtagaag

SEQ ID NO: 7475340 - DNA, 22 bp, Homo sapiens
gcatggcatttgaaggtagaag

SEQ ID NO: 7475341 - DNA, 22 bp, Homo sapiens
gcatggcattaacaagatggaa

SEQ ID NO: 7475342 - DNA, 22 bp, Homo sapiens
gcatggcattaacaagatggaa

SEQ ID NO: 7475343 - DNA, 22 bp, Homo sapiens
attgtacatgcagtgagtcatc

SEQ ID NO: 7475344 - DNA, 22 bp, Homo sapiens
attgtacatgcagtgagtcatc

SEQ ID NO: 7475345 - DNA, 22 bp, Homo sapiens
attgtacatgcagtgagtcatc

SEQ ID NO: 7475346 - DNA, 22 bp, Homo sapiens
attgtacatgcagtgagtcatc

SEQ ID NO: 7475347 - DNA, 22 bp, Homo sapiens
attgtacatgcagtgagtcatc

SEQ ID NO: 7475348 - DNA, 22 bp, Homo sapiens
attgtacatgcagtgagtcatc

SEQ ID NO: 7475349 - DNA, 22 bp, Homo sapiens
attgtacatatgatgtatgtaa

SEQ ID NO: 7475350 - DNA, 22 bp, Homo sapiens
attgtacatatgatgtatgtaa

SEQ ID NO: 7475351 - DNA, 22 bp, Homo sapiens
attgtacatatgatgtatgtaa

SEQ ID NO: 7475352 - DNA, 22 bp, Homo sapiens
attgtacatatgatgtatgtaa

SEQ ID NO: 7475353 - DNA, 22 bp, Homo sapiens
attgtacatatgatgtatgtaa

SEQ ID NO: 7475354 - DNA, 22 bp, Homo sapiens
attgtacatatgatgtatgtaa

SEQ ID NO: 7475355 - DNA, 22 bp, Homo sapiens
attgtacatatgatgtatgtaa

SEQ ID NO: 7475356 - DNA, 22 bp, Homo sapiens
attgtacatatgatgtatgtaa

SEQ ID NO: 7475357 - DNA, 22 bp, Homo sapiens
attgtacaggttggaggaagtg

SEQ ID NO: 7475358 - DNA, 22 bp, Homo sapiens
attgtacaggttggaggaagtg

SEQ ID NO: 7475359 - DNA, 22 bp, Homo sapiens
attgtacaggttggaggaagtg

SEQ ID NO: 7475360 - DNA, 22 bp, Homo sapiens
attgtacagctctgagaggggg

SEQ ID NO: 7475361 - DNA, 22 bp, Homo sapiens
attgtacaggttggaggaagtg

SEQ ID NO: 7475362 - DNA, 22 bp, Homo sapiens
attgtacagatgaggtaagtga

SEQ ID NO: 7475363 - DNA, 22 bp, Homo sapiens
attgtacagctctgagaggggg

SEQ ID NO: 7475364 - DNA, 22 bp, Homo sapiens
attgtacagatgaggtaagtga

SEQ ID NO: 7475365 - DNA, 22 bp, Homo sapiens
attgtacagatgaggtaagtga

SEQ ID NO: 7475366 - DNA, 22 bp, Homo sapiens
attgtacagctctgagaggggg

SEQ ID NO: 7475367 - DNA, 22 bp, Homo sapiens
attgtacagctctgagaggggg

SEQ ID NO: 7475368 - DNA, 22 bp, Homo sapiens
attgtacataaaatgtatgtct

SEQ ID NO: 7475369 - DNA, 22 bp, Homo sapiens
attgtacataaaatgtatgtct

SEQ ID NO: 7475370 - DNA, 22 bp, Homo sapiens
attgtacataaaatgtatgtct

SEQ ID NO: 7475371 - DNA, 22 bp, Homo sapiens
attgtacataaaatgtatgtct

SEQ ID NO: 7475372 - DNA, 22 bp, Homo sapiens
attgtacataaaatgtatgtct

SEQ ID NO: 7475373 - DNA, 22 bp, Homo sapiens
attgtacataaaatgtatgtct

SEQ ID NO: 7475374 - DNA, 22 bp, Homo sapiens
attgtacataaaatgtatgtct

SEQ ID NO: 7475375 - DNA, 22 bp, Homo sapiens
attgtacataaaatgtatgtct

SEQ ID NO: 7475376 - DNA, 22 bp, Homo sapiens
atttattggtttgcatggtgaa

SEQ ID NO: 7475377 - DNA, 22 bp, Homo sapiens
atttattggtttgcatggtgaa

SEQ ID NO: 7475378 - DNA, 22 bp, Homo sapiens
atttattggtttgcatggtgaa

SEQ ID NO: 7475379 - DNA, 19 bp, Homo sapiens
atttattgtatgattccat

SEQ ID NO: 7475380 - DNA, 19 bp, Homo sapiens
atttattgtatgattccat

SEQ ID NO: 7475381 - DNA, 19 bp, Homo sapiens
atttattgtatgattccat

SEQ ID NO: 7475382 - DNA, 19 bp, Homo sapiens
atttattgtatgattccat

SEQ ID NO: 7475383 - DNA, 19 bp, Homo sapiens
atttattgtatgattccat

SEQ ID NO: 7475384 - DNA, 19 bp, Homo sapiens
atttattgtatgattccat

SEQ ID NO: 7475385 - DNA, 19 bp, Homo sapiens
atttattgtatgattccat

SEQ ID NO: 7475386 - DNA, 19 bp, Homo sapiens
atttattgtatgattccat

SEQ ID NO: 7475387 - DNA, 19 bp, Homo sapiens
atttattgtatgattccat

SEQ ID NO: 7475388 - DNA, 19 bp, Homo sapiens
atttattgtatgattccat

SEQ ID NO: 7475389 - DNA, 22 bp, Homo sapiens
atttcaacagagtttgaaggca

SEQ ID NO: 7475390 - DNA, 19 bp, Homo sapiens
atttattgtatgattccat

SEQ ID NO: 7475391 - DNA, 22 bp, Homo sapiens
atttattggtttgcatggtgaa

SEQ ID NO: 7475392 - DNA, 22 bp, Homo sapiens
gccatggacttctgcggacaca

SEQ ID NO: 7475393 - DNA, 22 bp, Homo sapiens
atttattggtttgcatggtgaa

SEQ ID NO: 7475394 - DNA, 22 bp, Homo sapiens
atttattggtttgcatggtgaa

SEQ ID NO: 7475395 - DNA, 22 bp, Homo sapiens
gccatgagtaaactggaaagcc

SEQ ID NO: 7475396 - DNA, 22 bp, Homo sapiens
gccatggcccataccaggtgca

SEQ ID NO: 7475397 - DNA, 23 bp, Homo sapiens
gccatggctgccccacaggcctc

SEQ ID NO: 7475398 - DNA, 22 bp, Homo sapiens
gccatggcccataccaggtgca

SEQ ID NO: 7475399 - DNA, 22 bp, Homo sapiens
gccatggcccataccaggtgca

SEQ ID NO: 7475400 - DNA, 22 bp, Homo sapiens
gccatgcatccttggacttggc

SEQ ID NO: 7475401 - DNA, 22 bp, Homo sapiens
gccatgcctgtgtctccaggcc

SEQ ID NO: 7475402 - DNA, 22 bp, Homo sapiens
gccatgctggaggcttcgattt

SEQ ID NO: 7475403 - DNA, 22 bp, Homo sapiens
gccatgcttggtatgctgtgag

SEQ ID NO: 7475404 - DNA, 22 bp, Homo sapiens
gccatcctctgagcactaggca

SEQ ID NO: 7475405 - DNA, 22 bp, Homo sapiens
gccatcctgatgacaggccact

SEQ ID NO: 7475406 - DNA, 22 bp, Homo sapiens
gccatcctgatgacaggccact

SEQ ID NO: 7475407 - DNA, 22 bp, Homo sapiens
gccatcctggattcagaccaaa

SEQ ID NO: 7475408 - DNA, 22 bp, Homo sapiens
gccatcctctgagcactaggca

SEQ ID NO: 7475409 - DNA, 20 bp, Homo sapiens
gccatccagcctcccaggag

SEQ ID NO: 7475410 - DNA, 19 bp, Homo sapiens
gccatcccaagcattttgg

SEQ ID NO: 7475411 - DNA, 22 bp, Homo sapiens
gccatctcggagctatcaaagg

SEQ ID NO: 7475412 - DNA, 22 bp, Homo sapiens
gccatcctggattcagaccaaa

SEQ ID NO: 7475413 - DNA, 22 bp, Homo sapiens
gccatcctgtatcacaagatgt

SEQ ID NO: 7475414 - DNA, 22 bp, Homo sapiens
gccatctgcgcggtgtccagct

SEQ ID NO: 7475415 - DNA, 22 bp, Homo sapiens
gccatctgcgcggtgtccagct

SEQ ID NO: 7475416 - DNA, 22 bp, Homo sapiens
gccatcctgtatcacaagatgt

SEQ ID NO: 7475417 - DNA, 22 bp, Homo sapiens
gccatctggcattgcagcacct

SEQ ID NO: 7475418 - DNA, 22 bp, Homo sapiens
gccatctgctgctctccagtgt

SEQ ID NO: 7475419 - DNA, 22 bp, Homo sapiens
gccatgagaagaaatgaagggc

SEQ ID NO: 7475420 - DNA, 22 bp, Homo sapiens
gccatgaggctccgagaagtca

SEQ ID NO: 7475421 - DNA, 22 bp, Homo sapiens
gccatgagatgttttatttgca

SEQ ID NO: 7475422 - DNA, 22 bp, Homo sapiens
gccatgactctccataccaaag

SEQ ID NO: 7475423 - DNA, 22 bp, Homo sapiens
gccatgactctccataccaaag

SEQ ID NO: 7475424 - DNA, 22 bp, Homo sapiens
gccatgactctccataccaaag

SEQ ID NO: 7475425 - DNA, 22 bp, Homo sapiens
gccatgaactcgggcatggaga

SEQ ID NO: 7475426 - DNA, 22 bp, Homo sapiens
gccatcttgggccatgatgcca

SEQ ID NO: 7475427 - DNA, 22 bp, Homo sapiens
gccatgaactcgggcatggaga

SEQ ID NO: 7475428 - DNA, 22 bp, Homo sapiens
gccatgaaaccagaggatggct

SEQ ID NO: 7475429 - DNA, 21 bp, Homo sapiens
gccatcttgcaagatgagaaa

SEQ ID NO: 7475430 - DNA, 21 bp, Homo sapiens
gccatcttgcaagatgagaaa

SEQ ID NO: 7475431 - DNA, 21 bp, Homo sapiens
gccatcttgcaagatgagaaa

SEQ ID NO: 7475432 - DNA, 22 bp, Homo sapiens
gccatcttgagccaggaagtga

SEQ ID NO: 7475433 - DNA, 22 bp, Homo sapiens
gccatcttgagccaggaagtga

SEQ ID NO: 7475434 - DNA, 23 bp, Homo sapiens
gccatctggtatttcctgacttc

SEQ ID NO: 7475435 - DNA, 23 bp, Homo sapiens
gccatctggtatttcctgacttc

SEQ ID NO: 7475436 - DNA, 22 bp, Homo sapiens
gcccagggtctacaaaaatatt

SEQ ID NO: 7475437 - DNA, 22 bp, Homo sapiens
gcccagggtctacaaaaatatt

SEQ ID NO: 7475438 - DNA, 19 bp, Homo sapiens
gcccaggggcccgatgctg

SEQ ID NO: 7475439 - DNA, 19 bp, Homo sapiens
gcccaggggcccgatgctg

SEQ ID NO: 7475440 - DNA, 19 bp, Homo sapiens
gcccaggggcccgatgctg

SEQ ID NO: 7475441 - DNA, 19 bp, Homo sapiens
gcccaggggcccgatgctg

SEQ ID NO: 7475442 - DNA, 22 bp, Homo sapiens
gcccaggagttgaatgcagcag

SEQ ID NO: 7475443 - DNA, 22 bp, Homo sapiens
gcccaggagttgaatgcagcag

SEQ ID NO: 7475444 - DNA, 22 bp, Homo sapiens
gcccaggagttgaatgcagcag

SEQ ID NO: 7475445 - DNA, 22 bp, Homo sapiens
gcccaggagttgaagggctgac

SEQ ID NO: 7475446 - DNA, 22 bp, Homo sapiens
gcccaggagttgaatgcagcag

SEQ ID NO: 7475447 - DNA, 22 bp, Homo sapiens
gcccaggagttgaatgcagcag

SEQ ID NO: 7475448 - DNA, 22 bp, Homo sapiens
atttcaagtgttgagctcataa

SEQ ID NO: 7475449 - DNA, 22 bp, Homo sapiens
gcccaggagttgaagggctgac

SEQ ID NO: 7475450 - DNA, 22 bp, Homo sapiens
atttcaaggggtccttgcttgg

SEQ ID NO: 7475451 - DNA, 22 bp, Homo sapiens
atttcaaggggtccttgcttgg

SEQ ID NO: 7475452 - DNA, 22 bp, Homo sapiens
atttcaagtccaagtcttgggt

SEQ ID NO: 7475453 - DNA, 22 bp, Homo sapiens
atttcaagtgttgagctcataa

SEQ ID NO: 7475454 - DNA, 22 bp, Homo sapiens
atttcaagtgttgagctcataa

SEQ ID NO: 7475455 - DNA, 19 bp, Homo sapiens
atttcaagaggtttattgg

SEQ ID NO: 7475456 - DNA, 22 bp, Homo sapiens
atttcaagaaggcagcagtggt

SEQ ID NO: 7475457 - DNA, 22 bp, Homo sapiens
atttcaagaaggcagcagtggt

SEQ ID NO: 7475458 - DNA, 19 bp, Homo sapiens
atttcaagaggtttattgg

SEQ ID NO: 7475459 - DNA, 19 bp, Homo sapiens
atttcaagaggtttattgg

SEQ ID NO: 7475460 - DNA, 22 bp, Homo sapiens
atttcaacgttagatgtaatag

SEQ ID NO: 7475461 - DNA, 22 bp, Homo sapiens
atttcaacgttagatgtaatag

SEQ ID NO: 7475462 - DNA, 22 bp, Homo sapiens
atttcaaggctacagaaacctt

SEQ ID NO: 7475463 - DNA, 22 bp, Homo sapiens
atttcaaggctacagaaacctt

SEQ ID NO: 7475464 - DNA, 22 bp, Homo sapiens
atttcaaggactacttttcaat

SEQ ID NO: 7475465 - DNA, 22 bp, Homo sapiens
atttcaaggactacttttcaat

SEQ ID NO: 7475466 - DNA, 22 bp, Homo sapiens
atttcaaggactacttttcaat

SEQ ID NO: 7475467 - DNA, 22 bp, Homo sapiens
atttcaaggactacttttcaat

SEQ ID NO: 7475468 - DNA, 22 bp, Homo sapiens
atttcaaggctattaatataaa

SEQ ID NO: 7475469 - DNA, 22 bp, Homo sapiens
atttcaaggctacagaaacctt

SEQ ID NO: 7475470 - DNA, 22 bp, Homo sapiens
atttcaaggctacagaaacctt

SEQ ID NO: 7475471 - DNA, 22 bp, Homo sapiens
atttcaaggctattaatataaa

SEQ ID NO: 7475472 - DNA, 22 bp, Homo sapiens
atttcaaggctattaatataaa

SEQ ID NO: 7475473 - DNA, 22 bp, Homo sapiens
atttcaaggctattaatataaa

SEQ ID NO: 7475474 - DNA, 22 bp, Homo sapiens
gcccagggtgcttagaacccat

SEQ ID NO: 7475475 - DNA, 22 bp, Homo sapiens
gcccagggtgcttagaacccat

SEQ ID NO: 7475476 - DNA, 22 bp, Homo sapiens
gcccagggtgcttagaacccat

SEQ ID NO: 7475477 - DNA, 22 bp, Homo sapiens
gcccagggtgaagtgcagttgt

SEQ ID NO: 7475478 - DNA, 22 bp, Homo sapiens
gcccagggtgaagtgcagttgt

SEQ ID NO: 7475479 - DNA, 22 bp, Homo sapiens
gcccagggtgaagtgcagttgt

SEQ ID NO: 7475480 - DNA, 22 bp, Homo sapiens
gcccaggttggagagcagtggc

SEQ ID NO: 7475481 - DNA, 22 bp, Homo sapiens
gcccaggttggagagcagtggc

SEQ ID NO: 7475482 - DNA, 22 bp, Homo sapiens
gcccaggtttcatctgctccgt

SEQ ID NO: 7475483 - DNA, 22 bp, Homo sapiens
gcccaggttggagagcagtggc

SEQ ID NO: 7475484 - DNA, 22 bp, Homo sapiens
gcccaggttggagagcagtggc

SEQ ID NO: 7475485 - DNA, 22 bp, Homo sapiens
gcccaggtgccctctgccttac

SEQ ID NO: 7475486 - DNA, 22 bp, Homo sapiens
gcccaggtgccctctgccttac

SEQ ID NO: 7475487 - DNA, 22 bp, Homo sapiens
gcccaggtgccctctgccttac

SEQ ID NO: 7475488 - DNA, 22 bp, Homo sapiens
gcccagtctcttctggccctgt

SEQ ID NO: 7475489 - DNA, 22 bp, Homo sapiens
gcccagtctccaggagactctc

SEQ ID NO: 7475490 - DNA, 22 bp, Homo sapiens
gcccagtagttcaaggttgcag

SEQ ID NO: 7475491 - DNA, 22 bp, Homo sapiens
gcccagtagttcaaggttgcag

SEQ ID NO: 7475492 - DNA, 22 bp, Homo sapiens
gcccagtagttcaaggttgcag

SEQ ID NO: 7475493 - DNA, 22 bp, Homo sapiens
gcccagtagttcaaggttgcag

SEQ ID NO: 7475494 - DNA, 22 bp, Homo sapiens
gcccagtagttcaaggttgcag

SEQ ID NO: 7475495 - DNA, 22 bp, Homo sapiens
gcccagtagttcaaggttgcag

SEQ ID NO: 7475496 - DNA, 22 bp, Homo sapiens
gcccaggtttcatctgctccgt

SEQ ID NO: 7475497 - DNA, 22 bp, Homo sapiens
gcccaggtttcatctgctccgt

SEQ ID NO: 7475498 - DNA, 22 bp, Homo sapiens
gcccagtctcttctggccctgt

SEQ ID NO: 7475499 - DNA, 22 bp, Homo sapiens
gcccagtctcttctggccctgt

SEQ ID NO: 7475500 - DNA, 22 bp, Homo sapiens
gcccagtctcttctggccctgt

SEQ ID NO: 7475501 - DNA, 22 bp, Homo sapiens
gcccagtctcttctggccctgt

SEQ ID NO: 7475502 - DNA, 21 bp, Homo sapiens
gcccagtgatttcttcacagt

SEQ ID NO: 7475503 - DNA, 22 bp, Homo sapiens
gcccagtgccctagaatgcact

SEQ ID NO: 7475504 - DNA, 22 bp, Homo sapiens
gcccagtgccctagaatgcact

SEQ ID NO: 7475505 - DNA, 22 bp, Homo sapiens
gcccagtctcttctggccctgt

SEQ ID NO: 7475506 - DNA, 21 bp, Homo sapiens
gcccagtgatttcttcacagt

SEQ ID NO: 7475507 - DNA, 21 bp, Homo sapiens
gcccagtgatttcttcacagt

SEQ ID NO: 7475508 - DNA, 22 bp, Homo sapiens
gcccagtgccctagaatgcact

SEQ ID NO: 7475509 - DNA, 22 bp, Homo sapiens
gcccagtgctgagggtgctgct

SEQ ID NO: 7475510 - DNA, 22 bp, Homo sapiens
gcccagtgccctagaatgcact

SEQ ID NO: 7475511 - DNA, 21 bp, Homo sapiens
gcccagtgatttcttcacagt

SEQ ID NO: 7475512 - DNA, 22 bp, Homo sapiens
gcccagtgccctagaatgcact

SEQ ID NO: 7475513 - DNA, 22 bp, Homo sapiens
atttcttcaggtcagaaataga

SEQ ID NO: 7475514 - DNA, 22 bp, Homo sapiens
atttcttcaggtcagaaataga

SEQ ID NO: 7475515 - DNA, 22 bp, Homo sapiens
atttcttcaggtcagaaataga

SEQ ID NO: 7475516 - DNA, 22 bp, Homo sapiens
atttcttcaggttcttctagga

SEQ ID NO: 7475517 - DNA, 22 bp, Homo sapiens
atttcttcaggttcttctagga

SEQ ID NO: 7475518 - DNA, 22 bp, Homo sapiens
atttcttcaggttcttctagga

SEQ ID NO: 7475519 - DNA, 22 bp, Homo sapiens
atttcttcaggttcttctagga

SEQ ID NO: 7475520 - DNA, 22 bp, Homo sapiens
atttcttcaggttcttctagga

SEQ ID NO: 7475521 - DNA, 22 bp, Homo sapiens
atttcttcaggttcttctagga

SEQ ID NO: 7475522 - DNA, 22 bp, Homo sapiens
atttcttatgaatattgactgt

SEQ ID NO: 7475523 - DNA, 22 bp, Homo sapiens
atttcttatgaatattgactgt

SEQ ID NO: 7475524 - DNA, 22 bp, Homo sapiens
atttcttatgaatattgactgt

SEQ ID NO: 7475525 - DNA, 22 bp, Homo sapiens
atttcttatgaatattgactgt

SEQ ID NO: 7475526 - DNA, 22 bp, Homo sapiens
atttcttatgaatattgactgt

SEQ ID NO: 7475527 - DNA, 22 bp, Homo sapiens
atttcttatgaatattgactgt

SEQ ID NO: 7475528 - DNA, 22 bp, Homo sapiens
atttcttatgaatattgactgt

SEQ ID NO: 7475529 - DNA, 22 bp, Homo sapiens
atttcttatgaatattgactgt

SEQ ID NO: 7475530 - DNA, 22 bp, Homo sapiens
atttcttcaggtcagaaataga

SEQ ID NO: 7475531 - DNA, 22 bp, Homo sapiens
atttcttcaggtcagaaataga

SEQ ID NO: 7475532 - DNA, 22 bp, Homo sapiens
atttcttcaggtcagaaataga

SEQ ID NO: 7475533 - DNA, 22 bp, Homo sapiens
atttctgtttgctactataagt

SEQ ID NO: 7475534 - DNA, 22 bp, Homo sapiens
atttctgtttgctactataagt

SEQ ID NO: 7475535 - DNA, 22 bp, Homo sapiens
atttcttaaaacttcagggaga

SEQ ID NO: 7475536 - DNA, 22 bp, Homo sapiens
atttctgtttgctactataagt

SEQ ID NO: 7475537 - DNA, 22 bp, Homo sapiens
atttcttaaaacttcagggaga

SEQ ID NO: 7475538 - DNA, 22 bp, Homo sapiens
atttcttaaaacttcagggaga

SEQ ID NO: 7475539 - DNA, 22 bp, Homo sapiens
atttcttacataacaaattgtt

SEQ ID NO: 7475540 - DNA, 22 bp, Homo sapiens
atttcttacataacaaattgtt

SEQ ID NO: 7475541 - DNA, 22 bp, Homo sapiens
atttcttacataacaaattgtt

SEQ ID NO: 7475542 - DNA, 22 bp, Homo sapiens
atttcttatctgaggtctacat

SEQ ID NO: 7475543 - DNA, 22 bp, Homo sapiens
atttcttacataacaaattgtt

SEQ ID NO: 7475544 - DNA, 22 bp, Homo sapiens
atttcttatctgaggtctacat

SEQ ID NO: 7475545 - DNA, 22 bp, Homo sapiens
atttcttatctgaggtctacat

SEQ ID NO: 7475546 - DNA, 22 bp, Homo sapiens
atttcttatgaatattgactgt

SEQ ID NO: 7475547 - DNA, 22 bp, Homo sapiens
atttcttatgaatattgactgt

SEQ ID NO: 7475548 - DNA, 22 bp, Homo sapiens
atttcttacataacaaattgtt

SEQ ID NO: 7475549 - DNA, 22 bp, Homo sapiens
atttcttacataacaaattgtt

SEQ ID NO: 7475550 - DNA, 22 bp, Homo sapiens
atttcttacataacaaattgtt

SEQ ID NO: 7475551 - DNA, 22 bp, Homo sapiens
atttcttacataacaaattgtt

SEQ ID NO: 7475552 - DNA, 22 bp, Homo sapiens
atttcttacataacaaattgtt

SEQ ID NO: 7475553 - DNA, 22 bp, Homo sapiens
atttcttacataacaaattgtt

SEQ ID NO: 7475554 - DNA, 22 bp, Homo sapiens
gccctgtgatggagactagagg

SEQ ID NO: 7475555 - DNA, 22 bp, Homo sapiens
gccctgtgagtcatgcggcaga

SEQ ID NO: 7475556 - DNA, 22 bp, Homo sapiens
gccctgtgagtcatgcggcaga

SEQ ID NO: 7475557 - DNA, 22 bp, Homo sapiens
gccctgtgagtcatgcggcaga

SEQ ID NO: 7475558 - DNA, 22 bp, Homo sapiens
gccctgtgagtcatgcggcaga

SEQ ID NO: 7475559 - DNA, 22 bp, Homo sapiens
gccctgtgagtcatgcggcaga

SEQ ID NO: 7475560 - DNA, 22 bp, Homo sapiens
gccctgtgatggagactagagg

SEQ ID NO: 7475561 - DNA, 22 bp, Homo sapiens
gccctgtgatggagactagagg

SEQ ID NO: 7475562 - DNA, 20 bp, Homo sapiens
gccctgtgatgtcttgacct

SEQ ID NO: 7475563 - DNA, 20 bp, Homo sapiens
gccctgtgatgtcttgacct

SEQ ID NO: 7475564 - DNA, 20 bp, Homo sapiens
gccctgtgatgtcttgacct

SEQ ID NO: 7475565 - DNA, 20 bp, Homo sapiens
gccctgtgatgtcttgacct

SEQ ID NO: 7475566 - DNA, 22 bp, Homo sapiens
gccctgtgcaggtgtgcagcag

SEQ ID NO: 7475567 - DNA, 22 bp, Homo sapiens
gccctgtgcaggtgtgcagcag

SEQ ID NO: 7475568 - DNA, 22 bp, Homo sapiens
gccctgtgcaggtgtgcagcag

SEQ ID NO: 7475569 - DNA, 22 bp, Homo sapiens
gccctgtgcaggtgtgcagcag

SEQ ID NO: 7475570 - DNA, 22 bp, Homo sapiens
gccctgtgcaggtgtgcagcag

SEQ ID NO: 7475571 - DNA, 22 bp, Homo sapiens
gccctgtgccagtcacgctgtg

SEQ ID NO: 7475572 - DNA, 22 bp, Homo sapiens
gccctgtgccagtcacgctgtg

SEQ ID NO: 7475573 - DNA, 22 bp, Homo sapiens
gccctgtgcaggtgtgcagcag

SEQ ID NO: 7475574 - DNA, 22 bp, Homo sapiens
gccctgtgcaggtgtgcagcag

SEQ ID NO: 7475575 - DNA, 22 bp, Homo sapiens
atttctgtttgctactataagt

SEQ ID NO: 7475576 - DNA, 22 bp, Homo sapiens
gccctgtgccagtcacgctgtg

SEQ ID NO: 7475577 - DNA, 22 bp, Homo sapiens
gccctgtgccagtcacgctgtg

SEQ ID NO: 7475578 - DNA, 22 bp, Homo sapiens
gccctgtgccagtcacgctgtg

SEQ ID NO: 7475579 - DNA, 22 bp, Homo sapiens
gccctgtcggaactgcgacctc

SEQ ID NO: 7475580 - DNA, 22 bp, Homo sapiens
gccctgtcggaactgcgacctc

SEQ ID NO: 7475581 - DNA, 22 bp, Homo sapiens
gccctgtgagtcatgcggcaga

SEQ ID NO: 7475582 - DNA, 22 bp, Homo sapiens
gccctgtgagattagaacagca

SEQ ID NO: 7475583 - DNA, 22 bp, Homo sapiens
gccctgtcctcctgactgagtg

SEQ ID NO: 7475584 - DNA, 22 bp, Homo sapiens
gccctgtgagattagaacagca

SEQ ID NO: 7475585 - DNA, 22 bp, Homo sapiens
gccctggttttagaggagcagg

SEQ ID NO: 7475586 - DNA, 22 bp, Homo sapiens
gccctggttttagaggagcagg

SEQ ID NO: 7475587 - DNA, 22 bp, Homo sapiens
gccctgtcccttggcttctagg

SEQ ID NO: 7475588 - DNA, 22 bp, Homo sapiens
gccctgtcctcctgactgagtg

SEQ ID NO: 7475589 - DNA, 18 bp, Homo sapiens
gccctggtggagctggtg

SEQ ID NO: 7475590 - DNA, 18 bp, Homo sapiens
gccctggtggagctggtg

SEQ ID NO: 7475591 - DNA, 18 bp, Homo sapiens
gccctggtggagctggtg

SEQ ID NO: 7475592 - DNA, 22 bp, Homo sapiens
gccctggtgtgcccagcatggg

SEQ ID NO: 7475593 - DNA, 22 bp, Homo sapiens
gccctggtgtgcccagcatggg

SEQ ID NO: 7475594 - DNA, 22 bp, Homo sapiens
gccctggttttagaggagcagg

SEQ ID NO: 7475595 - DNA, 22 bp, Homo sapiens
gccctggtgtgcccagcatggg

SEQ ID NO: 7475596 - DNA, 22 bp, Homo sapiens
gccctggtgtgcccagcatggg

SEQ ID NO: 7475597 - DNA, 22 bp, Homo sapiens
atttcccaggactagaaatata

SEQ ID NO: 7475598 - DNA, 22 bp, Homo sapiens
atttcccagctttgatcagttt

SEQ ID NO: 7475599 - DNA, 22 bp, Homo sapiens
atttcccaggactagaaatata

SEQ ID NO: 7475600 - DNA, 22 bp, Homo sapiens
atttcccagctttgatcagttt

SEQ ID NO: 7475601 - DNA, 22 bp, Homo sapiens
atttcccagataaacagctgga

SEQ ID NO: 7475602 - DNA, 17 bp, Homo sapiens
atttcccagcagtgcta

SEQ ID NO: 7475603 - DNA, 22 bp, Homo sapiens
atttcccagggccctcatagtt

SEQ ID NO: 7475604 - DNA, 22 bp, Homo sapiens
atttcccaggactagaaatata

SEQ ID NO: 7475605 - DNA, 22 bp, Homo sapiens
atttcccagggcctgggatttg

SEQ ID NO: 7475606 - DNA, 22 bp, Homo sapiens
atttcccagggccctcatagtt

SEQ ID NO: 7475607 - DNA, 22 bp, Homo sapiens
atttcccaatacgctaagtgga

SEQ ID NO: 7475608 - DNA, 22 bp, Homo sapiens
gcccagtggtaaaagcaggcct

SEQ ID NO: 7475609 - DNA, 22 bp, Homo sapiens
gcccagtgggaagctaaggtgg

SEQ ID NO: 7475610 - DNA, 22 bp, Homo sapiens
gcccagtgggaagctaaggtgg

SEQ ID NO: 7475611 - DNA, 22 bp, Homo sapiens
gcccagtgctgagggtgctgct

SEQ ID NO: 7475612 - DNA, 22 bp, Homo sapiens
gcccagtgctgagggtgctgct

SEQ ID NO: 7475613 - DNA, 22 bp, Homo sapiens
gcccagtggcatcttcactgct

SEQ ID NO: 7475614 - DNA, 22 bp, Homo sapiens
gcccagtggcatcttcactgct

SEQ ID NO: 7475615 - DNA, 22 bp, Homo sapiens
gcccagtggcatcttcactgct

SEQ ID NO: 7475616 - DNA, 22 bp, Homo sapiens
gcccagtgctgagggtgctgct

SEQ ID NO: 7475617 - DNA, 22 bp, Homo sapiens
gcccagtgctgagggtgctgct

SEQ ID NO: 7475618 - DNA, 22 bp, Homo sapiens
gcccagtgctgagggtgctgct

SEQ ID NO: 7475619 - DNA, 22 bp, Homo sapiens
atttcccactctactacatgct

SEQ ID NO: 7475620 - DNA, 22 bp, Homo sapiens
atttcccagataaacagctgga

SEQ ID NO: 7475621 - DNA, 22 bp, Homo sapiens
atttcccactctactacatgct

SEQ ID NO: 7475622 - DNA, 22 bp, Homo sapiens
atttcccactctactacatgct

SEQ ID NO: 7475623 - DNA, 22 bp, Homo sapiens
atttcccactcaggccgcggcg

SEQ ID NO: 7475624 - DNA, 17 bp, Homo sapiens
gccctgcctgctgccct

SEQ ID NO: 7475625 - DNA, 17 bp, Homo sapiens
gccctgcctgctgccct

SEQ ID NO: 7475626 - DNA, 17 bp, Homo sapiens
gccctgcctgctgccct

SEQ ID NO: 7475627 - DNA, 17 bp, Homo sapiens
gccctgcctgctgccct

SEQ ID NO: 7475628 - DNA, 22 bp, Homo sapiens
gccctgggctccctgctccaca

SEQ ID NO: 7475629 - DNA, 22 bp, Homo sapiens
gccctgggctccctgctccaca

SEQ ID NO: 7475630 - DNA, 22 bp, Homo sapiens
gccctgggctccctgctccaca

SEQ ID NO: 7475631 - DNA, 22 bp, Homo sapiens
gccctggggaaggtgtctccaa

SEQ ID NO: 7475632 - DNA, 22 bp, Homo sapiens
gccctggggaaggtgtctccaa

SEQ ID NO: 7475633 - DNA, 22 bp, Homo sapiens
gccctgggctccctgctccaca

SEQ ID NO: 7475634 - DNA, 22 bp, Homo sapiens
gccctgggctccctgctccaca

SEQ ID NO: 7475635 - DNA, 22 bp, Homo sapiens
gccctgggctccctgctccaca

SEQ ID NO: 7475636 - DNA, 22 bp, Homo sapiens
gccctggggaaggtgtctccaa

SEQ ID NO: 7475637 - DNA, 22 bp, Homo sapiens
gccctggggaaggtgtctccaa

SEQ ID NO: 7475638 - DNA, 22 bp, Homo sapiens
gccctggggaaggtgtctccaa

SEQ ID NO: 7475639 - DNA, 22 bp, Homo sapiens
gccctggggaaggtgtctccaa

SEQ ID NO: 7475640 - DNA, 23 bp, Homo sapiens
atttcctactataaaagaggtaa

SEQ ID NO: 7475641 - DNA, 22 bp, Homo sapiens
gccctgcctgccggtgtgggtc

SEQ ID NO: 7475642 - DNA, 22 bp, Homo sapiens
atttcctaatttatgcaggagt

SEQ ID NO: 7475643 - DNA, 23 bp, Homo sapiens
atttcctactataaaagaggtaa

SEQ ID NO: 7475644 - DNA, 22 bp, Homo sapiens
atttcctaatttatgcaggagt

SEQ ID NO: 7475645 - DNA, 22 bp, Homo sapiens
atttcctaacagaggcaacagt

SEQ ID NO: 7475646 - DNA, 22 bp, Homo sapiens
atttcctaatttagggatagac

SEQ ID NO: 7475647 - DNA, 23 bp, Homo sapiens
atttcctaaaagataatcattac

SEQ ID NO: 7475648 - DNA, 23 bp, Homo sapiens
atttcctaaaagataatcattac

SEQ ID NO: 7475649 - DNA, 23 bp, Homo sapiens
atttcctaaaagataatcattac

SEQ ID NO: 7475650 - DNA, 23 bp, Homo sapiens
atttcctaaaagataatcattac

SEQ ID NO: 7475651 - DNA, 23 bp, Homo sapiens
atttcctaaaagataatcattac

SEQ ID NO: 7475652 - DNA, 22 bp, Homo sapiens
atttccctccagggaaagctta

SEQ ID NO: 7475653 - DNA, 22 bp, Homo sapiens
atttccctccagggaaagctta

SEQ ID NO: 7475654 - DNA, 22 bp, Homo sapiens
atttcccatgtgaatcaattgg

SEQ ID NO: 7475655 - DNA, 23 bp, Homo sapiens
atttcccattgtgtcagcagagc

SEQ ID NO: 7475656 - DNA, 22 bp, Homo sapiens
attatggacatcaaataactct

SEQ ID NO: 7475657 - DNA, 22 bp, Homo sapiens
attatggacgttaattttggaa

SEQ ID NO: 7475658 - DNA, 22 bp, Homo sapiens
attatggacatcaaataactct

SEQ ID NO: 7475659 - DNA, 22 bp, Homo sapiens
attatggacatcaaataactct

SEQ ID NO: 7475660 - DNA, 22 bp, Homo sapiens
attatggatggaggcattagtc

SEQ ID NO: 7475661 - DNA, 22 bp, Homo sapiens
attatggagaaatatgtacagg

SEQ ID NO: 7475662 - DNA, 22 bp, Homo sapiens
attatggctttcatgggcaata

SEQ ID NO: 7475663 - DNA, 22 bp, Homo sapiens
attatggagaaatatgtacagg

SEQ ID NO: 7475664 - DNA, 22 bp, Homo sapiens
attatgggtataacacagttat

SEQ ID NO: 7475665 - DNA, 22 bp, Homo sapiens
attatggatggaggcattagtc

SEQ ID NO: 7475666 - DNA, 22 bp, Homo sapiens
attatgtatttggtatagtttg

SEQ ID NO: 7475667 - DNA, 22 bp, Homo sapiens
attatgtatttggtatagtttg

SEQ ID NO: 7475668 - DNA, 22 bp, Homo sapiens
attatgtatttggtatagtttg

SEQ ID NO: 7475669 - DNA, 22 bp, Homo sapiens
attatgtatttggtatagtttg

SEQ ID NO: 7475670 - DNA, 22 bp, Homo sapiens
attatgtatttggtatagtttg

SEQ ID NO: 7475671 - DNA, 22 bp, Homo sapiens
attatgtaggttaggtggttgt

SEQ ID NO: 7475672 - DNA, 22 bp, Homo sapiens
attatgtagctaaaaattgtgt

SEQ ID NO: 7475673 - DNA, 22 bp, Homo sapiens
attatgtaggttaggtggttgt

SEQ ID NO: 7475674 - DNA, 22 bp, Homo sapiens
attatgtagctaaaaattgtgt

SEQ ID NO: 7475675 - DNA, 22 bp, Homo sapiens
attatgtagctaaaaattgtgt

SEQ ID NO: 7475676 - DNA, 22 bp, Homo sapiens
attatgtagctaaaaattgtgt

SEQ ID NO: 7475677 - DNA, 22 bp, Homo sapiens
attatgggtataacacagttat

SEQ ID NO: 7475678 - DNA, 22 bp, Homo sapiens
attatgtaactgtggttcagca

SEQ ID NO: 7475679 - DNA, 22 bp, Homo sapiens
attatgtaactgtggttcagca

SEQ ID NO: 7475680 - DNA, 22 bp, Homo sapiens
attatgtctttagatatttggt

SEQ ID NO: 7475681 - DNA, 22 bp, Homo sapiens
attatgtctttagatatttggt

SEQ ID NO: 7475682 - DNA, 22 bp, Homo sapiens
attatgtatttggtatagtttg

SEQ ID NO: 7475683 - DNA, 22 bp, Homo sapiens
attatgtatttggtatagtttg

SEQ ID NO: 7475684 - DNA, 21 bp, Homo sapiens
attatgttcccatctgtttgg

SEQ ID NO: 7475685 - DNA, 21 bp, Homo sapiens
attatgttcccatctgtttgg

SEQ ID NO: 7475686 - DNA, 22 bp, Homo sapiens
attatgtgtaacgagtttattg

SEQ ID NO: 7475687 - DNA, 21 bp, Homo sapiens
attatgttcccatctgtttgg

SEQ ID NO: 7475688 - DNA, 22 bp, Homo sapiens
attattaaaatgtgtttctctt

SEQ ID NO: 7475689 - DNA, 21 bp, Homo sapiens
attatgttcccatctgtttgg

SEQ ID NO: 7475690 - DNA, 22 bp, Homo sapiens
attattaaaatgtgtttctctt

SEQ ID NO: 7475691 - DNA, 22 bp, Homo sapiens
gcagacaaagcagcatgcctat

SEQ ID NO: 7475692 - DNA, 22 bp, Homo sapiens
gcagagaaggattgaaaccaga

SEQ ID NO: 7475693 - DNA, 22 bp, Homo sapiens
gcagacaatttattagcagatt

SEQ ID NO: 7475694 - DNA, 22 bp, Homo sapiens
gcagaattttctgttttctaga

SEQ ID NO: 7475695 - DNA, 22 bp, Homo sapiens
gcagacaaagcagcatgcctat

SEQ ID NO: 7475696 - DNA, 22 bp, Homo sapiens
gcagacaaagcagcatgcctat

SEQ ID NO: 7475697 - DNA, 22 bp, Homo sapiens
gcagaatttgggggtaaccttt

SEQ ID NO: 7475698 - DNA, 22 bp, Homo sapiens
attattaaaatgtgtttctctt

SEQ ID NO: 7475699 - DNA, 22 bp, Homo sapiens
gcacccacttaggccagtcaat

SEQ ID NO: 7475700 - DNA, 22 bp, Homo sapiens
gcacccacttaggccagtcaat

SEQ ID NO: 7475701 - DNA, 22 bp, Homo sapiens
gcaccattgctgggctagttcc

SEQ ID NO: 7475702 - DNA, 22 bp, Homo sapiens
gcaccatgatggagcctcatta

SEQ ID NO: 7475703 - DNA, 22 bp, Homo sapiens
gcaccatgatggagcctcatta

SEQ ID NO: 7475704 - DNA, 22 bp, Homo sapiens
gcacccagaataaggacaggac

SEQ ID NO: 7475705 - DNA, 22 bp, Homo sapiens
gcaccattgctgggctagttcc

SEQ ID NO: 7475706 - DNA, 22 bp, Homo sapiens
gcacccagaataaggacaggac

SEQ ID NO: 7475707 - DNA, 22 bp, Homo sapiens
gcacccagaataaggacaggac

SEQ ID NO: 7475708 - DNA, 22 bp, Homo sapiens
gcacccagaataaggacaggac

SEQ ID NO: 7475709 - DNA, 22 bp, Homo sapiens
gcacccagaataaggacaggac

SEQ ID NO: 7475710 - DNA, 22 bp, Homo sapiens
gcacccagaataaggacaggac

SEQ ID NO: 7475711 - DNA, 22 bp, Homo sapiens
gcacccacttaggccagtcaat

SEQ ID NO: 7475712 - DNA, 22 bp, Homo sapiens
gcacccagaataaggacaggac

SEQ ID NO: 7475713 - DNA, 22 bp, Homo sapiens
gcacccagaataaggacaggac

SEQ ID NO: 7475714 - DNA, 23 bp, Homo sapiens
attatccagtgcacttcacagct

SEQ ID NO: 7475715 - DNA, 23 bp, Homo sapiens
attatccagtgcacttcacagct

SEQ ID NO: 7475716 - DNA, 22 bp, Homo sapiens
gcacccagagggcagggtctcc

SEQ ID NO: 7475717 - DNA, 22 bp, Homo sapiens
gcacccagagggcagggtctcc

SEQ ID NO: 7475718 - DNA, 22 bp, Homo sapiens
attatctaggaattgacagaag

SEQ ID NO: 7475719 - DNA, 22 bp, Homo sapiens
attatcctcagaaaacatgtga

SEQ ID NO: 7475720 - DNA, 22 bp, Homo sapiens
attatgcattccaaccttattc

SEQ ID NO: 7475721 - DNA, 22 bp, Homo sapiens
attatgccaggacatttcccta

SEQ ID NO: 7475722 - DNA, 22 bp, Homo sapiens
attatgctcacctggcaacttg

SEQ ID NO: 7475723 - DNA, 18 bp, Homo sapiens
attatgctcattacagtg

SEQ ID NO: 7475724 - DNA, 22 bp, Homo sapiens
attatgctcttcatctctgtag

SEQ ID NO: 7475725 - DNA, 22 bp, Homo sapiens
attatgctggtttacacatttt

SEQ ID NO: 7475726 - DNA, 22 bp, Homo sapiens
attatgcttaggaaaatatgaa

SEQ ID NO: 7475727 - DNA, 22 bp, Homo sapiens
attatgcatatacatttgacta

SEQ ID NO: 7475728 - DNA, 22 bp, Homo sapiens
attatgcatttgttagtattaa

SEQ ID NO: 7475729 - DNA, 22 bp, Homo sapiens
attatgagaggagaaaagtcag

SEQ ID NO: 7475730 - DNA, 22 bp, Homo sapiens
attatgcatatacatttgacta

SEQ ID NO: 7475731 - DNA, 22 bp, Homo sapiens
attatgaagttgagggaccctg

SEQ ID NO: 7475732 - DNA, 22 bp, Homo sapiens
attatcttgataaaatggcagt

SEQ ID NO: 7475733 - DNA, 22 bp, Homo sapiens
attatcttgataaaatggcagt

SEQ ID NO: 7475734 - DNA, 22 bp, Homo sapiens
attatctatgtagaatgatttt

SEQ ID NO: 7475735 - DNA, 22 bp, Homo sapiens
attatctatgtagaatgatttt

SEQ ID NO: 7475736 - DNA, 22 bp, Homo sapiens
attatctatgtagaatgatttt

SEQ ID NO: 7475737 - DNA, 19 bp, Homo sapiens
gcagagatgtggtagcttg

SEQ ID NO: 7475738 - DNA, 22 bp, Homo sapiens
gcagagattatgccatggaaag

SEQ ID NO: 7475739 - DNA, 22 bp, Homo sapiens
gcagagattatgccatggaaag

SEQ ID NO: 7475740 - DNA, 19 bp, Homo sapiens
gcagagatgtggtagcttg

SEQ ID NO: 7475741 - DNA, 22 bp, Homo sapiens
gcagagatgaggcactcatccc

SEQ ID NO: 7475742 - DNA, 22 bp, Homo sapiens
gcagagatgatgataagcctgc

SEQ ID NO: 7475743 - DNA, 22 bp, Homo sapiens
gcagagatggctgcctctgagt

SEQ ID NO: 7475744 - DNA, 22 bp, Homo sapiens
gcagagatgggccagtgacgca

SEQ ID NO: 7475745 - DNA, 22 bp, Homo sapiens
gcagagatgggccagtgacgca

SEQ ID NO: 7475746 - DNA, 22 bp, Homo sapiens
gcagagatgaggcactcatccc

SEQ ID NO: 7475747 - DNA, 22 bp, Homo sapiens
gcagagatgagctatcaggaca

SEQ ID NO: 7475748 - DNA, 22 bp, Homo sapiens
gcagagatgagctatcaggaca

SEQ ID NO: 7475749 - DNA, 22 bp, Homo sapiens
gcagagatctgagaaggctgcc

SEQ ID NO: 7475750 - DNA, 22 bp, Homo sapiens
gcagagatctgagaaggctgcc

SEQ ID NO: 7475751 - DNA, 22 bp, Homo sapiens
gcagagatgagctatcaggaca

SEQ ID NO: 7475752 - DNA, 22 bp, Homo sapiens
gcagagatgatgataagcctgc

SEQ ID NO: 7475753 - DNA, 22 bp, Homo sapiens
gcagagatggctgatctattcc

SEQ ID NO: 7475754 - DNA, 22 bp, Homo sapiens
gcagagatggctgatctattcc

SEQ ID NO: 7475755 - DNA, 22 bp, Homo sapiens
gcagagatggctgcctctgagt

SEQ ID NO: 7475756 - DNA, 22 bp, Homo sapiens
gcagagatctgagaaggctgcc

SEQ ID NO: 7475757 - DNA, 22 bp, Homo sapiens
gcagagatcggacactcagtaa

SEQ ID NO: 7475758 - DNA, 22 bp, Homo sapiens
gcagagatcggacactcagtaa

SEQ ID NO: 7475759 - DNA, 22 bp, Homo sapiens
gcagagatctgagaaggctgcc

SEQ ID NO: 7475760 - DNA, 22 bp, Homo sapiens
gcagagatcggacactcagtaa

SEQ ID NO: 7475761 - DNA, 22 bp, Homo sapiens
gcagagatccttgctggatgac

SEQ ID NO: 7475762 - DNA, 22 bp, Homo sapiens
gcagagatccttgctggatgac

SEQ ID NO: 7475763 - DNA, 22 bp, Homo sapiens
gcagagatattgatatagattt

SEQ ID NO: 7475764 - DNA, 22 bp, Homo sapiens
gcagagatattgatatagattt

SEQ ID NO: 7475765 - DNA, 22 bp, Homo sapiens
gcagagataagtagacaggatg

SEQ ID NO: 7475766 - DNA, 22 bp, Homo sapiens
gcagagataagtagacaggatg

SEQ ID NO: 7475767 - DNA, 22 bp, Homo sapiens
gcagagataagtagacaggatg

SEQ ID NO: 7475768 - DNA, 22 bp, Homo sapiens
gcagagataagtagacaggatg

SEQ ID NO: 7475769 - DNA, 22 bp, Homo sapiens
gcagagatattgatatagattt

SEQ ID NO: 7475770 - DNA, 22 bp, Homo sapiens
gcagagatattgatatagattt

SEQ ID NO: 7475771 - DNA, 22 bp, Homo sapiens
gcagagatccagggtataggtt

SEQ ID NO: 7475772 - DNA, 22 bp, Homo sapiens
gcagagatccagggtataggtt

SEQ ID NO: 7475773 - DNA, 22 bp, Homo sapiens
gcagagatccttgctggatgac

SEQ ID NO: 7475774 - DNA, 22 bp, Homo sapiens
gcagagatccttgctggatgac

SEQ ID NO: 7475775 - DNA, 22 bp, Homo sapiens
attcaagtggctgctatgttaa

SEQ ID NO: 7475776 - DNA, 22 bp, Homo sapiens
attcaagtggctgctatgttaa

SEQ ID NO: 7475777 - DNA, 22 bp, Homo sapiens
attcaagtggctgctatgttaa

SEQ ID NO: 7475778 - DNA, 22 bp, Homo sapiens
attcaagttcttctgtctttgc

SEQ ID NO: 7475779 - DNA, 22 bp, Homo sapiens
attcaagttcttctgtctttgc

SEQ ID NO: 7475780 - DNA, 22 bp, Homo sapiens
attcaataaatatgctacatgg

SEQ ID NO: 7475781 - DNA, 22 bp, Homo sapiens
attcaagttcttctgtctttgc

SEQ ID NO: 7475782 - DNA, 22 bp, Homo sapiens
gcagagattggaagatgaattt

SEQ ID NO: 7475783 - DNA, 22 bp, Homo sapiens
gcagagattatgccatggaaag

SEQ ID NO: 7475784 - DNA, 22 bp, Homo sapiens
gcagagattatgccatggaaag

SEQ ID NO: 7475785 - DNA, 22 bp, Homo sapiens
gcagagattggtgcactgatga

SEQ ID NO: 7475786 - DNA, 22 bp, Homo sapiens
gcagagattggtgcactgatga

SEQ ID NO: 7475787 - DNA, 22 bp, Homo sapiens
gcagagattggtgcactgatga

SEQ ID NO: 7475788 - DNA, 22 bp, Homo sapiens
attcaagtccagcttctctaca

SEQ ID NO: 7475789 - DNA, 22 bp, Homo sapiens
attcaagtccagcttctctaca

SEQ ID NO: 7475790 - DNA, 22 bp, Homo sapiens
gcagagatggctgcctctgagt

SEQ ID NO: 7475791 - DNA, 22 bp, Homo sapiens
gcagagattggaagatgaattt

SEQ ID NO: 7475792 - DNA, 22 bp, Homo sapiens
attcaagtacagttttcttctt

SEQ ID NO: 7475793 - DNA, 22 bp, Homo sapiens
attcaagtccagcttctctaca

SEQ ID NO: 7475794 - DNA, 22 bp, Homo sapiens
gcagagactccactgtcttgtg

SEQ ID NO: 7475795 - DNA, 22 bp, Homo sapiens
gcagagactccactgtcttgtg

SEQ ID NO: 7475796 - DNA, 22 bp, Homo sapiens
gcagagaggaatgaagccatcc

SEQ ID NO: 7475797 - DNA, 22 bp, Homo sapiens
gcagagaggaatgaagccatcc

SEQ ID NO: 7475798 - DNA, 22 bp, Homo sapiens
gcagagaggaatgaagccatcc

SEQ ID NO: 7475799 - DNA, 22 bp, Homo sapiens
gcagagaggaatgaagccatcc

SEQ ID NO: 7475800 - DNA, 22 bp, Homo sapiens
gcagagaggaatgaagccatcc

SEQ ID NO: 7475801 - DNA, 22 bp, Homo sapiens
gcagagaggatattattgtcca

SEQ ID NO: 7475802 - DNA, 22 bp, Homo sapiens
gcagagaggatattattgtcca

SEQ ID NO: 7475803 - DNA, 22 bp, Homo sapiens
gcagagaggatattattgtcca

SEQ ID NO: 7475804 - DNA, 22 bp, Homo sapiens
gcagagagttgggctgcgccag

SEQ ID NO: 7475805 - DNA, 22 bp, Homo sapiens
gcagagagttgggctgcgccag

SEQ ID NO: 7475806 - DNA, 22 bp, Homo sapiens
gcagagagttgggctgcgccag

SEQ ID NO: 7475807 - DNA, 22 bp, Homo sapiens
gcagagagttgggctgcgccag

SEQ ID NO: 7475808 - DNA, 22 bp, Homo sapiens
gcagagagttgggctgcgccag

SEQ ID NO: 7475809 - DNA, 22 bp, Homo sapiens
gcagagataagtagacaggatg

SEQ ID NO: 7475810 - DNA, 22 bp, Homo sapiens
gcagagaggatattattgtcca

SEQ ID NO: 7475811 - DNA, 22 bp, Homo sapiens
gcagagagttgggctgcgccag

SEQ ID NO: 7475812 - DNA, 22 bp, Homo sapiens
gcagagaggatattattgtcca

SEQ ID NO: 7475813 - DNA, 22 bp, Homo sapiens
gcagagaggatattattgtcca

SEQ ID NO: 7475814 - DNA, 22 bp, Homo sapiens
gcagagagttgggctgcgccag

SEQ ID NO: 7475815 - DNA, 22 bp, Homo sapiens
gcagagagttgggctgcgccag

SEQ ID NO: 7475816 - DNA, 22 bp, Homo sapiens
gcagagagttgggctgcgccag

SEQ ID NO: 7475817 - DNA, 22 bp, Homo sapiens
gcagagagttgggctgcgccag

SEQ ID NO: 7475818 - DNA, 22 bp, Homo sapiens
gcagagaccccgcagtgaggcc

SEQ ID NO: 7475819 - DNA, 22 bp, Homo sapiens
gcagagactagtagtgcagact

SEQ ID NO: 7475820 - DNA, 22 bp, Homo sapiens
gcagagactagtagtgcagact

SEQ ID NO: 7475821 - DNA, 22 bp, Homo sapiens
gcagagacaggataatgggttc

SEQ ID NO: 7475822 - DNA, 22 bp, Homo sapiens
gcagagactccactgtcttgtg

SEQ ID NO: 7475823 - DNA, 22 bp, Homo sapiens
gcagagactccactgtcttgtg

SEQ ID NO: 7475824 - DNA, 22 bp, Homo sapiens
gcagagacaggataatgggttc

SEQ ID NO: 7475825 - DNA, 23 bp, Homo sapiens
gcagagacagccccagcgcgatg

SEQ ID NO: 7475826 - DNA, 23 bp, Homo sapiens
gcagagacagccccagcgcgatg

SEQ ID NO: 7475827 - DNA, 22 bp, Homo sapiens
gcagagacagactaatgaaaag

SEQ ID NO: 7475828 - DNA, 22 bp, Homo sapiens
gcagagacagactaatgaaaag

SEQ ID NO: 7475829 - DNA, 22 bp, Homo sapiens
gcagagacagactaatgaaaag

SEQ ID NO: 7475830 - DNA, 21 bp, Homo sapiens
gcagagaatgaactttggctt

SEQ ID NO: 7475831 - DNA, 22 bp, Homo sapiens
gcagagaaggattgaaaccaga

SEQ ID NO: 7475832 - DNA, 22 bp, Homo sapiens
gcagagaaggattgaaaccaga

SEQ ID NO: 7475833 - DNA, 21 bp, Homo sapiens
gcagagaatgaactttggctt

SEQ ID NO: 7475834 - DNA, 21 bp, Homo sapiens
gcagagaatgaactttggctt

SEQ ID NO: 7475835 - DNA, 21 bp, Homo sapiens
gcagagaatgaactttggctt

SEQ ID NO: 7475836 - DNA, 21 bp, Homo sapiens
gcagagaatgaactttggctt

SEQ ID NO: 7475837 - DNA, 22 bp, Homo sapiens
attatattgagtataaccagag

SEQ ID NO: 7475838 - DNA, 22 bp, Homo sapiens
attatattgagtataaccagag

SEQ ID NO: 7475839 - DNA, 22 bp, Homo sapiens
attatattgagtataaccagag

SEQ ID NO: 7475840 - DNA, 22 bp, Homo sapiens
attatattgagtataaccagag

SEQ ID NO: 7475841 - DNA, 22 bp, Homo sapiens
attatatttgaaaggttggaag

SEQ ID NO: 7475842 - DNA, 22 bp, Homo sapiens
attatattgagtataaccagag

SEQ ID NO: 7475843 - DNA, 22 bp, Homo sapiens
attatattgagtataaccagag

SEQ ID NO: 7475844 - DNA, 22 bp, Homo sapiens
attatattgagtataaccagag

SEQ ID NO: 7475845 - DNA, 22 bp, Homo sapiens
attatattgagtataaccagag

SEQ ID NO: 7475846 - DNA, 22 bp, Homo sapiens
attatattgagtataaccagag

SEQ ID NO: 7475847 - DNA, 22 bp, Homo sapiens
attatatgtgggatagaattta

SEQ ID NO: 7475848 - DNA, 22 bp, Homo sapiens
attatatgtgggatagaattta

SEQ ID NO: 7475849 - DNA, 22 bp, Homo sapiens
attatataggacttgcccttcc

SEQ ID NO: 7475850 - DNA, 22 bp, Homo sapiens
attatataggacttgcccttcc

SEQ ID NO: 7475851 - DNA, 22 bp, Homo sapiens
attatcagccgtcccactacat

SEQ ID NO: 7475852 - DNA, 22 bp, Homo sapiens
attatcagaaattcaaagggtg

SEQ ID NO: 7475853 - DNA, 22 bp, Homo sapiens
attatcagccgtcccactacat

SEQ ID NO: 7475854 - DNA, 22 bp, Homo sapiens
attatcagccgtcccactacat

SEQ ID NO: 7475855 - DNA, 22 bp, Homo sapiens
attatccaacacccagttacat

SEQ ID NO: 7475856 - DNA, 22 bp, Homo sapiens
attatcacaggtgagtctcact

SEQ ID NO: 7475857 - DNA, 22 bp, Homo sapiens
attatatttgaaaggttggaag

SEQ ID NO: 7475858 - DNA, 22 bp, Homo sapiens
attatcaagtttactgtgtgga

SEQ ID NO: 7475859 - DNA, 22 bp, Homo sapiens
gcacacagaatcagtgggcata

SEQ ID NO: 7475860 - DNA, 22 bp, Homo sapiens
gcacacagaattgattcactgt

SEQ ID NO: 7475861 - DNA, 22 bp, Homo sapiens
gcacacagaattgattcactgt

SEQ ID NO: 7475862 - DNA, 22 bp, Homo sapiens
gcacacagaattgattcactgt

SEQ ID NO: 7475863 - DNA, 22 bp, Homo sapiens
gcacacagaattgattcactgt

SEQ ID NO: 7475864 - DNA, 22 bp, Homo sapiens
gcacacagaattgattcactgt

SEQ ID NO: 7475865 - DNA, 22 bp, Homo sapiens
attatccaacacccagttacat

SEQ ID NO: 7475866 - DNA, 22 bp, Homo sapiens
attatccaacacccagttacat

SEQ ID NO: 7475867 - DNA, 22 bp, Homo sapiens
attatccagcaccaatgtcaga

SEQ ID NO: 7475868 - DNA, 22 bp, Homo sapiens
attatccagcaccaatgtcaga

SEQ ID NO: 7475869 - DNA, 22 bp, Homo sapiens
attatccagcaccaatgtcaga

SEQ ID NO: 7475870 - DNA, 22 bp, Homo sapiens
attagttgtacagttcattttg

SEQ ID NO: 7475871 - DNA, 22 bp, Homo sapiens
attagttgtgtggttctcaatt

SEQ ID NO: 7475872 - DNA, 22 bp, Homo sapiens
attagtttggtgcaaaagtaat

SEQ ID NO: 7475873 - DNA, 22 bp, Homo sapiens
attagttggggtggagaaggat

SEQ ID NO: 7475874 - DNA, 22 bp, Homo sapiens
attaagatcattgtagaagatt

SEQ ID NO: 7475875 - DNA, 22 bp, Homo sapiens
attaagatcattgtagaagatt

SEQ ID NO: 7475876 - DNA, 22 bp, Homo sapiens
attaagatcattgtagaagatt

SEQ ID NO: 7475877 - DNA, 22 bp, Homo sapiens
attaagatcattgtagaagatt

SEQ ID NO: 7475878 - DNA, 22 bp, Homo sapiens
attaagatcattgtagaagatt

SEQ ID NO: 7475879 - DNA, 22 bp, Homo sapiens
attaagatcattgtagaagatt

SEQ ID NO: 7475880 - DNA, 22 bp, Homo sapiens
attaagatcattgtagaagatt

SEQ ID NO: 7475881 - DNA, 22 bp, Homo sapiens
attaagagttacaaatagagta

SEQ ID NO: 7475882 - DNA, 22 bp, Homo sapiens
attaagagttacaaatagagta

SEQ ID NO: 7475883 - DNA, 22 bp, Homo sapiens
attaagagcctactatgtgccg

SEQ ID NO: 7475884 - DNA, 21 bp, Homo sapiens
attaacttgttaacctaaagt

SEQ ID NO: 7475885 - DNA, 22 bp, Homo sapiens
attaagaatcacacggctgtgt

SEQ ID NO: 7475886 - DNA, 22 bp, Homo sapiens
attaacttttgatcagtgtggt

SEQ ID NO: 7475887 - DNA, 22 bp, Homo sapiens
attaactgtactttctaatttt

SEQ ID NO: 7475888 - DNA, 22 bp, Homo sapiens
attaactgtactttctaatttt

SEQ ID NO: 7475889 - DNA, 21 bp, Homo sapiens
attaacttgttaacctaaagt

SEQ ID NO: 7475890 - DNA, 22 bp, Homo sapiens
attaagaatcacacggctgtgt

SEQ ID NO: 7475891 - DNA, 22 bp, Homo sapiens
attaagactattgatatttaca

SEQ ID NO: 7475892 - DNA, 22 bp, Homo sapiens
attaagactgcccatgttttta

SEQ ID NO: 7475893 - DNA, 22 bp, Homo sapiens
attaagactgcccatgttttta

SEQ ID NO: 7475894 - DNA, 22 bp, Homo sapiens
attataggcttgagccaccgtg

SEQ ID NO: 7475895 - DNA, 22 bp, Homo sapiens
attatataaaattctggaagct

SEQ ID NO: 7475896 - DNA, 22 bp, Homo sapiens
attatagggaattctagaagtc

SEQ ID NO: 7475897 - DNA, 22 bp, Homo sapiens
attataggcttgagccaccgtg

SEQ ID NO: 7475898 - DNA, 22 bp, Homo sapiens
attataggcttgagccaccgtg

SEQ ID NO: 7475899 - DNA, 22 bp, Homo sapiens
attataggcttgagccaccgtg

SEQ ID NO: 7475900 - DNA, 22 bp, Homo sapiens
attagtttggtgcaaaagtaat

SEQ ID NO: 7475901 - DNA, 22 bp, Homo sapiens
attagtttggtgcaaaagtaat

SEQ ID NO: 7475902 - DNA, 22 bp, Homo sapiens
attagtttggtgcaaaagtaat

SEQ ID NO: 7475903 - DNA, 22 bp, Homo sapiens
attataggcttgagccaccgtg

SEQ ID NO: 7475904 - DNA, 22 bp, Homo sapiens
attataggcttgagccaccgtg

SEQ ID NO: 7475905 - DNA, 22 bp, Homo sapiens
attataggcttgagccaccgtg

SEQ ID NO: 7475906 - DNA, 22 bp, Homo sapiens
attataggcttgagccaccgtg

SEQ ID NO: 7475907 - DNA, 22 bp, Homo sapiens
gcaccaggcttagagccccagg

SEQ ID NO: 7475908 - DNA, 22 bp, Homo sapiens
gcaccaggcttagagccccagg

SEQ ID NO: 7475909 - DNA, 22 bp, Homo sapiens
gcaccaggcttagagccccagg

SEQ ID NO: 7475910 - DNA, 22 bp, Homo sapiens
gcaccaggcttagagccccagg

SEQ ID NO: 7475911 - DNA, 22 bp, Homo sapiens
gcaccaggcttagagccccagg

SEQ ID NO: 7475912 - DNA, 22 bp, Homo sapiens
gcaccaggcagctgagcaggcc

SEQ ID NO: 7475913 - DNA, 22 bp, Homo sapiens
gcaccaggcttagagccccagg

SEQ ID NO: 7475914 - DNA, 22 bp, Homo sapiens
gcaccaggcagctgagcaggcc

SEQ ID NO: 7475915 - DNA, 22 bp, Homo sapiens
gcaccaggcagctgagcaggcc

SEQ ID NO: 7475916 - DNA, 22 bp, Homo sapiens
gcaccaggtgcagccgggcccc

SEQ ID NO: 7475917 - DNA, 22 bp, Homo sapiens
gcaccaggtgcagccgggcccc

SEQ ID NO: 7475918 - DNA, 22 bp, Homo sapiens
gcaccagggtgctgtgttctgg

SEQ ID NO: 7475919 - DNA, 22 bp, Homo sapiens
gcaccaggtgcagccgggcccc

SEQ ID NO: 7475920 - DNA, 22 bp, Homo sapiens
gcaccagggagggtgtgcttca

SEQ ID NO: 7475921 - DNA, 22 bp, Homo sapiens
gcaccagggagggtgtgcttca

SEQ ID NO: 7475922 - DNA, 22 bp, Homo sapiens
gcaccagggagggtgtgcttca

SEQ ID NO: 7475923 - DNA, 22 bp, Homo sapiens
gcaccagggagggtgtgcttca

SEQ ID NO: 7475924 - DNA, 22 bp, Homo sapiens
gcacagggcctggcacataaga

SEQ ID NO: 7475925 - DNA, 22 bp, Homo sapiens
gcacagggcctggcacataaga

SEQ ID NO: 7475926 - DNA, 22 bp, Homo sapiens
gcacacaggcagtttccagcca

SEQ ID NO: 7475927 - DNA, 22 bp, Homo sapiens
gcacagggctgccaggcggctt

SEQ ID NO: 7475928 - DNA, 22 bp, Homo sapiens
gcaccaggaggcccttctcatc

SEQ ID NO: 7475929 - DNA, 22 bp, Homo sapiens
gcaccaggcagctgagcaggcc

SEQ ID NO: 7475930 - DNA, 22 bp, Homo sapiens
gcaccaggcagctgagcaggcc

SEQ ID NO: 7475931 - DNA, 22 bp, Homo sapiens
gcaccaggcagctgagcaggcc

SEQ ID NO: 7475932 - DNA, 22 bp, Homo sapiens
gcacacagccagctgagggcta

SEQ ID NO: 7475933 - DNA, 22 bp, Homo sapiens
gcaccaggcagctgagcaggcc

SEQ ID NO: 7475934 - DNA, 22 bp, Homo sapiens
gcaccaggcagctgagcaggcc

SEQ ID NO: 7475935 - DNA, 22 bp, Homo sapiens
gcaccaggcagctgagcaggcc

SEQ ID NO: 7475936 - DNA, 22 bp, Homo sapiens
gcaccaggcagctgagcaggcc

SEQ ID NO: 7475937 - DNA, 22 bp, Homo sapiens
gcaccaggcagctgagcaggcc

SEQ ID NO: 7475938 - DNA, 22 bp, Homo sapiens
gcaccaggcagctgagcaggcc

SEQ ID NO: 7475939 - DNA, 22 bp, Homo sapiens
gcaccaggcagctgagcaggcc

SEQ ID NO: 7475940 - DNA, 22 bp, Homo sapiens
gcacacagccagctgagggcta

SEQ ID NO: 7475941 - DNA, 22 bp, Homo sapiens
gcacacagctagattaccattc

SEQ ID NO: 7475942 - DNA, 22 bp, Homo sapiens
gcacacagctagattaccattc

SEQ ID NO: 7475943 - DNA, 22 bp, Homo sapiens
gcacacagctagattaccattc

SEQ ID NO: 7475944 - DNA, 22 bp, Homo sapiens
gcacacagccagctgagggcta

SEQ ID NO: 7475945 - DNA, 22 bp, Homo sapiens
gcacacagccagctgagggcta

SEQ ID NO: 7475946 - DNA, 22 bp, Homo sapiens
gcacacagccagctgagggcta

SEQ ID NO: 7475947 - DNA, 22 bp, Homo sapiens
gcacacaggcagtttccagcca

SEQ ID NO: 7475948 - DNA, 22 bp, Homo sapiens
gcacacagctagattaccattc

SEQ ID NO: 7475949 - DNA, 22 bp, Homo sapiens
gcacacagctagattaccattc

SEQ ID NO: 7475950 - DNA, 22 bp, Homo sapiens
gcacacaggcagtttccagcca

SEQ ID NO: 7475951 - DNA, 22 bp, Homo sapiens
gcacacaggcagtttccagcca

SEQ ID NO: 7475952 - DNA, 22 bp, Homo sapiens
gcacacaggcagtttccagcca

SEQ ID NO: 7475953 - DNA, 22 bp, Homo sapiens
gcacacagattaggaaacagaa

SEQ ID NO: 7475954 - DNA, 16 bp, Homo sapiens
gcacacagccagcctt

SEQ ID NO: 7475955 - DNA, 16 bp, Homo sapiens
gcacacagccagcctt

SEQ ID NO: 7475956 - DNA, 22 bp, Homo sapiens
gcacacagattaggaaacagaa

SEQ ID NO: 7475957 - DNA, 22 bp, Homo sapiens
gcacacagagaggtggtatgtc

SEQ ID NO: 7475958 - DNA, 22 bp, Homo sapiens
gcacacagattaggaaacagaa

SEQ ID NO: 7475959 - DNA, 22 bp, Homo sapiens
gcacacagattaggaaacagaa

SEQ ID NO: 7475960 - DNA, 22 bp, Homo sapiens
gcacacagaattgattcactgt

SEQ ID NO: 7475961 - DNA, 22 bp, Homo sapiens
gcacacagaattgattcactgt

SEQ ID NO: 7475962 - DNA, 22 bp, Homo sapiens
gcacacagaattgattcactgt

SEQ ID NO: 7475963 - DNA, 22 bp, Homo sapiens
gcacacagagaggtggtatgtc

SEQ ID NO: 7475964 - DNA, 22 bp, Homo sapiens
gcacacagagaggtggtatgtc

SEQ ID NO: 7475965 - DNA, 22 bp, Homo sapiens
gcacacagactaaccatatttc

SEQ ID NO: 7475966 - DNA, 22 bp, Homo sapiens
gcacacagactaaccatatttc

SEQ ID NO: 7475967 - DNA, 22 bp, Homo sapiens
gcacacagactaaccatatttc

SEQ ID NO: 7475968 - DNA, 22 bp, Homo sapiens
gattcagcctctgcttccctga

SEQ ID NO: 7475969 - DNA, 22 bp, Homo sapiens
gattcagcttctgagcagtaat

SEQ ID NO: 7475970 - DNA, 22 bp, Homo sapiens
gattcactcatattttacgttt

SEQ ID NO: 7475971 - DNA, 22 bp, Homo sapiens
gatgtgtatttggaagacaaaa

SEQ ID NO: 7475972 - DNA, 22 bp, Homo sapiens
gattcactcatattttacgttt

SEQ ID NO: 7475973 - DNA, 22 bp, Homo sapiens
gattcactcatattttacgttt

SEQ ID NO: 7475974 - DNA, 22 bp, Homo sapiens
gattcattctcagtttctagag

SEQ ID NO: 7475975 - DNA, 22 bp, Homo sapiens
gattcataccgtttcttctcca

SEQ ID NO: 7475976 - DNA, 22 bp, Homo sapiens
gattcattctcagtttctagag

SEQ ID NO: 7475977 - DNA, 22 bp, Homo sapiens
gattcattctcagtttctagag

SEQ ID NO: 7475978 - DNA, 22 bp, Homo sapiens
gattcattctcagtttctagag

SEQ ID NO: 7475979 - DNA, 22 bp, Homo sapiens
gattccacagcttcgaggtctt

SEQ ID NO: 7475980 - DNA, 22 bp, Homo sapiens
gattccaaatggagatgtccac

SEQ ID NO: 7475981 - DNA, 22 bp, Homo sapiens
gattcagtgagggtgagaagaa

SEQ ID NO: 7475982 - DNA, 22 bp, Homo sapiens
gattcaggcctgcatctcagca

SEQ ID NO: 7475983 - DNA, 22 bp, Homo sapiens
gattcagtgagggtgagaagaa

SEQ ID NO: 7475984 - DNA, 22 bp, Homo sapiens
gattcagtgggctttgggacag

SEQ ID NO: 7475985 - DNA, 22 bp, Homo sapiens
gatgtggatgatcttagatggt

SEQ ID NO: 7475986 - DNA, 22 bp, Homo sapiens
gatgtggcataagagtgaacac

SEQ ID NO: 7475987 - DNA, 22 bp, Homo sapiens
gatgtggcatctgggtgacagc

SEQ ID NO: 7475988 - DNA, 22 bp, Homo sapiens
gatgtggcatagaatgatggtt

SEQ ID NO: 7475989 - DNA, 22 bp, Homo sapiens
gatgtggggataatactggtac

SEQ ID NO: 7475990 - DNA, 22 bp, Homo sapiens
gatgtgtacctccttttgtttt

SEQ ID NO: 7475991 - DNA, 22 bp, Homo sapiens
gatgtgtaacatgctgtgacat

SEQ ID NO: 7475992 - DNA, 22 bp, Homo sapiens
gatgtgtaacatgctgtgacat

SEQ ID NO: 7475993 - DNA, 22 bp, Homo sapiens
gatgtgggtgtcttcagctggt

SEQ ID NO: 7475994 - DNA, 22 bp, Homo sapiens
gatgtggtgcagggcagtgctt

SEQ ID NO: 7475995 - DNA, 22 bp, Homo sapiens
gatgtgggtgtcttcagctggt

SEQ ID NO: 7475996 - DNA, 22 bp, Homo sapiens
gatgtggggttgagggaccagc

SEQ ID NO: 7475997 - DNA, 22 bp, Homo sapiens
gatgtggggttgagggaccagc

SEQ ID NO: 7475998 - DNA, 22 bp, Homo sapiens
gatgtcttggcttgctctctgt

SEQ ID NO: 7475999 - DNA, 22 bp, Homo sapiens
gatgtcttggcttgctctctgt

SEQ ID NO: 7476000 - DNA, 22 bp, Homo sapiens
gatgtcttcccatgttcatgtg

SEQ ID NO: 7476001 - DNA, 22 bp, Homo sapiens
gatgtcttctcaactgtagacc

SEQ ID NO: 7476002 - DNA, 22 bp, Homo sapiens
gatgtcttctcaactgtagacc

SEQ ID NO: 7476003 - DNA, 22 bp, Homo sapiens
gatggccacatacatggctggg

SEQ ID NO: 7476004 - DNA, 22 bp, Homo sapiens
gatgtcttcagatggcaagaga

SEQ ID NO: 7476005 - DNA, 22 bp, Homo sapiens
gatgtcttcccatgttcatgtg

SEQ ID NO: 7476006 - DNA, 22 bp, Homo sapiens
gatgtcttcagatggcaagaga

SEQ ID NO: 7476007 - DNA, 22 bp, Homo sapiens
gatgtcttggtcaacttgggct

SEQ ID NO: 7476008 - DNA, 22 bp, Homo sapiens
gatgtcttggtcaacttgggct

SEQ ID NO: 7476009 - DNA, 20 bp, Homo sapiens
gatgtcttggtcacagtggc

SEQ ID NO: 7476010 - DNA, 22 bp, Homo sapiens
gatgtcttgttgatttcattct

SEQ ID NO: 7476011 - DNA, 20 bp, Homo sapiens
gatgtcttggtcacagtggc

SEQ ID NO: 7476012 - DNA, 22 bp, Homo sapiens
gatgtctttctaatactggctt

SEQ ID NO: 7476013 - DNA, 22 bp, Homo sapiens
gatgtctttagggcaaaatatt

SEQ ID NO: 7476014 - DNA, 22 bp, Homo sapiens
gatgtctttagggcaaaatatt

SEQ ID NO: 7476015 - DNA, 22 bp, Homo sapiens
gatgtctttgaggctcactgct

SEQ ID NO: 7476016 - DNA, 22 bp, Homo sapiens
gatgtctttctgtgtgcctaga

SEQ ID NO: 7476017 - DNA, 20 bp, Homo sapiens
gatgtcttggtcacagtggc

SEQ ID NO: 7476018 - DNA, 22 bp, Homo sapiens
gatgtctttctgtgtgcctaga

SEQ ID NO: 7476019 - DNA, 22 bp, Homo sapiens
gatgtctttgccatgcatgtgt

SEQ ID NO: 7476020 - DNA, 22 bp, Homo sapiens
gatgtctttgccatgcatgtgt

SEQ ID NO: 7476021 - DNA, 22 bp, Homo sapiens
gatgtctttgctgttatccact

SEQ ID NO: 7476022 - DNA, 20 bp, Homo sapiens
gatgtcttttctggtctcct

SEQ ID NO: 7476023 - DNA, 22 bp, Homo sapiens
gatgtctttttccaggctcttt

SEQ ID NO: 7476024 - DNA, 22 bp, Homo sapiens
gatgtctttttccaggctcttt

SEQ ID NO: 7476025 - DNA, 22 bp, Homo sapiens
gatgtgaggactcatgtggagg

SEQ ID NO: 7476026 - DNA, 22 bp, Homo sapiens
gattctcttggatgtaggcata

SEQ ID NO: 7476027 - DNA, 22 bp, Homo sapiens
gattctcttggatgtaggcata

SEQ ID NO: 7476028 - DNA, 22 bp, Homo sapiens
gattctgagctggtgttttacg

SEQ ID NO: 7476029 - DNA, 22 bp, Homo sapiens
gattctgagctggtgttttacg

SEQ ID NO: 7476030 - DNA, 22 bp, Homo sapiens
gattctgagctggtgttttacg

SEQ ID NO: 7476031 - DNA, 22 bp, Homo sapiens
gattctgaaattaacagactgg

SEQ ID NO: 7476032 - DNA, 18 bp, Homo sapiens
gattctgattctggaggc

SEQ ID NO: 7476033 - DNA, 18 bp, Homo sapiens
gattctgattctggaggc

SEQ ID NO: 7476034 - DNA, 18 bp, Homo sapiens
gattctgattctggaggc

SEQ ID NO: 7476035 - DNA, 22 bp, Homo sapiens
gattctgcgatgaggacgagct

SEQ ID NO: 7476036 - DNA, 22 bp, Homo sapiens
gattctggagttaaggatgcct

SEQ ID NO: 7476037 - DNA, 22 bp, Homo sapiens
gattctgcttaccatttgatct

SEQ ID NO: 7476038 - DNA, 22 bp, Homo sapiens
gattctgaggccttgctcaaga

SEQ ID NO: 7476039 - DNA, 22 bp, Homo sapiens
gattctgaggccttgctcaaga

SEQ ID NO: 7476040 - DNA, 22 bp, Homo sapiens
gattctgatctatagtgttata

SEQ ID NO: 7476041 - DNA, 22 bp, Homo sapiens
gattctgatctatagtgttata

SEQ ID NO: 7476042 - DNA, 22 bp, Homo sapiens
gattctgatctatagtgttata

SEQ ID NO: 7476043 - DNA, 22 bp, Homo sapiens
gattctgatgccagttcaggac

SEQ ID NO: 7476044 - DNA, 22 bp, Homo sapiens
gattctgatgctggtggaggaa

SEQ ID NO: 7476045 - DNA, 22 bp, Homo sapiens
gattctgatgctggtggaggaa

SEQ ID NO: 7476046 - DNA, 22 bp, Homo sapiens
gattccttggctctgtctcagg

SEQ ID NO: 7476047 - DNA, 22 bp, Homo sapiens
gattccttccctacccaggcct

SEQ ID NO: 7476048 - DNA, 22 bp, Homo sapiens
gattccttggctctgtctcagg

SEQ ID NO: 7476049 - DNA, 22 bp, Homo sapiens
gattcctttcgcctgccgagct

SEQ ID NO: 7476050 - DNA, 22 bp, Homo sapiens
gattcctttcgcctgccgagct

SEQ ID NO: 7476051 - DNA, 22 bp, Homo sapiens
gattcctttcgcctgccgagct

SEQ ID NO: 7476052 - DNA, 22 bp, Homo sapiens
gattcctttggtgaactgccga

SEQ ID NO: 7476053 - DNA, 22 bp, Homo sapiens
gattcctttggtgaactgccga

SEQ ID NO: 7476054 - DNA, 22 bp, Homo sapiens
gattctctctggatcccatgga

SEQ ID NO: 7476055 - DNA, 20 bp, Homo sapiens
gattcctctgagaactggag

SEQ ID NO: 7476056 - DNA, 22 bp, Homo sapiens
gattcctagcaaactcttggag

SEQ ID NO: 7476057 - DNA, 22 bp, Homo sapiens
gattcctatccctgaaacagtg

SEQ ID NO: 7476058 - DNA, 22 bp, Homo sapiens
gattcctgctattcacagggct

SEQ ID NO: 7476059 - DNA, 22 bp, Homo sapiens
gattcctgattccagcacaacc

SEQ ID NO: 7476060 - DNA, 22 bp, Homo sapiens
gattcctatttggctcctgttc

SEQ ID NO: 7476061 - DNA, 22 bp, Homo sapiens
gattcctgggctacaccccaga

SEQ ID NO: 7476062 - DNA, 22 bp, Homo sapiens
gattccttccctacccaggcct

SEQ ID NO: 7476063 - DNA, 23 bp, Homo sapiens
gattcctagtacttctgacattg

SEQ ID NO: 7476064 - DNA, 22 bp, Homo sapiens
gattcctagatctcccctttag

SEQ ID NO: 7476065 - DNA, 22 bp, Homo sapiens
gattcccatgtctgaggaggtg

SEQ ID NO: 7476066 - DNA, 22 bp, Homo sapiens
gattcctaacagcaacaggtga

SEQ ID NO: 7476067 - DNA, 22 bp, Homo sapiens
gattcccatcctcagcagcagc

SEQ ID NO: 7476068 - DNA, 22 bp, Homo sapiens
gattcccatcctcagcagcagc

SEQ ID NO: 7476069 - DNA, 22 bp, Homo sapiens
gattcccatgtctgaggaggtg

SEQ ID NO: 7476070 - DNA, 22 bp, Homo sapiens
gattccacagcttcgaggtctt

SEQ ID NO: 7476071 - DNA, 22 bp, Homo sapiens
gattccagaaaccagtgaagat

SEQ ID NO: 7476072 - DNA, 22 bp, Homo sapiens
gattccagaaaccagtgaagat

SEQ ID NO: 7476073 - DNA, 22 bp, Homo sapiens
gattccagaaaccagtgaagat

SEQ ID NO: 7476074 - DNA, 22 bp, Homo sapiens
gattccagaaaccagtgaagat

SEQ ID NO: 7476075 - DNA, 22 bp, Homo sapiens
gattccagactatttatactgc

SEQ ID NO: 7476076 - DNA, 22 bp, Homo sapiens
gattccagactatttatactgc

SEQ ID NO: 7476077 - DNA, 22 bp, Homo sapiens
gattccagcttggtatttactc

SEQ ID NO: 7476078 - DNA, 22 bp, Homo sapiens
gattccagcttggtatttactc

SEQ ID NO: 7476079 - DNA, 22 bp, Homo sapiens
gattccagtccgtgactattct

SEQ ID NO: 7476080 - DNA, 22 bp, Homo sapiens
gattccagtccgtgactattct

SEQ ID NO: 7476081 - DNA, 20 bp, Homo sapiens
gattccagttctatccactt

SEQ ID NO: 7476082 - DNA, 20 bp, Homo sapiens
gattccagttctatccactt

SEQ ID NO: 7476083 - DNA, 22 bp, Homo sapiens
attaactgtactttctaatttt

SEQ ID NO: 7476084 - DNA, 22 bp, Homo sapiens
attaacatgcagccagacacac

SEQ ID NO: 7476085 - DNA, 22 bp, Homo sapiens
attaacatgcagccagacacac

SEQ ID NO: 7476086 - DNA, 22 bp, Homo sapiens
attaacagtttatgatgtgcct

SEQ ID NO: 7476087 - DNA, 22 bp, Homo sapiens
attaacagaattttacatgctt

SEQ ID NO: 7476088 - DNA, 22 bp, Homo sapiens
attaacatgagttggagatagg

SEQ ID NO: 7476089 - DNA, 22 bp, Homo sapiens
attaaattttcactaggctccc

SEQ ID NO: 7476090 - DNA, 22 bp, Homo sapiens
attaaattttcactaggctccc

SEQ ID NO: 7476091 - DNA, 22 bp, Homo sapiens
attaaattttcactaggctccc

SEQ ID NO: 7476092 - DNA, 22 bp, Homo sapiens
attaacagaattttacatgctt

SEQ ID NO: 7476093 - DNA, 22 bp, Homo sapiens
attaacagaattttacatgctt

SEQ ID NO: 7476094 - DNA, 22 bp, Homo sapiens
attaacagaattttacatgctt

SEQ ID NO: 7476095 - DNA, 22 bp, Homo sapiens
attaacagcagcatccccagcc

SEQ ID NO: 7476096 - DNA, 22 bp, Homo sapiens
gattcttgggccttctgaagtt

SEQ ID NO: 7476097 - DNA, 22 bp, Homo sapiens
attaaattggatctgcatagtt

SEQ ID NO: 7476098 - DNA, 22 bp, Homo sapiens
attaaattggatctgcatagtt

SEQ ID NO: 7476099 - DNA, 22 bp, Homo sapiens
attaaattggacgctgggggaa

SEQ ID NO: 7476100 - DNA, 22 bp, Homo sapiens
attaaattggatctgcatagtt

SEQ ID NO: 7476101 - DNA, 22 bp, Homo sapiens
attaaattggatctgcatagtt

SEQ ID NO: 7476102 - DNA, 22 bp, Homo sapiens
gattcttgggccttctgaagtt

SEQ ID NO: 7476103 - DNA, 22 bp, Homo sapiens
attaaattggatctgcatagtt

SEQ ID NO: 7476104 - DNA, 23 bp, Homo sapiens
atgttattattagcagtcttgcc

SEQ ID NO: 7476105 - DNA, 23 bp, Homo sapiens
atgttattattagcagtcttgcc

SEQ ID NO: 7476106 - DNA, 22 bp, Homo sapiens
atgttattcaatttgaatccaa

SEQ ID NO: 7476107 - DNA, 21 bp, Homo sapiens
atgttattctgttcctccagc

SEQ ID NO: 7476108 - DNA, 22 bp, Homo sapiens
atgttattaaagtacagattct

SEQ ID NO: 7476109 - DNA, 22 bp, Homo sapiens
atgttattaaagtacagattct

SEQ ID NO: 7476110 - DNA, 22 bp, Homo sapiens
atgttattaaagtacagattct

SEQ ID NO: 7476111 - DNA, 22 bp, Homo sapiens
atgttatgtgcaagatacataa

SEQ ID NO: 7476112 - DNA, 22 bp, Homo sapiens
atgttatgtgcaagatacataa

SEQ ID NO: 7476113 - DNA, 22 bp, Homo sapiens
atgttattaaagtacagattct

SEQ ID NO: 7476114 - DNA, 22 bp, Homo sapiens
atgttattaaagtacagattct

SEQ ID NO: 7476115 - DNA, 23 bp, Homo sapiens
atgttattattagcagtcttgcc

SEQ ID NO: 7476116 - DNA, 22 bp, Homo sapiens
atgttatgtctgggaaggggta

SEQ ID NO: 7476117 - DNA, 22 bp, Homo sapiens
atgttatgtctgggaaggggta

SEQ ID NO: 7476118 - DNA, 22 bp, Homo sapiens
atgttatgtctgggaaggggta

SEQ ID NO: 7476119 - DNA, 22 bp, Homo sapiens
atgttatgtgcaagatacataa

SEQ ID NO: 7476120 - DNA, 22 bp, Homo sapiens
gagtggggcgtggatccagcgt

SEQ ID NO: 7476121 - DNA, 22 bp, Homo sapiens
gagtggggcgtggatccagcgt

SEQ ID NO: 7476122 - DNA, 22 bp, Homo sapiens
gagtggggcgtggatccagcgt

SEQ ID NO: 7476123 - DNA, 22 bp, Homo sapiens
gagtggggcgaagtcggcgagt

SEQ ID NO: 7476124 - DNA, 22 bp, Homo sapiens
gagtggggcgaagtcggcgagt

SEQ ID NO: 7476125 - DNA, 22 bp, Homo sapiens
gagtggggcgaagtcggcgagt

SEQ ID NO: 7476126 - DNA, 22 bp, Homo sapiens
gagtggggcccactgctgggtg

SEQ ID NO: 7476127 - DNA, 22 bp, Homo sapiens
gagtggggcgtggatccagcgt

SEQ ID NO: 7476128 - DNA, 22 bp, Homo sapiens
gagtggggcgtggatccagcgt

SEQ ID NO: 7476129 - DNA, 22 bp, Homo sapiens
gagtggggcgtggatccagcgt

SEQ ID NO: 7476130 - DNA, 22 bp, Homo sapiens
gagtggggcgtggatccagcgt

SEQ ID NO: 7476131 - DNA, 22 bp, Homo sapiens
gagtggggcgaagtcggcgagt

SEQ ID NO: 7476132 - DNA, 22 bp, Homo sapiens
gagtggggcgaagtcggcgagt

SEQ ID NO: 7476133 - DNA, 22 bp, Homo sapiens
gagtggggcgaagtcggcgagt

SEQ ID NO: 7476134 - DNA, 22 bp, Homo sapiens
gagtgggcaccgtgggcacact

SEQ ID NO: 7476135 - DNA, 20 bp, Homo sapiens
gagtgggccatggagtgaga

SEQ ID NO: 7476136 - DNA, 20 bp, Homo sapiens
gagtgggccatggagtgaga

SEQ ID NO: 7476137 - DNA, 20 bp, Homo sapiens
gagtgggccatggagtgaga

SEQ ID NO: 7476138 - DNA, 22 bp, Homo sapiens
gagtgggcaccgtgggcacact

SEQ ID NO: 7476139 - DNA, 21 bp, Homo sapiens
gagtgggctgagatggggctg

SEQ ID NO: 7476140 - DNA, 20 bp, Homo sapiens
gagtgggccatggagtgaga

SEQ ID NO: 7476141 - DNA, 20 bp, Homo sapiens
gagtgggccatggagtgaga

SEQ ID NO: 7476142 - DNA, 22 bp, Homo sapiens
gagtggggaaagccaggacaga

SEQ ID NO: 7476143 - DNA, 22 bp, Homo sapiens
gagtggggaaagccaggacaga

SEQ ID NO: 7476144 - DNA, 22 bp, Homo sapiens
gagtggggaaagccaggacaga

SEQ ID NO: 7476145 - DNA, 22 bp, Homo sapiens
gagtggggaaagccaggacaga

SEQ ID NO: 7476146 - DNA, 22 bp, Homo sapiens
gagtggggaaagccaggacaga

SEQ ID NO: 7476147 - DNA, 22 bp, Homo sapiens
gagtggggaaagccaggacaga

SEQ ID NO: 7476148 - DNA, 22 bp, Homo sapiens
gagtggggaaagccaggacaga

SEQ ID NO: 7476149 - DNA, 21 bp, Homo sapiens
gagtgggctgagatggggctg

SEQ ID NO: 7476150 - DNA, 22 bp, Homo sapiens
gagtgggcttggggagagtttg

SEQ ID NO: 7476151 - DNA, 22 bp, Homo sapiens
gagtgggcttggggagagtttg

SEQ ID NO: 7476152 - DNA, 22 bp, Homo sapiens
gagtggggaaagccaggacaga

SEQ ID NO: 7476153 - DNA, 22 bp, Homo sapiens
gagtggggaaagccaggacaga

SEQ ID NO: 7476154 - DNA, 22 bp, Homo sapiens
gagtggggaaagccaggacaga

SEQ ID NO: 7476155 - DNA, 22 bp, Homo sapiens
gagtggggaaagccaggacaga

SEQ ID NO: 7476156 - DNA, 22 bp, Homo sapiens
gagtggggaaagccaggacaga

SEQ ID NO: 7476157 - DNA, 23 bp, Homo sapiens
gagtggggagaaattggttaaac

SEQ ID NO: 7476158 - DNA, 23 bp, Homo sapiens
gagtggggagaaattggttaaac

SEQ ID NO: 7476159 - DNA, 23 bp, Homo sapiens
gagtggggagaaattggttaaac

SEQ ID NO: 7476160 - DNA, 23 bp, Homo sapiens
gagtggggagaaattggttaaac

SEQ ID NO: 7476161 - DNA, 23 bp, Homo sapiens
gagtggggagaaattggttaaac

SEQ ID NO: 7476162 - DNA, 22 bp, Homo sapiens
gagtggggcccactgctgggtg

SEQ ID NO: 7476163 - DNA, 22 bp, Homo sapiens
gagtggggcccactgctgggtg

SEQ ID NO: 7476164 - DNA, 22 bp, Homo sapiens
gagtggggcccactgctgggtg

SEQ ID NO: 7476165 - DNA, 22 bp, Homo sapiens
gagtggggcccactgctgggtg

SEQ ID NO: 7476166 - DNA, 22 bp, Homo sapiens
gagtggggcccactgctgggtg

SEQ ID NO: 7476167 - DNA, 22 bp, Homo sapiens
gagtggggcccactgctgggtg

SEQ ID NO: 7476168 - DNA, 22 bp, Homo sapiens
gagtggggcccactgctgggtg

SEQ ID NO: 7476169 - DNA, 22 bp, Homo sapiens
gagtggggcccactgctgggtg

SEQ ID NO: 7476170 - DNA, 22 bp, Homo sapiens
gagtggggcccactgctgggtg

SEQ ID NO: 7476171 - DNA, 22 bp, Homo sapiens
gagtggggcccactgctgggtg

SEQ ID NO: 7476172 - DNA, 22 bp, Homo sapiens
gagtggggcccactgctgggtg

SEQ ID NO: 7476173 - DNA, 22 bp, Homo sapiens
gatggcagtcaaccaggtgagg

SEQ ID NO: 7476174 - DNA, 22 bp, Homo sapiens
gatggcagtcaaccaggtgagg

SEQ ID NO: 7476175 - DNA, 22 bp, Homo sapiens
gatggcagtcaaccaggtgagg

SEQ ID NO: 7476176 - DNA, 22 bp, Homo sapiens
gatggcagtcaaccaggtgagg

SEQ ID NO: 7476177 - DNA, 22 bp, Homo sapiens
gatggcaggtgatagccgagtc

SEQ ID NO: 7476178 - DNA, 22 bp, Homo sapiens
gatggcaggtgatagccgagtc

SEQ ID NO: 7476179 - DNA, 22 bp, Homo sapiens
gatggcaggtgatagccgagtc

SEQ ID NO: 7476180 - DNA, 22 bp, Homo sapiens
gatggcagtggagttagtgatt

SEQ ID NO: 7476181 - DNA, 22 bp, Homo sapiens
gatggcagtgggcctcgagtcc

SEQ ID NO: 7476182 - DNA, 22 bp, Homo sapiens
gatggcagtcaaccaggtgagg

SEQ ID NO: 7476183 - DNA, 22 bp, Homo sapiens
gatggcagtcaaccaggtgagg

SEQ ID NO: 7476184 - DNA, 22 bp, Homo sapiens
gatggcagtcaaccaggtgagg

SEQ ID NO: 7476185 - DNA, 22 bp, Homo sapiens
gatggccaaggaccacgcatcg

SEQ ID NO: 7476186 - DNA, 22 bp, Homo sapiens
gatggcagtgggcctcgagtcc

SEQ ID NO: 7476187 - DNA, 22 bp, Homo sapiens
gatggcagtgggcctcgagtcc

SEQ ID NO: 7476188 - DNA, 22 bp, Homo sapiens
gatggccaaggaccacgcatcg

SEQ ID NO: 7476189 - DNA, 22 bp, Homo sapiens
gatggccacatacatggctggg

SEQ ID NO: 7476190 - DNA, 22 bp, Homo sapiens
gatggccacatacatggctggg

SEQ ID NO: 7476191 - DNA, 22 bp, Homo sapiens
gatggcaggcaggtgagtagag

SEQ ID NO: 7476192 - DNA, 22 bp, Homo sapiens
gatggcagcatattgacagcat

SEQ ID NO: 7476193 - DNA, 22 bp, Homo sapiens
gatggcaggcaggtgagtagag

SEQ ID NO: 7476194 - DNA, 22 bp, Homo sapiens
gatggcaggcaggtgagtagag

SEQ ID NO: 7476195 - DNA, 22 bp, Homo sapiens
gatggcaggtagtggtctcatc

SEQ ID NO: 7476196 - DNA, 22 bp, Homo sapiens
gatggcagcatattgacagcat

SEQ ID NO: 7476197 - DNA, 22 bp, Homo sapiens
gatggcagcatattgacagcat

SEQ ID NO: 7476198 - DNA, 22 bp, Homo sapiens
gatggcagcagcagccagggat

SEQ ID NO: 7476199 - DNA, 22 bp, Homo sapiens
gatggcagcagcagccagggat

SEQ ID NO: 7476200 - DNA, 22 bp, Homo sapiens
gatggcacacagacatccccgc

SEQ ID NO: 7476201 - DNA, 22 bp, Homo sapiens
gatggcagcagcagccagggat

SEQ ID NO: 7476202 - DNA, 22 bp, Homo sapiens
gatggcagcagcagccagggat

SEQ ID NO: 7476203 - DNA, 22 bp, Homo sapiens
atgttatttattgaaacacttt

SEQ ID NO: 7476204 - DNA, 22 bp, Homo sapiens
atgttatttattatcctcggtt

SEQ ID NO: 7476205 - DNA, 22 bp, Homo sapiens
atgttatttattgaaacacttt

SEQ ID NO: 7476206 - DNA, 22 bp, Homo sapiens
atgttatttattgaaacacttt

SEQ ID NO: 7476207 - DNA, 22 bp, Homo sapiens
atgttatttattgaaacacttt

SEQ ID NO: 7476208 - DNA, 22 bp, Homo sapiens
atgttatttattgaaacacttt

SEQ ID NO: 7476209 - DNA, 22 bp, Homo sapiens
atgttatttcaaaattcccttg

SEQ ID NO: 7476210 - DNA, 22 bp, Homo sapiens
atgttatttcaaaattcccttg

SEQ ID NO: 7476211 - DNA, 22 bp, Homo sapiens
atgttatttctgaaagatcatt

SEQ ID NO: 7476212 - DNA, 22 bp, Homo sapiens
atgttatttctgaaagatcatt

SEQ ID NO: 7476213 - DNA, 22 bp, Homo sapiens
atgttatttctgaaagatcatt

SEQ ID NO: 7476214 - DNA, 22 bp, Homo sapiens
atgttatttctgaaagatcatt

SEQ ID NO: 7476215 - DNA, 22 bp, Homo sapiens
atgttatttctgaaagatcatt

SEQ ID NO: 7476216 - DNA, 20 bp, Homo sapiens
gatggatttcaacacctttc

SEQ ID NO: 7476217 - DNA, 22 bp, Homo sapiens
gatggagtctgaagctgggaac

SEQ ID NO: 7476218 - DNA, 22 bp, Homo sapiens
gatggcaaactgggaccagagg

SEQ ID NO: 7476219 - DNA, 22 bp, Homo sapiens
gatggcaaactgggaccagagg

SEQ ID NO: 7476220 - DNA, 22 bp, Homo sapiens
gatggcacacagacatccccgc

SEQ ID NO: 7476221 - DNA, 22 bp, Homo sapiens
gatggcaccttgaacgctgcgt

SEQ ID NO: 7476222 - DNA, 22 bp, Homo sapiens
gatggcacacagacatccccgc

SEQ ID NO: 7476223 - DNA, 22 bp, Homo sapiens
gatggcacacagacatccccgc

SEQ ID NO: 7476224 - DNA, 22 bp, Homo sapiens
gatggcacacagacatccccgc

SEQ ID NO: 7476225 - DNA, 22 bp, Homo sapiens
gatggcacacagacatccccgc

SEQ ID NO: 7476226 - DNA, 22 bp, Homo sapiens
gatggcacacagacatccccgc

SEQ ID NO: 7476227 - DNA, 22 bp, Homo sapiens
gatggagtctgaagctgggaac

SEQ ID NO: 7476228 - DNA, 22 bp, Homo sapiens
gatggaggagatggcagggtgc

SEQ ID NO: 7476229 - DNA, 22 bp, Homo sapiens
gatggaggagatggcagggtgc

SEQ ID NO: 7476230 - DNA, 22 bp, Homo sapiens
gatgatgggatccagcaatgta

SEQ ID NO: 7476231 - DNA, 21 bp, Homo sapiens
gatgatggcaggcagcactgg

SEQ ID NO: 7476232 - DNA, 21 bp, Homo sapiens
gatgatggcaggcagcactgg

SEQ ID NO: 7476233 - DNA, 22 bp, Homo sapiens
gatgatgggatccagcaatgta

SEQ ID NO: 7476234 - DNA, 21 bp, Homo sapiens
gatgatggcaggcagcactgg

SEQ ID NO: 7476235 - DNA, 21 bp, Homo sapiens
gatgatggcaggcagcactgg

SEQ ID NO: 7476236 - DNA, 22 bp, Homo sapiens
attctcttctgatgtcttgcca

SEQ ID NO: 7476237 - DNA, 22 bp, Homo sapiens
attctctgtttccaagatgaaa

SEQ ID NO: 7476238 - DNA, 22 bp, Homo sapiens
attctccacacatccagacctt

SEQ ID NO: 7476239 - DNA, 22 bp, Homo sapiens
attctcttctgatgtcttgcca

SEQ ID NO: 7476240 - DNA, 22 bp, Homo sapiens
attctctgtttccaagatgaaa

SEQ ID NO: 7476241 - DNA, 22 bp, Homo sapiens
attctctttgtataacatcttg

SEQ ID NO: 7476242 - DNA, 22 bp, Homo sapiens
attctctttgtataacatcttg

SEQ ID NO: 7476243 - DNA, 22 bp, Homo sapiens
attctctttgtataacatcttg

SEQ ID NO: 7476244 - DNA, 22 bp, Homo sapiens
attctctttgtataacatcttg

SEQ ID NO: 7476245 - DNA, 22 bp, Homo sapiens
attctctttgtataacatcttg

SEQ ID NO: 7476246 - DNA, 22 bp, Homo sapiens
attccacttccactagtttctc

SEQ ID NO: 7476247 - DNA, 20 bp, Homo sapiens
attccacttgtttgaggtac

SEQ ID NO: 7476248 - DNA, 17 bp, Homo sapiens
attctcagtgtacagtg

SEQ ID NO: 7476249 - DNA, 17 bp, Homo sapiens
attctcagtgtacagtg

SEQ ID NO: 7476250 - DNA, 22 bp, Homo sapiens
attctcatttttatagatgaga

SEQ ID NO: 7476251 - DNA, 22 bp, Homo sapiens
attctcatttttatagatgaga

SEQ ID NO: 7476252 - DNA, 22 bp, Homo sapiens
attctcatttgctggctatatg

SEQ ID NO: 7476253 - DNA, 22 bp, Homo sapiens
attctcagttcactagtttctt

SEQ ID NO: 7476254 - DNA, 22 bp, Homo sapiens
attctgagaaatgcattgtcag

SEQ ID NO: 7476255 - DNA, 22 bp, Homo sapiens
attctgactttcatctgccttt

SEQ ID NO: 7476256 - DNA, 22 bp, Homo sapiens
attctgagaaatgcattgtcag

SEQ ID NO: 7476257 - DNA, 22 bp, Homo sapiens
attctgacctgaatagacttgg

SEQ ID NO: 7476258 - DNA, 22 bp, Homo sapiens
attctgaattctgagcctttca

SEQ ID NO: 7476259 - DNA, 22 bp, Homo sapiens
attctgaattctgagcctttca

SEQ ID NO: 7476260 - DNA, 22 bp, Homo sapiens
attctgaattctgagcctttca

SEQ ID NO: 7476261 - DNA, 22 bp, Homo sapiens
attctgaagttgcaggagaagc

SEQ ID NO: 7476262 - DNA, 22 bp, Homo sapiens
attctgaagttgcaggagaagc

SEQ ID NO: 7476263 - DNA, 22 bp, Homo sapiens
attctgaattctgagcctttca

SEQ ID NO: 7476264 - DNA, 22 bp, Homo sapiens
attctgaattctgagcctttca

SEQ ID NO: 7476265 - DNA, 22 bp, Homo sapiens
attctgaattctgagcctttca

SEQ ID NO: 7476266 - DNA, 22 bp, Homo sapiens
attctgaggacagagtctagca

SEQ ID NO: 7476267 - DNA, 22 bp, Homo sapiens
attctgaggacagagtctagca

SEQ ID NO: 7476268 - DNA, 22 bp, Homo sapiens
attctgagtacaacaagatgtt

SEQ ID NO: 7476269 - DNA, 22 bp, Homo sapiens
attctgagtacaacaagatgtt

SEQ ID NO: 7476270 - DNA, 22 bp, Homo sapiens
attctgagtacaacaagatgtt

SEQ ID NO: 7476271 - DNA, 22 bp, Homo sapiens
attctgagacaattgccgtcag

SEQ ID NO: 7476272 - DNA, 22 bp, Homo sapiens
attctgagacaattgccgtcag

SEQ ID NO: 7476273 - DNA, 22 bp, Homo sapiens
attctgagaggcacaatgtgga

SEQ ID NO: 7476274 - DNA, 22 bp, Homo sapiens
attctgagaggcacaatgtgga

SEQ ID NO: 7476275 - DNA, 22 bp, Homo sapiens
attctgagctactaattaggca

SEQ ID NO: 7476276 - DNA, 22 bp, Homo sapiens
attctgagctactaattaggca

SEQ ID NO: 7476277 - DNA, 21 bp, Homo sapiens
attctgagttgtcagtcttca

SEQ ID NO: 7476278 - DNA, 22 bp, Homo sapiens
attctgagttagagtcagccag

SEQ ID NO: 7476279 - DNA, 21 bp, Homo sapiens
attctgagttgtcagtcttca

SEQ ID NO: 7476280 - DNA, 22 bp, Homo sapiens
attctgagtttatttgggaggt

SEQ ID NO: 7476281 - DNA, 21 bp, Homo sapiens
attctgagttgtcagtcttca

SEQ ID NO: 7476282 - DNA, 22 bp, Homo sapiens
attctgatatcttattctagct

SEQ ID NO: 7476283 - DNA, 22 bp, Homo sapiens
attctgatatgaacacacatat

SEQ ID NO: 7476284 - DNA, 22 bp, Homo sapiens
attctgatatcttattctagct

SEQ ID NO: 7476285 - DNA, 22 bp, Homo sapiens
attctgataaataagcagcaag

SEQ ID NO: 7476286 - DNA, 23 bp, Homo sapiens
attctgagtcagaaagtttgggg

SEQ ID NO: 7476287 - DNA, 22 bp, Homo sapiens
attctgagtccatgggggcagg

SEQ ID NO: 7476288 - DNA, 22 bp, Homo sapiens
attctgagtccatgggggcagg

SEQ ID NO: 7476289 - DNA, 22 bp, Homo sapiens
attctgagtagaaattattctt

SEQ ID NO: 7476290 - DNA, 22 bp, Homo sapiens
attctgagtacaacaagatgtt

SEQ ID NO: 7476291 - DNA, 23 bp, Homo sapiens
attctgagtcagaaagtttgggg

SEQ ID NO: 7476292 - DNA, 22 bp, Homo sapiens
attctgagtggaaactatcaat

SEQ ID NO: 7476293 - DNA, 21 bp, Homo sapiens
attctgagtcttggggtctca

SEQ ID NO: 7476294 - DNA, 22 bp, Homo sapiens
attctgagtagaaattattctt

SEQ ID NO: 7476295 - DNA, 21 bp, Homo sapiens
attctgagtcttggggtctca

SEQ ID NO: 7476296 - DNA, 22 bp, Homo sapiens
attctgagttagagtcagccag

SEQ ID NO: 7476297 - DNA, 22 bp, Homo sapiens
gcagctgtgtaatgagcccaca

SEQ ID NO: 7476298 - DNA, 22 bp, Homo sapiens
gcagctgttcagctggccagat

SEQ ID NO: 7476299 - DNA, 22 bp, Homo sapiens
gcagctgttcagctggccagat

SEQ ID NO: 7476300 - DNA, 22 bp, Homo sapiens
gcagctgtgtaatgagcccaca

SEQ ID NO: 7476301 - DNA, 22 bp, Homo sapiens
gcagctgtgtaatgagcccaca

SEQ ID NO: 7476302 - DNA, 22 bp, Homo sapiens
gcagctgtgtaatgagcccaca

SEQ ID NO: 7476303 - DNA, 22 bp, Homo sapiens
gcagctgtgtaatgagcccaca

SEQ ID NO: 7476304 - DNA, 22 bp, Homo sapiens
gcagctgtggtgctgagatagg

SEQ ID NO: 7476305 - DNA, 22 bp, Homo sapiens
gcagctgtggtgctgagatagg

SEQ ID NO: 7476306 - DNA, 22 bp, Homo sapiens
gcagctgtgggttccaagtcta

SEQ ID NO: 7476307 - DNA, 22 bp, Homo sapiens
gcagctgtgggcctcggagagc

SEQ ID NO: 7476308 - DNA, 22 bp, Homo sapiens
gcagctgtgggcctcggagagc

SEQ ID NO: 7476309 - DNA, 22 bp, Homo sapiens
gcagctgtgggcctcggagagc

SEQ ID NO: 7476310 - DNA, 22 bp, Homo sapiens
gcagctgtgggcctcggagagc

SEQ ID NO: 7476311 - DNA, 22 bp, Homo sapiens
gcagctgtgggttccaagtcta

SEQ ID NO: 7476312 - DNA, 22 bp, Homo sapiens
attctgatcattcaagatgtca

SEQ ID NO: 7476313 - DNA, 19 bp, Homo sapiens
gcagctgtgggaagagcca

SEQ ID NO: 7476314 - DNA, 19 bp, Homo sapiens
gcagctgtgggaagagcca

SEQ ID NO: 7476315 - DNA, 19 bp, Homo sapiens
gcagctgtgggaagagcca

SEQ ID NO: 7476316 - DNA, 22 bp, Homo sapiens
gcagcttcaagatactttttct

SEQ ID NO: 7476317 - DNA, 22 bp, Homo sapiens
gcagcttcagccagagggccag

SEQ ID NO: 7476318 - DNA, 22 bp, Homo sapiens
gcagcttcagccagagggccag

SEQ ID NO: 7476319 - DNA, 22 bp, Homo sapiens
gcagcttcagccagagggccag

SEQ ID NO: 7476320 - DNA, 22 bp, Homo sapiens
gcagcttcagccagagggccag

SEQ ID NO: 7476321 - DNA, 22 bp, Homo sapiens
gcagcttcagccagagggccag

SEQ ID NO: 7476322 - DNA, 22 bp, Homo sapiens
gcagcttcaagatactttttct

SEQ ID NO: 7476323 - DNA, 22 bp, Homo sapiens
gcagcttagaaaaatgaaattg

SEQ ID NO: 7476324 - DNA, 22 bp, Homo sapiens
gcagcttcctgagtgtggacag

SEQ ID NO: 7476325 - DNA, 22 bp, Homo sapiens
gcagcttcctgagtgtggacag

SEQ ID NO: 7476326 - DNA, 22 bp, Homo sapiens
gcagcttggatttctgtagttt

SEQ ID NO: 7476327 - DNA, 22 bp, Homo sapiens
gcagcttgaagctcggaggagc

SEQ ID NO: 7476328 - DNA, 22 bp, Homo sapiens
gcagcttcagtaggtgaagaca

SEQ ID NO: 7476329 - DNA, 22 bp, Homo sapiens
gcagcttcagtaggtgaagaca

SEQ ID NO: 7476330 - DNA, 22 bp, Homo sapiens
gcagcttcagtaggtgaagaca

SEQ ID NO: 7476331 - DNA, 22 bp, Homo sapiens
gcagcttcctgagtgtggacag

SEQ ID NO: 7476332 - DNA, 22 bp, Homo sapiens
gcagcttcctgagtgtggacag

SEQ ID NO: 7476333 - DNA, 22 bp, Homo sapiens
gcagcttggatttctgtagttt

SEQ ID NO: 7476334 - DNA, 22 bp, Homo sapiens
gcagcttggatttctgtagttt

SEQ ID NO: 7476335 - DNA, 22 bp, Homo sapiens
gcagcttgaagctcggaggagc

SEQ ID NO: 7476336 - DNA, 22 bp, Homo sapiens
gcagcttggtgaaaggtgatgg

SEQ ID NO: 7476337 - DNA, 22 bp, Homo sapiens
gcagcttggggacatgaaaaga

SEQ ID NO: 7476338 - DNA, 22 bp, Homo sapiens
gcagcttggggacatgaaaaga

SEQ ID NO: 7476339 - DNA, 22 bp, Homo sapiens
gcagcttgtcagacctttactg

SEQ ID NO: 7476340 - DNA, 22 bp, Homo sapiens
gcagcttgtcagacctttactg

SEQ ID NO: 7476341 - DNA, 22 bp, Homo sapiens
gcagcttggtgaaaggtgatgg

SEQ ID NO: 7476342 - DNA, 23 bp, Homo sapiens
gcagcttgtggtttagtagaggg

SEQ ID NO: 7476343 - DNA, 22 bp, Homo sapiens
gcaggcaattttggaaggtcag

SEQ ID NO: 7476344 - DNA, 22 bp, Homo sapiens
gcaggcaattttggaaggtcag

SEQ ID NO: 7476345 - DNA, 19 bp, Homo sapiens
gcaggcagctggggtatcc

SEQ ID NO: 7476346 - DNA, 19 bp, Homo sapiens
gcaggcagctggggtatcc

SEQ ID NO: 7476347 - DNA, 22 bp, Homo sapiens
gcaggcaagaatttgggtctga

SEQ ID NO: 7476348 - DNA, 22 bp, Homo sapiens
gcaggattgggctgaaggagtg

SEQ ID NO: 7476349 - DNA, 22 bp, Homo sapiens
gcaggcaaggaacagagactgt

SEQ ID NO: 7476350 - DNA, 22 bp, Homo sapiens
gcaggcaaggaacagagactgt

SEQ ID NO: 7476351 - DNA, 20 bp, Homo sapiens
gcaggcagggaatgggggtg

SEQ ID NO: 7476352 - DNA, 20 bp, Homo sapiens
gcaggcagggaatgggggtg

SEQ ID NO: 7476353 - DNA, 22 bp, Homo sapiens
gcaggcaggcttccttgaactg

SEQ ID NO: 7476354 - DNA, 20 bp, Homo sapiens
gcaggcagggaatgggggtg

SEQ ID NO: 7476355 - DNA, 20 bp, Homo sapiens
gcaggcagggaatgggggtg

SEQ ID NO: 7476356 - DNA, 20 bp, Homo sapiens
gcaggcagggaatgggggtg

SEQ ID NO: 7476357 - DNA, 22 bp, Homo sapiens
gcaggcaggcttccttgaactg

SEQ ID NO: 7476358 - DNA, 20 bp, Homo sapiens
gcaggcagggaatgggggtg

SEQ ID NO: 7476359 - DNA, 20 bp, Homo sapiens
gcaggcagggaatgggggtg

SEQ ID NO: 7476360 - DNA, 22 bp, Homo sapiens
gcaggcaggcttccttgaactg

SEQ ID NO: 7476361 - DNA, 22 bp, Homo sapiens
gcaggcaggcttccttgaactg

SEQ ID NO: 7476362 - DNA, 22 bp, Homo sapiens
gcaggcaggcttccttgaactg

SEQ ID NO: 7476363 - DNA, 22 bp, Homo sapiens
gcaggcaggcttccttgaactg

SEQ ID NO: 7476364 - DNA, 22 bp, Homo sapiens
gcaggcaggcttccttgaactg

SEQ ID NO: 7476365 - DNA, 22 bp, Homo sapiens
gcaggcaggcttccttgaactg

SEQ ID NO: 7476366 - DNA, 22 bp, Homo sapiens
gcaggcaggcttccttgaactg

SEQ ID NO: 7476367 - DNA, 22 bp, Homo sapiens
gcaggcaggaaggactaagtaa

SEQ ID NO: 7476368 - DNA, 19 bp, Homo sapiens
gcaggcagctggggtatcc

SEQ ID NO: 7476369 - DNA, 22 bp, Homo sapiens
gcaggcaggaaggactaagtaa

SEQ ID NO: 7476370 - DNA, 22 bp, Homo sapiens
gcaggcaggaaggactaagtaa

SEQ ID NO: 7476371 - DNA, 19 bp, Homo sapiens
gcaggcagctggggtatcc

SEQ ID NO: 7476372 - DNA, 22 bp, Homo sapiens
gcaggcaggaaggactaagtaa

SEQ ID NO: 7476373 - DNA, 22 bp, Homo sapiens
gcaggcaggaaggactaagtaa

SEQ ID NO: 7476374 - DNA, 22 bp, Homo sapiens
gcaggcaggaaggactaagtaa

SEQ ID NO: 7476375 - DNA, 22 bp, Homo sapiens
gcaggcaggaaggactaagtaa

SEQ ID NO: 7476376 - DNA, 22 bp, Homo sapiens
gcaggcaggaaggactaagtaa

SEQ ID NO: 7476377 - DNA, 22 bp, Homo sapiens
gcaggcaggagcccaactgcct

SEQ ID NO: 7476378 - DNA, 22 bp, Homo sapiens
gcaggcaggagcccaactgcct

SEQ ID NO: 7476379 - DNA, 22 bp, Homo sapiens
gcaggcaggaaggactaagtaa

SEQ ID NO: 7476380 - DNA, 22 bp, Homo sapiens
gcaggcaggagcccaactgcct

SEQ ID NO: 7476381 - DNA, 22 bp, Homo sapiens
gcaggcaggagcccaactgcct

SEQ ID NO: 7476382 - DNA, 22 bp, Homo sapiens
gcaggcaggagcccaactgcct

SEQ ID NO: 7476383 - DNA, 22 bp, Homo sapiens
gcaggcaggagcccaactgcct

SEQ ID NO: 7476384 - DNA, 22 bp, Homo sapiens
gcaggcaggagcccaactgcct

SEQ ID NO: 7476385 - DNA, 22 bp, Homo sapiens
gcaggcaggagcccaactgcct

SEQ ID NO: 7476386 - DNA, 22 bp, Homo sapiens
gcaggcaggagcccaactgcct

SEQ ID NO: 7476387 - DNA, 22 bp, Homo sapiens
attccacagtgccttccgtgaa

SEQ ID NO: 7476388 - DNA, 22 bp, Homo sapiens
attccacagtgccttccgtgaa

SEQ ID NO: 7476389 - DNA, 22 bp, Homo sapiens
attccacagtgccttccgtgaa

SEQ ID NO: 7476390 - DNA, 22 bp, Homo sapiens
attccacagtgtgtggtgagga

SEQ ID NO: 7476391 - DNA, 22 bp, Homo sapiens
attccacagtgtgtggtgagga

SEQ ID NO: 7476392 - DNA, 22 bp, Homo sapiens
attccacagtgtgtggtgagga

SEQ ID NO: 7476393 - DNA, 22 bp, Homo sapiens
attccacataggccttcatgac

SEQ ID NO: 7476394 - DNA, 22 bp, Homo sapiens
attccacataggccttcatgac

SEQ ID NO: 7476395 - DNA, 22 bp, Homo sapiens
attccacataggccttcatgac

SEQ ID NO: 7476396 - DNA, 22 bp, Homo sapiens
attccacataggccttcatgac

SEQ ID NO: 7476397 - DNA, 22 bp, Homo sapiens
attccacataggccttcatgac

SEQ ID NO: 7476398 - DNA, 22 bp, Homo sapiens
attccacatgaaaggagctgaa

SEQ ID NO: 7476399 - DNA, 22 bp, Homo sapiens
attccacatgaaaggagctgaa

SEQ ID NO: 7476400 - DNA, 22 bp, Homo sapiens
attccacataggccttcatgac

SEQ ID NO: 7476401 - DNA, 20 bp, Homo sapiens
attccacttatatgaggtcc

SEQ ID NO: 7476402 - DNA, 22 bp, Homo sapiens
attccacttatatgaagtaacg

SEQ ID NO: 7476403 - DNA, 22 bp, Homo sapiens
attccactgttataaaatgtcc

SEQ ID NO: 7476404 - DNA, 22 bp, Homo sapiens
attccacttagtgactcatttg

SEQ ID NO: 7476405 - DNA, 22 bp, Homo sapiens
attccactgccgaatgatacat

SEQ ID NO: 7476406 - DNA, 22 bp, Homo sapiens
attccaccttctacctgggaga

SEQ ID NO: 7476407 - DNA, 22 bp, Homo sapiens
attccaccttctacctgggaga

SEQ ID NO: 7476408 - DNA, 22 bp, Homo sapiens
attccactccaataagtgtcaa

SEQ ID NO: 7476409 - DNA, 22 bp, Homo sapiens
attccactccaataagtgtcaa

SEQ ID NO: 7476410 - DNA, 22 bp, Homo sapiens
attccacagctacatcaatcta

SEQ ID NO: 7476411 - DNA, 22 bp, Homo sapiens
attccacagctacatcaatcta

SEQ ID NO: 7476412 - DNA, 22 bp, Homo sapiens
attccacagctacatcaatcta

SEQ ID NO: 7476413 - DNA, 22 bp, Homo sapiens
attccacagctacatcaatcta

SEQ ID NO: 7476414 - DNA, 22 bp, Homo sapiens
attccacagctacatcaatcta

SEQ ID NO: 7476415 - DNA, 22 bp, Homo sapiens
attccacagctacatcaatcta

SEQ ID NO: 7476416 - DNA, 22 bp, Homo sapiens
attccacagctacgttttgagc

SEQ ID NO: 7476417 - DNA, 22 bp, Homo sapiens
attccacagctacgttttgagc

SEQ ID NO: 7476418 - DNA, 22 bp, Homo sapiens
attccacagctacatcaatcta

SEQ ID NO: 7476419 - DNA, 22 bp, Homo sapiens
attccacagaggactccgattg

SEQ ID NO: 7476420 - DNA, 22 bp, Homo sapiens
attccacagccgataccatgac

SEQ ID NO: 7476421 - DNA, 22 bp, Homo sapiens
attccacagccgataccatgac

SEQ ID NO: 7476422 - DNA, 22 bp, Homo sapiens
attccacagccgataccatgac

SEQ ID NO: 7476423 - DNA, 22 bp, Homo sapiens
attccacagccgataccatgac

SEQ ID NO: 7476424 - DNA, 22 bp, Homo sapiens
attccacagccgataccatgac

SEQ ID NO: 7476425 - DNA, 22 bp, Homo sapiens
attccacagaggactccgattg

SEQ ID NO: 7476426 - DNA, 22 bp, Homo sapiens
attccacagaggactccgattg

SEQ ID NO: 7476427 - DNA, 22 bp, Homo sapiens
attccacaggactaccaatgtg

SEQ ID NO: 7476428 - DNA, 22 bp, Homo sapiens
attccacaggactaccaatgtg

SEQ ID NO: 7476429 - DNA, 22 bp, Homo sapiens
attccacagctcagcctctctt

SEQ ID NO: 7476430 - DNA, 22 bp, Homo sapiens
attccacaggactaccaatgtg

SEQ ID NO: 7476431 - DNA, 22 bp, Homo sapiens
attccacagctacgttttgagc

SEQ ID NO: 7476432 - DNA, 22 bp, Homo sapiens
attccacagctacgttttgagc

SEQ ID NO: 7476433 - DNA, 22 bp, Homo sapiens
attccacagctcagcctctctt

SEQ ID NO: 7476434 - DNA, 22 bp, Homo sapiens
attccacagctcagcctctctt

SEQ ID NO: 7476435 - DNA, 17 bp, Homo sapiens
attccacagggaatctg

SEQ ID NO: 7476436 - DNA, 22 bp, Homo sapiens
attccacaggagctggttttct

SEQ ID NO: 7476437 - DNA, 22 bp, Homo sapiens
attccacaggagctggttttct

SEQ ID NO: 7476438 - DNA, 22 bp, Homo sapiens
attccacaggagctggttttct

SEQ ID NO: 7476439 - DNA, 17 bp, Homo sapiens
attccacagggaatctg

SEQ ID NO: 7476440 - DNA, 17 bp, Homo sapiens
attccacagggaatctg

SEQ ID NO: 7476441 - DNA, 22 bp, Homo sapiens
attccaaagcacatcagaacta

SEQ ID NO: 7476442 - DNA, 22 bp, Homo sapiens
attccaaagcacatcagaacta

SEQ ID NO: 7476443 - DNA, 22 bp, Homo sapiens
attccaaagcacatcagaacta

SEQ ID NO: 7476444 - DNA, 22 bp, Homo sapiens
attccaaagcacatcagaacta

SEQ ID NO: 7476445 - DNA, 22 bp, Homo sapiens
attccaaagacagaagcagctg

SEQ ID NO: 7476446 - DNA, 22 bp, Homo sapiens
attccaaagacagaagcagctg

SEQ ID NO: 7476447 - DNA, 22 bp, Homo sapiens
attccaaagcacatcagaacta

SEQ ID NO: 7476448 - DNA, 22 bp, Homo sapiens
attccaaagcctgaataatgga

SEQ ID NO: 7476449 - DNA, 22 bp, Homo sapiens
attccaaagcacatcagaacta

SEQ ID NO: 7476450 - DNA, 22 bp, Homo sapiens
attccaaagcacatcagaacta

SEQ ID NO: 7476451 - DNA, 22 bp, Homo sapiens
attccaaagcctgaataatgga

SEQ ID NO: 7476452 - DNA, 22 bp, Homo sapiens
attccaaagcctgaataatgga

SEQ ID NO: 7476453 - DNA, 22 bp, Homo sapiens
attccaaagcctgaataatgga

SEQ ID NO: 7476454 - DNA, 22 bp, Homo sapiens
attccaaagcctgaataatgga

SEQ ID NO: 7476455 - DNA, 22 bp, Homo sapiens
attccaaagcctgaataatgga

SEQ ID NO: 7476456 - DNA, 22 bp, Homo sapiens
attccaaaggctggcctggagg

SEQ ID NO: 7476457 - DNA, 22 bp, Homo sapiens
attccaaaggctggcctggagg

SEQ ID NO: 7476458 - DNA, 22 bp, Homo sapiens
attccaaaggttaatgcccatt

SEQ ID NO: 7476459 - DNA, 22 bp, Homo sapiens
attccaaaggttaatgcccatt

SEQ ID NO: 7476460 - DNA, 22 bp, Homo sapiens
attccaaaggttaatgcccatt

SEQ ID NO: 7476461 - DNA, 22 bp, Homo sapiens
attccaaggtctttctagattg

SEQ ID NO: 7476462 - DNA, 22 bp, Homo sapiens
attccaattgtacttgctttta

SEQ ID NO: 7476463 - DNA, 22 bp, Homo sapiens
attccaaggtctttctagattg

SEQ ID NO: 7476464 - DNA, 22 bp, Homo sapiens
attccaaggtctttctagattg

SEQ ID NO: 7476465 - DNA, 22 bp, Homo sapiens
attccacaagaccataaattag

SEQ ID NO: 7476466 - DNA, 22 bp, Homo sapiens
attccacaagaccataaattag

SEQ ID NO: 7476467 - DNA, 22 bp, Homo sapiens
attccacaagaccataaattag

SEQ ID NO: 7476468 - DNA, 22 bp, Homo sapiens
attccacaagaccataaattag

SEQ ID NO: 7476469 - DNA, 22 bp, Homo sapiens
attccacacagtaatactcaat

SEQ ID NO: 7476470 - DNA, 22 bp, Homo sapiens
attccacacagtaatactcaat

SEQ ID NO: 7476471 - DNA, 22 bp, Homo sapiens
attccacacagtaatactcaat

SEQ ID NO: 7476472 - DNA, 22 bp, Homo sapiens
attccacacagtaatactcaat

SEQ ID NO: 7476473 - DNA, 22 bp, Homo sapiens
attccacacagtaatactcaat

SEQ ID NO: 7476474 - DNA, 22 bp, Homo sapiens
attccacacagtaatactcaat

SEQ ID NO: 7476475 - DNA, 22 bp, Homo sapiens
attccacacagtaatactcaat

SEQ ID NO: 7476476 - DNA, 22 bp, Homo sapiens
attccacacagtaatactcaat

SEQ ID NO: 7476477 - DNA, 22 bp, Homo sapiens
attccacaagaccataaattag

SEQ ID NO: 7476478 - DNA, 22 bp, Homo sapiens
attccacaagaccataaattag

SEQ ID NO: 7476479 - DNA, 22 bp, Homo sapiens
attccacaagaccataaattag

SEQ ID NO: 7476480 - DNA, 22 bp, Homo sapiens
attcaataagtcactgtggaat

SEQ ID NO: 7476481 - DNA, 22 bp, Homo sapiens
attcaataagtcactgtggaat

SEQ ID NO: 7476482 - DNA, 22 bp, Homo sapiens
attcacaaaatgatatagatac

SEQ ID NO: 7476483 - DNA, 22 bp, Homo sapiens
attcacaaaatgatatagatac

SEQ ID NO: 7476484 - DNA, 22 bp, Homo sapiens
attcacaaaatgatatagatac

SEQ ID NO: 7476485 - DNA, 22 bp, Homo sapiens
attcacaaaatgatatagatac

SEQ ID NO: 7476486 - DNA, 20 bp, Homo sapiens
attcacaaagccagtgttgc

SEQ ID NO: 7476487 - DNA, 20 bp, Homo sapiens
attcacaaagccagtgttgc

SEQ ID NO: 7476488 - DNA, 20 bp, Homo sapiens
attcacaaagccagtgttgc

SEQ ID NO: 7476489 - DNA, 20 bp, Homo sapiens
attcacaaagccagtgttgc

SEQ ID NO: 7476490 - DNA, 22 bp, Homo sapiens
attcacaaagaagggaagtaca

SEQ ID NO: 7476491 - DNA, 22 bp, Homo sapiens
attcacaaagaagggaagtaca

SEQ ID NO: 7476492 - DNA, 22 bp, Homo sapiens
attcacaaagaagggaagtaca

SEQ ID NO: 7476493 - DNA, 22 bp, Homo sapiens
attcacaaaatgatatagatac

SEQ ID NO: 7476494 - DNA, 22 bp, Homo sapiens
attcacaaaatgatatagatac

SEQ ID NO: 7476495 - DNA, 22 bp, Homo sapiens
attcacaaagaagggaagtaca

SEQ ID NO: 7476496 - DNA, 22 bp, Homo sapiens
attcacaactgatccttgctca

SEQ ID NO: 7476497 - DNA, 22 bp, Homo sapiens
attcacaactgatccttgctca

SEQ ID NO: 7476498 - DNA, 22 bp, Homo sapiens
attcacaactgatccttgctca

SEQ ID NO: 7476499 - DNA, 22 bp, Homo sapiens
attcacaacaaaaggatatgag

SEQ ID NO: 7476500 - DNA, 22 bp, Homo sapiens
attcacaacaaaaggatatgag

SEQ ID NO: 7476501 - DNA, 16 bp, Homo sapiens
attcacaaggcatcgg

SEQ ID NO: 7476502 - DNA, 22 bp, Homo sapiens
attcacaagttctagggattag

SEQ ID NO: 7476503 - DNA, 22 bp, Homo sapiens
attcacaagttctagggattag

SEQ ID NO: 7476504 - DNA, 22 bp, Homo sapiens
attcacaaagtcacccttacac

SEQ ID NO: 7476505 - DNA, 22 bp, Homo sapiens
attcacaaataacaggtgcaga

SEQ ID NO: 7476506 - DNA, 22 bp, Homo sapiens
attcacaaataacaggtgcaga

SEQ ID NO: 7476507 - DNA, 22 bp, Homo sapiens
attcacaaataacaggtgcaga

SEQ ID NO: 7476508 - DNA, 22 bp, Homo sapiens
attcacaaataacaggtgcaga

SEQ ID NO: 7476509 - DNA, 22 bp, Homo sapiens
attcacaaataacaggtgcaga

SEQ ID NO: 7476510 - DNA, 22 bp, Homo sapiens
attcacaaatgctgccccattc

SEQ ID NO: 7476511 - DNA, 22 bp, Homo sapiens
attcacaaatgctgccccattc

SEQ ID NO: 7476512 - DNA, 22 bp, Homo sapiens
attcacaacaaaaggatatgag

SEQ ID NO: 7476513 - DNA, 22 bp, Homo sapiens
attcacaacaaaaggatatgag

SEQ ID NO: 7476514 - DNA, 19 bp, Homo sapiens
attcatttttgccttctaa

SEQ ID NO: 7476515 - DNA, 22 bp, Homo sapiens
attcatgaatctacattgtggt

SEQ ID NO: 7476516 - DNA, 19 bp, Homo sapiens
attcatttttgccttctaa

SEQ ID NO: 7476517 - DNA, 19 bp, Homo sapiens
attcatttttgccttctaa

SEQ ID NO: 7476518 - DNA, 22 bp, Homo sapiens
attcatgcaggattgtctccaa

SEQ ID NO: 7476519 - DNA, 22 bp, Homo sapiens
attcatttgctattgtgtatgg

SEQ ID NO: 7476520 - DNA, 22 bp, Homo sapiens
attccaaaaggatgttagaatg

SEQ ID NO: 7476521 - DNA, 19 bp, Homo sapiens
attcatttttgccttctaa

SEQ ID NO: 7476522 - DNA, 22 bp, Homo sapiens
attccaaaaggatgttagaatg

SEQ ID NO: 7476523 - DNA, 19 bp, Homo sapiens
attcatttttgccttctaa

SEQ ID NO: 7476524 - DNA, 19 bp, Homo sapiens
attcatttttgccttctaa

SEQ ID NO: 7476525 - DNA, 22 bp, Homo sapiens
attcacaagttgatggatattt

SEQ ID NO: 7476526 - DNA, 22 bp, Homo sapiens
attcacaagttgatggatattt

SEQ ID NO: 7476527 - DNA, 22 bp, Homo sapiens
attcatgaccccatggttgatt

SEQ ID NO: 7476528 - DNA, 19 bp, Homo sapiens
attcatgaaggcttgaagg

SEQ ID NO: 7476529 - DNA, 22 bp, Homo sapiens
attcatgaatctacattgtggt

SEQ ID NO: 7476530 - DNA, 17 bp, Homo sapiens
attcatgaacatgtcct

SEQ ID NO: 7476531 - DNA, 17 bp, Homo sapiens
attcatgaacatgtcct

SEQ ID NO: 7476532 - DNA, 22 bp, Homo sapiens
attccaaaaggatgttagaatg

SEQ ID NO: 7476533 - DNA, 22 bp, Homo sapiens
attccaaaaggatgttagaatg

SEQ ID NO: 7476534 - DNA, 22 bp, Homo sapiens
attccaaacagtgctgcagact

SEQ ID NO: 7476535 - DNA, 22 bp, Homo sapiens
attccaaacagtgctgcagact

SEQ ID NO: 7476536 - DNA, 22 bp, Homo sapiens
attccaaacagtgctgcagact

SEQ ID NO: 7476537 - DNA, 22 bp, Homo sapiens
attccaaacgcctcgcggactt

SEQ ID NO: 7476538 - DNA, 22 bp, Homo sapiens
attccaaactctttccctgtcg

SEQ ID NO: 7476539 - DNA, 22 bp, Homo sapiens
attccaaactctttccctgtcg

SEQ ID NO: 7476540 - DNA, 22 bp, Homo sapiens
attccaaactctttccctgtcg

SEQ ID NO: 7476541 - DNA, 22 bp, Homo sapiens
attccaaactctttccctgtcg

SEQ ID NO: 7476542 - DNA, 22 bp, Homo sapiens
attccaaacttaccccagagga

SEQ ID NO: 7476543 - DNA, 22 bp, Homo sapiens
attccaaacttaccccagagga

SEQ ID NO: 7476544 - DNA, 22 bp, Homo sapiens
attccaaacttaccccagagga

SEQ ID NO: 7476545 - DNA, 22 bp, Homo sapiens
attccaaacttaccccagagga

SEQ ID NO: 7476546 - DNA, 22 bp, Homo sapiens
attccaaagacagaagcagctg

SEQ ID NO: 7476547 - DNA, 22 bp, Homo sapiens
attcttttttaaggaatagaac

SEQ ID NO: 7476548 - DNA, 22 bp, Homo sapiens
attcttttttaaggaatagaac

SEQ ID NO: 7476549 - DNA, 22 bp, Homo sapiens
attcttttttaaggaatagaac

SEQ ID NO: 7476550 - DNA, 19 bp, Homo sapiens
gcaggtggatgtggtcagc

SEQ ID NO: 7476551 - DNA, 22 bp, Homo sapiens
attgaaaaatgactattgctta

SEQ ID NO: 7476552 - DNA, 19 bp, Homo sapiens
gcaggtggatgtggtcagc

SEQ ID NO: 7476553 - DNA, 19 bp, Homo sapiens
gcaggtggatgtggtcagc

SEQ ID NO: 7476554 - DNA, 19 bp, Homo sapiens
gcaggtggatgtggtcagc

SEQ ID NO: 7476555 - DNA, 18 bp, Homo sapiens
gcaggtgtggagaagggg

SEQ ID NO: 7476556 - DNA, 22 bp, Homo sapiens
gcaggtgtgggtggctgccagg

SEQ ID NO: 7476557 - DNA, 22 bp, Homo sapiens
gcaggtgtggatttgcatccag

SEQ ID NO: 7476558 - DNA, 22 bp, Homo sapiens
gcaggttagatttaatccattc

SEQ ID NO: 7476559 - DNA, 22 bp, Homo sapiens
gcaggttagatttaatccattc

SEQ ID NO: 7476560 - DNA, 22 bp, Homo sapiens
gcaggttatccaactacaatgt

SEQ ID NO: 7476561 - DNA, 22 bp, Homo sapiens
gcagtaaaaaaggatatgtgca

SEQ ID NO: 7476562 - DNA, 22 bp, Homo sapiens
gcaggttatccaactacaatgt

SEQ ID NO: 7476563 - DNA, 22 bp, Homo sapiens
gcagtaaaaaaggatatgtgca

SEQ ID NO: 7476564 - DNA, 19 bp, Homo sapiens
gcaggtggatgtggtcagc

SEQ ID NO: 7476565 - DNA, 22 bp, Homo sapiens
gcaggtgttctcagaggaggct

SEQ ID NO: 7476566 - DNA, 22 bp, Homo sapiens
gcaggtgttttaagacattgaa

SEQ ID NO: 7476567 - DNA, 22 bp, Homo sapiens
attgcaaaggtcccattcaaga

SEQ ID NO: 7476568 - DNA, 22 bp, Homo sapiens
attgcaaaggtcccattcaaga

SEQ ID NO: 7476569 - DNA, 22 bp, Homo sapiens
attgcaaaggtcccattcaaga

SEQ ID NO: 7476570 - DNA, 22 bp, Homo sapiens
gcagtaagatgtaagtgctata

SEQ ID NO: 7476571 - DNA, 22 bp, Homo sapiens
gcagtaagatgtttcccagagc

SEQ ID NO: 7476572 - DNA, 22 bp, Homo sapiens
gcagtaagatgtttcccagagc

SEQ ID NO: 7476573 - DNA, 22 bp, Homo sapiens
gcagtaagatgtaagtgctata

SEQ ID NO: 7476574 - DNA, 22 bp, Homo sapiens
gcagtaagatggggtaatcgta

SEQ ID NO: 7476575 - DNA, 22 bp, Homo sapiens
gcagtaagaaagtcaagcagtt

SEQ ID NO: 7476576 - DNA, 22 bp, Homo sapiens
gcagtaagaaagtcaagcagtt

SEQ ID NO: 7476577 - DNA, 22 bp, Homo sapiens
gcagtaaataattttgtgtata

SEQ ID NO: 7476578 - DNA, 22 bp, Homo sapiens
gcagtaaaggtgacaatatagg

SEQ ID NO: 7476579 - DNA, 22 bp, Homo sapiens
gcagtaaaggtgacaatatagg

SEQ ID NO: 7476580 - DNA, 22 bp, Homo sapiens
gcagtaaaggtgacaatatagg

SEQ ID NO: 7476581 - DNA, 22 bp, Homo sapiens
gcagtaaattgagagtcatgtt

SEQ ID NO: 7476582 - DNA, 22 bp, Homo sapiens
gcagtaaataattttgtgtata

SEQ ID NO: 7476583 - DNA, 22 bp, Homo sapiens
gcagtaaaaaaggatatgtgca

SEQ ID NO: 7476584 - DNA, 16 bp, Homo sapiens
gcagtaaaatggttag

SEQ ID NO: 7476585 - DNA, 22 bp, Homo sapiens
gcagtaaagcctgagatatatg

SEQ ID NO: 7476586 - DNA, 22 bp, Homo sapiens
attgcaaataactgtactgaat

SEQ ID NO: 7476587 - DNA, 22 bp, Homo sapiens
attgcaaataactgtactgaat

SEQ ID NO: 7476588 - DNA, 22 bp, Homo sapiens
attgcaaataactgtactgaat

SEQ ID NO: 7476589 - DNA, 22 bp, Homo sapiens
attgcaaataactgtactgaat

SEQ ID NO: 7476590 - DNA, 22 bp, Homo sapiens
attgcaaaggtcccattcaaga

SEQ ID NO: 7476591 - DNA, 22 bp, Homo sapiens
attgcaaaggtcccattcaaga

SEQ ID NO: 7476592 - DNA, 22 bp, Homo sapiens
attgcaaaggtcccattcaaga

SEQ ID NO: 7476593 - DNA, 22 bp, Homo sapiens
attgcaaaggtcccattcaaga

SEQ ID NO: 7476594 - DNA, 22 bp, Homo sapiens
attgcaaataatgcgagccagt

SEQ ID NO: 7476595 - DNA, 22 bp, Homo sapiens
attgcaaatgagtcttaatata

SEQ ID NO: 7476596 - DNA, 22 bp, Homo sapiens
attgcaaatgagtcttaatata

SEQ ID NO: 7476597 - DNA, 22 bp, Homo sapiens
attgcaaggtgtagttatggtt

SEQ ID NO: 7476598 - DNA, 22 bp, Homo sapiens
attgcaaatggtttggtcatct

SEQ ID NO: 7476599 - DNA, 22 bp, Homo sapiens
attgcaaatgagtcttaatata

SEQ ID NO: 7476600 - DNA, 22 bp, Homo sapiens
attgcaaatggtttggtcatct

SEQ ID NO: 7476601 - DNA, 22 bp, Homo sapiens
gcatggaattcccttatgggcc

SEQ ID NO: 7476602 - DNA, 22 bp, Homo sapiens
gcatggaattcccttatgggcc

SEQ ID NO: 7476603 - DNA, 22 bp, Homo sapiens
gcatggatgggagtggacagat

SEQ ID NO: 7476604 - DNA, 22 bp, Homo sapiens
gcatggatctaagaggtcaagg

SEQ ID NO: 7476605 - DNA, 22 bp, Homo sapiens
gcatggagaagtgggaacaggt

SEQ ID NO: 7476606 - DNA, 22 bp, Homo sapiens
gcatggcaagatcaggagacca

SEQ ID NO: 7476607 - DNA, 22 bp, Homo sapiens
gcatggcaagatcaggagacca

SEQ ID NO: 7476608 - DNA, 22 bp, Homo sapiens
gcatggcaagaccctgtctcta

SEQ ID NO: 7476609 - DNA, 22 bp, Homo sapiens
gcatggcaagaccctgtctcta

SEQ ID NO: 7476610 - DNA, 22 bp, Homo sapiens
gcatggcaagaccctgtctcta

SEQ ID NO: 7476611 - DNA, 22 bp, Homo sapiens
gcatggcaagaccctgtctcta

SEQ ID NO: 7476612 - DNA, 22 bp, Homo sapiens
gcatggcaaatatcgagggcag

SEQ ID NO: 7476613 - DNA, 22 bp, Homo sapiens
gcatggatctaagaggtcaagg

SEQ ID NO: 7476614 - DNA, 22 bp, Homo sapiens
gcatggcaaatatcgagggcag

SEQ ID NO: 7476615 - DNA, 22 bp, Homo sapiens
gcatggcaaatatcgagggcag

SEQ ID NO: 7476616 - DNA, 22 bp, Homo sapiens
gcatggatgggagtggacagat

SEQ ID NO: 7476617 - DNA, 22 bp, Homo sapiens
gcatggcaaatatcgagggcag

SEQ ID NO: 7476618 - DNA, 22 bp, Homo sapiens
gcatggcaaatatcgagggcag

SEQ ID NO: 7476619 - DNA, 22 bp, Homo sapiens
gcatggcaaatatcgagggcag

SEQ ID NO: 7476620 - DNA, 22 bp, Homo sapiens
gcatggcagaacacctcgcccg

SEQ ID NO: 7476621 - DNA, 22 bp, Homo sapiens
gcatggcagccagtacatggtg

SEQ ID NO: 7476622 - DNA, 22 bp, Homo sapiens
gcatggcagaacacctcgcccg

SEQ ID NO: 7476623 - DNA, 22 bp, Homo sapiens
gcatggcaagatcaggagacca

SEQ ID NO: 7476624 - DNA, 22 bp, Homo sapiens
gcatggcagaacacctcgcccg

SEQ ID NO: 7476625 - DNA, 22 bp, Homo sapiens
gcatggcaagatcaggagacca

SEQ ID NO: 7476626 - DNA, 22 bp, Homo sapiens
gcatggcaagatcaggagacca

SEQ ID NO: 7476627 - DNA, 22 bp, Homo sapiens
gcatggcaagatcaggagacca

SEQ ID NO: 7476628 - DNA, 22 bp, Homo sapiens
gcatggcaagatcaggagacca

SEQ ID NO: 7476629 - DNA, 22 bp, Homo sapiens
gcatggcaagatcaggagacca

SEQ ID NO: 7476630 - DNA, 21 bp, Homo sapiens
gcatggcaggtcactggggca

SEQ ID NO: 7476631 - DNA, 21 bp, Homo sapiens
gcatggcaggtcactggggca

SEQ ID NO: 7476632 - DNA, 22 bp, Homo sapiens
gcatggcagggattagtagtag

SEQ ID NO: 7476633 - DNA, 22 bp, Homo sapiens
gcatggcagtgaggatggtgct

SEQ ID NO: 7476634 - DNA, 22 bp, Homo sapiens
gcatggcagtgaggatggtgct

SEQ ID NO: 7476635 - DNA, 22 bp, Homo sapiens
gcatggcagtgaggatggtgct

SEQ ID NO: 7476636 - DNA, 22 bp, Homo sapiens
attgcacatctgcactacagcc

SEQ ID NO: 7476637 - DNA, 22 bp, Homo sapiens
attgcactccagcctgggcaac

SEQ ID NO: 7476638 - DNA, 22 bp, Homo sapiens
attgcactccagcctgggcgac

SEQ ID NO: 7476639 - DNA, 22 bp, Homo sapiens
attgcactccagcctgggggac

SEQ ID NO: 7476640 - DNA, 22 bp, Homo sapiens
attgcactccagcctgggtgac

SEQ ID NO: 7476641 - DNA, 22 bp, Homo sapiens
attgcactccagcctgggtgac

SEQ ID NO: 7476642 - DNA, 22 bp, Homo sapiens
attgcactccagcctgggggac

SEQ ID NO: 7476643 - DNA, 22 bp, Homo sapiens
attgcactccagcctgggggac

SEQ ID NO: 7476644 - DNA, 22 bp, Homo sapiens
attgcactccagcctgggggac

SEQ ID NO: 7476645 - DNA, 22 bp, Homo sapiens
attgcacaaacacagtcagact

SEQ ID NO: 7476646 - DNA, 22 bp, Homo sapiens
attgcacaaagagggaaactga

SEQ ID NO: 7476647 - DNA, 22 bp, Homo sapiens
attgcaatctggtgaaaacagt

SEQ ID NO: 7476648 - DNA, 22 bp, Homo sapiens
attgcaatctggtgaaaacagt

SEQ ID NO: 7476649 - DNA, 22 bp, Homo sapiens
attgcaatctggtgaaaacagt

SEQ ID NO: 7476650 - DNA, 18 bp, Homo sapiens
attgcacaccagcctggg

SEQ ID NO: 7476651 - DNA, 22 bp, Homo sapiens
attgcacagctgaatattttgg

SEQ ID NO: 7476652 - DNA, 22 bp, Homo sapiens
attgcacagctgaatattttgg

SEQ ID NO: 7476653 - DNA, 22 bp, Homo sapiens
attgcacagctgaatattttgg

SEQ ID NO: 7476654 - DNA, 22 bp, Homo sapiens
gcatcagttactaggagggaaa

SEQ ID NO: 7476655 - DNA, 22 bp, Homo sapiens
gcatcagcaccaaccttccagg

SEQ ID NO: 7476656 - DNA, 22 bp, Homo sapiens
gcatcagcaccaaccttccagg

SEQ ID NO: 7476657 - DNA, 19 bp, Homo sapiens
gcatcagagcagaaggggt

SEQ ID NO: 7476658 - DNA, 22 bp, Homo sapiens
gcatcagcaccaaccttccagg

SEQ ID NO: 7476659 - DNA, 22 bp, Homo sapiens
gcatcattttcttcttcctgca

SEQ ID NO: 7476660 - DNA, 19 bp, Homo sapiens
gcatgcttggtggcttctg

SEQ ID NO: 7476661 - DNA, 22 bp, Homo sapiens
gcatcattctggctctttccat

SEQ ID NO: 7476662 - DNA, 19 bp, Homo sapiens
gcatcatttgtctcttctt

SEQ ID NO: 7476663 - DNA, 22 bp, Homo sapiens
gcatcatttgtcctctaggact

SEQ ID NO: 7476664 - DNA, 22 bp, Homo sapiens
gcatcatcacggtcaccgagcc

SEQ ID NO: 7476665 - DNA, 22 bp, Homo sapiens
attgcactccatcctgggcaat

SEQ ID NO: 7476666 - DNA, 22 bp, Homo sapiens
attgcactccagcctgggtgac

SEQ ID NO: 7476667 - DNA, 22 bp, Homo sapiens
attgcactccagcctgggtgac

SEQ ID NO: 7476668 - DNA, 22 bp, Homo sapiens
attgcactccagcctgggtgac

SEQ ID NO: 7476669 - DNA, 22 bp, Homo sapiens
attgcactccagcctgggtgac

SEQ ID NO: 7476670 - DNA, 22 bp, Homo sapiens
attgcactccggcctgggtgac

SEQ ID NO: 7476671 - DNA, 22 bp, Homo sapiens
attgcactccggcctgggtgac

SEQ ID NO: 7476672 - DNA, 22 bp, Homo sapiens
attgcactccggcctgggtgac

SEQ ID NO: 7476673 - DNA, 22 bp, Homo sapiens
attgcactccggcctgggtgac

SEQ ID NO: 7476674 - DNA, 22 bp, Homo sapiens
attgcactccggcctgggtgac

SEQ ID NO: 7476675 - DNA, 22 bp, Homo sapiens
attctgcacttcctttgcttcc

SEQ ID NO: 7476676 - DNA, 22 bp, Homo sapiens
attctgcacttcctttgcttcc

SEQ ID NO: 7476677 - DNA, 22 bp, Homo sapiens
attctgcacttcctttgcttcc

SEQ ID NO: 7476678 - DNA, 22 bp, Homo sapiens
attctgcacttcctttgcttcc

SEQ ID NO: 7476679 - DNA, 22 bp, Homo sapiens
attctgcaggtggaggatggca

SEQ ID NO: 7476680 - DNA, 22 bp, Homo sapiens
attctgcatggtggtgtctctg

SEQ ID NO: 7476681 - DNA, 22 bp, Homo sapiens
attctgcatggtggtgtctctg

SEQ ID NO: 7476682 - DNA, 22 bp, Homo sapiens
attctgcatggtggtgtctctg

SEQ ID NO: 7476683 - DNA, 22 bp, Homo sapiens
attctgcataatttcctggcag

SEQ ID NO: 7476684 - DNA, 22 bp, Homo sapiens
attctgcaggtggaggatggca

SEQ ID NO: 7476685 - DNA, 22 bp, Homo sapiens
attctgcatggtggtgtctctg

SEQ ID NO: 7476686 - DNA, 22 bp, Homo sapiens
attctgcataatttcctggcag

SEQ ID NO: 7476687 - DNA, 22 bp, Homo sapiens
attctgcatgtaggtttgctca

SEQ ID NO: 7476688 - DNA, 22 bp, Homo sapiens
attctgcatgtaggtttgctca

SEQ ID NO: 7476689 - DNA, 22 bp, Homo sapiens
attctgcatgtaggtttgctca

SEQ ID NO: 7476690 - DNA, 22 bp, Homo sapiens
attctgcattgctcacaaagat

SEQ ID NO: 7476691 - DNA, 22 bp, Homo sapiens
attctgctagtaacagatgaag

SEQ ID NO: 7476692 - DNA, 22 bp, Homo sapiens
attctgcattgctcacaaagat

SEQ ID NO: 7476693 - DNA, 20 bp, Homo sapiens
gcaggcagggaatgggggtg

SEQ ID NO: 7476694 - DNA, 20 bp, Homo sapiens
gcaggcagggaatgggggtg

SEQ ID NO: 7476695 - DNA, 22 bp, Homo sapiens
gcaggcaggtggcatcttgtga

SEQ ID NO: 7476696 - DNA, 22 bp, Homo sapiens
gcaggcaggtggcatcttgtga

SEQ ID NO: 7476697 - DNA, 22 bp, Homo sapiens
gcaggcaggtggcatcttgtga

SEQ ID NO: 7476698 - DNA, 20 bp, Homo sapiens
gcaggcagggaatgggggtg

SEQ ID NO: 7476699 - DNA, 15 bp, Homo sapiens
gcaggcaggtcacct

SEQ ID NO: 7476700 - DNA, 15 bp, Homo sapiens
gcaggcaggtcacct

SEQ ID NO: 7476701 - DNA, 22 bp, Homo sapiens
attctgcacatccaagaacagg

SEQ ID NO: 7476702 - DNA, 22 bp, Homo sapiens
attctgcaactgttgttggtgg

SEQ ID NO: 7476703 - DNA, 22 bp, Homo sapiens
attctgcacatccaagaacagg

SEQ ID NO: 7476704 - DNA, 22 bp, Homo sapiens
attctgcacatccaagaacagg

SEQ ID NO: 7476705 - DNA, 22 bp, Homo sapiens
attctgcaactgttgttggtgg

SEQ ID NO: 7476706 - DNA, 22 bp, Homo sapiens
attctgattcattaggtctagg

SEQ ID NO: 7476707 - DNA, 22 bp, Homo sapiens
attctgattcattaggtctagg

SEQ ID NO: 7476708 - DNA, 22 bp, Homo sapiens
attctgattcattaggtctagg

SEQ ID NO: 7476709 - DNA, 22 bp, Homo sapiens
gcaggcaggtggcatcttgtga

SEQ ID NO: 7476710 - DNA, 22 bp, Homo sapiens
gcaggcaggtggcatcttgtga

SEQ ID NO: 7476711 - DNA, 22 bp, Homo sapiens
gcaggcaggtggcatcttgtga

SEQ ID NO: 7476712 - DNA, 22 bp, Homo sapiens
attctgatgcctgggtactgcc

SEQ ID NO: 7476713 - DNA, 22 bp, Homo sapiens
gcagggcagtgtgtctgtgggg

SEQ ID NO: 7476714 - DNA, 22 bp, Homo sapiens
gcagggcagtgtgtctgtgggg

SEQ ID NO: 7476715 - DNA, 22 bp, Homo sapiens
gcagggcagtgtgtctgtgggg

SEQ ID NO: 7476716 - DNA, 22 bp, Homo sapiens
gcagggcagtgtgtctgtgggg

SEQ ID NO: 7476717 - DNA, 22 bp, Homo sapiens
gcagggcagtgtgtctgtgggg

SEQ ID NO: 7476718 - DNA, 22 bp, Homo sapiens
gcagggcagtgtgtctgtgggg

SEQ ID NO: 7476719 - DNA, 22 bp, Homo sapiens
gcagggcagtaagagctagagt

SEQ ID NO: 7476720 - DNA, 22 bp, Homo sapiens
gcagggcagtaagagctagagt

SEQ ID NO: 7476721 - DNA, 22 bp, Homo sapiens
gcagggcagtaagagctagagt

SEQ ID NO: 7476722 - DNA, 22 bp, Homo sapiens
gcagggcagtaagagctagagt

SEQ ID NO: 7476723 - DNA, 22 bp, Homo sapiens
gcagggcaaacccaggtgttca

SEQ ID NO: 7476724 - DNA, 22 bp, Homo sapiens
gcagggcaaacccaggtgttca

SEQ ID NO: 7476725 - DNA, 22 bp, Homo sapiens
gcagggcaaacccaggtgttca

SEQ ID NO: 7476726 - DNA, 22 bp, Homo sapiens
gcagggcaaacccaggtgttca

SEQ ID NO: 7476727 - DNA, 22 bp, Homo sapiens
attctggaaagctattctctct

SEQ ID NO: 7476728 - DNA, 22 bp, Homo sapiens
attctggaaagctattctctct

SEQ ID NO: 7476729 - DNA, 22 bp, Homo sapiens
attctggaagcaagcttttaaa

SEQ ID NO: 7476730 - DNA, 22 bp, Homo sapiens
attctgctgcacaccttccccc

SEQ ID NO: 7476731 - DNA, 22 bp, Homo sapiens
attctgctgcacaccttccccc

SEQ ID NO: 7476732 - DNA, 22 bp, Homo sapiens
attctgctgcacaccttccccc

SEQ ID NO: 7476733 - DNA, 16 bp, Homo sapiens
attctgctgcctgctc

SEQ ID NO: 7476734 - DNA, 22 bp, Homo sapiens
attctgctcattttatttccag

SEQ ID NO: 7476735 - DNA, 22 bp, Homo sapiens
attctgctcattttatttccag

SEQ ID NO: 7476736 - DNA, 20 bp, Homo sapiens
attctgctttgaaaataagg

SEQ ID NO: 7476737 - DNA, 22 bp, Homo sapiens
attctggaaagctattctctct

SEQ ID NO: 7476738 - DNA, 22 bp, Homo sapiens
attctggaaagctattctctct

SEQ ID NO: 7476739 - DNA, 22 bp, Homo sapiens
gcagggcagtgtgtctgtgggg

SEQ ID NO: 7476740 - DNA, 22 bp, Homo sapiens
gcagggcagtgtgtctgtgggg

SEQ ID NO: 7476741 - DNA, 22 bp, Homo sapiens
gcagggcagtgtgtctgtgggg

SEQ ID NO: 7476742 - DNA, 22 bp, Homo sapiens
gcagggcagtgtgtctgtgggg

SEQ ID NO: 7476743 - DNA, 22 bp, Homo sapiens
gcagggcatagaggcacggagg

SEQ ID NO: 7476744 - DNA, 22 bp, Homo sapiens
gcagggcatagaggcacggagg

SEQ ID NO: 7476745 - DNA, 22 bp, Homo sapiens
gcagggcagtgtgtctgtgggg

SEQ ID NO: 7476746 - DNA, 22 bp, Homo sapiens
gcagggcagtgtgtctgtgggg

SEQ ID NO: 7476747 - DNA, 22 bp, Homo sapiens
gcagggcatccctgagcgggtg

SEQ ID NO: 7476748 - DNA, 22 bp, Homo sapiens
gcagggcatccctgagcgggtg

SEQ ID NO: 7476749 - DNA, 22 bp, Homo sapiens
gcagggcatagaggcacggagg

SEQ ID NO: 7476750 - DNA, 22 bp, Homo sapiens
gcagggcatagaggcacggagg

SEQ ID NO: 7476751 - DNA, 22 bp, Homo sapiens
gcagggcatagaggcacggagg

SEQ ID NO: 7476752 - DNA, 22 bp, Homo sapiens
gcagggcatagaggcacggagg

SEQ ID NO: 7476753 - DNA, 22 bp, Homo sapiens
gcagggcatagaggcacggagg

SEQ ID NO: 7476754 - DNA, 22 bp, Homo sapiens
gcagggcatccctgagcgggtg

SEQ ID NO: 7476755 - DNA, 22 bp, Homo sapiens
gcagggcatccctgagcgggtg

SEQ ID NO: 7476756 - DNA, 22 bp, Homo sapiens
gcagggcatccctgagcgggtg

SEQ ID NO: 7476757 - DNA, 22 bp, Homo sapiens
gcagggcatccctgagcgggtg

SEQ ID NO: 7476758 - DNA, 22 bp, Homo sapiens
gcagggcatccctgagcgggtg

SEQ ID NO: 7476759 - DNA, 20 bp, Homo sapiens
gcagggcatcttggccccca

SEQ ID NO: 7476760 - DNA, 22 bp, Homo sapiens
gcagggcatccctgagcgggtg

SEQ ID NO: 7476761 - DNA, 22 bp, Homo sapiens
attctttccagacactgattgc

SEQ ID NO: 7476762 - DNA, 22 bp, Homo sapiens
gcagggcatgggccctgtctgc

SEQ ID NO: 7476763 - DNA, 20 bp, Homo sapiens
gcagggcatcttggccccca

SEQ ID NO: 7476764 - DNA, 20 bp, Homo sapiens
gcagggcatcttggccccca

SEQ ID NO: 7476765 - DNA, 20 bp, Homo sapiens
gcagggcatcttggccccca

SEQ ID NO: 7476766 - DNA, 20 bp, Homo sapiens
gcagggcatcttggccccca

SEQ ID NO: 7476767 - DNA, 22 bp, Homo sapiens
attcttttcccaactgctttaa

SEQ ID NO: 7476768 - DNA, 22 bp, Homo sapiens
attcttttcccaactgctttaa

SEQ ID NO: 7476769 - DNA, 22 bp, Homo sapiens
attcttttaagccccagggatt

SEQ ID NO: 7476770 - DNA, 22 bp, Homo sapiens
attcttttcccaactgctttaa

SEQ ID NO: 7476771 - DNA, 22 bp, Homo sapiens
attcttttcccaactgctttaa

SEQ ID NO: 7476772 - DNA, 22 bp, Homo sapiens
attcttttcccaactgctttaa

SEQ ID NO: 7476773 - DNA, 22 bp, Homo sapiens
attcttttcccaactgctttaa

SEQ ID NO: 7476774 - DNA, 22 bp, Homo sapiens
attcttttcccaactgctttaa

SEQ ID NO: 7476775 - DNA, 22 bp, Homo sapiens
attcttttgtcctagcttgata

SEQ ID NO: 7476776 - DNA, 22 bp, Homo sapiens
attcttttttaaggaatagaac

SEQ ID NO: 7476777 - DNA, 22 bp, Homo sapiens
attcttttttaaggaatagaac

SEQ ID NO: 7476778 - DNA, 22 bp, Homo sapiens
attcttttttaaggaatagaac

SEQ ID NO: 7476779 - DNA, 22 bp, Homo sapiens
attcttttttaaggaatagaac

SEQ ID NO: 7476780 - DNA, 22 bp, Homo sapiens
attcttttttaaggaatagaac

SEQ ID NO: 7476781 - DNA, 22 bp, Homo sapiens
attcttttgtcctagcttgata

SEQ ID NO: 7476782 - DNA, 22 bp, Homo sapiens
attcttttcccaactgctttaa

SEQ ID NO: 7476783 - DNA, 22 bp, Homo sapiens
attcttttgtcctagcttgata

SEQ ID NO: 7476784 - DNA, 22 bp, Homo sapiens
attcttttgtcctagcttgata

SEQ ID NO: 7476785 - DNA, 22 bp, Homo sapiens
attcttttgtcctagcttgata

SEQ ID NO: 7476786 - DNA, 22 bp, Homo sapiens
attcttttaaatggcagtagta

SEQ ID NO: 7476787 - DNA, 22 bp, Homo sapiens
attcttttaaatggcagtagta

SEQ ID NO: 7476788 - DNA, 22 bp, Homo sapiens
attcttttaaatggcagtagta

SEQ ID NO: 7476789 - DNA, 22 bp, Homo sapiens
attcttttaaatggcagtagta

SEQ ID NO: 7476790 - DNA, 19 bp, Homo sapiens
attctttggtgtccatttc

SEQ ID NO: 7476791 - DNA, 19 bp, Homo sapiens
attctttggtgtccatttc

SEQ ID NO: 7476792 - DNA, 22 bp, Homo sapiens
attctttggacaataagtggtg

SEQ ID NO: 7476793 - DNA, 22 bp, Homo sapiens
attctttggacaataagtggtg

SEQ ID NO: 7476794 - DNA, 22 bp, Homo sapiens
attcttttaaatggcagtagta

SEQ ID NO: 7476795 - DNA, 22 bp, Homo sapiens
attcttttaagccccagggatt

SEQ ID NO: 7476796 - DNA, 22 bp, Homo sapiens
attcttttaagccccagggatt

SEQ ID NO: 7476797 - DNA, 22 bp, Homo sapiens
attcttttaagccccagggatt

SEQ ID NO: 7476798 - DNA, 22 bp, Homo sapiens
attcttttaagccccagggatt

SEQ ID NO: 7476799 - DNA, 22 bp, Homo sapiens
attcttttaagccccagggatt

SEQ ID NO: 7476800 - DNA, 22 bp, Homo sapiens
attctttccagacactgattgc

SEQ ID NO: 7476801 - DNA, 22 bp, Homo sapiens
attctttgaacagttttcctgt

SEQ ID NO: 7476802 - DNA, 22 bp, Homo sapiens
attctttgaacagttttcctgt

SEQ ID NO: 7476803 - DNA, 17 bp, Homo sapiens
attctttgatgtctctg

SEQ ID NO: 7476804 - DNA, 17 bp, Homo sapiens
attctttgatgtctctg

SEQ ID NO: 7476805 - DNA, 21 bp, Homo sapiens
attctttgatgtgcaataagt

SEQ ID NO: 7476806 - DNA, 21 bp, Homo sapiens
attctttgatgtgcaataagt

SEQ ID NO: 7476807 - DNA, 22 bp, Homo sapiens
attctttgcatctctgggtggc

SEQ ID NO: 7476808 - DNA, 22 bp, Homo sapiens
attctttggacaataagtggtg

SEQ ID NO: 7476809 - DNA, 22 bp, Homo sapiens
attctttgcatctctgggtggc

SEQ ID NO: 7476810 - DNA, 22 bp, Homo sapiens
atagtcttcagcactttgatca

SEQ ID NO: 7476811 - DNA, 22 bp, Homo sapiens
atagtcttagtctatagttttg

SEQ ID NO: 7476812 - DNA, 22 bp, Homo sapiens
atagtcttagtctatagttttg

SEQ ID NO: 7476813 - DNA, 22 bp, Homo sapiens
atagtcttcagcactttgatca

SEQ ID NO: 7476814 - DNA, 22 bp, Homo sapiens
atagtcttagatcagataaagt

SEQ ID NO: 7476815 - DNA, 22 bp, Homo sapiens
atagtcttagatcagataaagt

SEQ ID NO: 7476816 - DNA, 22 bp, Homo sapiens
atagtcttagatcagataaagt

SEQ ID NO: 7476817 - DNA, 22 bp, Homo sapiens
atagtcaaccttgtaattagcc

SEQ ID NO: 7476818 - DNA, 22 bp, Homo sapiens
atagtcaaccttgtaattagcc

SEQ ID NO: 7476819 - DNA, 22 bp, Homo sapiens
atagtcataggcaaatagaaga

SEQ ID NO: 7476820 - DNA, 23 bp, Homo sapiens
atagtctgcgcaactgagagagg

SEQ ID NO: 7476821 - DNA, 22 bp, Homo sapiens
atagtcttacttttctctgcta

SEQ ID NO: 7476822 - DNA, 22 bp, Homo sapiens
atagtcatccagaaagattaca

SEQ ID NO: 7476823 - DNA, 22 bp, Homo sapiens
atagtactccaccagtacatgt

SEQ ID NO: 7476824 - DNA, 22 bp, Homo sapiens
atagtagaaggcatatttggaa

SEQ ID NO: 7476825 - DNA, 22 bp, Homo sapiens
atagtatgagctcatacacttg

SEQ ID NO: 7476826 - DNA, 22 bp, Homo sapiens
atagtatgagctcatacacttg

SEQ ID NO: 7476827 - DNA, 22 bp, Homo sapiens
atagtatgaattaaatcatgag

SEQ ID NO: 7476828 - DNA, 22 bp, Homo sapiens
atagtatgaattaaatcatgag

SEQ ID NO: 7476829 - DNA, 22 bp, Homo sapiens
atagtatgtgtgtttatgtaca

SEQ ID NO: 7476830 - DNA, 22 bp, Homo sapiens
atagtatgtgtgtttatgtaca

SEQ ID NO: 7476831 - DNA, 22 bp, Homo sapiens
atagtacagcatttttcctgag

SEQ ID NO: 7476832 - DNA, 22 bp, Homo sapiens
atagtacatgggtgtcctcaca

SEQ ID NO: 7476833 - DNA, 22 bp, Homo sapiens
atagtacagatccattaattat

SEQ ID NO: 7476834 - DNA, 22 bp, Homo sapiens
atagtacagatccattaattat

SEQ ID NO: 7476835 - DNA, 22 bp, Homo sapiens
atagtacagatccattaattat

SEQ ID NO: 7476836 - DNA, 22 bp, Homo sapiens
atagtacagatccattaattat

SEQ ID NO: 7476837 - DNA, 22 bp, Homo sapiens
atagtacagatccattaattat

SEQ ID NO: 7476838 - DNA, 22 bp, Homo sapiens
atagtatttccagaaatagtct

SEQ ID NO: 7476839 - DNA, 22 bp, Homo sapiens
atagtatttccagaaatagtct

SEQ ID NO: 7476840 - DNA, 22 bp, Homo sapiens
atagtatttccagaaatagtct

SEQ ID NO: 7476841 - DNA, 22 bp, Homo sapiens
atagtatgttgtggtaaataat

SEQ ID NO: 7476842 - DNA, 22 bp, Homo sapiens
atagtatttccagaaatagtct

SEQ ID NO: 7476843 - DNA, 22 bp, Homo sapiens
atagtatttccagaaatagtct

SEQ ID NO: 7476844 - DNA, 22 bp, Homo sapiens
atagtatttccagaaatagtct

SEQ ID NO: 7476845 - DNA, 22 bp, Homo sapiens
atagtatttccagaaatagtct

SEQ ID NO: 7476846 - DNA, 22 bp, Homo sapiens
atagtgaaaatgctgtcagcat

SEQ ID NO: 7476847 - DNA, 22 bp, Homo sapiens
atagtgattattattgctattg

SEQ ID NO: 7476848 - DNA, 22 bp, Homo sapiens
atagtgattgaaaacattctgt

SEQ ID NO: 7476849 - DNA, 22 bp, Homo sapiens
atagtctttactgctgaattga

SEQ ID NO: 7476850 - DNA, 22 bp, Homo sapiens
atagtcttccaggtcttctact

SEQ ID NO: 7476851 - DNA, 22 bp, Homo sapiens
atagtgaaaatgctgtcagcat

SEQ ID NO: 7476852 - DNA, 19 bp, Homo sapiens
atagtctttccaattatac

SEQ ID NO: 7476853 - DNA, 22 bp, Homo sapiens
atatatgtgcaggctcacacat

SEQ ID NO: 7476854 - DNA, 22 bp, Homo sapiens
atatattttgaatagcctctgt

SEQ ID NO: 7476855 - DNA, 22 bp, Homo sapiens
atatattacaaaagaggaagga

SEQ ID NO: 7476856 - DNA, 22 bp, Homo sapiens
atatattttgaatagcctctgt

SEQ ID NO: 7476857 - DNA, 22 bp, Homo sapiens
atatattacaaaagaggaagga

SEQ ID NO: 7476858 - DNA, 20 bp, Homo sapiens
atatatgtatgcgtgtggtt

SEQ ID NO: 7476859 - DNA, 22 bp, Homo sapiens
atatatgtatgtggcggagagg

SEQ ID NO: 7476860 - DNA, 20 bp, Homo sapiens
atatatgtatgcgtgtggtt

SEQ ID NO: 7476861 - DNA, 19 bp, Homo sapiens
atatatgtatacaatgtgg

SEQ ID NO: 7476862 - DNA, 22 bp, Homo sapiens
atatattttgcggtcacgtggc

SEQ ID NO: 7476863 - DNA, 22 bp, Homo sapiens
atatattttgcggtcacgtggc

SEQ ID NO: 7476864 - DNA, 22 bp, Homo sapiens
atatattttgcggtcacgtggc

SEQ ID NO: 7476865 - DNA, 22 bp, Homo sapiens
atatattttgcggtcacgtggc

SEQ ID NO: 7476866 - DNA, 22 bp, Homo sapiens
atatattttgcggtcacgtggc

SEQ ID NO: 7476867 - DNA, 22 bp, Homo sapiens
atatattttgcggtcacgtggc

SEQ ID NO: 7476868 - DNA, 22 bp, Homo sapiens
atatattttgcggtcacgtggc

SEQ ID NO: 7476869 - DNA, 22 bp, Homo sapiens
atatattttgcggtcacgtggc

SEQ ID NO: 7476870 - DNA, 22 bp, Homo sapiens
atatattttgcggtcacgtggc

SEQ ID NO: 7476871 - DNA, 22 bp, Homo sapiens
atatattttttgagacagagtc

SEQ ID NO: 7476872 - DNA, 22 bp, Homo sapiens
atatattttttgagacagagtc

SEQ ID NO: 7476873 - DNA, 22 bp, Homo sapiens
atatattttttgagacagagtc

SEQ ID NO: 7476874 - DNA, 22 bp, Homo sapiens
atatattttttgagacagagtc

SEQ ID NO: 7476875 - DNA, 22 bp, Homo sapiens
atatattttttgagacagagtc

SEQ ID NO: 7476876 - DNA, 22 bp, Homo sapiens
atatattttttgagacagagtc

SEQ ID NO: 7476877 - DNA, 22 bp, Homo sapiens
atatattttttgagacagagtc

SEQ ID NO: 7476878 - DNA, 22 bp, Homo sapiens
atatattttgcggtcacgtggc

SEQ ID NO: 7476879 - DNA, 22 bp, Homo sapiens
atatcacaggtgtttacctgat

SEQ ID NO: 7476880 - DNA, 22 bp, Homo sapiens
atatcacagtagttgtttagtt

SEQ ID NO: 7476881 - DNA, 22 bp, Homo sapiens
atatcacaggtgtttacctgat

SEQ ID NO: 7476882 - DNA, 22 bp, Homo sapiens
atatcacaggtgtttacctgat

SEQ ID NO: 7476883 - DNA, 22 bp, Homo sapiens
atatcacaggaaaggaagatac

SEQ ID NO: 7476884 - DNA, 22 bp, Homo sapiens
atatcacaggaaaggaagatac

SEQ ID NO: 7476885 - DNA, 22 bp, Homo sapiens
atatcacaggaaaggaagatac

SEQ ID NO: 7476886 - DNA, 22 bp, Homo sapiens
atatcacagctctttcattgct

SEQ ID NO: 7476887 - DNA, 23 bp, Homo sapiens
atatcacacccagtacagtctcc

SEQ ID NO: 7476888 - DNA, 22 bp, Homo sapiens
atatcacagatgcagaaagaga

SEQ ID NO: 7476889 - DNA, 22 bp, Homo sapiens
atatcacagatgcagaaagaga

SEQ ID NO: 7476890 - DNA, 22 bp, Homo sapiens
atatcacagatgcagaaagaga

SEQ ID NO: 7476891 - DNA, 22 bp, Homo sapiens
atatcacagatgcagaaagaga

SEQ ID NO: 7476892 - DNA, 22 bp, Homo sapiens
atatcacagctctttcattgct

SEQ ID NO: 7476893 - DNA, 22 bp, Homo sapiens
atatcacagctctttcattgct

SEQ ID NO: 7476894 - DNA, 22 bp, Homo sapiens
atatcacagctctttcattgct

SEQ ID NO: 7476895 - DNA, 22 bp, Homo sapiens
atatcacaggaaaggaagatac

SEQ ID NO: 7476896 - DNA, 22 bp, Homo sapiens
atatcattatgttatgagcaca

SEQ ID NO: 7476897 - DNA, 22 bp, Homo sapiens
atatcataaatcggtgcatgaa

SEQ ID NO: 7476898 - DNA, 22 bp, Homo sapiens
atatcattatgttatgagcaca

SEQ ID NO: 7476899 - DNA, 22 bp, Homo sapiens
atatcattatgttatgagcaca

SEQ ID NO: 7476900 - DNA, 22 bp, Homo sapiens
atatcattatgttatgagcaca

SEQ ID NO: 7476901 - DNA, 22 bp, Homo sapiens
atatcattatgttatgagcaca

SEQ ID NO: 7476902 - DNA, 22 bp, Homo sapiens
atatcattatgttatgagcaca

SEQ ID NO: 7476903 - DNA, 22 bp, Homo sapiens
atatcattatgttatgagcaca

SEQ ID NO: 7476904 - DNA, 22 bp, Homo sapiens
atatcattatgttatgagcaca

SEQ ID NO: 7476905 - DNA, 22 bp, Homo sapiens
atatcattctgatgtatatctt

SEQ ID NO: 7476906 - DNA, 22 bp, Homo sapiens
atatcattatgttatgagcaca

SEQ ID NO: 7476907 - DNA, 22 bp, Homo sapiens
atatcattatgttatgagcaca

SEQ ID NO: 7476908 - DNA, 22 bp, Homo sapiens
atatcataaatcggtgcatgaa

SEQ ID NO: 7476909 - DNA, 22 bp, Homo sapiens
atatcatgttctctgtgtgtca

SEQ ID NO: 7476910 - DNA, 22 bp, Homo sapiens
atatcatgttctctgtgtgtca

SEQ ID NO: 7476911 - DNA, 22 bp, Homo sapiens
atatcataaatcggtgcatgaa

SEQ ID NO: 7476912 - DNA, 22 bp, Homo sapiens
atatcacagtagttgtttagtt

SEQ ID NO: 7476913 - DNA, 22 bp, Homo sapiens
atatcacagtagttgtttagtt

SEQ ID NO: 7476914 - DNA, 22 bp, Homo sapiens
atatcagaaatagtaagcagag

SEQ ID NO: 7476915 - DNA, 18 bp, Homo sapiens
atatcagctacttcatgg

SEQ ID NO: 7476916 - DNA, 18 bp, Homo sapiens
atatcagctacttcatgg

SEQ ID NO: 7476917 - DNA, 22 bp, Homo sapiens
atatcaaagctagtggaaattt

SEQ ID NO: 7476918 - DNA, 22 bp, Homo sapiens
atatcaaagctagtggaaattt

SEQ ID NO: 7476919 - DNA, 22 bp, Homo sapiens
atatcaaacgaagttattttaa

SEQ ID NO: 7476920 - DNA, 22 bp, Homo sapiens
atatcaaagctagtggaaattt

SEQ ID NO: 7476921 - DNA, 22 bp, Homo sapiens
atatcaaagctagtggaaattt

SEQ ID NO: 7476922 - DNA, 22 bp, Homo sapiens
atatcaaagctagtggaaattt

SEQ ID NO: 7476923 - DNA, 22 bp, Homo sapiens
atatcaaagctagtggaaattt

SEQ ID NO: 7476924 - DNA, 22 bp, Homo sapiens
atatcaaacgaagttattttaa

SEQ ID NO: 7476925 - DNA, 22 bp, Homo sapiens
atatcaaacgaagttattttaa

SEQ ID NO: 7476926 - DNA, 22 bp, Homo sapiens
atatcaaacgaagttattttaa

SEQ ID NO: 7476927 - DNA, 22 bp, Homo sapiens
atatcaaaataaacagcatgca

SEQ ID NO: 7476928 - DNA, 22 bp, Homo sapiens
atatcaaaataaacagcatgca

SEQ ID NO: 7476929 - DNA, 22 bp, Homo sapiens
atatcaaaataaacagcatgca

SEQ ID NO: 7476930 - DNA, 22 bp, Homo sapiens
atatcaaaataaacagcatgca

SEQ ID NO: 7476931 - DNA, 22 bp, Homo sapiens
atatcaaaataaacagcatgca

SEQ ID NO: 7476932 - DNA, 22 bp, Homo sapiens
atatcaaacgaagttattttaa

SEQ ID NO: 7476933 - DNA, 22 bp, Homo sapiens
atatcaaacgaagttattttaa

SEQ ID NO: 7476934 - DNA, 22 bp, Homo sapiens
atatcaaacgaagttattttaa

SEQ ID NO: 7476935 - DNA, 22 bp, Homo sapiens
atatcaaagctagtggaaattt

SEQ ID NO: 7476936 - DNA, 22 bp, Homo sapiens
atatcaaagctagtggaaattt

SEQ ID NO: 7476937 - DNA, 22 bp, Homo sapiens
atatcaaagctagtggaaattt

SEQ ID NO: 7476938 - DNA, 22 bp, Homo sapiens
atatcacaaacaagtctgtact

SEQ ID NO: 7476939 - DNA, 23 bp, Homo sapiens
atatcacacccagtacagtctcc

SEQ ID NO: 7476940 - DNA, 23 bp, Homo sapiens
atatcacacccagtacagtctcc

SEQ ID NO: 7476941 - DNA, 23 bp, Homo sapiens
atatcacacccagtacagtctcc

SEQ ID NO: 7476942 - DNA, 23 bp, Homo sapiens
atatcacacccagtacagtctcc

SEQ ID NO: 7476943 - DNA, 23 bp, Homo sapiens
atatcacacccagtacagtctcc

SEQ ID NO: 7476944 - DNA, 23 bp, Homo sapiens
atatcacacccagtacagtctcc

SEQ ID NO: 7476945 - DNA, 23 bp, Homo sapiens
atatcacacccagtacagtctcc

SEQ ID NO: 7476946 - DNA, 23 bp, Homo sapiens
atatcacacccagtacagtctcc

SEQ ID NO: 7476947 - DNA, 23 bp, Homo sapiens
atatcacacccagtacagtctcc

SEQ ID NO: 7476948 - DNA, 21 bp, Homo sapiens
atatcacaaacatatggtctg

SEQ ID NO: 7476949 - DNA, 21 bp, Homo sapiens
atatcacaaacatatggtctg

SEQ ID NO: 7476950 - DNA, 22 bp, Homo sapiens
atatcacaaacaagtctgtact

SEQ ID NO: 7476951 - DNA, 22 bp, Homo sapiens
ctgggcctgagctctgaagagt

SEQ ID NO: 7476952 - DNA, 22 bp, Homo sapiens
ctgggcctgagctctgaagagt

SEQ ID NO: 7476953 - DNA, 22 bp, Homo sapiens
ctgggcctgagctctgaagagt

SEQ ID NO: 7476954 - DNA, 22 bp, Homo sapiens
ctgggcctgagctctgaagagt

SEQ ID NO: 7476955 - DNA, 19 bp, Homo sapiens
ctgggcctgcatggttgtt

SEQ ID NO: 7476956 - DNA, 19 bp, Homo sapiens
ctgggcctgcatggttgtt

SEQ ID NO: 7476957 - DNA, 19 bp, Homo sapiens
ctgggcctgcatggttgtt

SEQ ID NO: 7476958 - DNA, 19 bp, Homo sapiens
ctgggcctgcatggttgtt

SEQ ID NO: 7476959 - DNA, 22 bp, Homo sapiens
ctgggcctgagctctgaagagt

SEQ ID NO: 7476960 - DNA, 22 bp, Homo sapiens
ctgggcctgagctctgaagagt

SEQ ID NO: 7476961 - DNA, 22 bp, Homo sapiens
ctgggcctgccaccatcttagg

SEQ ID NO: 7476962 - DNA, 19 bp, Homo sapiens
ctgggcctgcatggttgtt

SEQ ID NO: 7476963 - DNA, 22 bp, Homo sapiens
ctgggcctgccaccatcttagg

SEQ ID NO: 7476964 - DNA, 22 bp, Homo sapiens
ctgggcctgccaccatcttagg

SEQ ID NO: 7476965 - DNA, 22 bp, Homo sapiens
ctgggcctggacgggcagatct

SEQ ID NO: 7476966 - DNA, 22 bp, Homo sapiens
ctgggcctggacgggcagatct

SEQ ID NO: 7476967 - DNA, 22 bp, Homo sapiens
ctgggcctggacgggcagatct

SEQ ID NO: 7476968 - DNA, 22 bp, Homo sapiens
ctgggcctggacgggcagatct

SEQ ID NO: 7476969 - DNA, 22 bp, Homo sapiens
ctgggcctggacgggcagatct

SEQ ID NO: 7476970 - DNA, 22 bp, Homo sapiens
ctgggcctggacgggcagatct

SEQ ID NO: 7476971 - DNA, 22 bp, Homo sapiens
ctgggcctggacgggcagatct

SEQ ID NO: 7476972 - DNA, 22 bp, Homo sapiens
ctgggcctgggaggccaggtct

SEQ ID NO: 7476973 - DNA, 22 bp, Homo sapiens
ctgggcctgggaggccaggtct

SEQ ID NO: 7476974 - DNA, 22 bp, Homo sapiens
ctgggcctgggaggccaggtct

SEQ ID NO: 7476975 - DNA, 22 bp, Homo sapiens
ctgggcctgggaggccaggtct

SEQ ID NO: 7476976 - DNA, 22 bp, Homo sapiens
ctgggcctgggaggccaggtct

SEQ ID NO: 7476977 - DNA, 22 bp, Homo sapiens
ctgggcctggcgttccaggctg

SEQ ID NO: 7476978 - DNA, 22 bp, Homo sapiens
ctgggcctggcgttccaggctg

SEQ ID NO: 7476979 - DNA, 22 bp, Homo sapiens
ctgggcctggcgttccaggctg

SEQ ID NO: 7476980 - DNA, 22 bp, Homo sapiens
ctgggcctggcgttccaggctg

SEQ ID NO: 7476981 - DNA, 22 bp, Homo sapiens
ctgggcctggcgttccaggctg

SEQ ID NO: 7476982 - DNA, 22 bp, Homo sapiens
ctgggcctggagcccacgagcc

SEQ ID NO: 7476983 - DNA, 22 bp, Homo sapiens
ctgggcctggagcccacgagcc

SEQ ID NO: 7476984 - DNA, 22 bp, Homo sapiens
ctgggcctggagcccacgagcc

SEQ ID NO: 7476985 - DNA, 22 bp, Homo sapiens
ctgggcctggagcccacgagcc

SEQ ID NO: 7476986 - DNA, 22 bp, Homo sapiens
ctgggcctggagcccacgagcc

SEQ ID NO: 7476987 - DNA, 22 bp, Homo sapiens
ctgggcctggagcccacgagcc

SEQ ID NO: 7476988 - DNA, 22 bp, Homo sapiens
ctgggcctggacgggcagatct

SEQ ID NO: 7476989 - DNA, 22 bp, Homo sapiens
ctgggcctggggctgttgagag

SEQ ID NO: 7476990 - DNA, 22 bp, Homo sapiens
ctgggcctggggctgttgagag

SEQ ID NO: 7476991 - DNA, 22 bp, Homo sapiens
ctgggcctggggctgttgagag

SEQ ID NO: 7476992 - DNA, 22 bp, Homo sapiens
ctgggcctggggctgttgagag

SEQ ID NO: 7476993 - DNA, 22 bp, Homo sapiens
ctgggcctggggctgttgagag

SEQ ID NO: 7476994 - DNA, 22 bp, Homo sapiens
ctgggctgatttagtcacgttt

SEQ ID NO: 7476995 - DNA, 22 bp, Homo sapiens
ctgggctgatttagtcacgttt

SEQ ID NO: 7476996 - DNA, 22 bp, Homo sapiens
ctgggctgatttagtcacgttt

SEQ ID NO: 7476997 - DNA, 22 bp, Homo sapiens
ctgggctgatttagtcacgttt

SEQ ID NO: 7476998 - DNA, 22 bp, Homo sapiens
ctgggcctgggaggccaggtct

SEQ ID NO: 7476999 - DNA, 22 bp, Homo sapiens
ctgggcctgggaggccaggtct

SEQ ID NO: 7477000 - DNA, 22 bp, Homo sapiens
ctgggctgatttagtcacgttt

SEQ ID NO: 7477001 - DNA, 22 bp, Homo sapiens
ctgggctgcagcgggagcgacg

SEQ ID NO: 7477002 - DNA, 22 bp, Homo sapiens
ctgggctggcgcatccgacacg

SEQ ID NO: 7477003 - DNA, 22 bp, Homo sapiens
ctgggctgcagcgggagcgacg

SEQ ID NO: 7477004 - DNA, 22 bp, Homo sapiens
ctgggctgcagcgggagcgacg

SEQ ID NO: 7477005 - DNA, 22 bp, Homo sapiens
ctgggctgcagcgggagcgacg

SEQ ID NO: 7477006 - DNA, 22 bp, Homo sapiens
ctgggctgcagcgggagcgacg

SEQ ID NO: 7477007 - DNA, 22 bp, Homo sapiens
ctgggctgcagcgggagcgacg

SEQ ID NO: 7477008 - DNA, 20 bp, Homo sapiens
ctgggctgggctacagggtc

SEQ ID NO: 7477009 - DNA, 20 bp, Homo sapiens
ctgggctgggctacagggtc

SEQ ID NO: 7477010 - DNA, 20 bp, Homo sapiens
ctgggctgggctacagggtc

SEQ ID NO: 7477011 - DNA, 22 bp, Homo sapiens
ctgggctgtaatgtggcactga

SEQ ID NO: 7477012 - DNA, 22 bp, Homo sapiens
ctgggctgtaatgtggcactga

SEQ ID NO: 7477013 - DNA, 22 bp, Homo sapiens
ctgggctgtcaatggccctctg

SEQ ID NO: 7477014 - DNA, 22 bp, Homo sapiens
ctgggctgtaatgtggcactga

SEQ ID NO: 7477015 - DNA, 22 bp, Homo sapiens
ctgggctgtcaatggccctctg

SEQ ID NO: 7477016 - DNA, 22 bp, Homo sapiens
ctgggctgtcaatggccctctg

SEQ ID NO: 7477017 - DNA, 22 bp, Homo sapiens
ctgggctgtcaatggccctctg

SEQ ID NO: 7477018 - DNA, 22 bp, Homo sapiens
ctgggctgtaatgtggcactga

SEQ ID NO: 7477019 - DNA, 22 bp, Homo sapiens
ctgggctgtaatgtggcactga

SEQ ID NO: 7477020 - DNA, 22 bp, Homo sapiens
ctgggctgtaatgtggcactga

SEQ ID NO: 7477021 - DNA, 22 bp, Homo sapiens
ctgggctgtaatgtggcactga

SEQ ID NO: 7477022 - DNA, 22 bp, Homo sapiens
ctgggctgtaatgtggcactga

SEQ ID NO: 7477023 - DNA, 22 bp, Homo sapiens
ctgggctgtaatgtggcactga

SEQ ID NO: 7477024 - DNA, 22 bp, Homo sapiens
ctgggctgtaatgtggcactga

SEQ ID NO: 7477025 - DNA, 22 bp, Homo sapiens
ctgggctgtaatgtggcactga

SEQ ID NO: 7477026 - DNA, 22 bp, Homo sapiens
ctgggctgggtttaccctcttc

SEQ ID NO: 7477027 - DNA, 20 bp, Homo sapiens
ctgggctgggctacagggtc

SEQ ID NO: 7477028 - DNA, 20 bp, Homo sapiens
ctgggctgggctacagggtc

SEQ ID NO: 7477029 - DNA, 22 bp, Homo sapiens
ctgggctgggtttaccctcttc

SEQ ID NO: 7477030 - DNA, 22 bp, Homo sapiens
ctgggctgggtttaccctcttc

SEQ ID NO: 7477031 - DNA, 22 bp, Homo sapiens
ctgggctgggtttaccctcttc

SEQ ID NO: 7477032 - DNA, 22 bp, Homo sapiens
ctgggccatctctctgcaagtg

SEQ ID NO: 7477033 - DNA, 22 bp, Homo sapiens
ctgggccatctctctgcaagtg

SEQ ID NO: 7477034 - DNA, 22 bp, Homo sapiens
ctgggccatctctctgcaagtg

SEQ ID NO: 7477035 - DNA, 22 bp, Homo sapiens
ctgggccatctctctgcaagtg

SEQ ID NO: 7477036 - DNA, 22 bp, Homo sapiens
ctgggccatctctctgcaagtg

SEQ ID NO: 7477037 - DNA, 22 bp, Homo sapiens
ctgggccatctctctgcaagtg

SEQ ID NO: 7477038 - DNA, 22 bp, Homo sapiens
ctgggccatctctctgcaagtg

SEQ ID NO: 7477039 - DNA, 22 bp, Homo sapiens
ctgggccatggaagtctctgcc

SEQ ID NO: 7477040 - DNA, 22 bp, Homo sapiens
ctgggccatggaagtctctgcc

SEQ ID NO: 7477041 - DNA, 22 bp, Homo sapiens
ctgggccatggaagtctctgcc

SEQ ID NO: 7477042 - DNA, 22 bp, Homo sapiens
ctgggccatctctctgcaagtg

SEQ ID NO: 7477043 - DNA, 22 bp, Homo sapiens
ctgggccatctctctgcaagtg

SEQ ID NO: 7477044 - DNA, 22 bp, Homo sapiens
ctgggccatgggccagcgaggc

SEQ ID NO: 7477045 - DNA, 22 bp, Homo sapiens
ctgggccatgggccagcgaggc

SEQ ID NO: 7477046 - DNA, 22 bp, Homo sapiens
ctgggccatgggccagcgaggc

SEQ ID NO: 7477047 - DNA, 22 bp, Homo sapiens
ctgggccatgggccagcgaggc

SEQ ID NO: 7477048 - DNA, 22 bp, Homo sapiens
ctgggccatgggccagcgaggc

SEQ ID NO: 7477049 - DNA, 22 bp, Homo sapiens
ctgggccatgggccagcgaggc

SEQ ID NO: 7477050 - DNA, 22 bp, Homo sapiens
ctgggccatgggccagcgaggc

SEQ ID NO: 7477051 - DNA, 22 bp, Homo sapiens
ctgggccatgggccagcgaggc

SEQ ID NO: 7477052 - DNA, 22 bp, Homo sapiens
ctgggccatggaagtctctgcc

SEQ ID NO: 7477053 - DNA, 22 bp, Homo sapiens
ctgggcccacaagtggaatcgt

SEQ ID NO: 7477054 - DNA, 22 bp, Homo sapiens
ctgggccatgggccagcgaggc

SEQ ID NO: 7477055 - DNA, 22 bp, Homo sapiens
ctgggcctctcagctcccgcgg

SEQ ID NO: 7477056 - DNA, 22 bp, Homo sapiens
ctgggcctctcagctcccgcgg

SEQ ID NO: 7477057 - DNA, 22 bp, Homo sapiens
ctgggcccacaagtggaatcgt

SEQ ID NO: 7477058 - DNA, 22 bp, Homo sapiens
ctgggccatgggccagcgaggc

SEQ ID NO: 7477059 - DNA, 22 bp, Homo sapiens
ctgggccatgggccagcgaggc

SEQ ID NO: 7477060 - DNA, 22 bp, Homo sapiens
ctgggccatgggccagcgaggc

SEQ ID NO: 7477061 - DNA, 22 bp, Homo sapiens
ctgggccatgggccagcgaggc

SEQ ID NO: 7477062 - DNA, 22 bp, Homo sapiens
ctgggccatgggccagcgaggc

SEQ ID NO: 7477063 - DNA, 22 bp, Homo sapiens
ctgggccatgggccagcgaggc

SEQ ID NO: 7477064 - DNA, 22 bp, Homo sapiens
ctgggccatgggccagcgaggc

SEQ ID NO: 7477065 - DNA, 17 bp, Homo sapiens
ctgggcctctgcccttt

SEQ ID NO: 7477066 - DNA, 17 bp, Homo sapiens
ctgggcctctgcccttt

SEQ ID NO: 7477067 - DNA, 17 bp, Homo sapiens
ctgggcctctgcccttt

SEQ ID NO: 7477068 - DNA, 22 bp, Homo sapiens
ctgggcctctcagctcccgcgg

SEQ ID NO: 7477069 - DNA, 22 bp, Homo sapiens
ctgggcctctcagctcccgcgg

SEQ ID NO: 7477070 - DNA, 22 bp, Homo sapiens
ctgggcctctcagctcccgcgg

SEQ ID NO: 7477071 - DNA, 17 bp, Homo sapiens
ctgggcctctgcccttt

SEQ ID NO: 7477072 - DNA, 17 bp, Homo sapiens
ctgggcctctgcccttt

SEQ ID NO: 7477073 - DNA, 17 bp, Homo sapiens
ctgggcctctgcccttt

SEQ ID NO: 7477074 - DNA, 17 bp, Homo sapiens
ctgggcctctgcccttt

SEQ ID NO: 7477075 - DNA, 17 bp, Homo sapiens
ctgggcctctgcccttt

SEQ ID NO: 7477076 - DNA, 22 bp, Homo sapiens
ctgggccagtctcggccgctct

SEQ ID NO: 7477077 - DNA, 22 bp, Homo sapiens
ctgggccagggaggtgtctgta

SEQ ID NO: 7477078 - DNA, 22 bp, Homo sapiens
ctgggccagggaggtgtctgta

SEQ ID NO: 7477079 - DNA, 22 bp, Homo sapiens
ctgggccagtctcggccgctct

SEQ ID NO: 7477080 - DNA, 22 bp, Homo sapiens
ctgggccagtctcggccgctct

SEQ ID NO: 7477081 - DNA, 22 bp, Homo sapiens
ctgggccagtctcggccgctct

SEQ ID NO: 7477082 - DNA, 22 bp, Homo sapiens
ctgggccagtctcggccgctct

SEQ ID NO: 7477083 - DNA, 22 bp, Homo sapiens
ctgggcagttcgctttcgtttt

SEQ ID NO: 7477084 - DNA, 22 bp, Homo sapiens
ctgggcagtttacattcctacc

SEQ ID NO: 7477085 - DNA, 22 bp, Homo sapiens
ctgggcagtttacattcctacc

SEQ ID NO: 7477086 - DNA, 22 bp, Homo sapiens
ctgggcagtttattcagttctg

SEQ ID NO: 7477087 - DNA, 22 bp, Homo sapiens
ctgggccagggaggtgtctgta

SEQ ID NO: 7477088 - DNA, 22 bp, Homo sapiens
ctgggccagggaggtgtctgta

SEQ ID NO: 7477089 - DNA, 22 bp, Homo sapiens
ctgggccagggaggtgtctgta

SEQ ID NO: 7477090 - DNA, 22 bp, Homo sapiens
ctgggccagtctcggccgctct

SEQ ID NO: 7477091 - DNA, 22 bp, Homo sapiens
ctgggccagtctcggccgctct

SEQ ID NO: 7477092 - DNA, 22 bp, Homo sapiens
ctgggccagttatgtctcatct

SEQ ID NO: 7477093 - DNA, 22 bp, Homo sapiens
ctgggccagttatgtctcatct

SEQ ID NO: 7477094 - DNA, 22 bp, Homo sapiens
ctgggccagttatgtctcatct

SEQ ID NO: 7477095 - DNA, 22 bp, Homo sapiens
ctgggccagttatgtctcatct

SEQ ID NO: 7477096 - DNA, 22 bp, Homo sapiens
ctgggccatcagaggggctgga

SEQ ID NO: 7477097 - DNA, 22 bp, Homo sapiens
ctgggccagttatgtctcatct

SEQ ID NO: 7477098 - DNA, 22 bp, Homo sapiens
ctgggccatcagaggggctgga

SEQ ID NO: 7477099 - DNA, 22 bp, Homo sapiens
ctgggccatcagaggggctgga

SEQ ID NO: 7477100 - DNA, 22 bp, Homo sapiens
ctgggccatctctctgcaagtg

SEQ ID NO: 7477101 - DNA, 22 bp, Homo sapiens
ctgggccatctcctttgtgtgg

SEQ ID NO: 7477102 - DNA, 22 bp, Homo sapiens
ctgggccatctcctttgtgtgg

SEQ ID NO: 7477103 - DNA, 20 bp, Homo sapiens
ctgggccatccttttacaat

SEQ ID NO: 7477104 - DNA, 20 bp, Homo sapiens
ctgggccatccttttacaat

SEQ ID NO: 7477105 - DNA, 22 bp, Homo sapiens
ctgggccatcagaggggctgga

SEQ ID NO: 7477106 - DNA, 22 bp, Homo sapiens
ctgggccatcagaggggctgga

SEQ ID NO: 7477107 - DNA, 20 bp, Homo sapiens
ctgggccatccttttacaat

SEQ ID NO: 7477108 - DNA, 22 bp, Homo sapiens
ctggggaggatgctacgacctg

SEQ ID NO: 7477109 - DNA, 22 bp, Homo sapiens
ctggggaggatgctacgacctg

SEQ ID NO: 7477110 - DNA, 22 bp, Homo sapiens
ctggggaggatgctacgacctg

SEQ ID NO: 7477111 - DNA, 22 bp, Homo sapiens
ctggggaggatgctacgacctg

SEQ ID NO: 7477112 - DNA, 22 bp, Homo sapiens
ctggggaggatgctacgacctg

SEQ ID NO: 7477113 - DNA, 22 bp, Homo sapiens
ctgggctgttctgcccctgggt

SEQ ID NO: 7477114 - DNA, 22 bp, Homo sapiens
ctgggctgttctgcccctgggt

SEQ ID NO: 7477115 - DNA, 22 bp, Homo sapiens
ctggggaggcagggctgcccct

SEQ ID NO: 7477116 - DNA, 22 bp, Homo sapiens
ctggggaggatgctacgacctg

SEQ ID NO: 7477117 - DNA, 22 bp, Homo sapiens
ctggggaggatgctacgacctg

SEQ ID NO: 7477118 - DNA, 22 bp, Homo sapiens
ctggggaggatgctacgacctg

SEQ ID NO: 7477119 - DNA, 22 bp, Homo sapiens
ctggggaggcagggctgcccct

SEQ ID NO: 7477120 - DNA, 22 bp, Homo sapiens
ctggggaggcagggctgcccct

SEQ ID NO: 7477121 - DNA, 22 bp, Homo sapiens
ctggggaggcagggctgcccct

SEQ ID NO: 7477122 - DNA, 22 bp, Homo sapiens
ctggggaggcagggctgcccct

SEQ ID NO: 7477123 - DNA, 22 bp, Homo sapiens
ctggggaggcagggctgcccct

SEQ ID NO: 7477124 - DNA, 22 bp, Homo sapiens
ctggggaggcagggctgcccct

SEQ ID NO: 7477125 - DNA, 22 bp, Homo sapiens
ctggggaggcagggctgcccct

SEQ ID NO: 7477126 - DNA, 22 bp, Homo sapiens
ctggggagtgaaattcttaaat

SEQ ID NO: 7477127 - DNA, 22 bp, Homo sapiens
ctggggagtgaaattcttaaat

SEQ ID NO: 7477128 - DNA, 22 bp, Homo sapiens
ctggggatgggacctggcataa

SEQ ID NO: 7477129 - DNA, 22 bp, Homo sapiens
ctggggatgggacctggcataa

SEQ ID NO: 7477130 - DNA, 22 bp, Homo sapiens
ctggggatgggacctggcataa

SEQ ID NO: 7477131 - DNA, 22 bp, Homo sapiens
ctggggatgggacctggcataa

SEQ ID NO: 7477132 - DNA, 22 bp, Homo sapiens
ctggggatgggacctggcataa

SEQ ID NO: 7477133 - DNA, 22 bp, Homo sapiens
ctggggagtgaaggtaattaca

SEQ ID NO: 7477134 - DNA, 22 bp, Homo sapiens
ctggggatcctttttgcatcta

SEQ ID NO: 7477135 - DNA, 22 bp, Homo sapiens
ctggggatcctttttgcatcta

SEQ ID NO: 7477136 - DNA, 22 bp, Homo sapiens
ctgggctgtcccagggcggcag

SEQ ID NO: 7477137 - DNA, 22 bp, Homo sapiens
ctgggctgtcccagggcggcag

SEQ ID NO: 7477138 - DNA, 22 bp, Homo sapiens
ctgggctgtcccagggcggcag

SEQ ID NO: 7477139 - DNA, 22 bp, Homo sapiens
ctgggctgtcccagggcggcag

SEQ ID NO: 7477140 - DNA, 22 bp, Homo sapiens
ctgggctgtcccaaccccatcc

SEQ ID NO: 7477141 - DNA, 22 bp, Homo sapiens
ctgggctgtcccagggcggcag

SEQ ID NO: 7477142 - DNA, 22 bp, Homo sapiens
ctgggctgtcccagggcggcag

SEQ ID NO: 7477143 - DNA, 22 bp, Homo sapiens
ctgggctgtcccaaccccatcc

SEQ ID NO: 7477144 - DNA, 22 bp, Homo sapiens
ctgggctgtcaatggccctctg

SEQ ID NO: 7477145 - DNA, 22 bp, Homo sapiens
ctgggctgtcaatggccctctg

SEQ ID NO: 7477146 - DNA, 22 bp, Homo sapiens
ctgggctgtcaatggccctctg

SEQ ID NO: 7477147 - DNA, 22 bp, Homo sapiens
ctgggctgtcagttttgtttta

SEQ ID NO: 7477148 - DNA, 22 bp, Homo sapiens
ctgggctgtcagttttgtttta

SEQ ID NO: 7477149 - DNA, 22 bp, Homo sapiens
ctgggctgttctgcccctgggt

SEQ ID NO: 7477150 - DNA, 22 bp, Homo sapiens
ctgggctgttctgcccctgggt

SEQ ID NO: 7477151 - DNA, 22 bp, Homo sapiens
ctgggctgtggtgtggcccaaa

SEQ ID NO: 7477152 - DNA, 22 bp, Homo sapiens
ctgggctgtggtgtggcccaaa

SEQ ID NO: 7477153 - DNA, 22 bp, Homo sapiens
ctgggctgtggtgtggcccaaa

SEQ ID NO: 7477154 - DNA, 22 bp, Homo sapiens
ctgggctgtggtgtggcccaaa

SEQ ID NO: 7477155 - DNA, 22 bp, Homo sapiens
ctgggctgtggtgtggcccaaa

SEQ ID NO: 7477156 - DNA, 22 bp, Homo sapiens
ctgggctgtggtgtggcccaaa

SEQ ID NO: 7477157 - DNA, 22 bp, Homo sapiens
ctgggctgtggtgtggcccaaa

SEQ ID NO: 7477158 - DNA, 22 bp, Homo sapiens
ctgggctgtggtgtggcccaaa

SEQ ID NO: 7477159 - DNA, 22 bp, Homo sapiens
ctgggctgtggtgtggcccaaa

SEQ ID NO: 7477160 - DNA, 22 bp, Homo sapiens
ctgggctgtggtgtggcccaaa

SEQ ID NO: 7477161 - DNA, 22 bp, Homo sapiens
ctgggctgtggtgtggcccaaa

SEQ ID NO: 7477162 - DNA, 23 bp, Homo sapiens
ctgggctgtcctgaggtcacctc

SEQ ID NO: 7477163 - DNA, 23 bp, Homo sapiens
ctgggctgtcctgaggtcacctc

SEQ ID NO: 7477164 - DNA, 23 bp, Homo sapiens
ctgggctgtcctgaggtcacctc

SEQ ID NO: 7477165 - DNA, 23 bp, Homo sapiens
ctgggctgtcctgaggtcacctc

SEQ ID NO: 7477166 - DNA, 23 bp, Homo sapiens
ctgggctgtcctgaggtcacctc

SEQ ID NO: 7477167 - DNA, 23 bp, Homo sapiens
ctgggctgtcctgaggtcacctc

SEQ ID NO: 7477168 - DNA, 22 bp, Homo sapiens
ctgggctgtcccagggcggcag

SEQ ID NO: 7477169 - DNA, 17 bp, Homo sapiens
ctggggatgtgggactc

SEQ ID NO: 7477170 - DNA, 17 bp, Homo sapiens
ctggggatgtgggactc

SEQ ID NO: 7477171 - DNA, 17 bp, Homo sapiens
ctggggatgtgggactc

SEQ ID NO: 7477172 - DNA, 22 bp, Homo sapiens
ctggggcagagcccagcaattt

SEQ ID NO: 7477173 - DNA, 22 bp, Homo sapiens
ctggggcagagcccagcaattt

SEQ ID NO: 7477174 - DNA, 22 bp, Homo sapiens
ctggggcagagcccagcaattt

SEQ ID NO: 7477175 - DNA, 22 bp, Homo sapiens
ctggggcagagcccagcaattt

SEQ ID NO: 7477176 - DNA, 22 bp, Homo sapiens
ctggggcagagcccagcaattt

SEQ ID NO: 7477177 - DNA, 22 bp, Homo sapiens
ctggggcagagcccagcaattt

SEQ ID NO: 7477178 - DNA, 22 bp, Homo sapiens
ctggggcatcatccattctttc

SEQ ID NO: 7477179 - DNA, 22 bp, Homo sapiens
ctggggcagagcctttagcaaa

SEQ ID NO: 7477180 - DNA, 22 bp, Homo sapiens
ctggggcagagcctttagcaaa

SEQ ID NO: 7477181 - DNA, 22 bp, Homo sapiens
ctggtcctctccagcaggcatt

SEQ ID NO: 7477182 - DNA, 22 bp, Homo sapiens
ctggtcctctccagcaggcatt

SEQ ID NO: 7477183 - DNA, 22 bp, Homo sapiens
ctggtcctctccagcaggcatt

SEQ ID NO: 7477184 - DNA, 22 bp, Homo sapiens
ctggtcctctccagcaggcatt

SEQ ID NO: 7477185 - DNA, 19 bp, Homo sapiens
ctggtcctgactgaggggt

SEQ ID NO: 7477186 - DNA, 19 bp, Homo sapiens
ctggtcctgactgaggggt

SEQ ID NO: 7477187 - DNA, 19 bp, Homo sapiens
ctggtcctgactgaggggt

SEQ ID NO: 7477188 - DNA, 19 bp, Homo sapiens
ctggtgcttgagtgagtca

SEQ ID NO: 7477189 - DNA, 22 bp, Homo sapiens
ctggtgctgggcagggctcagg

SEQ ID NO: 7477190 - DNA, 19 bp, Homo sapiens
ctggtgcttgagtgagtca

SEQ ID NO: 7477191 - DNA, 22 bp, Homo sapiens
ctggtggaatggcagagggaac

SEQ ID NO: 7477192 - DNA, 22 bp, Homo sapiens
ctggtggaagcctgggctcaga

SEQ ID NO: 7477193 - DNA, 22 bp, Homo sapiens
ctggtggaagcctgggctcaga

SEQ ID NO: 7477194 - DNA, 22 bp, Homo sapiens
ctggtggagagtgggctctgga

SEQ ID NO: 7477195 - DNA, 22 bp, Homo sapiens
ctggtggagagtgggctctgga

SEQ ID NO: 7477196 - DNA, 22 bp, Homo sapiens
ctggtggaatggcagagggaac

SEQ ID NO: 7477197 - DNA, 22 bp, Homo sapiens
ctggtggagagtgggctctgga

SEQ ID NO: 7477198 - DNA, 22 bp, Homo sapiens
ctggtggagagtgggctctgga

SEQ ID NO: 7477199 - DNA, 22 bp, Homo sapiens
ctggtggaatggcagagggaac

SEQ ID NO: 7477200 - DNA, 22 bp, Homo sapiens
ctggtggaagcctgggctcaga

SEQ ID NO: 7477201 - DNA, 19 bp, Homo sapiens
ctggtgcttgagtgagtca

SEQ ID NO: 7477202 - DNA, 22 bp, Homo sapiens
ctggtgctgggcagggctcagg

SEQ ID NO: 7477203 - DNA, 22 bp, Homo sapiens
ctggtgctggcaacagagtagg

SEQ ID NO: 7477204 - DNA, 22 bp, Homo sapiens
ctggtgctggcaacagagtagg

SEQ ID NO: 7477205 - DNA, 22 bp, Homo sapiens
ctggtccttgacgcgtgggagg

SEQ ID NO: 7477206 - DNA, 22 bp, Homo sapiens
ctggtccttgacgcgtgggagg

SEQ ID NO: 7477207 - DNA, 22 bp, Homo sapiens
ctggtccttgacgcgtgggagg

SEQ ID NO: 7477208 - DNA, 22 bp, Homo sapiens
ctggtgggaggcaaggtggaag

SEQ ID NO: 7477209 - DNA, 22 bp, Homo sapiens
ctggtgggagcagcaggcagct

SEQ ID NO: 7477210 - DNA, 22 bp, Homo sapiens
ctggtgggagcagcaggcagct

SEQ ID NO: 7477211 - DNA, 22 bp, Homo sapiens
ctggtgggagcagcaggcagct

SEQ ID NO: 7477212 - DNA, 22 bp, Homo sapiens
ctggtgggagcagcaggcagct

SEQ ID NO: 7477213 - DNA, 22 bp, Homo sapiens
ctggtgggagcagcaggcagct

SEQ ID NO: 7477214 - DNA, 22 bp, Homo sapiens
ctggtgggagcagcaggcagct

SEQ ID NO: 7477215 - DNA, 22 bp, Homo sapiens
ctggtggggagtcctggtctcc

SEQ ID NO: 7477216 - DNA, 22 bp, Homo sapiens
ctggtgggaggcaaggtggaag

SEQ ID NO: 7477217 - DNA, 22 bp, Homo sapiens
ctggtgggaggcaaggtggaag

SEQ ID NO: 7477218 - DNA, 22 bp, Homo sapiens
ctggtgggaggcaaggtggaag

SEQ ID NO: 7477219 - DNA, 22 bp, Homo sapiens
ctggtgggaggcaaggtggaag

SEQ ID NO: 7477220 - DNA, 22 bp, Homo sapiens
ctggtgggaggcaaggtggaag

SEQ ID NO: 7477221 - DNA, 22 bp, Homo sapiens
ctggtggcaatgaggcgtcact

SEQ ID NO: 7477222 - DNA, 22 bp, Homo sapiens
ctggtggcatcttgagacggtt

SEQ ID NO: 7477223 - DNA, 22 bp, Homo sapiens
ctggtggcatcttgagacggtt

SEQ ID NO: 7477224 - DNA, 22 bp, Homo sapiens
ctggtggcatcttgagacggtt

SEQ ID NO: 7477225 - DNA, 22 bp, Homo sapiens
ctggtggcaatgaggcgtcact

SEQ ID NO: 7477226 - DNA, 22 bp, Homo sapiens
ctggtggcaatgaggcgtcact

SEQ ID NO: 7477227 - DNA, 22 bp, Homo sapiens
ctggtggaggtgccaggatttg

SEQ ID NO: 7477228 - DNA, 22 bp, Homo sapiens
ctggtggagagtgggctctgga

SEQ ID NO: 7477229 - DNA, 22 bp, Homo sapiens
ctggtggagatgcctggcccct

SEQ ID NO: 7477230 - DNA, 22 bp, Homo sapiens
ctggtggagatgcctggcccct

SEQ ID NO: 7477231 - DNA, 22 bp, Homo sapiens
ctggtggagatgcctggcccct

SEQ ID NO: 7477232 - DNA, 22 bp, Homo sapiens
ctggtggagggacaggcttagc

SEQ ID NO: 7477233 - DNA, 22 bp, Homo sapiens
ctggtgggagcagcaggcagct

SEQ ID NO: 7477234 - DNA, 22 bp, Homo sapiens
ctggtgggagcagcaggcagct

SEQ ID NO: 7477235 - DNA, 22 bp, Homo sapiens
ctggtgggagcagcaggcagct

SEQ ID NO: 7477236 - DNA, 22 bp, Homo sapiens
ctggtgggaagatggaaaacat

SEQ ID NO: 7477237 - DNA, 22 bp, Homo sapiens
ctggtgggaagatggaaaacat

SEQ ID NO: 7477238 - DNA, 22 bp, Homo sapiens
ctggtggcatcttgagatggtt

SEQ ID NO: 7477239 - DNA, 22 bp, Homo sapiens
ctggtggcatcttgagatggtt

SEQ ID NO: 7477240 - DNA, 22 bp, Homo sapiens
ctggtggcatcttgagatggtt

SEQ ID NO: 7477241 - DNA, 22 bp, Homo sapiens
ctggtggcatcttgagacggtt

SEQ ID NO: 7477242 - DNA, 22 bp, Homo sapiens
ctggtggcatcttgagatggtt

SEQ ID NO: 7477243 - DNA, 22 bp, Homo sapiens
ctggtggcatcttgagatggtt

SEQ ID NO: 7477244 - DNA, 22 bp, Homo sapiens
ctggtggcatcttgagatggtt

SEQ ID NO: 7477245 - DNA, 22 bp, Homo sapiens
ctgtattgaagtgttggctgag

SEQ ID NO: 7477246 - DNA, 22 bp, Homo sapiens
ctgtatttagttaaaatgctaa

SEQ ID NO: 7477247 - DNA, 22 bp, Homo sapiens
ctgtattctgggcagggaagga

SEQ ID NO: 7477248 - DNA, 22 bp, Homo sapiens
ctgtattctgggcagggaagga

SEQ ID NO: 7477249 - DNA, 22 bp, Homo sapiens
ctgtatttagttaaaatgctaa

SEQ ID NO: 7477250 - DNA, 22 bp, Homo sapiens
ctgtatttcccacattctctat

SEQ ID NO: 7477251 - DNA, 22 bp, Homo sapiens
ctgtatttagttaaaatgctaa

SEQ ID NO: 7477252 - DNA, 22 bp, Homo sapiens
ctgtatttagttaaaatgctaa

SEQ ID NO: 7477253 - DNA, 22 bp, Homo sapiens
ctgtatttagttaaaatgctaa

SEQ ID NO: 7477254 - DNA, 22 bp, Homo sapiens
ctgtatttcccacattctctat

SEQ ID NO: 7477255 - DNA, 22 bp, Homo sapiens
ctgtatttcccacattctctat

SEQ ID NO: 7477256 - DNA, 22 bp, Homo sapiens
ctgtatttcttggacagttgct

SEQ ID NO: 7477257 - DNA, 22 bp, Homo sapiens
ctgtatttcttggacagttgct

SEQ ID NO: 7477258 - DNA, 22 bp, Homo sapiens
ctgtcattgtacatgttataca

SEQ ID NO: 7477259 - DNA, 22 bp, Homo sapiens
ctgtatttgaaagaaaagattt

SEQ ID NO: 7477260 - DNA, 22 bp, Homo sapiens
ctgtatttgaaagaaaagattt

SEQ ID NO: 7477261 - DNA, 22 bp, Homo sapiens
ctgtatttcttggacagttgct

SEQ ID NO: 7477262 - DNA, 22 bp, Homo sapiens
ctgtatgttccgttttgtcact

SEQ ID NO: 7477263 - DNA, 22 bp, Homo sapiens
ctgtatgttccgttttgtcact

SEQ ID NO: 7477264 - DNA, 22 bp, Homo sapiens
ctgtatgttgggtaagcattgc

SEQ ID NO: 7477265 - DNA, 22 bp, Homo sapiens
ctgtatgttccgttttgtcact

SEQ ID NO: 7477266 - DNA, 22 bp, Homo sapiens
ctgtatgtttctatgaatgtga

SEQ ID NO: 7477267 - DNA, 22 bp, Homo sapiens
ctgtatgtttctatgaatgtga

SEQ ID NO: 7477268 - DNA, 22 bp, Homo sapiens
ctgtatgttgggtaagcattgc

SEQ ID NO: 7477269 - DNA, 22 bp, Homo sapiens
ctgtatgtgaaaatgtcaagtg

SEQ ID NO: 7477270 - DNA, 22 bp, Homo sapiens
ctgtatgtcttgtgaattgtag

SEQ ID NO: 7477271 - DNA, 22 bp, Homo sapiens
ctgtatgtcttgtgaattgtag

SEQ ID NO: 7477272 - DNA, 22 bp, Homo sapiens
ctgtatgtgaaaatgtcaagtg

SEQ ID NO: 7477273 - DNA, 22 bp, Homo sapiens
ctgtatgtagaatagctgacaa

SEQ ID NO: 7477274 - DNA, 22 bp, Homo sapiens
ctgtatgtagaatagctgacaa

SEQ ID NO: 7477275 - DNA, 22 bp, Homo sapiens
ctgtatgtcttgtgaattgtag

SEQ ID NO: 7477276 - DNA, 22 bp, Homo sapiens
ctgtattaaaggcagtgatctt

SEQ ID NO: 7477277 - DNA, 22 bp, Homo sapiens
ctgtatgttttctcctttggtt

SEQ ID NO: 7477278 - DNA, 22 bp, Homo sapiens
ctgtatgttttctcctttggtt

SEQ ID NO: 7477279 - DNA, 22 bp, Homo sapiens
ctgtatgtttctatgaatgtga

SEQ ID NO: 7477280 - DNA, 22 bp, Homo sapiens
ctgtatgtttctatgaatgtga

SEQ ID NO: 7477281 - DNA, 22 bp, Homo sapiens
ctgtattagccaggtgcacaag

SEQ ID NO: 7477282 - DNA, 22 bp, Homo sapiens
ctgtattaaaggcagtgatctt

SEQ ID NO: 7477283 - DNA, 21 bp, Homo sapiens
ctgtattaacttttgcacctt

SEQ ID NO: 7477284 - DNA, 22 bp, Homo sapiens
ctgtattcaaagtgaggatgta

SEQ ID NO: 7477285 - DNA, 22 bp, Homo sapiens
ctgtattcaagcttctgcccaa

SEQ ID NO: 7477286 - DNA, 22 bp, Homo sapiens
ctgtccacatggagaacctggt

SEQ ID NO: 7477287 - DNA, 22 bp, Homo sapiens
ctgtccacatggagaacctggt

SEQ ID NO: 7477288 - DNA, 22 bp, Homo sapiens
ctgtccacctttgataggctct

SEQ ID NO: 7477289 - DNA, 22 bp, Homo sapiens
ctgtccagaaagggggcaacaa

SEQ ID NO: 7477290 - DNA, 22 bp, Homo sapiens
ctgtccacctactgactagttg

SEQ ID NO: 7477291 - DNA, 22 bp, Homo sapiens
ctgtccagaaagggggcaacaa

SEQ ID NO: 7477292 - DNA, 22 bp, Homo sapiens
ctgtccagaaagggggcaacaa

SEQ ID NO: 7477293 - DNA, 21 bp, Homo sapiens
ctgtccaaatttcataacttt

SEQ ID NO: 7477294 - DNA, 21 bp, Homo sapiens
ctgtccacatcacagagcctc

SEQ ID NO: 7477295 - DNA, 21 bp, Homo sapiens
ctgtccacatcacagagcctc

SEQ ID NO: 7477296 - DNA, 21 bp, Homo sapiens
ctgtccacatcacagagcctc

SEQ ID NO: 7477297 - DNA, 19 bp, Homo sapiens
ctgtccacacactcgcttc

SEQ ID NO: 7477298 - DNA, 19 bp, Homo sapiens
ctgtccacacactcgcttc

SEQ ID NO: 7477299 - DNA, 21 bp, Homo sapiens
ctgtccacatcacagagcctc

SEQ ID NO: 7477300 - DNA, 22 bp, Homo sapiens
ctgtcatttctattatagagga

SEQ ID NO: 7477301 - DNA, 22 bp, Homo sapiens
ctgtcatttaagacattctgga

SEQ ID NO: 7477302 - DNA, 22 bp, Homo sapiens
ctgtcatttaagacattctgga

SEQ ID NO: 7477303 - DNA, 22 bp, Homo sapiens
ctgtcatttgtctgctccctct

SEQ ID NO: 7477304 - DNA, 22 bp, Homo sapiens
ctgtcatttttttagaacacct

SEQ ID NO: 7477305 - DNA, 21 bp, Homo sapiens
ctgtccaaatttcataacttt

SEQ ID NO: 7477306 - DNA, 21 bp, Homo sapiens
ctgtccaaatttcataacttt

SEQ ID NO: 7477307 - DNA, 21 bp, Homo sapiens
ctgtccaaatttcataacttt

SEQ ID NO: 7477308 - DNA, 22 bp, Homo sapiens
ctgtccagcttggctcctgggg

SEQ ID NO: 7477309 - DNA, 22 bp, Homo sapiens
ctgtccagcttggctcctgggg

SEQ ID NO: 7477310 - DNA, 22 bp, Homo sapiens
ctgtccagcttggctcctgggg

SEQ ID NO: 7477311 - DNA, 22 bp, Homo sapiens
ctgtccagcttggctcctgggg

SEQ ID NO: 7477312 - DNA, 22 bp, Homo sapiens
ctgtccagcttggctcctgggg

SEQ ID NO: 7477313 - DNA, 22 bp, Homo sapiens
ctgtccagcttggctcctgggg

SEQ ID NO: 7477314 - DNA, 22 bp, Homo sapiens
ctgtccagctgaccagagcagc

SEQ ID NO: 7477315 - DNA, 22 bp, Homo sapiens
ctgtccagctgaccagagcagc

SEQ ID NO: 7477316 - DNA, 22 bp, Homo sapiens
ctgtccagctgaccagagcagc

SEQ ID NO: 7477317 - DNA, 22 bp, Homo sapiens
ctgtccagctgaccagagcagc

SEQ ID NO: 7477318 - DNA, 22 bp, Homo sapiens
ctgtccagctgaccagagcagc

SEQ ID NO: 7477319 - DNA, 22 bp, Homo sapiens
ctgtccagctgaccagagcagc

SEQ ID NO: 7477320 - DNA, 22 bp, Homo sapiens
ctgtccagctgaccagagcagc

SEQ ID NO: 7477321 - DNA, 22 bp, Homo sapiens
ctgtccagctgaccagagcagc

SEQ ID NO: 7477322 - DNA, 22 bp, Homo sapiens
ctgtccagcgactaggggatgg

SEQ ID NO: 7477323 - DNA, 22 bp, Homo sapiens
ctgtccagcgactaggggatgg

SEQ ID NO: 7477324 - DNA, 22 bp, Homo sapiens
ctgtccagcacatgtctgcccc

SEQ ID NO: 7477325 - DNA, 22 bp, Homo sapiens
ctgtccagcgactaggggatgg

SEQ ID NO: 7477326 - DNA, 22 bp, Homo sapiens
ctgtccagcgactaggggatgg

SEQ ID NO: 7477327 - DNA, 22 bp, Homo sapiens
ctgtccagctgaccagagcagc

SEQ ID NO: 7477328 - DNA, 22 bp, Homo sapiens
ctgtccagctgaccagagcagc

SEQ ID NO: 7477329 - DNA, 22 bp, Homo sapiens
ctgtccagctgaccagagcagc

SEQ ID NO: 7477330 - DNA, 22 bp, Homo sapiens
ctgtccagctgaccagagcagc

SEQ ID NO: 7477331 - DNA, 22 bp, Homo sapiens
ctgtccagcacatgtctgcccc

SEQ ID NO: 7477332 - DNA, 22 bp, Homo sapiens
ctgtccagaataggcaaatcca

SEQ ID NO: 7477333 - DNA, 16 bp, Homo sapiens
ctgtccagcatctgcc

SEQ ID NO: 7477334 - DNA, 16 bp, Homo sapiens
ctgtccagcatctgcc

SEQ ID NO: 7477335 - DNA, 22 bp, Homo sapiens
ctgtccagaaagggggcaacaa

SEQ ID NO: 7477336 - DNA, 22 bp, Homo sapiens
ctgtccagaaagggggcaacaa

SEQ ID NO: 7477337 - DNA, 22 bp, Homo sapiens
ctgtccagaaagggggcaacaa

SEQ ID NO: 7477338 - DNA, 22 bp, Homo sapiens
ctgtccagaataggcaaatcca

SEQ ID NO: 7477339 - DNA, 22 bp, Homo sapiens
ctgtccagaataggcaaatcca

SEQ ID NO: 7477340 - DNA, 22 bp, Homo sapiens
atattttcactgaaccaaagta

SEQ ID NO: 7477341 - DNA, 22 bp, Homo sapiens
atattttcactgaaccaaagta

SEQ ID NO: 7477342 - DNA, 22 bp, Homo sapiens
atattttcactgaaccaaagta

SEQ ID NO: 7477343 - DNA, 22 bp, Homo sapiens
atattttcactgaaccaaagta

SEQ ID NO: 7477344 - DNA, 22 bp, Homo sapiens
atattttcacagaacttgcaaa

SEQ ID NO: 7477345 - DNA, 22 bp, Homo sapiens
atattttcactgaaccaaagta

SEQ ID NO: 7477346 - DNA, 22 bp, Homo sapiens
atattttcactgaaccaaagta

SEQ ID NO: 7477347 - DNA, 22 bp, Homo sapiens
atattttcactgaaccaaagta

SEQ ID NO: 7477348 - DNA, 22 bp, Homo sapiens
atattttccgaacttgaggtag

SEQ ID NO: 7477349 - DNA, 22 bp, Homo sapiens
atattttccgaacttgaggtag

SEQ ID NO: 7477350 - DNA, 22 bp, Homo sapiens
atattttccgaacttgaggtag

SEQ ID NO: 7477351 - DNA, 22 bp, Homo sapiens
atattttccgaacttgaggtag

SEQ ID NO: 7477352 - DNA, 22 bp, Homo sapiens
atattttgaagttaataatgtg

SEQ ID NO: 7477353 - DNA, 22 bp, Homo sapiens
atattttgaagttaataatgtg

SEQ ID NO: 7477354 - DNA, 22 bp, Homo sapiens
atattttctggaactatgcctg

SEQ ID NO: 7477355 - DNA, 22 bp, Homo sapiens
atattttctggaactatgcctg

SEQ ID NO: 7477356 - DNA, 22 bp, Homo sapiens
atattttctggaactatgcctg

SEQ ID NO: 7477357 - DNA, 22 bp, Homo sapiens
atattttcacagaacttgcaaa

SEQ ID NO: 7477358 - DNA, 22 bp, Homo sapiens
atattttcacagaacttgcaaa

SEQ ID NO: 7477359 - DNA, 22 bp, Homo sapiens
atattttcacagaacttgcaaa

SEQ ID NO: 7477360 - DNA, 22 bp, Homo sapiens
atattttcacagaacttgcaaa

SEQ ID NO: 7477361 - DNA, 22 bp, Homo sapiens
atatttgtttggcagagttcag

SEQ ID NO: 7477362 - DNA, 22 bp, Homo sapiens
atatttgtttggcagagttcag

SEQ ID NO: 7477363 - DNA, 22 bp, Homo sapiens
atattttcacagaacttgcaaa

SEQ ID NO: 7477364 - DNA, 22 bp, Homo sapiens
atattttcacagaacttgcaaa

SEQ ID NO: 7477365 - DNA, 22 bp, Homo sapiens
atattttcacagaacttgcaaa

SEQ ID NO: 7477366 - DNA, 22 bp, Homo sapiens
atattttcacagaacttgcaaa

SEQ ID NO: 7477367 - DNA, 22 bp, Homo sapiens
atatttgttgagttcttatgat

SEQ ID NO: 7477368 - DNA, 22 bp, Homo sapiens
atatttgttgagttcttatgat

SEQ ID NO: 7477369 - DNA, 22 bp, Homo sapiens
atatttgtttggcagagttcag

SEQ ID NO: 7477370 - DNA, 22 bp, Homo sapiens
atatttgtttggcagagttcag

SEQ ID NO: 7477371 - DNA, 22 bp, Homo sapiens
ctggtggggagtcctggtctcc

SEQ ID NO: 7477372 - DNA, 22 bp, Homo sapiens
atatttgttagagtctatgtgt

SEQ ID NO: 7477373 - DNA, 22 bp, Homo sapiens
atatttgttagagtctatgtgt

SEQ ID NO: 7477374 - DNA, 22 bp, Homo sapiens
ctgtatctgtcagctggtctcg

SEQ ID NO: 7477375 - DNA, 22 bp, Homo sapiens
ctgtatctgtcagctggtctcg

SEQ ID NO: 7477376 - DNA, 20 bp, Homo sapiens
ctgtatcaggttacaaagta

SEQ ID NO: 7477377 - DNA, 22 bp, Homo sapiens
ctgtatatgtgcatacacacac

SEQ ID NO: 7477378 - DNA, 22 bp, Homo sapiens
ctgtatatgtgcatacacacac

SEQ ID NO: 7477379 - DNA, 22 bp, Homo sapiens
ctgtatatgtgcatacacacac

SEQ ID NO: 7477380 - DNA, 22 bp, Homo sapiens
ctgtatggtccacgtgggtgcc

SEQ ID NO: 7477381 - DNA, 22 bp, Homo sapiens
ctgtatggggcacagggctggc

SEQ ID NO: 7477382 - DNA, 22 bp, Homo sapiens
ctgtatggtggttatgtaagag

SEQ ID NO: 7477383 - DNA, 22 bp, Homo sapiens
ctgtatctgtgttggatgagtt

SEQ ID NO: 7477384 - DNA, 22 bp, Homo sapiens
ctgtatctgtgttggatgagtt

SEQ ID NO: 7477385 - DNA, 22 bp, Homo sapiens
ctgtaattcactagggtcagcg

SEQ ID NO: 7477386 - DNA, 22 bp, Homo sapiens
ctgtaatcccagctactcggga

SEQ ID NO: 7477387 - DNA, 22 bp, Homo sapiens
ctgtaatcccagctactcggga

SEQ ID NO: 7477388 - DNA, 22 bp, Homo sapiens
ctgtaatcccagctactcggga

SEQ ID NO: 7477389 - DNA, 22 bp, Homo sapiens
ctgtaatcccagctactcggga

SEQ ID NO: 7477390 - DNA, 22 bp, Homo sapiens
ctgtaatcccagctactcggga

SEQ ID NO: 7477391 - DNA, 22 bp, Homo sapiens
atattttggcaaatgtctagat

SEQ ID NO: 7477392 - DNA, 22 bp, Homo sapiens
atattttgaagttaataatgtg

SEQ ID NO: 7477393 - DNA, 22 bp, Homo sapiens
atattttgaagttaataatgtg

SEQ ID NO: 7477394 - DNA, 22 bp, Homo sapiens
atattttgaagttaataatgtg

SEQ ID NO: 7477395 - DNA, 22 bp, Homo sapiens
atattttgaagttaataatgtg

SEQ ID NO: 7477396 - DNA, 22 bp, Homo sapiens
atattttgaagttaataatgtg

SEQ ID NO: 7477397 - DNA, 22 bp, Homo sapiens
atattttggcaaatgtctagat

SEQ ID NO: 7477398 - DNA, 22 bp, Homo sapiens
atattttggcaaatgtctagat

SEQ ID NO: 7477399 - DNA, 22 bp, Homo sapiens
atattttggcaaatgtctagat

SEQ ID NO: 7477400 - DNA, 22 bp, Homo sapiens
atattttggcaaatgtctagat

SEQ ID NO: 7477401 - DNA, 22 bp, Homo sapiens
atattttgaagttaataatgtg

SEQ ID NO: 7477402 - DNA, 22 bp, Homo sapiens
atattttgaagttaataatgtg

SEQ ID NO: 7477403 - DNA, 22 bp, Homo sapiens
cttcatgctcccatttcctaca

SEQ ID NO: 7477404 - DNA, 22 bp, Homo sapiens
cttcatgatgaccaactgccat

SEQ ID NO: 7477405 - DNA, 22 bp, Homo sapiens
cttcatgatgaccaactgccat

SEQ ID NO: 7477406 - DNA, 22 bp, Homo sapiens
cttcatgctgagaagctgaatg

SEQ ID NO: 7477407 - DNA, 22 bp, Homo sapiens
cttcatgctgatatcctcgatg

SEQ ID NO: 7477408 - DNA, 22 bp, Homo sapiens
cttcatgagggtaatctacaaa

SEQ ID NO: 7477409 - DNA, 22 bp, Homo sapiens
cttcatgagggtaatctacaaa

SEQ ID NO: 7477410 - DNA, 22 bp, Homo sapiens
cttcatgatcctaccacattga

SEQ ID NO: 7477411 - DNA, 22 bp, Homo sapiens
cttcatgagtgtacaacctgtg

SEQ ID NO: 7477412 - DNA, 22 bp, Homo sapiens
cttcatgatcctaccacattga

SEQ ID NO: 7477413 - DNA, 22 bp, Homo sapiens
cttcatgagtgtacaacctgtg

SEQ ID NO: 7477414 - DNA, 22 bp, Homo sapiens
cttcatgacccataaaaattta

SEQ ID NO: 7477415 - DNA, 22 bp, Homo sapiens
cttcatctttctgagcctcagt

SEQ ID NO: 7477416 - DNA, 22 bp, Homo sapiens
cttcatctttctgagcctcagt

SEQ ID NO: 7477417 - DNA, 22 bp, Homo sapiens
cttcatctttctgagcctcagt

SEQ ID NO: 7477418 - DNA, 22 bp, Homo sapiens
cttcatctttctgagcctcagt

SEQ ID NO: 7477419 - DNA, 21 bp, Homo sapiens
cttcatcccggagattctggt

SEQ ID NO: 7477420 - DNA, 21 bp, Homo sapiens
cttcatcccggagattctggt

SEQ ID NO: 7477421 - DNA, 22 bp, Homo sapiens
cttcatgaggaagatttcacaa

SEQ ID NO: 7477422 - DNA, 22 bp, Homo sapiens
cttcatgaggaagatttcacaa

SEQ ID NO: 7477423 - DNA, 22 bp, Homo sapiens
cttcatgagactccactgccat

SEQ ID NO: 7477424 - DNA, 22 bp, Homo sapiens
cttcatgagactccactgccat

SEQ ID NO: 7477425 - DNA, 22 bp, Homo sapiens
cttcatgagactccactgccat

SEQ ID NO: 7477426 - DNA, 22 bp, Homo sapiens
cttcatcatttgcactctaaga

SEQ ID NO: 7477427 - DNA, 22 bp, Homo sapiens
cttcatcatttgcactctaaga

SEQ ID NO: 7477428 - DNA, 22 bp, Homo sapiens
cttcatcaactctaacaaatgt

SEQ ID NO: 7477429 - DNA, 22 bp, Homo sapiens
cttcatcagctggcttactgtt

SEQ ID NO: 7477430 - DNA, 23 bp, Homo sapiens
cttcatcaaaagttaacactagt

SEQ ID NO: 7477431 - DNA, 23 bp, Homo sapiens
cttcatcaaaagttaacactagt

SEQ ID NO: 7477432 - DNA, 22 bp, Homo sapiens
cttcatcaactctaacaaatgt

SEQ ID NO: 7477433 - DNA, 22 bp, Homo sapiens
cttcatagggttgtaaggatta

SEQ ID NO: 7477434 - DNA, 22 bp, Homo sapiens
cttcatagtgagtttaatgatg

SEQ ID NO: 7477435 - DNA, 22 bp, Homo sapiens
cttcatatctctgtagagtttt

SEQ ID NO: 7477436 - DNA, 22 bp, Homo sapiens
cttcatatctctgtagagtttt

SEQ ID NO: 7477437 - DNA, 23 bp, Homo sapiens
cttcatcaaaagttaacactagt

SEQ ID NO: 7477438 - DNA, 22 bp, Homo sapiens
cttcataatctgaaatttgtaa

SEQ ID NO: 7477439 - DNA, 22 bp, Homo sapiens
cttcataaactcagaaggcagc

SEQ ID NO: 7477440 - DNA, 22 bp, Homo sapiens
cttcataattaccttgtctgcc

SEQ ID NO: 7477441 - DNA, 22 bp, Homo sapiens
cttcataatctgaaatttgtaa

SEQ ID NO: 7477442 - DNA, 22 bp, Homo sapiens
cttcatacaattttttgacata

SEQ ID NO: 7477443 - DNA, 22 bp, Homo sapiens
cttcataattaccttgtctgcc

SEQ ID NO: 7477444 - DNA, 22 bp, Homo sapiens
cttcataggcttacttgagaaa

SEQ ID NO: 7477445 - DNA, 22 bp, Homo sapiens
cttcataggcttacttgagaaa

SEQ ID NO: 7477446 - DNA, 22 bp, Homo sapiens
cttcataaactcagaaggcagc

SEQ ID NO: 7477447 - DNA, 22 bp, Homo sapiens
cttcagtttatcccatcatcca

SEQ ID NO: 7477448 - DNA, 22 bp, Homo sapiens
cttcataagattgttgtgagga

SEQ ID NO: 7477449 - DNA, 22 bp, Homo sapiens
cttcataagattgttgtgagga

SEQ ID NO: 7477450 - DNA, 22 bp, Homo sapiens
cttcataagattgttgtgagga

SEQ ID NO: 7477451 - DNA, 22 bp, Homo sapiens
cttcataagattgttgtgagga

SEQ ID NO: 7477452 - DNA, 21 bp, Homo sapiens
atctggaaattctgccagaga

SEQ ID NO: 7477453 - DNA, 21 bp, Homo sapiens
atctggaaattctgccagaga

SEQ ID NO: 7477454 - DNA, 21 bp, Homo sapiens
atctggaaattctgccagaga

SEQ ID NO: 7477455 - DNA, 22 bp, Homo sapiens
atctggaaataaatacgagttc

SEQ ID NO: 7477456 - DNA, 22 bp, Homo sapiens
atctggaaataaatacgagttc

SEQ ID NO: 7477457 - DNA, 22 bp, Homo sapiens
atctggaaataaatacgagttc

SEQ ID NO: 7477458 - DNA, 22 bp, Homo sapiens
atctggaaaacacagtgtagac

SEQ ID NO: 7477459 - DNA, 22 bp, Homo sapiens
cttcatgtacagttattggaga

SEQ ID NO: 7477460 - DNA, 22 bp, Homo sapiens
cttcatgtacagttattggaga

SEQ ID NO: 7477461 - DNA, 22 bp, Homo sapiens
cttcattaaccaaaatgcaata

SEQ ID NO: 7477462 - DNA, 22 bp, Homo sapiens
cttcatgttcttggtgaaaggc

SEQ ID NO: 7477463 - DNA, 22 bp, Homo sapiens
cttcattaaccaaaatgcaata

SEQ ID NO: 7477464 - DNA, 22 bp, Homo sapiens
cttcattaaccaaaatgcaata

SEQ ID NO: 7477465 - DNA, 22 bp, Homo sapiens
cttcattaaccaaaatgcaata

SEQ ID NO: 7477466 - DNA, 22 bp, Homo sapiens
atctgcatgtatctctctgcat

SEQ ID NO: 7477467 - DNA, 22 bp, Homo sapiens
atctgcatgtccccatggatcc

SEQ ID NO: 7477468 - DNA, 22 bp, Homo sapiens
atctgcatgtccccatggatcc

SEQ ID NO: 7477469 - DNA, 22 bp, Homo sapiens
atctgcatttacattgcttgta

SEQ ID NO: 7477470 - DNA, 21 bp, Homo sapiens
atctggaagaactggtaagtg

SEQ ID NO: 7477471 - DNA, 22 bp, Homo sapiens
atctggaagattgaaggggagt

SEQ ID NO: 7477472 - DNA, 22 bp, Homo sapiens
atctggaagccagatactcagt

SEQ ID NO: 7477473 - DNA, 22 bp, Homo sapiens
atctggaagccagatactcagt

SEQ ID NO: 7477474 - DNA, 22 bp, Homo sapiens
atctggaagccagatactcagt

SEQ ID NO: 7477475 - DNA, 17 bp, Homo sapiens
atctggaagctagctga

SEQ ID NO: 7477476 - DNA, 17 bp, Homo sapiens
atctggaagctagctga

SEQ ID NO: 7477477 - DNA, 22 bp, Homo sapiens
atctggaacaaagcttaggaat

SEQ ID NO: 7477478 - DNA, 22 bp, Homo sapiens
atctggaacaaagcttaggaat

SEQ ID NO: 7477479 - DNA, 22 bp, Homo sapiens
atctggaacaaagcttaggaat

SEQ ID NO: 7477480 - DNA, 19 bp, Homo sapiens
atctggaactcgtttgttt

SEQ ID NO: 7477481 - DNA, 21 bp, Homo sapiens
atctggaagaactggtaagtg

SEQ ID NO: 7477482 - DNA, 21 bp, Homo sapiens
atctggaagaactggtaagtg

SEQ ID NO: 7477483 - DNA, 22 bp, Homo sapiens
atctcaggtgaaacttctaggt

SEQ ID NO: 7477484 - DNA, 22 bp, Homo sapiens
atctcaggtgaaacttctaggt

SEQ ID NO: 7477485 - DNA, 22 bp, Homo sapiens
atctcataaacacacatatatg

SEQ ID NO: 7477486 - DNA, 22 bp, Homo sapiens
atctcataaacacacatatatg

SEQ ID NO: 7477487 - DNA, 22 bp, Homo sapiens
atctcagtcaggttgaatttgg

SEQ ID NO: 7477488 - DNA, 22 bp, Homo sapiens
atctcagtcaggttgaatttgg

SEQ ID NO: 7477489 - DNA, 22 bp, Homo sapiens
atctcagtcaggttgaatttgg

SEQ ID NO: 7477490 - DNA, 22 bp, Homo sapiens
atctatttctgctaataacaat

SEQ ID NO: 7477491 - DNA, 22 bp, Homo sapiens
atctatttctgctaataacaat

SEQ ID NO: 7477492 - DNA, 22 bp, Homo sapiens
atctatttctgctaataacaat

SEQ ID NO: 7477493 - DNA, 22 bp, Homo sapiens
atctatttctgctaataacaat

SEQ ID NO: 7477494 - DNA, 22 bp, Homo sapiens
atctcagtcaggttgaatttgg

SEQ ID NO: 7477495 - DNA, 22 bp, Homo sapiens
atctcagttcaggctccactgt

SEQ ID NO: 7477496 - DNA, 22 bp, Homo sapiens
atctcataatcgtcattgcttt

SEQ ID NO: 7477497 - DNA, 22 bp, Homo sapiens
atctcatcagatctgtataagc

SEQ ID NO: 7477498 - DNA, 22 bp, Homo sapiens
atctcattctcccgtgccatgg

SEQ ID NO: 7477499 - DNA, 22 bp, Homo sapiens
atctcatctgggggaccatttt

SEQ ID NO: 7477500 - DNA, 22 bp, Homo sapiens
atctcattttggtttctactta

SEQ ID NO: 7477501 - DNA, 22 bp, Homo sapiens
atctcattttggtttctactta

SEQ ID NO: 7477502 - DNA, 22 bp, Homo sapiens
atctcattttggtttctactta

SEQ ID NO: 7477503 - DNA, 22 bp, Homo sapiens
atctcattttggtttctactta

SEQ ID NO: 7477504 - DNA, 22 bp, Homo sapiens
atctccagctggctgtgataaa

SEQ ID NO: 7477505 - DNA, 22 bp, Homo sapiens
atctccaggattttcacactca

SEQ ID NO: 7477506 - DNA, 22 bp, Homo sapiens
atctccaggattttcacactca

SEQ ID NO: 7477507 - DNA, 22 bp, Homo sapiens
atctccagctcgcagagctcct

SEQ ID NO: 7477508 - DNA, 22 bp, Homo sapiens
atctccagctcgcagagctcct

SEQ ID NO: 7477509 - DNA, 22 bp, Homo sapiens
atctcattttggtttctactta

SEQ ID NO: 7477510 - DNA, 22 bp, Homo sapiens
atctccagaacatttataaacg

SEQ ID NO: 7477511 - DNA, 22 bp, Homo sapiens
atctccagcaatggggagctct

SEQ ID NO: 7477512 - DNA, 22 bp, Homo sapiens
cttcagtttacaatgcattggc

SEQ ID NO: 7477513 - DNA, 22 bp, Homo sapiens
cttcagttctaaagtagaatgt

SEQ ID NO: 7477514 - DNA, 22 bp, Homo sapiens
cttcagttatgtgccaaggaca

SEQ ID NO: 7477515 - DNA, 22 bp, Homo sapiens
cttcagttctaaagtagaatgt

SEQ ID NO: 7477516 - DNA, 22 bp, Homo sapiens
cttcagtttatcccatcatcca

SEQ ID NO: 7477517 - DNA, 22 bp, Homo sapiens
cttcagtttacaatgcattggc

SEQ ID NO: 7477518 - DNA, 22 bp, Homo sapiens
cttcagtttacaatgcattggc

SEQ ID NO: 7477519 - DNA, 22 bp, Homo sapiens
cttcagtttatcccatcatcca

SEQ ID NO: 7477520 - DNA, 22 bp, Homo sapiens
cttcagttatgtgccaaggaca

SEQ ID NO: 7477521 - DNA, 18 bp, Homo sapiens
atctcccattggccaagg

SEQ ID NO: 7477522 - DNA, 22 bp, Homo sapiens
cttcagttagtttcatgtgagc

SEQ ID NO: 7477523 - DNA, 22 bp, Homo sapiens
cttcagttatgtgccaaggaca

SEQ ID NO: 7477524 - DNA, 22 bp, Homo sapiens
cttcagttatgtgccaaggaca

SEQ ID NO: 7477525 - DNA, 22 bp, Homo sapiens
atctcccacaggctgctacttc

SEQ ID NO: 7477526 - DNA, 22 bp, Homo sapiens
atctcccagccacagcattctt

SEQ ID NO: 7477527 - DNA, 22 bp, Homo sapiens
atctcccacaggctgctacttc

SEQ ID NO: 7477528 - DNA, 22 bp, Homo sapiens
atctcccaattccctgataaat

SEQ ID NO: 7477529 - DNA, 22 bp, Homo sapiens
atctccagtgaggcagattctg

SEQ ID NO: 7477530 - DNA, 22 bp, Homo sapiens
atctccagtgaggcagattctg

SEQ ID NO: 7477531 - DNA, 22 bp, Homo sapiens
atctccagttagcagtactgat

SEQ ID NO: 7477532 - DNA, 22 bp, Homo sapiens
atctccagttagcagtactgat

SEQ ID NO: 7477533 - DNA, 22 bp, Homo sapiens
atctccagttagcagtactgat

SEQ ID NO: 7477534 - DNA, 22 bp, Homo sapiens
atctccaggcatttcaagagac

SEQ ID NO: 7477535 - DNA, 22 bp, Homo sapiens
atctccagtcctggtttcctgg

SEQ ID NO: 7477536 - DNA, 22 bp, Homo sapiens
atctccaggttgtgcctgcgtc

SEQ ID NO: 7477537 - DNA, 22 bp, Homo sapiens
atctccaggttgtgcctgcgtc

SEQ ID NO: 7477538 - DNA, 22 bp, Homo sapiens
atccttgggtctctggaaattg

SEQ ID NO: 7477539 - DNA, 18 bp, Homo sapiens
atccttggggctgctgct

SEQ ID NO: 7477540 - DNA, 22 bp, Homo sapiens
atccttggccctgaatgaagtt

SEQ ID NO: 7477541 - DNA, 22 bp, Homo sapiens
atccttggcagctcagacctac

SEQ ID NO: 7477542 - DNA, 22 bp, Homo sapiens
atccttgggaactaaatgtaag

SEQ ID NO: 7477543 - DNA, 22 bp, Homo sapiens
atccttgggaagagaggaatat

SEQ ID NO: 7477544 - DNA, 22 bp, Homo sapiens
atccttgggaactaaatgtaag

SEQ ID NO: 7477545 - DNA, 18 bp, Homo sapiens
atccttggggctgctgct

SEQ ID NO: 7477546 - DNA, 22 bp, Homo sapiens
atcctttaagttaataaaattc

SEQ ID NO: 7477547 - DNA, 22 bp, Homo sapiens
atccttggtaagagagttggat

SEQ ID NO: 7477548 - DNA, 22 bp, Homo sapiens
atccttggtaagagagttggat

SEQ ID NO: 7477549 - DNA, 22 bp, Homo sapiens
atctattctctacagtagacag

SEQ ID NO: 7477550 - DNA, 22 bp, Homo sapiens
atctattctctacagtagacag

SEQ ID NO: 7477551 - DNA, 22 bp, Homo sapiens
atcctttaagttaataaaattc

SEQ ID NO: 7477552 - DNA, 22 bp, Homo sapiens
atcctttaagttaataaaattc

SEQ ID NO: 7477553 - DNA, 22 bp, Homo sapiens
atctattatgctgagaaactgt

SEQ ID NO: 7477554 - DNA, 22 bp, Homo sapiens
atccttgagaaaataaatgacc

SEQ ID NO: 7477555 - DNA, 22 bp, Homo sapiens
atccttggatcctgtgttcctg

SEQ ID NO: 7477556 - DNA, 22 bp, Homo sapiens
atccttggatcctgtgttcctg

SEQ ID NO: 7477557 - DNA, 21 bp, Homo sapiens
atccttgatcagaagagtgct

SEQ ID NO: 7477558 - DNA, 22 bp, Homo sapiens
atccttggcagctcagacctac

SEQ ID NO: 7477559 - DNA, 20 bp, Homo sapiens
atccttggcagaatccagga

SEQ ID NO: 7477560 - DNA, 22 bp, Homo sapiens
atccttggatgtgtctttttgt

SEQ ID NO: 7477561 - DNA, 22 bp, Homo sapiens
atccttggatgtgtctttttgt

SEQ ID NO: 7477562 - DNA, 22 bp, Homo sapiens
atccttggcacagtggaattca

SEQ ID NO: 7477563 - DNA, 22 bp, Homo sapiens
atccttggcacagtggaattca

SEQ ID NO: 7477564 - DNA, 22 bp, Homo sapiens
atccttctccaaaactggctcc

SEQ ID NO: 7477565 - DNA, 22 bp, Homo sapiens
atccttgaacttagacactagg

SEQ ID NO: 7477566 - DNA, 22 bp, Homo sapiens
atccttgacacactccagtact

SEQ ID NO: 7477567 - DNA, 22 bp, Homo sapiens
atccttgacacactccagtact

SEQ ID NO: 7477568 - DNA, 22 bp, Homo sapiens
atccttcttctgctagtgtcta

SEQ ID NO: 7477569 - DNA, 22 bp, Homo sapiens
atccttcttctgctagtgtcta

SEQ ID NO: 7477570 - DNA, 22 bp, Homo sapiens
atccttctacctaggactattt

SEQ ID NO: 7477571 - DNA, 22 bp, Homo sapiens
atccttccagagttattctcaa

SEQ ID NO: 7477572 - DNA, 22 bp, Homo sapiens
atccttccttcatttgacaggt

SEQ ID NO: 7477573 - DNA, 22 bp, Homo sapiens
atccttccagagttattctcaa

SEQ ID NO: 7477574 - DNA, 22 bp, Homo sapiens
atccttcaggaaaccatcctca

SEQ ID NO: 7477575 - DNA, 22 bp, Homo sapiens
atccttcagtggaagacagtag

SEQ ID NO: 7477576 - DNA, 22 bp, Homo sapiens
cttcagcagcctcttgcataaa

SEQ ID NO: 7477577 - DNA, 22 bp, Homo sapiens
cttcagcagatgtgctagagat

SEQ ID NO: 7477578 - DNA, 22 bp, Homo sapiens
cttcagcaccatagctccttct

SEQ ID NO: 7477579 - DNA, 22 bp, Homo sapiens
cttcagcaactttggaatgttt

SEQ ID NO: 7477580 - DNA, 22 bp, Homo sapiens
atccttaatttacttgcatctt

SEQ ID NO: 7477581 - DNA, 22 bp, Homo sapiens
cttcagcatctttttcttgggg

SEQ ID NO: 7477582 - DNA, 21 bp, Homo sapiens
atccttagcacttagaagagt

SEQ ID NO: 7477583 - DNA, 22 bp, Homo sapiens
atccttcaaaaggaatagcagg

SEQ ID NO: 7477584 - DNA, 22 bp, Homo sapiens
atccttcaaggggctgacagct

SEQ ID NO: 7477585 - DNA, 22 bp, Homo sapiens
atccttcaaaaggaatagcagg

SEQ ID NO: 7477586 - DNA, 22 bp, Homo sapiens
atccttcaaaaggaatagcagg

SEQ ID NO: 7477587 - DNA, 22 bp, Homo sapiens
atccttcaaaaggaatagcagg

SEQ ID NO: 7477588 - DNA, 22 bp, Homo sapiens
atccttcagctgccctgttacc

SEQ ID NO: 7477589 - DNA, 22 bp, Homo sapiens
atccttcagctgccctgttacc

SEQ ID NO: 7477590 - DNA, 22 bp, Homo sapiens
atccttcaaggggctgacagct

SEQ ID NO: 7477591 - DNA, 22 bp, Homo sapiens
atccttcaatgggaagttttag

SEQ ID NO: 7477592 - DNA, 22 bp, Homo sapiens
atccttcaattagaaccaattg

SEQ ID NO: 7477593 - DNA, 22 bp, Homo sapiens
atccttcaattagaaccaattg

SEQ ID NO: 7477594 - DNA, 22 bp, Homo sapiens
cttcagaattcctcagcctcag

SEQ ID NO: 7477595 - DNA, 22 bp, Homo sapiens
cttcagaattcctcagcctcag

SEQ ID NO: 7477596 - DNA, 22 bp, Homo sapiens
cttcagaattcctcagcctcag

SEQ ID NO: 7477597 - DNA, 22 bp, Homo sapiens
cttcagaattcctcagcctcag

SEQ ID NO: 7477598 - DNA, 22 bp, Homo sapiens
cttcagaattcctcagcctcag

SEQ ID NO: 7477599 - DNA, 22 bp, Homo sapiens
cttcagagaacttgatcgctgc

SEQ ID NO: 7477600 - DNA, 22 bp, Homo sapiens
cttcagagaacttgatcgctgc

SEQ ID NO: 7477601 - DNA, 22 bp, Homo sapiens
cttcagagaacttgatcgctgc

SEQ ID NO: 7477602 - DNA, 22 bp, Homo sapiens
cttcagaatccagaatcagaat

SEQ ID NO: 7477603 - DNA, 22 bp, Homo sapiens
cttcagaatccagaatcagaat

SEQ ID NO: 7477604 - DNA, 22 bp, Homo sapiens
cttcagaatccagaatcagaat

SEQ ID NO: 7477605 - DNA, 22 bp, Homo sapiens
cttcacacccactaggatggct

SEQ ID NO: 7477606 - DNA, 22 bp, Homo sapiens
cttcacagaataaactcattat

SEQ ID NO: 7477607 - DNA, 22 bp, Homo sapiens
cttcacagaataaactcattat

SEQ ID NO: 7477608 - DNA, 22 bp, Homo sapiens
cttcacagaataaactcattat

SEQ ID NO: 7477609 - DNA, 22 bp, Homo sapiens
cttcagagtgcagaagattggg

SEQ ID NO: 7477610 - DNA, 22 bp, Homo sapiens
cttcagagtgcagaagattggg

SEQ ID NO: 7477611 - DNA, 22 bp, Homo sapiens
cttcagagtgcagaagattggg

SEQ ID NO: 7477612 - DNA, 22 bp, Homo sapiens
cttcagagtgactcagcatctt

SEQ ID NO: 7477613 - DNA, 22 bp, Homo sapiens
cttcagagtgactcagcatctt

SEQ ID NO: 7477614 - DNA, 22 bp, Homo sapiens
cttcagatccctctgccactgt

SEQ ID NO: 7477615 - DNA, 21 bp, Homo sapiens
cttcagcaaatacttggcagg

SEQ ID NO: 7477616 - DNA, 22 bp, Homo sapiens
cttcagatccctctgccactgt

SEQ ID NO: 7477617 - DNA, 22 bp, Homo sapiens
cttcagatattaatatcaatta

SEQ ID NO: 7477618 - DNA, 22 bp, Homo sapiens
cttcagatattaatatcaatta

SEQ ID NO: 7477619 - DNA, 22 bp, Homo sapiens
cttcagagagtccagggactgc

SEQ ID NO: 7477620 - DNA, 22 bp, Homo sapiens
cttcagagcatcacttcagctg

SEQ ID NO: 7477621 - DNA, 22 bp, Homo sapiens
cttcagagcttgttaaaactgt

SEQ ID NO: 7477622 - DNA, 22 bp, Homo sapiens
cttcagagcttgttaaaactgt

SEQ ID NO: 7477623 - DNA, 22 bp, Homo sapiens
cttcagaggggactcaaagtca

SEQ ID NO: 7477624 - DNA, 22 bp, Homo sapiens
cttcagaggggactcaaagtca

SEQ ID NO: 7477625 - DNA, 22 bp, Homo sapiens
cttcagaggggactcaaagtca

SEQ ID NO: 7477626 - DNA, 22 bp, Homo sapiens
cttcagagtgactcagcatctt

SEQ ID NO: 7477627 - DNA, 22 bp, Homo sapiens
cttcagagtgactcagcatctt

SEQ ID NO: 7477628 - DNA, 22 bp, Homo sapiens
cttcagaggggactcaaagtca

SEQ ID NO: 7477629 - DNA, 22 bp, Homo sapiens
cttcagaggggactcaaagtca

SEQ ID NO: 7477630 - DNA, 22 bp, Homo sapiens
cttcacacccactaaaatgatg

SEQ ID NO: 7477631 - DNA, 22 bp, Homo sapiens
cttcacaatcaccttttcggaa

SEQ ID NO: 7477632 - DNA, 22 bp, Homo sapiens
cttcacaattctaacagggcaa

SEQ ID NO: 7477633 - DNA, 23 bp, Homo sapiens
cttcacaatcaaaatcagttctg

SEQ ID NO: 7477634 - DNA, 22 bp, Homo sapiens
ctgtttctccacactcttccca

SEQ ID NO: 7477635 - DNA, 22 bp, Homo sapiens
ctgtttctccacactcttccca

SEQ ID NO: 7477636 - DNA, 22 bp, Homo sapiens
ctgtttctaaagggagcagatt

SEQ ID NO: 7477637 - DNA, 22 bp, Homo sapiens
ctgtttcctgtcttctcactat

SEQ ID NO: 7477638 - DNA, 22 bp, Homo sapiens
ctgtttctaaagggagcagatt

SEQ ID NO: 7477639 - DNA, 22 bp, Homo sapiens
ctgtttcctgtcttctcactat

SEQ ID NO: 7477640 - DNA, 22 bp, Homo sapiens
ctgtttcctaccgtttttcatt

SEQ ID NO: 7477641 - DNA, 22 bp, Homo sapiens
ctgtttcctgtcttctcactat

SEQ ID NO: 7477642 - DNA, 22 bp, Homo sapiens
ctgtttcctgtcttctcactat

SEQ ID NO: 7477643 - DNA, 22 bp, Homo sapiens
ctgtttcctgtcttctcactat

SEQ ID NO: 7477644 - DNA, 22 bp, Homo sapiens
ctgtttccaccttcatggctaa

SEQ ID NO: 7477645 - DNA, 22 bp, Homo sapiens
ctgtttccccatgccctgactc

SEQ ID NO: 7477646 - DNA, 22 bp, Homo sapiens
ctgtttccctccagggggtgga

SEQ ID NO: 7477647 - DNA, 22 bp, Homo sapiens
ctgtttccctccagggggtgga

SEQ ID NO: 7477648 - DNA, 22 bp, Homo sapiens
ctgtttccccatgccctgactc

SEQ ID NO: 7477649 - DNA, 22 bp, Homo sapiens
ctgtttcctaccgtttttcatt

SEQ ID NO: 7477650 - DNA, 22 bp, Homo sapiens
ctgtttcctaccgtttttcatt

SEQ ID NO: 7477651 - DNA, 22 bp, Homo sapiens
ctgtttcatgaatgcaatttca

SEQ ID NO: 7477652 - DNA, 22 bp, Homo sapiens
ctgtttcatgtcttccgcagct

SEQ ID NO: 7477653 - DNA, 22 bp, Homo sapiens
ctgtttccaccttcatggctaa

SEQ ID NO: 7477654 - DNA, 22 bp, Homo sapiens
ctgtttccaccttcatggctaa

SEQ ID NO: 7477655 - DNA, 22 bp, Homo sapiens
ctgtttccatacaggtttttgg

SEQ ID NO: 7477656 - DNA, 22 bp, Homo sapiens
ctgtttccatacaggtttttgg

SEQ ID NO: 7477657 - DNA, 22 bp, Homo sapiens
ctgtttcagctactgttccatg

SEQ ID NO: 7477658 - DNA, 22 bp, Homo sapiens
ctgtttcagaacttcttaaaaa

SEQ ID NO: 7477659 - DNA, 22 bp, Homo sapiens
ctgtttcagaacttcttaaaaa

SEQ ID NO: 7477660 - DNA, 22 bp, Homo sapiens
ctgtttcacgtgtttaagccca

SEQ ID NO: 7477661 - DNA, 22 bp, Homo sapiens
ctgtttcaatttgaggatcagc

SEQ ID NO: 7477662 - DNA, 22 bp, Homo sapiens
ctgtttcaagtgaagtcagaca

SEQ ID NO: 7477663 - DNA, 22 bp, Homo sapiens
ctgtttcaagtgaagtcagaca

SEQ ID NO: 7477664 - DNA, 19 bp, Homo sapiens
ctgtttcaagtaggaggag

SEQ ID NO: 7477665 - DNA, 22 bp, Homo sapiens
atcaggccagcaatccctgggc

SEQ ID NO: 7477666 - DNA, 22 bp, Homo sapiens
atcaggccagcaatccctgggc

SEQ ID NO: 7477667 - DNA, 22 bp, Homo sapiens
atcaggccagcaatccctgggc

SEQ ID NO: 7477668 - DNA, 22 bp, Homo sapiens
atcaggcagaagcagaaagatg

SEQ ID NO: 7477669 - DNA, 22 bp, Homo sapiens
atcaggatctgggagcctgaaa

SEQ ID NO: 7477670 - DNA, 22 bp, Homo sapiens
atcaggccagcaatccctgggc

SEQ ID NO: 7477671 - DNA, 22 bp, Homo sapiens
atcaggctaggaacctcactgc

SEQ ID NO: 7477672 - DNA, 22 bp, Homo sapiens
atcaggctagtgtgtgtgttca

SEQ ID NO: 7477673 - DNA, 22 bp, Homo sapiens
atcaggctagtgtgtgtgttca

SEQ ID NO: 7477674 - DNA, 22 bp, Homo sapiens
ctgtgggagcacatgacagata

SEQ ID NO: 7477675 - DNA, 20 bp, Homo sapiens
atcaggctttctgttgcgat

SEQ ID NO: 7477676 - DNA, 22 bp, Homo sapiens
ctgtgtatgactccagagggta

SEQ ID NO: 7477677 - DNA, 19 bp, Homo sapiens
ctgtgtcacatttatgaaa

SEQ ID NO: 7477678 - DNA, 22 bp, Homo sapiens
ctgtgggagcactggggaccga

SEQ ID NO: 7477679 - DNA, 22 bp, Homo sapiens
ctgtgggagcactggggaccga

SEQ ID NO: 7477680 - DNA, 22 bp, Homo sapiens
ctgtgggagcactggggaccga

SEQ ID NO: 7477681 - DNA, 22 bp, Homo sapiens
ctgtgggagcacatgacagata

SEQ ID NO: 7477682 - DNA, 22 bp, Homo sapiens
ctgtgtccaatggccttagcag

SEQ ID NO: 7477683 - DNA, 22 bp, Homo sapiens
ctgtgtccaatggccttagcag

SEQ ID NO: 7477684 - DNA, 22 bp, Homo sapiens
ctgtgtccaatggccttagcag

SEQ ID NO: 7477685 - DNA, 22 bp, Homo sapiens
ctgtgtccaatggccttagcag

SEQ ID NO: 7477686 - DNA, 22 bp, Homo sapiens
ctgtgtccatgttctaatttgg

SEQ ID NO: 7477687 - DNA, 22 bp, Homo sapiens
atcaggaagtctgccacaaggc

SEQ ID NO: 7477688 - DNA, 22 bp, Homo sapiens
atcaggaagtctgccacaaggc

SEQ ID NO: 7477689 - DNA, 22 bp, Homo sapiens
atcaggaagcgtctggtatttt

SEQ ID NO: 7477690 - DNA, 22 bp, Homo sapiens
atcaggaagcctgcactgagct

SEQ ID NO: 7477691 - DNA, 22 bp, Homo sapiens
atcaggaagcctgcactgagct

SEQ ID NO: 7477692 - DNA, 20 bp, Homo sapiens
atcaggaagagagactgacc

SEQ ID NO: 7477693 - DNA, 22 bp, Homo sapiens
atcaggaagatctagcgaatgt

SEQ ID NO: 7477694 - DNA, 22 bp, Homo sapiens
atcaggaagatctagcgaatgt

SEQ ID NO: 7477695 - DNA, 22 bp, Homo sapiens
atcaggaagatctagcgaatgt

SEQ ID NO: 7477696 - DNA, 22 bp, Homo sapiens
atcaggaagatctagcgaatgt

SEQ ID NO: 7477697 - DNA, 22 bp, Homo sapiens
atcaggaagatctagcgaatgt

SEQ ID NO: 7477698 - DNA, 22 bp, Homo sapiens
atcaggaagccagtctaatgga

SEQ ID NO: 7477699 - DNA, 22 bp, Homo sapiens
atcaggaagccagtctaatgga

SEQ ID NO: 7477700 - DNA, 22 bp, Homo sapiens
atcaggaagccagtctaatgga

SEQ ID NO: 7477701 - DNA, 22 bp, Homo sapiens
atcaggaattaggtgagatgga

SEQ ID NO: 7477702 - DNA, 22 bp, Homo sapiens
atcaggaattaggtgagatgga

SEQ ID NO: 7477703 - DNA, 22 bp, Homo sapiens
atcaggaattaggtgagatgga

SEQ ID NO: 7477704 - DNA, 22 bp, Homo sapiens
atcaggaattaggtgagatgga

SEQ ID NO: 7477705 - DNA, 22 bp, Homo sapiens
atcaggatcagggctagcagag

SEQ ID NO: 7477706 - DNA, 22 bp, Homo sapiens
atcaggaatcttttgtcagaca

SEQ ID NO: 7477707 - DNA, 22 bp, Homo sapiens
atcaggaatcttttgtcagaca

SEQ ID NO: 7477708 - DNA, 22 bp, Homo sapiens
atcaggaatcttttgtcagaca

SEQ ID NO: 7477709 - DNA, 22 bp, Homo sapiens
atcaggaatgaatacttttgga

SEQ ID NO: 7477710 - DNA, 22 bp, Homo sapiens
atcaggaatgaatacttttgga

SEQ ID NO: 7477711 - DNA, 22 bp, Homo sapiens
atcaggaatgaatacttttgga

SEQ ID NO: 7477712 - DNA, 22 bp, Homo sapiens
atcaggaacgttcatggactgt

SEQ ID NO: 7477713 - DNA, 22 bp, Homo sapiens
atcaggaacgttcatggactgt

SEQ ID NO: 7477714 - DNA, 22 bp, Homo sapiens
atcaggaacgttcatggactgt

SEQ ID NO: 7477715 - DNA, 22 bp, Homo sapiens
atcaggaacgttcatggactgt

SEQ ID NO: 7477716 - DNA, 22 bp, Homo sapiens
atcaggaagaagaatgtgttgg

SEQ ID NO: 7477717 - DNA, 22 bp, Homo sapiens
atcaggaagaagaatgtgttgg

SEQ ID NO: 7477718 - DNA, 22 bp, Homo sapiens
atcaggaagaattggatgctac

SEQ ID NO: 7477719 - DNA, 22 bp, Homo sapiens
atcaggaagaattggatgctac

SEQ ID NO: 7477720 - DNA, 22 bp, Homo sapiens
atcaggaagaattggatgctac

SEQ ID NO: 7477721 - DNA, 20 bp, Homo sapiens
atcaggaagagagactgacc

SEQ ID NO: 7477722 - DNA, 20 bp, Homo sapiens
atcaggaagagagactgacc

SEQ ID NO: 7477723 - DNA, 20 bp, Homo sapiens
atcaggaagagagactgacc

SEQ ID NO: 7477724 - DNA, 20 bp, Homo sapiens
atcaggaagagagactgacc

SEQ ID NO: 7477725 - DNA, 20 bp, Homo sapiens
atcaggaagagagactgacc

SEQ ID NO: 7477726 - DNA, 20 bp, Homo sapiens
atcaggaagagagactgacc

SEQ ID NO: 7477727 - DNA, 17 bp, Homo sapiens
ctgtgctcgagtgatgg

SEQ ID NO: 7477728 - DNA, 20 bp, Homo sapiens
ctgtgctccgggttcctgga

SEQ ID NO: 7477729 - DNA, 22 bp, Homo sapiens
atcaggaaatacttatttataa

SEQ ID NO: 7477730 - DNA, 22 bp, Homo sapiens
atcaggaaatacttatttataa

SEQ ID NO: 7477731 - DNA, 19 bp, Homo sapiens
atcaggaacaaggctgatc

SEQ ID NO: 7477732 - DNA, 19 bp, Homo sapiens
atcaggaacaaggctgatc

SEQ ID NO: 7477733 - DNA, 22 bp, Homo sapiens
atcaggaaatacttatttataa

SEQ ID NO: 7477734 - DNA, 19 bp, Homo sapiens
atcaggaacaaggctgatc

SEQ ID NO: 7477735 - DNA, 19 bp, Homo sapiens
atcaggaacaaggctgatc

SEQ ID NO: 7477736 - DNA, 19 bp, Homo sapiens
atcaggaacaaggctgatc

SEQ ID NO: 7477737 - DNA, 23 bp, Homo sapiens
ctgtgctcagagggagggagagc

SEQ ID NO: 7477738 - DNA, 23 bp, Homo sapiens
ctgtgctcagagggagggagagc

SEQ ID NO: 7477739 - DNA, 23 bp, Homo sapiens
ctgtgctcagagggagggagagc

SEQ ID NO: 7477740 - DNA, 22 bp, Homo sapiens
ctgtgctacaacctgacgtgtg

SEQ ID NO: 7477741 - DNA, 22 bp, Homo sapiens
ctgtgctccctctggcgccccg

SEQ ID NO: 7477742 - DNA, 22 bp, Homo sapiens
ctgtgcgtaagtagccaaaata

SEQ ID NO: 7477743 - DNA, 22 bp, Homo sapiens
ctgtgcgttgtgaaatgtttag

SEQ ID NO: 7477744 - DNA, 22 bp, Homo sapiens
ctgtgcctttgtagctgtgcct

SEQ ID NO: 7477745 - DNA, 22 bp, Homo sapiens
ctgtgccttctgcctggaacat

SEQ ID NO: 7477746 - DNA, 22 bp, Homo sapiens
ctgtgccttctgcctggaacat

SEQ ID NO: 7477747 - DNA, 22 bp, Homo sapiens
ctgtgccttctacttcactcta

SEQ ID NO: 7477748 - DNA, 22 bp, Homo sapiens
ctgtgccttctacttcactcta

SEQ ID NO: 7477749 - DNA, 22 bp, Homo sapiens
ctgtgccttggcgctgtgccac

SEQ ID NO: 7477750 - DNA, 22 bp, Homo sapiens
ctgtgcctttgtagctgtgcct

SEQ ID NO: 7477751 - DNA, 22 bp, Homo sapiens
ctgtgccttggcgctgtgccac

SEQ ID NO: 7477752 - DNA, 22 bp, Homo sapiens
ctgtgccttggcgctgtgccac

SEQ ID NO: 7477753 - DNA, 22 bp, Homo sapiens
ctgtgcctgcaggccacatcaa

SEQ ID NO: 7477754 - DNA, 22 bp, Homo sapiens
ctgtgcctgcaggccacatcaa

SEQ ID NO: 7477755 - DNA, 20 bp, Homo sapiens
ctgtgcctcctgctagtcct

SEQ ID NO: 7477756 - DNA, 22 bp, Homo sapiens
ctgtgcctccagtctcgcttct

SEQ ID NO: 7477757 - DNA, 22 bp, Homo sapiens
ctgtgccttagtattctcattt

SEQ ID NO: 7477758 - DNA, 22 bp, Homo sapiens
ctgtgcctggggggcagagctg

SEQ ID NO: 7477759 - DNA, 22 bp, Homo sapiens
ctgtgcctggggggcagagctg

SEQ ID NO: 7477760 - DNA, 22 bp, Homo sapiens
ctgtgccttagtattctcattt

SEQ ID NO: 7477761 - DNA, 22 bp, Homo sapiens
ctgtgcctggggggcagagctg

SEQ ID NO: 7477762 - DNA, 22 bp, Homo sapiens
ctgtgcctggggggcagagctg

SEQ ID NO: 7477763 - DNA, 22 bp, Homo sapiens
ctgtgcctgccttgttcactga

SEQ ID NO: 7477764 - DNA, 22 bp, Homo sapiens
ctgtgcctgccttgttcactga

SEQ ID NO: 7477765 - DNA, 22 bp, Homo sapiens
ctgtgcctccaagtggtctctg

SEQ ID NO: 7477766 - DNA, 22 bp, Homo sapiens
ctgtgcctaagatgcatgtctc

SEQ ID NO: 7477767 - DNA, 22 bp, Homo sapiens
ctgtgcctcagtgtcctcgagt

SEQ ID NO: 7477768 - DNA, 22 bp, Homo sapiens
ctgtgcctcagtgtcctcgagt

SEQ ID NO: 7477769 - DNA, 22 bp, Homo sapiens
ctgtgcctaagatgcatgtctc

SEQ ID NO: 7477770 - DNA, 22 bp, Homo sapiens
ctgtgcctaagatgcatgtctc

SEQ ID NO: 7477771 - DNA, 22 bp, Homo sapiens
ctgtgcctaagatgcatgtctc

SEQ ID NO: 7477772 - DNA, 22 bp, Homo sapiens
ctgtgcctaagatgcatgtctc

SEQ ID NO: 7477773 - DNA, 20 bp, Homo sapiens
ctgtgcctaaacctccgggt

SEQ ID NO: 7477774 - DNA, 20 bp, Homo sapiens
ctgtgcctaaacctccgggt

SEQ ID NO: 7477775 - DNA, 22 bp, Homo sapiens
ctgtgccctttgtcctcgtctc

SEQ ID NO: 7477776 - DNA, 22 bp, Homo sapiens
ctgtgccctttgtcctcgtctc

SEQ ID NO: 7477777 - DNA, 22 bp, Homo sapiens
ctgtgccctttcgctgcactgt

SEQ ID NO: 7477778 - DNA, 22 bp, Homo sapiens
ctgtgccctttcgctgcactgt

SEQ ID NO: 7477779 - DNA, 22 bp, Homo sapiens
ctgtgcagtaggtcagggctgg

SEQ ID NO: 7477780 - DNA, 22 bp, Homo sapiens
ctgtgcagtaggtcagggctgg

SEQ ID NO: 7477781 - DNA, 22 bp, Homo sapiens
ctgtccagggtgtgcaggggct

SEQ ID NO: 7477782 - DNA, 22 bp, Homo sapiens
ctgtccagggtgtgcaggggct

SEQ ID NO: 7477783 - DNA, 22 bp, Homo sapiens
ctgtccaggctgaggagtttat

SEQ ID NO: 7477784 - DNA, 23 bp, Homo sapiens
ctgtccaggattcttgagagaac

SEQ ID NO: 7477785 - DNA, 22 bp, Homo sapiens
ctgtccagggtgtgcaggggct

SEQ ID NO: 7477786 - DNA, 22 bp, Homo sapiens
ctgtccagggtgtgcaggggct

SEQ ID NO: 7477787 - DNA, 22 bp, Homo sapiens
ctgtccagggtgtgcaggggct

SEQ ID NO: 7477788 - DNA, 22 bp, Homo sapiens
ctgtccagggtgtgcaggggct

SEQ ID NO: 7477789 - DNA, 22 bp, Homo sapiens
ctgtccagcttggctcctgggg

SEQ ID NO: 7477790 - DNA, 22 bp, Homo sapiens
ctgtccagcttggctcctgggg

SEQ ID NO: 7477791 - DNA, 23 bp, Homo sapiens
ctgtccaggattcttgagagaac

SEQ ID NO: 7477792 - DNA, 23 bp, Homo sapiens
ctgtccaggattcttgagagaac

SEQ ID NO: 7477793 - DNA, 23 bp, Homo sapiens
ctgtccaggattcttgagagaac

SEQ ID NO: 7477794 - DNA, 23 bp, Homo sapiens
ctgtccaggattcttgagagaac

SEQ ID NO: 7477795 - DNA, 22 bp, Homo sapiens
ctgtgcagtaggtcagggctgg

SEQ ID NO: 7477796 - DNA, 18 bp, Homo sapiens
ctgtccagtagactctgc

SEQ ID NO: 7477797 - DNA, 22 bp, Homo sapiens
ctgtccagtcagaacgtcatta

SEQ ID NO: 7477798 - DNA, 22 bp, Homo sapiens
ctgtccagtcagaacgtcatta

SEQ ID NO: 7477799 - DNA, 21 bp, Homo sapiens
ctgtccagtaattcctggcac

SEQ ID NO: 7477800 - DNA, 21 bp, Homo sapiens
ctgtccagtaattcctggcac

SEQ ID NO: 7477801 - DNA, 21 bp, Homo sapiens
ctgtccagtaattcctggcac

SEQ ID NO: 7477802 - DNA, 21 bp, Homo sapiens
ctgtccagtaattcctggcac

SEQ ID NO: 7477803 - DNA, 21 bp, Homo sapiens
ctgtccagtaattcctggcac

SEQ ID NO: 7477804 - DNA, 18 bp, Homo sapiens
ctgtccagtagactctgc

SEQ ID NO: 7477805 - DNA, 22 bp, Homo sapiens
ctgttacttcaatcttctcccg

SEQ ID NO: 7477806 - DNA, 22 bp, Homo sapiens
ctgttacttcaatcttctcccg

SEQ ID NO: 7477807 - DNA, 16 bp, Homo sapiens
ctgttacttgactgtt

SEQ ID NO: 7477808 - DNA, 22 bp, Homo sapiens
ctgttagtgatcaaagggagag

SEQ ID NO: 7477809 - DNA, 22 bp, Homo sapiens
ctgttagtcttttgcaggagag

SEQ ID NO: 7477810 - DNA, 22 bp, Homo sapiens
ctgttactgtatttaatcatct

SEQ ID NO: 7477811 - DNA, 22 bp, Homo sapiens
ctgtgtgtgaacacagcccagc

SEQ ID NO: 7477812 - DNA, 22 bp, Homo sapiens
ctgttactgttggcccagggtg

SEQ ID NO: 7477813 - DNA, 22 bp, Homo sapiens
ctgttactgctggagccattga

SEQ ID NO: 7477814 - DNA, 22 bp, Homo sapiens
ctgttactggacgcacgcagct

SEQ ID NO: 7477815 - DNA, 22 bp, Homo sapiens
ctgttattaaaaagctcaggct

SEQ ID NO: 7477816 - DNA, 23 bp, Homo sapiens
ctgttatgtaaatatgtttagtg

SEQ ID NO: 7477817 - DNA, 22 bp, Homo sapiens
ctgttattaaaaagctcaggct

SEQ ID NO: 7477818 - DNA, 22 bp, Homo sapiens
ctgttatagctgtttgtattct

SEQ ID NO: 7477819 - DNA, 22 bp, Homo sapiens
ctgttatctgttattgccagtt

SEQ ID NO: 7477820 - DNA, 22 bp, Homo sapiens
ctgttatattggtatatttaca

SEQ ID NO: 7477821 - DNA, 22 bp, Homo sapiens
ctgttatgactaaataggaagg

SEQ ID NO: 7477822 - DNA, 22 bp, Homo sapiens
ctgttatgcatggtcattgcct

SEQ ID NO: 7477823 - DNA, 22 bp, Homo sapiens
ctgttattcaagacaaaggcag

SEQ ID NO: 7477824 - DNA, 22 bp, Homo sapiens
ctgttattcaagacaaaggcag

SEQ ID NO: 7477825 - DNA, 22 bp, Homo sapiens
ctgttattcaagacaaaggcag

SEQ ID NO: 7477826 - DNA, 23 bp, Homo sapiens
ctgttattccaggctgatgggtg

SEQ ID NO: 7477827 - DNA, 22 bp, Homo sapiens
ctgttattccccttgctgtggt

SEQ ID NO: 7477828 - DNA, 19 bp, Homo sapiens
ctgttattgtcagagctcc

SEQ ID NO: 7477829 - DNA, 22 bp, Homo sapiens
ctgttatttagaacatggaatc

SEQ ID NO: 7477830 - DNA, 19 bp, Homo sapiens
ctgttattgtcagagctcc

SEQ ID NO: 7477831 - DNA, 22 bp, Homo sapiens
ctgttatttagaacatggaatc

SEQ ID NO: 7477832 - DNA, 22 bp, Homo sapiens
ctgttatttagaacatggaatc

SEQ ID NO: 7477833 - DNA, 22 bp, Homo sapiens
ctgttatttctgccaggtgagt

SEQ ID NO: 7477834 - DNA, 22 bp, Homo sapiens
ctgttatttgagagtgttgaat

SEQ ID NO: 7477835 - DNA, 22 bp, Homo sapiens
ctgttatttctgaatgccatcc

SEQ ID NO: 7477836 - DNA, 22 bp, Homo sapiens
ctgttattttataattcaagaa

SEQ ID NO: 7477837 - DNA, 22 bp, Homo sapiens
ctgttattttataattcaagaa

SEQ ID NO: 7477838 - DNA, 22 bp, Homo sapiens
ctgttattttataattcaagaa

SEQ ID NO: 7477839 - DNA, 22 bp, Homo sapiens
ctgttatttgagagtgttgaat

SEQ ID NO: 7477840 - DNA, 22 bp, Homo sapiens
ctgttatttgctggaagagttt

SEQ ID NO: 7477841 - DNA, 22 bp, Homo sapiens
ctgtttatctctaacctgttta

SEQ ID NO: 7477842 - DNA, 22 bp, Homo sapiens
ctgtttatctctaacctgttta

SEQ ID NO: 7477843 - DNA, 22 bp, Homo sapiens
ctgtttatctaggagttgcagg

SEQ ID NO: 7477844 - DNA, 22 bp, Homo sapiens
ctgtttatccctttggtcagca

SEQ ID NO: 7477845 - DNA, 22 bp, Homo sapiens
ctgtttatctaggagttgcagg

SEQ ID NO: 7477846 - DNA, 22 bp, Homo sapiens
ctgtttatctaggagttgcagg

SEQ ID NO: 7477847 - DNA, 22 bp, Homo sapiens
ctgtttcaaagggtactgtgag

SEQ ID NO: 7477848 - DNA, 22 bp, Homo sapiens
ctgtttcaaaactagtacaaca

SEQ ID NO: 7477849 - DNA, 22 bp, Homo sapiens
ctgtttcaaaactagtacaaca

SEQ ID NO: 7477850 - DNA, 21 bp, Homo sapiens
ctgtttatttcacctgggtgc

SEQ ID NO: 7477851 - DNA, 22 bp, Homo sapiens
ctgtttcaaaactagtacaaca

SEQ ID NO: 7477852 - DNA, 22 bp, Homo sapiens
ctgtttcaaaactagtacaaca

SEQ ID NO: 7477853 - DNA, 22 bp, Homo sapiens
ctgtttattgagcaatctgcca

SEQ ID NO: 7477854 - DNA, 22 bp, Homo sapiens
ctgtttattgagcaatctgcca

SEQ ID NO: 7477855 - DNA, 22 bp, Homo sapiens
ctgtttatggaggtaaggcatc

SEQ ID NO: 7477856 - DNA, 22 bp, Homo sapiens
ctgtttatgaagctgtggttta

SEQ ID NO: 7477857 - DNA, 22 bp, Homo sapiens
ctgtttattctcatctaaaatg

SEQ ID NO: 7477858 - DNA, 22 bp, Homo sapiens
ctgtttattacgtaattaatat

SEQ ID NO: 7477859 - DNA, 22 bp, Homo sapiens
ctgtttattacgtaattaatat

SEQ ID NO: 7477860 - DNA, 22 bp, Homo sapiens
ctgtttattacactggatagca

SEQ ID NO: 7477861 - DNA, 22 bp, Homo sapiens
atcattagaccaaactagagct

SEQ ID NO: 7477862 - DNA, 21 bp, Homo sapiens
atcattaattgctgagtgaca

SEQ ID NO: 7477863 - DNA, 22 bp, Homo sapiens
atcattactcctgtaaaattgt

SEQ ID NO: 7477864 - DNA, 23 bp, Homo sapiens
atcattaacagtgcaggggtagg

SEQ ID NO: 7477865 - DNA, 22 bp, Homo sapiens
atcattaacactaaggcgctga

SEQ ID NO: 7477866 - DNA, 21 bp, Homo sapiens
atcattaattgctgagtgaca

SEQ ID NO: 7477867 - DNA, 22 bp, Homo sapiens
atcattaaatataagcttcaca

SEQ ID NO: 7477868 - DNA, 22 bp, Homo sapiens
atcattaaatataagcttcaca

SEQ ID NO: 7477869 - DNA, 22 bp, Homo sapiens
atcattaaatataagcttcaca

SEQ ID NO: 7477870 - DNA, 22 bp, Homo sapiens
ctgtgtcccttgtcccagagcc

SEQ ID NO: 7477871 - DNA, 22 bp, Homo sapiens
ctgtgtcccttgtcccagagcc

SEQ ID NO: 7477872 - DNA, 22 bp, Homo sapiens
ctgtgtcctccccatcacttct

SEQ ID NO: 7477873 - DNA, 22 bp, Homo sapiens
ctgtgtccccctcagccaggtg

SEQ ID NO: 7477874 - DNA, 22 bp, Homo sapiens
ctgtgtccccctcagccaggtg

SEQ ID NO: 7477875 - DNA, 22 bp, Homo sapiens
ctgtgtccccctcagccaggtg

SEQ ID NO: 7477876 - DNA, 22 bp, Homo sapiens
ctgtgtccccctcagccaggtg

SEQ ID NO: 7477877 - DNA, 22 bp, Homo sapiens
ctgtgtccccctcagccaggtg

SEQ ID NO: 7477878 - DNA, 22 bp, Homo sapiens
ctgtgtcccttgtcccagagcc

SEQ ID NO: 7477879 - DNA, 22 bp, Homo sapiens
ctgtgtcccacacgaggtgtat

SEQ ID NO: 7477880 - DNA, 22 bp, Homo sapiens
ctgtgtccatttatcattgtca

SEQ ID NO: 7477881 - DNA, 22 bp, Homo sapiens
ctgtgtcccacacgaggtgtat

SEQ ID NO: 7477882 - DNA, 22 bp, Homo sapiens
ctgtgtattgaaaaagggttaa

SEQ ID NO: 7477883 - DNA, 22 bp, Homo sapiens
ctgtgtcccagccaggataatg

SEQ ID NO: 7477884 - DNA, 22 bp, Homo sapiens
ctgtgtcccagccaggataatg

SEQ ID NO: 7477885 - DNA, 22 bp, Homo sapiens
ctgtgtcccagtaccttgggta

SEQ ID NO: 7477886 - DNA, 22 bp, Homo sapiens
ctgtgtcccagtaccttgggta

SEQ ID NO: 7477887 - DNA, 22 bp, Homo sapiens
ctgtgtcccagtaccttgggta

SEQ ID NO: 7477888 - DNA, 22 bp, Homo sapiens
ctgtgtgtgaacacagcccagc

SEQ ID NO: 7477889 - DNA, 22 bp, Homo sapiens
ctgtgtgtgaacacagcccagc

SEQ ID NO: 7477890 - DNA, 22 bp, Homo sapiens
ctgtgtgtgaacacagcccagc

SEQ ID NO: 7477891 - DNA, 22 bp, Homo sapiens
ctgtgtgtcctcggacgagttt

SEQ ID NO: 7477892 - DNA, 22 bp, Homo sapiens
ctgtgtgtgaacacagcccagc

SEQ ID NO: 7477893 - DNA, 22 bp, Homo sapiens
ctgtgtgtgaacacagcccagc

SEQ ID NO: 7477894 - DNA, 22 bp, Homo sapiens
ctgttactgaaatgcaccgtgc

SEQ ID NO: 7477895 - DNA, 22 bp, Homo sapiens
ctgttactaatcttttctgcta

SEQ ID NO: 7477896 - DNA, 22 bp, Homo sapiens
ctgttactcctttggcagatta

SEQ ID NO: 7477897 - DNA, 22 bp, Homo sapiens
atcattcatcttattgccagtc

SEQ ID NO: 7477898 - DNA, 22 bp, Homo sapiens
atcattcagtgaccacttccca

SEQ ID NO: 7477899 - DNA, 22 bp, Homo sapiens
atcattcagtgaccacttccca

SEQ ID NO: 7477900 - DNA, 22 bp, Homo sapiens
atcattcagtgaccacttccca

SEQ ID NO: 7477901 - DNA, 22 bp, Homo sapiens
atcattcagtctctgggacagt

SEQ ID NO: 7477902 - DNA, 22 bp, Homo sapiens
atcattccacatgtaccactag

SEQ ID NO: 7477903 - DNA, 22 bp, Homo sapiens
atcattctagctgttgtgttga

SEQ ID NO: 7477904 - DNA, 22 bp, Homo sapiens
ctgtgtgtcctcggacgagttt

SEQ ID NO: 7477905 - DNA, 22 bp, Homo sapiens
atcattcaagtgctctaaaatg

SEQ ID NO: 7477906 - DNA, 22 bp, Homo sapiens
atcattcaagtgctctaaaatg

SEQ ID NO: 7477907 - DNA, 22 bp, Homo sapiens
atcattcaaatgatttggaggt

SEQ ID NO: 7477908 - DNA, 22 bp, Homo sapiens
atcattatcctcctatttgcct

SEQ ID NO: 7477909 - DNA, 22 bp, Homo sapiens
atcattcaaatgatttggaggt

SEQ ID NO: 7477910 - DNA, 22 bp, Homo sapiens
atcattatcctcctatttgcct

SEQ ID NO: 7477911 - DNA, 22 bp, Homo sapiens
atcattagttgtggaattcttg

SEQ ID NO: 7477912 - DNA, 22 bp, Homo sapiens
atcattataatggtatagttgt

SEQ ID NO: 7477913 - DNA, 22 bp, Homo sapiens
atcattagcaattttcaataag

SEQ ID NO: 7477914 - DNA, 22 bp, Homo sapiens
atcattagcaattttcaataag

SEQ ID NO: 7477915 - DNA, 22 bp, Homo sapiens
atcattcagcctaagcaagtac

SEQ ID NO: 7477916 - DNA, 22 bp, Homo sapiens
atcattcagcctaagcaagtac

SEQ ID NO: 7477917 - DNA, 22 bp, Homo sapiens
atcattcagcctaagcaagtac

SEQ ID NO: 7477918 - DNA, 22 bp, Homo sapiens
atcattcaagtgctctaaaatg

SEQ ID NO: 7477919 - DNA, 22 bp, Homo sapiens
atcattcagcctaagcaagtac

SEQ ID NO: 7477920 - DNA, 22 bp, Homo sapiens
atcattcaagtgctctaaaatg

SEQ ID NO: 7477921 - DNA, 22 bp, Homo sapiens
atcattcagtctctgggacagt

SEQ ID NO: 7477922 - DNA, 22 bp, Homo sapiens
atcattcagtctctgggacagt

SEQ ID NO: 7477923 - DNA, 22 bp, Homo sapiens
atcattcagtctctgggacagt

SEQ ID NO: 7477924 - DNA, 22 bp, Homo sapiens
atcattcagcctaagcaagtac

SEQ ID NO: 7477925 - DNA, 22 bp, Homo sapiens
atcattcagtctctgggacagt

SEQ ID NO: 7477926 - DNA, 22 bp, Homo sapiens
ataatttacaactgcttttaat

SEQ ID NO: 7477927 - DNA, 22 bp, Homo sapiens
ataatttacaactgcttttaat

SEQ ID NO: 7477928 - DNA, 22 bp, Homo sapiens
ataatttacaactgcttttaat

SEQ ID NO: 7477929 - DNA, 22 bp, Homo sapiens
ataatttaattttcacagtggt

SEQ ID NO: 7477930 - DNA, 22 bp, Homo sapiens
ataatttaattttcacagtggt

SEQ ID NO: 7477931 - DNA, 22 bp, Homo sapiens
ataatttaattttcacagtggt

SEQ ID NO: 7477932 - DNA, 22 bp, Homo sapiens
ataatttaattttcacagtggt

SEQ ID NO: 7477933 - DNA, 22 bp, Homo sapiens
ataatttaattttcacagtggt

SEQ ID NO: 7477934 - DNA, 22 bp, Homo sapiens
ataatttaattttcacagtggt

SEQ ID NO: 7477935 - DNA, 22 bp, Homo sapiens
ataatttaaattagtatgtgat

SEQ ID NO: 7477936 - DNA, 22 bp, Homo sapiens
ataatttaaattagtatgtgat

SEQ ID NO: 7477937 - DNA, 22 bp, Homo sapiens
ataatttaaattagtatgtgat

SEQ ID NO: 7477938 - DNA, 22 bp, Homo sapiens
ataatttaattttcacagtggt

SEQ ID NO: 7477939 - DNA, 22 bp, Homo sapiens
ataatttaattttcacagtggt

SEQ ID NO: 7477940 - DNA, 22 bp, Homo sapiens
ataatttaattttcacagtggt

SEQ ID NO: 7477941 - DNA, 20 bp, Homo sapiens
atacacattcatagaaaaat

SEQ ID NO: 7477942 - DNA, 20 bp, Homo sapiens
atacacattcatagaaaaat

SEQ ID NO: 7477943 - DNA, 20 bp, Homo sapiens
atacacattcatagaaaaat

SEQ ID NO: 7477944 - DNA, 20 bp, Homo sapiens
atacacattcatagaaaaat

SEQ ID NO: 7477945 - DNA, 22 bp, Homo sapiens
atacactttagaaaaacgctgc

SEQ ID NO: 7477946 - DNA, 20 bp, Homo sapiens
atacacattcatagaaaaat

SEQ ID NO: 7477947 - DNA, 20 bp, Homo sapiens
ataatttaccctgcaccact

SEQ ID NO: 7477948 - DNA, 20 bp, Homo sapiens
ataatttaccctgcaccact

SEQ ID NO: 7477949 - DNA, 20 bp, Homo sapiens
ataatttaccctgcaccact

SEQ ID NO: 7477950 - DNA, 20 bp, Homo sapiens
ataatttaccctgcaccact

SEQ ID NO: 7477951 - DNA, 20 bp, Homo sapiens
ataatttaccctgcaccact

SEQ ID NO: 7477952 - DNA, 20 bp, Homo sapiens
ataatttaccctgcaccact

SEQ ID NO: 7477953 - DNA, 22 bp, Homo sapiens
ataatttacaactgcttttaat

SEQ ID NO: 7477954 - DNA, 22 bp, Homo sapiens
ataatttacaactgcttttaat

SEQ ID NO: 7477955 - DNA, 22 bp, Homo sapiens
ataatttacaactgcttttaat

SEQ ID NO: 7477956 - DNA, 22 bp, Homo sapiens
atacactttagaaaaacgctgc

SEQ ID NO: 7477957 - DNA, 22 bp, Homo sapiens
atacagaaaagtggatagccag

SEQ ID NO: 7477958 - DNA, 22 bp, Homo sapiens
atacagaaaagtggatagccag

SEQ ID NO: 7477959 - DNA, 22 bp, Homo sapiens
atacagaaaagtggatagccag

SEQ ID NO: 7477960 - DNA, 22 bp, Homo sapiens
atacagaaaagtggatagccag

SEQ ID NO: 7477961 - DNA, 22 bp, Homo sapiens
atacactttagaaaaacgctgc

SEQ ID NO: 7477962 - DNA, 22 bp, Homo sapiens
atacactttagaaaaacgctgc

SEQ ID NO: 7477963 - DNA, 22 bp, Homo sapiens
atacagaaaatgatgcagagtt

SEQ ID NO: 7477964 - DNA, 22 bp, Homo sapiens
atacagaaaatgatgcagagtt

SEQ ID NO: 7477965 - DNA, 22 bp, Homo sapiens
atacagaaaatgatgcagagtt

SEQ ID NO: 7477966 - DNA, 22 bp, Homo sapiens
atacagaaaagtggatagccag

SEQ ID NO: 7477967 - DNA, 22 bp, Homo sapiens
atacagaaaatgatgcagagtt

SEQ ID NO: 7477968 - DNA, 22 bp, Homo sapiens
atacagaaaatgatgcagagtt

SEQ ID NO: 7477969 - DNA, 22 bp, Homo sapiens
atacagaaaatgatgcagagtt

SEQ ID NO: 7477970 - DNA, 22 bp, Homo sapiens
atacagaaaatgatgcagagtt

SEQ ID NO: 7477971 - DNA, 21 bp, Homo sapiens
atacagaacattgatccaaga

SEQ ID NO: 7477972 - DNA, 21 bp, Homo sapiens
atacagaacattgatccaaga

SEQ ID NO: 7477973 - DNA, 22 bp, Homo sapiens
atacagaacaagcctcacctcc

SEQ ID NO: 7477974 - DNA, 22 bp, Homo sapiens
atacagaacaagcctcacctcc

SEQ ID NO: 7477975 - DNA, 22 bp, Homo sapiens
atacagaacaagcctcacctcc

SEQ ID NO: 7477976 - DNA, 22 bp, Homo sapiens
atacagaaaatgatgcagagtt

SEQ ID NO: 7477977 - DNA, 22 bp, Homo sapiens
atacagaacaagcctcacctcc

SEQ ID NO: 7477978 - DNA, 22 bp, Homo sapiens
atacagaacaagcctcacctcc

SEQ ID NO: 7477979 - DNA, 22 bp, Homo sapiens
atacagaagaactatagccact

SEQ ID NO: 7477980 - DNA, 22 bp, Homo sapiens
atacagaagaactatagccact

SEQ ID NO: 7477981 - DNA, 22 bp, Homo sapiens
atacagaagaactatagccact

SEQ ID NO: 7477982 - DNA, 22 bp, Homo sapiens
atacagaagaactatagccact

SEQ ID NO: 7477983 - DNA, 22 bp, Homo sapiens
atacagaactctcagttgtata

SEQ ID NO: 7477984 - DNA, 22 bp, Homo sapiens
atacagaactctcagttgtata

SEQ ID NO: 7477985 - DNA, 22 bp, Homo sapiens
atacagaagaactatagccact

SEQ ID NO: 7477986 - DNA, 22 bp, Homo sapiens
atacagaagaactatagccact

SEQ ID NO: 7477987 - DNA, 22 bp, Homo sapiens
atacagaagaactatagccact

SEQ ID NO: 7477988 - DNA, 22 bp, Homo sapiens
atacagaactctcagttgtata

SEQ ID NO: 7477989 - DNA, 22 bp, Homo sapiens
atacagaactctcagttgtata

SEQ ID NO: 7477990 - DNA, 22 bp, Homo sapiens
atacagaactctcagttgtata

SEQ ID NO: 7477991 - DNA, 22 bp, Homo sapiens
atacagaactctcagttgtata

SEQ ID NO: 7477992 - DNA, 22 bp, Homo sapiens
atacagaactctcagttgtata

SEQ ID NO: 7477993 - DNA, 22 bp, Homo sapiens
atacagaactctcagttgtata

SEQ ID NO: 7477994 - DNA, 22 bp, Homo sapiens
atacagaactctcagttgtata

SEQ ID NO: 7477995 - DNA, 21 bp, Homo sapiens
atacagaacattgatccaaga

SEQ ID NO: 7477996 - DNA, 21 bp, Homo sapiens
atacagaacattgatccaaga

SEQ ID NO: 7477997 - DNA, 21 bp, Homo sapiens
atacagaacattgatccaaga

SEQ ID NO: 7477998 - DNA, 22 bp, Homo sapiens
ataatgttgatgattgtctttg

SEQ ID NO: 7477999 - DNA, 22 bp, Homo sapiens
ataatgtgttcatcttacaatt

SEQ ID NO: 7478000 - DNA, 22 bp, Homo sapiens
ataatgtaggtatgtgtattta

SEQ ID NO: 7478001 - DNA, 22 bp, Homo sapiens
ataatgtctgcagagccacaca

SEQ ID NO: 7478002 - DNA, 22 bp, Homo sapiens
ataatgtctgcagagccacaca

SEQ ID NO: 7478003 - DNA, 22 bp, Homo sapiens
ataatgtgatatttcatttaca

SEQ ID NO: 7478004 - DNA, 22 bp, Homo sapiens
ataatgtgaagataatgcaaga

SEQ ID NO: 7478005 - DNA, 22 bp, Homo sapiens
ataatgtttcagtactgtctgt

SEQ ID NO: 7478006 - DNA, 22 bp, Homo sapiens
ataatgttgatgattgtctttg

SEQ ID NO: 7478007 - DNA, 22 bp, Homo sapiens
ataatgtttcagtactgtctgt

SEQ ID NO: 7478008 - DNA, 22 bp, Homo sapiens
ataatgtttttgtataagcatg

SEQ ID NO: 7478009 - DNA, 22 bp, Homo sapiens
ataatgtttttgtataagcatg

SEQ ID NO: 7478010 - DNA, 22 bp, Homo sapiens
ataatgtttttgtataagcatg

SEQ ID NO: 7478011 - DNA, 22 bp, Homo sapiens
ctgcctgcttttctgggagccg

SEQ ID NO: 7478012 - DNA, 22 bp, Homo sapiens
ataatcattttaattagtggtt

SEQ ID NO: 7478013 - DNA, 22 bp, Homo sapiens
ataatggcttctgagtattagg

SEQ ID NO: 7478014 - DNA, 22 bp, Homo sapiens
ataatggcttgtggtgttattc

SEQ ID NO: 7478015 - DNA, 22 bp, Homo sapiens
ataatggtagatgtccacgcag

SEQ ID NO: 7478016 - DNA, 22 bp, Homo sapiens
ataatcattcacataaggtgct

SEQ ID NO: 7478017 - DNA, 22 bp, Homo sapiens
ataatcagaattcatgaaagat

SEQ ID NO: 7478018 - DNA, 22 bp, Homo sapiens
ctgcctggaaggagcaagggga

SEQ ID NO: 7478019 - DNA, 22 bp, Homo sapiens
ataatcattcacataaggtgct

SEQ ID NO: 7478020 - DNA, 22 bp, Homo sapiens
ataatgtacaactgcttttaat

SEQ ID NO: 7478021 - DNA, 21 bp, Homo sapiens
ataatgtacaaaaactgtctt

SEQ ID NO: 7478022 - DNA, 21 bp, Homo sapiens
ataatgtacaaaaactgtctt

SEQ ID NO: 7478023 - DNA, 21 bp, Homo sapiens
ataatgtacaaaaactgtctt

SEQ ID NO: 7478024 - DNA, 20 bp, Homo sapiens
ataattatttacttttgtgc

SEQ ID NO: 7478025 - DNA, 20 bp, Homo sapiens
ataattatttacttttgtgc

SEQ ID NO: 7478026 - DNA, 22 bp, Homo sapiens
ataattatctcagacacttgtt

SEQ ID NO: 7478027 - DNA, 22 bp, Homo sapiens
ataattatctcagacacttgtt

SEQ ID NO: 7478028 - DNA, 22 bp, Homo sapiens
ataattcaggttttctggcaca

SEQ ID NO: 7478029 - DNA, 22 bp, Homo sapiens
ataattcatgggcctttcacct

SEQ ID NO: 7478030 - DNA, 22 bp, Homo sapiens
ataattgatgaggctttggaca

SEQ ID NO: 7478031 - DNA, 22 bp, Homo sapiens
ataattctccaatttttgttgt

SEQ ID NO: 7478032 - DNA, 22 bp, Homo sapiens
ataattctccaatttttgttgt

SEQ ID NO: 7478033 - DNA, 22 bp, Homo sapiens
ataattctccaatttttgttgt

SEQ ID NO: 7478034 - DNA, 22 bp, Homo sapiens
ataatttaaattagtatgtgat

SEQ ID NO: 7478035 - DNA, 22 bp, Homo sapiens
ataatttaaattagtatgtgat

SEQ ID NO: 7478036 - DNA, 22 bp, Homo sapiens
ataatttaaattagtatgtgat

SEQ ID NO: 7478037 - DNA, 22 bp, Homo sapiens
ataatttaaattagtatgtgat

SEQ ID NO: 7478038 - DNA, 22 bp, Homo sapiens
ataatttaaattagtatgtgat

SEQ ID NO: 7478039 - DNA, 22 bp, Homo sapiens
ataattaatttcagtaatctcc

SEQ ID NO: 7478040 - DNA, 22 bp, Homo sapiens
ataattaatttcagtaatctcc

SEQ ID NO: 7478041 - DNA, 22 bp, Homo sapiens
ataattaatttcagtaatctcc

SEQ ID NO: 7478042 - DNA, 22 bp, Homo sapiens
ataattaatttcagtaatctcc

SEQ ID NO: 7478043 - DNA, 22 bp, Homo sapiens
ataattaatttcagtaatctcc

SEQ ID NO: 7478044 - DNA, 22 bp, Homo sapiens
ataattatctcagacacttgtt

SEQ ID NO: 7478045 - DNA, 22 bp, Homo sapiens
ataattatctcagacacttgtt

SEQ ID NO: 7478046 - DNA, 22 bp, Homo sapiens
ataattatctcagacacttgtt

SEQ ID NO: 7478047 - DNA, 22 bp, Homo sapiens
ataattatctcagacacttgtt

SEQ ID NO: 7478048 - DNA, 22 bp, Homo sapiens
ataattatctcagacacttgtt

SEQ ID NO: 7478049 - DNA, 22 bp, Homo sapiens
atacatcttccttttaaaatgc

SEQ ID NO: 7478050 - DNA, 22 bp, Homo sapiens
atacatcttccttttaaaatgc

SEQ ID NO: 7478051 - DNA, 22 bp, Homo sapiens
atacatcttccttttaaaatgc

SEQ ID NO: 7478052 - DNA, 22 bp, Homo sapiens
atacatcttccttttaaaatgc

SEQ ID NO: 7478053 - DNA, 22 bp, Homo sapiens
atacatcttccttttaaaatgc

SEQ ID NO: 7478054 - DNA, 22 bp, Homo sapiens
atacatctggatgtatgcattt

SEQ ID NO: 7478055 - DNA, 22 bp, Homo sapiens
atacatcttccttttaaaatgc

SEQ ID NO: 7478056 - DNA, 22 bp, Homo sapiens
atacatcttgtcagattcatgt

SEQ ID NO: 7478057 - DNA, 22 bp, Homo sapiens
atacatcttgtcagattcatgt

SEQ ID NO: 7478058 - DNA, 22 bp, Homo sapiens
atacatcttccttttaaaatgc

SEQ ID NO: 7478059 - DNA, 22 bp, Homo sapiens
atacatctctttgaagtgcttt

SEQ ID NO: 7478060 - DNA, 22 bp, Homo sapiens
atacatctctttgaagtgcttt

SEQ ID NO: 7478061 - DNA, 22 bp, Homo sapiens
atacatctctttgaagtgcttt

SEQ ID NO: 7478062 - DNA, 22 bp, Homo sapiens
atacatctggatgtatgcattt

SEQ ID NO: 7478063 - DNA, 22 bp, Homo sapiens
atacatctggatgtatgcattt

SEQ ID NO: 7478064 - DNA, 22 bp, Homo sapiens
atacatctctttgaagtgcttt

SEQ ID NO: 7478065 - DNA, 22 bp, Homo sapiens
atacatctcatgtaagagataa

SEQ ID NO: 7478066 - DNA, 22 bp, Homo sapiens
atacatctcatgtaagagataa

SEQ ID NO: 7478067 - DNA, 22 bp, Homo sapiens
atacatctcatgtaagagataa

SEQ ID NO: 7478068 - DNA, 22 bp, Homo sapiens
atacatctcatgtaagagataa

SEQ ID NO: 7478069 - DNA, 22 bp, Homo sapiens
atacatgactcacacattctgc

SEQ ID NO: 7478070 - DNA, 22 bp, Homo sapiens
atacatgaggctcatttatgtc

SEQ ID NO: 7478071 - DNA, 22 bp, Homo sapiens
atacatgaggctcatttatgtc

SEQ ID NO: 7478072 - DNA, 22 bp, Homo sapiens
atacatgactcacacattctgc

SEQ ID NO: 7478073 - DNA, 22 bp, Homo sapiens
atacatgacagcatagcatcct

SEQ ID NO: 7478074 - DNA, 22 bp, Homo sapiens
atacatgacagcatagcatcct

SEQ ID NO: 7478075 - DNA, 22 bp, Homo sapiens
atacatgacagcatagcatcct

SEQ ID NO: 7478076 - DNA, 22 bp, Homo sapiens
atacatgactcacacattctgc

SEQ ID NO: 7478077 - DNA, 22 bp, Homo sapiens
atacatgacactgggctacagg

SEQ ID NO: 7478078 - DNA, 22 bp, Homo sapiens
atacatgacactgggctacagg

SEQ ID NO: 7478079 - DNA, 22 bp, Homo sapiens
atacatgacactgggctacagg

SEQ ID NO: 7478080 - DNA, 22 bp, Homo sapiens
atacatcttgtcagattcatgt

SEQ ID NO: 7478081 - DNA, 22 bp, Homo sapiens
atacatcttgtcagattcatgt

SEQ ID NO: 7478082 - DNA, 22 bp, Homo sapiens
atacatcttgtcagattcatgt

SEQ ID NO: 7478083 - DNA, 22 bp, Homo sapiens
atacatgatacttagtacgtag

SEQ ID NO: 7478084 - DNA, 22 bp, Homo sapiens
atacatgatcactgtattataa

SEQ ID NO: 7478085 - DNA, 22 bp, Homo sapiens
atacatgatacttagtacgtag

SEQ ID NO: 7478086 - DNA, 22 bp, Homo sapiens
atacatgaggctcatttatgtc

SEQ ID NO: 7478087 - DNA, 22 bp, Homo sapiens
atacatgatcactgtattataa

SEQ ID NO: 7478088 - DNA, 22 bp, Homo sapiens
ctggagctgccagacgggcaca

SEQ ID NO: 7478089 - DNA, 22 bp, Homo sapiens
ctggagctgccagacgggcaca

SEQ ID NO: 7478090 - DNA, 22 bp, Homo sapiens
atacatgatcactgtattataa

SEQ ID NO: 7478091 - DNA, 22 bp, Homo sapiens
ctggagctgccagggctgccgc

SEQ ID NO: 7478092 - DNA, 22 bp, Homo sapiens
ctggagctgccagggctgccgc

SEQ ID NO: 7478093 - DNA, 22 bp, Homo sapiens
ctggagctggcccaggctggcc

SEQ ID NO: 7478094 - DNA, 22 bp, Homo sapiens
ctggagctggcccaggctggcc

SEQ ID NO: 7478095 - DNA, 22 bp, Homo sapiens
ctggagctggcccaggctggcc

SEQ ID NO: 7478096 - DNA, 22 bp, Homo sapiens
ctggagctggtatagggacaaa

SEQ ID NO: 7478097 - DNA, 22 bp, Homo sapiens
ctggagctggtatagggacaaa

SEQ ID NO: 7478098 - DNA, 22 bp, Homo sapiens
ctggagctggtatagggacaaa

SEQ ID NO: 7478099 - DNA, 22 bp, Homo sapiens
ctggagctggtatagggacaaa

SEQ ID NO: 7478100 - DNA, 22 bp, Homo sapiens
ctggagctggtatagggacaaa

SEQ ID NO: 7478101 - DNA, 22 bp, Homo sapiens
ctggagctggtatagggacaaa

SEQ ID NO: 7478102 - DNA, 22 bp, Homo sapiens
ctggagctgtcttcacaggcct

SEQ ID NO: 7478103 - DNA, 22 bp, Homo sapiens
ctggagctgtcttcacaggcct

SEQ ID NO: 7478104 - DNA, 22 bp, Homo sapiens
ctggagctggtatagggacaaa

SEQ ID NO: 7478105 - DNA, 22 bp, Homo sapiens
ctggagctggtatagggacaaa

SEQ ID NO: 7478106 - DNA, 22 bp, Homo sapiens
ctggagctggtatagggacaaa

SEQ ID NO: 7478107 - DNA, 22 bp, Homo sapiens
ctggagctgggctagggtagga

SEQ ID NO: 7478108 - DNA, 22 bp, Homo sapiens
ctggagctggcttccttccact

SEQ ID NO: 7478109 - DNA, 22 bp, Homo sapiens
ctggagctggcttccttccact

SEQ ID NO: 7478110 - DNA, 22 bp, Homo sapiens
ctggaagacgtttgaagccatg

SEQ ID NO: 7478111 - DNA, 22 bp, Homo sapiens
ctggaagacgtttgaagccatg

SEQ ID NO: 7478112 - DNA, 22 bp, Homo sapiens
ctggaagacgtttgaagccatg

SEQ ID NO: 7478113 - DNA, 22 bp, Homo sapiens
ctggaagacgtttgaagccatg

SEQ ID NO: 7478114 - DNA, 22 bp, Homo sapiens
ctggaagacgtttgaagccatg

SEQ ID NO: 7478115 - DNA, 22 bp, Homo sapiens
ctggaagacgtttgaagccatg

SEQ ID NO: 7478116 - DNA, 22 bp, Homo sapiens
ctggaagaccccccaggactca

SEQ ID NO: 7478117 - DNA, 22 bp, Homo sapiens
ctggaagaccccccaggactca

SEQ ID NO: 7478118 - DNA, 21 bp, Homo sapiens
ctggaagaagcagcaggattc

SEQ ID NO: 7478119 - DNA, 22 bp, Homo sapiens
ctggaagaccccccaggactca

SEQ ID NO: 7478120 - DNA, 21 bp, Homo sapiens
ctggaagaagcagcaggattc

SEQ ID NO: 7478121 - DNA, 21 bp, Homo sapiens
ctggaagaagcagcaggattc

SEQ ID NO: 7478122 - DNA, 22 bp, Homo sapiens
atacatatatggtacttcctgg

SEQ ID NO: 7478123 - DNA, 22 bp, Homo sapiens
atacatctcatgtaagagataa

SEQ ID NO: 7478124 - DNA, 22 bp, Homo sapiens
atacatctatgcctttctgaca

SEQ ID NO: 7478125 - DNA, 22 bp, Homo sapiens
atacatatatggtacttcctgg

SEQ ID NO: 7478126 - DNA, 22 bp, Homo sapiens
atacatatatggtacttcctgg

SEQ ID NO: 7478127 - DNA, 22 bp, Homo sapiens
ctggaagacgtttgaagccatg

SEQ ID NO: 7478128 - DNA, 22 bp, Homo sapiens
ctggaagactcaatggcctgcc

SEQ ID NO: 7478129 - DNA, 22 bp, Homo sapiens
ctggaacacctgagttaccact

SEQ ID NO: 7478130 - DNA, 22 bp, Homo sapiens
ctggaacacctgagttaccact

SEQ ID NO: 7478131 - DNA, 22 bp, Homo sapiens
ctggaacagaagcactggagag

SEQ ID NO: 7478132 - DNA, 22 bp, Homo sapiens
ctggaacagaagcactggagag

SEQ ID NO: 7478133 - DNA, 22 bp, Homo sapiens
ctggaacagtgttggagcttga

SEQ ID NO: 7478134 - DNA, 22 bp, Homo sapiens
ctggaacagtgttggagcttga

SEQ ID NO: 7478135 - DNA, 23 bp, Homo sapiens
ctggaacatagtagatggtcaga

SEQ ID NO: 7478136 - DNA, 22 bp, Homo sapiens
ctggaacccaggcctggaagcc

SEQ ID NO: 7478137 - DNA, 22 bp, Homo sapiens
ctggaacccaggcctggaagcc

SEQ ID NO: 7478138 - DNA, 22 bp, Homo sapiens
ctggaactcaggatggttagga

SEQ ID NO: 7478139 - DNA, 22 bp, Homo sapiens
ctggaactcctggggagctggt

SEQ ID NO: 7478140 - DNA, 22 bp, Homo sapiens
ctggaactcctggggagctggt

SEQ ID NO: 7478141 - DNA, 22 bp, Homo sapiens
ctggaagaactccagttctgtg

SEQ ID NO: 7478142 - DNA, 22 bp, Homo sapiens
ctggaagaactccagttctgtg

SEQ ID NO: 7478143 - DNA, 22 bp, Homo sapiens
ctggaagaactccagttctgtg

SEQ ID NO: 7478144 - DNA, 22 bp, Homo sapiens
ctggaactcctggggagctggt

SEQ ID NO: 7478145 - DNA, 22 bp, Homo sapiens
ctggaagaactccagttctgtg

SEQ ID NO: 7478146 - DNA, 22 bp, Homo sapiens
ctggaagaactccagttctgtg

SEQ ID NO: 7478147 - DNA, 21 bp, Homo sapiens
ctggaagaagcagcaggattc

SEQ ID NO: 7478148 - DNA, 21 bp, Homo sapiens
ctggaagaagcagcaggattc

SEQ ID NO: 7478149 - DNA, 21 bp, Homo sapiens
ctggaagaagcagcaggattc

SEQ ID NO: 7478150 - DNA, 22 bp, Homo sapiens
ctggaagaactccagttctgtg

SEQ ID NO: 7478151 - DNA, 22 bp, Homo sapiens
ctggaagaactccagttctgtg

SEQ ID NO: 7478152 - DNA, 22 bp, Homo sapiens
ctggaagaactccagttctgtg

SEQ ID NO: 7478153 - DNA, 21 bp, Homo sapiens
atacagaaggtggcaaagtac

SEQ ID NO: 7478154 - DNA, 21 bp, Homo sapiens
atacagaaggtggcaaagtac

SEQ ID NO: 7478155 - DNA, 21 bp, Homo sapiens
atacagaaggtggcaaagtac

SEQ ID NO: 7478156 - DNA, 21 bp, Homo sapiens
atacagaaggtggcaaagtac

SEQ ID NO: 7478157 - DNA, 21 bp, Homo sapiens
atacagaaggtggcaaagtac

SEQ ID NO: 7478158 - DNA, 21 bp, Homo sapiens
atacagaaggtggcaaagtac

SEQ ID NO: 7478159 - DNA, 21 bp, Homo sapiens
atacagaaggtggcaaagtac

SEQ ID NO: 7478160 - DNA, 21 bp, Homo sapiens
atacagaaggcagactctctc

SEQ ID NO: 7478161 - DNA, 21 bp, Homo sapiens
atacagaaggcagactctctc

SEQ ID NO: 7478162 - DNA, 22 bp, Homo sapiens
atacagaagcctgtatttctgg

SEQ ID NO: 7478163 - DNA, 21 bp, Homo sapiens
atacagaaggcagactctctc

SEQ ID NO: 7478164 - DNA, 22 bp, Homo sapiens
atacagaagcctgtatttctgg

SEQ ID NO: 7478165 - DNA, 22 bp, Homo sapiens
atacagaagcctgtatttctgg

SEQ ID NO: 7478166 - DNA, 22 bp, Homo sapiens
atacagaagcctgtatttctgg

SEQ ID NO: 7478167 - DNA, 22 bp, Homo sapiens
atacagaagcctgtatttctgg

SEQ ID NO: 7478168 - DNA, 22 bp, Homo sapiens
atacagaagcctgtatttctgg

SEQ ID NO: 7478169 - DNA, 22 bp, Homo sapiens
atacagaagcctgtatttctgg

SEQ ID NO: 7478170 - DNA, 22 bp, Homo sapiens
atacagaagcctgtatttctgg

SEQ ID NO: 7478171 - DNA, 22 bp, Homo sapiens
atacagaagcctgtatttctgg

SEQ ID NO: 7478172 - DNA, 22 bp, Homo sapiens
atacagaagaactatagccact

SEQ ID NO: 7478173 - DNA, 22 bp, Homo sapiens
atacagaagaactatagccact

SEQ ID NO: 7478174 - DNA, 22 bp, Homo sapiens
atacagaagaactatagccact

SEQ ID NO: 7478175 - DNA, 22 bp, Homo sapiens
atacagaagacccctccgtcat

SEQ ID NO: 7478176 - DNA, 22 bp, Homo sapiens
atacagaagacccctccgtcat

SEQ ID NO: 7478177 - DNA, 22 bp, Homo sapiens
ctggaaatcactactagtcaat

SEQ ID NO: 7478178 - DNA, 22 bp, Homo sapiens
ctggaaatcactactagtcaat

SEQ ID NO: 7478179 - DNA, 22 bp, Homo sapiens
ctggaacaagtggccttgcaag

SEQ ID NO: 7478180 - DNA, 21 bp, Homo sapiens
ctggaacaaatactagcaaac

SEQ ID NO: 7478181 - DNA, 22 bp, Homo sapiens
ctggaacaagtggccttgcaag

SEQ ID NO: 7478182 - DNA, 22 bp, Homo sapiens
ctggaacacctgagttaccact

SEQ ID NO: 7478183 - DNA, 22 bp, Homo sapiens
ctggaaattggagatgatgttt

SEQ ID NO: 7478184 - DNA, 21 bp, Homo sapiens
ctggaacaaatactagcaaac

SEQ ID NO: 7478185 - DNA, 22 bp, Homo sapiens
atacagaagttttccacttatt

SEQ ID NO: 7478186 - DNA, 21 bp, Homo sapiens
atacagaaggtggcaaagtac

SEQ ID NO: 7478187 - DNA, 21 bp, Homo sapiens
atacagaaggtggcaaagtac

SEQ ID NO: 7478188 - DNA, 19 bp, Homo sapiens
ctggaaagttggcagtgag

SEQ ID NO: 7478189 - DNA, 22 bp, Homo sapiens
ctggaaatcactactagtcaat

SEQ ID NO: 7478190 - DNA, 22 bp, Homo sapiens
atacagaagttttccacttatt

SEQ ID NO: 7478191 - DNA, 19 bp, Homo sapiens
ctggaaagttggcagtgag

SEQ ID NO: 7478192 - DNA, 22 bp, Homo sapiens
atagaattacagtgtgtttgga

SEQ ID NO: 7478193 - DNA, 22 bp, Homo sapiens
atagaatgtattatagtacaga

SEQ ID NO: 7478194 - DNA, 22 bp, Homo sapiens
atagaatgtattatagtacaga

SEQ ID NO: 7478195 - DNA, 22 bp, Homo sapiens
atagaatgtattatagtacaga

SEQ ID NO: 7478196 - DNA, 22 bp, Homo sapiens
atagaatgtattatagtacaga

SEQ ID NO: 7478197 - DNA, 22 bp, Homo sapiens
atagaatgtattatagtacaga

SEQ ID NO: 7478198 - DNA, 22 bp, Homo sapiens
atagaatgtattatagtacaga

SEQ ID NO: 7478199 - DNA, 22 bp, Homo sapiens
atagaattcgtgtttgtaattc

SEQ ID NO: 7478200 - DNA, 22 bp, Homo sapiens
atagaattctttgaaatttatg

SEQ ID NO: 7478201 - DNA, 22 bp, Homo sapiens
atagaattctttgaaatttatg

SEQ ID NO: 7478202 - DNA, 22 bp, Homo sapiens
atagaattcgtgtttgtaattc

SEQ ID NO: 7478203 - DNA, 22 bp, Homo sapiens
atagaattcgtgtttgtaattc

SEQ ID NO: 7478204 - DNA, 22 bp, Homo sapiens
atagaattcgtgtttgtaattc

SEQ ID NO: 7478205 - DNA, 22 bp, Homo sapiens
atagaattatggaaagcatctt

SEQ ID NO: 7478206 - DNA, 22 bp, Homo sapiens
atagacaaacacgaagatgaca

SEQ ID NO: 7478207 - DNA, 22 bp, Homo sapiens
atagacaaacacgaagatgaca

SEQ ID NO: 7478208 - DNA, 22 bp, Homo sapiens
atagacaaacacgaagatgaca

SEQ ID NO: 7478209 - DNA, 22 bp, Homo sapiens
atagacaaacacgaagatgaca

SEQ ID NO: 7478210 - DNA, 22 bp, Homo sapiens
atagacaaacacgaagatgaca

SEQ ID NO: 7478211 - DNA, 22 bp, Homo sapiens
atagacaaacacgaagatgaca

SEQ ID NO: 7478212 - DNA, 22 bp, Homo sapiens
atagaatttgtacttgtagaac

SEQ ID NO: 7478213 - DNA, 20 bp, Homo sapiens
atagacaaagacatgccaga

SEQ ID NO: 7478214 - DNA, 20 bp, Homo sapiens
atagacaaagacatgccaga

SEQ ID NO: 7478215 - DNA, 22 bp, Homo sapiens
atagacaaacacgaagatgaca

SEQ ID NO: 7478216 - DNA, 22 bp, Homo sapiens
atagaatttgtacttgtagaac

SEQ ID NO: 7478217 - DNA, 22 bp, Homo sapiens
atagaatttgtacttgtagaac

SEQ ID NO: 7478218 - DNA, 22 bp, Homo sapiens
atagaatttgtacttgtagaac

SEQ ID NO: 7478219 - DNA, 22 bp, Homo sapiens
atagaatttgcactaaatctgc

SEQ ID NO: 7478220 - DNA, 22 bp, Homo sapiens
atagaatttgcactaaatctgc

SEQ ID NO: 7478221 - DNA, 22 bp, Homo sapiens
atagaatttgcactaaatctgc

SEQ ID NO: 7478222 - DNA, 22 bp, Homo sapiens
atagaatttgcactaaatctgc

SEQ ID NO: 7478223 - DNA, 22 bp, Homo sapiens
atagaattctttgaaatttatg

SEQ ID NO: 7478224 - DNA, 22 bp, Homo sapiens
atagacatatggctttgtttct

SEQ ID NO: 7478225 - DNA, 22 bp, Homo sapiens
atagacatatggctttgtttct

SEQ ID NO: 7478226 - DNA, 22 bp, Homo sapiens
atagacatagccgtaatttatt

SEQ ID NO: 7478227 - DNA, 22 bp, Homo sapiens
atagacatagccgtaatttatt

SEQ ID NO: 7478228 - DNA, 22 bp, Homo sapiens
atagacatagccgtaatttatt

SEQ ID NO: 7478229 - DNA, 22 bp, Homo sapiens
atagacatagccgtaatttatt

SEQ ID NO: 7478230 - DNA, 22 bp, Homo sapiens
atagacagctacatagaatata

SEQ ID NO: 7478231 - DNA, 22 bp, Homo sapiens
atagacatggtcttttgtcatt

SEQ ID NO: 7478232 - DNA, 22 bp, Homo sapiens
atagacatgcaacactttttac

SEQ ID NO: 7478233 - DNA, 22 bp, Homo sapiens
atagacattataacacagagct

SEQ ID NO: 7478234 - DNA, 22 bp, Homo sapiens
atagacattataacacagagct

SEQ ID NO: 7478235 - DNA, 22 bp, Homo sapiens
atagacatgcaacactttttac

SEQ ID NO: 7478236 - DNA, 22 bp, Homo sapiens
atagacaacacttattattcct

SEQ ID NO: 7478237 - DNA, 22 bp, Homo sapiens
atagacaacacttattattcct

SEQ ID NO: 7478238 - DNA, 22 bp, Homo sapiens
atagacaacacttattattcct

SEQ ID NO: 7478239 - DNA, 22 bp, Homo sapiens
atagacaatggtttgccaagaa

SEQ ID NO: 7478240 - DNA, 22 bp, Homo sapiens
atagacaatggtttgccaagaa

SEQ ID NO: 7478241 - DNA, 22 bp, Homo sapiens
atagacaatggtttgccaagaa

SEQ ID NO: 7478242 - DNA, 22 bp, Homo sapiens
atagacaacacttattattcct

SEQ ID NO: 7478243 - DNA, 22 bp, Homo sapiens
atagacagatgatagataaatc

SEQ ID NO: 7478244 - DNA, 22 bp, Homo sapiens
atagacagcgcattaaaaatgt

SEQ ID NO: 7478245 - DNA, 22 bp, Homo sapiens
atagacagcgcattaaaaatgt

SEQ ID NO: 7478246 - DNA, 22 bp, Homo sapiens
atagacagctacatagaatata

SEQ ID NO: 7478247 - DNA, 22 bp, Homo sapiens
atagacagatgatagataaatc

SEQ ID NO: 7478248 - DNA, 22 bp, Homo sapiens
atagacagatgatagataaatc

SEQ ID NO: 7478249 - DNA, 22 bp, Homo sapiens
atagacagaaagataatagaat

SEQ ID NO: 7478250 - DNA, 22 bp, Homo sapiens
atagacagaaagataatagaat

SEQ ID NO: 7478251 - DNA, 22 bp, Homo sapiens
atagacacagctatgatttgag

SEQ ID NO: 7478252 - DNA, 22 bp, Homo sapiens
atagacagaaagataatagaat

SEQ ID NO: 7478253 - DNA, 22 bp, Homo sapiens
atagacagaaagataatagaat

SEQ ID NO: 7478254 - DNA, 22 bp, Homo sapiens
atagacacagatctatatatgt

SEQ ID NO: 7478255 - DNA, 22 bp, Homo sapiens
atagacacatgttattatactt

SEQ ID NO: 7478256 - DNA, 22 bp, Homo sapiens
ataggtctgaaagtgtatcctg

SEQ ID NO: 7478257 - DNA, 22 bp, Homo sapiens
ataggtccaaggagaggtcttt

SEQ ID NO: 7478258 - DNA, 22 bp, Homo sapiens
ataggtaaatgtgtgccacggt

SEQ ID NO: 7478259 - DNA, 22 bp, Homo sapiens
ataggtacagcagatattctta

SEQ ID NO: 7478260 - DNA, 21 bp, Homo sapiens
ataggtaacccagcagacttg

SEQ ID NO: 7478261 - DNA, 22 bp, Homo sapiens
ataggtcagagccacagtgaag

SEQ ID NO: 7478262 - DNA, 22 bp, Homo sapiens
ataggtcagagccacagtgaag

SEQ ID NO: 7478263 - DNA, 22 bp, Homo sapiens
ataggggcagatgaggaatggg

SEQ ID NO: 7478264 - DNA, 22 bp, Homo sapiens
ataggggcagatgaggaatggg

SEQ ID NO: 7478265 - DNA, 22 bp, Homo sapiens
atagtaaattatcgtggagaga

SEQ ID NO: 7478266 - DNA, 20 bp, Homo sapiens
ataggttacaggtctttcaa

SEQ ID NO: 7478267 - DNA, 22 bp, Homo sapiens
ataggtttgggaattaggcaga

SEQ ID NO: 7478268 - DNA, 22 bp, Homo sapiens
atagtaactggcatgtttatga

SEQ ID NO: 7478269 - DNA, 22 bp, Homo sapiens
atagtaactggcatgtttatga

SEQ ID NO: 7478270 - DNA, 22 bp, Homo sapiens
atagtaactggcatgtttatga

SEQ ID NO: 7478271 - DNA, 22 bp, Homo sapiens
atagtaactggcatgtttatga

SEQ ID NO: 7478272 - DNA, 22 bp, Homo sapiens
atagtaatcagttgttggatca

SEQ ID NO: 7478273 - DNA, 22 bp, Homo sapiens
atagtacaatcagttaattagt

SEQ ID NO: 7478274 - DNA, 22 bp, Homo sapiens
atagtacaatcagttaattagt

SEQ ID NO: 7478275 - DNA, 22 bp, Homo sapiens
atagtacaatcagttaattagt

SEQ ID NO: 7478276 - DNA, 22 bp, Homo sapiens
atagtacacatcctacaatgtt

SEQ ID NO: 7478277 - DNA, 22 bp, Homo sapiens
atagtacacatcctacaatgtt

SEQ ID NO: 7478278 - DNA, 22 bp, Homo sapiens
atagtacaatcagttaattagt

SEQ ID NO: 7478279 - DNA, 22 bp, Homo sapiens
atagtacaatcagttaattagt

SEQ ID NO: 7478280 - DNA, 22 bp, Homo sapiens
atagtacaatcagttaattagt

SEQ ID NO: 7478281 - DNA, 22 bp, Homo sapiens
atagtacaagggaagagtgaag

SEQ ID NO: 7478282 - DNA, 22 bp, Homo sapiens
atagtacaagggaagagtgaag

SEQ ID NO: 7478283 - DNA, 22 bp, Homo sapiens
atagtacaagggaagagtgaag

SEQ ID NO: 7478284 - DNA, 22 bp, Homo sapiens
atagtacaagggaagagtgaag

SEQ ID NO: 7478285 - DNA, 22 bp, Homo sapiens
atagtacacatcctacaatgtt

SEQ ID NO: 7478286 - DNA, 22 bp, Homo sapiens
atagtacacatcctacaatgtt

SEQ ID NO: 7478287 - DNA, 22 bp, Homo sapiens
atagtacacatcctacaatgtt

SEQ ID NO: 7478288 - DNA, 22 bp, Homo sapiens
atagtacacatcctacaatgtt

SEQ ID NO: 7478289 - DNA, 22 bp, Homo sapiens
atagtacacatcctacaatgtt

SEQ ID NO: 7478290 - DNA, 22 bp, Homo sapiens
atagtacacatcctacaatgtt

SEQ ID NO: 7478291 - DNA, 22 bp, Homo sapiens
atagtacacatcctacaatgtt

SEQ ID NO: 7478292 - DNA, 22 bp, Homo sapiens
atagtacacatcctacaatgtt

SEQ ID NO: 7478293 - DNA, 22 bp, Homo sapiens
atagcagtgacattttaatgtg

SEQ ID NO: 7478294 - DNA, 22 bp, Homo sapiens
atagcagttgtcaaactccatc

SEQ ID NO: 7478295 - DNA, 22 bp, Homo sapiens
atagcagtggatgtggagaaag

SEQ ID NO: 7478296 - DNA, 22 bp, Homo sapiens
atagcatacatgttgttacttg

SEQ ID NO: 7478297 - DNA, 22 bp, Homo sapiens
atagcatacatgttgttacttg

SEQ ID NO: 7478298 - DNA, 22 bp, Homo sapiens
atagcagttgtcaaactccatc

SEQ ID NO: 7478299 - DNA, 22 bp, Homo sapiens
atagcatataagttataaaact

SEQ ID NO: 7478300 - DNA, 22 bp, Homo sapiens
atagcatagtcagcttcgctga

SEQ ID NO: 7478301 - DNA, 22 bp, Homo sapiens
ataggcagaaatgctccctatt

SEQ ID NO: 7478302 - DNA, 22 bp, Homo sapiens
atagcagtgacattttaatgtg

SEQ ID NO: 7478303 - DNA, 23 bp, Homo sapiens
atagacccaagagtaaaggcatc

SEQ ID NO: 7478304 - DNA, 22 bp, Homo sapiens
atagaccctggaaatggcagag

SEQ ID NO: 7478305 - DNA, 22 bp, Homo sapiens
atagacatttactgagcacgta

SEQ ID NO: 7478306 - DNA, 21 bp, Homo sapiens
atagaccagtatggataacag

SEQ ID NO: 7478307 - DNA, 22 bp, Homo sapiens
ataggcagactctttttggagg

SEQ ID NO: 7478308 - DNA, 22 bp, Homo sapiens
ataggcagaaatgctccctatt

SEQ ID NO: 7478309 - DNA, 22 bp, Homo sapiens
ataggcatgacatgcagggatt

SEQ ID NO: 7478310 - DNA, 22 bp, Homo sapiens
ataggccagatatgctcgcagt

SEQ ID NO: 7478311 - DNA, 22 bp, Homo sapiens
ataggctggagtgcagtggcat

SEQ ID NO: 7478312 - DNA, 22 bp, Homo sapiens
ataggctgatctagcagcacag

SEQ ID NO: 7478313 - DNA, 22 bp, Homo sapiens
ataggctggagtgcagtggcat

SEQ ID NO: 7478314 - DNA, 22 bp, Homo sapiens
atagggaggaactgagtcagga

SEQ ID NO: 7478315 - DNA, 22 bp, Homo sapiens
ataggctttttaactctccaaa

SEQ ID NO: 7478316 - DNA, 22 bp, Homo sapiens
ataggctttgtgttttgttatc

SEQ ID NO: 7478317 - DNA, 22 bp, Homo sapiens
ataggctttgtgttttgttatc

SEQ ID NO: 7478318 - DNA, 22 bp, Homo sapiens
ataggctgtaataattcacatt

SEQ ID NO: 7478319 - DNA, 22 bp, Homo sapiens
ataggcttggcttattcttggg

SEQ ID NO: 7478320 - DNA, 22 bp, Homo sapiens
ataggctttcctgattctcagg

SEQ ID NO: 7478321 - DNA, 22 bp, Homo sapiens
ataggctttcctgattctcagg

SEQ ID NO: 7478322 - DNA, 22 bp, Homo sapiens
atagggaggaactgagtcagga

SEQ ID NO: 7478323 - DNA, 19 bp, Homo sapiens
atagggcaccctaaggagt

SEQ ID NO: 7478324 - DNA, 22 bp, Homo sapiens
atagggcagtggcatctcttaa

SEQ ID NO: 7478325 - DNA, 22 bp, Homo sapiens
atagggcagtggcatctcttaa

SEQ ID NO: 7478326 - DNA, 22 bp, Homo sapiens
atagggcatcctttattgagat

SEQ ID NO: 7478327 - DNA, 22 bp, Homo sapiens
atagaaatgtattttggactag

SEQ ID NO: 7478328 - DNA, 22 bp, Homo sapiens
atagaatagcatagaaaattga

SEQ ID NO: 7478329 - DNA, 22 bp, Homo sapiens
atagaatagcatagaaaattga

SEQ ID NO: 7478330 - DNA, 22 bp, Homo sapiens
atagaatagcatagaaaattga

SEQ ID NO: 7478331 - DNA, 22 bp, Homo sapiens
atagaatagcatagaaaattga

SEQ ID NO: 7478332 - DNA, 22 bp, Homo sapiens
atagaatagcatagaaaattga

SEQ ID NO: 7478333 - DNA, 22 bp, Homo sapiens
atagaatatgacttttagatcc

SEQ ID NO: 7478334 - DNA, 22 bp, Homo sapiens
atagaatatgacttttagatcc

SEQ ID NO: 7478335 - DNA, 22 bp, Homo sapiens
atagaatatgacttttagatcc

SEQ ID NO: 7478336 - DNA, 22 bp, Homo sapiens
atagaatatgacttttagatcc

SEQ ID NO: 7478337 - DNA, 22 bp, Homo sapiens
atagaatatgacttttagatcc

SEQ ID NO: 7478338 - DNA, 22 bp, Homo sapiens
atagaatatgacttttagatcc

SEQ ID NO: 7478339 - DNA, 22 bp, Homo sapiens
atagaatatgacttttagatcc

SEQ ID NO: 7478340 - DNA, 22 bp, Homo sapiens
atagaatatgacttttagatcc

SEQ ID NO: 7478341 - DNA, 22 bp, Homo sapiens
atagaatatgacttttagatcc

SEQ ID NO: 7478342 - DNA, 19 bp, Homo sapiens
atagaaagggttaaagaca

SEQ ID NO: 7478343 - DNA, 19 bp, Homo sapiens
atagaaagggttaaagaca

SEQ ID NO: 7478344 - DNA, 19 bp, Homo sapiens
atagaaagggttaaagaca

SEQ ID NO: 7478345 - DNA, 18 bp, Homo sapiens
atagaaacctttaatcag

SEQ ID NO: 7478346 - DNA, 18 bp, Homo sapiens
atagaaacctttaatcag

SEQ ID NO: 7478347 - DNA, 22 bp, Homo sapiens
atagaaacagggaagcaaagca

SEQ ID NO: 7478348 - DNA, 19 bp, Homo sapiens
atagaaagggttaaagaca

SEQ ID NO: 7478349 - DNA, 19 bp, Homo sapiens
atagaaagggttaaagaca

SEQ ID NO: 7478350 - DNA, 19 bp, Homo sapiens
atagaaagggttaaagaca

SEQ ID NO: 7478351 - DNA, 19 bp, Homo sapiens
atagaaagggttaaagaca

SEQ ID NO: 7478352 - DNA, 23 bp, Homo sapiens
atagaaactaacaatttggctta

SEQ ID NO: 7478353 - DNA, 22 bp, Homo sapiens
atagaaatggcagctggtgcta

SEQ ID NO: 7478354 - DNA, 22 bp, Homo sapiens
atagaaaggtctttggcagaca

SEQ ID NO: 7478355 - DNA, 22 bp, Homo sapiens
atagaaaggtctttggcagaca

SEQ ID NO: 7478356 - DNA, 22 bp, Homo sapiens
atagaaaggtctttggcagaca

SEQ ID NO: 7478357 - DNA, 19 bp, Homo sapiens
atagaaagggttaaagaca

SEQ ID NO: 7478358 - DNA, 22 bp, Homo sapiens
atagaaatgtattttggactag

SEQ ID NO: 7478359 - DNA, 22 bp, Homo sapiens
atagaaatgtattttggactag

SEQ ID NO: 7478360 - DNA, 22 bp, Homo sapiens
atagaaatgtattttggactag

SEQ ID NO: 7478361 - DNA, 22 bp, Homo sapiens
atagaaatggcagctggtgcta

SEQ ID NO: 7478362 - DNA, 22 bp, Homo sapiens
atagaaatggcagctggtgcta

SEQ ID NO: 7478363 - DNA, 22 bp, Homo sapiens
atactttgctagtatcagtgtg

SEQ ID NO: 7478364 - DNA, 22 bp, Homo sapiens
atactttgctagtatcagtgtg

SEQ ID NO: 7478365 - DNA, 22 bp, Homo sapiens
atactttgctagtatcagtgtg

SEQ ID NO: 7478366 - DNA, 22 bp, Homo sapiens
atactttgctacattgtacatt

SEQ ID NO: 7478367 - DNA, 22 bp, Homo sapiens
atactttgctacattgtacatt

SEQ ID NO: 7478368 - DNA, 21 bp, Homo sapiens
atactttgaattacagccttg

SEQ ID NO: 7478369 - DNA, 22 bp, Homo sapiens
atacttttaattccttctgagt

SEQ ID NO: 7478370 - DNA, 22 bp, Homo sapiens
atacttttaattccttctgagt

SEQ ID NO: 7478371 - DNA, 22 bp, Homo sapiens
atactttggtcactattattgg

SEQ ID NO: 7478372 - DNA, 22 bp, Homo sapiens
atactttgggggttagtgtaga

SEQ ID NO: 7478373 - DNA, 22 bp, Homo sapiens
atactttggtcactattattgg

SEQ ID NO: 7478374 - DNA, 22 bp, Homo sapiens
atacttttaattccttctgagt

SEQ ID NO: 7478375 - DNA, 22 bp, Homo sapiens
atagaaaacagatgtccttaaa

SEQ ID NO: 7478376 - DNA, 22 bp, Homo sapiens
atacttttaattccttctgagt

SEQ ID NO: 7478377 - DNA, 22 bp, Homo sapiens
atacttttaattccttctgagt

SEQ ID NO: 7478378 - DNA, 22 bp, Homo sapiens
atacttttaattccttctgagt

SEQ ID NO: 7478379 - DNA, 22 bp, Homo sapiens
atacttttaattccttctgagt

SEQ ID NO: 7478380 - DNA, 22 bp, Homo sapiens
atagaaaacagatgtccttaaa

SEQ ID NO: 7478381 - DNA, 22 bp, Homo sapiens
atagaaaacagatgtccttaaa

SEQ ID NO: 7478382 - DNA, 22 bp, Homo sapiens
atagaaaacagatgtccttaaa

SEQ ID NO: 7478383 - DNA, 22 bp, Homo sapiens
atagaaaacagatgtccttaaa

SEQ ID NO: 7478384 - DNA, 22 bp, Homo sapiens
atagaaaacagatgtccttaaa

SEQ ID NO: 7478385 - DNA, 22 bp, Homo sapiens
atagaaaacagatgtccttaaa

SEQ ID NO: 7478386 - DNA, 22 bp, Homo sapiens
atagaaaacagatgtccttaaa

SEQ ID NO: 7478387 - DNA, 22 bp, Homo sapiens
atagaaaacagatgtccttaaa

SEQ ID NO: 7478388 - DNA, 22 bp, Homo sapiens
atagaaaacagatgtccttaaa

SEQ ID NO: 7478389 - DNA, 22 bp, Homo sapiens
atagaaacagaggtcaggcatt

SEQ ID NO: 7478390 - DNA, 22 bp, Homo sapiens
atagaaaacagatgtccttaaa

SEQ ID NO: 7478391 - DNA, 22 bp, Homo sapiens
atagaaaacagatgtccttaaa

SEQ ID NO: 7478392 - DNA, 22 bp, Homo sapiens
atagaaaacagatgtccttaaa

SEQ ID NO: 7478393 - DNA, 22 bp, Homo sapiens
atagaaaacagatgtccttaaa

SEQ ID NO: 7478394 - DNA, 22 bp, Homo sapiens
atagaaacagggaagcaaagca

SEQ ID NO: 7478395 - DNA, 22 bp, Homo sapiens
atagaaacagggaagcaaagca

SEQ ID NO: 7478396 - DNA, 22 bp, Homo sapiens
atagaaacagggaagcaaagca

SEQ ID NO: 7478397 - DNA, 22 bp, Homo sapiens
atagaaacagggaagcaaagca

SEQ ID NO: 7478398 - DNA, 22 bp, Homo sapiens
atagaaacagatgcacttctct

SEQ ID NO: 7478399 - DNA, 22 bp, Homo sapiens
atagaaacagatgcacttctct

SEQ ID NO: 7478400 - DNA, 22 bp, Homo sapiens
atagaaacagaggtcaggcatt

SEQ ID NO: 7478401 - DNA, 22 bp, Homo sapiens
atagaaacagatgcacttctct

SEQ ID NO: 7478402 - DNA, 22 bp, Homo sapiens
ctggccaggctctcacgtggtc

SEQ ID NO: 7478403 - DNA, 22 bp, Homo sapiens
ctggccaggctctcacgtggtc

SEQ ID NO: 7478404 - DNA, 22 bp, Homo sapiens
ctggccaggctctcacgtggtc

SEQ ID NO: 7478405 - DNA, 22 bp, Homo sapiens
ctggccagaggttcctctgccc

SEQ ID NO: 7478406 - DNA, 22 bp, Homo sapiens
ctggccaggcttgggacagaca

SEQ ID NO: 7478407 - DNA, 22 bp, Homo sapiens
ctggccaggcttgggacagaca

SEQ ID NO: 7478408 - DNA, 22 bp, Homo sapiens
ctggccaggcttgggacagaca

SEQ ID NO: 7478409 - DNA, 22 bp, Homo sapiens
ctggccaggcttgggacagaca

SEQ ID NO: 7478410 - DNA, 22 bp, Homo sapiens
ctggccaggcttgggacagaca

SEQ ID NO: 7478411 - DNA, 22 bp, Homo sapiens
ctggccaggctctcacgtggtc

SEQ ID NO: 7478412 - DNA, 22 bp, Homo sapiens
ctggccagaggttcctctgccc

SEQ ID NO: 7478413 - DNA, 22 bp, Homo sapiens
ctggccagaggttcctctgccc

SEQ ID NO: 7478414 - DNA, 22 bp, Homo sapiens
ctggccagaggttcctctgccc

SEQ ID NO: 7478415 - DNA, 22 bp, Homo sapiens
ctggccagaggttcctctgccc

SEQ ID NO: 7478416 - DNA, 22 bp, Homo sapiens
ctggccagaggttcctctgccc

SEQ ID NO: 7478417 - DNA, 17 bp, Homo sapiens
ctggagctgtgtaacct

SEQ ID NO: 7478418 - DNA, 22 bp, Homo sapiens
ctggagctgtcttcacaggcct

SEQ ID NO: 7478419 - DNA, 22 bp, Homo sapiens
ctggagcttattgggagcagaa

SEQ ID NO: 7478420 - DNA, 22 bp, Homo sapiens
ctggagcttattgggagcagaa

SEQ ID NO: 7478421 - DNA, 21 bp, Homo sapiens
ctggagcttggtgagaagtgt

SEQ ID NO: 7478422 - DNA, 21 bp, Homo sapiens
ctggagcttggtgagaagtgt

SEQ ID NO: 7478423 - DNA, 22 bp, Homo sapiens
ctggaggaaaacaactgcagac

SEQ ID NO: 7478424 - DNA, 22 bp, Homo sapiens
ctggaggaaaacaactgcagac

SEQ ID NO: 7478425 - DNA, 22 bp, Homo sapiens
ctggccagggtgcgatcgtggt

SEQ ID NO: 7478426 - DNA, 22 bp, Homo sapiens
ctggccagggtgcgatcgtggt

SEQ ID NO: 7478427 - DNA, 22 bp, Homo sapiens
ctggccagggtgcgatcgtggt

SEQ ID NO: 7478428 - DNA, 22 bp, Homo sapiens
ctggccaggcttgggacagaca

SEQ ID NO: 7478429 - DNA, 22 bp, Homo sapiens
ctggccaggcttgggacagaca

SEQ ID NO: 7478430 - DNA, 22 bp, Homo sapiens
ctggccaggcttgggacagaca

SEQ ID NO: 7478431 - DNA, 22 bp, Homo sapiens
ctggccaggcttgggacagaca

SEQ ID NO: 7478432 - DNA, 22 bp, Homo sapiens
ctggccaggttttgaacagttg

SEQ ID NO: 7478433 - DNA, 22 bp, Homo sapiens
ctggccaggttttgaacagttg

SEQ ID NO: 7478434 - DNA, 22 bp, Homo sapiens
ctggccaggttttgaacagttg

SEQ ID NO: 7478435 - DNA, 22 bp, Homo sapiens
ctggccagggtgcgatcgtggt

SEQ ID NO: 7478436 - DNA, 22 bp, Homo sapiens
ctggccagggtgcgatcgtggt

SEQ ID NO: 7478437 - DNA, 22 bp, Homo sapiens
ctggccagggtgcgatcgtggt

SEQ ID NO: 7478438 - DNA, 22 bp, Homo sapiens
ctggccagggtgcgatcgtggt

SEQ ID NO: 7478439 - DNA, 22 bp, Homo sapiens
ctggccagggtgcgatcgtggt

SEQ ID NO: 7478440 - DNA, 22 bp, Homo sapiens
ctggccagggtgcgatcgtggt

SEQ ID NO: 7478441 - DNA, 22 bp, Homo sapiens
ctggccagtgcctgtgggcccc

SEQ ID NO: 7478442 - DNA, 22 bp, Homo sapiens
ctggccagtgcctgtgggcccc

SEQ ID NO: 7478443 - DNA, 22 bp, Homo sapiens
ctggccagtgcctgtgggcccc

SEQ ID NO: 7478444 - DNA, 22 bp, Homo sapiens
ctggccagtgactgctcacccg

SEQ ID NO: 7478445 - DNA, 22 bp, Homo sapiens
ctggccagtgactgctcacccg

SEQ ID NO: 7478446 - DNA, 22 bp, Homo sapiens
ctggccagtgactgctcacccg

SEQ ID NO: 7478447 - DNA, 22 bp, Homo sapiens
ctggccagtgcctgtgggcccc

SEQ ID NO: 7478448 - DNA, 22 bp, Homo sapiens
ctggccagtgcctgtgggcccc

SEQ ID NO: 7478449 - DNA, 22 bp, Homo sapiens
ctggccagtgcctgtgggcccc

SEQ ID NO: 7478450 - DNA, 22 bp, Homo sapiens
ctggccagtgcctgtgggcccc

SEQ ID NO: 7478451 - DNA, 22 bp, Homo sapiens
ctggccagtgcctgtgggcccc

SEQ ID NO: 7478452 - DNA, 22 bp, Homo sapiens
ctggccagtgcctgtgggcccc

SEQ ID NO: 7478453 - DNA, 22 bp, Homo sapiens
ctggccagtgactgctcacccg

SEQ ID NO: 7478454 - DNA, 22 bp, Homo sapiens
ctggccagtgactgctcacccg

SEQ ID NO: 7478455 - DNA, 22 bp, Homo sapiens
ctggccagtgactgctcacccg

SEQ ID NO: 7478456 - DNA, 22 bp, Homo sapiens
ctggccaggttttgaacagttg

SEQ ID NO: 7478457 - DNA, 22 bp, Homo sapiens
ctggccaggttttgaacagttg

SEQ ID NO: 7478458 - DNA, 22 bp, Homo sapiens
ctggccagtgactgctcacccg

SEQ ID NO: 7478459 - DNA, 22 bp, Homo sapiens
ctggccaggttttgaacagttg

SEQ ID NO: 7478460 - DNA, 22 bp, Homo sapiens
ctggccaggttttgaacagttg

SEQ ID NO: 7478461 - DNA, 22 bp, Homo sapiens
agtttattgtatatggtagttt

SEQ ID NO: 7478462 - DNA, 22 bp, Homo sapiens
agtttattgtatatggtagttt

SEQ ID NO: 7478463 - DNA, 22 bp, Homo sapiens
agtttattgtatatggtagttt

SEQ ID NO: 7478464 - DNA, 22 bp, Homo sapiens
agtttattctgcttggccctcc

SEQ ID NO: 7478465 - DNA, 17 bp, Homo sapiens
agtttatttagccttct

SEQ ID NO: 7478466 - DNA, 17 bp, Homo sapiens
agtttatttagccttct

SEQ ID NO: 7478467 - DNA, 22 bp, Homo sapiens
agtttattgtatatggtagttt

SEQ ID NO: 7478468 - DNA, 17 bp, Homo sapiens
agtttatttagccttct

SEQ ID NO: 7478469 - DNA, 17 bp, Homo sapiens
agtttatttagccttct

SEQ ID NO: 7478470 - DNA, 22 bp, Homo sapiens
agtttattgtatatggtagttt

SEQ ID NO: 7478471 - DNA, 22 bp, Homo sapiens
agtttattgtatatggtagttt

SEQ ID NO: 7478472 - DNA, 22 bp, Homo sapiens
agtttattctctggtcttagta

SEQ ID NO: 7478473 - DNA, 22 bp, Homo sapiens
agtttattctctggtcttagta

SEQ ID NO: 7478474 - DNA, 22 bp, Homo sapiens
agtttattctctggtcttagta

SEQ ID NO: 7478475 - DNA, 20 bp, Homo sapiens
agtttattccaggagaactg

SEQ ID NO: 7478476 - DNA, 20 bp, Homo sapiens
agtttattccaggagaactg

SEQ ID NO: 7478477 - DNA, 20 bp, Homo sapiens
agtttattccaggagaactg

SEQ ID NO: 7478478 - DNA, 22 bp, Homo sapiens
agtttattctctggtcttagta

SEQ ID NO: 7478479 - DNA, 22 bp, Homo sapiens
agtttattctctggtcttagta

SEQ ID NO: 7478480 - DNA, 22 bp, Homo sapiens
agtttattctgcttggccctcc

SEQ ID NO: 7478481 - DNA, 22 bp, Homo sapiens
agtttattctgcttggccctcc

SEQ ID NO: 7478482 - DNA, 22 bp, Homo sapiens
agtttattctgcttggccctcc

SEQ ID NO: 7478483 - DNA, 22 bp, Homo sapiens
agtttattctgcttggccctcc

SEQ ID NO: 7478484 - DNA, 22 bp, Homo sapiens
agtttcacagaatatgaaggtt

SEQ ID NO: 7478485 - DNA, 22 bp, Homo sapiens
agtttcacagaatatgaaggtt

SEQ ID NO: 7478486 - DNA, 22 bp, Homo sapiens
agtttcacagagggttagacgc

SEQ ID NO: 7478487 - DNA, 21 bp, Homo sapiens
agtttcacagaggggccgtcc

SEQ ID NO: 7478488 - DNA, 22 bp, Homo sapiens
agtttcacagtctgtcattgtt

SEQ ID NO: 7478489 - DNA, 22 bp, Homo sapiens
agtttcacacaacatttgcatg

SEQ ID NO: 7478490 - DNA, 22 bp, Homo sapiens
agtttcaattcttttcacaaag

SEQ ID NO: 7478491 - DNA, 22 bp, Homo sapiens
agtttcaaattactgcccatgg

SEQ ID NO: 7478492 - DNA, 22 bp, Homo sapiens
agtttcaattcttttcacaaag

SEQ ID NO: 7478493 - DNA, 22 bp, Homo sapiens
agtttcaattcttttcacaaag

SEQ ID NO: 7478494 - DNA, 22 bp, Homo sapiens
agtttatttttgataagtcttg

SEQ ID NO: 7478495 - DNA, 22 bp, Homo sapiens
agtttatttttgataagtcttg

SEQ ID NO: 7478496 - DNA, 22 bp, Homo sapiens
agtttatttctccatttaccta

SEQ ID NO: 7478497 - DNA, 22 bp, Homo sapiens
agtttatttctccatttaccta

SEQ ID NO: 7478498 - DNA, 22 bp, Homo sapiens
agtttatttctccatttaccta

SEQ ID NO: 7478499 - DNA, 22 bp, Homo sapiens
agtttatttctccatttaccta

SEQ ID NO: 7478500 - DNA, 17 bp, Homo sapiens
agtttatttagccttct

SEQ ID NO: 7478501 - DNA, 17 bp, Homo sapiens
agtttatttagccttct

SEQ ID NO: 7478502 - DNA, 17 bp, Homo sapiens
agtttatttagccttct

SEQ ID NO: 7478503 - DNA, 22 bp, Homo sapiens
agtttatttttgataagtcttg

SEQ ID NO: 7478504 - DNA, 22 bp, Homo sapiens
agtttatttttgataagtcttg

SEQ ID NO: 7478505 - DNA, 22 bp, Homo sapiens
agtttatttttgataagtcttg

SEQ ID NO: 7478506 - DNA, 22 bp, Homo sapiens
agtttatttttgataagtcttg

SEQ ID NO: 7478507 - DNA, 22 bp, Homo sapiens
agtttatttctccatttaccta

SEQ ID NO: 7478508 - DNA, 19 bp, Homo sapiens
agtttattataggtgattc

SEQ ID NO: 7478509 - DNA, 19 bp, Homo sapiens
agtttattataggtgattc

SEQ ID NO: 7478510 - DNA, 22 bp, Homo sapiens
agtttatgttgtttataagcca

SEQ ID NO: 7478511 - DNA, 22 bp, Homo sapiens
agtttatgtagaattggcaata

SEQ ID NO: 7478512 - DNA, 22 bp, Homo sapiens
agtttatgtaaaattagtaatg

SEQ ID NO: 7478513 - DNA, 21 bp, Homo sapiens
agtttacaactgtccagcccc

SEQ ID NO: 7478514 - DNA, 22 bp, Homo sapiens
agtttatgtagaattggcaata

SEQ ID NO: 7478515 - DNA, 22 bp, Homo sapiens
agtttatgtgtaagacagctgt

SEQ ID NO: 7478516 - DNA, 22 bp, Homo sapiens
agtttatgttgtttataagcca

SEQ ID NO: 7478517 - DNA, 22 bp, Homo sapiens
agtttatgtgtaagacagctgt

SEQ ID NO: 7478518 - DNA, 22 bp, Homo sapiens
agtttatgtctttacttcagct

SEQ ID NO: 7478519 - DNA, 20 bp, Homo sapiens
agtttattccaggagaactg

SEQ ID NO: 7478520 - DNA, 20 bp, Homo sapiens
agtttattccaggagaactg

SEQ ID NO: 7478521 - DNA, 20 bp, Homo sapiens
agtttattccaggagaactg

SEQ ID NO: 7478522 - DNA, 19 bp, Homo sapiens
agtttattataggtgattc

SEQ ID NO: 7478523 - DNA, 19 bp, Homo sapiens
agtttattataggtgattc

SEQ ID NO: 7478524 - DNA, 19 bp, Homo sapiens
agtttattataggtgattc

SEQ ID NO: 7478525 - DNA, 22 bp, Homo sapiens
agtttacaacagtagctatgga

SEQ ID NO: 7478526 - DNA, 22 bp, Homo sapiens
agtttacaacagtagctatgga

SEQ ID NO: 7478527 - DNA, 22 bp, Homo sapiens
agtttacaacagtagctatgga

SEQ ID NO: 7478528 - DNA, 21 bp, Homo sapiens
agtttacaactgtccagcccc

SEQ ID NO: 7478529 - DNA, 22 bp, Homo sapiens
agtttatgtaaaattagtaatg

SEQ ID NO: 7478530 - DNA, 22 bp, Homo sapiens
agtgttctagcgctgtgcttgt

SEQ ID NO: 7478531 - DNA, 22 bp, Homo sapiens
agtgttctagcgctgtgcttgt

SEQ ID NO: 7478532 - DNA, 22 bp, Homo sapiens
agtgttctcagctactagagag

SEQ ID NO: 7478533 - DNA, 22 bp, Homo sapiens
agtttacaacagtagctatgga

SEQ ID NO: 7478534 - DNA, 22 bp, Homo sapiens
agtttacaacagtagctatgga

SEQ ID NO: 7478535 - DNA, 22 bp, Homo sapiens
agtttacaacagtagctatgga

SEQ ID NO: 7478536 - DNA, 22 bp, Homo sapiens
agtttacaacagtagctatgga

SEQ ID NO: 7478537 - DNA, 22 bp, Homo sapiens
agtttacaacagtagctatgga

SEQ ID NO: 7478538 - DNA, 22 bp, Homo sapiens
agtgttcatttattcattcact

SEQ ID NO: 7478539 - DNA, 22 bp, Homo sapiens
agtgttccttgctttcccagag

SEQ ID NO: 7478540 - DNA, 22 bp, Homo sapiens
agtgttctaacaactgctttca

SEQ ID NO: 7478541 - DNA, 22 bp, Homo sapiens
agtgttctaacaactgctttca

SEQ ID NO: 7478542 - DNA, 22 bp, Homo sapiens
agtgttcctgctctcaggaagc

SEQ ID NO: 7478543 - DNA, 22 bp, Homo sapiens
agtgttccacacatctggggaa

SEQ ID NO: 7478544 - DNA, 23 bp, Homo sapiens
agtgttccagttggttgagagtg

SEQ ID NO: 7478545 - DNA, 22 bp, Homo sapiens
agtgttagtggctgcagctggt

SEQ ID NO: 7478546 - DNA, 22 bp, Homo sapiens
agtgttagtggctgcagctggt

SEQ ID NO: 7478547 - DNA, 22 bp, Homo sapiens
agtgttatttattgtttcataa

SEQ ID NO: 7478548 - DNA, 21 bp, Homo sapiens
agtgttataggagcagggaaa

SEQ ID NO: 7478549 - DNA, 23 bp, Homo sapiens
agtgttcagcatgtagtaaatac

SEQ ID NO: 7478550 - DNA, 22 bp, Homo sapiens
agtgttcactctgtggagccca

SEQ ID NO: 7478551 - DNA, 23 bp, Homo sapiens
agtgttcagcatgtagtaaatac

SEQ ID NO: 7478552 - DNA, 22 bp, Homo sapiens
agtgttcactctgtggagccca

SEQ ID NO: 7478553 - DNA, 22 bp, Homo sapiens
agtgttcactctgtggagccca

SEQ ID NO: 7478554 - DNA, 23 bp, Homo sapiens
agtgttcagcatgtagtaaatac

SEQ ID NO: 7478555 - DNA, 22 bp, Homo sapiens
agtgttcaggatctgaggccag

SEQ ID NO: 7478556 - DNA, 22 bp, Homo sapiens
agtgttcagtgattgtcaaccg

SEQ ID NO: 7478557 - DNA, 22 bp, Homo sapiens
agtgttcagtgattgtcaaccg

SEQ ID NO: 7478558 - DNA, 22 bp, Homo sapiens
agtgttcagtgattgtcaaccg

SEQ ID NO: 7478559 - DNA, 22 bp, Homo sapiens
ctgagaggcggaggttgcagtg

SEQ ID NO: 7478560 - DNA, 22 bp, Homo sapiens
agtgttaagagaaaattctgct

SEQ ID NO: 7478561 - DNA, 22 bp, Homo sapiens
ctgagaggcggaggttgcagtg

SEQ ID NO: 7478562 - DNA, 22 bp, Homo sapiens
agtgttaagagaaaattctgct

SEQ ID NO: 7478563 - DNA, 22 bp, Homo sapiens
ctgagaggcggaggttgcagtg

SEQ ID NO: 7478564 - DNA, 22 bp, Homo sapiens
ctgagaggcggaggttgcagtg

SEQ ID NO: 7478565 - DNA, 22 bp, Homo sapiens
agtgttaaggctggttgctata

SEQ ID NO: 7478566 - DNA, 22 bp, Homo sapiens
agtgttaagagaaaattctgct

SEQ ID NO: 7478567 - DNA, 18 bp, Homo sapiens
agtgttaagtaagtagca

SEQ ID NO: 7478568 - DNA, 18 bp, Homo sapiens
agtgttaagtaagtagca

SEQ ID NO: 7478569 - DNA, 18 bp, Homo sapiens
agtgttaagtaagtagca

SEQ ID NO: 7478570 - DNA, 22 bp, Homo sapiens
agtgttaatggtgtatattagg

SEQ ID NO: 7478571 - DNA, 22 bp, Homo sapiens
agtgttaatggtgtatattagg

SEQ ID NO: 7478572 - DNA, 22 bp, Homo sapiens
agtgttaatggtgtatattagg

SEQ ID NO: 7478573 - DNA, 22 bp, Homo sapiens
agtgttaatggtgtatattagg

SEQ ID NO: 7478574 - DNA, 21 bp, Homo sapiens
agtgttaatggaaattatatt

SEQ ID NO: 7478575 - DNA, 21 bp, Homo sapiens
agtgttaatggaaattatatt

SEQ ID NO: 7478576 - DNA, 22 bp, Homo sapiens
agtgttacattagccggggcca

SEQ ID NO: 7478577 - DNA, 22 bp, Homo sapiens
agtgttactacagactggttaa

SEQ ID NO: 7478578 - DNA, 22 bp, Homo sapiens
agtgttactacagactggttaa

SEQ ID NO: 7478579 - DNA, 22 bp, Homo sapiens
agtgttactcagttttgtccag

SEQ ID NO: 7478580 - DNA, 22 bp, Homo sapiens
agtgttactggttcatgaatct

SEQ ID NO: 7478581 - DNA, 22 bp, Homo sapiens
agtgttactggttcatgaatct

SEQ ID NO: 7478582 - DNA, 22 bp, Homo sapiens
agtgttactggttcatgaatct

SEQ ID NO: 7478583 - DNA, 22 bp, Homo sapiens
ctgatattctttgagctgctaa

SEQ ID NO: 7478584 - DNA, 22 bp, Homo sapiens
ctgatatttctcttaacactag

SEQ ID NO: 7478585 - DNA, 22 bp, Homo sapiens
ctgatatttctcttaacactag

SEQ ID NO: 7478586 - DNA, 22 bp, Homo sapiens
ctgatattcttgaaatcatggt

SEQ ID NO: 7478587 - DNA, 22 bp, Homo sapiens
ctgatattctattttgcttgct

SEQ ID NO: 7478588 - DNA, 22 bp, Homo sapiens
ctgatattcattatggagctcc

SEQ ID NO: 7478589 - DNA, 22 bp, Homo sapiens
ctgatattattgaagctggagt

SEQ ID NO: 7478590 - DNA, 22 bp, Homo sapiens
ctgatattaacaggcaagtgag

SEQ ID NO: 7478591 - DNA, 22 bp, Homo sapiens
ctgatatggtaactgtgtttct

SEQ ID NO: 7478592 - DNA, 22 bp, Homo sapiens
ctgatattaacaggcaagtgag

SEQ ID NO: 7478593 - DNA, 20 bp, Homo sapiens
agtttgtgtgtctatgcgct

SEQ ID NO: 7478594 - DNA, 22 bp, Homo sapiens
agtttgtatgccaacagcaaag

SEQ ID NO: 7478595 - DNA, 22 bp, Homo sapiens
agtttgtctgtcttcaaagcct

SEQ ID NO: 7478596 - DNA, 22 bp, Homo sapiens
agttttatgttcacagaaggat

SEQ ID NO: 7478597 - DNA, 22 bp, Homo sapiens
agttttatgttcacagaaggat

SEQ ID NO: 7478598 - DNA, 22 bp, Homo sapiens
agttttatgttcacagaaggat

SEQ ID NO: 7478599 - DNA, 22 bp, Homo sapiens
agttttatgttcacagaaggat

SEQ ID NO: 7478600 - DNA, 22 bp, Homo sapiens
agttttattaaatccacagaag

SEQ ID NO: 7478601 - DNA, 22 bp, Homo sapiens
agttttatgttcacagaaggat

SEQ ID NO: 7478602 - DNA, 22 bp, Homo sapiens
agttttatgttcacagaaggat

SEQ ID NO: 7478603 - DNA, 22 bp, Homo sapiens
agttttcaatatatgatagtga

SEQ ID NO: 7478604 - DNA, 22 bp, Homo sapiens
agttttattgtcccagaggtga

SEQ ID NO: 7478605 - DNA, 22 bp, Homo sapiens
agttttattgtcccagaggtga

SEQ ID NO: 7478606 - DNA, 22 bp, Homo sapiens
agttttattgtcccagaggtga

SEQ ID NO: 7478607 - DNA, 22 bp, Homo sapiens
agttttattgtcccagaggtga

SEQ ID NO: 7478608 - DNA, 22 bp, Homo sapiens
agttttattgtcccagaggtga

SEQ ID NO: 7478609 - DNA, 22 bp, Homo sapiens
agttttattgtcccagaggtga

SEQ ID NO: 7478610 - DNA, 22 bp, Homo sapiens
agttttattccaatgtgcagca

SEQ ID NO: 7478611 - DNA, 22 bp, Homo sapiens
agttttattccaatgtgcagca

SEQ ID NO: 7478612 - DNA, 22 bp, Homo sapiens
agttttattccaatgtgcagca

SEQ ID NO: 7478613 - DNA, 22 bp, Homo sapiens
agttttattccaatgtgcagca

SEQ ID NO: 7478614 - DNA, 22 bp, Homo sapiens
agttttattccaatgtgcagca

SEQ ID NO: 7478615 - DNA, 22 bp, Homo sapiens
agttttattccaatgtgcagca

SEQ ID NO: 7478616 - DNA, 22 bp, Homo sapiens
agttttattccaatgtgcagca

SEQ ID NO: 7478617 - DNA, 22 bp, Homo sapiens
agttttattaaatccacagaag

SEQ ID NO: 7478618 - DNA, 22 bp, Homo sapiens
agttttattaaatccacagaag

SEQ ID NO: 7478619 - DNA, 22 bp, Homo sapiens
agttttattaaatccacagaag

SEQ ID NO: 7478620 - DNA, 22 bp, Homo sapiens
agttttattaaatccacagaag

SEQ ID NO: 7478621 - DNA, 22 bp, Homo sapiens
agttttattccaatgtgcagca

SEQ ID NO: 7478622 - DNA, 22 bp, Homo sapiens
agttttattaaatccacagaag

SEQ ID NO: 7478623 - DNA, 22 bp, Homo sapiens
agttttattaaatccacagaag

SEQ ID NO: 7478624 - DNA, 22 bp, Homo sapiens
ctgagtgggtttctgcttgtca

SEQ ID NO: 7478625 - DNA, 22 bp, Homo sapiens
ctgagtgggtttctgcttgtca

SEQ ID NO: 7478626 - DNA, 22 bp, Homo sapiens
ctgagtggaacataggatgata

SEQ ID NO: 7478627 - DNA, 18 bp, Homo sapiens
ctgagtgatgatggggtg

SEQ ID NO: 7478628 - DNA, 22 bp, Homo sapiens
ctgagtggaacataggatgata

SEQ ID NO: 7478629 - DNA, 22 bp, Homo sapiens
ctgagtgatagcgatggggaac

SEQ ID NO: 7478630 - DNA, 22 bp, Homo sapiens
ctgagtgaggggagcttgatgg

SEQ ID NO: 7478631 - DNA, 22 bp, Homo sapiens
ctgagtgaggggagcttgatgg

SEQ ID NO: 7478632 - DNA, 22 bp, Homo sapiens
ctgagttctgcccaaggtctgg

SEQ ID NO: 7478633 - DNA, 22 bp, Homo sapiens
ctgagttctgcccaaggtctgg

SEQ ID NO: 7478634 - DNA, 22 bp, Homo sapiens
ctgagtgttttcagccacggcc

SEQ ID NO: 7478635 - DNA, 22 bp, Homo sapiens
ctgagtgttttcagccacggcc

SEQ ID NO: 7478636 - DNA, 21 bp, Homo sapiens
ctgataattgttaaattattt

SEQ ID NO: 7478637 - DNA, 21 bp, Homo sapiens
ctgataattgttaaattattt

SEQ ID NO: 7478638 - DNA, 21 bp, Homo sapiens
ctgataattgttaaattattt

SEQ ID NO: 7478639 - DNA, 22 bp, Homo sapiens
ctgagtttccagataagacctt

SEQ ID NO: 7478640 - DNA, 22 bp, Homo sapiens
ctgataatgtcctgcagtaaat

SEQ ID NO: 7478641 - DNA, 22 bp, Homo sapiens
ctgatacatagtagcatgtcat

SEQ ID NO: 7478642 - DNA, 22 bp, Homo sapiens
ctgatacactccctaaaatata

SEQ ID NO: 7478643 - DNA, 22 bp, Homo sapiens
ctgatacatagtagcatgtcat

SEQ ID NO: 7478644 - DNA, 22 bp, Homo sapiens
ctgatacatagtagcatgtcat

SEQ ID NO: 7478645 - DNA, 22 bp, Homo sapiens
ctgatatgacctggattttata

SEQ ID NO: 7478646 - DNA, 22 bp, Homo sapiens
ctgatatgatgggtgattttca

SEQ ID NO: 7478647 - DNA, 22 bp, Homo sapiens
ctgatatggatgcctcattgtc

SEQ ID NO: 7478648 - DNA, 22 bp, Homo sapiens
ctgatagacaatcaccatggga

SEQ ID NO: 7478649 - DNA, 22 bp, Homo sapiens
ctgataatgtcctgcagtaaat

SEQ ID NO: 7478650 - DNA, 22 bp, Homo sapiens
ctgatacaatgctaataaattt

SEQ ID NO: 7478651 - DNA, 22 bp, Homo sapiens
ctgataatttcaaaaatcttca

SEQ ID NO: 7478652 - DNA, 22 bp, Homo sapiens
ctgatacaatgctaataaattt

SEQ ID NO: 7478653 - DNA, 22 bp, Homo sapiens
ctgatacaatgctaataaattt

SEQ ID NO: 7478654 - DNA, 22 bp, Homo sapiens
ctgatacactccctaaaatata

SEQ ID NO: 7478655 - DNA, 22 bp, Homo sapiens
ctgatacactccctaaaatata

SEQ ID NO: 7478656 - DNA, 22 bp, Homo sapiens
ctgatacaatgtctgctttata

SEQ ID NO: 7478657 - DNA, 22 bp, Homo sapiens
agtttctagcctcactgtttag

SEQ ID NO: 7478658 - DNA, 22 bp, Homo sapiens
agtttctatgtaagctacgtga

SEQ ID NO: 7478659 - DNA, 22 bp, Homo sapiens
agtttctagcctcactgtttag

SEQ ID NO: 7478660 - DNA, 22 bp, Homo sapiens
agtttctagcctcactgtttag

SEQ ID NO: 7478661 - DNA, 22 bp, Homo sapiens
agtttctatgtaagctacgtga

SEQ ID NO: 7478662 - DNA, 22 bp, Homo sapiens
agtttcatgtagccatatttac

SEQ ID NO: 7478663 - DNA, 22 bp, Homo sapiens
agtttcatgtagccatatttac

SEQ ID NO: 7478664 - DNA, 22 bp, Homo sapiens
agtttctagcaaggattgttga

SEQ ID NO: 7478665 - DNA, 22 bp, Homo sapiens
agtttcatgagacagattttca

SEQ ID NO: 7478666 - DNA, 22 bp, Homo sapiens
agtttcatgagacagattttca

SEQ ID NO: 7478667 - DNA, 22 bp, Homo sapiens
agtttctctagagtctttgaaa

SEQ ID NO: 7478668 - DNA, 22 bp, Homo sapiens
agtttctattttcatgtctgtt

SEQ ID NO: 7478669 - DNA, 22 bp, Homo sapiens
agtttctatgtgaaatgcacat

SEQ ID NO: 7478670 - DNA, 22 bp, Homo sapiens
agtttctctagagtctttgaaa

SEQ ID NO: 7478671 - DNA, 22 bp, Homo sapiens
agtttctctagagtctttgaaa

SEQ ID NO: 7478672 - DNA, 22 bp, Homo sapiens
agtttctctcagtatagaatag

SEQ ID NO: 7478673 - DNA, 22 bp, Homo sapiens
agtttctctcagtatagaatag

SEQ ID NO: 7478674 - DNA, 22 bp, Homo sapiens
agtttctcttaatctagtatct

SEQ ID NO: 7478675 - DNA, 21 bp, Homo sapiens
agtttcaggaagttcagctgc

SEQ ID NO: 7478676 - DNA, 22 bp, Homo sapiens
agtttcagaatttatgcagaca

SEQ ID NO: 7478677 - DNA, 22 bp, Homo sapiens
agtttcacatgcatggatgtgt

SEQ ID NO: 7478678 - DNA, 22 bp, Homo sapiens
agtttcacatagctcagtgctc

SEQ ID NO: 7478679 - DNA, 22 bp, Homo sapiens
agtttcacatagctcagtgctc

SEQ ID NO: 7478680 - DNA, 22 bp, Homo sapiens
agtttcacatagctcagtgctc

SEQ ID NO: 7478681 - DNA, 22 bp, Homo sapiens
agtttcatattaccatgtcacc

SEQ ID NO: 7478682 - DNA, 22 bp, Homo sapiens
agtttcatattaccatgtcacc

SEQ ID NO: 7478683 - DNA, 22 bp, Homo sapiens
agtttcatattaccatgtcacc

SEQ ID NO: 7478684 - DNA, 22 bp, Homo sapiens
agtttcatattaccatgtcacc

SEQ ID NO: 7478685 - DNA, 22 bp, Homo sapiens
agtttcatccgatctggtctca

SEQ ID NO: 7478686 - DNA, 22 bp, Homo sapiens
agtttcagttctgtcatttata

SEQ ID NO: 7478687 - DNA, 22 bp, Homo sapiens
agtttcagtgttgacagatggt

SEQ ID NO: 7478688 - DNA, 20 bp, Homo sapiens
agtttcagggagtcccatct

SEQ ID NO: 7478689 - DNA, 18 bp, Homo sapiens
agtttcagggcaggaaac

SEQ ID NO: 7478690 - DNA, 22 bp, Homo sapiens
agtttcagtgttgacagatggt

SEQ ID NO: 7478691 - DNA, 22 bp, Homo sapiens
agtttctttagatagaaagttc

SEQ ID NO: 7478692 - DNA, 22 bp, Homo sapiens
agtttctttagatagaaagttc

SEQ ID NO: 7478693 - DNA, 22 bp, Homo sapiens
ctgagtctcccggcagtggagg

SEQ ID NO: 7478694 - DNA, 22 bp, Homo sapiens
ctgagtctcccggcagtggagg

SEQ ID NO: 7478695 - DNA, 22 bp, Homo sapiens
ctgagtctgtacgttagccata

SEQ ID NO: 7478696 - DNA, 22 bp, Homo sapiens
ctgagtgaaagaagccagacat

SEQ ID NO: 7478697 - DNA, 22 bp, Homo sapiens
agtttcttgaagactgatgttt

SEQ ID NO: 7478698 - DNA, 22 bp, Homo sapiens
agtttcttgaagactgatgttt

SEQ ID NO: 7478699 - DNA, 22 bp, Homo sapiens
agtttcttgccgtgctttccat

SEQ ID NO: 7478700 - DNA, 22 bp, Homo sapiens
agtttcttgaagactgatgttt

SEQ ID NO: 7478701 - DNA, 22 bp, Homo sapiens
agtttcttgaagactgatgttt

SEQ ID NO: 7478702 - DNA, 22 bp, Homo sapiens
agtttcttgaagactgatgttt

SEQ ID NO: 7478703 - DNA, 22 bp, Homo sapiens
agtttcttggtcacagttttca

SEQ ID NO: 7478704 - DNA, 22 bp, Homo sapiens
agtttcttgccgtgctttccat

SEQ ID NO: 7478705 - DNA, 22 bp, Homo sapiens
agtttcttggtcacagttttca

SEQ ID NO: 7478706 - DNA, 22 bp, Homo sapiens
agtttctttagatagaaagttc

SEQ ID NO: 7478707 - DNA, 22 bp, Homo sapiens
agtttctttagatagaaagttc

SEQ ID NO: 7478708 - DNA, 22 bp, Homo sapiens
agtttctttagatagaaagttc

SEQ ID NO: 7478709 - DNA, 22 bp, Homo sapiens
agtttctgcaaatcatttttat

SEQ ID NO: 7478710 - DNA, 22 bp, Homo sapiens
agtttcttattcttagttatgt

SEQ ID NO: 7478711 - DNA, 22 bp, Homo sapiens
agtttcttattcttagttatgt

SEQ ID NO: 7478712 - DNA, 22 bp, Homo sapiens
agtttcttcatccaaaaaatgg

SEQ ID NO: 7478713 - DNA, 22 bp, Homo sapiens
agtttcttcatccaaaaaatgg

SEQ ID NO: 7478714 - DNA, 22 bp, Homo sapiens
agtttcttcatccaaaaaatgg

SEQ ID NO: 7478715 - DNA, 22 bp, Homo sapiens
agtttctctttgacaccaaaat

SEQ ID NO: 7478716 - DNA, 22 bp, Homo sapiens
agtttctctttgacaccaaaat

SEQ ID NO: 7478717 - DNA, 22 bp, Homo sapiens
agtttctgcaaatcatttttat

SEQ ID NO: 7478718 - DNA, 22 bp, Homo sapiens
agtttctgtgactcttggcata

SEQ ID NO: 7478719 - DNA, 22 bp, Homo sapiens
agtttctgttaccatatttgac

SEQ ID NO: 7478720 - DNA, 22 bp, Homo sapiens
ctgccctgtctttttctgatga

SEQ ID NO: 7478721 - DNA, 22 bp, Homo sapiens
ctgccctgtctttttctgatga

SEQ ID NO: 7478722 - DNA, 22 bp, Homo sapiens
ctgccctgtctgcagcctggct

SEQ ID NO: 7478723 - DNA, 22 bp, Homo sapiens
ctgccctgtctgcagcctggct

SEQ ID NO: 7478724 - DNA, 22 bp, Homo sapiens
ctgccctgtctgcagcctggct

SEQ ID NO: 7478725 - DNA, 22 bp, Homo sapiens
ctgccctgtatcttctcccaat

SEQ ID NO: 7478726 - DNA, 22 bp, Homo sapiens
ctgccctgtatcttctcccaat

SEQ ID NO: 7478727 - DNA, 22 bp, Homo sapiens
ctgccctgtagctgttctagca

SEQ ID NO: 7478728 - DNA, 22 bp, Homo sapiens
ctgccctgtagctgttctagca

SEQ ID NO: 7478729 - DNA, 22 bp, Homo sapiens
ctgccctgtccttcccgccggc

SEQ ID NO: 7478730 - DNA, 22 bp, Homo sapiens
ctgccctgtccttcccgccggc

SEQ ID NO: 7478731 - DNA, 22 bp, Homo sapiens
ctgccctgtccttcccgccggc

SEQ ID NO: 7478732 - DNA, 22 bp, Homo sapiens
ctgccctgtatcttctcccaat

SEQ ID NO: 7478733 - DNA, 22 bp, Homo sapiens
ctgccctgtatcttctcccaat

SEQ ID NO: 7478734 - DNA, 22 bp, Homo sapiens
ctgccctgtggctctgagtcat

SEQ ID NO: 7478735 - DNA, 22 bp, Homo sapiens
ctgccctgtggctctgagtcat

SEQ ID NO: 7478736 - DNA, 22 bp, Homo sapiens
ctgccctgtggctctgagtcat

SEQ ID NO: 7478737 - DNA, 22 bp, Homo sapiens
ctgccctgtgcacaggaaactg

SEQ ID NO: 7478738 - DNA, 22 bp, Homo sapiens
ctgccctgtgcacaggaaactg

SEQ ID NO: 7478739 - DNA, 22 bp, Homo sapiens
ctgccctgtgcacaggaaactg

SEQ ID NO: 7478740 - DNA, 22 bp, Homo sapiens
ctgccctgtgagggtccttggg

SEQ ID NO: 7478741 - DNA, 22 bp, Homo sapiens
ctgccctgtgagggtccttggg

SEQ ID NO: 7478742 - DNA, 22 bp, Homo sapiens
ctgccctgtgagggtccttggg

SEQ ID NO: 7478743 - DNA, 22 bp, Homo sapiens
ctgccctgtgagggtccttggg

SEQ ID NO: 7478744 - DNA, 22 bp, Homo sapiens
ctgccctgtgagggtccttggg

SEQ ID NO: 7478745 - DNA, 22 bp, Homo sapiens
ctgccctgtgagggtccttggg

SEQ ID NO: 7478746 - DNA, 22 bp, Homo sapiens
ataagtgctgtgctttaagact

SEQ ID NO: 7478747 - DNA, 22 bp, Homo sapiens
ataagtgctgattagctcttca

SEQ ID NO: 7478748 - DNA, 22 bp, Homo sapiens
ataagtgcttgttgaataatag

SEQ ID NO: 7478749 - DNA, 22 bp, Homo sapiens
ataagttcaggtaaagaaatca

SEQ ID NO: 7478750 - DNA, 19 bp, Homo sapiens
ataagttcaactggaccca

SEQ ID NO: 7478751 - DNA, 22 bp, Homo sapiens
ataagtttgtctttgtaaagat

SEQ ID NO: 7478752 - DNA, 22 bp, Homo sapiens
ataagtttgtctttgtaaagat

SEQ ID NO: 7478753 - DNA, 22 bp, Homo sapiens
ataagtttgtctttgtaaagat

SEQ ID NO: 7478754 - DNA, 22 bp, Homo sapiens
ataagtttgtctttgtaaagat

SEQ ID NO: 7478755 - DNA, 22 bp, Homo sapiens
ataagtttgtctttgtaaagat

SEQ ID NO: 7478756 - DNA, 22 bp, Homo sapiens
ataataaaccaggatgggtctg

SEQ ID NO: 7478757 - DNA, 22 bp, Homo sapiens
ataataaaccaggatgggtctg

SEQ ID NO: 7478758 - DNA, 22 bp, Homo sapiens
ataataaaccaggatgggtctg

SEQ ID NO: 7478759 - DNA, 22 bp, Homo sapiens
ataataaaccaggatgggtctg

SEQ ID NO: 7478760 - DNA, 22 bp, Homo sapiens
ataataaaccaggatgggtctg

SEQ ID NO: 7478761 - DNA, 22 bp, Homo sapiens
ctgccctgtggctctgagtcat

SEQ ID NO: 7478762 - DNA, 22 bp, Homo sapiens
ctgccctgtttggacagcccgg

SEQ ID NO: 7478763 - DNA, 22 bp, Homo sapiens
ctgccctgtttggacagcccgg

SEQ ID NO: 7478764 - DNA, 22 bp, Homo sapiens
ctgccctgtggttgtgggttct

SEQ ID NO: 7478765 - DNA, 22 bp, Homo sapiens
ataagcatttcacaggtgtgtt

SEQ ID NO: 7478766 - DNA, 22 bp, Homo sapiens
ctgccctgtttggacagcccgg

SEQ ID NO: 7478767 - DNA, 22 bp, Homo sapiens
ataagtgatatttagctataga

SEQ ID NO: 7478768 - DNA, 22 bp, Homo sapiens
ataagtgactgcagggaattca

SEQ ID NO: 7478769 - DNA, 23 bp, Homo sapiens
ataagccttttctttctgcccca

SEQ ID NO: 7478770 - DNA, 23 bp, Homo sapiens
ataagccttttctttctgcccca

SEQ ID NO: 7478771 - DNA, 22 bp, Homo sapiens
ataagctctggacagccacatt

SEQ ID NO: 7478772 - DNA, 22 bp, Homo sapiens
ataagcatttcacaggtgtgtt

SEQ ID NO: 7478773 - DNA, 22 bp, Homo sapiens
ataagccataatttctgccttt

SEQ ID NO: 7478774 - DNA, 22 bp, Homo sapiens
ataagcctgattcacttgtcat

SEQ ID NO: 7478775 - DNA, 22 bp, Homo sapiens
ataataatgaaagccactgtgt

SEQ ID NO: 7478776 - DNA, 22 bp, Homo sapiens
ataataatgaaagccactgtgt

SEQ ID NO: 7478777 - DNA, 22 bp, Homo sapiens
ataataactcctgttgaagaac

SEQ ID NO: 7478778 - DNA, 22 bp, Homo sapiens
ataataacacctgaataggaaa

SEQ ID NO: 7478779 - DNA, 22 bp, Homo sapiens
ataataacacctgaataggaaa

SEQ ID NO: 7478780 - DNA, 22 bp, Homo sapiens
ataataacacctgaataggaaa

SEQ ID NO: 7478781 - DNA, 23 bp, Homo sapiens
ataataacgtctgtcttgtctct

SEQ ID NO: 7478782 - DNA, 22 bp, Homo sapiens
ataataacacctgaataggaaa

SEQ ID NO: 7478783 - DNA, 23 bp, Homo sapiens
ataataacgtctgtcttgtctct

SEQ ID NO: 7478784 - DNA, 22 bp, Homo sapiens
ataataaaccaggatgggtctg

SEQ ID NO: 7478785 - DNA, 22 bp, Homo sapiens
ataataaaccaggatgggtctg

SEQ ID NO: 7478786 - DNA, 22 bp, Homo sapiens
ataataaaccaggatgggtctg

SEQ ID NO: 7478787 - DNA, 22 bp, Homo sapiens
ataataacaatgccagatgcct

SEQ ID NO: 7478788 - DNA, 22 bp, Homo sapiens
ataataacacctgaataggaaa

SEQ ID NO: 7478789 - DNA, 22 bp, Homo sapiens
ataataaaccaggatgggtctg

SEQ ID NO: 7478790 - DNA, 22 bp, Homo sapiens
ataataacaatgccagatgcct

SEQ ID NO: 7478791 - DNA, 22 bp, Homo sapiens
ataataaaccaggatgggtctg

SEQ ID NO: 7478792 - DNA, 22 bp, Homo sapiens
ataataaaccaggatgggtctg

SEQ ID NO: 7478793 - DNA, 23 bp, Homo sapiens
ataataattatggcagcaaagtg

SEQ ID NO: 7478794 - DNA, 18 bp, Homo sapiens
ctgcctgctctccagctt

SEQ ID NO: 7478795 - DNA, 22 bp, Homo sapiens
ctgcctgctctatccaggcctg

SEQ ID NO: 7478796 - DNA, 22 bp, Homo sapiens
ataatacatggttaacctcttt

SEQ ID NO: 7478797 - DNA, 22 bp, Homo sapiens
ataatacatggttaacctcttt

SEQ ID NO: 7478798 - DNA, 18 bp, Homo sapiens
ctgcctgctctccagctt

SEQ ID NO: 7478799 - DNA, 18 bp, Homo sapiens
ctgcctgctctccagctt

SEQ ID NO: 7478800 - DNA, 18 bp, Homo sapiens
ctgcctgctctccagctt

SEQ ID NO: 7478801 - DNA, 18 bp, Homo sapiens
ctgcctgctctccagctt

SEQ ID NO: 7478802 - DNA, 18 bp, Homo sapiens
ctgcctgctctccagctt

SEQ ID NO: 7478803 - DNA, 18 bp, Homo sapiens
ctgcctgctctccagctt

SEQ ID NO: 7478804 - DNA, 18 bp, Homo sapiens
ctgcctgctctccagctt

SEQ ID NO: 7478805 - DNA, 23 bp, Homo sapiens
ataataattatggcagcaaagtg

SEQ ID NO: 7478806 - DNA, 23 bp, Homo sapiens
ataataattatggcagcaaagtg

SEQ ID NO: 7478807 - DNA, 23 bp, Homo sapiens
ataataattatggcagcaaagtg

SEQ ID NO: 7478808 - DNA, 23 bp, Homo sapiens
ataataattatggcagcaaagtg

SEQ ID NO: 7478809 - DNA, 23 bp, Homo sapiens
ataataattatggcagcaaagtg

SEQ ID NO: 7478810 - DNA, 23 bp, Homo sapiens
ataataattatggcagcaaagtg

SEQ ID NO: 7478811 - DNA, 23 bp, Homo sapiens
ataataattatggcagcaaagtg

SEQ ID NO: 7478812 - DNA, 23 bp, Homo sapiens
ataataattatggcagcaaagtg

SEQ ID NO: 7478813 - DNA, 23 bp, Homo sapiens
ataataattatggcagcaaagtg

SEQ ID NO: 7478814 - DNA, 22 bp, Homo sapiens
ataataatgaaagccactgtgt

SEQ ID NO: 7478815 - DNA, 22 bp, Homo sapiens
ataataatgaaagccactgtgt

SEQ ID NO: 7478816 - DNA, 22 bp, Homo sapiens
ataataatactgtgcaatggat

SEQ ID NO: 7478817 - DNA, 22 bp, Homo sapiens
ataataatgaaagccactgtgt

SEQ ID NO: 7478818 - DNA, 22 bp, Homo sapiens
ctgcctgctgcctgtggagggt

SEQ ID NO: 7478819 - DNA, 22 bp, Homo sapiens
ctgcctgctgcctgtggagggt

SEQ ID NO: 7478820 - DNA, 22 bp, Homo sapiens
ctgcctgctgccctccagagcc

SEQ ID NO: 7478821 - DNA, 22 bp, Homo sapiens
ctgcctgctgccctccagagcc

SEQ ID NO: 7478822 - DNA, 22 bp, Homo sapiens
ctgcctgctgccctccagagcc

SEQ ID NO: 7478823 - DNA, 22 bp, Homo sapiens
ctgcctgctgccctccagagcc

SEQ ID NO: 7478824 - DNA, 22 bp, Homo sapiens
ctgcctgctgccctccagagcc

SEQ ID NO: 7478825 - DNA, 22 bp, Homo sapiens
ctgcctgctgccctccagagcc

SEQ ID NO: 7478826 - DNA, 22 bp, Homo sapiens
ctgcctgctgattagtattgtc

SEQ ID NO: 7478827 - DNA, 22 bp, Homo sapiens
ctgcctgctgattagtattgtc

SEQ ID NO: 7478828 - DNA, 22 bp, Homo sapiens
ctgcctgctgccctccagagcc

SEQ ID NO: 7478829 - DNA, 22 bp, Homo sapiens
ctgcctgctgccctccagagcc

SEQ ID NO: 7478830 - DNA, 18 bp, Homo sapiens
ctgcctgctctccagctt

SEQ ID NO: 7478831 - DNA, 23 bp, Homo sapiens
ctgcctgctggggagacagatct

SEQ ID NO: 7478832 - DNA, 22 bp, Homo sapiens
ctgcctgcttaccatgcatcag

SEQ ID NO: 7478833 - DNA, 23 bp, Homo sapiens
ctgcctgctggggagacagatct

SEQ ID NO: 7478834 - DNA, 23 bp, Homo sapiens
ctgcctgctggggagacagatct

SEQ ID NO: 7478835 - DNA, 23 bp, Homo sapiens
ctgcctgctggggagacagatct

SEQ ID NO: 7478836 - DNA, 22 bp, Homo sapiens
ctgcctgcttaccatgcatcag

SEQ ID NO: 7478837 - DNA, 22 bp, Homo sapiens
ctgcctgcttaccatgcatcag

SEQ ID NO: 7478838 - DNA, 22 bp, Homo sapiens
ctgcctgcttaccatgcatcag

SEQ ID NO: 7478839 - DNA, 22 bp, Homo sapiens
ctgcctgcttctgagccagagg

SEQ ID NO: 7478840 - DNA, 22 bp, Homo sapiens
ctgcctgcttctgagccagagg

SEQ ID NO: 7478841 - DNA, 22 bp, Homo sapiens
ctgcctgcttctgagccagagg

SEQ ID NO: 7478842 - DNA, 22 bp, Homo sapiens
ctgcctgcttctgagccagagg

SEQ ID NO: 7478843 - DNA, 22 bp, Homo sapiens
ctgcctgcttttctgggagccg

SEQ ID NO: 7478844 - DNA, 22 bp, Homo sapiens
ctgcctgcttttctgggagccg

SEQ ID NO: 7478845 - DNA, 22 bp, Homo sapiens
ctgcctgcttttctgggagccg

SEQ ID NO: 7478846 - DNA, 22 bp, Homo sapiens
agttttcagtaaatattagtga

SEQ ID NO: 7478847 - DNA, 22 bp, Homo sapiens
agttttcagtaaatattagtga

SEQ ID NO: 7478848 - DNA, 22 bp, Homo sapiens
agttttcagtaaatattagtga

SEQ ID NO: 7478849 - DNA, 22 bp, Homo sapiens
agttttcagtaaatattagtga

SEQ ID NO: 7478850 - DNA, 22 bp, Homo sapiens
agttttcagggtttctgtcctc

SEQ ID NO: 7478851 - DNA, 22 bp, Homo sapiens
agttttcagggtttctgtcctc

SEQ ID NO: 7478852 - DNA, 22 bp, Homo sapiens
agttttcagtaaatattagtga

SEQ ID NO: 7478853 - DNA, 22 bp, Homo sapiens
agttttcagtaaatattagtga

SEQ ID NO: 7478854 - DNA, 22 bp, Homo sapiens
agttttcagtaaatattagtga

SEQ ID NO: 7478855 - DNA, 21 bp, Homo sapiens
agttttccattagggagggag

SEQ ID NO: 7478856 - DNA, 21 bp, Homo sapiens
agttttccattagggagggag

SEQ ID NO: 7478857 - DNA, 22 bp, Homo sapiens
agttttcattaccatgctgcaa

SEQ ID NO: 7478858 - DNA, 22 bp, Homo sapiens
agttttcaatatatgatagtga

SEQ ID NO: 7478859 - DNA, 22 bp, Homo sapiens
agttttcacactcaccaaaagg

SEQ ID NO: 7478860 - DNA, 20 bp, Homo sapiens
agttttcagcagaacaccca

SEQ ID NO: 7478861 - DNA, 22 bp, Homo sapiens
agttttcagaaattgcgaccca

SEQ ID NO: 7478862 - DNA, 22 bp, Homo sapiens
agttttcacactcaccaaaagg

SEQ ID NO: 7478863 - DNA, 20 bp, Homo sapiens
agttttcagcagaacaccca

SEQ ID NO: 7478864 - DNA, 22 bp, Homo sapiens
agttttctcacatcaaaaatga

SEQ ID NO: 7478865 - DNA, 22 bp, Homo sapiens
agttttctcacatcaaaaatga

SEQ ID NO: 7478866 - DNA, 22 bp, Homo sapiens
agttttctctgtgttctgctta

SEQ ID NO: 7478867 - DNA, 22 bp, Homo sapiens
agttttctctgtgttctgctta

SEQ ID NO: 7478868 - DNA, 22 bp, Homo sapiens
agttttctgacccctgctctat

SEQ ID NO: 7478869 - DNA, 22 bp, Homo sapiens
agttttctgacccctgctctat

SEQ ID NO: 7478870 - DNA, 22 bp, Homo sapiens
agttttctgacccctgctctat

SEQ ID NO: 7478871 - DNA, 22 bp, Homo sapiens
agttttctctgtgttctgctta

SEQ ID NO: 7478872 - DNA, 22 bp, Homo sapiens
agttttctctgtgttctgctta

SEQ ID NO: 7478873 - DNA, 22 bp, Homo sapiens
agttttctgacccctgctctat

SEQ ID NO: 7478874 - DNA, 22 bp, Homo sapiens
agttttctgacccctgctctat

SEQ ID NO: 7478875 - DNA, 22 bp, Homo sapiens
agttttctgacccctgctctat

SEQ ID NO: 7478876 - DNA, 21 bp, Homo sapiens
agttttctgagttataaaata

SEQ ID NO: 7478877 - DNA, 21 bp, Homo sapiens
agttttctgagttataaaata

SEQ ID NO: 7478878 - DNA, 21 bp, Homo sapiens
agttttctgagttataaaata

SEQ ID NO: 7478879 - DNA, 21 bp, Homo sapiens
agttttctgagttataaaata

SEQ ID NO: 7478880 - DNA, 22 bp, Homo sapiens
agttttcctttattgagtacca

SEQ ID NO: 7478881 - DNA, 22 bp, Homo sapiens
agttttctcacatcaaaaatga

SEQ ID NO: 7478882 - DNA, 22 bp, Homo sapiens
agttttctcacatcaaaaatga

SEQ ID NO: 7478883 - DNA, 22 bp, Homo sapiens
agttttctcacatcaaaaatga

SEQ ID NO: 7478884 - DNA, 22 bp, Homo sapiens
agttttcctttattgagtacca

SEQ ID NO: 7478885 - DNA, 22 bp, Homo sapiens
agttttcctggtcacagcttgg

SEQ ID NO: 7478886 - DNA, 22 bp, Homo sapiens
agttttcctggtcacagcttgg

SEQ ID NO: 7478887 - DNA, 22 bp, Homo sapiens
agttttcctctcatttatcaat

SEQ ID NO: 7478888 - DNA, 22 bp, Homo sapiens
agttttcctctcatttatcaat

SEQ ID NO: 7478889 - DNA, 22 bp, Homo sapiens
agttttcctctcatttatcaat

SEQ ID NO: 7478890 - DNA, 22 bp, Homo sapiens
agttttcctctcatttatcaat

SEQ ID NO: 7478891 - DNA, 22 bp, Homo sapiens
agttttctttcgcaaaggtaca

SEQ ID NO: 7478892 - DNA, 22 bp, Homo sapiens
agttttctttcgcaaaggtaca

SEQ ID NO: 7478893 - DNA, 22 bp, Homo sapiens
agttttctttcgcaaaggtaca

SEQ ID NO: 7478894 - DNA, 22 bp, Homo sapiens
agttttctttcatctatcagca

SEQ ID NO: 7478895 - DNA, 22 bp, Homo sapiens
agttttctttcatctatcagca

SEQ ID NO: 7478896 - DNA, 22 bp, Homo sapiens
agttttgaaatgaaatgtagtt

SEQ ID NO: 7478897 - DNA, 22 bp, Homo sapiens
agttttctttcgcaaaggtaca

SEQ ID NO: 7478898 - DNA, 22 bp, Homo sapiens
agttttctttcatctatcagca

SEQ ID NO: 7478899 - DNA, 22 bp, Homo sapiens
agttttctttcatctatcagca

SEQ ID NO: 7478900 - DNA, 22 bp, Homo sapiens
agttttctttcatctatcagca

SEQ ID NO: 7478901 - DNA, 22 bp, Homo sapiens
agttttctttcatctatcagca

SEQ ID NO: 7478902 - DNA, 22 bp, Homo sapiens
agttttcttcattttgtggcca

SEQ ID NO: 7478903 - DNA, 22 bp, Homo sapiens
agttttcttcattttgtggcca

SEQ ID NO: 7478904 - DNA, 22 bp, Homo sapiens
agttttcttcattttgtggcca

SEQ ID NO: 7478905 - DNA, 22 bp, Homo sapiens
agttttctgttctacaatttga

SEQ ID NO: 7478906 - DNA, 22 bp, Homo sapiens
agttttctgttctacaatttga

SEQ ID NO: 7478907 - DNA, 22 bp, Homo sapiens
agttttctgttctacaatttga

SEQ ID NO: 7478908 - DNA, 22 bp, Homo sapiens
agttttctgttctacaatttga

SEQ ID NO: 7478909 - DNA, 22 bp, Homo sapiens
agttttctgttctacaatttga

SEQ ID NO: 7478910 - DNA, 22 bp, Homo sapiens
agttttctgttctacaatttga

SEQ ID NO: 7478911 - DNA, 22 bp, Homo sapiens
agttttctgatgtgtagtgaga

SEQ ID NO: 7478912 - DNA, 22 bp, Homo sapiens
agttttctgatgtgtagtgaga

SEQ ID NO: 7478913 - DNA, 21 bp, Homo sapiens
agttttctgagttataaaata

SEQ ID NO: 7478914 - DNA, 22 bp, Homo sapiens
agttttctgatgtgtagtgaga

SEQ ID NO: 7478915 - DNA, 22 bp, Homo sapiens
agttttctgatgtgtagtgaga

SEQ ID NO: 7478916 - DNA, 22 bp, Homo sapiens
agttttctgcctctggatgcgt

SEQ ID NO: 7478917 - DNA, 22 bp, Homo sapiens
agttttctgcctctggatgcgt

SEQ ID NO: 7478918 - DNA, 22 bp, Homo sapiens
agttttctgcctctggatgcgt

SEQ ID NO: 7478919 - DNA, 22 bp, Homo sapiens
agttttctgatgtgtagtgaga

SEQ ID NO: 7478920 - DNA, 21 bp, Homo sapiens
agttttctgagttataaaata

SEQ ID NO: 7478921 - DNA, 21 bp, Homo sapiens
agttttctgagttataaaata

SEQ ID NO: 7478922 - DNA, 21 bp, Homo sapiens
agttttctgagttataaaata

SEQ ID NO: 7478923 - DNA, 22 bp, Homo sapiens
agttttctgctaaaccagctaa

SEQ ID NO: 7478924 - DNA, 22 bp, Homo sapiens
agttttctgctaaaccagctaa

SEQ ID NO: 7478925 - DNA, 22 bp, Homo sapiens
agttttctgctaaaccagctaa

SEQ ID NO: 7478926 - DNA, 22 bp, Homo sapiens
agttttctgggatcactggaat

SEQ ID NO: 7478927 - DNA, 19 bp, Homo sapiens
agttttctgtgatccattt

SEQ ID NO: 7478928 - DNA, 22 bp, Homo sapiens
agttttctgggatcactggaat

SEQ ID NO: 7478929 - DNA, 19 bp, Homo sapiens
agttttctgtgatccattt

SEQ ID NO: 7478930 - DNA, 19 bp, Homo sapiens
agttttctgtgatccattt

SEQ ID NO: 7478931 - DNA, 22 bp, Homo sapiens
agttttctgttctacaatttga

SEQ ID NO: 7478932 - DNA, 22 bp, Homo sapiens
agttttctgttctacaatttga

SEQ ID NO: 7478933 - DNA, 22 bp, Homo sapiens
agttttctgggatcactggaat

SEQ ID NO: 7478934 - DNA, 22 bp, Homo sapiens
agttttctgggatcactggaat

SEQ ID NO: 7478935 - DNA, 22 bp, Homo sapiens
ctgccctgactgaccttttgaa

SEQ ID NO: 7478936 - DNA, 22 bp, Homo sapiens
ctgccctgactgaccttttgaa

SEQ ID NO: 7478937 - DNA, 22 bp, Homo sapiens
ctgccctgacctgcctcagagt

SEQ ID NO: 7478938 - DNA, 22 bp, Homo sapiens
ctgccctgacctgcctcagagt

SEQ ID NO: 7478939 - DNA, 22 bp, Homo sapiens
ctgccctggtcccatggctgat

SEQ ID NO: 7478940 - DNA, 22 bp, Homo sapiens
ctgccctggtcccatggctgat

SEQ ID NO: 7478941 - DNA, 22 bp, Homo sapiens
ctgccctggtcccatggctgat

SEQ ID NO: 7478942 - DNA, 22 bp, Homo sapiens
ctgccctggtcccatggctgat

SEQ ID NO: 7478943 - DNA, 22 bp, Homo sapiens
ctgccctgtagctgttctagca

SEQ ID NO: 7478944 - DNA, 22 bp, Homo sapiens
ctgccctgtagctgttctagca

SEQ ID NO: 7478945 - DNA, 22 bp, Homo sapiens
ctgccctgtagctgttctagca

SEQ ID NO: 7478946 - DNA, 22 bp, Homo sapiens
ctgccctggtcccatggctgat

SEQ ID NO: 7478947 - DNA, 22 bp, Homo sapiens
ctgccctggtcccatggctgat

SEQ ID NO: 7478948 - DNA, 22 bp, Homo sapiens
ctgccctctagaggaggactga

SEQ ID NO: 7478949 - DNA, 22 bp, Homo sapiens
ctgccctctagaggaggactga

SEQ ID NO: 7478950 - DNA, 22 bp, Homo sapiens
ctgccctctagaggaggactga

SEQ ID NO: 7478951 - DNA, 22 bp, Homo sapiens
ctgccctctagaggaggactga

SEQ ID NO: 7478952 - DNA, 22 bp, Homo sapiens
ctgccctctagaggaggactga

SEQ ID NO: 7478953 - DNA, 22 bp, Homo sapiens
ctgccctctagaggaggactga

SEQ ID NO: 7478954 - DNA, 22 bp, Homo sapiens
ctgccctctagaggaggactga

SEQ ID NO: 7478955 - DNA, 22 bp, Homo sapiens
ctgccctctagggatgcactgg

SEQ ID NO: 7478956 - DNA, 22 bp, Homo sapiens
ctgccctctagggatgcactgg

SEQ ID NO: 7478957 - DNA, 22 bp, Homo sapiens
ctgccctctagggatgcactgg

SEQ ID NO: 7478958 - DNA, 22 bp, Homo sapiens
ctgccctctagggatgcactgg

SEQ ID NO: 7478959 - DNA, 22 bp, Homo sapiens
ctgccctctagggatgcactgg

SEQ ID NO: 7478960 - DNA, 22 bp, Homo sapiens
ctgccctctagggatgcactgg

SEQ ID NO: 7478961 - DNA, 22 bp, Homo sapiens
ctgccctctagggatgcactgg

SEQ ID NO: 7478962 - DNA, 22 bp, Homo sapiens
ctgccctctagggatgcactgg

SEQ ID NO: 7478963 - DNA, 22 bp, Homo sapiens
ctgccctctagggatgcactgg

SEQ ID NO: 7478964 - DNA, 22 bp, Homo sapiens
ctgccctctagggatgcactgg

SEQ ID NO: 7478965 - DNA, 22 bp, Homo sapiens
ctgccctctagggatgcactgg

SEQ ID NO: 7478966 - DNA, 22 bp, Homo sapiens
ctgccctgacctgcctcagagt

SEQ ID NO: 7478967 - DNA, 22 bp, Homo sapiens
ctgccctgacctgcctcagagt

SEQ ID NO: 7478968 - DNA, 22 bp, Homo sapiens
ctgccctgacctgcctcagagt

SEQ ID NO: 7478969 - DNA, 22 bp, Homo sapiens
ctgccctgacctgcctcagagt

SEQ ID NO: 7478970 - DNA, 21 bp, Homo sapiens
ctgccctagatggctctggaa

SEQ ID NO: 7478971 - DNA, 21 bp, Homo sapiens
ctgccctagatggctctggaa

SEQ ID NO: 7478972 - DNA, 22 bp, Homo sapiens
ctgccctcccagttggtccgtg

SEQ ID NO: 7478973 - DNA, 22 bp, Homo sapiens
ctgccctcccagttggtccgtg

SEQ ID NO: 7478974 - DNA, 18 bp, Homo sapiens
ctgccccttctctgagat

SEQ ID NO: 7478975 - DNA, 22 bp, Homo sapiens
ctgcccggagctggcaaaggct

SEQ ID NO: 7478976 - DNA, 22 bp, Homo sapiens
ctgcccggagctggcaaaggct

SEQ ID NO: 7478977 - DNA, 22 bp, Homo sapiens
ctgcccgtccctttgctctcgc

SEQ ID NO: 7478978 - DNA, 22 bp, Homo sapiens
ctgcccgtccctttgctctcgc

SEQ ID NO: 7478979 - DNA, 22 bp, Homo sapiens
ctgcccgtccctttgctctcgc

SEQ ID NO: 7478980 - DNA, 22 bp, Homo sapiens
ctgccctcgggccctcccatag

SEQ ID NO: 7478981 - DNA, 22 bp, Homo sapiens
ctgccctcgggccctcccatag

SEQ ID NO: 7478982 - DNA, 22 bp, Homo sapiens
ctgccctcgggccctcccatag

SEQ ID NO: 7478983 - DNA, 22 bp, Homo sapiens
ctgccctcccagttggtccgtg

SEQ ID NO: 7478984 - DNA, 22 bp, Homo sapiens
ctgccctcgggccctcccatag

SEQ ID NO: 7478985 - DNA, 22 bp, Homo sapiens
ctgccctcgggccctcccatag

SEQ ID NO: 7478986 - DNA, 22 bp, Homo sapiens
ctgccctcgggccctcccatag

SEQ ID NO: 7478987 - DNA, 22 bp, Homo sapiens
ctgccctctagaggaggactga

SEQ ID NO: 7478988 - DNA, 22 bp, Homo sapiens
ctgccctcgggccctcccatag

SEQ ID NO: 7478989 - DNA, 22 bp, Homo sapiens
ctgccctcgggccctcccatag

SEQ ID NO: 7478990 - DNA, 22 bp, Homo sapiens
ctgccctcgggccctcccatag

SEQ ID NO: 7478991 - DNA, 22 bp, Homo sapiens
ctgccctcccagttggtccgtg

SEQ ID NO: 7478992 - DNA, 22 bp, Homo sapiens
ctgccctcgggccctcccatag

SEQ ID NO: 7478993 - DNA, 22 bp, Homo sapiens
agttttgatactttctcttcat

SEQ ID NO: 7478994 - DNA, 22 bp, Homo sapiens
agttttgatactttctcttcat

SEQ ID NO: 7478995 - DNA, 21 bp, Homo sapiens
agttttgagagtgggtagtgt

SEQ ID NO: 7478996 - DNA, 18 bp, Homo sapiens
ctgcccagagcatttcat

SEQ ID NO: 7478997 - DNA, 17 bp, Homo sapiens
agttttgatataatggc

SEQ ID NO: 7478998 - DNA, 17 bp, Homo sapiens
agttttgatataatggc

SEQ ID NO: 7478999 - DNA, 18 bp, Homo sapiens
ctgcccagagcacttgtg

SEQ ID NO: 7479000 - DNA, 18 bp, Homo sapiens
ctgccccttctctgagat

SEQ ID NO: 7479001 - DNA, 18 bp, Homo sapiens
ctgccccttctctgagat

SEQ ID NO: 7479002 - DNA, 18 bp, Homo sapiens
ctgccccttctctgagat

SEQ ID NO: 7479003 - DNA, 18 bp, Homo sapiens
ctgcccagagcatttcat

SEQ ID NO: 7479004 - DNA, 22 bp, Homo sapiens
ctgcccagattttaccacctgc

SEQ ID NO: 7479005 - DNA, 18 bp, Homo sapiens
ctgccccttctctgagat

SEQ ID NO: 7479006 - DNA, 22 bp, Homo sapiens
aggttatttcatccttccctgg

SEQ ID NO: 7479007 - DNA, 22 bp, Homo sapiens
aggttatttcatccttccctgg

SEQ ID NO: 7479008 - DNA, 22 bp, Homo sapiens
aggttatttaggaaggtagagc

SEQ ID NO: 7479009 - DNA, 22 bp, Homo sapiens
aggttattttgctcagggaact

SEQ ID NO: 7479010 - DNA, 22 bp, Homo sapiens
aggttatttgcagatggaattc

SEQ ID NO: 7479011 - DNA, 22 bp, Homo sapiens
aggttattgtagattataggca

SEQ ID NO: 7479012 - DNA, 22 bp, Homo sapiens
aggttattgctctccaagttca

SEQ ID NO: 7479013 - DNA, 22 bp, Homo sapiens
aggttattgctctccaagttca

SEQ ID NO: 7479014 - DNA, 22 bp, Homo sapiens
aggttattgtagattataggca

SEQ ID NO: 7479015 - DNA, 22 bp, Homo sapiens
aggttattctctatctcatccc

SEQ ID NO: 7479016 - DNA, 22 bp, Homo sapiens
aggttattctctatctcatccc

SEQ ID NO: 7479017 - DNA, 22 bp, Homo sapiens
aggttattctctatctcatccc

SEQ ID NO: 7479018 - DNA, 22 bp, Homo sapiens
aggttattaaagtgtatttttg

SEQ ID NO: 7479019 - DNA, 22 bp, Homo sapiens
aggttattaaagtgtatttttg

SEQ ID NO: 7479020 - DNA, 21 bp, Homo sapiens
aggttattacaatttttctac

SEQ ID NO: 7479021 - DNA, 21 bp, Homo sapiens
aggttattacaatttttctac

SEQ ID NO: 7479022 - DNA, 21 bp, Homo sapiens
aggttattacaatttttctac

SEQ ID NO: 7479023 - DNA, 22 bp, Homo sapiens
aggttattaaagtgtatttttg

SEQ ID NO: 7479024 - DNA, 23 bp, Homo sapiens
aggttatgattatagagcgagga

SEQ ID NO: 7479025 - DNA, 22 bp, Homo sapiens
aggttatatgtcatactgaagt

SEQ ID NO: 7479026 - DNA, 23 bp, Homo sapiens
aggttatgattatagagcgagga

SEQ ID NO: 7479027 - DNA, 23 bp, Homo sapiens
aggttatgattatagagcgagga

SEQ ID NO: 7479028 - DNA, 22 bp, Homo sapiens
aggttatatgtcatactgaagt

SEQ ID NO: 7479029 - DNA, 22 bp, Homo sapiens
aggttataaaatggtgtacaat

SEQ ID NO: 7479030 - DNA, 22 bp, Homo sapiens
aggttataaaatggtgtacaat

SEQ ID NO: 7479031 - DNA, 22 bp, Homo sapiens
aggttatatgtcatactgaagt

SEQ ID NO: 7479032 - DNA, 22 bp, Homo sapiens
aggttatatgtcatactgaagt

SEQ ID NO: 7479033 - DNA, 22 bp, Homo sapiens
aggttagtgctgaaatgacatg

SEQ ID NO: 7479034 - DNA, 22 bp, Homo sapiens
aggttatagaaactgaggctct

SEQ ID NO: 7479035 - DNA, 22 bp, Homo sapiens
aggttatagaaactgaggctct

SEQ ID NO: 7479036 - DNA, 22 bp, Homo sapiens
aggttaaaaaggattcagttaa

SEQ ID NO: 7479037 - DNA, 18 bp, Homo sapiens
aggtgtgtttctaggagc

SEQ ID NO: 7479038 - DNA, 22 bp, Homo sapiens
aggtgtgtataaacatacatat

SEQ ID NO: 7479039 - DNA, 22 bp, Homo sapiens
aggtgtgtataaacatacatat

SEQ ID NO: 7479040 - DNA, 22 bp, Homo sapiens
aggtgtgtataaacatacatat

SEQ ID NO: 7479041 - DNA, 22 bp, Homo sapiens
aggtgtgttccaggaatggtga

SEQ ID NO: 7479042 - DNA, 19 bp, Homo sapiens
aggttacaggtgtcacaga

SEQ ID NO: 7479043 - DNA, 19 bp, Homo sapiens
aggttacaggtgtcacaga

SEQ ID NO: 7479044 - DNA, 22 bp, Homo sapiens
aggttaactgggataacacatt

SEQ ID NO: 7479045 - DNA, 19 bp, Homo sapiens
aggttacaggtgtcacaga

SEQ ID NO: 7479046 - DNA, 19 bp, Homo sapiens
aggttacaggtgtcacaga

SEQ ID NO: 7479047 - DNA, 22 bp, Homo sapiens
aggttaaataaagttggattat

SEQ ID NO: 7479048 - DNA, 22 bp, Homo sapiens
aggttaaataaagttggattat

SEQ ID NO: 7479049 - DNA, 22 bp, Homo sapiens
aggttaacccttcttttcctct

SEQ ID NO: 7479050 - DNA, 22 bp, Homo sapiens
aggttaaaaaggattcagttaa

SEQ ID NO: 7479051 - DNA, 22 bp, Homo sapiens
aggttacagtgattataggttt

SEQ ID NO: 7479052 - DNA, 22 bp, Homo sapiens
aggttacagtgattataggttt

SEQ ID NO: 7479053 - DNA, 22 bp, Homo sapiens
aggttacagtgattataggttt

SEQ ID NO: 7479054 - DNA, 23 bp, Homo sapiens
aggttacagttgttaagttgcaa

SEQ ID NO: 7479055 - DNA, 23 bp, Homo sapiens
aggttacagttgttaagttgcaa

SEQ ID NO: 7479056 - DNA, 22 bp, Homo sapiens
aggttacagtcatctcagaatc

SEQ ID NO: 7479057 - DNA, 22 bp, Homo sapiens
aggttacagtcatctcagaatc

SEQ ID NO: 7479058 - DNA, 22 bp, Homo sapiens
aggttacagtcatctcagaatc

SEQ ID NO: 7479059 - DNA, 22 bp, Homo sapiens
aggttaggaatttggacagaga

SEQ ID NO: 7479060 - DNA, 22 bp, Homo sapiens
aggttaggaaatagggctgtaa

SEQ ID NO: 7479061 - DNA, 22 bp, Homo sapiens
aggttaggaaccagtgtttgac

SEQ ID NO: 7479062 - DNA, 22 bp, Homo sapiens
aggttacataggctttaaaagt

SEQ ID NO: 7479063 - DNA, 22 bp, Homo sapiens
aggttacataggctttaaaagt

SEQ ID NO: 7479064 - DNA, 23 bp, Homo sapiens
aggttacagttgttaagttgcaa

SEQ ID NO: 7479065 - DNA, 22 bp, Homo sapiens
aggttacataggctttaaaagt

SEQ ID NO: 7479066 - DNA, 22 bp, Homo sapiens
aggttgggatgagtgggtgagc

SEQ ID NO: 7479067 - DNA, 22 bp, Homo sapiens
aggttgggatgagtgggtgagc

SEQ ID NO: 7479068 - DNA, 22 bp, Homo sapiens
aggtttactgagggtgctggtt

SEQ ID NO: 7479069 - DNA, 22 bp, Homo sapiens
aggttgttttgcctcattatcc

SEQ ID NO: 7479070 - DNA, 22 bp, Homo sapiens
aggttgttttgcctcattatcc

SEQ ID NO: 7479071 - DNA, 22 bp, Homo sapiens
aggtttagttctgcttatattg

SEQ ID NO: 7479072 - DNA, 22 bp, Homo sapiens
aggtttataggaaatttgttcc

SEQ ID NO: 7479073 - DNA, 22 bp, Homo sapiens
aggtttataggaaatttgttcc

SEQ ID NO: 7479074 - DNA, 22 bp, Homo sapiens
aggtttatctcatagaaagaat

SEQ ID NO: 7479075 - DNA, 22 bp, Homo sapiens
aggttggcctcagggaggctct

SEQ ID NO: 7479076 - DNA, 22 bp, Homo sapiens
aggttggccaagctgctggccc

SEQ ID NO: 7479077 - DNA, 22 bp, Homo sapiens
aggttggcctcagggaggctct

SEQ ID NO: 7479078 - DNA, 22 bp, Homo sapiens
aggttccaagaaatcatcagtg

SEQ ID NO: 7479079 - DNA, 22 bp, Homo sapiens
aggttccaagaaatcatcagtg

SEQ ID NO: 7479080 - DNA, 22 bp, Homo sapiens
aggttggctgctcttttcctaa

SEQ ID NO: 7479081 - DNA, 22 bp, Homo sapiens
aggttggcctcagggaggctct

SEQ ID NO: 7479082 - DNA, 22 bp, Homo sapiens
aggttggcctcagggaggctct

SEQ ID NO: 7479083 - DNA, 22 bp, Homo sapiens
aggttcaaattgttgcagtttc

SEQ ID NO: 7479084 - DNA, 22 bp, Homo sapiens
aggttcaaattgttgcagtttc

SEQ ID NO: 7479085 - DNA, 22 bp, Homo sapiens
aggttcacacacacaaaaagat

SEQ ID NO: 7479086 - DNA, 22 bp, Homo sapiens
aggttcaaatgcaagagatgct

SEQ ID NO: 7479087 - DNA, 22 bp, Homo sapiens
aggttatttttgcttagaaaga

SEQ ID NO: 7479088 - DNA, 23 bp, Homo sapiens
aggttcagctttcttactctggg

SEQ ID NO: 7479089 - DNA, 23 bp, Homo sapiens
aggttcagctttcttactctggg

SEQ ID NO: 7479090 - DNA, 22 bp, Homo sapiens
aggttcagatgacttttatgct

SEQ ID NO: 7479091 - DNA, 22 bp, Homo sapiens
aggttcagagttgttgatgttt

SEQ ID NO: 7479092 - DNA, 22 bp, Homo sapiens
aggttcagacgcataataggca

SEQ ID NO: 7479093 - DNA, 22 bp, Homo sapiens
aggttcagtgcctggaacaggg

SEQ ID NO: 7479094 - DNA, 22 bp, Homo sapiens
aggttcagtctttggacccctc

SEQ ID NO: 7479095 - DNA, 17 bp, Homo sapiens
aggttcaggttacattc

SEQ ID NO: 7479096 - DNA, 22 bp, Homo sapiens
aggttcagtaaatgttagttga

SEQ ID NO: 7479097 - DNA, 22 bp, Homo sapiens
aggttcaggctgcacacctgag

SEQ ID NO: 7479098 - DNA, 17 bp, Homo sapiens
aggttcaggttacattc

SEQ ID NO: 7479099 - DNA, 22 bp, Homo sapiens
aggttcaggcacttgcccaaca

SEQ ID NO: 7479100 - DNA, 22 bp, Homo sapiens
aggttcaggctgcacacctgag

SEQ ID NO: 7479101 - DNA, 23 bp, Homo sapiens
aggttcaggagatggaggaacaa

SEQ ID NO: 7479102 - DNA, 23 bp, Homo sapiens
aggttcaggagatggaggaacaa

SEQ ID NO: 7479103 - DNA, 23 bp, Homo sapiens
aggttcaggagatggaggaacaa

SEQ ID NO: 7479104 - DNA, 22 bp, Homo sapiens
cctggtgcccccaagccagctg

SEQ ID NO: 7479105 - DNA, 22 bp, Homo sapiens
cctggtgcccccaagccagctg

SEQ ID NO: 7479106 - DNA, 22 bp, Homo sapiens
cctggtgcccccaagccagctg

SEQ ID NO: 7479107 - DNA, 22 bp, Homo sapiens
cctggtgcccccaagccagctg

SEQ ID NO: 7479108 - DNA, 22 bp, Homo sapiens
cctggtgcccccaagccagctg

SEQ ID NO: 7479109 - DNA, 22 bp, Homo sapiens
cctggtgccactagagaatgtc

SEQ ID NO: 7479110 - DNA, 22 bp, Homo sapiens
cctggtgccactagagaatgtc

SEQ ID NO: 7479111 - DNA, 22 bp, Homo sapiens
cctggtgagctgggtgcacggc

SEQ ID NO: 7479112 - DNA, 22 bp, Homo sapiens
cctggtgaatgttcatggactg

SEQ ID NO: 7479113 - DNA, 22 bp, Homo sapiens
cctggtgaatgttcatggactg

SEQ ID NO: 7479114 - DNA, 22 bp, Homo sapiens
cctggtccttacgtcattgctt

SEQ ID NO: 7479115 - DNA, 22 bp, Homo sapiens
cctggtgcaccaagtaagggtg

SEQ ID NO: 7479116 - DNA, 22 bp, Homo sapiens
cctggtcctaggggtggaacca

SEQ ID NO: 7479117 - DNA, 22 bp, Homo sapiens
cctggtcctaggggtggaacca

SEQ ID NO: 7479118 - DNA, 22 bp, Homo sapiens
cctggtccccatcggcccagcg

SEQ ID NO: 7479119 - DNA, 22 bp, Homo sapiens
cctggtccccatcggcccagcg

SEQ ID NO: 7479120 - DNA, 22 bp, Homo sapiens
cctggtccccatcggcccagcg

SEQ ID NO: 7479121 - DNA, 22 bp, Homo sapiens
aggtggggttcagtctcagccg

SEQ ID NO: 7479122 - DNA, 22 bp, Homo sapiens
aggtggggttcagtctcagccg

SEQ ID NO: 7479123 - DNA, 22 bp, Homo sapiens
cctggtgcccccaagccagctg

SEQ ID NO: 7479124 - DNA, 22 bp, Homo sapiens
aggtggggttcagtctcagccg

SEQ ID NO: 7479125 - DNA, 22 bp, Homo sapiens
aggtggggttcagtctcagccg

SEQ ID NO: 7479126 - DNA, 22 bp, Homo sapiens
aggtggggttcagtctcagccg

SEQ ID NO: 7479127 - DNA, 22 bp, Homo sapiens
aggtggggttcagtctcagccg

SEQ ID NO: 7479128 - DNA, 22 bp, Homo sapiens
aggtggggttcagtctcagccg

SEQ ID NO: 7479129 - DNA, 22 bp, Homo sapiens
aggtgtctgggctttggagtca

SEQ ID NO: 7479130 - DNA, 22 bp, Homo sapiens
aggtgtctggatgggtgtcctt

SEQ ID NO: 7479131 - DNA, 22 bp, Homo sapiens
aggtgtctgtgatgggagcgat

SEQ ID NO: 7479132 - DNA, 22 bp, Homo sapiens
aggtgtcttcagggtgagacag

SEQ ID NO: 7479133 - DNA, 22 bp, Homo sapiens
aggtgtctggatgggtgtcctt

SEQ ID NO: 7479134 - DNA, 22 bp, Homo sapiens
aggtgtctgggctttggagtca

SEQ ID NO: 7479135 - DNA, 22 bp, Homo sapiens
aggtgtctgtgatgggagcgat

SEQ ID NO: 7479136 - DNA, 22 bp, Homo sapiens
aggtgtctttgcggcccgccgc

SEQ ID NO: 7479137 - DNA, 22 bp, Homo sapiens
aggtgtctttgcggcccgccgc

SEQ ID NO: 7479138 - DNA, 22 bp, Homo sapiens
aggtgtcttcagggtgagacag

SEQ ID NO: 7479139 - DNA, 22 bp, Homo sapiens
aggtgtcttcagggtgagacag

SEQ ID NO: 7479140 - DNA, 22 bp, Homo sapiens
aggtgtctttcagtcatggctt

SEQ ID NO: 7479141 - DNA, 22 bp, Homo sapiens
aggtgtggctggggcagaggcc

SEQ ID NO: 7479142 - DNA, 22 bp, Homo sapiens
aggtgtggctggggcagaggcc

SEQ ID NO: 7479143 - DNA, 22 bp, Homo sapiens
aggtgtggctggggcagaggcc

SEQ ID NO: 7479144 - DNA, 22 bp, Homo sapiens
aggtgtggcttgaagtctctat

SEQ ID NO: 7479145 - DNA, 22 bp, Homo sapiens
aggtgtggcttgaagtctctat

SEQ ID NO: 7479146 - DNA, 22 bp, Homo sapiens
aggtgtggcttgaagtctctat

SEQ ID NO: 7479147 - DNA, 22 bp, Homo sapiens
aggtgtgagaaacgtgaccagt

SEQ ID NO: 7479148 - DNA, 22 bp, Homo sapiens
aggtgtgcaggatgaacccctc

SEQ ID NO: 7479149 - DNA, 23 bp, Homo sapiens
aggtgtgcttctgggcacctggg

SEQ ID NO: 7479150 - DNA, 22 bp, Homo sapiens
aggtgtggctatgctgtgttcc

SEQ ID NO: 7479151 - DNA, 23 bp, Homo sapiens
aggtgtgcttctgggcacctggg

SEQ ID NO: 7479152 - DNA, 22 bp, Homo sapiens
aggtgtggctggggcagaggcc

SEQ ID NO: 7479153 - DNA, 22 bp, Homo sapiens
aggtgtggctggggcagaggcc

SEQ ID NO: 7479154 - DNA, 22 bp, Homo sapiens
aggtgtggctggggcagaggcc

SEQ ID NO: 7479155 - DNA, 22 bp, Homo sapiens
aggtgtggctggggcagaggcc

SEQ ID NO: 7479156 - DNA, 22 bp, Homo sapiens
aggtgtggctggggcagaggcc

SEQ ID NO: 7479157 - DNA, 22 bp, Homo sapiens
aggtgtggctggggcagaggcc

SEQ ID NO: 7479158 - DNA, 22 bp, Homo sapiens
aggtgtggctggggcagaggcc

SEQ ID NO: 7479159 - DNA, 19 bp, Homo sapiens
aggtgtgggggctgcagac

SEQ ID NO: 7479160 - DNA, 19 bp, Homo sapiens
aggtgtgggggctgcagac

SEQ ID NO: 7479161 - DNA, 19 bp, Homo sapiens
aggtgtgggggctgcagac

SEQ ID NO: 7479162 - DNA, 19 bp, Homo sapiens
aggtgtgggggctgcagac

SEQ ID NO: 7479163 - DNA, 19 bp, Homo sapiens
aggtgtgggggctgcagac

SEQ ID NO: 7479164 - DNA, 22 bp, Homo sapiens
aggtgtgggaaacgggtgacct

SEQ ID NO: 7479165 - DNA, 22 bp, Homo sapiens
aggtgtgggaaacgggtgacct

SEQ ID NO: 7479166 - DNA, 22 bp, Homo sapiens
aggtgtgggaaacgggtgacct

SEQ ID NO: 7479167 - DNA, 22 bp, Homo sapiens
aggtgtgggaaacgggtgacct

SEQ ID NO: 7479168 - DNA, 22 bp, Homo sapiens
aggtgtgggaaacgggtgacct

SEQ ID NO: 7479169 - DNA, 22 bp, Homo sapiens
aggtgtgggaaacgggtgacct

SEQ ID NO: 7479170 - DNA, 22 bp, Homo sapiens
aggtgtgggaaacgggtgacct

SEQ ID NO: 7479171 - DNA, 19 bp, Homo sapiens
aggtgtgggggctgcagac

SEQ ID NO: 7479172 - DNA, 17 bp, Homo sapiens
aggtgtggtcaagggag

SEQ ID NO: 7479173 - DNA, 17 bp, Homo sapiens
aggtgtggtcaagggag

SEQ ID NO: 7479174 - DNA, 17 bp, Homo sapiens
aggtgtggtcaagggag

SEQ ID NO: 7479175 - DNA, 17 bp, Homo sapiens
aggtgtggtcaagggag

SEQ ID NO: 7479176 - DNA, 22 bp, Homo sapiens
cctttatgagatcctggggtga

SEQ ID NO: 7479177 - DNA, 19 bp, Homo sapiens
cctttagttgctcagagaa

SEQ ID NO: 7479178 - DNA, 22 bp, Homo sapiens
cctttaggagtgaggaccgagc

SEQ ID NO: 7479179 - DNA, 22 bp, Homo sapiens
cctttaggagtgaggaccgagc

SEQ ID NO: 7479180 - DNA, 22 bp, Homo sapiens
cctttaggagtgaggaccgagc

SEQ ID NO: 7479181 - DNA, 21 bp, Homo sapiens
cctttagatttctatgcagtt

SEQ ID NO: 7479182 - DNA, 22 bp, Homo sapiens
cctttattcaattagtcctaat

SEQ ID NO: 7479183 - DNA, 22 bp, Homo sapiens
cctttattcaattagtcctaat

SEQ ID NO: 7479184 - DNA, 20 bp, Homo sapiens
cctttattatttgtatgatg

SEQ ID NO: 7479185 - DNA, 20 bp, Homo sapiens
cctttattatttgtatgatg

SEQ ID NO: 7479186 - DNA, 20 bp, Homo sapiens
cctttattatttgtatgatg

SEQ ID NO: 7479187 - DNA, 20 bp, Homo sapiens
cctttattatttgtatgatg

SEQ ID NO: 7479188 - DNA, 19 bp, Homo sapiens
cctttagttgctcagagaa

SEQ ID NO: 7479189 - DNA, 20 bp, Homo sapiens
cctttattatttgtatgatg

SEQ ID NO: 7479190 - DNA, 22 bp, Homo sapiens
cctttatgtcactctggagagc

SEQ ID NO: 7479191 - DNA, 20 bp, Homo sapiens
cctttattatttgtatgatg

SEQ ID NO: 7479192 - DNA, 20 bp, Homo sapiens
cctttattatttgtatgatg

SEQ ID NO: 7479193 - DNA, 20 bp, Homo sapiens
cctttattatttgtatgatg

SEQ ID NO: 7479194 - DNA, 20 bp, Homo sapiens
cctttattatttgtatgatg

SEQ ID NO: 7479195 - DNA, 21 bp, Homo sapiens
aggtttctcttttatggaggg

SEQ ID NO: 7479196 - DNA, 21 bp, Homo sapiens
aggtttctcttttatggaggg

SEQ ID NO: 7479197 - DNA, 22 bp, Homo sapiens
aggtttctgcaatgtgtgtaca

SEQ ID NO: 7479198 - DNA, 22 bp, Homo sapiens
aggtttctactgtgttaagaaa

SEQ ID NO: 7479199 - DNA, 19 bp, Homo sapiens
aggtttctaactattcaag

SEQ ID NO: 7479200 - DNA, 22 bp, Homo sapiens
aggtttccagcatggggaaggc

SEQ ID NO: 7479201 - DNA, 22 bp, Homo sapiens
aggtttccagcatggggaaggc

SEQ ID NO: 7479202 - DNA, 22 bp, Homo sapiens
aggtttctatgctgtttatctt

SEQ ID NO: 7479203 - DNA, 22 bp, Homo sapiens
aggtttctcctttaaagcatgg

SEQ ID NO: 7479204 - DNA, 22 bp, Homo sapiens
aggtttctcctttaaagcatgg

SEQ ID NO: 7479205 - DNA, 22 bp, Homo sapiens
aggtttattaagtaaatagagc

SEQ ID NO: 7479206 - DNA, 21 bp, Homo sapiens
aggtttatttcaacttcagga

SEQ ID NO: 7479207 - DNA, 22 bp, Homo sapiens
aggtttcatgggagacaactca

SEQ ID NO: 7479208 - DNA, 17 bp, Homo sapiens
aggtttatggtatttga

SEQ ID NO: 7479209 - DNA, 17 bp, Homo sapiens
aggtttatggtatttga

SEQ ID NO: 7479210 - DNA, 22 bp, Homo sapiens
aggtttatgattctgcacgtgg

SEQ ID NO: 7479211 - DNA, 22 bp, Homo sapiens
aggtttatgattctgcacgtgg

SEQ ID NO: 7479212 - DNA, 22 bp, Homo sapiens
agtacaaaggcccttgattact

SEQ ID NO: 7479213 - DNA, 22 bp, Homo sapiens
agtacaaaggcccttgattact

SEQ ID NO: 7479214 - DNA, 22 bp, Homo sapiens
agtacaaaggcccttgattact

SEQ ID NO: 7479215 - DNA, 22 bp, Homo sapiens
agtacaaaggcccttgattact

SEQ ID NO: 7479216 - DNA, 22 bp, Homo sapiens
agtacaaaggcccttgattact

SEQ ID NO: 7479217 - DNA, 22 bp, Homo sapiens
agtacaaaggcccttgattact

SEQ ID NO: 7479218 - DNA, 22 bp, Homo sapiens
agtacaaaggcccttgattact

SEQ ID NO: 7479219 - DNA, 22 bp, Homo sapiens
agtacaaaggcccttgattact

SEQ ID NO: 7479220 - DNA, 22 bp, Homo sapiens
agtacaaaggcccttgattact

SEQ ID NO: 7479221 - DNA, 22 bp, Homo sapiens
agtacaaaggcccttgattact

SEQ ID NO: 7479222 - DNA, 22 bp, Homo sapiens
agtacaaaggcccttgattact

SEQ ID NO: 7479223 - DNA, 22 bp, Homo sapiens
agtacaaaatgcagcatcatca

SEQ ID NO: 7479224 - DNA, 22 bp, Homo sapiens
agtacaaaatgcagcatcatca

SEQ ID NO: 7479225 - DNA, 21 bp, Homo sapiens
agtacaaaaattcctttctca

SEQ ID NO: 7479226 - DNA, 22 bp, Homo sapiens
agtacaaaatgcagcatcatca

SEQ ID NO: 7479227 - DNA, 22 bp, Homo sapiens
agtacaaactgtttcaaagtag

SEQ ID NO: 7479228 - DNA, 22 bp, Homo sapiens
agtacaaactgtttcaaagtag

SEQ ID NO: 7479229 - DNA, 22 bp, Homo sapiens
agtacaaactgtttcaaagtag

SEQ ID NO: 7479230 - DNA, 22 bp, Homo sapiens
agtacaaactgtttcaaagtag

SEQ ID NO: 7479231 - DNA, 22 bp, Homo sapiens
agtacaaactgtttcaaagtag

SEQ ID NO: 7479232 - DNA, 22 bp, Homo sapiens
agtacaaactgtttcaaagtag

SEQ ID NO: 7479233 - DNA, 22 bp, Homo sapiens
agtacaaactgtttcaaagtag

SEQ ID NO: 7479234 - DNA, 22 bp, Homo sapiens
agtacaaactgtttcaaagtag

SEQ ID NO: 7479235 - DNA, 22 bp, Homo sapiens
agtacaaaggcccttgattact

SEQ ID NO: 7479236 - DNA, 22 bp, Homo sapiens
agtacaaaggcccttgattact

SEQ ID NO: 7479237 - DNA, 22 bp, Homo sapiens
agtacaaagtgctcctggttct

SEQ ID NO: 7479238 - DNA, 22 bp, Homo sapiens
agtacaaagtgctcctggttct

SEQ ID NO: 7479239 - DNA, 22 bp, Homo sapiens
agtacaaagtgctcctggttct

SEQ ID NO: 7479240 - DNA, 22 bp, Homo sapiens
agtacaaatgcagccagagtag

SEQ ID NO: 7479241 - DNA, 22 bp, Homo sapiens
cgcctggagaggaggcgacgcg

SEQ ID NO: 7479242 - DNA, 22 bp, Homo sapiens
cgcctggaacctctaggaccag

SEQ ID NO: 7479243 - DNA, 22 bp, Homo sapiens
cgcctgcttaacgaattgtgtt

SEQ ID NO: 7479244 - DNA, 22 bp, Homo sapiens
cgcctgctctcactggacagct

SEQ ID NO: 7479245 - DNA, 22 bp, Homo sapiens
cgcctgctctcactggacagct

SEQ ID NO: 7479246 - DNA, 22 bp, Homo sapiens
cgcctgctctgtttccatgtgg

SEQ ID NO: 7479247 - DNA, 22 bp, Homo sapiens
agtaatttgttataaagcaata

SEQ ID NO: 7479248 - DNA, 21 bp, Homo sapiens
agtacaaaaattcctttctca

SEQ ID NO: 7479249 - DNA, 21 bp, Homo sapiens
agtacaaaaattcctttctca

SEQ ID NO: 7479250 - DNA, 21 bp, Homo sapiens
agtacaaaaattcctttctca

SEQ ID NO: 7479251 - DNA, 21 bp, Homo sapiens
agtacaaaaattcctttctca

SEQ ID NO: 7479252 - DNA, 21 bp, Homo sapiens
agtacaaaaattcctttctca

SEQ ID NO: 7479253 - DNA, 22 bp, Homo sapiens
agtaatttgttataaagcaata

SEQ ID NO: 7479254 - DNA, 22 bp, Homo sapiens
agtaatttgttataaagcaata

SEQ ID NO: 7479255 - DNA, 22 bp, Homo sapiens
agtaatttgttataaagcaata

SEQ ID NO: 7479256 - DNA, 22 bp, Homo sapiens
agtaatttgttataaagcaata

SEQ ID NO: 7479257 - DNA, 22 bp, Homo sapiens
agtaattggctacagtgtaatt

SEQ ID NO: 7479258 - DNA, 22 bp, Homo sapiens
agtaattggctacagtgtaatt

SEQ ID NO: 7479259 - DNA, 22 bp, Homo sapiens
agtaattctactaggaatttat

SEQ ID NO: 7479260 - DNA, 22 bp, Homo sapiens
agtaatctgattttatagctat

SEQ ID NO: 7479261 - DNA, 22 bp, Homo sapiens
agtaatgaatacggtatttgaa

SEQ ID NO: 7479262 - DNA, 23 bp, Homo sapiens
agtaatgagtgatgcagatattc

SEQ ID NO: 7479263 - DNA, 23 bp, Homo sapiens
agtaatgagtgatgcagatattc

SEQ ID NO: 7479264 - DNA, 22 bp, Homo sapiens
agtaatgattatgtacagaatg

SEQ ID NO: 7479265 - DNA, 22 bp, Homo sapiens
agtaatgtgcctgaaatacttg

SEQ ID NO: 7479266 - DNA, 22 bp, Homo sapiens
agtaatgtgcctgaaatacttg

SEQ ID NO: 7479267 - DNA, 22 bp, Homo sapiens
agtaatgtcccttaaatgtggt

SEQ ID NO: 7479268 - DNA, 22 bp, Homo sapiens
agtaatgaggatgtttgcaaaa

SEQ ID NO: 7479269 - DNA, 22 bp, Homo sapiens
agtaatggagcaggaaatacat

SEQ ID NO: 7479270 - DNA, 22 bp, Homo sapiens
agtaatggagcaggaaatacat

SEQ ID NO: 7479271 - DNA, 22 bp, Homo sapiens
agtaatgggttgaaatttagtt

SEQ ID NO: 7479272 - DNA, 22 bp, Homo sapiens
agtaatagagattttaatgtcc

SEQ ID NO: 7479273 - DNA, 22 bp, Homo sapiens
agtaataatttatattagggag

SEQ ID NO: 7479274 - DNA, 22 bp, Homo sapiens
agtaataatttatattagggag

SEQ ID NO: 7479275 - DNA, 22 bp, Homo sapiens
agtaatcaatttttcggtggat

SEQ ID NO: 7479276 - DNA, 22 bp, Homo sapiens
agtaatcaatttttcggtggat

SEQ ID NO: 7479277 - DNA, 22 bp, Homo sapiens
agtaataatttatattagggag

SEQ ID NO: 7479278 - DNA, 22 bp, Homo sapiens
agtaatcaaattaagctaattg

SEQ ID NO: 7479279 - DNA, 22 bp, Homo sapiens
agtaatcaatttttcggtggat

SEQ ID NO: 7479280 - DNA, 22 bp, Homo sapiens
agtaatctgattttatagctat

SEQ ID NO: 7479281 - DNA, 22 bp, Homo sapiens
agtaatcaatttttcggtggat

SEQ ID NO: 7479282 - DNA, 22 bp, Homo sapiens
agtaacaggtgtacagactatc

SEQ ID NO: 7479283 - DNA, 22 bp, Homo sapiens
agtaacaggtgtacagactatc

SEQ ID NO: 7479284 - DNA, 22 bp, Homo sapiens
agtaacaggatccaaagaatgt

SEQ ID NO: 7479285 - DNA, 22 bp, Homo sapiens
cctttattcaattagtcctaat

SEQ ID NO: 7479286 - DNA, 22 bp, Homo sapiens
agtaacaggatccaaagaatgt

SEQ ID NO: 7479287 - DNA, 22 bp, Homo sapiens
agtaacagggtatttgtgtggg

SEQ ID NO: 7479288 - DNA, 22 bp, Homo sapiens
agtaacagggtatttgtgtggg

SEQ ID NO: 7479289 - DNA, 22 bp, Homo sapiens
agtaacaggtgtacagactatc

SEQ ID NO: 7479290 - DNA, 22 bp, Homo sapiens
agtcagagtcgccgacagtcaa

SEQ ID NO: 7479291 - DNA, 17 bp, Homo sapiens
agtcagaggagtatctg

SEQ ID NO: 7479292 - DNA, 22 bp, Homo sapiens
agtcagagtcgccgacagtcaa

SEQ ID NO: 7479293 - DNA, 22 bp, Homo sapiens
agtcagagtcgccgacagtcaa

SEQ ID NO: 7479294 - DNA, 17 bp, Homo sapiens
agtcagaggagtatctg

SEQ ID NO: 7479295 - DNA, 22 bp, Homo sapiens
agtcagagtctattgctgtggt

SEQ ID NO: 7479296 - DNA, 22 bp, Homo sapiens
agtcagagtcgccgacagtcaa

SEQ ID NO: 7479297 - DNA, 22 bp, Homo sapiens
agtcagagtcgccgacagtcaa

SEQ ID NO: 7479298 - DNA, 22 bp, Homo sapiens
agtcagaggaatgggccaggct

SEQ ID NO: 7479299 - DNA, 22 bp, Homo sapiens
agtcagaggaatgggccaggct

SEQ ID NO: 7479300 - DNA, 22 bp, Homo sapiens
agtcagaggaatgggccaggct

SEQ ID NO: 7479301 - DNA, 22 bp, Homo sapiens
agtcagaggaatgggccaggct

SEQ ID NO: 7479302 - DNA, 17 bp, Homo sapiens
agtcagaggagtatctg

SEQ ID NO: 7479303 - DNA, 17 bp, Homo sapiens
agtcagaggagtatctg

SEQ ID NO: 7479304 - DNA, 17 bp, Homo sapiens
agtcagaggagtatctg

SEQ ID NO: 7479305 - DNA, 22 bp, Homo sapiens
agtcagagtctattgctgtggt

SEQ ID NO: 7479306 - DNA, 22 bp, Homo sapiens
agtcagagtctattgctgtggt

SEQ ID NO: 7479307 - DNA, 22 bp, Homo sapiens
agtcagagtctattgctgtggt

SEQ ID NO: 7479308 - DNA, 22 bp, Homo sapiens
agtcagagttcttggggagaca

SEQ ID NO: 7479309 - DNA, 22 bp, Homo sapiens
agtcagagttcttggggagaca

SEQ ID NO: 7479310 - DNA, 22 bp, Homo sapiens
agtcagagttcttggggagaca

SEQ ID NO: 7479311 - DNA, 22 bp, Homo sapiens
agtcagagtgtgcaggccggct

SEQ ID NO: 7479312 - DNA, 22 bp, Homo sapiens
agtcagagtgtgcaggccggct

SEQ ID NO: 7479313 - DNA, 22 bp, Homo sapiens
agtcagagttttgaggtgtgac

SEQ ID NO: 7479314 - DNA, 22 bp, Homo sapiens
agtcagagttcttggggagaca

SEQ ID NO: 7479315 - DNA, 22 bp, Homo sapiens
agtcagagttttgaggtgtgac

SEQ ID NO: 7479316 - DNA, 22 bp, Homo sapiens
agtcagagttttgaggtgtgac

SEQ ID NO: 7479317 - DNA, 22 bp, Homo sapiens
agtcagatttagatgtagcaag

SEQ ID NO: 7479318 - DNA, 22 bp, Homo sapiens
agtcagcactcctgaggatcac

SEQ ID NO: 7479319 - DNA, 22 bp, Homo sapiens
agtcagagttttgaggtgtgac

SEQ ID NO: 7479320 - DNA, 22 bp, Homo sapiens
agtcagagttttgaggtgtgac

SEQ ID NO: 7479321 - DNA, 22 bp, Homo sapiens
agtcagatgatgtgaggagtgg

SEQ ID NO: 7479322 - DNA, 22 bp, Homo sapiens
agtcagatttagatgtagcaag

SEQ ID NO: 7479323 - DNA, 23 bp, Homo sapiens
ctacaagagcaagcatggacaag

SEQ ID NO: 7479324 - DNA, 23 bp, Homo sapiens
ctacaagagcaagcatggacaag

SEQ ID NO: 7479325 - DNA, 23 bp, Homo sapiens
ctacaagagcaagcatggacaag

SEQ ID NO: 7479326 - DNA, 23 bp, Homo sapiens
ctacaagagcaagcatggacaag

SEQ ID NO: 7479327 - DNA, 22 bp, Homo sapiens
ctacacagagcctacttctgca

SEQ ID NO: 7479328 - DNA, 22 bp, Homo sapiens
ctacacagagcctacttctgca

SEQ ID NO: 7479329 - DNA, 22 bp, Homo sapiens
ctacaatgacagaattgagtag

SEQ ID NO: 7479330 - DNA, 22 bp, Homo sapiens
ctacaagtcattccaggtactt

SEQ ID NO: 7479331 - DNA, 22 bp, Homo sapiens
ctacaagtcattccaggtactt

SEQ ID NO: 7479332 - DNA, 22 bp, Homo sapiens
ctacaagtgcaacctgtgcgac

SEQ ID NO: 7479333 - DNA, 22 bp, Homo sapiens
ctacaagtggagttctgacgca

SEQ ID NO: 7479334 - DNA, 22 bp, Homo sapiens
ctacaagtatgggggctccaaa

SEQ ID NO: 7479335 - DNA, 22 bp, Homo sapiens
ctacaagcatctatgtttcaag

SEQ ID NO: 7479336 - DNA, 21 bp, Homo sapiens
ctacaagtaaagtattgggac

SEQ ID NO: 7479337 - DNA, 22 bp, Homo sapiens
ctacaagatttttaaaactgta

SEQ ID NO: 7479338 - DNA, 22 bp, Homo sapiens
ctacaagatttttaaaactgta

SEQ ID NO: 7479339 - DNA, 22 bp, Homo sapiens
ctacaagatttttaaaactgta

SEQ ID NO: 7479340 - DNA, 22 bp, Homo sapiens
agtcagagaataaagaatgcat

SEQ ID NO: 7479341 - DNA, 22 bp, Homo sapiens
agtcagagaataaagaatgcat

SEQ ID NO: 7479342 - DNA, 22 bp, Homo sapiens
agtcagagaatgttttcatgga

SEQ ID NO: 7479343 - DNA, 22 bp, Homo sapiens
agtcagagaaaacagccctgtg

SEQ ID NO: 7479344 - DNA, 22 bp, Homo sapiens
agtcagagaataaagaatgcat

SEQ ID NO: 7479345 - DNA, 22 bp, Homo sapiens
agtcagagaaaacagccctgtg

SEQ ID NO: 7479346 - DNA, 22 bp, Homo sapiens
agtcagagaaaacagccctgtg

SEQ ID NO: 7479347 - DNA, 22 bp, Homo sapiens
agtcagaattcgatcccaggtc

SEQ ID NO: 7479348 - DNA, 22 bp, Homo sapiens
agtcagacacgttttccattag

SEQ ID NO: 7479349 - DNA, 22 bp, Homo sapiens
agtcagacacgttttccattag

SEQ ID NO: 7479350 - DNA, 22 bp, Homo sapiens
agtcagacataattctaacatt

SEQ ID NO: 7479351 - DNA, 22 bp, Homo sapiens
agtcagaagccggcctaaggga

SEQ ID NO: 7479352 - DNA, 22 bp, Homo sapiens
agtcactttgctactctgcctt

SEQ ID NO: 7479353 - DNA, 22 bp, Homo sapiens
agtcagaatctgcattttaacc

SEQ ID NO: 7479354 - DNA, 22 bp, Homo sapiens
agtcaccaacatggttcccagg

SEQ ID NO: 7479355 - DNA, 22 bp, Homo sapiens
agtcacatttgggggtgtcaaa

SEQ ID NO: 7479356 - DNA, 22 bp, Homo sapiens
agtcactttatgagagaaccat

SEQ ID NO: 7479357 - DNA, 22 bp, Homo sapiens
agtcactttatgagagaaccat

SEQ ID NO: 7479358 - DNA, 22 bp, Homo sapiens
agtcactttctacttggtttct

SEQ ID NO: 7479359 - DNA, 23 bp, Homo sapiens
agtcagagagtgtgagacaactg

SEQ ID NO: 7479360 - DNA, 23 bp, Homo sapiens
agtcagagagtgtgagacaactg

SEQ ID NO: 7479361 - DNA, 22 bp, Homo sapiens
agtcagagcaaactggacagac

SEQ ID NO: 7479362 - DNA, 22 bp, Homo sapiens
agtcagagcaaactggacagac

SEQ ID NO: 7479363 - DNA, 22 bp, Homo sapiens
agtcagagcaaactggacagac

SEQ ID NO: 7479364 - DNA, 22 bp, Homo sapiens
agtcagagctatgttgttatat

SEQ ID NO: 7479365 - DNA, 23 bp, Homo sapiens
agtcagagcagaagggctgcttg

SEQ ID NO: 7479366 - DNA, 23 bp, Homo sapiens
agtcagagcagaagggctgcttg

SEQ ID NO: 7479367 - DNA, 23 bp, Homo sapiens
agtcagagcagaagggctgcttg

SEQ ID NO: 7479368 - DNA, 23 bp, Homo sapiens
agtcagagcagaagggctgcttg

SEQ ID NO: 7479369 - DNA, 22 bp, Homo sapiens
agtcagagagctctcagcatag

SEQ ID NO: 7479370 - DNA, 22 bp, Homo sapiens
agtcagagagctctcagcatag

SEQ ID NO: 7479371 - DNA, 22 bp, Homo sapiens
agtcagagagctctcagcatag

SEQ ID NO: 7479372 - DNA, 22 bp, Homo sapiens
agtcagagagctctcagcatag

SEQ ID NO: 7479373 - DNA, 22 bp, Homo sapiens
agtcagagagctctcagcatag

SEQ ID NO: 7479374 - DNA, 23 bp, Homo sapiens
agtcagagagtgtgagacaactg

SEQ ID NO: 7479375 - DNA, 23 bp, Homo sapiens
agtcagagagtgtgagacaactg

SEQ ID NO: 7479376 - DNA, 23 bp, Homo sapiens
agtcagagagtgtgagacaactg

SEQ ID NO: 7479377 - DNA, 23 bp, Homo sapiens
agtcagagagtgtgagacaactg

SEQ ID NO: 7479378 - DNA, 22 bp, Homo sapiens
agtcagagaccctagatctaat

SEQ ID NO: 7479379 - DNA, 22 bp, Homo sapiens
agtcagagaccctagatctaat

SEQ ID NO: 7479380 - DNA, 22 bp, Homo sapiens
agtcagagaatgttttcatgga

SEQ ID NO: 7479381 - DNA, 22 bp, Homo sapiens
agtcagagaatgttttcatgga

SEQ ID NO: 7479382 - DNA, 22 bp, Homo sapiens
agtcagagaccctagatctaat

SEQ ID NO: 7479383 - DNA, 22 bp, Homo sapiens
ctacactgagagctcttcaggg

SEQ ID NO: 7479384 - DNA, 20 bp, Homo sapiens
ctacacttggcacctggcat

SEQ ID NO: 7479385 - DNA, 22 bp, Homo sapiens
ctacacttgttcgactgcagga

SEQ ID NO: 7479386 - DNA, 22 bp, Homo sapiens
ctacactttggttgactttgtg

SEQ ID NO: 7479387 - DNA, 20 bp, Homo sapiens
ctacacagggttcgctgggc

SEQ ID NO: 7479388 - DNA, 20 bp, Homo sapiens
ctacacagggttcgctgggc

SEQ ID NO: 7479389 - DNA, 20 bp, Homo sapiens
ctacacagggttcgctgggc

SEQ ID NO: 7479390 - DNA, 22 bp, Homo sapiens
ctacacagttctgcctaatggc

SEQ ID NO: 7479391 - DNA, 22 bp, Homo sapiens
ctacacagttctgcctaatggc

SEQ ID NO: 7479392 - DNA, 22 bp, Homo sapiens
ctacacagagcctacttctgca

SEQ ID NO: 7479393 - DNA, 21 bp, Homo sapiens
ctacacagctttctataggaa

SEQ ID NO: 7479394 - DNA, 21 bp, Homo sapiens
ctacacagctttctataggaa

SEQ ID NO: 7479395 - DNA, 21 bp, Homo sapiens
ctacacagctttctataggaa

SEQ ID NO: 7479396 - DNA, 22 bp, Homo sapiens
ctacagaaacactggacatgtg

SEQ ID NO: 7479397 - DNA, 22 bp, Homo sapiens
ctacagaaacactggacatgtg

SEQ ID NO: 7479398 - DNA, 22 bp, Homo sapiens
ctacagaaacctttttcataca

SEQ ID NO: 7479399 - DNA, 22 bp, Homo sapiens
ctacagaaaatcagccacaggc

SEQ ID NO: 7479400 - DNA, 22 bp, Homo sapiens
ctacagaaaatcagccacaggc

SEQ ID NO: 7479401 - DNA, 22 bp, Homo sapiens
ctacagaagaaactatcactat

SEQ ID NO: 7479402 - DNA, 22 bp, Homo sapiens
ctacagaagaaactatcactat

SEQ ID NO: 7479403 - DNA, 22 bp, Homo sapiens
ctacagaagaaactatcactat

SEQ ID NO: 7479404 - DNA, 22 bp, Homo sapiens
ctacagaaacctttttcataca

SEQ ID NO: 7479405 - DNA, 22 bp, Homo sapiens
ctacagaaacctttttcataca

SEQ ID NO: 7479406 - DNA, 21 bp, Homo sapiens
ctacagaatcgagcattctgg

SEQ ID NO: 7479407 - DNA, 21 bp, Homo sapiens
ctacagaatcgagcattctgg

SEQ ID NO: 7479408 - DNA, 21 bp, Homo sapiens
ctacagaatcgagcattctgg

SEQ ID NO: 7479409 - DNA, 21 bp, Homo sapiens
ctacagaatcgagcattctgg

SEQ ID NO: 7479410 - DNA, 21 bp, Homo sapiens
ctacagaatcgagcattctgg

SEQ ID NO: 7479411 - DNA, 22 bp, Homo sapiens
ctacagaagtttcccttgctta

SEQ ID NO: 7479412 - DNA, 22 bp, Homo sapiens
ctacagaagtttcccttgctta

SEQ ID NO: 7479413 - DNA, 22 bp, Homo sapiens
ctacagaaggagaaatgggtaa

SEQ ID NO: 7479414 - DNA, 22 bp, Homo sapiens
ctacagaaggagaaatgggtaa

SEQ ID NO: 7479415 - DNA, 21 bp, Homo sapiens
ctacagaagctctcctatcca

SEQ ID NO: 7479416 - DNA, 21 bp, Homo sapiens
ctacagaagctctcctatcca

SEQ ID NO: 7479417 - DNA, 22 bp, Homo sapiens
ctacagaagccgtggtcaggaa

SEQ ID NO: 7479418 - DNA, 22 bp, Homo sapiens
ctacagaagccgtggtcaggaa

SEQ ID NO: 7479419 - DNA, 22 bp, Homo sapiens
ctacagaagaaactatcactat

SEQ ID NO: 7479420 - DNA, 22 bp, Homo sapiens
ctacagaagaaactatcactat

SEQ ID NO: 7479421 - DNA, 22 bp, Homo sapiens
agtcaggggatctagacttgaa

SEQ ID NO: 7479422 - DNA, 22 bp, Homo sapiens
agtcagggcctggcctgctgaa

SEQ ID NO: 7479423 - DNA, 22 bp, Homo sapiens
agtcaggctgacaggctaggag

SEQ ID NO: 7479424 - DNA, 22 bp, Homo sapiens
agtcagggcctggcctgctgaa

SEQ ID NO: 7479425 - DNA, 22 bp, Homo sapiens
agtcaggctccttgcctttccc

SEQ ID NO: 7479426 - DNA, 22 bp, Homo sapiens
agtcaggcagctgagctttatg

SEQ ID NO: 7479427 - DNA, 22 bp, Homo sapiens
agtcaggattttggattattcg

SEQ ID NO: 7479428 - DNA, 22 bp, Homo sapiens
agtcaggattttggattattcg

SEQ ID NO: 7479429 - DNA, 21 bp, Homo sapiens
ctacagaatcgagcattctgg

SEQ ID NO: 7479430 - DNA, 22 bp, Homo sapiens
agtcagttaaactttgtaaagt

SEQ ID NO: 7479431 - DNA, 22 bp, Homo sapiens
agtcagttaacctcacagcatc

SEQ ID NO: 7479432 - DNA, 22 bp, Homo sapiens
agtcagttaaactttgtaaagt

SEQ ID NO: 7479433 - DNA, 22 bp, Homo sapiens
agtcagtgtgattctcaggagg

SEQ ID NO: 7479434 - DNA, 22 bp, Homo sapiens
agtcagtgtagaaagcccaggc

SEQ ID NO: 7479435 - DNA, 22 bp, Homo sapiens
agtcagtgtcaacaggaagtag

SEQ ID NO: 7479436 - DNA, 22 bp, Homo sapiens
agtcagtgtgattctcaggagg

SEQ ID NO: 7479437 - DNA, 22 bp, Homo sapiens
agtcagttcatggctctgtcct

SEQ ID NO: 7479438 - DNA, 19 bp, Homo sapiens
agtcagttctgaggaggaa

SEQ ID NO: 7479439 - DNA, 19 bp, Homo sapiens
agtcagttctgaggaggaa

SEQ ID NO: 7479440 - DNA, 22 bp, Homo sapiens
agtcagttgtggagatttaact

SEQ ID NO: 7479441 - DNA, 22 bp, Homo sapiens
agtcagttgcagtttatggatg

SEQ ID NO: 7479442 - DNA, 22 bp, Homo sapiens
agtcagttgcaaacatcaggca

SEQ ID NO: 7479443 - DNA, 22 bp, Homo sapiens
agtcagttgcaaacatcaggca

SEQ ID NO: 7479444 - DNA, 22 bp, Homo sapiens
agtcagtttccctggaaagcag

SEQ ID NO: 7479445 - DNA, 22 bp, Homo sapiens
agtcagttttctccagggggct

SEQ ID NO: 7479446 - DNA, 22 bp, Homo sapiens
agtcagttttctccagggggct

SEQ ID NO: 7479447 - DNA, 22 bp, Homo sapiens
agtcataattataaacatcagt

SEQ ID NO: 7479448 - DNA, 22 bp, Homo sapiens
agtcataactgtcctgggtgag

SEQ ID NO: 7479449 - DNA, 22 bp, Homo sapiens
agtcataattataaacatcagt

SEQ ID NO: 7479450 - DNA, 22 bp, Homo sapiens
ctaaacaatgaacaaagcactg

SEQ ID NO: 7479451 - DNA, 22 bp, Homo sapiens
ctaaacactatgtaagcaagaa

SEQ ID NO: 7479452 - DNA, 22 bp, Homo sapiens
ctaaacaatgaacaaagcactg

SEQ ID NO: 7479453 - DNA, 22 bp, Homo sapiens
ctaaacaggaaggagcacctga

SEQ ID NO: 7479454 - DNA, 22 bp, Homo sapiens
ctaaacatcttgcaatgcacag

SEQ ID NO: 7479455 - DNA, 22 bp, Homo sapiens
ctaaacaagggattataattga

SEQ ID NO: 7479456 - DNA, 22 bp, Homo sapiens
ctaaacaagggattataattga

SEQ ID NO: 7479457 - DNA, 22 bp, Homo sapiens
ctaaacaagggattataattga

SEQ ID NO: 7479458 - DNA, 22 bp, Homo sapiens
ctaaacaagggattataattga

SEQ ID NO: 7479459 - DNA, 22 bp, Homo sapiens
ctaaacaatgaacaaagcactg

SEQ ID NO: 7479460 - DNA, 22 bp, Homo sapiens
ctaaacaatgaacaaagcactg

SEQ ID NO: 7479461 - DNA, 22 bp, Homo sapiens
ctaaacaatgaacaaagcactg

SEQ ID NO: 7479462 - DNA, 22 bp, Homo sapiens
ctaaacaatgaacaaagcactg

SEQ ID NO: 7479463 - DNA, 22 bp, Homo sapiens
ctaaacaatgaacaaagcactg

SEQ ID NO: 7479464 - DNA, 22 bp, Homo sapiens
ctaaacatggcttagaacactc

SEQ ID NO: 7479465 - DNA, 22 bp, Homo sapiens
ctaaacatggcttagaacactc

SEQ ID NO: 7479466 - DNA, 22 bp, Homo sapiens
ctaaacatgcaagagcttctgg

SEQ ID NO: 7479467 - DNA, 22 bp, Homo sapiens
ctaaacatgcaagagcttctgg

SEQ ID NO: 7479468 - DNA, 22 bp, Homo sapiens
ctaaacatgcaagagcttctgg

SEQ ID NO: 7479469 - DNA, 22 bp, Homo sapiens
ctaaacatcttgcaatgcacag

SEQ ID NO: 7479470 - DNA, 22 bp, Homo sapiens
ctaaacatgaactacatttagg

SEQ ID NO: 7479471 - DNA, 22 bp, Homo sapiens
ctaaacatgaactacatttagg

SEQ ID NO: 7479472 - DNA, 22 bp, Homo sapiens
ctaaacatgaactacatttagg

SEQ ID NO: 7479473 - DNA, 22 bp, Homo sapiens
ctaaacatcttgcaatgcacag

SEQ ID NO: 7479474 - DNA, 22 bp, Homo sapiens
ctaaacatgaactacatttagg

SEQ ID NO: 7479475 - DNA, 22 bp, Homo sapiens
ctaaacatgtagcttttgtggt

SEQ ID NO: 7479476 - DNA, 22 bp, Homo sapiens
ctaaacatgtagcttttgtggt

SEQ ID NO: 7479477 - DNA, 22 bp, Homo sapiens
ctaaacatgttggtgctttaaa

SEQ ID NO: 7479478 - DNA, 22 bp, Homo sapiens
ctaaacatgttggtgctttaaa

SEQ ID NO: 7479479 - DNA, 22 bp, Homo sapiens
ctaaacctttgtgcttgcaatt

SEQ ID NO: 7479480 - DNA, 22 bp, Homo sapiens
ctaaacatgttggtgctttaaa

SEQ ID NO: 7479481 - DNA, 22 bp, Homo sapiens
ctaaaattatcaagataattcc

SEQ ID NO: 7479482 - DNA, 22 bp, Homo sapiens
ctaaaattatcaagataattcc

SEQ ID NO: 7479483 - DNA, 22 bp, Homo sapiens
cgtggctggggcgactccacgg

SEQ ID NO: 7479484 - DNA, 22 bp, Homo sapiens
cgtggctggggaggtcagccag

SEQ ID NO: 7479485 - DNA, 22 bp, Homo sapiens
cgtggctggggcgactccacgg

SEQ ID NO: 7479486 - DNA, 22 bp, Homo sapiens
cgtggctcttttctgcatcagg

SEQ ID NO: 7479487 - DNA, 22 bp, Homo sapiens
cgtggctcttttctgcatcagg

SEQ ID NO: 7479488 - DNA, 22 bp, Homo sapiens
cgtggcctttgagtgagctccc

SEQ ID NO: 7479489 - DNA, 17 bp, Homo sapiens
cgtggctgagccataga

SEQ ID NO: 7479490 - DNA, 22 bp, Homo sapiens
ctaaacaagatactaatgaggt

SEQ ID NO: 7479491 - DNA, 22 bp, Homo sapiens
ctaaacaagatactaatgaggt

SEQ ID NO: 7479492 - DNA, 22 bp, Homo sapiens
ctaaacaagatactaatgaggt

SEQ ID NO: 7479493 - DNA, 22 bp, Homo sapiens
ctaaacaagatactaatgaggt

SEQ ID NO: 7479494 - DNA, 22 bp, Homo sapiens
ctaaaattatcaagataattcc

SEQ ID NO: 7479495 - DNA, 22 bp, Homo sapiens
ctaaaattatcaagataattcc

SEQ ID NO: 7479496 - DNA, 22 bp, Homo sapiens
ctaaaattatcaagataattcc

SEQ ID NO: 7479497 - DNA, 22 bp, Homo sapiens
ctaaaattatcaagataattcc

SEQ ID NO: 7479498 - DNA, 22 bp, Homo sapiens
ctaaaattatcaagataattcc

SEQ ID NO: 7479499 - DNA, 22 bp, Homo sapiens
ctaaaattatcaagataattcc

SEQ ID NO: 7479500 - DNA, 22 bp, Homo sapiens
cgtgctgggtctgcggggccgt

SEQ ID NO: 7479501 - DNA, 20 bp, Homo sapiens
cgtgctgtgaccttgagcat

SEQ ID NO: 7479502 - DNA, 22 bp, Homo sapiens
cgtgctctggactcgtggcaca

SEQ ID NO: 7479503 - DNA, 22 bp, Homo sapiens
cgtgcttttcaaccattctcaa

SEQ ID NO: 7479504 - DNA, 22 bp, Homo sapiens
cgtggcagtggaaggctgggtg

SEQ ID NO: 7479505 - DNA, 22 bp, Homo sapiens
cgtggcagtggaaggctgggtg

SEQ ID NO: 7479506 - DNA, 22 bp, Homo sapiens
cgtggcagtggaaggctgggtg

SEQ ID NO: 7479507 - DNA, 22 bp, Homo sapiens
cgtggcagtggaaggctgggtg

SEQ ID NO: 7479508 - DNA, 22 bp, Homo sapiens
cgtggaatattataatggcaca

SEQ ID NO: 7479509 - DNA, 19 bp, Homo sapiens
cgtggagctggcaggcagg

SEQ ID NO: 7479510 - DNA, 22 bp, Homo sapiens
cgtggccagcacaaggcagtga

SEQ ID NO: 7479511 - DNA, 22 bp, Homo sapiens
cgtggccagcacaaggcagtga

SEQ ID NO: 7479512 - DNA, 22 bp, Homo sapiens
cgtggccagcacaaggcagtga

SEQ ID NO: 7479513 - DNA, 22 bp, Homo sapiens
cgtggccacccagtggtgcgtg

SEQ ID NO: 7479514 - DNA, 22 bp, Homo sapiens
cgtggcagtggaaggctgggtg

SEQ ID NO: 7479515 - DNA, 22 bp, Homo sapiens
cgtggcagtggtgtttcttagg

SEQ ID NO: 7479516 - DNA, 22 bp, Homo sapiens
cgtggccacccagtggtgcgtg

SEQ ID NO: 7479517 - DNA, 22 bp, Homo sapiens
cgtggccacccagtggtgcgtg

SEQ ID NO: 7479518 - DNA, 22 bp, Homo sapiens
cgtggccagtttcaagctacca

SEQ ID NO: 7479519 - DNA, 22 bp, Homo sapiens
cgtggccagccatttcctggaa

SEQ ID NO: 7479520 - DNA, 22 bp, Homo sapiens
cgtggcctctatggctcccgcc

SEQ ID NO: 7479521 - DNA, 22 bp, Homo sapiens
cgtggccagtttcaagctacca

SEQ ID NO: 7479522 - DNA, 22 bp, Homo sapiens
cgtgcgcctcagcctcgtgcgc

SEQ ID NO: 7479523 - DNA, 22 bp, Homo sapiens
cgtgccccggtgaggagttcag

SEQ ID NO: 7479524 - DNA, 22 bp, Homo sapiens
cgtgcgcctcagcctcgtgcgc

SEQ ID NO: 7479525 - DNA, 22 bp, Homo sapiens
cgtgccactgcactctagcctg

SEQ ID NO: 7479526 - DNA, 22 bp, Homo sapiens
cgtgccccggtgaggagttcag

SEQ ID NO: 7479527 - DNA, 22 bp, Homo sapiens
cgtgccactgcactccagtctg

SEQ ID NO: 7479528 - DNA, 22 bp, Homo sapiens
cgtgcatgatatatgagttgtt

SEQ ID NO: 7479529 - DNA, 22 bp, Homo sapiens
cgtgcagcggagctggtcactg

SEQ ID NO: 7479530 - DNA, 22 bp, Homo sapiens
cgtgccactgcactctagcctg

SEQ ID NO: 7479531 - DNA, 22 bp, Homo sapiens
cgtgccactgcactctagcctg

SEQ ID NO: 7479532 - DNA, 22 bp, Homo sapiens
cgtgatttgcaaattgaggcag

SEQ ID NO: 7479533 - DNA, 22 bp, Homo sapiens
cgtgattttgttgactggggcc

SEQ ID NO: 7479534 - DNA, 22 bp, Homo sapiens
cgtgatttatggtctggtggcg

SEQ ID NO: 7479535 - DNA, 22 bp, Homo sapiens
cgtgatttctggctttctatat

SEQ ID NO: 7479536 - DNA, 22 bp, Homo sapiens
cgtgatttctggctttctatat

SEQ ID NO: 7479537 - DNA, 22 bp, Homo sapiens
cgtgattggcttctgcattgga

SEQ ID NO: 7479538 - DNA, 22 bp, Homo sapiens
cgtgattggcttctgcattgga

SEQ ID NO: 7479539 - DNA, 22 bp, Homo sapiens
cgtgatagatttctgctcaagc

SEQ ID NO: 7479540 - DNA, 22 bp, Homo sapiens
cgtgaggggggtaaggcgtccg

SEQ ID NO: 7479541 - DNA, 22 bp, Homo sapiens
cgtgaggggggtaaggcgtccg

SEQ ID NO: 7479542 - DNA, 22 bp, Homo sapiens
cgtgagggcatggcagtgagga

SEQ ID NO: 7479543 - DNA, 22 bp, Homo sapiens
cgtgagggcatggcagtgagga

SEQ ID NO: 7479544 - DNA, 22 bp, Homo sapiens
cgtgagggcatggcagtgagga

SEQ ID NO: 7479545 - DNA, 22 bp, Homo sapiens
cgtgagggcatggcagtgagga

SEQ ID NO: 7479546 - DNA, 17 bp, Homo sapiens
cgtgagcagcaggtgcc

SEQ ID NO: 7479547 - DNA, 22 bp, Homo sapiens
cgctcacccgcccgcctgttgt

SEQ ID NO: 7479548 - DNA, 22 bp, Homo sapiens
cggtcaggtgcagcgttggcac

SEQ ID NO: 7479549 - DNA, 22 bp, Homo sapiens
cggtcaggtgcagcgttggcac

SEQ ID NO: 7479550 - DNA, 22 bp, Homo sapiens
cggtcaggtgcagcgttggcac

SEQ ID NO: 7479551 - DNA, 22 bp, Homo sapiens
cggtcaggtgcagcgttggcac

SEQ ID NO: 7479552 - DNA, 22 bp, Homo sapiens
cggtcaggtgcagcgttggcac

SEQ ID NO: 7479553 - DNA, 22 bp, Homo sapiens
cggtcaggtgcagcgttggcac

SEQ ID NO: 7479554 - DNA, 22 bp, Homo sapiens
cggtcaggtgcagcgttggcac

SEQ ID NO: 7479555 - DNA, 22 bp, Homo sapiens
cggtcaggtgcagcgttggcac

SEQ ID NO: 7479556 - DNA, 22 bp, Homo sapiens
cgtgagcaaaatggacactccc

SEQ ID NO: 7479557 - DNA, 19 bp, Homo sapiens
cgcctggcaggccctgcgc

SEQ ID NO: 7479558 - DNA, 19 bp, Homo sapiens
cgcctggcaggccctgcgc

SEQ ID NO: 7479559 - DNA, 22 bp, Homo sapiens
cgcctggaacctctaggaccag

SEQ ID NO: 7479560 - DNA, 19 bp, Homo sapiens
cgcctggcaggccctgcgc

SEQ ID NO: 7479561 - DNA, 19 bp, Homo sapiens
cgcctggcaggccctgcgc

SEQ ID NO: 7479562 - DNA, 22 bp, Homo sapiens
cgcctggatgttcacgggcagc

SEQ ID NO: 7479563 - DNA, 22 bp, Homo sapiens
cgcctggctgcagccggcgagg

SEQ ID NO: 7479564 - DNA, 22 bp, Homo sapiens
cgcctgggagtccacacctgct

SEQ ID NO: 7479565 - DNA, 19 bp, Homo sapiens
cgcctggcaggccctgcgc

SEQ ID NO: 7479566 - DNA, 22 bp, Homo sapiens
cgcctggctgcagccggcgagg

SEQ ID NO: 7479567 - DNA, 22 bp, Homo sapiens
cgcctgggagtccacacctgct

SEQ ID NO: 7479568 - DNA, 22 bp, Homo sapiens
cgcctgggagtccacacctgct

SEQ ID NO: 7479569 - DNA, 22 bp, Homo sapiens
cgcctttaaattgttttacact

SEQ ID NO: 7479570 - DNA, 22 bp, Homo sapiens
cgccttcaggccctttttgttg

SEQ ID NO: 7479571 - DNA, 22 bp, Homo sapiens
cgccttcaggccctttttgttg

SEQ ID NO: 7479572 - DNA, 22 bp, Homo sapiens
cgccttcacaaggacagtatat

SEQ ID NO: 7479573 - DNA, 22 bp, Homo sapiens
cgccttcacaaggacagtatat

SEQ ID NO: 7479574 - DNA, 22 bp, Homo sapiens
cgcgaggtggaggttgcagtga

SEQ ID NO: 7479575 - DNA, 22 bp, Homo sapiens
cgcgcggctctcgcgagatgtg

SEQ ID NO: 7479576 - DNA, 22 bp, Homo sapiens
cgcgctctccttctggcaccca

SEQ ID NO: 7479577 - DNA, 22 bp, Homo sapiens
cgcgctcatttccgcctccttc

SEQ ID NO: 7479578 - DNA, 22 bp, Homo sapiens
cgcggggctggaaaggaacttc

SEQ ID NO: 7479579 - DNA, 22 bp, Homo sapiens
cgcggagctccgcccggtgccc

SEQ ID NO: 7479580 - DNA, 22 bp, Homo sapiens
cgcggcgcgcccccgggtgtgt

SEQ ID NO: 7479581 - DNA, 22 bp, Homo sapiens
cgcggcgcgcccccgggtgtgt

SEQ ID NO: 7479582 - DNA, 22 bp, Homo sapiens
cgcggaggaggtcaggaggtga

SEQ ID NO: 7479583 - DNA, 22 bp, Homo sapiens
cgcgctgtttacgtgacttaat

SEQ ID NO: 7479584 - DNA, 22 bp, Homo sapiens
cgcggagctccgcccggtgccc

SEQ ID NO: 7479585 - DNA, 22 bp, Homo sapiens
cgcgctgcagacagcggaggcc

SEQ ID NO: 7479586 - DNA, 22 bp, Homo sapiens
cgcgctgcagacagcggaggcc

SEQ ID NO: 7479587 - DNA, 22 bp, Homo sapiens
cgcgggggtcctcaggcaggcg

SEQ ID NO: 7479588 - DNA, 22 bp, Homo sapiens
cgcggggctggaaaggaacttc

SEQ ID NO: 7479589 - DNA, 22 bp, Homo sapiens
cgcggggcttcagccgcccagt

SEQ ID NO: 7479590 - DNA, 22 bp, Homo sapiens
cgcggggcttcagccgcccagt

SEQ ID NO: 7479591 - DNA, 22 bp, Homo sapiens
cgcggtggcggcctccagcgcc

SEQ ID NO: 7479592 - DNA, 22 bp, Homo sapiens
cgcggtggcggcctccagcgcc

SEQ ID NO: 7479593 - DNA, 22 bp, Homo sapiens
cgcggtggcggcctccagcgcc

SEQ ID NO: 7479594 - DNA, 22 bp, Homo sapiens
cgcggtggcggcctccagcgcc

SEQ ID NO: 7479595 - DNA, 22 bp, Homo sapiens
cgcggtggcggcctccagcgcc

SEQ ID NO: 7479596 - DNA, 22 bp, Homo sapiens
cgcggtggcggcctccagcgcc

SEQ ID NO: 7479597 - DNA, 22 bp, Homo sapiens
cgcggtggcggcctccagcgcc

SEQ ID NO: 7479598 - DNA, 22 bp, Homo sapiens
cctgcctggagctgagtgtgga

SEQ ID NO: 7479599 - DNA, 22 bp, Homo sapiens
cctgcctggagctgagtgtgga

SEQ ID NO: 7479600 - DNA, 22 bp, Homo sapiens
cctgcctggagctgagtgtgga

SEQ ID NO: 7479601 - DNA, 22 bp, Homo sapiens
cctgcctggagctgagtgtgga

SEQ ID NO: 7479602 - DNA, 22 bp, Homo sapiens
cctgcctgctttctgctttgca

SEQ ID NO: 7479603 - DNA, 22 bp, Homo sapiens
cctgcctgcgtcctctgagggc

SEQ ID NO: 7479604 - DNA, 22 bp, Homo sapiens
cctgcctgctttctgctttgca

SEQ ID NO: 7479605 - DNA, 22 bp, Homo sapiens
cctgcctgctttctgctttgca

SEQ ID NO: 7479606 - DNA, 22 bp, Homo sapiens
cctgcctgctttctgctttgca

SEQ ID NO: 7479607 - DNA, 22 bp, Homo sapiens
cctgcctggatcagccatcctg

SEQ ID NO: 7479608 - DNA, 22 bp, Homo sapiens
cctgcctggatcagccatcctg

SEQ ID NO: 7479609 - DNA, 22 bp, Homo sapiens
cctgcctggatcagccatcctg

SEQ ID NO: 7479610 - DNA, 22 bp, Homo sapiens
cctgcctggatcagccatcctg

SEQ ID NO: 7479611 - DNA, 22 bp, Homo sapiens
cctgcctggatcagccatcctg

SEQ ID NO: 7479612 - DNA, 22 bp, Homo sapiens
cctgcctggatcagccatcctg

SEQ ID NO: 7479613 - DNA, 22 bp, Homo sapiens
cctgcctggcacatagtactct

SEQ ID NO: 7479614 - DNA, 22 bp, Homo sapiens
cctgcctggcacatagtactct

SEQ ID NO: 7479615 - DNA, 22 bp, Homo sapiens
cctgcctggatcagccatcctg

SEQ ID NO: 7479616 - DNA, 22 bp, Homo sapiens
cctgcctggcccaccttgccac

SEQ ID NO: 7479617 - DNA, 22 bp, Homo sapiens
cctgcctggcccaccttgccac

SEQ ID NO: 7479618 - DNA, 22 bp, Homo sapiens
cctgcctggcccaccttgccac

SEQ ID NO: 7479619 - DNA, 20 bp, Homo sapiens
cctgcctggccattccttgg

SEQ ID NO: 7479620 - DNA, 20 bp, Homo sapiens
cctgcctggccattccttgg

SEQ ID NO: 7479621 - DNA, 22 bp, Homo sapiens
cctgcctggcacatagtactct

SEQ ID NO: 7479622 - DNA, 22 bp, Homo sapiens
cctgcctggctgtcagcagagc

SEQ ID NO: 7479623 - DNA, 22 bp, Homo sapiens
cctgcctggctgtcagcagagc

SEQ ID NO: 7479624 - DNA, 22 bp, Homo sapiens
cctgcctggctgtcagcagagc

SEQ ID NO: 7479625 - DNA, 22 bp, Homo sapiens
cctgcctggctgtcagcagagc

SEQ ID NO: 7479626 - DNA, 22 bp, Homo sapiens
cctgcctggcccaccttgccac

SEQ ID NO: 7479627 - DNA, 22 bp, Homo sapiens
cctgcctggcccaccttgccac

SEQ ID NO: 7479628 - DNA, 22 bp, Homo sapiens
cctgcctggctgtcagcagagc

SEQ ID NO: 7479629 - DNA, 22 bp, Homo sapiens
cctgcctggctgtcagcagagc

SEQ ID NO: 7479630 - DNA, 22 bp, Homo sapiens
cctggagcaggagctgcagagg

SEQ ID NO: 7479631 - DNA, 22 bp, Homo sapiens
cctggagcaggagctgcagagg

SEQ ID NO: 7479632 - DNA, 22 bp, Homo sapiens
cctggagcatcaggaggaaggg

SEQ ID NO: 7479633 - DNA, 22 bp, Homo sapiens
cctggagcatcaggaggaaggg

SEQ ID NO: 7479634 - DNA, 22 bp, Homo sapiens
cctggagcatcaggaggaaggg

SEQ ID NO: 7479635 - DNA, 22 bp, Homo sapiens
cctggagcatcaggaggaaggg

SEQ ID NO: 7479636 - DNA, 22 bp, Homo sapiens
cctggagcatcaggaggaaggg

SEQ ID NO: 7479637 - DNA, 22 bp, Homo sapiens
cctggagcccaaggcagtgaga

SEQ ID NO: 7479638 - DNA, 22 bp, Homo sapiens
cctggagcccaaggcagtgaga

SEQ ID NO: 7479639 - DNA, 22 bp, Homo sapiens
cctggagcccaaggcagtgaga

SEQ ID NO: 7479640 - DNA, 22 bp, Homo sapiens
cctggagcccaaggcagtgaga

SEQ ID NO: 7479641 - DNA, 22 bp, Homo sapiens
cctggagcccaaggcagtgaga

SEQ ID NO: 7479642 - DNA, 22 bp, Homo sapiens
cctggagcccaaggcagtgaga

SEQ ID NO: 7479643 - DNA, 22 bp, Homo sapiens
cctggagcccaaggcagtgaga

SEQ ID NO: 7479644 - DNA, 22 bp, Homo sapiens
cctggagcccaaggcagtgaga

SEQ ID NO: 7479645 - DNA, 21 bp, Homo sapiens
cctggactaaaaccaggccac

SEQ ID NO: 7479646 - DNA, 21 bp, Homo sapiens
cctggactaaaaccaggccac

SEQ ID NO: 7479647 - DNA, 18 bp, Homo sapiens
cctggacctgtctccttt

SEQ ID NO: 7479648 - DNA, 18 bp, Homo sapiens
cctggacctgtctccttt

SEQ ID NO: 7479649 - DNA, 21 bp, Homo sapiens
cctggactaaaaccaggccac

SEQ ID NO: 7479650 - DNA, 21 bp, Homo sapiens
cctggactaaaaccaggccac

SEQ ID NO: 7479651 - DNA, 18 bp, Homo sapiens
cctggacctgtctccttt

SEQ ID NO: 7479652 - DNA, 22 bp, Homo sapiens
cctggactcagaggtgctggtg

SEQ ID NO: 7479653 - DNA, 22 bp, Homo sapiens
cctggagcaggagctgcagagg

SEQ ID NO: 7479654 - DNA, 22 bp, Homo sapiens
cctggactcagaggtgctggtg

SEQ ID NO: 7479655 - DNA, 21 bp, Homo sapiens
cctggactaaaaccaggccac

SEQ ID NO: 7479656 - DNA, 22 bp, Homo sapiens
cctggactaaaatcttttctta

SEQ ID NO: 7479657 - DNA, 22 bp, Homo sapiens
cctggactaaaatcttttctta

SEQ ID NO: 7479658 - DNA, 22 bp, Homo sapiens
cctggagcaggagctgcagagg

SEQ ID NO: 7479659 - DNA, 22 bp, Homo sapiens
cctggagcaggagctgcagagg

SEQ ID NO: 7479660 - DNA, 22 bp, Homo sapiens
cctggagcaggagctgcagagg

SEQ ID NO: 7479661 - DNA, 19 bp, Homo sapiens
agggtggcaaaggagggtg

SEQ ID NO: 7479662 - DNA, 20 bp, Homo sapiens
agggtggcaagttagtgaca

SEQ ID NO: 7479663 - DNA, 20 bp, Homo sapiens
agggtggcaagttagtgaca

SEQ ID NO: 7479664 - DNA, 19 bp, Homo sapiens
agggtggcaaaggagggtg

SEQ ID NO: 7479665 - DNA, 19 bp, Homo sapiens
agggtggcaaaggagggtg

SEQ ID NO: 7479666 - DNA, 19 bp, Homo sapiens
agggtggcaaaggagggtg

SEQ ID NO: 7479667 - DNA, 19 bp, Homo sapiens
agggtggcaaaggagggtg

SEQ ID NO: 7479668 - DNA, 22 bp, Homo sapiens
agggtggcactggtggctctat

SEQ ID NO: 7479669 - DNA, 22 bp, Homo sapiens
agggtggcacctggaagggatg

SEQ ID NO: 7479670 - DNA, 22 bp, Homo sapiens
agggtggcacctggaagggatg

SEQ ID NO: 7479671 - DNA, 22 bp, Homo sapiens
agggtggcacctggaagggatg

SEQ ID NO: 7479672 - DNA, 20 bp, Homo sapiens
agggtggcaagttagtgaca

SEQ ID NO: 7479673 - DNA, 22 bp, Homo sapiens
agggtggcaccacatatcatag

SEQ ID NO: 7479674 - DNA, 22 bp, Homo sapiens
agggtggcaccacatatcatag

SEQ ID NO: 7479675 - DNA, 22 bp, Homo sapiens
agggtggcacctggaagggatg

SEQ ID NO: 7479676 - DNA, 22 bp, Homo sapiens
agggtggcagttactggagcaa

SEQ ID NO: 7479677 - DNA, 22 bp, Homo sapiens
cctgcctgcggcccgcggggag

SEQ ID NO: 7479678 - DNA, 22 bp, Homo sapiens
cctgcctgcggcccgcggggag

SEQ ID NO: 7479679 - DNA, 22 bp, Homo sapiens
agggtggcagttactggagcaa

SEQ ID NO: 7479680 - DNA, 22 bp, Homo sapiens
cctgcctgcgtcctctgagggc

SEQ ID NO: 7479681 - DNA, 22 bp, Homo sapiens
cctgcctgcgtcctctgagggc

SEQ ID NO: 7479682 - DNA, 22 bp, Homo sapiens
cctgcctgcgtcctctgagggc

SEQ ID NO: 7479683 - DNA, 22 bp, Homo sapiens
cctgcctgcgtcctctgagggc

SEQ ID NO: 7479684 - DNA, 22 bp, Homo sapiens
cctgcctgcgtcctctgagggc

SEQ ID NO: 7479685 - DNA, 22 bp, Homo sapiens
agggtggcactggtggctctat

SEQ ID NO: 7479686 - DNA, 22 bp, Homo sapiens
agggtggcactggtggctctat

SEQ ID NO: 7479687 - DNA, 22 bp, Homo sapiens
agggtggcactggtggctctat

SEQ ID NO: 7479688 - DNA, 22 bp, Homo sapiens
agggtggcactggtggctctat

SEQ ID NO: 7479689 - DNA, 22 bp, Homo sapiens
agggtggcagttactggagcaa

SEQ ID NO: 7479690 - DNA, 22 bp, Homo sapiens
agggtggcagttactggagcaa

SEQ ID NO: 7479691 - DNA, 22 bp, Homo sapiens
agggtggcagttactggagcaa

SEQ ID NO: 7479692 - DNA, 22 bp, Homo sapiens
agggtggcactggtggctctat

SEQ ID NO: 7479693 - DNA, 22 bp, Homo sapiens
aggggctttggtgctggtcctg

SEQ ID NO: 7479694 - DNA, 22 bp, Homo sapiens
aggggctttggtgctggtcctg

SEQ ID NO: 7479695 - DNA, 22 bp, Homo sapiens
aggggctttggtgctggtcctg

SEQ ID NO: 7479696 - DNA, 22 bp, Homo sapiens
aggggcttgtggagttgctggt

SEQ ID NO: 7479697 - DNA, 17 bp, Homo sapiens
agggggaacctgggagg

SEQ ID NO: 7479698 - DNA, 22 bp, Homo sapiens
aggggcttatgtttctccaggc

SEQ ID NO: 7479699 - DNA, 23 bp, Homo sapiens
agggtgagcaagctatggagacc

SEQ ID NO: 7479700 - DNA, 23 bp, Homo sapiens
agggtgagcaagctatggagacc

SEQ ID NO: 7479701 - DNA, 23 bp, Homo sapiens
agggtgagcaagctatggagacc

SEQ ID NO: 7479702 - DNA, 23 bp, Homo sapiens
agggtgagcaagctatggagacc

SEQ ID NO: 7479703 - DNA, 23 bp, Homo sapiens
agggtgagcaagctatggagacc

SEQ ID NO: 7479704 - DNA, 23 bp, Homo sapiens
agggtgagcaagctatggagacc

SEQ ID NO: 7479705 - DNA, 22 bp, Homo sapiens
aggggcttcccttcctgggtag

SEQ ID NO: 7479706 - DNA, 22 bp, Homo sapiens
aggggcttcccttcctgggtag

SEQ ID NO: 7479707 - DNA, 22 bp, Homo sapiens
aggggcttgtggagttgctggt

SEQ ID NO: 7479708 - DNA, 22 bp, Homo sapiens
aggggcttatgtttctccaggc

SEQ ID NO: 7479709 - DNA, 22 bp, Homo sapiens
aggggctgtggaaaccaactct

SEQ ID NO: 7479710 - DNA, 22 bp, Homo sapiens
aggggctgtggaaaccaactct

SEQ ID NO: 7479711 - DNA, 22 bp, Homo sapiens
aggggctgtggaaaccaactct

SEQ ID NO: 7479712 - DNA, 19 bp, Homo sapiens
agggtggcaaaggagggtg

SEQ ID NO: 7479713 - DNA, 19 bp, Homo sapiens
agggtggcaaaggagggtg

SEQ ID NO: 7479714 - DNA, 19 bp, Homo sapiens
agggtggcaaaggagggtg

SEQ ID NO: 7479715 - DNA, 22 bp, Homo sapiens
agggtggagggagtccctgagc

SEQ ID NO: 7479716 - DNA, 22 bp, Homo sapiens
agggtggagggagtccctgagc

SEQ ID NO: 7479717 - DNA, 19 bp, Homo sapiens
agggtggcaaaggagggtg

SEQ ID NO: 7479718 - DNA, 22 bp, Homo sapiens
agggtggaagatggcactatct

SEQ ID NO: 7479719 - DNA, 22 bp, Homo sapiens
agggtgctgccggacaggtggg

SEQ ID NO: 7479720 - DNA, 22 bp, Homo sapiens
agggtggaagatggcactatct

SEQ ID NO: 7479721 - DNA, 22 bp, Homo sapiens
agggtggaagatggcactatct

SEQ ID NO: 7479722 - DNA, 22 bp, Homo sapiens
agggtgctgccggacaggtggg

SEQ ID NO: 7479723 - DNA, 22 bp, Homo sapiens
agggtggaagatggcactatct

SEQ ID NO: 7479724 - DNA, 22 bp, Homo sapiens
agggtgctctggaaaatgtagt

SEQ ID NO: 7479725 - DNA, 22 bp, Homo sapiens
agggtgctgccggacaggtggg

SEQ ID NO: 7479726 - DNA, 22 bp, Homo sapiens
agggtgctaatctcattcacat

SEQ ID NO: 7479727 - DNA, 22 bp, Homo sapiens
agggtgctaatctcattcacat

SEQ ID NO: 7479728 - DNA, 23 bp, Homo sapiens
agggtgagcaagctatggagacc

SEQ ID NO: 7479729 - DNA, 23 bp, Homo sapiens
agggtgagcaagctatggagacc

SEQ ID NO: 7479730 - DNA, 22 bp, Homo sapiens
cctggccagcagccccttcctc

SEQ ID NO: 7479731 - DNA, 22 bp, Homo sapiens
cctggccagcagccccttcctc

SEQ ID NO: 7479732 - DNA, 22 bp, Homo sapiens
cctggccagccagggctggggt

SEQ ID NO: 7479733 - DNA, 22 bp, Homo sapiens
cctggccagccagggctggggt

SEQ ID NO: 7479734 - DNA, 22 bp, Homo sapiens
cctggccagccagggctggggt

SEQ ID NO: 7479735 - DNA, 22 bp, Homo sapiens
cctggccagccagggctggggt

SEQ ID NO: 7479736 - DNA, 22 bp, Homo sapiens
cctggccttaagggcagggagc

SEQ ID NO: 7479737 - DNA, 22 bp, Homo sapiens
cctggccttaagggcagggagc

SEQ ID NO: 7479738 - DNA, 22 bp, Homo sapiens
cctggccttaagggcagggagc

SEQ ID NO: 7479739 - DNA, 22 bp, Homo sapiens
agggtggcttaattccaaaggg

SEQ ID NO: 7479740 - DNA, 22 bp, Homo sapiens
agggtggcttaattccaaaggg

SEQ ID NO: 7479741 - DNA, 22 bp, Homo sapiens
agggtggctgtgaagtgcttgg

SEQ ID NO: 7479742 - DNA, 22 bp, Homo sapiens
agggtggctgtgaagtgcttgg

SEQ ID NO: 7479743 - DNA, 22 bp, Homo sapiens
cctggccagcagccccttcctc

SEQ ID NO: 7479744 - DNA, 23 bp, Homo sapiens
agggtggcttgctttgcttcctt

SEQ ID NO: 7479745 - DNA, 23 bp, Homo sapiens
agggtggcttgctttgcttcctt

SEQ ID NO: 7479746 - DNA, 22 bp, Homo sapiens
agggtggcttaattccaaaggg

SEQ ID NO: 7479747 - DNA, 22 bp, Homo sapiens
agggtggcttaattccaaaggg

SEQ ID NO: 7479748 - DNA, 21 bp, Homo sapiens
agggtggctctgggtcagaac

SEQ ID NO: 7479749 - DNA, 22 bp, Homo sapiens
agggtggctgagtagatggaag

SEQ ID NO: 7479750 - DNA, 22 bp, Homo sapiens
agggtggctgagtagatggaag

SEQ ID NO: 7479751 - DNA, 22 bp, Homo sapiens
agggtggctgagtagatggaag

SEQ ID NO: 7479752 - DNA, 21 bp, Homo sapiens
agggtggctctgggtcagaac

SEQ ID NO: 7479753 - DNA, 21 bp, Homo sapiens
agggtggctctgggtcagaac

SEQ ID NO: 7479754 - DNA, 21 bp, Homo sapiens
agggtggctctgggtcagaac

SEQ ID NO: 7479755 - DNA, 21 bp, Homo sapiens
agggtggctctgggtcagaac

SEQ ID NO: 7479756 - DNA, 21 bp, Homo sapiens
agggtggctctgggtcagaac

SEQ ID NO: 7479757 - DNA, 22 bp, Homo sapiens
agggtggctgtgaagtgcttgg

SEQ ID NO: 7479758 - DNA, 22 bp, Homo sapiens
agggtggctgtgaagtgcttgg

SEQ ID NO: 7479759 - DNA, 22 bp, Homo sapiens
agggtggctgtgaagtgcttgg

SEQ ID NO: 7479760 - DNA, 22 bp, Homo sapiens
agggtggctggaggaatcagaa

SEQ ID NO: 7479761 - DNA, 22 bp, Homo sapiens
agggtggctggaggaatcagaa

SEQ ID NO: 7479762 - DNA, 22 bp, Homo sapiens
agggtggctggaggaatcagaa

SEQ ID NO: 7479763 - DNA, 21 bp, Homo sapiens
agggtggctctgggtcagaac

SEQ ID NO: 7479764 - DNA, 22 bp, Homo sapiens
agggtggctgagtagatggaag

SEQ ID NO: 7479765 - DNA, 22 bp, Homo sapiens
agggtggctggaggaatcagaa

SEQ ID NO: 7479766 - DNA, 22 bp, Homo sapiens
agggtggctggaggaatcagaa

SEQ ID NO: 7479767 - DNA, 22 bp, Homo sapiens
agggtggctgagtagatggaag

SEQ ID NO: 7479768 - DNA, 22 bp, Homo sapiens
agggtggctgagtagatggaag

SEQ ID NO: 7479769 - DNA, 22 bp, Homo sapiens
cctggagcccctctggccagcc

SEQ ID NO: 7479770 - DNA, 20 bp, Homo sapiens
cctggagcctggaaggagtc

SEQ ID NO: 7479771 - DNA, 20 bp, Homo sapiens
cctggagcctggaaggagtc

SEQ ID NO: 7479772 - DNA, 22 bp, Homo sapiens
cctggagcgcgggtcaagctgg

SEQ ID NO: 7479773 - DNA, 22 bp, Homo sapiens
cctggagcgcgggtcaagctgg

SEQ ID NO: 7479774 - DNA, 22 bp, Homo sapiens
cctggagcgcgggtcaagctgg

SEQ ID NO: 7479775 - DNA, 22 bp, Homo sapiens
cctggagcccctctggccagcc

SEQ ID NO: 7479776 - DNA, 22 bp, Homo sapiens
cctggagcccctctggccagcc

SEQ ID NO: 7479777 - DNA, 22 bp, Homo sapiens
cctggagcccctctggccagcc

SEQ ID NO: 7479778 - DNA, 22 bp, Homo sapiens
cctggagcccctctggccagcc

SEQ ID NO: 7479779 - DNA, 22 bp, Homo sapiens
cctggagcccctctggccagcc

SEQ ID NO: 7479780 - DNA, 22 bp, Homo sapiens
cctggagcccctctggccagcc

SEQ ID NO: 7479781 - DNA, 22 bp, Homo sapiens
cctggagcccctctggccagcc

SEQ ID NO: 7479782 - DNA, 22 bp, Homo sapiens
cctggagcccctctggccagcc

SEQ ID NO: 7479783 - DNA, 22 bp, Homo sapiens
agggtggccccactttggttgg

SEQ ID NO: 7479784 - DNA, 22 bp, Homo sapiens
agggtggccccactttggttgg

SEQ ID NO: 7479785 - DNA, 22 bp, Homo sapiens
agggtggccatgagggagagat

SEQ ID NO: 7479786 - DNA, 22 bp, Homo sapiens
agggtggccatgagggagagat

SEQ ID NO: 7479787 - DNA, 22 bp, Homo sapiens
agggtggccatgagggagagat

SEQ ID NO: 7479788 - DNA, 22 bp, Homo sapiens
agggtggccatgagggagagat

SEQ ID NO: 7479789 - DNA, 22 bp, Homo sapiens
agggtggccatgagggagagat

SEQ ID NO: 7479790 - DNA, 22 bp, Homo sapiens
agggtggccatgagggagagat

SEQ ID NO: 7479791 - DNA, 22 bp, Homo sapiens
agggtggccatgagggagagat

SEQ ID NO: 7479792 - DNA, 22 bp, Homo sapiens
cctggagctcactgggagccgg

SEQ ID NO: 7479793 - DNA, 22 bp, Homo sapiens
cctggagctcactgggagccgg

SEQ ID NO: 7479794 - DNA, 22 bp, Homo sapiens
cctggagctcactgggagccgg

SEQ ID NO: 7479795 - DNA, 22 bp, Homo sapiens
agggtggccaccaagtatgtca

SEQ ID NO: 7479796 - DNA, 22 bp, Homo sapiens
agggtggccaccaagtatgtca

SEQ ID NO: 7479797 - DNA, 22 bp, Homo sapiens
aggtatatattctggtccttat

SEQ ID NO: 7479798 - DNA, 18 bp, Homo sapiens
aggtataagtgatctgct

SEQ ID NO: 7479799 - DNA, 22 bp, Homo sapiens
aggtatagaattgaaagggttt

SEQ ID NO: 7479800 - DNA, 22 bp, Homo sapiens
aggtatatgaagatgaaataac

SEQ ID NO: 7479801 - DNA, 22 bp, Homo sapiens
aggtatatgaagatgaaataac

SEQ ID NO: 7479802 - DNA, 22 bp, Homo sapiens
aggtatatattctggtccttat

SEQ ID NO: 7479803 - DNA, 22 bp, Homo sapiens
aggtataagaagattatttata

SEQ ID NO: 7479804 - DNA, 22 bp, Homo sapiens
aggtataagtctcatttctgtt

SEQ ID NO: 7479805 - DNA, 18 bp, Homo sapiens
aggtataagtgatctgct

SEQ ID NO: 7479806 - DNA, 22 bp, Homo sapiens
aggtataagtctcatttctgtt

SEQ ID NO: 7479807 - DNA, 22 bp, Homo sapiens
aggtatattttgtatatactct

SEQ ID NO: 7479808 - DNA, 22 bp, Homo sapiens
aggtatcaacagcagagtctga

SEQ ID NO: 7479809 - DNA, 22 bp, Homo sapiens
aggtatctggtaagaggcagac

SEQ ID NO: 7479810 - DNA, 22 bp, Homo sapiens
aggtatctggtaagaggcagac

SEQ ID NO: 7479811 - DNA, 22 bp, Homo sapiens
aggtatctggtaagaggcagac

SEQ ID NO: 7479812 - DNA, 18 bp, Homo sapiens
aggtatatgaatctcttt

SEQ ID NO: 7479813 - DNA, 22 bp, Homo sapiens
aggtatatgttcatgtatgtgt

SEQ ID NO: 7479814 - DNA, 22 bp, Homo sapiens
aggtatattgaatgcttactta

SEQ ID NO: 7479815 - DNA, 22 bp, Homo sapiens
cctggctcagtgttgaaggggt

SEQ ID NO: 7479816 - DNA, 22 bp, Homo sapiens
cctggctcagtgttgaaggggt

SEQ ID NO: 7479817 - DNA, 22 bp, Homo sapiens
cctggctcagtgttgaaggggt

SEQ ID NO: 7479818 - DNA, 22 bp, Homo sapiens
cctggctcattatgtgccccca

SEQ ID NO: 7479819 - DNA, 22 bp, Homo sapiens
cctggctcattatgtgccccca

SEQ ID NO: 7479820 - DNA, 22 bp, Homo sapiens
cctggctcattatgtgccccca

SEQ ID NO: 7479821 - DNA, 22 bp, Homo sapiens
cctggctcagtgttgaaggggt

SEQ ID NO: 7479822 - DNA, 22 bp, Homo sapiens
cctggctcagtgttgaaggggt

SEQ ID NO: 7479823 - DNA, 22 bp, Homo sapiens
cctggctcagtgttgaaggggt

SEQ ID NO: 7479824 - DNA, 22 bp, Homo sapiens
cctggctcaggcacgcatggct

SEQ ID NO: 7479825 - DNA, 22 bp, Homo sapiens
cctggctcaggcacgcatggct

SEQ ID NO: 7479826 - DNA, 22 bp, Homo sapiens
cctggctcaggcacgcatggct

SEQ ID NO: 7479827 - DNA, 22 bp, Homo sapiens
cctggctccaaagctgtgactc

SEQ ID NO: 7479828 - DNA, 22 bp, Homo sapiens
cctggctccaaagctgtgactc

SEQ ID NO: 7479829 - DNA, 22 bp, Homo sapiens
cctggctccaaagctgtgactc

SEQ ID NO: 7479830 - DNA, 22 bp, Homo sapiens
cctggctcattatgtgccccca

SEQ ID NO: 7479831 - DNA, 22 bp, Homo sapiens
cctggctcattatgtgccccca

SEQ ID NO: 7479832 - DNA, 22 bp, Homo sapiens
cctggctcattatgtgccccca

SEQ ID NO: 7479833 - DNA, 22 bp, Homo sapiens
aggtataagaagattatttata

SEQ ID NO: 7479834 - DNA, 20 bp, Homo sapiens
aggtataagaaatgtgattt

SEQ ID NO: 7479835 - DNA, 17 bp, Homo sapiens
aggtataaaatggtagc

SEQ ID NO: 7479836 - DNA, 17 bp, Homo sapiens
aggtataaaatggtagc

SEQ ID NO: 7479837 - DNA, 17 bp, Homo sapiens
aggtataaaatggtagc

SEQ ID NO: 7479838 - DNA, 22 bp, Homo sapiens
cctggctcaaggcgaggactcc

SEQ ID NO: 7479839 - DNA, 22 bp, Homo sapiens
cctggctcaaggcgaggactcc

SEQ ID NO: 7479840 - DNA, 22 bp, Homo sapiens
cctggctcaaggcgaggactcc

SEQ ID NO: 7479841 - DNA, 22 bp, Homo sapiens
cctggctcaaggcgaggactcc

SEQ ID NO: 7479842 - DNA, 22 bp, Homo sapiens
cctggctaggagagctgggctc

SEQ ID NO: 7479843 - DNA, 22 bp, Homo sapiens
cctggcctttgaacgctagact

SEQ ID NO: 7479844 - DNA, 22 bp, Homo sapiens
cctggctaggagagctgggctc

SEQ ID NO: 7479845 - DNA, 22 bp, Homo sapiens
cctggcctttgaacgctagact

SEQ ID NO: 7479846 - DNA, 22 bp, Homo sapiens
cctggcctttgaacgctagact

SEQ ID NO: 7479847 - DNA, 22 bp, Homo sapiens
cctggccttaagggcagggagc

SEQ ID NO: 7479848 - DNA, 22 bp, Homo sapiens
cctggctcaaggcgaggactcc

SEQ ID NO: 7479849 - DNA, 22 bp, Homo sapiens
cctggctcaaggcgaggactcc

SEQ ID NO: 7479850 - DNA, 22 bp, Homo sapiens
cctggctcaaggcgaggactcc

SEQ ID NO: 7479851 - DNA, 22 bp, Homo sapiens
cctggctcaaggcgaggactcc

SEQ ID NO: 7479852 - DNA, 22 bp, Homo sapiens
cctggctcaaggcgaggactcc

SEQ ID NO: 7479853 - DNA, 23 bp, Homo sapiens
cctggctcaccccttatgtccag

SEQ ID NO: 7479854 - DNA, 23 bp, Homo sapiens
cctggctcaccccttatgtccag

SEQ ID NO: 7479855 - DNA, 23 bp, Homo sapiens
cctggctcaccccttatgtccag

SEQ ID NO: 7479856 - DNA, 23 bp, Homo sapiens
cctggctcaccccttatgtccag

SEQ ID NO: 7479857 - DNA, 23 bp, Homo sapiens
cctggctcaccccttatgtccag

SEQ ID NO: 7479858 - DNA, 23 bp, Homo sapiens
cctggctcaccccttatgtccag

SEQ ID NO: 7479859 - DNA, 23 bp, Homo sapiens
cctggctcaccccttatgtccag

SEQ ID NO: 7479860 - DNA, 22 bp, Homo sapiens
cctggctcagcagctctttctc

SEQ ID NO: 7479861 - DNA, 22 bp, Homo sapiens
cctggctcagagtatgtcatcg

SEQ ID NO: 7479862 - DNA, 22 bp, Homo sapiens
cctggctcagagtatgtcatcg

SEQ ID NO: 7479863 - DNA, 22 bp, Homo sapiens
cctggctcagcagctctttctc

SEQ ID NO: 7479864 - DNA, 22 bp, Homo sapiens
cctggctcaggcacgcatggct

SEQ ID NO: 7479865 - DNA, 22 bp, Homo sapiens
cctggctcagcagctctttctc

SEQ ID NO: 7479866 - DNA, 22 bp, Homo sapiens
cctggctcaggcacgcatggct

SEQ ID NO: 7479867 - DNA, 22 bp, Homo sapiens
cctggctcaggcacgcatggct

SEQ ID NO: 7479868 - DNA, 22 bp, Homo sapiens
cctggctcaggcacgcatggct

SEQ ID NO: 7479869 - DNA, 22 bp, Homo sapiens
cctggctcaggcacgcatggct

SEQ ID NO: 7479870 - DNA, 22 bp, Homo sapiens
cctggctcaggcacgcatggct

SEQ ID NO: 7479871 - DNA, 22 bp, Homo sapiens
cctggctcaggcacgcatggct

SEQ ID NO: 7479872 - DNA, 22 bp, Homo sapiens
cctggctcagaccccagttctg

SEQ ID NO: 7479873 - DNA, 22 bp, Homo sapiens
cctggctcagaccccagttctg

SEQ ID NO: 7479874 - DNA, 22 bp, Homo sapiens
cctggctcagaccccagttctg

SEQ ID NO: 7479875 - DNA, 22 bp, Homo sapiens
cctggctcagaccccagttctg

SEQ ID NO: 7479876 - DNA, 22 bp, Homo sapiens
cctggctcagagtatgtcatcg

SEQ ID NO: 7479877 - DNA, 22 bp, Homo sapiens
cctggctcagagtatgtcatcg

SEQ ID NO: 7479878 - DNA, 22 bp, Homo sapiens
cctggctcagaccccagttctg

SEQ ID NO: 7479879 - DNA, 22 bp, Homo sapiens
cctggctcagaccccagttctg

SEQ ID NO: 7479880 - DNA, 22 bp, Homo sapiens
cctggctcagaccccagttctg

SEQ ID NO: 7479881 - DNA, 22 bp, Homo sapiens
cctggctcagaccccagttctg

SEQ ID NO: 7479882 - DNA, 22 bp, Homo sapiens
aggtatgtggttccatgatgag

SEQ ID NO: 7479883 - DNA, 22 bp, Homo sapiens
aggtatgtggttccatgatgag

SEQ ID NO: 7479884 - DNA, 21 bp, Homo sapiens
aggtatgttgagaactgagga

SEQ ID NO: 7479885 - DNA, 22 bp, Homo sapiens
aggtattattagcatctctatt

SEQ ID NO: 7479886 - DNA, 22 bp, Homo sapiens
aggtattattagcatctctatt

SEQ ID NO: 7479887 - DNA, 22 bp, Homo sapiens
aggtattagaagagtcatggga

SEQ ID NO: 7479888 - DNA, 22 bp, Homo sapiens
aggtattattagcatctctatt

SEQ ID NO: 7479889 - DNA, 22 bp, Homo sapiens
aggtattattagcatctctatt

SEQ ID NO: 7479890 - DNA, 22 bp, Homo sapiens
aggtattattagcatctctatt

SEQ ID NO: 7479891 - DNA, 22 bp, Homo sapiens
aggtattattagcatctctatt

SEQ ID NO: 7479892 - DNA, 22 bp, Homo sapiens
aggtattcagagagatgctttt

SEQ ID NO: 7479893 - DNA, 22 bp, Homo sapiens
aggtattcagagagatgctttt

SEQ ID NO: 7479894 - DNA, 22 bp, Homo sapiens
aggtatgtatgtgtgtatattt

SEQ ID NO: 7479895 - DNA, 22 bp, Homo sapiens
aggtatgtatgtgtgtatattt

SEQ ID NO: 7479896 - DNA, 22 bp, Homo sapiens
aggtatgtgctattgttatatt

SEQ ID NO: 7479897 - DNA, 22 bp, Homo sapiens
aggtatgtgctattgttatatt

SEQ ID NO: 7479898 - DNA, 22 bp, Homo sapiens
aggtatgagagccactctgtag

SEQ ID NO: 7479899 - DNA, 22 bp, Homo sapiens
aggtatgagcctctgcacccag

SEQ ID NO: 7479900 - DNA, 22 bp, Homo sapiens
aggtatgccaattaggtcaagt

SEQ ID NO: 7479901 - DNA, 22 bp, Homo sapiens
aggtatggcataaatcacaggg

SEQ ID NO: 7479902 - DNA, 22 bp, Homo sapiens
aggtatggcataaatcacaggg

SEQ ID NO: 7479903 - DNA, 17 bp, Homo sapiens
aggtctgagagtatctg

SEQ ID NO: 7479904 - DNA, 22 bp, Homo sapiens
aggtctgacttcaagcctgtgg

SEQ ID NO: 7479905 - DNA, 20 bp, Homo sapiens
aggtctgaatgtcagggctg

SEQ ID NO: 7479906 - DNA, 20 bp, Homo sapiens
aggtctgaatgtcagggctg

SEQ ID NO: 7479907 - DNA, 22 bp, Homo sapiens
aggtctcttgctgtctctgggc

SEQ ID NO: 7479908 - DNA, 22 bp, Homo sapiens
aggtcctgtctatcaccctcgc

SEQ ID NO: 7479909 - DNA, 22 bp, Homo sapiens
aggtctcttgctgtctctgggc

SEQ ID NO: 7479910 - DNA, 22 bp, Homo sapiens
aggtcctgtccttggtctctga

SEQ ID NO: 7479911 - DNA, 22 bp, Homo sapiens
aggtcctgtccttggtctctga

SEQ ID NO: 7479912 - DNA, 22 bp, Homo sapiens
aggtcctgtccttggtctctga

SEQ ID NO: 7479913 - DNA, 22 bp, Homo sapiens
aggtcctgtccttggtctctga

SEQ ID NO: 7479914 - DNA, 22 bp, Homo sapiens
aggtctggaaacagcagggaga

SEQ ID NO: 7479915 - DNA, 22 bp, Homo sapiens
aggtctggaaacagcagggaga

SEQ ID NO: 7479916 - DNA, 22 bp, Homo sapiens
aggtctggaaacagcagggaga

SEQ ID NO: 7479917 - DNA, 19 bp, Homo sapiens
aggtctgcagctgcagttt

SEQ ID NO: 7479918 - DNA, 22 bp, Homo sapiens
aggtctgcctcactcacttctg

SEQ ID NO: 7479919 - DNA, 22 bp, Homo sapiens
aggtctgcctcactcacttctg

SEQ ID NO: 7479920 - DNA, 22 bp, Homo sapiens
aggtctgcctcactcacttctg

SEQ ID NO: 7479921 - DNA, 22 bp, Homo sapiens
aggtctggaaacagcagggaga

SEQ ID NO: 7479922 - DNA, 22 bp, Homo sapiens
aggtctgctatgtgagcaatac

SEQ ID NO: 7479923 - DNA, 22 bp, Homo sapiens
aggtctgcctcactcacttctg

SEQ ID NO: 7479924 - DNA, 22 bp, Homo sapiens
aggtctgagtatggcctgagaa

SEQ ID NO: 7479925 - DNA, 22 bp, Homo sapiens
aggtctgagtcccaggggtacc

SEQ ID NO: 7479926 - DNA, 22 bp, Homo sapiens
aggtctgagtctatatacattg

SEQ ID NO: 7479927 - DNA, 22 bp, Homo sapiens
aggtctgatatttgttgtatga

SEQ ID NO: 7479928 - DNA, 20 bp, Homo sapiens
aggtctgattccagaatcag

SEQ ID NO: 7479929 - DNA, 22 bp, Homo sapiens
aggtctgattttttattcccag

SEQ ID NO: 7479930 - DNA, 18 bp, Homo sapiens
aggtctgaggaagagcct

SEQ ID NO: 7479931 - DNA, 22 bp, Homo sapiens
aggtctgagtagagaaaaggca

SEQ ID NO: 7479932 - DNA, 22 bp, Homo sapiens
aggtctgagtagagaaaaggca

SEQ ID NO: 7479933 - DNA, 22 bp, Homo sapiens
aggtctgagtatggcctgagaa

SEQ ID NO: 7479934 - DNA, 22 bp, Homo sapiens
aggtctgagtatggcctgagaa

SEQ ID NO: 7479935 - DNA, 22 bp, Homo sapiens
aggtctgagtatggcctgagaa

SEQ ID NO: 7479936 - DNA, 22 bp, Homo sapiens
aggtctgagtatggcctgagaa

SEQ ID NO: 7479937 - DNA, 22 bp, Homo sapiens
aggtctgagctcagggcctggc

SEQ ID NO: 7479938 - DNA, 22 bp, Homo sapiens
aggtctgagcaggggagaacag

SEQ ID NO: 7479939 - DNA, 22 bp, Homo sapiens
aggtctgagcaggggagaacag

SEQ ID NO: 7479940 - DNA, 22 bp, Homo sapiens
aggtctgagctcagggcctggc

SEQ ID NO: 7479941 - DNA, 22 bp, Homo sapiens
aggtctgagctccttcctctga

SEQ ID NO: 7479942 - DNA, 18 bp, Homo sapiens
aggtctgaggaagagcct

SEQ ID NO: 7479943 - DNA, 19 bp, Homo sapiens
aggtgaggggcaccatgtc

SEQ ID NO: 7479944 - DNA, 19 bp, Homo sapiens
aggtgaggggcaccatgtc

SEQ ID NO: 7479945 - DNA, 22 bp, Homo sapiens
aggtctggtgttgggcctgaaa

SEQ ID NO: 7479946 - DNA, 22 bp, Homo sapiens
aggtctggtgttgggcctgaaa

SEQ ID NO: 7479947 - DNA, 22 bp, Homo sapiens
aggtctggtgttgggcctgaaa

SEQ ID NO: 7479948 - DNA, 22 bp, Homo sapiens
aggtctggtgttgatgaattcc

SEQ ID NO: 7479949 - DNA, 22 bp, Homo sapiens
aggtctggtgttgggcctgaaa

SEQ ID NO: 7479950 - DNA, 22 bp, Homo sapiens
aggtctggtgttgggcctgaaa

SEQ ID NO: 7479951 - DNA, 22 bp, Homo sapiens
aggtctggtgttgggcctgaaa

SEQ ID NO: 7479952 - DNA, 19 bp, Homo sapiens
aggtgaggggcaccatgtc

SEQ ID NO: 7479953 - DNA, 19 bp, Homo sapiens
aggtgaggggcaccatgtc

SEQ ID NO: 7479954 - DNA, 19 bp, Homo sapiens
aggtgaggggcaccatgtc

SEQ ID NO: 7479955 - DNA, 19 bp, Homo sapiens
aggtgaggggcaccatgtc

SEQ ID NO: 7479956 - DNA, 22 bp, Homo sapiens
aggtgagggtgccagtgcatgg

SEQ ID NO: 7479957 - DNA, 22 bp, Homo sapiens
aggtgagggtgccagtgcatgg

SEQ ID NO: 7479958 - DNA, 22 bp, Homo sapiens
aggtgagggtgccagtgcatgg

SEQ ID NO: 7479959 - DNA, 22 bp, Homo sapiens
aggtgagggtgccagtgcatgg

SEQ ID NO: 7479960 - DNA, 22 bp, Homo sapiens
aggtgagggtgccagtgcatgg

SEQ ID NO: 7479961 - DNA, 22 bp, Homo sapiens
aggtgagggtgccagtgcatgg

SEQ ID NO: 7479962 - DNA, 22 bp, Homo sapiens
aggtgagggtgccagtgcatgg

SEQ ID NO: 7479963 - DNA, 22 bp, Homo sapiens
aggtgagggtgccagtgcatgg

SEQ ID NO: 7479964 - DNA, 22 bp, Homo sapiens
aggtgagggtgccagtgcatgg

SEQ ID NO: 7479965 - DNA, 22 bp, Homo sapiens
aggtgagggtgccagtgcatgg

SEQ ID NO: 7479966 - DNA, 22 bp, Homo sapiens
aggtgaggtttgggaggtgtca

SEQ ID NO: 7479967 - DNA, 22 bp, Homo sapiens
aggtgaggtttgggaggtgtca

SEQ ID NO: 7479968 - DNA, 22 bp, Homo sapiens
aggtgaggtttgggaggtgtca

SEQ ID NO: 7479969 - DNA, 22 bp, Homo sapiens
aggtgaggtttgggaggtgtca

SEQ ID NO: 7479970 - DNA, 22 bp, Homo sapiens
aggtgaggtttgggaggtgtca

SEQ ID NO: 7479971 - DNA, 22 bp, Homo sapiens
aggtctggtgagagcaggtgct

SEQ ID NO: 7479972 - DNA, 22 bp, Homo sapiens
aggtctggtgagagcaggtgct

SEQ ID NO: 7479973 - DNA, 22 bp, Homo sapiens
aggtctggtgagagcaggtgct

SEQ ID NO: 7479974 - DNA, 22 bp, Homo sapiens
aggtctggtgagagcaggtgct

SEQ ID NO: 7479975 - DNA, 22 bp, Homo sapiens
aggtctggtgagagcaggtgct

SEQ ID NO: 7479976 - DNA, 22 bp, Homo sapiens
aggtctggtgagagcaggtgct

SEQ ID NO: 7479977 - DNA, 22 bp, Homo sapiens
aggtctggtgagagcaggtgct

SEQ ID NO: 7479978 - DNA, 22 bp, Homo sapiens
aggtctgggattgaagacatca

SEQ ID NO: 7479979 - DNA, 22 bp, Homo sapiens
aggtctgggattgaagacatca

SEQ ID NO: 7479980 - DNA, 22 bp, Homo sapiens
aggtctgggcaccactggctgc

SEQ ID NO: 7479981 - DNA, 22 bp, Homo sapiens
aggtctgggattgaagacatca

SEQ ID NO: 7479982 - DNA, 22 bp, Homo sapiens
aggtctgggcaccactggctgc

SEQ ID NO: 7479983 - DNA, 23 bp, Homo sapiens
aggtctggacccttggcccctgc

SEQ ID NO: 7479984 - DNA, 23 bp, Homo sapiens
aggtctggacccttggcccctgc

SEQ ID NO: 7479985 - DNA, 23 bp, Homo sapiens
aggtctggacccttggcccctgc

SEQ ID NO: 7479986 - DNA, 22 bp, Homo sapiens
aggtctggaggcggagtcagga

SEQ ID NO: 7479987 - DNA, 22 bp, Homo sapiens
aggtctggaggcggagtcagga

SEQ ID NO: 7479988 - DNA, 22 bp, Homo sapiens
aggtctggaggcggagtcagga

SEQ ID NO: 7479989 - DNA, 22 bp, Homo sapiens
aggtctggaggcggagtcagga

SEQ ID NO: 7479990 - DNA, 22 bp, Homo sapiens
aggtctggaggcggagtcagga

SEQ ID NO: 7479991 - DNA, 22 bp, Homo sapiens
aggtctggaggcggagtcagga

SEQ ID NO: 7479992 - DNA, 22 bp, Homo sapiens
aggtctgggagttcattccctg

SEQ ID NO: 7479993 - DNA, 22 bp, Homo sapiens
aggtctgggagttcattccctg

SEQ ID NO: 7479994 - DNA, 22 bp, Homo sapiens
aggtctggctcttctccacaga

SEQ ID NO: 7479995 - DNA, 22 bp, Homo sapiens
aggtctggctcttctccacaga

SEQ ID NO: 7479996 - DNA, 22 bp, Homo sapiens
aggtctggagtgggatctgaga

SEQ ID NO: 7479997 - DNA, 22 bp, Homo sapiens
aggtctggagtgggatctgaga

SEQ ID NO: 7479998 - DNA, 22 bp, Homo sapiens
aggtctggaggcggagtcagga

SEQ ID NO: 7479999 - DNA, 22 bp, Homo sapiens
aggtctggaggcggagtcagga

SEQ ID NO: 7480000 - DNA, 22 bp, Homo sapiens
aggtctggagtgggatctgaga

SEQ ID NO: 7480001 - DNA, 22 bp, Homo sapiens
cctgggcagtgctggagttgaa

SEQ ID NO: 7480002 - DNA, 22 bp, Homo sapiens
cctgggcagtgctggagttgaa

SEQ ID NO: 7480003 - DNA, 22 bp, Homo sapiens
cctgggcagtgctggagttgaa

SEQ ID NO: 7480004 - DNA, 22 bp, Homo sapiens
cctgggcaggtgtggcttcccc

SEQ ID NO: 7480005 - DNA, 22 bp, Homo sapiens
aggtgcttccaggagacaaggt

SEQ ID NO: 7480006 - DNA, 22 bp, Homo sapiens
aggtgctgtttgtcagcagttt

SEQ ID NO: 7480007 - DNA, 22 bp, Homo sapiens
cctgggcataaatcactccaag

SEQ ID NO: 7480008 - DNA, 22 bp, Homo sapiens
cctgggcagtgctggagttgaa

SEQ ID NO: 7480009 - DNA, 22 bp, Homo sapiens
cctgggcagtgctggagttgaa

SEQ ID NO: 7480010 - DNA, 22 bp, Homo sapiens
cctgggcaggtgtggcttcccc

SEQ ID NO: 7480011 - DNA, 22 bp, Homo sapiens
cctgggcaggtgtggcttcccc

SEQ ID NO: 7480012 - DNA, 22 bp, Homo sapiens
cctgggcaggtgtggcttcccc

SEQ ID NO: 7480013 - DNA, 22 bp, Homo sapiens
cctgggcaggtgtggcttcccc

SEQ ID NO: 7480014 - DNA, 22 bp, Homo sapiens
cctgggcaggtgtggcttcccc

SEQ ID NO: 7480015 - DNA, 22 bp, Homo sapiens
cctgggcagggctggactctca

SEQ ID NO: 7480016 - DNA, 22 bp, Homo sapiens
cctgggcagggctggactctca

SEQ ID NO: 7480017 - DNA, 22 bp, Homo sapiens
cctgggcaggccggacgctggg

SEQ ID NO: 7480018 - DNA, 22 bp, Homo sapiens
cctgggcaggccggacgctggg

SEQ ID NO: 7480019 - DNA, 22 bp, Homo sapiens
cctgggcaggccggacgctggg

SEQ ID NO: 7480020 - DNA, 22 bp, Homo sapiens
cctgggcaggccggacgctggg

SEQ ID NO: 7480021 - DNA, 22 bp, Homo sapiens
cctgggcaggccggacgctggg

SEQ ID NO: 7480022 - DNA, 22 bp, Homo sapiens
cctgggcaggatgggcccggtg

SEQ ID NO: 7480023 - DNA, 22 bp, Homo sapiens
cctgggcagggagaccaggctc

SEQ ID NO: 7480024 - DNA, 22 bp, Homo sapiens
cctgggcagggagaccaggctc

SEQ ID NO: 7480025 - DNA, 22 bp, Homo sapiens
cctgggcagggagaccaggctc

SEQ ID NO: 7480026 - DNA, 22 bp, Homo sapiens
cctgggcagggagaccaggctc

SEQ ID NO: 7480027 - DNA, 22 bp, Homo sapiens
cctgggcagggctggactctca

SEQ ID NO: 7480028 - DNA, 22 bp, Homo sapiens
cctgggcagggctggactctca

SEQ ID NO: 7480029 - DNA, 22 bp, Homo sapiens
cctgggcagggctggactctca

SEQ ID NO: 7480030 - DNA, 22 bp, Homo sapiens
aggtgcagaaaaaagtccttta

SEQ ID NO: 7480031 - DNA, 22 bp, Homo sapiens
aggtgcacctgagggtgtcatc

SEQ ID NO: 7480032 - DNA, 22 bp, Homo sapiens
aggtgcacctgagggtgtcatc

SEQ ID NO: 7480033 - DNA, 22 bp, Homo sapiens
aggtgcagaaaaaagtccttta

SEQ ID NO: 7480034 - DNA, 23 bp, Homo sapiens
aggtgcactgtggtggcagtggc

SEQ ID NO: 7480035 - DNA, 21 bp, Homo sapiens
aggtgcagagccagggaccag

SEQ ID NO: 7480036 - DNA, 21 bp, Homo sapiens
aggtgcagagccagggaccag

SEQ ID NO: 7480037 - DNA, 22 bp, Homo sapiens
cctgggcaggatgggcccggtg

SEQ ID NO: 7480038 - DNA, 22 bp, Homo sapiens
cctgggcaggatgggcccggtg

SEQ ID NO: 7480039 - DNA, 22 bp, Homo sapiens
cctgggcaggatgggcccggtg

SEQ ID NO: 7480040 - DNA, 21 bp, Homo sapiens
aggtgcagagccagggaccag

SEQ ID NO: 7480041 - DNA, 21 bp, Homo sapiens
aggtgcagagccagggaccag

SEQ ID NO: 7480042 - DNA, 21 bp, Homo sapiens
aggtgcagagccagggaccag

SEQ ID NO: 7480043 - DNA, 21 bp, Homo sapiens
aggtgcagagccagggaccag

SEQ ID NO: 7480044 - DNA, 21 bp, Homo sapiens
aggtgcagagccagggaccag

SEQ ID NO: 7480045 - DNA, 22 bp, Homo sapiens
cctgggcagcctgctcaaggac

SEQ ID NO: 7480046 - DNA, 20 bp, Homo sapiens
aggtgcaagcagtaaattgc

SEQ ID NO: 7480047 - DNA, 19 bp, Homo sapiens
aggtgatgtgactctagaa

SEQ ID NO: 7480048 - DNA, 19 bp, Homo sapiens
aggtgatgtgactctagaa

SEQ ID NO: 7480049 - DNA, 22 bp, Homo sapiens
aggtgattagcttgaaatcctt

SEQ ID NO: 7480050 - DNA, 22 bp, Homo sapiens
aggtgataagtgttaaataaag

SEQ ID NO: 7480051 - DNA, 22 bp, Homo sapiens
aggtgatgtccacagcttgcag

SEQ ID NO: 7480052 - DNA, 22 bp, Homo sapiens
aggtgagttacaggaggaggtc

SEQ ID NO: 7480053 - DNA, 19 bp, Homo sapiens
aggtgagtgtgggaaaggg

SEQ ID NO: 7480054 - DNA, 22 bp, Homo sapiens
aggtgagtcctgggcacaggta

SEQ ID NO: 7480055 - DNA, 22 bp, Homo sapiens
aggtgaggtttgggaggtgtca

SEQ ID NO: 7480056 - DNA, 22 bp, Homo sapiens
aggtgagtcctgggcacaggta

SEQ ID NO: 7480057 - DNA, 22 bp, Homo sapiens
cctgggtgtcatgggcagctgg

SEQ ID NO: 7480058 - DNA, 22 bp, Homo sapiens
aggtggatcacctgacgtcagg

SEQ ID NO: 7480059 - DNA, 22 bp, Homo sapiens
aggtggatcacctgacgtcagg

SEQ ID NO: 7480060 - DNA, 22 bp, Homo sapiens
aggtggatcatatactagacca

SEQ ID NO: 7480061 - DNA, 22 bp, Homo sapiens
aggtggatctgacagaaatgaa

SEQ ID NO: 7480062 - DNA, 22 bp, Homo sapiens
aggtggatctcagctcatctaa

SEQ ID NO: 7480063 - DNA, 22 bp, Homo sapiens
aggtggagttggctgtagttca

SEQ ID NO: 7480064 - DNA, 22 bp, Homo sapiens
aggtggagttggctgtagttca

SEQ ID NO: 7480065 - DNA, 22 bp, Homo sapiens
aggtggagttggctgtagttca

SEQ ID NO: 7480066 - DNA, 22 bp, Homo sapiens
aggtggagtgtgcagggagagc

SEQ ID NO: 7480067 - DNA, 22 bp, Homo sapiens
aggtggagttaagtgtgaactg

SEQ ID NO: 7480068 - DNA, 22 bp, Homo sapiens
aggtggagttaagtgtgaactg

SEQ ID NO: 7480069 - DNA, 22 bp, Homo sapiens
aggtggagttaagtgtgaactg

SEQ ID NO: 7480070 - DNA, 22 bp, Homo sapiens
aggtggagttaagtgtgaactg

SEQ ID NO: 7480071 - DNA, 22 bp, Homo sapiens
cctggtccccatcggcccagcg

SEQ ID NO: 7480072 - DNA, 22 bp, Homo sapiens
cctggtcccattgcggctgcct

SEQ ID NO: 7480073 - DNA, 22 bp, Homo sapiens
cctggtccccatcggcccagcg

SEQ ID NO: 7480074 - DNA, 22 bp, Homo sapiens
cctggtccccatcggcccagcg

SEQ ID NO: 7480075 - DNA, 22 bp, Homo sapiens
cctggtcccattgcggctgcct

SEQ ID NO: 7480076 - DNA, 22 bp, Homo sapiens
cctggtcaggtaactgggctga

SEQ ID NO: 7480077 - DNA, 22 bp, Homo sapiens
cctggtcccattgcggctgcct

SEQ ID NO: 7480078 - DNA, 22 bp, Homo sapiens
cctggtcaggtaactgggctga

SEQ ID NO: 7480079 - DNA, 22 bp, Homo sapiens
cctggtcaggtaactgggctga

SEQ ID NO: 7480080 - DNA, 22 bp, Homo sapiens
cctggtcagagcagtcaggatc

SEQ ID NO: 7480081 - DNA, 22 bp, Homo sapiens
cctggtcagagcagtcaggatc

SEQ ID NO: 7480082 - DNA, 22 bp, Homo sapiens
cctgggttggagagcaatggtg

SEQ ID NO: 7480083 - DNA, 23 bp, Homo sapiens
cctgggtttcagagctgcttttc

SEQ ID NO: 7480084 - DNA, 22 bp, Homo sapiens
cctggtcacccctctctctgca

SEQ ID NO: 7480085 - DNA, 22 bp, Homo sapiens
cctggtcacccctctctctgca

SEQ ID NO: 7480086 - DNA, 23 bp, Homo sapiens
aggtggagctgtgcagccggggc

SEQ ID NO: 7480087 - DNA, 23 bp, Homo sapiens
aggtggagctgtgcagccggggc

SEQ ID NO: 7480088 - DNA, 23 bp, Homo sapiens
aggtggagctgtgcagccggggc

SEQ ID NO: 7480089 - DNA, 23 bp, Homo sapiens
aggtggagctgtgcagccggggc

SEQ ID NO: 7480090 - DNA, 23 bp, Homo sapiens
aggtggagctgtgcagccggggc

SEQ ID NO: 7480091 - DNA, 22 bp, Homo sapiens
aggtgcttggctcgtgcacaca

SEQ ID NO: 7480092 - DNA, 22 bp, Homo sapiens
aggtgcttggctcgtgcacaca

SEQ ID NO: 7480093 - DNA, 22 bp, Homo sapiens
aggtgcttggctcgtgcacaca

SEQ ID NO: 7480094 - DNA, 22 bp, Homo sapiens
aggtggagtgaaggaaaggcag

SEQ ID NO: 7480095 - DNA, 22 bp, Homo sapiens
aggtggagtgaaggaaaggcag

SEQ ID NO: 7480096 - DNA, 22 bp, Homo sapiens
aggtggagtgaaggaaaggcag

SEQ ID NO: 7480097 - DNA, 22 bp, Homo sapiens
aggtggagtgaaggaaaggcag

SEQ ID NO: 7480098 - DNA, 22 bp, Homo sapiens
aggtggagtgaaggaaaggcag

SEQ ID NO: 7480099 - DNA, 22 bp, Homo sapiens
aggtggagtgaaggaaaggcag

SEQ ID NO: 7480100 - DNA, 22 bp, Homo sapiens
aggtggagtgaaggaaaggcag

SEQ ID NO: 7480101 - DNA, 22 bp, Homo sapiens
aggtggagtgaaggaaaggcag

SEQ ID NO: 7480102 - DNA, 22 bp, Homo sapiens
aggtggagtgaaggaaaggcag

SEQ ID NO: 7480103 - DNA, 22 bp, Homo sapiens
aggtggagtgaaggaaaggcag

SEQ ID NO: 7480104 - DNA, 22 bp, Homo sapiens
aggtggagtgaaggaaaggcag

SEQ ID NO: 7480105 - DNA, 22 bp, Homo sapiens
aggtggagtgtgcagggagagc

SEQ ID NO: 7480106 - DNA, 22 bp, Homo sapiens
aggtggagtgtgcagggagagc

SEQ ID NO: 7480107 - DNA, 22 bp, Homo sapiens
aggtggagtgaaggaaaggcag

SEQ ID NO: 7480108 - DNA, 22 bp, Homo sapiens
aggtggagtgtgcagggagagc

SEQ ID NO: 7480109 - DNA, 22 bp, Homo sapiens
aggtggagtgtgcagggagagc

SEQ ID NO: 7480110 - DNA, 22 bp, Homo sapiens
aggtggagtgtgcagggagagc

SEQ ID NO: 7480111 - DNA, 22 bp, Homo sapiens
aggtggagtgtgcagggagagc

SEQ ID NO: 7480112 - DNA, 22 bp, Homo sapiens
aggtggagtgtgcagggagagc

SEQ ID NO: 7480113 - DNA, 21 bp, Homo sapiens
aggtggagtgcttagcatcca

SEQ ID NO: 7480114 - DNA, 21 bp, Homo sapiens
aggtggagtgcttagcatcca

SEQ ID NO: 7480115 - DNA, 22 bp, Homo sapiens
aggtggagtgaaggaaaggcag

SEQ ID NO: 7480116 - DNA, 21 bp, Homo sapiens
aggtggagtgcttagcatcca

SEQ ID NO: 7480117 - DNA, 21 bp, Homo sapiens
aggtggagtgcttagcatcca

SEQ ID NO: 7480118 - DNA, 22 bp, Homo sapiens
aggtggagtgtgcagggagagc

SEQ ID NO: 7480119 - DNA, 22 bp, Homo sapiens
aggtggagtgtgcagggagagc

SEQ ID NO: 7480120 - DNA, 22 bp, Homo sapiens
aggtggagtgtgcagggagagc

SEQ ID NO: 7480121 - DNA, 22 bp, Homo sapiens
aggtggagtgtgcagggagagc

SEQ ID NO: 7480122 - DNA, 22 bp, Homo sapiens
aggtggagtgtgcagggagagc

SEQ ID NO: 7480123 - DNA, 22 bp, Homo sapiens
aggtggagtgtgcagggagagc

SEQ ID NO: 7480124 - DNA, 22 bp, Homo sapiens
agtgacagtctcagagatcagg

SEQ ID NO: 7480125 - DNA, 22 bp, Homo sapiens
agtgacagtctcagagatcagg

SEQ ID NO: 7480126 - DNA, 22 bp, Homo sapiens
agtgacagtctcagagatcagg

SEQ ID NO: 7480127 - DNA, 22 bp, Homo sapiens
agtgacagtctcagagatcagg

SEQ ID NO: 7480128 - DNA, 22 bp, Homo sapiens
agtgacagtttcaggcattttt

SEQ ID NO: 7480129 - DNA, 22 bp, Homo sapiens
agtgacagtctgatttctcaaa

SEQ ID NO: 7480130 - DNA, 22 bp, Homo sapiens
agtgacagtctgatttctcaaa

SEQ ID NO: 7480131 - DNA, 22 bp, Homo sapiens
agtgacagtctgatttctcaaa

SEQ ID NO: 7480132 - DNA, 22 bp, Homo sapiens
agtgacagtttcaggcattttt

SEQ ID NO: 7480133 - DNA, 22 bp, Homo sapiens
agtgacagtttcaggcattttt

SEQ ID NO: 7480134 - DNA, 22 bp, Homo sapiens
agtgacattaaggattcttcaa

SEQ ID NO: 7480135 - DNA, 22 bp, Homo sapiens
agtgacattaaggattcttcaa

SEQ ID NO: 7480136 - DNA, 22 bp, Homo sapiens
agtgacatttaaaaccacagct

SEQ ID NO: 7480137 - DNA, 22 bp, Homo sapiens
agtgacatttgcaccagctgct

SEQ ID NO: 7480138 - DNA, 22 bp, Homo sapiens
agtgacatttgcaccagctgct

SEQ ID NO: 7480139 - DNA, 22 bp, Homo sapiens
agtgacatttaaagacccaccc

SEQ ID NO: 7480140 - DNA, 22 bp, Homo sapiens
agtgacatttaaaaccacagct

SEQ ID NO: 7480141 - DNA, 22 bp, Homo sapiens
agtgacatgagttctcggtaaa

SEQ ID NO: 7480142 - DNA, 22 bp, Homo sapiens
agtgacatgaccacaaagcagc

SEQ ID NO: 7480143 - DNA, 22 bp, Homo sapiens
agtgacatgctctcaggcataa

SEQ ID NO: 7480144 - DNA, 22 bp, Homo sapiens
agtgacatgctctcaggcataa

SEQ ID NO: 7480145 - DNA, 22 bp, Homo sapiens
agtgacatgaccacaaagcagc

SEQ ID NO: 7480146 - DNA, 22 bp, Homo sapiens
agtgacatcatgtcagcaaagt

SEQ ID NO: 7480147 - DNA, 22 bp, Homo sapiens
agtgacatcatgtcagcaaagt

SEQ ID NO: 7480148 - DNA, 22 bp, Homo sapiens
agtgacatcatgtcagcaaagt

SEQ ID NO: 7480149 - DNA, 22 bp, Homo sapiens
agtgacagtatttgttgccaat

SEQ ID NO: 7480150 - DNA, 22 bp, Homo sapiens
agtgacagtatttgttgccaat

SEQ ID NO: 7480151 - DNA, 22 bp, Homo sapiens
agtgacagtatttgttgccaat

SEQ ID NO: 7480152 - DNA, 22 bp, Homo sapiens
ctccatggaaaaggctgttgtt

SEQ ID NO: 7480153 - DNA, 22 bp, Homo sapiens
ctccatgaatttgagctttgtg

SEQ ID NO: 7480154 - DNA, 20 bp, Homo sapiens
ctccatgacttgaattagta

SEQ ID NO: 7480155 - DNA, 22 bp, Homo sapiens
ctccatcatgtttgatcctgag

SEQ ID NO: 7480156 - DNA, 22 bp, Homo sapiens
ctccatatggccctgggacctg

SEQ ID NO: 7480157 - DNA, 22 bp, Homo sapiens
ctccatcatgtttgatcctgag

SEQ ID NO: 7480158 - DNA, 22 bp, Homo sapiens
ctccatcatgtttgatcctgag

SEQ ID NO: 7480159 - DNA, 22 bp, Homo sapiens
ctccagttggccccagttggtt

SEQ ID NO: 7480160 - DNA, 22 bp, Homo sapiens
ctccagttggccccagttggtt

SEQ ID NO: 7480161 - DNA, 22 bp, Homo sapiens
ctccagttggccccagttggtt

SEQ ID NO: 7480162 - DNA, 22 bp, Homo sapiens
ctccagttggccccagttggtt

SEQ ID NO: 7480163 - DNA, 22 bp, Homo sapiens
ctccatcagctgttggttgagg

SEQ ID NO: 7480164 - DNA, 22 bp, Homo sapiens
ctccatcagctgttggttgagg

SEQ ID NO: 7480165 - DNA, 22 bp, Homo sapiens
ctccatcagctgttggttgagg

SEQ ID NO: 7480166 - DNA, 22 bp, Homo sapiens
ctccagggagctgcgggagcca

SEQ ID NO: 7480167 - DNA, 22 bp, Homo sapiens
ctccagggagctgcgggagcca

SEQ ID NO: 7480168 - DNA, 22 bp, Homo sapiens
ctccagggagctgcgggagcca

SEQ ID NO: 7480169 - DNA, 22 bp, Homo sapiens
ctccagggagctgcgggagcca

SEQ ID NO: 7480170 - DNA, 21 bp, Homo sapiens
ctcaggcatttgaggagagtc

SEQ ID NO: 7480171 - DNA, 22 bp, Homo sapiens
ctcaggcagttgtttgcatagt

SEQ ID NO: 7480172 - DNA, 22 bp, Homo sapiens
ctcaggcagttgtttgcatagt

SEQ ID NO: 7480173 - DNA, 21 bp, Homo sapiens
ctcaggcatttgaggagagtc

SEQ ID NO: 7480174 - DNA, 22 bp, Homo sapiens
ctccagtgggggtgagcctaga

SEQ ID NO: 7480175 - DNA, 22 bp, Homo sapiens
ctccagtggcacaaatgggtgc

SEQ ID NO: 7480176 - DNA, 22 bp, Homo sapiens
ctccagtggcacaaatgggtgc

SEQ ID NO: 7480177 - DNA, 22 bp, Homo sapiens
ctccagtgggggtgagcctaga

SEQ ID NO: 7480178 - DNA, 22 bp, Homo sapiens
ctccagtgggggtgagcctaga

SEQ ID NO: 7480179 - DNA, 22 bp, Homo sapiens
ctccagtgcttctagaaaatac

SEQ ID NO: 7480180 - DNA, 22 bp, Homo sapiens
ctccagtggcaagtccgggcgg

SEQ ID NO: 7480181 - DNA, 22 bp, Homo sapiens
ctccagtggcaagtccgggcgg

SEQ ID NO: 7480182 - DNA, 22 bp, Homo sapiens
ctccagtgggggtgagcctaga

SEQ ID NO: 7480183 - DNA, 22 bp, Homo sapiens
ctccagtgggggtgagcctaga

SEQ ID NO: 7480184 - DNA, 22 bp, Homo sapiens
ctccagtggtgatggggaagaa

SEQ ID NO: 7480185 - DNA, 22 bp, Homo sapiens
ctccagtggtgatggggaagaa

SEQ ID NO: 7480186 - DNA, 22 bp, Homo sapiens
ctccagtggtgatggggaagaa

SEQ ID NO: 7480187 - DNA, 22 bp, Homo sapiens
ctccagtggtgatggggaagaa

SEQ ID NO: 7480188 - DNA, 22 bp, Homo sapiens
ctccagttggccccagttggtt

SEQ ID NO: 7480189 - DNA, 22 bp, Homo sapiens
ctccagttggccccagttggtt

SEQ ID NO: 7480190 - DNA, 20 bp, Homo sapiens
ctccagtgttcaggggagtg

SEQ ID NO: 7480191 - DNA, 20 bp, Homo sapiens
ctccagtgttcaggggagtg

SEQ ID NO: 7480192 - DNA, 20 bp, Homo sapiens
ctccagtgttcaggggagtg

SEQ ID NO: 7480193 - DNA, 22 bp, Homo sapiens
ctccagtgtctcagagcagatg

SEQ ID NO: 7480194 - DNA, 20 bp, Homo sapiens
ctccagtgttcaggggagtg

SEQ ID NO: 7480195 - DNA, 20 bp, Homo sapiens
ctccagtgttcaggggagtg

SEQ ID NO: 7480196 - DNA, 20 bp, Homo sapiens
ctccagtgttcaggggagtg

SEQ ID NO: 7480197 - DNA, 20 bp, Homo sapiens
ctccagtgttcaggggagtg

SEQ ID NO: 7480198 - DNA, 22 bp, Homo sapiens
ctccagtggtgatggggaagaa

SEQ ID NO: 7480199 - DNA, 22 bp, Homo sapiens
ctccagtgtctcagagcagatg

SEQ ID NO: 7480200 - DNA, 22 bp, Homo sapiens
ctccagtgtctcagagcagatg

SEQ ID NO: 7480201 - DNA, 22 bp, Homo sapiens
ctccagtgtctcagagcagatg

SEQ ID NO: 7480202 - DNA, 22 bp, Homo sapiens
ctccagtgtctcagagcagatg

SEQ ID NO: 7480203 - DNA, 22 bp, Homo sapiens
agtgaccgaggcacttggcaac

SEQ ID NO: 7480204 - DNA, 22 bp, Homo sapiens
agtgaccgaggcacttggcaac

SEQ ID NO: 7480205 - DNA, 22 bp, Homo sapiens
agtgacgtttattgggtgtgaa

SEQ ID NO: 7480206 - DNA, 22 bp, Homo sapiens
agtgaccgaggcacttggcaac

SEQ ID NO: 7480207 - DNA, 23 bp, Homo sapiens
agtgacccatttcagggtgtctt

SEQ ID NO: 7480208 - DNA, 22 bp, Homo sapiens
agtgaccatgttatttatttga

SEQ ID NO: 7480209 - DNA, 22 bp, Homo sapiens
agtgacccctgtctcctcgctg

SEQ ID NO: 7480210 - DNA, 22 bp, Homo sapiens
agtgaccattttcagctagagg

SEQ ID NO: 7480211 - DNA, 22 bp, Homo sapiens
agtgaccattttcagctagagg

SEQ ID NO: 7480212 - DNA, 22 bp, Homo sapiens
agtgaccattttcagctagagg

SEQ ID NO: 7480213 - DNA, 22 bp, Homo sapiens
agtgaccaaagatatttttcag

SEQ ID NO: 7480214 - DNA, 22 bp, Homo sapiens
agtgaccaacaatgctgagaag

SEQ ID NO: 7480215 - DNA, 22 bp, Homo sapiens
agtgaccaacaatgctgagaag

SEQ ID NO: 7480216 - DNA, 22 bp, Homo sapiens
agtgacattttccccgctatgt

SEQ ID NO: 7480217 - DNA, 22 bp, Homo sapiens
agtgaccaagcctgaccaatca

SEQ ID NO: 7480218 - DNA, 22 bp, Homo sapiens
agtgaccaagcctgaccaatca

SEQ ID NO: 7480219 - DNA, 22 bp, Homo sapiens
agtgaccaatcactgaatgatt

SEQ ID NO: 7480220 - DNA, 22 bp, Homo sapiens
agtgaccaatcactgaatgatt

SEQ ID NO: 7480221 - DNA, 22 bp, Homo sapiens
agtgaccaatcatggttagatt

SEQ ID NO: 7480222 - DNA, 22 bp, Homo sapiens
agtgaccaatcatggttagatt

SEQ ID NO: 7480223 - DNA, 22 bp, Homo sapiens
agtgaccaacaatgctgagaag

SEQ ID NO: 7480224 - DNA, 22 bp, Homo sapiens
agtgaccacaccctgcagacct

SEQ ID NO: 7480225 - DNA, 22 bp, Homo sapiens
agtgaccacaccctgcagacct

SEQ ID NO: 7480226 - DNA, 22 bp, Homo sapiens
agtgaccatacaggtgcagagc

SEQ ID NO: 7480227 - DNA, 22 bp, Homo sapiens
agtgaccatatatcatttttgt

SEQ ID NO: 7480228 - DNA, 22 bp, Homo sapiens
agtgaccatctaacgcctgtga

SEQ ID NO: 7480229 - DNA, 22 bp, Homo sapiens
agtgaccatctaacgcctgtga

SEQ ID NO: 7480230 - DNA, 22 bp, Homo sapiens
agtgatttgactcttttattgt

SEQ ID NO: 7480231 - DNA, 22 bp, Homo sapiens
agtgactggtgtgaagttaaat

SEQ ID NO: 7480232 - DNA, 22 bp, Homo sapiens
agtgatttgactcttttattgt

SEQ ID NO: 7480233 - DNA, 22 bp, Homo sapiens
agtgatttgactcttttattgt

SEQ ID NO: 7480234 - DNA, 22 bp, Homo sapiens
agtgactggtgtgaagttaaat

SEQ ID NO: 7480235 - DNA, 22 bp, Homo sapiens
agtgactggtgtgaagttaaat

SEQ ID NO: 7480236 - DNA, 22 bp, Homo sapiens
agtgactggtgtgaagttaaat

SEQ ID NO: 7480237 - DNA, 22 bp, Homo sapiens
agtgactggtgtgaagttaaat

SEQ ID NO: 7480238 - DNA, 20 bp, Homo sapiens
agtgactgggagaatggatt

SEQ ID NO: 7480239 - DNA, 22 bp, Homo sapiens
agtgactgacacctgtaatccc

SEQ ID NO: 7480240 - DNA, 22 bp, Homo sapiens
agtgactggtgtgaagttaaat

SEQ ID NO: 7480241 - DNA, 22 bp, Homo sapiens
agtgactgggcagggcagggcc

SEQ ID NO: 7480242 - DNA, 22 bp, Homo sapiens
agtgactgggcagggcagggcc

SEQ ID NO: 7480243 - DNA, 22 bp, Homo sapiens
agtgcactgagctaggagtgga

SEQ ID NO: 7480244 - DNA, 22 bp, Homo sapiens
agtgcactggcaccatctcagc

SEQ ID NO: 7480245 - DNA, 22 bp, Homo sapiens
agtgcacagcctgctgcagaat

SEQ ID NO: 7480246 - DNA, 22 bp, Homo sapiens
agtgcacagcgtgatgtattgg

SEQ ID NO: 7480247 - DNA, 22 bp, Homo sapiens
agtgcacagcgtgatgtattgg

SEQ ID NO: 7480248 - DNA, 22 bp, Homo sapiens
agtgcacttttgggggatgtta

SEQ ID NO: 7480249 - DNA, 22 bp, Homo sapiens
agtgcacttttccacatccata

SEQ ID NO: 7480250 - DNA, 22 bp, Homo sapiens
agtgcacttttccacatccata

SEQ ID NO: 7480251 - DNA, 22 bp, Homo sapiens
agtgcagactgaaatgaccttc

SEQ ID NO: 7480252 - DNA, 22 bp, Homo sapiens
agtgcagagacctggtcaggca

SEQ ID NO: 7480253 - DNA, 22 bp, Homo sapiens
agtgatttgcagtatttactaa

SEQ ID NO: 7480254 - DNA, 22 bp, Homo sapiens
agtgatttgaggattattgctc

SEQ ID NO: 7480255 - DNA, 22 bp, Homo sapiens
agtgatttgaggattattgctc

SEQ ID NO: 7480256 - DNA, 22 bp, Homo sapiens
agtgcacagcctgctgcagaat

SEQ ID NO: 7480257 - DNA, 22 bp, Homo sapiens
agtgcacagcctgctgcagaat

SEQ ID NO: 7480258 - DNA, 22 bp, Homo sapiens
agtgcacaccttagtacaaagt

SEQ ID NO: 7480259 - DNA, 22 bp, Homo sapiens
agtgcacaccttagtacaaagt

SEQ ID NO: 7480260 - DNA, 22 bp, Homo sapiens
agtgcacaccttagtacaaagt

SEQ ID NO: 7480261 - DNA, 22 bp, Homo sapiens
agtgcacaccttagtacaaagt

SEQ ID NO: 7480262 - DNA, 22 bp, Homo sapiens
agtgatttgcagtatttactaa

SEQ ID NO: 7480263 - DNA, 22 bp, Homo sapiens
agtgatttgcagtatttactaa

SEQ ID NO: 7480264 - DNA, 22 bp, Homo sapiens
agtgcagagagcaatactctac

SEQ ID NO: 7480265 - DNA, 22 bp, Homo sapiens
agtgcagaggctgggaaatgct

SEQ ID NO: 7480266 - DNA, 22 bp, Homo sapiens
agtgcagaggctgggaaatgct

SEQ ID NO: 7480267 - DNA, 22 bp, Homo sapiens
agtgcagagacctggtcaggca

SEQ ID NO: 7480268 - DNA, 22 bp, Homo sapiens
agtgcagagacctggtcaggca

SEQ ID NO: 7480269 - DNA, 22 bp, Homo sapiens
agtgcagagacctggtcaggca

SEQ ID NO: 7480270 - DNA, 22 bp, Homo sapiens
agtgcagagacctggtcaggca

SEQ ID NO: 7480271 - DNA, 22 bp, Homo sapiens
agtgcagatttttagtcagctt

SEQ ID NO: 7480272 - DNA, 22 bp, Homo sapiens
agtgcagatttttagtcagctt

SEQ ID NO: 7480273 - DNA, 22 bp, Homo sapiens
agtgcagatttttagtcagctt

SEQ ID NO: 7480274 - DNA, 22 bp, Homo sapiens
agtgcagcaacaaactgccctc

SEQ ID NO: 7480275 - DNA, 22 bp, Homo sapiens
agtgcagatttttagtcagctt

SEQ ID NO: 7480276 - DNA, 22 bp, Homo sapiens
agtgcagatttttagtcagctt

SEQ ID NO: 7480277 - DNA, 22 bp, Homo sapiens
agtgcagagtacatttgtggca

SEQ ID NO: 7480278 - DNA, 22 bp, Homo sapiens
agtgcagaggctgggaaatgct

SEQ ID NO: 7480279 - DNA, 22 bp, Homo sapiens
agtgcagaggctgggaaatgct

SEQ ID NO: 7480280 - DNA, 22 bp, Homo sapiens
agtgcagaggctgggaaatgct

SEQ ID NO: 7480281 - DNA, 22 bp, Homo sapiens
agtgcagctttttctttacatg

SEQ ID NO: 7480282 - DNA, 22 bp, Homo sapiens
agtgcagctttttctttacatg

SEQ ID NO: 7480283 - DNA, 22 bp, Homo sapiens
agtgcagctttttctttacatg

SEQ ID NO: 7480284 - DNA, 22 bp, Homo sapiens
agtgcagctttttctttacatg

SEQ ID NO: 7480285 - DNA, 22 bp, Homo sapiens
agtgcaggagcctggccagagc

SEQ ID NO: 7480286 - DNA, 22 bp, Homo sapiens
agtgcaggagcctggccagagc

SEQ ID NO: 7480287 - DNA, 22 bp, Homo sapiens
agtgcaggagcctggccagagc

SEQ ID NO: 7480288 - DNA, 22 bp, Homo sapiens
agtgcaggagcctggccagagc

SEQ ID NO: 7480289 - DNA, 22 bp, Homo sapiens
agtgcaggagcctggccagagc

SEQ ID NO: 7480290 - DNA, 22 bp, Homo sapiens
agtgcaggagcctggccagagc

SEQ ID NO: 7480291 - DNA, 22 bp, Homo sapiens
agtgcagctccctcacctgctt

SEQ ID NO: 7480292 - DNA, 22 bp, Homo sapiens
agtgcagctgggactgtagggt

SEQ ID NO: 7480293 - DNA, 22 bp, Homo sapiens
agtgcagctccctcacctgctt

SEQ ID NO: 7480294 - DNA, 22 bp, Homo sapiens
agtgcagctgggactgtagggt

SEQ ID NO: 7480295 - DNA, 22 bp, Homo sapiens
agtgcagctgggactgtagggt

SEQ ID NO: 7480296 - DNA, 22 bp, Homo sapiens
agtgcagcttataaagcatcaa

SEQ ID NO: 7480297 - DNA, 22 bp, Homo sapiens
agtgcagcttataaagcatcaa

SEQ ID NO: 7480298 - DNA, 22 bp, Homo sapiens
agtgcagcttataaagcatcaa

SEQ ID NO: 7480299 - DNA, 22 bp, Homo sapiens
agtgcagctaagtggctctgtg

SEQ ID NO: 7480300 - DNA, 22 bp, Homo sapiens
agtgcagccttctgggccgctt

SEQ ID NO: 7480301 - DNA, 22 bp, Homo sapiens
agtgcagctaagtggctctgtg

SEQ ID NO: 7480302 - DNA, 22 bp, Homo sapiens
agtgcagctaagtggctctgtg

SEQ ID NO: 7480303 - DNA, 22 bp, Homo sapiens
agtgcagctaagtggctctgtg

SEQ ID NO: 7480304 - DNA, 22 bp, Homo sapiens
agtgcagctattacaacagtgt

SEQ ID NO: 7480305 - DNA, 22 bp, Homo sapiens
agtgcagctattacaacagtgt

SEQ ID NO: 7480306 - DNA, 22 bp, Homo sapiens
agtgcagctattacaacagtgt

SEQ ID NO: 7480307 - DNA, 22 bp, Homo sapiens
agtgcagctccctcacctgctt

SEQ ID NO: 7480308 - DNA, 22 bp, Homo sapiens
ctcctcctggacacaggctgtg

SEQ ID NO: 7480309 - DNA, 22 bp, Homo sapiens
ctcctcctggacacaggctgtg

SEQ ID NO: 7480310 - DNA, 22 bp, Homo sapiens
ctcctccttcctgtgttgtgca

SEQ ID NO: 7480311 - DNA, 22 bp, Homo sapiens
ctcctccttcctgtgttgtgca

SEQ ID NO: 7480312 - DNA, 22 bp, Homo sapiens
ctcctcgaagcaacctgcaggc

SEQ ID NO: 7480313 - DNA, 23 bp, Homo sapiens
ctcctcgtaactctgtggtgggt

SEQ ID NO: 7480314 - DNA, 23 bp, Homo sapiens
ctcctcgtaactctgtggtgggt

SEQ ID NO: 7480315 - DNA, 22 bp, Homo sapiens
ctcctctcaggctggatggcgc

SEQ ID NO: 7480316 - DNA, 22 bp, Homo sapiens
ctcctctcaggctggatggcgc

SEQ ID NO: 7480317 - DNA, 22 bp, Homo sapiens
ctcctctccatcagcgccaccc

SEQ ID NO: 7480318 - DNA, 22 bp, Homo sapiens
ctcctctccatcagcgccaccc

SEQ ID NO: 7480319 - DNA, 22 bp, Homo sapiens
ctcctctcaaaagtaggttgac

SEQ ID NO: 7480320 - DNA, 22 bp, Homo sapiens
ctcctctagaagctgacctgga

SEQ ID NO: 7480321 - DNA, 22 bp, Homo sapiens
ctcctctagaagctgacctgga

SEQ ID NO: 7480322 - DNA, 22 bp, Homo sapiens
ctcctctcaaaagtaggttgac

SEQ ID NO: 7480323 - DNA, 22 bp, Homo sapiens
ctcctcctcaaattagcttttg

SEQ ID NO: 7480324 - DNA, 22 bp, Homo sapiens
ctcctcctcaaattagcttttg

SEQ ID NO: 7480325 - DNA, 22 bp, Homo sapiens
ctcctcctggacacaggctgtg

SEQ ID NO: 7480326 - DNA, 22 bp, Homo sapiens
ctcctcctcaaattagcttttg

SEQ ID NO: 7480327 - DNA, 22 bp, Homo sapiens
ctcctcctggacacaggctgtg

SEQ ID NO: 7480328 - DNA, 22 bp, Homo sapiens
ctcctcctggacacaggctgtg

SEQ ID NO: 7480329 - DNA, 22 bp, Homo sapiens
ctcctcctggacacaggctgtg

SEQ ID NO: 7480330 - DNA, 22 bp, Homo sapiens
ctcctcctaaatgattcttcct

SEQ ID NO: 7480331 - DNA, 22 bp, Homo sapiens
ctcctcctaaatgattcttcct

SEQ ID NO: 7480332 - DNA, 22 bp, Homo sapiens
ctcctccctgggaggctggcat

SEQ ID NO: 7480333 - DNA, 22 bp, Homo sapiens
ctcctccctgggaggctggcat

SEQ ID NO: 7480334 - DNA, 22 bp, Homo sapiens
ctcctccctgcgattgctctgc

SEQ ID NO: 7480335 - DNA, 22 bp, Homo sapiens
ctcctccctgcgattgctctgc

SEQ ID NO: 7480336 - DNA, 22 bp, Homo sapiens
ctcctccctgcgattgctctgc

SEQ ID NO: 7480337 - DNA, 22 bp, Homo sapiens
ctcctccctgcgattgctctgc

SEQ ID NO: 7480338 - DNA, 22 bp, Homo sapiens
ctcctccctctttgccacacat

SEQ ID NO: 7480339 - DNA, 22 bp, Homo sapiens
ctcctccctgcgattgctctgc

SEQ ID NO: 7480340 - DNA, 22 bp, Homo sapiens
ctcctccctgcgattgctctgc

SEQ ID NO: 7480341 - DNA, 22 bp, Homo sapiens
ctcctccctgcgattgctctgc

SEQ ID NO: 7480342 - DNA, 22 bp, Homo sapiens
ctcctccctctttgccacacat

SEQ ID NO: 7480343 - DNA, 22 bp, Homo sapiens
ctcctccctctttgccacacat

SEQ ID NO: 7480344 - DNA, 22 bp, Homo sapiens
ctcctccctctttgccacacat

SEQ ID NO: 7480345 - DNA, 22 bp, Homo sapiens
ctcctccctctttgccacacat

SEQ ID NO: 7480346 - DNA, 22 bp, Homo sapiens
ctcctccctctttgccacacat

SEQ ID NO: 7480347 - DNA, 22 bp, Homo sapiens
ctcctccctctttgccacacat

SEQ ID NO: 7480348 - DNA, 22 bp, Homo sapiens
ctcctccctctttgccacacat

SEQ ID NO: 7480349 - DNA, 22 bp, Homo sapiens
ctcctccctctttgccacacat

SEQ ID NO: 7480350 - DNA, 22 bp, Homo sapiens
ctcctccctctttgccacacat

SEQ ID NO: 7480351 - DNA, 22 bp, Homo sapiens
ctcctccctctttgccacacat

SEQ ID NO: 7480352 - DNA, 22 bp, Homo sapiens
ctcctccctctttgccacacat

SEQ ID NO: 7480353 - DNA, 22 bp, Homo sapiens
ctcctccccttgagtctgggat

SEQ ID NO: 7480354 - DNA, 18 bp, Homo sapiens
ctcctccctaagggctca

SEQ ID NO: 7480355 - DNA, 18 bp, Homo sapiens
ctcctccctaagggctca

SEQ ID NO: 7480356 - DNA, 22 bp, Homo sapiens
ctcctcccacggtctcaggaag

SEQ ID NO: 7480357 - DNA, 22 bp, Homo sapiens
ctcctcccacggtctcaggaag

SEQ ID NO: 7480358 - DNA, 22 bp, Homo sapiens
ctcctcccacggtctcaggaag

SEQ ID NO: 7480359 - DNA, 22 bp, Homo sapiens
ctcctcccacggtctcaggaag

SEQ ID NO: 7480360 - DNA, 22 bp, Homo sapiens
ctcctcccacggtctcaggaag

SEQ ID NO: 7480361 - DNA, 22 bp, Homo sapiens
ctcctccccttgagtctgggat

SEQ ID NO: 7480362 - DNA, 22 bp, Homo sapiens
ctcctccccttgagtctgggat

SEQ ID NO: 7480363 - DNA, 22 bp, Homo sapiens
ctcctcccacggtctcaggaag

SEQ ID NO: 7480364 - DNA, 22 bp, Homo sapiens
ctcctcccacggtctcaggaag

SEQ ID NO: 7480365 - DNA, 22 bp, Homo sapiens
agtgcagccgagatcaggtgct

SEQ ID NO: 7480366 - DNA, 22 bp, Homo sapiens
agtgcagcatgctggggaggct

SEQ ID NO: 7480367 - DNA, 22 bp, Homo sapiens
agtgcagccgagatcaggtgct

SEQ ID NO: 7480368 - DNA, 22 bp, Homo sapiens
agtgcagccttctgggccgctt

SEQ ID NO: 7480369 - DNA, 22 bp, Homo sapiens
agtgcagccgagatcaggtgct

SEQ ID NO: 7480370 - DNA, 22 bp, Homo sapiens
agtgcagccgagatcaggtgct

SEQ ID NO: 7480371 - DNA, 22 bp, Homo sapiens
agtgcagccgagatcaggtgct

SEQ ID NO: 7480372 - DNA, 22 bp, Homo sapiens
ctcccaggggaactatcaagta

SEQ ID NO: 7480373 - DNA, 22 bp, Homo sapiens
agtgcagccttctgggccgctt

SEQ ID NO: 7480374 - DNA, 22 bp, Homo sapiens
agtgcagcatgctggggaggct

SEQ ID NO: 7480375 - DNA, 22 bp, Homo sapiens
ctcccaggggaactatcaagta

SEQ ID NO: 7480376 - DNA, 22 bp, Homo sapiens
agtgcagcagctgctccttaac

SEQ ID NO: 7480377 - DNA, 22 bp, Homo sapiens
agtgcagcaccatgttacagag

SEQ ID NO: 7480378 - DNA, 22 bp, Homo sapiens
agtgcagcagctgctccttaac

SEQ ID NO: 7480379 - DNA, 22 bp, Homo sapiens
agtgcagcagctgctccttaac

SEQ ID NO: 7480380 - DNA, 22 bp, Homo sapiens
agtgcagcaccatgttacagag

SEQ ID NO: 7480381 - DNA, 22 bp, Homo sapiens
agtgcagcaccatgttacagag

SEQ ID NO: 7480382 - DNA, 22 bp, Homo sapiens
agtgcagcaacaaactgccctc

SEQ ID NO: 7480383 - DNA, 22 bp, Homo sapiens
agtgcagatttttagtcagctt

SEQ ID NO: 7480384 - DNA, 22 bp, Homo sapiens
agtgcagcaccatgttacagag

SEQ ID NO: 7480385 - DNA, 22 bp, Homo sapiens
agtgcagcatgctggggaggct

SEQ ID NO: 7480386 - DNA, 22 bp, Homo sapiens
agtgcagcatgaagcacatgtg

SEQ ID NO: 7480387 - DNA, 22 bp, Homo sapiens
agtgcagcatgctggggaggct

SEQ ID NO: 7480388 - DNA, 22 bp, Homo sapiens
agtgcagcatgctggggaggct

SEQ ID NO: 7480389 - DNA, 22 bp, Homo sapiens
agtgcagcatgaagcacatgtg

SEQ ID NO: 7480390 - DNA, 22 bp, Homo sapiens
agtgcagcatgaagcacatgtg

SEQ ID NO: 7480391 - DNA, 22 bp, Homo sapiens
agtgcagcatgaagcacatgtg

SEQ ID NO: 7480392 - DNA, 22 bp, Homo sapiens
ctcccagggtagggagagacta

SEQ ID NO: 7480393 - DNA, 22 bp, Homo sapiens
ctcccagggtagggagagacta

SEQ ID NO: 7480394 - DNA, 22 bp, Homo sapiens
ctcccagggtagggagagacta

SEQ ID NO: 7480395 - DNA, 22 bp, Homo sapiens
ctcccagggtagggagagacta

SEQ ID NO: 7480396 - DNA, 22 bp, Homo sapiens
ctcccaggggagtcatctgctt

SEQ ID NO: 7480397 - DNA, 22 bp, Homo sapiens
ctcccaggggagtcatctgctt

SEQ ID NO: 7480398 - DNA, 22 bp, Homo sapiens
ctcccaggggagtcatctgctt

SEQ ID NO: 7480399 - DNA, 22 bp, Homo sapiens
ctcccaggggagtcatctgctt

SEQ ID NO: 7480400 - DNA, 22 bp, Homo sapiens
ctcccagggtctaggctgctgg

SEQ ID NO: 7480401 - DNA, 22 bp, Homo sapiens
ctcccagggtctaggctgctgg

SEQ ID NO: 7480402 - DNA, 22 bp, Homo sapiens
ctcccagggtctaggctgctgg

SEQ ID NO: 7480403 - DNA, 22 bp, Homo sapiens
ctcccagggtagggagagacta

SEQ ID NO: 7480404 - DNA, 22 bp, Homo sapiens
ctcccagggtagggagagacta

SEQ ID NO: 7480405 - DNA, 21 bp, Homo sapiens
ctcccagggtgactgttcaac

SEQ ID NO: 7480406 - DNA, 21 bp, Homo sapiens
ctcccagggtgactgttcaac

SEQ ID NO: 7480407 - DNA, 22 bp, Homo sapiens
ctcccagggtagggagagacta

SEQ ID NO: 7480408 - DNA, 22 bp, Homo sapiens
ctcccaggtgtcccttctgcca

SEQ ID NO: 7480409 - DNA, 22 bp, Homo sapiens
ctcccaggtgtcccttctgcca

SEQ ID NO: 7480410 - DNA, 21 bp, Homo sapiens
ctcccagggtgactgttcaac

SEQ ID NO: 7480411 - DNA, 21 bp, Homo sapiens
ctcccagggtgactgttcaac

SEQ ID NO: 7480412 - DNA, 22 bp, Homo sapiens
ctcccaggttacatctgagcct

SEQ ID NO: 7480413 - DNA, 22 bp, Homo sapiens
ctcccaggttacatctgagcct

SEQ ID NO: 7480414 - DNA, 22 bp, Homo sapiens
ctcccaggttacatctgagcct

SEQ ID NO: 7480415 - DNA, 22 bp, Homo sapiens
ctcccaggttacatctgagcct

SEQ ID NO: 7480416 - DNA, 22 bp, Homo sapiens
ctcccaggttacatctgagcct

SEQ ID NO: 7480417 - DNA, 22 bp, Homo sapiens
ctcctcagagagcagcttgggg

SEQ ID NO: 7480418 - DNA, 22 bp, Homo sapiens
ctcccaggttccgacgcctctt

SEQ ID NO: 7480419 - DNA, 22 bp, Homo sapiens
ctcccaggttccgacgcctctt

SEQ ID NO: 7480420 - DNA, 22 bp, Homo sapiens
ctcccaggttccgacgcctctt

SEQ ID NO: 7480421 - DNA, 22 bp, Homo sapiens
ctcccaggttccgacgcctctt

SEQ ID NO: 7480422 - DNA, 22 bp, Homo sapiens
ctcccaggttccgacgcctctt

SEQ ID NO: 7480423 - DNA, 22 bp, Homo sapiens
ctcctcagctgggaggagtccc

SEQ ID NO: 7480424 - DNA, 22 bp, Homo sapiens
ctcctcagctgggaggagtccc

SEQ ID NO: 7480425 - DNA, 22 bp, Homo sapiens
ctcctcagctgggaggagtccc

SEQ ID NO: 7480426 - DNA, 22 bp, Homo sapiens
ctcctcagctgggaggagtccc

SEQ ID NO: 7480427 - DNA, 22 bp, Homo sapiens
ctcctcagctgggaggagtccc

SEQ ID NO: 7480428 - DNA, 22 bp, Homo sapiens
ctcctcagagagcagcttgggg

SEQ ID NO: 7480429 - DNA, 22 bp, Homo sapiens
ctcctcagagagcagcttgggg

SEQ ID NO: 7480430 - DNA, 22 bp, Homo sapiens
ctcctcagagagcagcttgggg

SEQ ID NO: 7480431 - DNA, 22 bp, Homo sapiens
ctcctcccacggtctcaggaag

SEQ ID NO: 7480432 - DNA, 22 bp, Homo sapiens
ctcctcagctgggaggagtccc

SEQ ID NO: 7480433 - DNA, 22 bp, Homo sapiens
ctcctcagctgggaggagtccc

SEQ ID NO: 7480434 - DNA, 22 bp, Homo sapiens
ctcctcagctgggaggagtccc

SEQ ID NO: 7480435 - DNA, 22 bp, Homo sapiens
ctcctcagctgggaggagtccc

SEQ ID NO: 7480436 - DNA, 22 bp, Homo sapiens
ctcctcagctgggaggagtccc

SEQ ID NO: 7480437 - DNA, 22 bp, Homo sapiens
agtctgcaaatatgttcatgtg

SEQ ID NO: 7480438 - DNA, 22 bp, Homo sapiens
agtctgcactcaggtggaggtc

SEQ ID NO: 7480439 - DNA, 22 bp, Homo sapiens
agtctgcaggaccgcgtcacat

SEQ ID NO: 7480440 - DNA, 22 bp, Homo sapiens
agtctgcattcacagcaattat

SEQ ID NO: 7480441 - DNA, 22 bp, Homo sapiens
agtctgcattcacagcaattat

SEQ ID NO: 7480442 - DNA, 22 bp, Homo sapiens
agtctgcaggctgtgatttttt

SEQ ID NO: 7480443 - DNA, 22 bp, Homo sapiens
agtctgccaagccagatcatgt

SEQ ID NO: 7480444 - DNA, 22 bp, Homo sapiens
agtctgccaagccagatcatgt

SEQ ID NO: 7480445 - DNA, 20 bp, Homo sapiens
agtctgcctgctccttctcc

SEQ ID NO: 7480446 - DNA, 22 bp, Homo sapiens
agtctgccaagccagatcatgt

SEQ ID NO: 7480447 - DNA, 19 bp, Homo sapiens
agtctgcatttctagcaag

SEQ ID NO: 7480448 - DNA, 19 bp, Homo sapiens
agtctgcatttctagcaag

SEQ ID NO: 7480449 - DNA, 19 bp, Homo sapiens
agtctgcatttctagcaag

SEQ ID NO: 7480450 - DNA, 22 bp, Homo sapiens
agtctgagtatctctgagccag

SEQ ID NO: 7480451 - DNA, 22 bp, Homo sapiens
agtctgagtatctctgagccag

SEQ ID NO: 7480452 - DNA, 22 bp, Homo sapiens
agtctgagttagtggaaatgta

SEQ ID NO: 7480453 - DNA, 22 bp, Homo sapiens
agtctgagttagtggaaatgta

SEQ ID NO: 7480454 - DNA, 22 bp, Homo sapiens
agtctgattcagagttggagaa

SEQ ID NO: 7480455 - DNA, 21 bp, Homo sapiens
agtctgaggtggggcctagga

SEQ ID NO: 7480456 - DNA, 21 bp, Homo sapiens
agtctgaggtggggcctagga

SEQ ID NO: 7480457 - DNA, 21 bp, Homo sapiens
agtctgaggtggggcctagga

SEQ ID NO: 7480458 - DNA, 22 bp, Homo sapiens
agtctgaggtaatatttttctc

SEQ ID NO: 7480459 - DNA, 23 bp, Homo sapiens
agtctgaattgagatgtgctgtg

SEQ ID NO: 7480460 - DNA, 22 bp, Homo sapiens
agtctgaaggcaatctgctgac

SEQ ID NO: 7480461 - DNA, 22 bp, Homo sapiens
agtctgaaggcaatctgctgac

SEQ ID NO: 7480462 - DNA, 22 bp, Homo sapiens
agtctgaagtagtctttagtgt

SEQ ID NO: 7480463 - DNA, 22 bp, Homo sapiens
agtctgaagtagtctttagtgt

SEQ ID NO: 7480464 - DNA, 22 bp, Homo sapiens
agtctgaagatattcttgcagg

SEQ ID NO: 7480465 - DNA, 22 bp, Homo sapiens
agtctgaagatattcttgcagg

SEQ ID NO: 7480466 - DNA, 22 bp, Homo sapiens
agtccaaacaaacttcccgagg

SEQ ID NO: 7480467 - DNA, 22 bp, Homo sapiens
agtctctccacattgttataaa

SEQ ID NO: 7480468 - DNA, 20 bp, Homo sapiens
agtctctcccagaatgagca

SEQ ID NO: 7480469 - DNA, 22 bp, Homo sapiens
agtctctttaatcacagtgtct

SEQ ID NO: 7480470 - DNA, 22 bp, Homo sapiens
agtctctttaatcacagtgtct

SEQ ID NO: 7480471 - DNA, 22 bp, Homo sapiens
agtctcttggcattctgaaaca

SEQ ID NO: 7480472 - DNA, 22 bp, Homo sapiens
agtctctctcctcgtggtaacc

SEQ ID NO: 7480473 - DNA, 22 bp, Homo sapiens
agtccaaggccatacagttgtg

SEQ ID NO: 7480474 - DNA, 22 bp, Homo sapiens
agtccaagattagggtgacagc

SEQ ID NO: 7480475 - DNA, 22 bp, Homo sapiens
agtccaagattagggtgacagc

SEQ ID NO: 7480476 - DNA, 22 bp, Homo sapiens
agtctcttttgcgaagagtgtt

SEQ ID NO: 7480477 - DNA, 22 bp, Homo sapiens
agtctcttttgcgaagagtgtt

SEQ ID NO: 7480478 - DNA, 22 bp, Homo sapiens
agtctcttttggttccaaaaat

SEQ ID NO: 7480479 - DNA, 22 bp, Homo sapiens
agtctcttttggttccaaaaat

SEQ ID NO: 7480480 - DNA, 22 bp, Homo sapiens
agtctctttgtataaataggca

SEQ ID NO: 7480481 - DNA, 22 bp, Homo sapiens
agtctgaaagtatgttgtaatg

SEQ ID NO: 7480482 - DNA, 22 bp, Homo sapiens
agtctgaaataatgtcactaag

SEQ ID NO: 7480483 - DNA, 22 bp, Homo sapiens
agtctgaaccagatggcaaggt

SEQ ID NO: 7480484 - DNA, 22 bp, Homo sapiens
agtctgaagactcatgtctgaa

SEQ ID NO: 7480485 - DNA, 22 bp, Homo sapiens
agtctgaagactcatgtctgaa

SEQ ID NO: 7480486 - DNA, 22 bp, Homo sapiens
agtctgaaccagatggcaaggt

SEQ ID NO: 7480487 - DNA, 22 bp, Homo sapiens
agtctgaagactcatgtctgaa

SEQ ID NO: 7480488 - DNA, 18 bp, Homo sapiens
agtcatttacttttgtga

SEQ ID NO: 7480489 - DNA, 18 bp, Homo sapiens
agtcatttacttttgtga

SEQ ID NO: 7480490 - DNA, 18 bp, Homo sapiens
agtcatttacttttgtga

SEQ ID NO: 7480491 - DNA, 22 bp, Homo sapiens
agtcatttatcttagccattat

SEQ ID NO: 7480492 - DNA, 22 bp, Homo sapiens
agtcatttatcttagccattat

SEQ ID NO: 7480493 - DNA, 22 bp, Homo sapiens
agtcatttctgcttccatggct

SEQ ID NO: 7480494 - DNA, 22 bp, Homo sapiens
agtcatttcccattcttcatat

SEQ ID NO: 7480495 - DNA, 22 bp, Homo sapiens
agtcatttcccattcttcatat

SEQ ID NO: 7480496 - DNA, 22 bp, Homo sapiens
agtcatttatcttagccattat

SEQ ID NO: 7480497 - DNA, 22 bp, Homo sapiens
agtcatttcccattcttcatat

SEQ ID NO: 7480498 - DNA, 22 bp, Homo sapiens
agtcatttcccattcttcatat

SEQ ID NO: 7480499 - DNA, 22 bp, Homo sapiens
agtcatttatcttagccattat

SEQ ID NO: 7480500 - DNA, 22 bp, Homo sapiens
agtcattttctgcctgtaatct

SEQ ID NO: 7480501 - DNA, 22 bp, Homo sapiens
agtcattttctgcctgtaatct

SEQ ID NO: 7480502 - DNA, 22 bp, Homo sapiens
agtcattttctgcctgtaatct

SEQ ID NO: 7480503 - DNA, 22 bp, Homo sapiens
agtcattttgccagtcttcagg

SEQ ID NO: 7480504 - DNA, 22 bp, Homo sapiens
agtcattttctgcctgtaatct

SEQ ID NO: 7480505 - DNA, 22 bp, Homo sapiens
agtcattttctgcctgtaatct

SEQ ID NO: 7480506 - DNA, 22 bp, Homo sapiens
agtcatttggagcaccttatta

SEQ ID NO: 7480507 - DNA, 22 bp, Homo sapiens
agtcatttggagcaccttatta

SEQ ID NO: 7480508 - DNA, 22 bp, Homo sapiens
agtcatttctgtagtcatgttt

SEQ ID NO: 7480509 - DNA, 22 bp, Homo sapiens
agtcatttctgtagtcatgttt

SEQ ID NO: 7480510 - DNA, 22 bp, Homo sapiens
agtcatttctgtagtcatgttt

SEQ ID NO: 7480511 - DNA, 22 bp, Homo sapiens
agtccaaagcagatgagggcca

SEQ ID NO: 7480512 - DNA, 22 bp, Homo sapiens
agtccaagaccaaggtgtcacc

SEQ ID NO: 7480513 - DNA, 22 bp, Homo sapiens
agtccaaatcttgtttcatatc

SEQ ID NO: 7480514 - DNA, 20 bp, Homo sapiens
agtccaaagcctgtttactt

SEQ ID NO: 7480515 - DNA, 22 bp, Homo sapiens
agtccaaagcagatgagggcca

SEQ ID NO: 7480516 - DNA, 22 bp, Homo sapiens
agtccaaagcagatgagggcca

SEQ ID NO: 7480517 - DNA, 22 bp, Homo sapiens
agtccaagattagggtgacagc

SEQ ID NO: 7480518 - DNA, 22 bp, Homo sapiens
agtccaagattagggtgacagc

SEQ ID NO: 7480519 - DNA, 22 bp, Homo sapiens
agtccaagatcaaggtgtcagg

SEQ ID NO: 7480520 - DNA, 22 bp, Homo sapiens
agtccaagatcaaggtgtcaac

SEQ ID NO: 7480521 - DNA, 22 bp, Homo sapiens
agtccaaagcagatgagggcca

SEQ ID NO: 7480522 - DNA, 22 bp, Homo sapiens
agtccaaagcagatgagggcca

SEQ ID NO: 7480523 - DNA, 22 bp, Homo sapiens
agtccaaaacactgattttcta

SEQ ID NO: 7480524 - DNA, 22 bp, Homo sapiens
agtccaaagcagatgagggcca

SEQ ID NO: 7480525 - DNA, 22 bp, Homo sapiens
agtccaaagcagatgagggcca

SEQ ID NO: 7480526 - DNA, 22 bp, Homo sapiens
agtccaaagcagatgagggcca

SEQ ID NO: 7480527 - DNA, 22 bp, Homo sapiens
agtccaaacaaacttcccgagg

SEQ ID NO: 7480528 - DNA, 22 bp, Homo sapiens
agtcattttgctaaatgagggt

SEQ ID NO: 7480529 - DNA, 22 bp, Homo sapiens
agtcattttgccagtcttcagg

SEQ ID NO: 7480530 - DNA, 22 bp, Homo sapiens
agtcattttgccagtcttcagg

SEQ ID NO: 7480531 - DNA, 22 bp, Homo sapiens
agtcatctcaacagcttgccca

SEQ ID NO: 7480532 - DNA, 22 bp, Homo sapiens
agtcatctatgggccacacgga

SEQ ID NO: 7480533 - DNA, 22 bp, Homo sapiens
agtcatcatttatatcaagtct

SEQ ID NO: 7480534 - DNA, 22 bp, Homo sapiens
agtcatccaagagcctgggcag

SEQ ID NO: 7480535 - DNA, 22 bp, Homo sapiens
agtcatcatttatatcaagtct

SEQ ID NO: 7480536 - DNA, 22 bp, Homo sapiens
agtcatcatttatatcaagtct

SEQ ID NO: 7480537 - DNA, 22 bp, Homo sapiens
agtcatcatgtacagagagcaa

SEQ ID NO: 7480538 - DNA, 22 bp, Homo sapiens
agtcatcatggaaaatgttgtt

SEQ ID NO: 7480539 - DNA, 22 bp, Homo sapiens
agtcatcatggaaaatgttgtt

SEQ ID NO: 7480540 - DNA, 22 bp, Homo sapiens
agtcatatttatataatttccc

SEQ ID NO: 7480541 - DNA, 17 bp, Homo sapiens
agtcatattgtgcagtt

SEQ ID NO: 7480542 - DNA, 19 bp, Homo sapiens
agtcatattgttcatcttg

SEQ ID NO: 7480543 - DNA, 19 bp, Homo sapiens
agtcatattgttcatcttg

SEQ ID NO: 7480544 - DNA, 22 bp, Homo sapiens
agtcatatgacccttcacaaac

SEQ ID NO: 7480545 - DNA, 22 bp, Homo sapiens
agtcatatgacccttcacaaac

SEQ ID NO: 7480546 - DNA, 22 bp, Homo sapiens
agtcatatctgaggaggaatcc

SEQ ID NO: 7480547 - DNA, 21 bp, Homo sapiens
agtcatctgttcattcaacag

SEQ ID NO: 7480548 - DNA, 22 bp, Homo sapiens
agtcatctggttttgcatggca

SEQ ID NO: 7480549 - DNA, 22 bp, Homo sapiens
agtcatctggttttgcatggca

SEQ ID NO: 7480550 - DNA, 22 bp, Homo sapiens
agtcatctgacctcttctcaga

SEQ ID NO: 7480551 - DNA, 22 bp, Homo sapiens
agtcatctgacctcttctcaga

SEQ ID NO: 7480552 - DNA, 22 bp, Homo sapiens
agtcatctttatccaaaacact

SEQ ID NO: 7480553 - DNA, 21 bp, Homo sapiens
agtcatctgttcattcaacag

SEQ ID NO: 7480554 - DNA, 22 bp, Homo sapiens
agtcatgctacttcatcttctg

SEQ ID NO: 7480555 - DNA, 20 bp, Homo sapiens
agtcatctcctctactgctt

SEQ ID NO: 7480556 - DNA, 20 bp, Homo sapiens
agtcatctcctctactgctt

SEQ ID NO: 7480557 - DNA, 22 bp, Homo sapiens
agtcatctccaatatacaaagc

SEQ ID NO: 7480558 - DNA, 22 bp, Homo sapiens
agtcatctcaggtagcatttac

SEQ ID NO: 7480559 - DNA, 22 bp, Homo sapiens
agtcatctctgagatagaagct

SEQ ID NO: 7480560 - DNA, 22 bp, Homo sapiens
agtcatctcttctacaatatgg

SEQ ID NO: 7480561 - DNA, 22 bp, Homo sapiens
agtcatctcttctacaatatgg

SEQ ID NO: 7480562 - DNA, 22 bp, Homo sapiens
agtcattacagcaggcagaagg

SEQ ID NO: 7480563 - DNA, 22 bp, Homo sapiens
agtcattacagcaggcagaagg

SEQ ID NO: 7480564 - DNA, 22 bp, Homo sapiens
agtcattacggactagtactac

SEQ ID NO: 7480565 - DNA, 22 bp, Homo sapiens
agtcatgctacttcatcttctg

SEQ ID NO: 7480566 - DNA, 23 bp, Homo sapiens
agtcattaagaagttcaggaact

SEQ ID NO: 7480567 - DNA, 22 bp, Homo sapiens
agtcattaattagtaggaaggt

SEQ ID NO: 7480568 - DNA, 22 bp, Homo sapiens
agtctgtgagtgatgtacctgc

SEQ ID NO: 7480569 - DNA, 22 bp, Homo sapiens
agtctgtgctgttggtgaggat

SEQ ID NO: 7480570 - DNA, 23 bp, Homo sapiens
agtctgtgcttggtgggagggcc

SEQ ID NO: 7480571 - DNA, 22 bp, Homo sapiens
agtctgtgctgttggtgaggat

SEQ ID NO: 7480572 - DNA, 23 bp, Homo sapiens
agtctgtgctgaagaagttacaa

SEQ ID NO: 7480573 - DNA, 22 bp, Homo sapiens
agtctgtggatggactggcaga

SEQ ID NO: 7480574 - DNA, 23 bp, Homo sapiens
agtctgtgcttggtgggagggcc

SEQ ID NO: 7480575 - DNA, 22 bp, Homo sapiens
agtctgtggatggactggcaga

SEQ ID NO: 7480576 - DNA, 23 bp, Homo sapiens
agtctgtgcttggtgggagggcc

SEQ ID NO: 7480577 - DNA, 22 bp, Homo sapiens
agtctgtgaacttggcagggaa

SEQ ID NO: 7480578 - DNA, 22 bp, Homo sapiens
agtctgtgactcattggatctc

SEQ ID NO: 7480579 - DNA, 22 bp, Homo sapiens
agtctgtgaacttggcagggaa

SEQ ID NO: 7480580 - DNA, 22 bp, Homo sapiens
agtctgtgactcattggatctc

SEQ ID NO: 7480581 - DNA, 22 bp, Homo sapiens
agtctgtgaacttggcagggaa

SEQ ID NO: 7480582 - DNA, 22 bp, Homo sapiens
agtctgtgagtgatgtacctgc

SEQ ID NO: 7480583 - DNA, 23 bp, Homo sapiens
agtctgtgctgaagaagttacaa

SEQ ID NO: 7480584 - DNA, 22 bp, Homo sapiens
agtctgtctctgctaatcacta

SEQ ID NO: 7480585 - DNA, 22 bp, Homo sapiens
agtctgtctctgctaatcacta

SEQ ID NO: 7480586 - DNA, 19 bp, Homo sapiens
agtctgtctgctttccctc

SEQ ID NO: 7480587 - DNA, 22 bp, Homo sapiens
agtctgtctacttaaagtctgt

SEQ ID NO: 7480588 - DNA, 22 bp, Homo sapiens
agtctgtctgtcacttctgcag

SEQ ID NO: 7480589 - DNA, 22 bp, Homo sapiens
agtctgtctgtcacttctgcag

SEQ ID NO: 7480590 - DNA, 22 bp, Homo sapiens
agtctgtgaaaagataggaagt

SEQ ID NO: 7480591 - DNA, 22 bp, Homo sapiens
agtctgtgaaaagataggaagt

SEQ ID NO: 7480592 - DNA, 22 bp, Homo sapiens
agtctgtctttggcttcaccac

SEQ ID NO: 7480593 - DNA, 19 bp, Homo sapiens
agtctgtctgctttccctc

SEQ ID NO: 7480594 - DNA, 17 bp, Homo sapiens
agtctgtctttccttgt

SEQ ID NO: 7480595 - DNA, 17 bp, Homo sapiens
agtctgtctttccttgt

SEQ ID NO: 7480596 - DNA, 22 bp, Homo sapiens
agtctggattagttgggggcaa

SEQ ID NO: 7480597 - DNA, 22 bp, Homo sapiens
agtctggagtttgctactggac

SEQ ID NO: 7480598 - DNA, 22 bp, Homo sapiens
agtctggagtttgctactggac

SEQ ID NO: 7480599 - DNA, 22 bp, Homo sapiens
agtctggatttagaggtgggcc

SEQ ID NO: 7480600 - DNA, 22 bp, Homo sapiens
agtctggatttagaggtgggcc

SEQ ID NO: 7480601 - DNA, 22 bp, Homo sapiens
agtctgcttttgtgaagagctg

SEQ ID NO: 7480602 - DNA, 22 bp, Homo sapiens
agtctgcttttgtgaagagctg

SEQ ID NO: 7480603 - DNA, 22 bp, Homo sapiens
agtctgcctttccaatcccgtg

SEQ ID NO: 7480604 - DNA, 22 bp, Homo sapiens
agtctgcttcctggagaactca

SEQ ID NO: 7480605 - DNA, 22 bp, Homo sapiens
agtctgcttcctggagaactca

SEQ ID NO: 7480606 - DNA, 22 bp, Homo sapiens
agtctgcctttccaatcccgtg

SEQ ID NO: 7480607 - DNA, 22 bp, Homo sapiens
agtctgcattttaacaagatcc

SEQ ID NO: 7480608 - DNA, 20 bp, Homo sapiens
agtctgcctgctccttctcc

SEQ ID NO: 7480609 - DNA, 20 bp, Homo sapiens
agtctgcctgctccttctcc

SEQ ID NO: 7480610 - DNA, 20 bp, Homo sapiens
agtctgcctgctccttctcc

SEQ ID NO: 7480611 - DNA, 22 bp, Homo sapiens
agtctggacctgctgggtctcc

SEQ ID NO: 7480612 - DNA, 22 bp, Homo sapiens
agtctggaatttggcctgagca

SEQ ID NO: 7480613 - DNA, 22 bp, Homo sapiens
agtctggaatttggcctgagca

SEQ ID NO: 7480614 - DNA, 22 bp, Homo sapiens
agtctggagtgcggcggcagga

SEQ ID NO: 7480615 - DNA, 22 bp, Homo sapiens
agtctggagtgcggcggcagga

SEQ ID NO: 7480616 - DNA, 22 bp, Homo sapiens
agtctggagtgattatgtggga

SEQ ID NO: 7480617 - DNA, 22 bp, Homo sapiens
agtctggagtagagcctagaaa

SEQ ID NO: 7480618 - DNA, 22 bp, Homo sapiens
agtctggagtagagcctagaaa

SEQ ID NO: 7480619 - DNA, 19 bp, Homo sapiens
agtctggagtaaaaggaat

SEQ ID NO: 7480620 - DNA, 19 bp, Homo sapiens
agtctggagtaaaaggaat

SEQ ID NO: 7480621 - DNA, 22 bp, Homo sapiens
agtctggaggtggcaggtgtgt

SEQ ID NO: 7480622 - DNA, 22 bp, Homo sapiens
agtctggagcagcagtattggt

SEQ ID NO: 7480623 - DNA, 22 bp, Homo sapiens
agtctggagctcagacttggga

SEQ ID NO: 7480624 - DNA, 22 bp, Homo sapiens
agtctggagcagcagtattggt

SEQ ID NO: 7480625 - DNA, 19 bp, Homo sapiens
agtctgtggatttgtgggt

SEQ ID NO: 7480626 - DNA, 22 bp, Homo sapiens
agtctgtggggtccctggggca

SEQ ID NO: 7480627 - DNA, 22 bp, Homo sapiens
agtctgtgtacctttggccttc

SEQ ID NO: 7480628 - DNA, 22 bp, Homo sapiens
agtctgtggggtccctggggca

SEQ ID NO: 7480629 - DNA, 22 bp, Homo sapiens
agtctgtgtactgggtttctgt

SEQ ID NO: 7480630 - DNA, 22 bp, Homo sapiens
agtctgtgtatattcactgccc

SEQ ID NO: 7480631 - DNA, 22 bp, Homo sapiens
agtctgtgtgaatgtgggcttt

SEQ ID NO: 7480632 - DNA, 22 bp, Homo sapiens
agtctgtgtgaatgtgggcttt

SEQ ID NO: 7480633 - DNA, 22 bp, Homo sapiens
agtctgtgtatattcactgccc

SEQ ID NO: 7480634 - DNA, 22 bp, Homo sapiens
agtcttaactatgcaagtacta

SEQ ID NO: 7480635 - DNA, 22 bp, Homo sapiens
agtcttaactatgcaagtacta

SEQ ID NO: 7480636 - DNA, 22 bp, Homo sapiens
agtcttaactatgcaagtacta

SEQ ID NO: 7480637 - DNA, 22 bp, Homo sapiens
ctcaggatgcaattccatcaag

SEQ ID NO: 7480638 - DNA, 22 bp, Homo sapiens
ctcaggagttggaggctacagt

SEQ ID NO: 7480639 - DNA, 23 bp, Homo sapiens
agtcttactgtcccagaacaggg

SEQ ID NO: 7480640 - DNA, 22 bp, Homo sapiens
ctcaggagttggaggctacagt

SEQ ID NO: 7480641 - DNA, 22 bp, Homo sapiens
agtcttaatagagaaaaactgt

SEQ ID NO: 7480642 - DNA, 23 bp, Homo sapiens
agtcttaatacagctcttttcta

SEQ ID NO: 7480643 - DNA, 22 bp, Homo sapiens
agtcttacatgagaaagaacct

SEQ ID NO: 7480644 - DNA, 22 bp, Homo sapiens
ctcaggagttggaggctacagt

SEQ ID NO: 7480645 - DNA, 22 bp, Homo sapiens
ctcaggagttggaggctacagt

SEQ ID NO: 7480646 - DNA, 23 bp, Homo sapiens
agtcttactgtcccagaacaggg

SEQ ID NO: 7480647 - DNA, 22 bp, Homo sapiens
agtcttacatgagaaagaacct

SEQ ID NO: 7480648 - DNA, 22 bp, Homo sapiens
ctcaggcagtgccctctggccg

SEQ ID NO: 7480649 - DNA, 22 bp, Homo sapiens
ctcaggcagtgccctctggccg

SEQ ID NO: 7480650 - DNA, 22 bp, Homo sapiens
ctcaggcagtgccctctggccg

SEQ ID NO: 7480651 - DNA, 22 bp, Homo sapiens
ctcaggcagtgccctctggccg

SEQ ID NO: 7480652 - DNA, 22 bp, Homo sapiens
ctcaggcagtgccctctggccg

SEQ ID NO: 7480653 - DNA, 18 bp, Homo sapiens
ctcaggcagagaagcttt

SEQ ID NO: 7480654 - DNA, 22 bp, Homo sapiens
ctcaggcagttgtttgcatagt

SEQ ID NO: 7480655 - DNA, 22 bp, Homo sapiens
ctcaggcagttctgtagcctcc

SEQ ID NO: 7480656 - DNA, 22 bp, Homo sapiens
ctcaggcagttctgtagcctcc

SEQ ID NO: 7480657 - DNA, 22 bp, Homo sapiens
ctcaggcagttctgtagcctcc

SEQ ID NO: 7480658 - DNA, 22 bp, Homo sapiens
ctcaggcacttttgtcacagac

SEQ ID NO: 7480659 - DNA, 18 bp, Homo sapiens
ctcaggcagagaagcttt

SEQ ID NO: 7480660 - DNA, 18 bp, Homo sapiens
ctcaggcagagaagcttt

SEQ ID NO: 7480661 - DNA, 22 bp, Homo sapiens
ctcaggcacttttgtcacagac

SEQ ID NO: 7480662 - DNA, 22 bp, Homo sapiens
ctcaggcacttttgtcacagac

SEQ ID NO: 7480663 - DNA, 22 bp, Homo sapiens
ctcaggcacttttgtcacagac

SEQ ID NO: 7480664 - DNA, 22 bp, Homo sapiens
ctcaggcacttttgtcacagac

SEQ ID NO: 7480665 - DNA, 22 bp, Homo sapiens
ctcaggcacttttgtcacagac

SEQ ID NO: 7480666 - DNA, 22 bp, Homo sapiens
ctcaggatgtcggtgactattg

SEQ ID NO: 7480667 - DNA, 22 bp, Homo sapiens
ctcaggatgtcggtgactattg

SEQ ID NO: 7480668 - DNA, 22 bp, Homo sapiens
ctcaggcacgggtcagtgagcg

SEQ ID NO: 7480669 - DNA, 22 bp, Homo sapiens
ctcaggcacgggtcagtgagcg

SEQ ID NO: 7480670 - DNA, 22 bp, Homo sapiens
ctcaggcacgggtcagtgagcg

SEQ ID NO: 7480671 - DNA, 22 bp, Homo sapiens
ctcaggcacgggtcagtgagcg

SEQ ID NO: 7480672 - DNA, 22 bp, Homo sapiens
ctcaggcacgggtcagtgagcg

SEQ ID NO: 7480673 - DNA, 22 bp, Homo sapiens
ctcaggatttactaatttcaag

SEQ ID NO: 7480674 - DNA, 22 bp, Homo sapiens
ctcaggcaaggcccgcattctc

SEQ ID NO: 7480675 - DNA, 22 bp, Homo sapiens
ctcaggcaaggcccgcattctc

SEQ ID NO: 7480676 - DNA, 22 bp, Homo sapiens
ctcaggcaaggcccgcattctc

SEQ ID NO: 7480677 - DNA, 22 bp, Homo sapiens
ctctgagcagaggccgtggcta

SEQ ID NO: 7480678 - DNA, 22 bp, Homo sapiens
ctctgagcagaggccgtggcta

SEQ ID NO: 7480679 - DNA, 22 bp, Homo sapiens
ctctgagcagaggccgtggcta

SEQ ID NO: 7480680 - DNA, 22 bp, Homo sapiens
agtgggagagaagcaagtagta

SEQ ID NO: 7480681 - DNA, 22 bp, Homo sapiens
agtgggagagaagcaagtagta

SEQ ID NO: 7480682 - DNA, 22 bp, Homo sapiens
ctctgagatgcttgaagaggat

SEQ ID NO: 7480683 - DNA, 22 bp, Homo sapiens
ctctgagatgcttgaagaggat

SEQ ID NO: 7480684 - DNA, 22 bp, Homo sapiens
ctctgagatgcttgaagaggat

SEQ ID NO: 7480685 - DNA, 22 bp, Homo sapiens
ctctgagatgcttgaagaggat

SEQ ID NO: 7480686 - DNA, 22 bp, Homo sapiens
ctctgagatgcttgaagaggat

SEQ ID NO: 7480687 - DNA, 22 bp, Homo sapiens
ctctgagatgataccttctgga

SEQ ID NO: 7480688 - DNA, 22 bp, Homo sapiens
agtgggagggccatatggtgaa

SEQ ID NO: 7480689 - DNA, 22 bp, Homo sapiens
agtgggagggccatatggtgaa

SEQ ID NO: 7480690 - DNA, 22 bp, Homo sapiens
agtgggagggccatatggtgaa

SEQ ID NO: 7480691 - DNA, 20 bp, Homo sapiens
agtgggagagggcagactgc

SEQ ID NO: 7480692 - DNA, 22 bp, Homo sapiens
agtgggcaaaacagctcagagc

SEQ ID NO: 7480693 - DNA, 21 bp, Homo sapiens
agtgggatactggaaggtaga

SEQ ID NO: 7480694 - DNA, 22 bp, Homo sapiens
agtgggagggccatatggtgaa

SEQ ID NO: 7480695 - DNA, 22 bp, Homo sapiens
agtgggagggccatatggtgaa

SEQ ID NO: 7480696 - DNA, 22 bp, Homo sapiens
agtgggagggccatatggtgaa

SEQ ID NO: 7480697 - DNA, 22 bp, Homo sapiens
agtgggcatatgaagtctcaag

SEQ ID NO: 7480698 - DNA, 22 bp, Homo sapiens
agtgggcatatgaagtctcaag

SEQ ID NO: 7480699 - DNA, 22 bp, Homo sapiens
agtgggcagtgcgctcggatgc

SEQ ID NO: 7480700 - DNA, 22 bp, Homo sapiens
agtgggcagcccaggaggtctt

SEQ ID NO: 7480701 - DNA, 22 bp, Homo sapiens
agtgggcagcccaggaggtctt

SEQ ID NO: 7480702 - DNA, 22 bp, Homo sapiens
agtgggcaggcagggtgcgcag

SEQ ID NO: 7480703 - DNA, 22 bp, Homo sapiens
agtgggcaggcagggtgcgcag

SEQ ID NO: 7480704 - DNA, 18 bp, Homo sapiens
agtgggcacacagagaac

SEQ ID NO: 7480705 - DNA, 18 bp, Homo sapiens
agtgggcacacagagaac

SEQ ID NO: 7480706 - DNA, 18 bp, Homo sapiens
agtgggcacacagagaac

SEQ ID NO: 7480707 - DNA, 22 bp, Homo sapiens
agtgggcagcccaggaggtctt

SEQ ID NO: 7480708 - DNA, 19 bp, Homo sapiens
agtgggcaaggaagatgac

SEQ ID NO: 7480709 - DNA, 18 bp, Homo sapiens
agtgggcacacagagaac

SEQ ID NO: 7480710 - DNA, 22 bp, Homo sapiens
agtgggcaaaacagctcagagc

SEQ ID NO: 7480711 - DNA, 19 bp, Homo sapiens
agtgggcaaggaagatgac

SEQ ID NO: 7480712 - DNA, 19 bp, Homo sapiens
agtgggcaaggaagatgac

SEQ ID NO: 7480713 - DNA, 22 bp, Homo sapiens
agtgggcaaaacagctcagagc

SEQ ID NO: 7480714 - DNA, 22 bp, Homo sapiens
agtgggcaaaacagctcagagc

SEQ ID NO: 7480715 - DNA, 22 bp, Homo sapiens
agtgggcaaaacagctcagagc

SEQ ID NO: 7480716 - DNA, 22 bp, Homo sapiens
agtgggcaaaacagctcagagc

SEQ ID NO: 7480717 - DNA, 22 bp, Homo sapiens
agtgggcaaaacagctcagagc

SEQ ID NO: 7480718 - DNA, 22 bp, Homo sapiens
agtggggaagagcatgggccct

SEQ ID NO: 7480719 - DNA, 22 bp, Homo sapiens
agtggggaagagcatgggccct

SEQ ID NO: 7480720 - DNA, 22 bp, Homo sapiens
agtggggaagagcatgggccct

SEQ ID NO: 7480721 - DNA, 22 bp, Homo sapiens
agtggggaagagcatgggccct

SEQ ID NO: 7480722 - DNA, 22 bp, Homo sapiens
agtggggaagagcatgggccct

SEQ ID NO: 7480723 - DNA, 22 bp, Homo sapiens
agtgggcttactgagggagtgt

SEQ ID NO: 7480724 - DNA, 22 bp, Homo sapiens
agtgggcttactgagggagtgt

SEQ ID NO: 7480725 - DNA, 22 bp, Homo sapiens
agtgggctgagcttgctgggtg

SEQ ID NO: 7480726 - DNA, 22 bp, Homo sapiens
agtgggctgagcttgctgggtg

SEQ ID NO: 7480727 - DNA, 22 bp, Homo sapiens
agtgggctggtggcagggagaa

SEQ ID NO: 7480728 - DNA, 22 bp, Homo sapiens
agtgggcttactgagggagtgt

SEQ ID NO: 7480729 - DNA, 22 bp, Homo sapiens
agtgggctgtaatttaggaatg

SEQ ID NO: 7480730 - DNA, 22 bp, Homo sapiens
agtgggctggtggcagggagaa

SEQ ID NO: 7480731 - DNA, 22 bp, Homo sapiens
agtgggctggtggcagggagaa

SEQ ID NO: 7480732 - DNA, 22 bp, Homo sapiens
agtgggccggacagcccaggcc

SEQ ID NO: 7480733 - DNA, 22 bp, Homo sapiens
agtgggccggacagcccaggcc

SEQ ID NO: 7480734 - DNA, 22 bp, Homo sapiens
agtgggcccttgtcacactgat

SEQ ID NO: 7480735 - DNA, 22 bp, Homo sapiens
agtgggccggacagcccaggcc

SEQ ID NO: 7480736 - DNA, 22 bp, Homo sapiens
agtgggcctgagtgaccagttc

SEQ ID NO: 7480737 - DNA, 22 bp, Homo sapiens
agtgggcctgagtgaccagttc

SEQ ID NO: 7480738 - DNA, 23 bp, Homo sapiens
agtgggctcagtcctccaacccc

SEQ ID NO: 7480739 - DNA, 22 bp, Homo sapiens
agtgggctgagcttgctgggtg

SEQ ID NO: 7480740 - DNA, 22 bp, Homo sapiens
agtgggccttagaaggttccct

SEQ ID NO: 7480741 - DNA, 22 bp, Homo sapiens
agtgggccttagaaggttccct

SEQ ID NO: 7480742 - DNA, 22 bp, Homo sapiens
agtgggcccgagccagtggtct

SEQ ID NO: 7480743 - DNA, 22 bp, Homo sapiens
agtgggcccgagccagtggtct

SEQ ID NO: 7480744 - DNA, 22 bp, Homo sapiens
agtgggcccgagccagtggtct

SEQ ID NO: 7480745 - DNA, 22 bp, Homo sapiens
agtgggccaaatggaggcaagt

SEQ ID NO: 7480746 - DNA, 22 bp, Homo sapiens
agtgggccaaatggaggcaagt

SEQ ID NO: 7480747 - DNA, 22 bp, Homo sapiens
agtgggccaagtgtatgtgtct

SEQ ID NO: 7480748 - DNA, 21 bp, Homo sapiens
agtgggccatgtgtaatattt

SEQ ID NO: 7480749 - DNA, 22 bp, Homo sapiens
agtgggcatgatctggtgtctg

SEQ ID NO: 7480750 - DNA, 22 bp, Homo sapiens
agtgggcatgatctggtgtctg

SEQ ID NO: 7480751 - DNA, 22 bp, Homo sapiens
agtgggcatatgaagtctcaag

SEQ ID NO: 7480752 - DNA, 22 bp, Homo sapiens
agtgggcatatgaagtctcaag

SEQ ID NO: 7480753 - DNA, 22 bp, Homo sapiens
agtgggcatatgaagtctcaag

SEQ ID NO: 7480754 - DNA, 22 bp, Homo sapiens
ctctgagacttagcatctacat

SEQ ID NO: 7480755 - DNA, 22 bp, Homo sapiens
ctctgagacttagcatctacat

SEQ ID NO: 7480756 - DNA, 22 bp, Homo sapiens
ctctgagacttagcatctacat

SEQ ID NO: 7480757 - DNA, 22 bp, Homo sapiens
ctctgagactcaagtgagtggg

SEQ ID NO: 7480758 - DNA, 22 bp, Homo sapiens
ctctgagactcaagtgagtggg

SEQ ID NO: 7480759 - DNA, 22 bp, Homo sapiens
ctctgagaatatgagctctttg

SEQ ID NO: 7480760 - DNA, 22 bp, Homo sapiens
ctctgagaatatgagctctttg

SEQ ID NO: 7480761 - DNA, 22 bp, Homo sapiens
ctctgagaatatgagctctttg

SEQ ID NO: 7480762 - DNA, 22 bp, Homo sapiens
ctctgagactcaagtgagtggg

SEQ ID NO: 7480763 - DNA, 22 bp, Homo sapiens
ctctgagaatatgagctctttg

SEQ ID NO: 7480764 - DNA, 23 bp, Homo sapiens
ctctgagacccaggtggacacgg

SEQ ID NO: 7480765 - DNA, 23 bp, Homo sapiens
ctctgagacccaggtggacacgg

SEQ ID NO: 7480766 - DNA, 22 bp, Homo sapiens
ctctgagaagccttgatgggga

SEQ ID NO: 7480767 - DNA, 22 bp, Homo sapiens
ctctgagaatataagactattt

SEQ ID NO: 7480768 - DNA, 22 bp, Homo sapiens
ctctgagaagccttgatgggga

SEQ ID NO: 7480769 - DNA, 22 bp, Homo sapiens
ctctgagaatataagactattt

SEQ ID NO: 7480770 - DNA, 22 bp, Homo sapiens
ctctgagaagccttgatgggga

SEQ ID NO: 7480771 - DNA, 22 bp, Homo sapiens
ctctgagaagagttcaagtaaa

SEQ ID NO: 7480772 - DNA, 22 bp, Homo sapiens
ctctgagaagagttcaagtaaa

SEQ ID NO: 7480773 - DNA, 22 bp, Homo sapiens
ctctgagaaagctgtgagctaa

SEQ ID NO: 7480774 - DNA, 22 bp, Homo sapiens
ctctgagagtgctcagagggta

SEQ ID NO: 7480775 - DNA, 22 bp, Homo sapiens
ctctgagagtgctcagagggta

SEQ ID NO: 7480776 - DNA, 22 bp, Homo sapiens
ctctgagagtgctcagagggta

SEQ ID NO: 7480777 - DNA, 22 bp, Homo sapiens
ctctgagatagtttctatcaat

SEQ ID NO: 7480778 - DNA, 22 bp, Homo sapiens
ctctgagagtgctcagagggta

SEQ ID NO: 7480779 - DNA, 22 bp, Homo sapiens
ctctgagagtgctcagagggta

SEQ ID NO: 7480780 - DNA, 22 bp, Homo sapiens
ctctgagaggtgagaagcagca

SEQ ID NO: 7480781 - DNA, 22 bp, Homo sapiens
ctctgagaggtgagaagcagca

SEQ ID NO: 7480782 - DNA, 22 bp, Homo sapiens
ctctgagaggtgagaagcagca

SEQ ID NO: 7480783 - DNA, 22 bp, Homo sapiens
ctctgagaggtgagaagcagca

SEQ ID NO: 7480784 - DNA, 22 bp, Homo sapiens
ctctgagaggtgagaagcagca

SEQ ID NO: 7480785 - DNA, 22 bp, Homo sapiens
ctctgagaggtgagaagcagca

SEQ ID NO: 7480786 - DNA, 22 bp, Homo sapiens
ctctgagagcggtctgtggctt

SEQ ID NO: 7480787 - DNA, 22 bp, Homo sapiens
ctctgagaggctgccctgccat

SEQ ID NO: 7480788 - DNA, 22 bp, Homo sapiens
ctctgagagagctggtgagcac

SEQ ID NO: 7480789 - DNA, 22 bp, Homo sapiens
ctctgagagagctggtgagcac

SEQ ID NO: 7480790 - DNA, 22 bp, Homo sapiens
ctctgagagagctggtgagcac

SEQ ID NO: 7480791 - DNA, 22 bp, Homo sapiens
ctctgagacttttcacctccca

SEQ ID NO: 7480792 - DNA, 22 bp, Homo sapiens
ctctgagacttttcacctccca

SEQ ID NO: 7480793 - DNA, 22 bp, Homo sapiens
ctctgacttatcggagaagtcc

SEQ ID NO: 7480794 - DNA, 22 bp, Homo sapiens
ctctgactgacctggaatgaat

SEQ ID NO: 7480795 - DNA, 22 bp, Homo sapiens
ctctgactgacctggaatgaat

SEQ ID NO: 7480796 - DNA, 22 bp, Homo sapiens
ctctgactgacctggaatgaat

SEQ ID NO: 7480797 - DNA, 22 bp, Homo sapiens
ctctgagaaagctgtgagctaa

SEQ ID NO: 7480798 - DNA, 22 bp, Homo sapiens
ctctgactttaaatacaggatg

SEQ ID NO: 7480799 - DNA, 22 bp, Homo sapiens
ctctgactttaaatacaggatg

SEQ ID NO: 7480800 - DNA, 22 bp, Homo sapiens
ctctgacttatcggagaagtcc

SEQ ID NO: 7480801 - DNA, 22 bp, Homo sapiens
ctctgacctctagccagctctg

SEQ ID NO: 7480802 - DNA, 22 bp, Homo sapiens
ctctgacctctagccagctctg

SEQ ID NO: 7480803 - DNA, 22 bp, Homo sapiens
ctctgacctctagccagctctg

SEQ ID NO: 7480804 - DNA, 22 bp, Homo sapiens
ctctgaccattcccttgatttt

SEQ ID NO: 7480805 - DNA, 22 bp, Homo sapiens
ctctgacattctgtgactctga

SEQ ID NO: 7480806 - DNA, 22 bp, Homo sapiens
ctctgacattctgtgactctga

SEQ ID NO: 7480807 - DNA, 18 bp, Homo sapiens
ctctgaccgccacttgct

SEQ ID NO: 7480808 - DNA, 18 bp, Homo sapiens
ctctgaccgccacttgct

SEQ ID NO: 7480809 - DNA, 22 bp, Homo sapiens
ctctgacattctgtgactctga

SEQ ID NO: 7480810 - DNA, 22 bp, Homo sapiens
ctctgacattctgtgactctga

SEQ ID NO: 7480811 - DNA, 22 bp, Homo sapiens
ctctgacaggtggcattatctc

SEQ ID NO: 7480812 - DNA, 22 bp, Homo sapiens
agtggctgtcctggctctaact

SEQ ID NO: 7480813 - DNA, 22 bp, Homo sapiens
agtggctgtcttccaaaatctg

SEQ ID NO: 7480814 - DNA, 21 bp, Homo sapiens
agtggctgtcaagggggcctt

SEQ ID NO: 7480815 - DNA, 21 bp, Homo sapiens
agtggctgtcaagggggcctt

SEQ ID NO: 7480816 - DNA, 21 bp, Homo sapiens
agtggctgtcaagggggcctt

SEQ ID NO: 7480817 - DNA, 22 bp, Homo sapiens
agtggctggtctaaggtcacag

SEQ ID NO: 7480818 - DNA, 22 bp, Homo sapiens
agtggctggtagttactgagca

SEQ ID NO: 7480819 - DNA, 22 bp, Homo sapiens
agtggctggtctaaggtcacag

SEQ ID NO: 7480820 - DNA, 22 bp, Homo sapiens
agtggctggtctaaggtcacag

SEQ ID NO: 7480821 - DNA, 22 bp, Homo sapiens
agtggctggtagttactgagca

SEQ ID NO: 7480822 - DNA, 22 bp, Homo sapiens
agtggctggtagttactgagca

SEQ ID NO: 7480823 - DNA, 19 bp, Homo sapiens
agtggctgggcagaagcaa

SEQ ID NO: 7480824 - DNA, 19 bp, Homo sapiens
agtggctgggcagaagcaa

SEQ ID NO: 7480825 - DNA, 22 bp, Homo sapiens
agtggctgtaggctatgagaga

SEQ ID NO: 7480826 - DNA, 22 bp, Homo sapiens
agtggctgtatcagtcaaccct

SEQ ID NO: 7480827 - DNA, 22 bp, Homo sapiens
agtggctgtatcagtcaaccct

SEQ ID NO: 7480828 - DNA, 21 bp, Homo sapiens
agtggctgtcaagggggcctt

SEQ ID NO: 7480829 - DNA, 22 bp, Homo sapiens
agtggctggtctaaggtcacag

SEQ ID NO: 7480830 - DNA, 22 bp, Homo sapiens
agtggctgtactattttttcat

SEQ ID NO: 7480831 - DNA, 22 bp, Homo sapiens
agtggctgtaggctatgagaga

SEQ ID NO: 7480832 - DNA, 22 bp, Homo sapiens
agtggctggagccccaggctgg

SEQ ID NO: 7480833 - DNA, 22 bp, Homo sapiens
agtggctggacgacaagggtga

SEQ ID NO: 7480834 - DNA, 22 bp, Homo sapiens
agtggctggagccccaggctgg

SEQ ID NO: 7480835 - DNA, 22 bp, Homo sapiens
agtggctggcataggaacagac

SEQ ID NO: 7480836 - DNA, 22 bp, Homo sapiens
agtggctggagccccaggctgg

SEQ ID NO: 7480837 - DNA, 22 bp, Homo sapiens
agtggctggagccccaggctgg

SEQ ID NO: 7480838 - DNA, 22 bp, Homo sapiens
agtggctggcataggaacagac

SEQ ID NO: 7480839 - DNA, 22 bp, Homo sapiens
agtggctggcataggaacagac

SEQ ID NO: 7480840 - DNA, 22 bp, Homo sapiens
agtggctggcataggaacagac

SEQ ID NO: 7480841 - DNA, 22 bp, Homo sapiens
agtggctggcataggaacagac

SEQ ID NO: 7480842 - DNA, 22 bp, Homo sapiens
agtggctggcataggaacagac

SEQ ID NO: 7480843 - DNA, 19 bp, Homo sapiens
agtggctgggcagaagcaa

SEQ ID NO: 7480844 - DNA, 19 bp, Homo sapiens
agtggctgggcagaagcaa

SEQ ID NO: 7480845 - DNA, 19 bp, Homo sapiens
agtggctgggcagaagcaa

SEQ ID NO: 7480846 - DNA, 19 bp, Homo sapiens
agtggctgggcagaagcaa

SEQ ID NO: 7480847 - DNA, 22 bp, Homo sapiens
agtggcaggcggagatgtagga

SEQ ID NO: 7480848 - DNA, 22 bp, Homo sapiens
agtggcaggcggagatgtagga

SEQ ID NO: 7480849 - DNA, 22 bp, Homo sapiens
agtggcaggcggagatgtagga

SEQ ID NO: 7480850 - DNA, 22 bp, Homo sapiens
agtggcaggcggagatgtagga

SEQ ID NO: 7480851 - DNA, 22 bp, Homo sapiens
agtggcaggcggagatgtagga

SEQ ID NO: 7480852 - DNA, 22 bp, Homo sapiens
agtggcaggcggagatgtagga

SEQ ID NO: 7480853 - DNA, 22 bp, Homo sapiens
agtggcaggcggagatgtagga

SEQ ID NO: 7480854 - DNA, 20 bp, Homo sapiens
agtggcaggcgatcattact

SEQ ID NO: 7480855 - DNA, 17 bp, Homo sapiens
agtggcaggcagatggg

SEQ ID NO: 7480856 - DNA, 22 bp, Homo sapiens
agtggcaggcggagatgtagga

SEQ ID NO: 7480857 - DNA, 17 bp, Homo sapiens
agtggcaggcagatggg

SEQ ID NO: 7480858 - DNA, 17 bp, Homo sapiens
agtggcaggcagatggg

SEQ ID NO: 7480859 - DNA, 17 bp, Homo sapiens
agtggcaggcagatggg

SEQ ID NO: 7480860 - DNA, 22 bp, Homo sapiens
agtggctggacgacaagggtga

SEQ ID NO: 7480861 - DNA, 22 bp, Homo sapiens
agtggctgacaactgggttaac

SEQ ID NO: 7480862 - DNA, 22 bp, Homo sapiens
agtggctgacaactgggttaac

SEQ ID NO: 7480863 - DNA, 23 bp, Homo sapiens
agtggctggacagactttcctgg

SEQ ID NO: 7480864 - DNA, 22 bp, Homo sapiens
agtggctgaagcatcaaaggca

SEQ ID NO: 7480865 - DNA, 22 bp, Homo sapiens
agtggctgaatatattttacta

SEQ ID NO: 7480866 - DNA, 22 bp, Homo sapiens
agtggctgacaactgggttaac

SEQ ID NO: 7480867 - DNA, 22 bp, Homo sapiens
agtggcagctgtcatgccctag

SEQ ID NO: 7480868 - DNA, 22 bp, Homo sapiens
agtggcagctgtcatgccctag

SEQ ID NO: 7480869 - DNA, 22 bp, Homo sapiens
agtggcaggaaagtggaagaga

SEQ ID NO: 7480870 - DNA, 22 bp, Homo sapiens
agtggcagctgtcatgccctag

SEQ ID NO: 7480871 - DNA, 22 bp, Homo sapiens
agtggcaggaaagtggaagaga

SEQ ID NO: 7480872 - DNA, 22 bp, Homo sapiens
agtggcaggaaagtggaagaga

SEQ ID NO: 7480873 - DNA, 22 bp, Homo sapiens
agtggcaggaaagtggaagaga

SEQ ID NO: 7480874 - DNA, 22 bp, Homo sapiens
agtggcaggaaagtggaagaga

SEQ ID NO: 7480875 - DNA, 22 bp, Homo sapiens
agtggcaggcagaagcttctca

SEQ ID NO: 7480876 - DNA, 22 bp, Homo sapiens
agtggcaggatctcggttcact

SEQ ID NO: 7480877 - DNA, 22 bp, Homo sapiens
agtggcaggatctcggttcact

SEQ ID NO: 7480878 - DNA, 22 bp, Homo sapiens
agtggcaggaaagtggaagaga

SEQ ID NO: 7480879 - DNA, 22 bp, Homo sapiens
agtggcaggaaagtggaagaga

SEQ ID NO: 7480880 - DNA, 22 bp, Homo sapiens
agtggcaggatctcggttcact

SEQ ID NO: 7480881 - DNA, 22 bp, Homo sapiens
agtggcaggatctcggttcact

SEQ ID NO: 7480882 - DNA, 17 bp, Homo sapiens
agtggcaggcagatggg

SEQ ID NO: 7480883 - DNA, 17 bp, Homo sapiens
agtggcaggcagatggg

SEQ ID NO: 7480884 - DNA, 17 bp, Homo sapiens
agtggcaggcagatggg

SEQ ID NO: 7480885 - DNA, 17 bp, Homo sapiens
agtggcaggcagatggg

SEQ ID NO: 7480886 - DNA, 17 bp, Homo sapiens
agtggcaggcagatggg

SEQ ID NO: 7480887 - DNA, 17 bp, Homo sapiens
agtggcaggcagatggg

SEQ ID NO: 7480888 - DNA, 17 bp, Homo sapiens
agtggcaggcagatggg

SEQ ID NO: 7480889 - DNA, 17 bp, Homo sapiens
agtggcaggcagatggg

SEQ ID NO: 7480890 - DNA, 22 bp, Homo sapiens
agtggcaggcagaagcttctca

SEQ ID NO: 7480891 - DNA, 22 bp, Homo sapiens
agtggcaggcagaagcttctca

SEQ ID NO: 7480892 - DNA, 22 bp, Homo sapiens
ctctctggtcccagattccaga

SEQ ID NO: 7480893 - DNA, 22 bp, Homo sapiens
ctctctggtacatagagtttgg

SEQ ID NO: 7480894 - DNA, 22 bp, Homo sapiens
agtggcagccgagcaggagatg

SEQ ID NO: 7480895 - DNA, 22 bp, Homo sapiens
agtggcagccgagcaggagatg

SEQ ID NO: 7480896 - DNA, 22 bp, Homo sapiens
agtggcagccgagcaggagatg

SEQ ID NO: 7480897 - DNA, 22 bp, Homo sapiens
agtggcagccgagcaggagatg

SEQ ID NO: 7480898 - DNA, 22 bp, Homo sapiens
agtggcagccgagcaggagatg

SEQ ID NO: 7480899 - DNA, 22 bp, Homo sapiens
agtggcagccgagcaggagatg

SEQ ID NO: 7480900 - DNA, 22 bp, Homo sapiens
agtggcagccttgttcattatg

SEQ ID NO: 7480901 - DNA, 22 bp, Homo sapiens
agtggcagccttgttcattatg

SEQ ID NO: 7480902 - DNA, 22 bp, Homo sapiens
agtggcagctgtcatgccctag

SEQ ID NO: 7480903 - DNA, 22 bp, Homo sapiens
agtggcagctgtcatgccctag

SEQ ID NO: 7480904 - DNA, 22 bp, Homo sapiens
agtggcagctgtcatgccctag

SEQ ID NO: 7480905 - DNA, 22 bp, Homo sapiens
agtggcagctgtcatgccctag

SEQ ID NO: 7480906 - DNA, 22 bp, Homo sapiens
agtggcagctgtcatgccctag

SEQ ID NO: 7480907 - DNA, 22 bp, Homo sapiens
agtggcagccgagcaggagatg

SEQ ID NO: 7480908 - DNA, 22 bp, Homo sapiens
agtggcagccgagcaggagatg

SEQ ID NO: 7480909 - DNA, 22 bp, Homo sapiens
agtggcagccgagcaggagatg

SEQ ID NO: 7480910 - DNA, 22 bp, Homo sapiens
agtggcagccgagcaggagatg

SEQ ID NO: 7480911 - DNA, 22 bp, Homo sapiens
agtggcagccgagcaggagatg

SEQ ID NO: 7480912 - DNA, 22 bp, Homo sapiens
agtgcaggctcgcttgtgaggc

SEQ ID NO: 7480913 - DNA, 22 bp, Homo sapiens
agtgcaggccccaggccaggcc

SEQ ID NO: 7480914 - DNA, 22 bp, Homo sapiens
agtgcaggccccaggccaggcc

SEQ ID NO: 7480915 - DNA, 22 bp, Homo sapiens
agtgcaggccccaggccaggcc

SEQ ID NO: 7480916 - DNA, 22 bp, Homo sapiens
agtgcaggccccaggccaggcc

SEQ ID NO: 7480917 - DNA, 22 bp, Homo sapiens
agtgcaggccccaggccaggcc

SEQ ID NO: 7480918 - DNA, 22 bp, Homo sapiens
agtgcaggagcctggccagagc

SEQ ID NO: 7480919 - DNA, 22 bp, Homo sapiens
agtgcaggagcctggccagagc

SEQ ID NO: 7480920 - DNA, 22 bp, Homo sapiens
agtgcaggagcctggccagagc

SEQ ID NO: 7480921 - DNA, 22 bp, Homo sapiens
agtgcaggagcctggccagagc

SEQ ID NO: 7480922 - DNA, 22 bp, Homo sapiens
agtgcaggccccaggccaggcc

SEQ ID NO: 7480923 - DNA, 22 bp, Homo sapiens
agtgcaggccccaggccaggcc

SEQ ID NO: 7480924 - DNA, 22 bp, Homo sapiens
agtgcaggccccaggccaggcc

SEQ ID NO: 7480925 - DNA, 22 bp, Homo sapiens
agtgcaggccccaggccaggcc

SEQ ID NO: 7480926 - DNA, 22 bp, Homo sapiens
agtgcaggccccaggccaggcc

SEQ ID NO: 7480927 - DNA, 22 bp, Homo sapiens
agtgcaggccccaggccaggcc

SEQ ID NO: 7480928 - DNA, 22 bp, Homo sapiens
agtgcaggctcgcttgtgaggc

SEQ ID NO: 7480929 - DNA, 22 bp, Homo sapiens
agtgcaggctcgcttgtgaggc

SEQ ID NO: 7480930 - DNA, 19 bp, Homo sapiens
agtgcagggagcaccctca

SEQ ID NO: 7480931 - DNA, 19 bp, Homo sapiens
agtgcagggagcaccctca

SEQ ID NO: 7480932 - DNA, 22 bp, Homo sapiens
ctctctccttagctgcagacca

SEQ ID NO: 7480933 - DNA, 22 bp, Homo sapiens
ctctctccttagctgcagacca

SEQ ID NO: 7480934 - DNA, 22 bp, Homo sapiens
ctctctccttagctgcagacca

SEQ ID NO: 7480935 - DNA, 22 bp, Homo sapiens
agtgcagggcctgcccagcagg

SEQ ID NO: 7480936 - DNA, 19 bp, Homo sapiens
agtgcagggagcaccctca

SEQ ID NO: 7480937 - DNA, 23 bp, Homo sapiens
ctctctctaccatgtgaggacac

SEQ ID NO: 7480938 - DNA, 23 bp, Homo sapiens
ctctctctaccatgtgaggacac

SEQ ID NO: 7480939 - DNA, 23 bp, Homo sapiens
ctctctctaccatgtgaggacac

SEQ ID NO: 7480940 - DNA, 22 bp, Homo sapiens
ctctctccttagctgcagacca

SEQ ID NO: 7480941 - DNA, 22 bp, Homo sapiens
ctctctggcttggcacggagat

SEQ ID NO: 7480942 - DNA, 22 bp, Homo sapiens
ctctctggcttggcacggagat

SEQ ID NO: 7480943 - DNA, 22 bp, Homo sapiens
ctctctggcttggcacggagat

SEQ ID NO: 7480944 - DNA, 22 bp, Homo sapiens
ctctctggcttggcacggagat

SEQ ID NO: 7480945 - DNA, 22 bp, Homo sapiens
ctctctgggcccagttggcacc

SEQ ID NO: 7480946 - DNA, 22 bp, Homo sapiens
ctctctgggcccagttggcacc

SEQ ID NO: 7480947 - DNA, 22 bp, Homo sapiens
ctctctgggggccatgccaaga

SEQ ID NO: 7480948 - DNA, 22 bp, Homo sapiens
ctctctggcttggcacggagat

SEQ ID NO: 7480949 - DNA, 22 bp, Homo sapiens
ctctctggcttggcacggagat

SEQ ID NO: 7480950 - DNA, 22 bp, Homo sapiens
ctctctggcttggcacggagat

SEQ ID NO: 7480951 - DNA, 22 bp, Homo sapiens
ctctctgggcccagttggcacc

SEQ ID NO: 7480952 - DNA, 22 bp, Homo sapiens
ctctctgggcccagttggcacc

SEQ ID NO: 7480953 - DNA, 22 bp, Homo sapiens
ctctctgggcccagttggcacc

SEQ ID NO: 7480954 - DNA, 22 bp, Homo sapiens
ctctctgggaatattttattct

SEQ ID NO: 7480955 - DNA, 22 bp, Homo sapiens
ctctctggggttccagacgtgg

SEQ ID NO: 7480956 - DNA, 22 bp, Homo sapiens
ctctctgggtcctcttttatag

SEQ ID NO: 7480957 - DNA, 22 bp, Homo sapiens
ctctctggggttccagacgtgg

SEQ ID NO: 7480958 - DNA, 22 bp, Homo sapiens
ctctctggggttccagacgtgg

SEQ ID NO: 7480959 - DNA, 18 bp, Homo sapiens
ctctctgggtgaggacaa

SEQ ID NO: 7480960 - DNA, 18 bp, Homo sapiens
ctctctgggtgaggacaa

SEQ ID NO: 7480961 - DNA, 22 bp, Homo sapiens
ctctctggggttccagacgtgg

SEQ ID NO: 7480962 - DNA, 22 bp, Homo sapiens
ctctctgggtcctcttttatag

SEQ ID NO: 7480963 - DNA, 18 bp, Homo sapiens
ctctctgggtgaggacaa

SEQ ID NO: 7480964 - DNA, 18 bp, Homo sapiens
ctctctgggtgaggacaa

SEQ ID NO: 7480965 - DNA, 18 bp, Homo sapiens
ctctctgggtgaggacaa

SEQ ID NO: 7480966 - DNA, 18 bp, Homo sapiens
ctctctgggtgaggacaa

SEQ ID NO: 7480967 - DNA, 18 bp, Homo sapiens
ctctctgggtgaggacaa

SEQ ID NO: 7480968 - DNA, 22 bp, Homo sapiens
ctctctggtacatagagtttgg

SEQ ID NO: 7480969 - DNA, 22 bp, Homo sapiens
ctcttagatatggagaattacc

SEQ ID NO: 7480970 - DNA, 22 bp, Homo sapiens
ctcttagaaactatagagatta

SEQ ID NO: 7480971 - DNA, 22 bp, Homo sapiens
ctcttacattcttttactagca

SEQ ID NO: 7480972 - DNA, 22 bp, Homo sapiens
ctcttacattcttttactagca

SEQ ID NO: 7480973 - DNA, 19 bp, Homo sapiens
ctcttacagaatagacaca

SEQ ID NO: 7480974 - DNA, 22 bp, Homo sapiens
ctcttacacagattcctctagc

SEQ ID NO: 7480975 - DNA, 19 bp, Homo sapiens
ctcttacagaatagacaca

SEQ ID NO: 7480976 - DNA, 22 bp, Homo sapiens
ctcttaattaagctgagatctg

SEQ ID NO: 7480977 - DNA, 20 bp, Homo sapiens
ctcttaattgctcacattag

SEQ ID NO: 7480978 - DNA, 20 bp, Homo sapiens
ctcttaattgctcacattag

SEQ ID NO: 7480979 - DNA, 22 bp, Homo sapiens
ctcttacaagctcccgatataa

SEQ ID NO: 7480980 - DNA, 20 bp, Homo sapiens
ctcttaattgctcacattag

SEQ ID NO: 7480981 - DNA, 22 bp, Homo sapiens
ctcttaattaagctgagatctg

SEQ ID NO: 7480982 - DNA, 19 bp, Homo sapiens
ctcttaaattgtctcttgc

SEQ ID NO: 7480983 - DNA, 20 bp, Homo sapiens
ctcttaaatgtaaagtaggc

SEQ ID NO: 7480984 - DNA, 22 bp, Homo sapiens
ctcttaatgttttatagattga

SEQ ID NO: 7480985 - DNA, 22 bp, Homo sapiens
ctcttaatgttttatagattga

SEQ ID NO: 7480986 - DNA, 22 bp, Homo sapiens
ctcttaatgaccttaattcaag

SEQ ID NO: 7480987 - DNA, 18 bp, Homo sapiens
ctcttaagcctttgtcaa

SEQ ID NO: 7480988 - DNA, 22 bp, Homo sapiens
ctcttaatgaccttaattcaag

SEQ ID NO: 7480989 - DNA, 22 bp, Homo sapiens
ctcttaatgaccttaattcaag

SEQ ID NO: 7480990 - DNA, 18 bp, Homo sapiens
ctcttaagcctttgtcaa

SEQ ID NO: 7480991 - DNA, 22 bp, Homo sapiens
ctcttaaataacatcattgctt

SEQ ID NO: 7480992 - DNA, 22 bp, Homo sapiens
ctcttaaataacatcattgctt

SEQ ID NO: 7480993 - DNA, 20 bp, Homo sapiens
ctcttaaatgtaaagtaggc

SEQ ID NO: 7480994 - DNA, 20 bp, Homo sapiens
ctcttaaatgtaaagtaggc

SEQ ID NO: 7480995 - DNA, 20 bp, Homo sapiens
ctcttaaatgtaaagtaggc

SEQ ID NO: 7480996 - DNA, 22 bp, Homo sapiens
ctcttaaataacatcattgctt

SEQ ID NO: 7480997 - DNA, 22 bp, Homo sapiens
ctcttaaataacatcattgctt

SEQ ID NO: 7480998 - DNA, 22 bp, Homo sapiens
ctcttaaagcttccagtttcaa

SEQ ID NO: 7480999 - DNA, 22 bp, Homo sapiens
ctcttaaagcttccagtttcaa

SEQ ID NO: 7481000 - DNA, 22 bp, Homo sapiens
ctcttaaagcttccagtttcaa

SEQ ID NO: 7481001 - DNA, 22 bp, Homo sapiens
ctcttaaagcttccagtttcaa

SEQ ID NO: 7481002 - DNA, 22 bp, Homo sapiens
agtgtctgcagtgatgtctctt

SEQ ID NO: 7481003 - DNA, 22 bp, Homo sapiens
agtgtctgcaaaatgaaagagc

SEQ ID NO: 7481004 - DNA, 22 bp, Homo sapiens
agtgtctgcagtgatgtctctt

SEQ ID NO: 7481005 - DNA, 22 bp, Homo sapiens
agtgtctgccaactgcatggtc

SEQ ID NO: 7481006 - DNA, 22 bp, Homo sapiens
agtgtctgccaactgcatggtc

SEQ ID NO: 7481007 - DNA, 22 bp, Homo sapiens
agtgtctgcagtgatgtctctt

SEQ ID NO: 7481008 - DNA, 22 bp, Homo sapiens
agtgtctgcagtgatgtctctt

SEQ ID NO: 7481009 - DNA, 22 bp, Homo sapiens
agtgtctgcagtgatgtctctt

SEQ ID NO: 7481010 - DNA, 22 bp, Homo sapiens
agtgtctgcaaaatgaaagagc

SEQ ID NO: 7481011 - DNA, 22 bp, Homo sapiens
agtgtctgcaaaatgaaagagc

SEQ ID NO: 7481012 - DNA, 22 bp, Homo sapiens
agtgtctgatgcacagttgtcc

SEQ ID NO: 7481013 - DNA, 22 bp, Homo sapiens
agtgtctgatgcacagttgtcc

SEQ ID NO: 7481014 - DNA, 22 bp, Homo sapiens
agtgtctgcaaaatgaaagagc

SEQ ID NO: 7481015 - DNA, 22 bp, Homo sapiens
agtgtctgcctatttttcaagc

SEQ ID NO: 7481016 - DNA, 22 bp, Homo sapiens
agtgtctgccagctgccaggtg

SEQ ID NO: 7481017 - DNA, 22 bp, Homo sapiens
agtgtctgccagctgccaggtg

SEQ ID NO: 7481018 - DNA, 22 bp, Homo sapiens
agtgtctgccagctgccaggtg

SEQ ID NO: 7481019 - DNA, 22 bp, Homo sapiens
agtgtctgccaactgcatggtc

SEQ ID NO: 7481020 - DNA, 22 bp, Homo sapiens
agtgtctgccagctgccaggtg

SEQ ID NO: 7481021 - DNA, 22 bp, Homo sapiens
agtgtctgccagctgccaggtg

SEQ ID NO: 7481022 - DNA, 22 bp, Homo sapiens
agtgtctgccaactgcatggtc

SEQ ID NO: 7481023 - DNA, 22 bp, Homo sapiens
agtgtctgccaactgcatggtc

SEQ ID NO: 7481024 - DNA, 22 bp, Homo sapiens
ctcttaaagaatgttccagctg

SEQ ID NO: 7481025 - DNA, 22 bp, Homo sapiens
ctcttaaagaatgttccagctg

SEQ ID NO: 7481026 - DNA, 22 bp, Homo sapiens
ctcttaaaattacctttgcaaa

SEQ ID NO: 7481027 - DNA, 22 bp, Homo sapiens
ctcttaaaattacctttgcaaa

SEQ ID NO: 7481028 - DNA, 22 bp, Homo sapiens
ctcttaaagaatgttccagctg

SEQ ID NO: 7481029 - DNA, 22 bp, Homo sapiens
ctcttaaaaacttgatatattt

SEQ ID NO: 7481030 - DNA, 22 bp, Homo sapiens
ctcttaaaaacttgatatattt

SEQ ID NO: 7481031 - DNA, 22 bp, Homo sapiens
ctcttaaaaacttgatatattt

SEQ ID NO: 7481032 - DNA, 22 bp, Homo sapiens
ctcttaaaaacttgatatattt

SEQ ID NO: 7481033 - DNA, 22 bp, Homo sapiens
ctcttaaaaacttgatatattt

SEQ ID NO: 7481034 - DNA, 22 bp, Homo sapiens
ctctgtttttcaatagttcttg

SEQ ID NO: 7481035 - DNA, 22 bp, Homo sapiens
ctctgtttttcaatagttcttg

SEQ ID NO: 7481036 - DNA, 22 bp, Homo sapiens
ctctgtttggcgctgctccttc

SEQ ID NO: 7481037 - DNA, 22 bp, Homo sapiens
agtgtctgcctatttttcaagc

SEQ ID NO: 7481038 - DNA, 22 bp, Homo sapiens
agtgtctgcctatttttcaagc

SEQ ID NO: 7481039 - DNA, 22 bp, Homo sapiens
agtgtctgcctatttttcaagc

SEQ ID NO: 7481040 - DNA, 22 bp, Homo sapiens
agtgtcctctattatgacttta

SEQ ID NO: 7481041 - DNA, 22 bp, Homo sapiens
agtgtctgaactgggtgctgac

SEQ ID NO: 7481042 - DNA, 22 bp, Homo sapiens
agtgtctgaactgggtgctgac

SEQ ID NO: 7481043 - DNA, 22 bp, Homo sapiens
agtgtctgaacctgcagtggga

SEQ ID NO: 7481044 - DNA, 22 bp, Homo sapiens
agtgtctgaactgggtgctgac

SEQ ID NO: 7481045 - DNA, 22 bp, Homo sapiens
agtgtctgaactgggtgctgac

SEQ ID NO: 7481046 - DNA, 22 bp, Homo sapiens
agtgtctgaacctgcagtggga

SEQ ID NO: 7481047 - DNA, 22 bp, Homo sapiens
agtgtctgaactgggtgctgac

SEQ ID NO: 7481048 - DNA, 22 bp, Homo sapiens
agtgtctgaagcctcagcccga

SEQ ID NO: 7481049 - DNA, 22 bp, Homo sapiens
agtgtctgaactgggtgctgac

SEQ ID NO: 7481050 - DNA, 22 bp, Homo sapiens
agtgtctgaagcctcagcccga

SEQ ID NO: 7481051 - DNA, 22 bp, Homo sapiens
agtgtctgaagcctcagcccga

SEQ ID NO: 7481052 - DNA, 22 bp, Homo sapiens
agtgtctgaaggatttggcttc

SEQ ID NO: 7481053 - DNA, 22 bp, Homo sapiens
agtgtctgaagcctcagcccga

SEQ ID NO: 7481054 - DNA, 22 bp, Homo sapiens
agtgtctgaaggatttggcttc

SEQ ID NO: 7481055 - DNA, 22 bp, Homo sapiens
agtgtctgagccagaattagaa

SEQ ID NO: 7481056 - DNA, 22 bp, Homo sapiens
agtgtctgaaggatttggcttc

SEQ ID NO: 7481057 - DNA, 22 bp, Homo sapiens
agtgtctgaaggatttggcttc

SEQ ID NO: 7481058 - DNA, 22 bp, Homo sapiens
agtgtctgaagcctcagcccga

SEQ ID NO: 7481059 - DNA, 21 bp, Homo sapiens
agtgtctgagcgctgcttctg

SEQ ID NO: 7481060 - DNA, 22 bp, Homo sapiens
agtgtctgagccagaattagaa

SEQ ID NO: 7481061 - DNA, 22 bp, Homo sapiens
agtgtctgatcagttgactaga

SEQ ID NO: 7481062 - DNA, 22 bp, Homo sapiens
agtgtctgatcagttgactaga

SEQ ID NO: 7481063 - DNA, 22 bp, Homo sapiens
agtgtctgatcagttgactaga

SEQ ID NO: 7481064 - DNA, 22 bp, Homo sapiens
agtgtctgatcagttgactaga

SEQ ID NO: 7481065 - DNA, 23 bp, Homo sapiens
agtgtctgagtgcaggctgtgca

SEQ ID NO: 7481066 - DNA, 23 bp, Homo sapiens
agtgtctgagtgcaggctgtgca

SEQ ID NO: 7481067 - DNA, 23 bp, Homo sapiens
agtgtctgagtgcaggctgtgca

SEQ ID NO: 7481068 - DNA, 22 bp, Homo sapiens
agtgtctgatgcacagttgtcc

SEQ ID NO: 7481069 - DNA, 22 bp, Homo sapiens
agtgtctgatcagttgactaga

SEQ ID NO: 7481070 - DNA, 22 bp, Homo sapiens
agtgtctgatgcacagttgtcc

SEQ ID NO: 7481071 - DNA, 22 bp, Homo sapiens
agtgtctgcaaaatgaaagagc

SEQ ID NO: 7481072 - DNA, 21 bp, Homo sapiens
agtgtctgagcgctgcttctg

SEQ ID NO: 7481073 - DNA, 22 bp, Homo sapiens
agtgtctgagccagaattagaa

SEQ ID NO: 7481074 - DNA, 22 bp, Homo sapiens
agtgtctgagccagaattagaa

SEQ ID NO: 7481075 - DNA, 22 bp, Homo sapiens
agtgtctgagctatcattaggg

SEQ ID NO: 7481076 - DNA, 22 bp, Homo sapiens
agtgtctgagctatcattaggg

SEQ ID NO: 7481077 - DNA, 22 bp, Homo sapiens
agtgtctgagctatcattaggg

SEQ ID NO: 7481078 - DNA, 21 bp, Homo sapiens
agtgtctgagcgctgcttctg

SEQ ID NO: 7481079 - DNA, 23 bp, Homo sapiens
agtgtctgagtgcaggctgtgca

SEQ ID NO: 7481080 - DNA, 23 bp, Homo sapiens
agtgtctgagtgcaggctgtgca

SEQ ID NO: 7481081 - DNA, 22 bp, Homo sapiens
agtgtctgagtaaatttctcat

SEQ ID NO: 7481082 - DNA, 22 bp, Homo sapiens
agtgtctgagtaaatttctcat

SEQ ID NO: 7481083 - DNA, 23 bp, Homo sapiens
agtgtctgagtgcaggctgtgca

SEQ ID NO: 7481084 - DNA, 23 bp, Homo sapiens
agtggggaatcaacagattcttt

SEQ ID NO: 7481085 - DNA, 22 bp, Homo sapiens
agtggggacaatgagagcaggt

SEQ ID NO: 7481086 - DNA, 22 bp, Homo sapiens
agtggggacaatgagagcaggt

SEQ ID NO: 7481087 - DNA, 22 bp, Homo sapiens
agtggggacaatgagagcaggt

SEQ ID NO: 7481088 - DNA, 22 bp, Homo sapiens
agtggggaagattttgcagtca

SEQ ID NO: 7481089 - DNA, 22 bp, Homo sapiens
agtggggaagagcatgggccct

SEQ ID NO: 7481090 - DNA, 22 bp, Homo sapiens
agtggggaagattttgcagtca

SEQ ID NO: 7481091 - DNA, 22 bp, Homo sapiens
agtggggacttatgccagcatt

SEQ ID NO: 7481092 - DNA, 22 bp, Homo sapiens
agtggggacttatgccagcatt

SEQ ID NO: 7481093 - DNA, 22 bp, Homo sapiens
agtggggacaatgagagcaggt

SEQ ID NO: 7481094 - DNA, 22 bp, Homo sapiens
agtggggacttatgccagcatt

SEQ ID NO: 7481095 - DNA, 22 bp, Homo sapiens
agtggggacaatgagagcaggt

SEQ ID NO: 7481096 - DNA, 22 bp, Homo sapiens
agtggggacaatgagagcaggt

SEQ ID NO: 7481097 - DNA, 22 bp, Homo sapiens
agtggggacaatgagagcaggt

SEQ ID NO: 7481098 - DNA, 22 bp, Homo sapiens
agtggggacaatgagagcaggt

SEQ ID NO: 7481099 - DNA, 22 bp, Homo sapiens
agtggggacaatgagagcaggt

SEQ ID NO: 7481100 - DNA, 20 bp, Homo sapiens
agtggggagtcaggagtgcc

SEQ ID NO: 7481101 - DNA, 20 bp, Homo sapiens
agtggggagtcaggagtgcc

SEQ ID NO: 7481102 - DNA, 20 bp, Homo sapiens
agtggggagtcaggagtgcc

SEQ ID NO: 7481103 - DNA, 20 bp, Homo sapiens
agtggggagtcaggagtgcc

SEQ ID NO: 7481104 - DNA, 20 bp, Homo sapiens
agtggggagtcaggagtgcc

SEQ ID NO: 7481105 - DNA, 20 bp, Homo sapiens
agtggggagtcaggagtgcc

SEQ ID NO: 7481106 - DNA, 20 bp, Homo sapiens
agtggggagtcaggagtgcc

SEQ ID NO: 7481107 - DNA, 20 bp, Homo sapiens
agtggggagtcaggagtgcc

SEQ ID NO: 7481108 - DNA, 20 bp, Homo sapiens
agtggggagtcaggagtgcc

SEQ ID NO: 7481109 - DNA, 20 bp, Homo sapiens
agtggggagtcaggagtgcc

SEQ ID NO: 7481110 - DNA, 22 bp, Homo sapiens
agtggggaggtccaggccaccc

SEQ ID NO: 7481111 - DNA, 22 bp, Homo sapiens
agtggggaggtccaggccaccc

SEQ ID NO: 7481112 - DNA, 22 bp, Homo sapiens
agtggggaggtccaggccaccc

SEQ ID NO: 7481113 - DNA, 20 bp, Homo sapiens
agtggggagtcaggagtgcc

SEQ ID NO: 7481114 - DNA, 22 bp, Homo sapiens
agtggggaggtccaggccaccc

SEQ ID NO: 7481115 - DNA, 22 bp, Homo sapiens
agtggggaggtccaggccaccc

SEQ ID NO: 7481116 - DNA, 22 bp, Homo sapiens
agtggggacttatgccagcatt

SEQ ID NO: 7481117 - DNA, 22 bp, Homo sapiens
agtggggacttatgccagcatt

SEQ ID NO: 7481118 - DNA, 22 bp, Homo sapiens
agtggggacttatgccagcatt

SEQ ID NO: 7481119 - DNA, 21 bp, Homo sapiens
agtgtgtgtggaatgagaata

SEQ ID NO: 7481120 - DNA, 22 bp, Homo sapiens
agtgtgtgtttgggcggtttat

SEQ ID NO: 7481121 - DNA, 22 bp, Homo sapiens
agtgtgtgtttgggcggtttat

SEQ ID NO: 7481122 - DNA, 22 bp, Homo sapiens
agtgtgtgtttgggcggtttat

SEQ ID NO: 7481123 - DNA, 22 bp, Homo sapiens
agtgtgtgtttgggcggtttat

SEQ ID NO: 7481124 - DNA, 22 bp, Homo sapiens
agtgtgtttggagcgagggagg

SEQ ID NO: 7481125 - DNA, 23 bp, Homo sapiens
agtgttaaatttcgcacctaaat

SEQ ID NO: 7481126 - DNA, 22 bp, Homo sapiens
agtgtgtttaggctgcgggttg

SEQ ID NO: 7481127 - DNA, 22 bp, Homo sapiens
agtgtgttctcaatgaaaagaa

SEQ ID NO: 7481128 - DNA, 22 bp, Homo sapiens
agtgtgttctcaatgaaaagaa

SEQ ID NO: 7481129 - DNA, 22 bp, Homo sapiens
ctgaagcaattgagagatgttt

SEQ ID NO: 7481130 - DNA, 22 bp, Homo sapiens
ctgaagcacagcatataaataa

SEQ ID NO: 7481131 - DNA, 22 bp, Homo sapiens
ctgaagcacagcatataaataa

SEQ ID NO: 7481132 - DNA, 23 bp, Homo sapiens
ctgaagcaatatcccctcacttc

SEQ ID NO: 7481133 - DNA, 22 bp, Homo sapiens
ctgaagcaattgagagatgttt

SEQ ID NO: 7481134 - DNA, 22 bp, Homo sapiens
ctgaagcaattgagagatgttt

SEQ ID NO: 7481135 - DNA, 22 bp, Homo sapiens
ctgaagcagatgtggctgagat

SEQ ID NO: 7481136 - DNA, 22 bp, Homo sapiens
ctgaagcaggaacagcgagatt

SEQ ID NO: 7481137 - DNA, 22 bp, Homo sapiens
ctgaagcaggaacagcgagatt

SEQ ID NO: 7481138 - DNA, 22 bp, Homo sapiens
ctgaagcagatgtggctgagat

SEQ ID NO: 7481139 - DNA, 22 bp, Homo sapiens
ctgaagcagatgtggctgagat

SEQ ID NO: 7481140 - DNA, 22 bp, Homo sapiens
ctgaagcaaatgaaacagctct

SEQ ID NO: 7481141 - DNA, 22 bp, Homo sapiens
agtgttaagagaaaattctgct

SEQ ID NO: 7481142 - DNA, 22 bp, Homo sapiens
agtgttaacatgaatggtttcc

SEQ ID NO: 7481143 - DNA, 23 bp, Homo sapiens
agtgttaaatttcgcacctaaat

SEQ ID NO: 7481144 - DNA, 19 bp, Homo sapiens
agtgttaacccagtgttgg

SEQ ID NO: 7481145 - DNA, 19 bp, Homo sapiens
agtgttaacccagtgttgg

SEQ ID NO: 7481146 - DNA, 22 bp, Homo sapiens
ctgaagcaaatgaaacagctct

SEQ ID NO: 7481147 - DNA, 22 bp, Homo sapiens
ctgaagcaaatgaaacagctct

SEQ ID NO: 7481148 - DNA, 22 bp, Homo sapiens
ctgaagcaaatgaaacagctct

SEQ ID NO: 7481149 - DNA, 23 bp, Homo sapiens
ctgaagcaatatcccctcacttc

SEQ ID NO: 7481150 - DNA, 23 bp, Homo sapiens
ctgaagcaatatcccctcacttc

SEQ ID NO: 7481151 - DNA, 23 bp, Homo sapiens
ctgaagcaatatcccctcacttc

SEQ ID NO: 7481152 - DNA, 23 bp, Homo sapiens
ctgaagcaatatcccctcacttc

SEQ ID NO: 7481153 - DNA, 18 bp, Homo sapiens
agtgtgtgccctttcagg

SEQ ID NO: 7481154 - DNA, 18 bp, Homo sapiens
agtgtgtgccctttcagg

SEQ ID NO: 7481155 - DNA, 18 bp, Homo sapiens
agtgtgtgccctttcagg

SEQ ID NO: 7481156 - DNA, 22 bp, Homo sapiens
agtgtgtgcatgcattcgtgca

SEQ ID NO: 7481157 - DNA, 22 bp, Homo sapiens
agtgtgtgcatgcattcgtgca

SEQ ID NO: 7481158 - DNA, 22 bp, Homo sapiens
agtgtgtgcatgcattcgtgca

SEQ ID NO: 7481159 - DNA, 22 bp, Homo sapiens
agtgtggggtcaccggcccagg

SEQ ID NO: 7481160 - DNA, 22 bp, Homo sapiens
agtgtgggggctttggtgtcac

SEQ ID NO: 7481161 - DNA, 22 bp, Homo sapiens
agtgtgggggctttggtgtcac

SEQ ID NO: 7481162 - DNA, 22 bp, Homo sapiens
agtgtggggtcaccggcccagg

SEQ ID NO: 7481163 - DNA, 21 bp, Homo sapiens
agtgtgtgataggcaggaaga

SEQ ID NO: 7481164 - DNA, 21 bp, Homo sapiens
agtgtgtgataggcaggaaga

SEQ ID NO: 7481165 - DNA, 21 bp, Homo sapiens
agtgtgtgataggcaggaaga

SEQ ID NO: 7481166 - DNA, 22 bp, Homo sapiens
agtgtgtgctgttccccggagg

SEQ ID NO: 7481167 - DNA, 22 bp, Homo sapiens
agtgtgtgctgttccccggagg

SEQ ID NO: 7481168 - DNA, 21 bp, Homo sapiens
agtgtgtgtggaatgagaata

SEQ ID NO: 7481169 - DNA, 21 bp, Homo sapiens
agtgtgtgtggaatgagaata

SEQ ID NO: 7481170 - DNA, 21 bp, Homo sapiens
agtgtgtgtggaatgagaata

SEQ ID NO: 7481171 - DNA, 21 bp, Homo sapiens
agtgtgtgtggaatgagaata

SEQ ID NO: 7481172 - DNA, 21 bp, Homo sapiens
agtgtgtgtggaatgagaata

SEQ ID NO: 7481173 - DNA, 21 bp, Homo sapiens
agtgtgtgtggaatgagaata

SEQ ID NO: 7481174 - DNA, 22 bp, Homo sapiens
agtgtgtgcctttggatacctg

SEQ ID NO: 7481175 - DNA, 22 bp, Homo sapiens
agtgtgtgcctttggatacctg

SEQ ID NO: 7481176 - DNA, 22 bp, Homo sapiens
agtgtgtgcctttggatacctg

SEQ ID NO: 7481177 - DNA, 22 bp, Homo sapiens
agtgtgtgcctttggatacctg

SEQ ID NO: 7481178 - DNA, 22 bp, Homo sapiens
agtgtgtgctgttccccggagg

SEQ ID NO: 7481179 - DNA, 22 bp, Homo sapiens
ctgagaggcggagcttgcagtg

SEQ ID NO: 7481180 - DNA, 22 bp, Homo sapiens
ctgagaggcagccagagaaaat

SEQ ID NO: 7481181 - DNA, 22 bp, Homo sapiens
ctgagaggcggagcttgcagtg

SEQ ID NO: 7481182 - DNA, 22 bp, Homo sapiens
ctgagaggcggagcttgcagtg

SEQ ID NO: 7481183 - DNA, 22 bp, Homo sapiens
ctgagaggcggagcttgcagtg

SEQ ID NO: 7481184 - DNA, 22 bp, Homo sapiens
ctgagaggcggaggttgcagtg

SEQ ID NO: 7481185 - DNA, 22 bp, Homo sapiens
ctgagaggcggaggttgcagtg

SEQ ID NO: 7481186 - DNA, 22 bp, Homo sapiens
ctgagaggcggaggttgcagtg

SEQ ID NO: 7481187 - DNA, 22 bp, Homo sapiens
ctgagaggcggagcttgcagtg

SEQ ID NO: 7481188 - DNA, 22 bp, Homo sapiens
ctgagaggcggagcttgcagtg

SEQ ID NO: 7481189 - DNA, 22 bp, Homo sapiens
ctgagaggcggagcttgcagtg

SEQ ID NO: 7481190 - DNA, 22 bp, Homo sapiens
ctgagaggcacaaggcatttcg

SEQ ID NO: 7481191 - DNA, 22 bp, Homo sapiens
ctgagaggcacaaggcatttcg

SEQ ID NO: 7481192 - DNA, 22 bp, Homo sapiens
ctgagaggcacaaggcatttcg

SEQ ID NO: 7481193 - DNA, 22 bp, Homo sapiens
ctgagaggcagccagagaaaat

SEQ ID NO: 7481194 - DNA, 22 bp, Homo sapiens
ctgagaggcggagcttgcagtg

SEQ ID NO: 7481195 - DNA, 22 bp, Homo sapiens
ctgagaggcagccagagaaaat

SEQ ID NO: 7481196 - DNA, 22 bp, Homo sapiens
ctgagaggcagccagagaaaat

SEQ ID NO: 7481197 - DNA, 22 bp, Homo sapiens
ctgagaggcagccagagaaaat

SEQ ID NO: 7481198 - DNA, 22 bp, Homo sapiens
ctgagaggcagccagagaaaat

SEQ ID NO: 7481199 - DNA, 22 bp, Homo sapiens
ctgagaggcagccagagaaaat

SEQ ID NO: 7481200 - DNA, 22 bp, Homo sapiens
ctgagagcagggacttgagcca

SEQ ID NO: 7481201 - DNA, 22 bp, Homo sapiens
ctgagagatggtgtgtttataa

SEQ ID NO: 7481202 - DNA, 22 bp, Homo sapiens
ctgagaaagtgagggttaaaca

SEQ ID NO: 7481203 - DNA, 22 bp, Homo sapiens
ctgagagatggtgtgtttataa

SEQ ID NO: 7481204 - DNA, 22 bp, Homo sapiens
ctgagagcctcctgttggctag

SEQ ID NO: 7481205 - DNA, 22 bp, Homo sapiens
ctgagagcatcgctggagatag

SEQ ID NO: 7481206 - DNA, 22 bp, Homo sapiens
ctgagagcctcctgttggctag

SEQ ID NO: 7481207 - DNA, 22 bp, Homo sapiens
ctgagagcatcgctggagatag

SEQ ID NO: 7481208 - DNA, 22 bp, Homo sapiens
ctgagagcatcgctggagatag

SEQ ID NO: 7481209 - DNA, 22 bp, Homo sapiens
ctgagaggaacatcttatgctt

SEQ ID NO: 7481210 - DNA, 22 bp, Homo sapiens
ctgagaggaacatcttatgctt

SEQ ID NO: 7481211 - DNA, 22 bp, Homo sapiens
ctgagagcagggacttgagcca

SEQ ID NO: 7481212 - DNA, 22 bp, Homo sapiens
ctgagaggatgctgcagtggag

SEQ ID NO: 7481213 - DNA, 22 bp, Homo sapiens
ctgagaggatgctgcagtggag

SEQ ID NO: 7481214 - DNA, 22 bp, Homo sapiens
ctgagaggatgctgcagtggag

SEQ ID NO: 7481215 - DNA, 22 bp, Homo sapiens
ctgagaggatgctgcagtggag

SEQ ID NO: 7481216 - DNA, 22 bp, Homo sapiens
ctgagaggatgctgcagtggag

SEQ ID NO: 7481217 - DNA, 22 bp, Homo sapiens
ctgagaggatgctgcagtggag

SEQ ID NO: 7481218 - DNA, 22 bp, Homo sapiens
ctgagaggatgctgcagtggag

SEQ ID NO: 7481219 - DNA, 22 bp, Homo sapiens
ctgaagctgaaaacttccagca

SEQ ID NO: 7481220 - DNA, 22 bp, Homo sapiens
ctgaagctgaaaacttccagca

SEQ ID NO: 7481221 - DNA, 22 bp, Homo sapiens
ctgaagctgcataccaaagact

SEQ ID NO: 7481222 - DNA, 22 bp, Homo sapiens
ctgaagctgaaaacttccagca

SEQ ID NO: 7481223 - DNA, 22 bp, Homo sapiens
ctgaagctgggcacttcctttt

SEQ ID NO: 7481224 - DNA, 22 bp, Homo sapiens
ctgagaaagtgagggttaaaca

SEQ ID NO: 7481225 - DNA, 22 bp, Homo sapiens
ctgagaaaggacctcaaacagg

SEQ ID NO: 7481226 - DNA, 22 bp, Homo sapiens
ctgaagcttagtttacgctcca

SEQ ID NO: 7481227 - DNA, 22 bp, Homo sapiens
ctgaagcttgataaactataaa

SEQ ID NO: 7481228 - DNA, 22 bp, Homo sapiens
ctgaagccagtttgctgccctt

SEQ ID NO: 7481229 - DNA, 22 bp, Homo sapiens
ctgaagccatgtgctcactggt

SEQ ID NO: 7481230 - DNA, 22 bp, Homo sapiens
ctgaagcatatcatgccaagtt

SEQ ID NO: 7481231 - DNA, 22 bp, Homo sapiens
ctgaagcatatcatgccaagtt

SEQ ID NO: 7481232 - DNA, 22 bp, Homo sapiens
ctgaagcatgcgtttgtaaact

SEQ ID NO: 7481233 - DNA, 22 bp, Homo sapiens
ctgaagcatatcatgccaagtt

SEQ ID NO: 7481234 - DNA, 22 bp, Homo sapiens
ctgaagcatgcgtttgtaaact

SEQ ID NO: 7481235 - DNA, 22 bp, Homo sapiens
ctgaagccacgatagcttccta

SEQ ID NO: 7481236 - DNA, 22 bp, Homo sapiens
ctgaagccacgatagcttccta

SEQ ID NO: 7481237 - DNA, 22 bp, Homo sapiens
ctgaagcaggaggggaggcgct

SEQ ID NO: 7481238 - DNA, 22 bp, Homo sapiens
ctgaagcaggaggggaggcgct

SEQ ID NO: 7481239 - DNA, 22 bp, Homo sapiens
ctgaagcaggcctacttcattg

SEQ ID NO: 7481240 - DNA, 22 bp, Homo sapiens
ctgaagcaggcctacttcattg

SEQ ID NO: 7481241 - DNA, 22 bp, Homo sapiens
ctgaagcaggcctacttcattg

SEQ ID NO: 7481242 - DNA, 22 bp, Homo sapiens
ctgaagcaggcctacttcattg

SEQ ID NO: 7481243 - DNA, 22 bp, Homo sapiens
ctgaagcaggcctacttcattg

SEQ ID NO: 7481244 - DNA, 22 bp, Homo sapiens
ctgaagcagggagtgatgaagt

SEQ ID NO: 7481245 - DNA, 22 bp, Homo sapiens
ctgaagcagggagtgatgaagt

SEQ ID NO: 7481246 - DNA, 23 bp, Homo sapiens
ctgaagcagttccctctctgccc

SEQ ID NO: 7481247 - DNA, 22 bp, Homo sapiens
ctgaagcagggagtgatgaagt

SEQ ID NO: 7481248 - DNA, 23 bp, Homo sapiens
ctgaagcagttccctctctgccc

SEQ ID NO: 7481249 - DNA, 22 bp, Homo sapiens
ctgaagcatatcatgccaagtt

SEQ ID NO: 7481250 - DNA, 22 bp, Homo sapiens
agggaacagtgaaaggcatcag

SEQ ID NO: 7481251 - DNA, 22 bp, Homo sapiens
agggaacagtgaaaggcatcag

SEQ ID NO: 7481252 - DNA, 22 bp, Homo sapiens
agggaacagtgaaaggcatcag

SEQ ID NO: 7481253 - DNA, 22 bp, Homo sapiens
agggaacagtgaaaggcatcag

SEQ ID NO: 7481254 - DNA, 22 bp, Homo sapiens
agggaagaaaatccatcgctgc

SEQ ID NO: 7481255 - DNA, 22 bp, Homo sapiens
agggaagaaaatccatcgctgc

SEQ ID NO: 7481256 - DNA, 22 bp, Homo sapiens
agggaacagtgaaaggcatcag

SEQ ID NO: 7481257 - DNA, 22 bp, Homo sapiens
agggaacagtgaaaggcatcag

SEQ ID NO: 7481258 - DNA, 23 bp, Homo sapiens
agggaacaagcaagctgctagtc

SEQ ID NO: 7481259 - DNA, 23 bp, Homo sapiens
agggaacaagcaagctgctagtc

SEQ ID NO: 7481260 - DNA, 20 bp, Homo sapiens
agggaacaatggacgctgtc

SEQ ID NO: 7481261 - DNA, 20 bp, Homo sapiens
agggaacaatggacgctgtc

SEQ ID NO: 7481262 - DNA, 20 bp, Homo sapiens
agggaacaatggacgctgtc

SEQ ID NO: 7481263 - DNA, 23 bp, Homo sapiens
agggaacaagcaagctgctagtc

SEQ ID NO: 7481264 - DNA, 23 bp, Homo sapiens
agggaacaagcaagctgctagtc

SEQ ID NO: 7481265 - DNA, 22 bp, Homo sapiens
agggaacaaaactctaaaattc

SEQ ID NO: 7481266 - DNA, 22 bp, Homo sapiens
agggaaattaatgtgagcaatg

SEQ ID NO: 7481267 - DNA, 22 bp, Homo sapiens
agggaaattaatgtgagcaatg

SEQ ID NO: 7481268 - DNA, 22 bp, Homo sapiens
agggaaattaatgtgagcaatg

SEQ ID NO: 7481269 - DNA, 22 bp, Homo sapiens
agggaaattaatgtgagcaatg

SEQ ID NO: 7481270 - DNA, 22 bp, Homo sapiens
agggaaatggagagtgtagttt

SEQ ID NO: 7481271 - DNA, 22 bp, Homo sapiens
agggaaattaatgtgagcaatg

SEQ ID NO: 7481272 - DNA, 22 bp, Homo sapiens
agggaaattaatgtgagcaatg

SEQ ID NO: 7481273 - DNA, 22 bp, Homo sapiens
agggaaattaatgtgagcaatg

SEQ ID NO: 7481274 - DNA, 22 bp, Homo sapiens
agggaaatctttcaacacttca

SEQ ID NO: 7481275 - DNA, 22 bp, Homo sapiens
agggaaatctttcaacacttca

SEQ ID NO: 7481276 - DNA, 22 bp, Homo sapiens
agggaaatctttcaacacttca

SEQ ID NO: 7481277 - DNA, 22 bp, Homo sapiens
agggaaatctttcaacacttca

SEQ ID NO: 7481278 - DNA, 22 bp, Homo sapiens
agggaaatggagagtgtagttt

SEQ ID NO: 7481279 - DNA, 22 bp, Homo sapiens
agggaaataatctattctgagg

SEQ ID NO: 7481280 - DNA, 22 bp, Homo sapiens
agggaaatctcagctctaaaat

SEQ ID NO: 7481281 - DNA, 21 bp, Homo sapiens
agggaaatccagtcacttttc

SEQ ID NO: 7481282 - DNA, 21 bp, Homo sapiens
agggaaatccagtcacttttc

SEQ ID NO: 7481283 - DNA, 23 bp, Homo sapiens
agggaaatactgcaatttttgga

SEQ ID NO: 7481284 - DNA, 23 bp, Homo sapiens
cccaggagtttcactgcaaaggt

SEQ ID NO: 7481285 - DNA, 23 bp, Homo sapiens
cccaggagtttcactgcaaaggt

SEQ ID NO: 7481286 - DNA, 22 bp, Homo sapiens
cccaggagttggaggctgcagt

SEQ ID NO: 7481287 - DNA, 22 bp, Homo sapiens
cccaggagttggaggctgcagt

SEQ ID NO: 7481288 - DNA, 22 bp, Homo sapiens
cccaggagttggaggctgcagt

SEQ ID NO: 7481289 - DNA, 23 bp, Homo sapiens
cccaggagtttcactgcaaaggt

SEQ ID NO: 7481290 - DNA, 23 bp, Homo sapiens
cccaggagtttcactgcaaaggt

SEQ ID NO: 7481291 - DNA, 23 bp, Homo sapiens
cccaggagtttcactgcaaaggt

SEQ ID NO: 7481292 - DNA, 23 bp, Homo sapiens
cccaggagtttcactgcaaaggt

SEQ ID NO: 7481293 - DNA, 23 bp, Homo sapiens
cccaggagtttcactgcaaaggt

SEQ ID NO: 7481294 - DNA, 23 bp, Homo sapiens
cccaggagtttcactgcaaaggt

SEQ ID NO: 7481295 - DNA, 23 bp, Homo sapiens
cccaggagtttcactgcaaaggt

SEQ ID NO: 7481296 - DNA, 22 bp, Homo sapiens
cccaggagttggaggctacggt

SEQ ID NO: 7481297 - DNA, 22 bp, Homo sapiens
cccaggagttggaggctgcagt

SEQ ID NO: 7481298 - DNA, 22 bp, Homo sapiens
cccaggagttggaggctgcagt

SEQ ID NO: 7481299 - DNA, 22 bp, Homo sapiens
cccaggagttggaggctgcagt

SEQ ID NO: 7481300 - DNA, 22 bp, Homo sapiens
cccaggagttggaggctgcagt

SEQ ID NO: 7481301 - DNA, 22 bp, Homo sapiens
cccaggagttggaggctgcagt

SEQ ID NO: 7481302 - DNA, 22 bp, Homo sapiens
cccaggagttggaggctgcagt

SEQ ID NO: 7481303 - DNA, 22 bp, Homo sapiens
cccaggagttggaggctgcagt

SEQ ID NO: 7481304 - DNA, 22 bp, Homo sapiens
cccaggagttggaggctgcagt

SEQ ID NO: 7481305 - DNA, 22 bp, Homo sapiens
cccaggagttggaggctgcagt

SEQ ID NO: 7481306 - DNA, 22 bp, Homo sapiens
cccaggagttggaggctgcagt

SEQ ID NO: 7481307 - DNA, 22 bp, Homo sapiens
cccaggatggggctgcagttat

SEQ ID NO: 7481308 - DNA, 22 bp, Homo sapiens
cccaggatgatcgagagtggga

SEQ ID NO: 7481309 - DNA, 22 bp, Homo sapiens
cccaggatcacctggtcaaggg

SEQ ID NO: 7481310 - DNA, 22 bp, Homo sapiens
cccaggatgatcgagagtggga

SEQ ID NO: 7481311 - DNA, 20 bp, Homo sapiens
cccaggagtttgctcttact

SEQ ID NO: 7481312 - DNA, 22 bp, Homo sapiens
cccaggatcacctggtcaaggg

SEQ ID NO: 7481313 - DNA, 20 bp, Homo sapiens
cccaggagtttgctcttact

SEQ ID NO: 7481314 - DNA, 20 bp, Homo sapiens
cccaggagtttgctcttact

SEQ ID NO: 7481315 - DNA, 20 bp, Homo sapiens
cccaggagtttgctcttact

SEQ ID NO: 7481316 - DNA, 20 bp, Homo sapiens
cccaggagtttgctcttact

SEQ ID NO: 7481317 - DNA, 22 bp, Homo sapiens
cccaggagtttgagttcagcat

SEQ ID NO: 7481318 - DNA, 22 bp, Homo sapiens
cccaggagtttgagttcagcat

SEQ ID NO: 7481319 - DNA, 22 bp, Homo sapiens
cccaggagtttgagttcagcat

SEQ ID NO: 7481320 - DNA, 22 bp, Homo sapiens
cccaggagtttgagttcagcat

SEQ ID NO: 7481321 - DNA, 22 bp, Homo sapiens
cccaggagtttgagttcagcat

SEQ ID NO: 7481322 - DNA, 22 bp, Homo sapiens
cccaggagtttgagttcagcat

SEQ ID NO: 7481323 - DNA, 23 bp, Homo sapiens
cccaggagtttcactgcaaaggt

SEQ ID NO: 7481324 - DNA, 23 bp, Homo sapiens
cccaggagtttcactgcaaaggt

SEQ ID NO: 7481325 - DNA, 23 bp, Homo sapiens
cccaggagtttcactgcaaaggt

SEQ ID NO: 7481326 - DNA, 23 bp, Homo sapiens
cccaggagtttcactgcaaaggt

SEQ ID NO: 7481327 - DNA, 22 bp, Homo sapiens
cccagggcttttctcactagac

SEQ ID NO: 7481328 - DNA, 22 bp, Homo sapiens
cccagggcttttctcactagac

SEQ ID NO: 7481329 - DNA, 22 bp, Homo sapiens
cccagggcttttctcactagac

SEQ ID NO: 7481330 - DNA, 22 bp, Homo sapiens
cccagggcttttctcactagac

SEQ ID NO: 7481331 - DNA, 22 bp, Homo sapiens
cccagggcttttctcactagac

SEQ ID NO: 7481332 - DNA, 22 bp, Homo sapiens
cccagggcttgagtcatccatg

SEQ ID NO: 7481333 - DNA, 22 bp, Homo sapiens
cccagggcttttctcactagac

SEQ ID NO: 7481334 - DNA, 22 bp, Homo sapiens
cccagggcttttctcactagac

SEQ ID NO: 7481335 - DNA, 22 bp, Homo sapiens
cccagggcttttctcactagac

SEQ ID NO: 7481336 - DNA, 22 bp, Homo sapiens
cccagggcttgagtcatccatg

SEQ ID NO: 7481337 - DNA, 22 bp, Homo sapiens
cccagggcttgagtcatccatg

SEQ ID NO: 7481338 - DNA, 22 bp, Homo sapiens
cccagggctgtagaatgtccaa

SEQ ID NO: 7481339 - DNA, 22 bp, Homo sapiens
cccagggcttgagtcatccatg

SEQ ID NO: 7481340 - DNA, 22 bp, Homo sapiens
cccagggctgtagaatgtccaa

SEQ ID NO: 7481341 - DNA, 22 bp, Homo sapiens
cccagggctgtagaatgtccaa

SEQ ID NO: 7481342 - DNA, 22 bp, Homo sapiens
cccagggctgcagatggaggct

SEQ ID NO: 7481343 - DNA, 22 bp, Homo sapiens
cccaggggtaaggcgcagcgtg

SEQ ID NO: 7481344 - DNA, 22 bp, Homo sapiens
cccaggggtaaggcgcagcgtg

SEQ ID NO: 7481345 - DNA, 22 bp, Homo sapiens
cccaggggtaaggcgcagcgtg

SEQ ID NO: 7481346 - DNA, 22 bp, Homo sapiens
cccaggggtaaggcgcagcgtg

SEQ ID NO: 7481347 - DNA, 22 bp, Homo sapiens
cccaggggtaaggcgcagcgtg

SEQ ID NO: 7481348 - DNA, 22 bp, Homo sapiens
cccaggggtatccatggagaag

SEQ ID NO: 7481349 - DNA, 22 bp, Homo sapiens
cccaggggtatccatggagaag

SEQ ID NO: 7481350 - DNA, 22 bp, Homo sapiens
cccaggggtatccatggagaag

SEQ ID NO: 7481351 - DNA, 22 bp, Homo sapiens
cccaggggtaaggcgcagcgtg

SEQ ID NO: 7481352 - DNA, 22 bp, Homo sapiens
cccaggggtaaggcgcagcgtg

SEQ ID NO: 7481353 - DNA, 22 bp, Homo sapiens
cccaggggaggtcctcagggaa

SEQ ID NO: 7481354 - DNA, 22 bp, Homo sapiens
cccaggggaggtcctcagggaa

SEQ ID NO: 7481355 - DNA, 19 bp, Homo sapiens
cccaggggacccagcccta

SEQ ID NO: 7481356 - DNA, 19 bp, Homo sapiens
cccaggggacccagcccta

SEQ ID NO: 7481357 - DNA, 19 bp, Homo sapiens
cccaggggacccagcccta

SEQ ID NO: 7481358 - DNA, 19 bp, Homo sapiens
cccaggggacccagcccta

SEQ ID NO: 7481359 - DNA, 22 bp, Homo sapiens
cccaggggaggtcctcagggaa

SEQ ID NO: 7481360 - DNA, 22 bp, Homo sapiens
cccaggggaggtcctcagggaa

SEQ ID NO: 7481361 - DNA, 22 bp, Homo sapiens
cccaggggaggtcctcagggaa

SEQ ID NO: 7481362 - DNA, 22 bp, Homo sapiens
cccaggggaggtcctcagggaa

SEQ ID NO: 7481363 - DNA, 22 bp, Homo sapiens
cccaggggaggtcctcagggaa

SEQ ID NO: 7481364 - DNA, 22 bp, Homo sapiens
cccaggggaggtcctcagggaa

SEQ ID NO: 7481365 - DNA, 23 bp, Homo sapiens
agggaagaaacatgaagggctgt

SEQ ID NO: 7481366 - DNA, 23 bp, Homo sapiens
agggaagaaacatgaagggctgt

SEQ ID NO: 7481367 - DNA, 23 bp, Homo sapiens
agggaagaaacatgaagggctgt

SEQ ID NO: 7481368 - DNA, 23 bp, Homo sapiens
agggaagaaacatgaagggctgt

SEQ ID NO: 7481369 - DNA, 23 bp, Homo sapiens
agggaagaaacatgaagggctgt

SEQ ID NO: 7481370 - DNA, 23 bp, Homo sapiens
agggaagaaacatgaagggctgt

SEQ ID NO: 7481371 - DNA, 23 bp, Homo sapiens
agggaagaaacatgaagggctgt

SEQ ID NO: 7481372 - DNA, 23 bp, Homo sapiens
agggaagaaacatgaagggctgt

SEQ ID NO: 7481373 - DNA, 23 bp, Homo sapiens
agggaagaaacatgaagggctgt

SEQ ID NO: 7481374 - DNA, 22 bp, Homo sapiens
agggaagaaaatccatcgctgc

SEQ ID NO: 7481375 - DNA, 23 bp, Homo sapiens
agggaagaaacatgaagggctgt

SEQ ID NO: 7481376 - DNA, 22 bp, Homo sapiens
cccagggaagccatttctgact

SEQ ID NO: 7481377 - DNA, 22 bp, Homo sapiens
cccagggaagccatttctgact

SEQ ID NO: 7481378 - DNA, 21 bp, Homo sapiens
cccagggaagccgcagtcacc

SEQ ID NO: 7481379 - DNA, 22 bp, Homo sapiens
agggaagaagctggtagtaggt

SEQ ID NO: 7481380 - DNA, 22 bp, Homo sapiens
agggaagaagctggtagtaggt

SEQ ID NO: 7481381 - DNA, 22 bp, Homo sapiens
agggaagaagctggtagtaggt

SEQ ID NO: 7481382 - DNA, 22 bp, Homo sapiens
agggaagaagctggtagtaggt

SEQ ID NO: 7481383 - DNA, 22 bp, Homo sapiens
agggaagaagctggtagtaggt

SEQ ID NO: 7481384 - DNA, 22 bp, Homo sapiens
agggaagaagaacccattttga

SEQ ID NO: 7481385 - DNA, 22 bp, Homo sapiens
agggaagaagaacccattttga

SEQ ID NO: 7481386 - DNA, 23 bp, Homo sapiens
agggaagaaacatgaagggctgt

SEQ ID NO: 7481387 - DNA, 22 bp, Homo sapiens
cccagggccctggacagctaca

SEQ ID NO: 7481388 - DNA, 21 bp, Homo sapiens
cccagggaagccgcagtcacc

SEQ ID NO: 7481389 - DNA, 22 bp, Homo sapiens
cccagggccctggacagctaca

SEQ ID NO: 7481390 - DNA, 22 bp, Homo sapiens
cccagggccctggacagctaca

SEQ ID NO: 7481391 - DNA, 21 bp, Homo sapiens
cccagggaagccgcagtcacc

SEQ ID NO: 7481392 - DNA, 22 bp, Homo sapiens
cccagggccctggacagctaca

SEQ ID NO: 7481393 - DNA, 22 bp, Homo sapiens
cccagggccctggacagctaca

SEQ ID NO: 7481394 - DNA, 21 bp, Homo sapiens
cccagggaagccgcagtcacc

SEQ ID NO: 7481395 - DNA, 21 bp, Homo sapiens
cccagggaagccgcagtcacc

SEQ ID NO: 7481396 - DNA, 22 bp, Homo sapiens
cccagggccctggacagctaca

SEQ ID NO: 7481397 - DNA, 22 bp, Homo sapiens
cccagggccctggacagctaca

SEQ ID NO: 7481398 - DNA, 22 bp, Homo sapiens
cccagggccctggacagctaca

SEQ ID NO: 7481399 - DNA, 22 bp, Homo sapiens
cccagggccctggacagctaca

SEQ ID NO: 7481400 - DNA, 22 bp, Homo sapiens
cccagggctgcagatggaggct

SEQ ID NO: 7481401 - DNA, 22 bp, Homo sapiens
cccagggctgcagatggaggct

SEQ ID NO: 7481402 - DNA, 22 bp, Homo sapiens
cccagggctgcagatggaggct

SEQ ID NO: 7481403 - DNA, 22 bp, Homo sapiens
cccagggctgcagatggaggct

SEQ ID NO: 7481404 - DNA, 22 bp, Homo sapiens
cccagggctgcagatggaggct

SEQ ID NO: 7481405 - DNA, 22 bp, Homo sapiens
cccagggctgcagatggaggct

SEQ ID NO: 7481406 - DNA, 22 bp, Homo sapiens
cccagggctgcagatggaggct

SEQ ID NO: 7481407 - DNA, 22 bp, Homo sapiens
cccagggctgcagatggaggct

SEQ ID NO: 7481408 - DNA, 22 bp, Homo sapiens
aggcttcctggaggaagaggta

SEQ ID NO: 7481409 - DNA, 22 bp, Homo sapiens
aggcttcgcaaggttagagctg

SEQ ID NO: 7481410 - DNA, 19 bp, Homo sapiens
aggcttctaccctgtccag

SEQ ID NO: 7481411 - DNA, 22 bp, Homo sapiens
aggcttctaaatcacaaggaaa

SEQ ID NO: 7481412 - DNA, 22 bp, Homo sapiens
aggcttctaaatcacaaggaaa

SEQ ID NO: 7481413 - DNA, 19 bp, Homo sapiens
aggcttctaccctgtccag

SEQ ID NO: 7481414 - DNA, 22 bp, Homo sapiens
aggcttcctggaggaagaggta

SEQ ID NO: 7481415 - DNA, 22 bp, Homo sapiens
aggcttcactcgacatgccaat

SEQ ID NO: 7481416 - DNA, 22 bp, Homo sapiens
aggcttcacgatgggtgaggtg

SEQ ID NO: 7481417 - DNA, 22 bp, Homo sapiens
aggctggctggcaggggacaca

SEQ ID NO: 7481418 - DNA, 22 bp, Homo sapiens
aggctggctggcaggggacaca

SEQ ID NO: 7481419 - DNA, 22 bp, Homo sapiens
aggcttcacctgcacctgagct

SEQ ID NO: 7481420 - DNA, 22 bp, Homo sapiens
aggctggctgagctgcagcctg

SEQ ID NO: 7481421 - DNA, 22 bp, Homo sapiens
aggctggctgagctgcagcctg

SEQ ID NO: 7481422 - DNA, 22 bp, Homo sapiens
aggctggctggcaggggacaca

SEQ ID NO: 7481423 - DNA, 22 bp, Homo sapiens
aggctggctggcaggggacaca

SEQ ID NO: 7481424 - DNA, 22 bp, Homo sapiens
aggctggctggcaggggacaca

SEQ ID NO: 7481425 - DNA, 22 bp, Homo sapiens
aggctggctggcaggggacaca

SEQ ID NO: 7481426 - DNA, 22 bp, Homo sapiens
aggctggctgagctgcagcctg

SEQ ID NO: 7481427 - DNA, 22 bp, Homo sapiens
aggctggctgagctgcagcctg

SEQ ID NO: 7481428 - DNA, 22 bp, Homo sapiens
aggctggctgagctgcagcctg

SEQ ID NO: 7481429 - DNA, 22 bp, Homo sapiens
aggctggctgagctgcagcctg

SEQ ID NO: 7481430 - DNA, 22 bp, Homo sapiens
aggctggctgacttctgaagca

SEQ ID NO: 7481431 - DNA, 22 bp, Homo sapiens
aggctggctgacttctgaagca

SEQ ID NO: 7481432 - DNA, 22 bp, Homo sapiens
aggctggctgacttctgaagca

SEQ ID NO: 7481433 - DNA, 22 bp, Homo sapiens
aggctggctgacttctgaagca

SEQ ID NO: 7481434 - DNA, 22 bp, Homo sapiens
aggcttctgctgtattaacact

SEQ ID NO: 7481435 - DNA, 22 bp, Homo sapiens
aggcttctgctgtattaacact

SEQ ID NO: 7481436 - DNA, 22 bp, Homo sapiens
aggcttctggaatccagtttct

SEQ ID NO: 7481437 - DNA, 22 bp, Homo sapiens
aggcttctgggattcccttggt

SEQ ID NO: 7481438 - DNA, 22 bp, Homo sapiens
aggcttctgggattcccttggt

SEQ ID NO: 7481439 - DNA, 22 bp, Homo sapiens
aggcttctgtctttaggagttg

SEQ ID NO: 7481440 - DNA, 22 bp, Homo sapiens
aggcttctctgcaagatgttaa

SEQ ID NO: 7481441 - DNA, 22 bp, Homo sapiens
aggcttctctgcaagatgttaa

SEQ ID NO: 7481442 - DNA, 22 bp, Homo sapiens
aggcttctctccttggcttgca

SEQ ID NO: 7481443 - DNA, 22 bp, Homo sapiens
aggcttctctccttggcttgca

SEQ ID NO: 7481444 - DNA, 22 bp, Homo sapiens
aggcttctgagcatggagtttt

SEQ ID NO: 7481445 - DNA, 22 bp, Homo sapiens
aggcttctgataccatgagaga

SEQ ID NO: 7481446 - DNA, 22 bp, Homo sapiens
aggcttctgataccatgagaga

SEQ ID NO: 7481447 - DNA, 22 bp, Homo sapiens
aggcttctctgcaagatgttaa

SEQ ID NO: 7481448 - DNA, 22 bp, Homo sapiens
aggcttctgctgatatttcatt

SEQ ID NO: 7481449 - DNA, 22 bp, Homo sapiens
aggcttctgataccatgagaga

SEQ ID NO: 7481450 - DNA, 22 bp, Homo sapiens
aggcttctacgtggtcccaggg

SEQ ID NO: 7481451 - DNA, 22 bp, Homo sapiens
aggcttctacgtggtcccaggg

SEQ ID NO: 7481452 - DNA, 19 bp, Homo sapiens
aggcttctaccctgtccag

SEQ ID NO: 7481453 - DNA, 22 bp, Homo sapiens
aggcttctacgtggtcccaggg

SEQ ID NO: 7481454 - DNA, 22 bp, Homo sapiens
aggcttctaggaaactttctgg

SEQ ID NO: 7481455 - DNA, 22 bp, Homo sapiens
aggcttctaggaaactttctgg

SEQ ID NO: 7481456 - DNA, 21 bp, Homo sapiens
aggcttctccgtgcaggaaga

SEQ ID NO: 7481457 - DNA, 21 bp, Homo sapiens
aggcttctccgtgcaggaaga

SEQ ID NO: 7481458 - DNA, 22 bp, Homo sapiens
aggcttctccacataaagttac

SEQ ID NO: 7481459 - DNA, 21 bp, Homo sapiens
aggcttctccgtgcaggaaga

SEQ ID NO: 7481460 - DNA, 22 bp, Homo sapiens
aggcttctccttcctaccttcc

SEQ ID NO: 7481461 - DNA, 22 bp, Homo sapiens
aggcttctagggttggcagcgg

SEQ ID NO: 7481462 - DNA, 22 bp, Homo sapiens
aggcttctagggttggcagcgg

SEQ ID NO: 7481463 - DNA, 22 bp, Homo sapiens
aggcttggaggttctgtagcca

SEQ ID NO: 7481464 - DNA, 21 bp, Homo sapiens
aggcttggatagatattcata

SEQ ID NO: 7481465 - DNA, 21 bp, Homo sapiens
aggcttggatagatattcata

SEQ ID NO: 7481466 - DNA, 21 bp, Homo sapiens
aggcttggatctagacaggcc

SEQ ID NO: 7481467 - DNA, 21 bp, Homo sapiens
aggcttggatctagacaggcc

SEQ ID NO: 7481468 - DNA, 22 bp, Homo sapiens
aggcttggaagtggcagaactg

SEQ ID NO: 7481469 - DNA, 22 bp, Homo sapiens
aggcttggaagtggcagaactg

SEQ ID NO: 7481470 - DNA, 22 bp, Homo sapiens
aggcttggaagtggcagaactg

SEQ ID NO: 7481471 - DNA, 22 bp, Homo sapiens
aggcttggaggttctgtagcca

SEQ ID NO: 7481472 - DNA, 22 bp, Homo sapiens
aggcttggaggttctgtagcca

SEQ ID NO: 7481473 - DNA, 22 bp, Homo sapiens
aggcttggaggttctgtagcca

SEQ ID NO: 7481474 - DNA, 19 bp, Homo sapiens
aggcttggattgtggccaa

SEQ ID NO: 7481475 - DNA, 21 bp, Homo sapiens
aggcttggatctagacaggcc

SEQ ID NO: 7481476 - DNA, 21 bp, Homo sapiens
aggcttggatctagacaggcc

SEQ ID NO: 7481477 - DNA, 21 bp, Homo sapiens
aggcttggatctagacaggcc

SEQ ID NO: 7481478 - DNA, 21 bp, Homo sapiens
aggcttggatctagacaggcc

SEQ ID NO: 7481479 - DNA, 21 bp, Homo sapiens
aggcttggatctagacaggcc

SEQ ID NO: 7481480 - DNA, 21 bp, Homo sapiens
aggcttggataggttatgtga

SEQ ID NO: 7481481 - DNA, 21 bp, Homo sapiens
aggcttggataggttatgtga

SEQ ID NO: 7481482 - DNA, 21 bp, Homo sapiens
aggcttggatctagacaggcc

SEQ ID NO: 7481483 - DNA, 21 bp, Homo sapiens
aggcttggatctagacaggcc

SEQ ID NO: 7481484 - DNA, 21 bp, Homo sapiens
aggcttggatctagacaggcc

SEQ ID NO: 7481485 - DNA, 22 bp, Homo sapiens
cccaggagttcgaggctgtagt

SEQ ID NO: 7481486 - DNA, 22 bp, Homo sapiens
cccaggaggtggagcttgcagt

SEQ ID NO: 7481487 - DNA, 22 bp, Homo sapiens
cccaggagttggaggctacggt

SEQ ID NO: 7481488 - DNA, 22 bp, Homo sapiens
cccaggaggtggaggctgcagt

SEQ ID NO: 7481489 - DNA, 22 bp, Homo sapiens
cccaggaggtggagcttgcagt

SEQ ID NO: 7481490 - DNA, 19 bp, Homo sapiens
aggcttggattgtggccaa

SEQ ID NO: 7481491 - DNA, 19 bp, Homo sapiens
aggcttggattgtggccaa

SEQ ID NO: 7481492 - DNA, 19 bp, Homo sapiens
aggcttggattgtggccaa

SEQ ID NO: 7481493 - DNA, 22 bp, Homo sapiens
cccaggaggtggagcttgcagt

SEQ ID NO: 7481494 - DNA, 22 bp, Homo sapiens
cccaggaggtggagcttgcagt

SEQ ID NO: 7481495 - DNA, 22 bp, Homo sapiens
cccaggagttggaggctacggt

SEQ ID NO: 7481496 - DNA, 22 bp, Homo sapiens
cccaggagttggaggctacggt

SEQ ID NO: 7481497 - DNA, 22 bp, Homo sapiens
cccaggagttggaggctacggt

SEQ ID NO: 7481498 - DNA, 22 bp, Homo sapiens
cccaggagttggaggctacggt

SEQ ID NO: 7481499 - DNA, 22 bp, Homo sapiens
cccaggagttggaggctacggt

SEQ ID NO: 7481500 - DNA, 22 bp, Homo sapiens
cccaggagttggaggctacggt

SEQ ID NO: 7481501 - DNA, 22 bp, Homo sapiens
cccaggagttggaggctacggt

SEQ ID NO: 7481502 - DNA, 22 bp, Homo sapiens
cccaggagttggaggctacggt

SEQ ID NO: 7481503 - DNA, 22 bp, Homo sapiens
cccaggagttggaggctacggt

SEQ ID NO: 7481504 - DNA, 22 bp, Homo sapiens
cccaggagttggaggctacggt

SEQ ID NO: 7481505 - DNA, 22 bp, Homo sapiens
cccaggagttggaggctgcagt

SEQ ID NO: 7481506 - DNA, 22 bp, Homo sapiens
cccaggagttggaggctgcagt

SEQ ID NO: 7481507 - DNA, 22 bp, Homo sapiens
aggcttctgtttcttaaaggtg

SEQ ID NO: 7481508 - DNA, 22 bp, Homo sapiens
aggcttctgtttcttaaaggtg

SEQ ID NO: 7481509 - DNA, 22 bp, Homo sapiens
aggcttctgtttcttaaaggtg

SEQ ID NO: 7481510 - DNA, 22 bp, Homo sapiens
aggcttcttagattggctggag

SEQ ID NO: 7481511 - DNA, 22 bp, Homo sapiens
aggcttcttagattggctggag

SEQ ID NO: 7481512 - DNA, 22 bp, Homo sapiens
aggcttcttagattggctggag

SEQ ID NO: 7481513 - DNA, 22 bp, Homo sapiens
aggcttcttcttcctatttagt

SEQ ID NO: 7481514 - DNA, 22 bp, Homo sapiens
aggcttcttcttcctatttagt

SEQ ID NO: 7481515 - DNA, 22 bp, Homo sapiens
aggcttcttctgcctgtctttg

SEQ ID NO: 7481516 - DNA, 22 bp, Homo sapiens
aggcttcttctctatgtacaag

SEQ ID NO: 7481517 - DNA, 22 bp, Homo sapiens
aggcttcttgataaaatgcaga

SEQ ID NO: 7481518 - DNA, 22 bp, Homo sapiens
aggcttcttgataaaatgcaga

SEQ ID NO: 7481519 - DNA, 22 bp, Homo sapiens
aggcttcttgataaaatgcaga

SEQ ID NO: 7481520 - DNA, 22 bp, Homo sapiens
aggcttcttgcttccaaatgca

SEQ ID NO: 7481521 - DNA, 22 bp, Homo sapiens
aggcttcttgcttccaaatgca

SEQ ID NO: 7481522 - DNA, 22 bp, Homo sapiens
aggcttcttgcttccaaatgca

SEQ ID NO: 7481523 - DNA, 18 bp, Homo sapiens
aggcttcttggctcagtc

SEQ ID NO: 7481524 - DNA, 22 bp, Homo sapiens
aggcttcttgagccccacaggc

SEQ ID NO: 7481525 - DNA, 22 bp, Homo sapiens
aggcttcttgagccccacaggc

SEQ ID NO: 7481526 - DNA, 22 bp, Homo sapiens
aggcttcttgagccccacaggc

SEQ ID NO: 7481527 - DNA, 19 bp, Homo sapiens
aggcttggaacagccttat

SEQ ID NO: 7481528 - DNA, 22 bp, Homo sapiens
aggcttgcagaatttatgtaat

SEQ ID NO: 7481529 - DNA, 22 bp, Homo sapiens
aggcttggaaaatttacagtgt

SEQ ID NO: 7481530 - DNA, 19 bp, Homo sapiens
aggcttggaacagccttat

SEQ ID NO: 7481531 - DNA, 19 bp, Homo sapiens
aggcttggaacagccttat

SEQ ID NO: 7481532 - DNA, 19 bp, Homo sapiens
aggcttggaacagccttat

SEQ ID NO: 7481533 - DNA, 19 bp, Homo sapiens
aggcttggaacagccttat

SEQ ID NO: 7481534 - DNA, 22 bp, Homo sapiens
aggcttgcaatggacacatgtg

SEQ ID NO: 7481535 - DNA, 22 bp, Homo sapiens
aggcttgcaatggacacatgtg

SEQ ID NO: 7481536 - DNA, 22 bp, Homo sapiens
aggcttgcacatgcacgcacgt

SEQ ID NO: 7481537 - DNA, 22 bp, Homo sapiens
aggcttgactgctgattttgcc

SEQ ID NO: 7481538 - DNA, 22 bp, Homo sapiens
aggcttgactgctgattttgcc

SEQ ID NO: 7481539 - DNA, 22 bp, Homo sapiens
aggcttgcagtgaatatgacca

SEQ ID NO: 7481540 - DNA, 22 bp, Homo sapiens
aggcttgcattttattttcagt

SEQ ID NO: 7481541 - DNA, 22 bp, Homo sapiens
aggcttgccacttgttagtcta

SEQ ID NO: 7481542 - DNA, 22 bp, Homo sapiens
aggcttggaaaatttacagtgt

SEQ ID NO: 7481543 - DNA, 22 bp, Homo sapiens
aggcttggaaaatttacagtgt

SEQ ID NO: 7481544 - DNA, 22 bp, Homo sapiens
aggcttggaaaatttacagtgt

SEQ ID NO: 7481545 - DNA, 22 bp, Homo sapiens
aggcttgacaattttacatgta

SEQ ID NO: 7481546 - DNA, 22 bp, Homo sapiens
aggcttgacaattttacatgta

SEQ ID NO: 7481547 - DNA, 22 bp, Homo sapiens
aggcttgactgctgattttgcc

SEQ ID NO: 7481548 - DNA, 22 bp, Homo sapiens
aggcttgaaatgaaatctgtaa

SEQ ID NO: 7481549 - DNA, 22 bp, Homo sapiens
aggcttcttttagaggggatgg

SEQ ID NO: 7481550 - DNA, 22 bp, Homo sapiens
aggcttcttgggcttcattctg

SEQ ID NO: 7481551 - DNA, 22 bp, Homo sapiens
aggcttcttgggcttcattctg

SEQ ID NO: 7481552 - DNA, 22 bp, Homo sapiens
aggcttcttttagaggggatgg

SEQ ID NO: 7481553 - DNA, 22 bp, Homo sapiens
aggcttcttttagaggggatgg

SEQ ID NO: 7481554 - DNA, 22 bp, Homo sapiens
agggatgctgctaagtggtcta

SEQ ID NO: 7481555 - DNA, 22 bp, Homo sapiens
agggatgctttgctgacagatt

SEQ ID NO: 7481556 - DNA, 22 bp, Homo sapiens
agggatggaagacttgaagacc

SEQ ID NO: 7481557 - DNA, 22 bp, Homo sapiens
agggatggaagacttgaagacc

SEQ ID NO: 7481558 - DNA, 22 bp, Homo sapiens
agggatggaagacttgaagacc

SEQ ID NO: 7481559 - DNA, 22 bp, Homo sapiens
agggatggaagacttgaagacc

SEQ ID NO: 7481560 - DNA, 22 bp, Homo sapiens
agggatggaagacttgaagacc

SEQ ID NO: 7481561 - DNA, 22 bp, Homo sapiens
agggatggaagacttgaagacc

SEQ ID NO: 7481562 - DNA, 22 bp, Homo sapiens
agggatggaagctcgtctgcaa

SEQ ID NO: 7481563 - DNA, 22 bp, Homo sapiens
agggatggaagctcgtctgcaa

SEQ ID NO: 7481564 - DNA, 22 bp, Homo sapiens
agggatgctgctaagtggtcta

SEQ ID NO: 7481565 - DNA, 22 bp, Homo sapiens
agggatgatttcagtgtctgcc

SEQ ID NO: 7481566 - DNA, 22 bp, Homo sapiens
agggatgatttcagtgtctgcc

SEQ ID NO: 7481567 - DNA, 22 bp, Homo sapiens
agggatgatttcagtgtctgcc

SEQ ID NO: 7481568 - DNA, 22 bp, Homo sapiens
agggatgatggaaagaagcagg

SEQ ID NO: 7481569 - DNA, 22 bp, Homo sapiens
agggatgatggaaagaagcagg

SEQ ID NO: 7481570 - DNA, 22 bp, Homo sapiens
agggatgatggaaagaagcagg

SEQ ID NO: 7481571 - DNA, 22 bp, Homo sapiens
agggatgatttcagtgtctgcc

SEQ ID NO: 7481572 - DNA, 22 bp, Homo sapiens
agggatgatggaaagaagcagg

SEQ ID NO: 7481573 - DNA, 22 bp, Homo sapiens
agggatggatcttggccctgga

SEQ ID NO: 7481574 - DNA, 22 bp, Homo sapiens
agggatggatcttggccctgga

SEQ ID NO: 7481575 - DNA, 22 bp, Homo sapiens
agggatggatcttggccctgga

SEQ ID NO: 7481576 - DNA, 22 bp, Homo sapiens
agggatggatcttggccctgga

SEQ ID NO: 7481577 - DNA, 22 bp, Homo sapiens
agggatggatcttggccctgga

SEQ ID NO: 7481578 - DNA, 22 bp, Homo sapiens
agggatggatcttggccctgga

SEQ ID NO: 7481579 - DNA, 22 bp, Homo sapiens
agggatggagtgcggcccggac

SEQ ID NO: 7481580 - DNA, 22 bp, Homo sapiens
agggatggagtgcggcccggac

SEQ ID NO: 7481581 - DNA, 22 bp, Homo sapiens
agggatggagtgcggcccggac

SEQ ID NO: 7481582 - DNA, 22 bp, Homo sapiens
agggatggagcccagctgttct

SEQ ID NO: 7481583 - DNA, 22 bp, Homo sapiens
agggatggatcttggccctgga

SEQ ID NO: 7481584 - DNA, 22 bp, Homo sapiens
agggatggatcttggccctgga

SEQ ID NO: 7481585 - DNA, 22 bp, Homo sapiens
agggatggatcttggccctgga

SEQ ID NO: 7481586 - DNA, 22 bp, Homo sapiens
agggatggatcttggccctgga

SEQ ID NO: 7481587 - DNA, 22 bp, Homo sapiens
agggatggagcccagctgttct

SEQ ID NO: 7481588 - DNA, 22 bp, Homo sapiens
agggatggagcccagctgttct

SEQ ID NO: 7481589 - DNA, 22 bp, Homo sapiens
agggatggagcccagctgttct

SEQ ID NO: 7481590 - DNA, 22 bp, Homo sapiens
agggatggaagctcgtctgcaa

SEQ ID NO: 7481591 - DNA, 22 bp, Homo sapiens
agggatggaagctcgtctgcaa

SEQ ID NO: 7481592 - DNA, 22 bp, Homo sapiens
agggatggagtgcggcccggac

SEQ ID NO: 7481593 - DNA, 22 bp, Homo sapiens
agggatggagtgcggcccggac

SEQ ID NO: 7481594 - DNA, 22 bp, Homo sapiens
agggatggagtgcggcccggac

SEQ ID NO: 7481595 - DNA, 22 bp, Homo sapiens
agggatggagcccagctgttct

SEQ ID NO: 7481596 - DNA, 22 bp, Homo sapiens
agggatggagtgcggcccggac

SEQ ID NO: 7481597 - DNA, 22 bp, Homo sapiens
agggatggagtgcggcccggac

SEQ ID NO: 7481598 - DNA, 22 bp, Homo sapiens
agggatggagtgcggcccggac

SEQ ID NO: 7481599 - DNA, 22 bp, Homo sapiens
agggatcagtagggacggcagc

SEQ ID NO: 7481600 - DNA, 22 bp, Homo sapiens
agggatcacggtggacttggat

SEQ ID NO: 7481601 - DNA, 22 bp, Homo sapiens
agggatcagcagagggtgtggt

SEQ ID NO: 7481602 - DNA, 18 bp, Homo sapiens
agggatcatcactgcagc

SEQ ID NO: 7481603 - DNA, 22 bp, Homo sapiens
agggatcatcctgcaagtgcct

SEQ ID NO: 7481604 - DNA, 18 bp, Homo sapiens
agggatctagatggagtc

SEQ ID NO: 7481605 - DNA, 22 bp, Homo sapiens
agggatgatcagggtagaggct

SEQ ID NO: 7481606 - DNA, 22 bp, Homo sapiens
agggatgatcagggtagaggct

SEQ ID NO: 7481607 - DNA, 22 bp, Homo sapiens
agggatgatcagggtagaggct

SEQ ID NO: 7481608 - DNA, 22 bp, Homo sapiens
agggatgatcagggtagaggct

SEQ ID NO: 7481609 - DNA, 22 bp, Homo sapiens
agggatgactcttggctgattc

SEQ ID NO: 7481610 - DNA, 22 bp, Homo sapiens
agggatgactcttggctgattc

SEQ ID NO: 7481611 - DNA, 22 bp, Homo sapiens
agggatgactcttggctgattc

SEQ ID NO: 7481612 - DNA, 22 bp, Homo sapiens
agggatgactcttggctgattc

SEQ ID NO: 7481613 - DNA, 22 bp, Homo sapiens
agggagtgttacataatgggtt

SEQ ID NO: 7481614 - DNA, 22 bp, Homo sapiens
agggagtgttacataatgggtt

SEQ ID NO: 7481615 - DNA, 22 bp, Homo sapiens
agggagtgttatattccatcag

SEQ ID NO: 7481616 - DNA, 22 bp, Homo sapiens
agggagtgttatattccatcag

SEQ ID NO: 7481617 - DNA, 22 bp, Homo sapiens
agggagtgtaaatggtgctcag

SEQ ID NO: 7481618 - DNA, 22 bp, Homo sapiens
agggagtgtaaatggtgctcag

SEQ ID NO: 7481619 - DNA, 22 bp, Homo sapiens
agggagtgtaaatggtgctcag

SEQ ID NO: 7481620 - DNA, 22 bp, Homo sapiens
agggagtgtaaatggtgctcag

SEQ ID NO: 7481621 - DNA, 22 bp, Homo sapiens
agggagtgtaaatggtgctcag

SEQ ID NO: 7481622 - DNA, 18 bp, Homo sapiens
agggagttttagggaagg

SEQ ID NO: 7481623 - DNA, 18 bp, Homo sapiens
agggagttttagggaagg

SEQ ID NO: 7481624 - DNA, 19 bp, Homo sapiens
agggatatttaaaaagctc

SEQ ID NO: 7481625 - DNA, 22 bp, Homo sapiens
agggatcacggtggacttggat

SEQ ID NO: 7481626 - DNA, 22 bp, Homo sapiens
agggatcaaaaaatgtacatgc

SEQ ID NO: 7481627 - DNA, 22 bp, Homo sapiens
agggagaaaattggatgcacaa

SEQ ID NO: 7481628 - DNA, 22 bp, Homo sapiens
agggagaaaattggatgcacaa

SEQ ID NO: 7481629 - DNA, 22 bp, Homo sapiens
agggagaaaattggatgcacaa

SEQ ID NO: 7481630 - DNA, 22 bp, Homo sapiens
agggagaaaattggatgcacaa

SEQ ID NO: 7481631 - DNA, 22 bp, Homo sapiens
agggagaaaattggatgcacaa

SEQ ID NO: 7481632 - DNA, 22 bp, Homo sapiens
agggagaaaattggatgcacaa

SEQ ID NO: 7481633 - DNA, 22 bp, Homo sapiens
agggagaaaattggatgcacaa

SEQ ID NO: 7481634 - DNA, 22 bp, Homo sapiens
agggagaacagttgcagcagac

SEQ ID NO: 7481635 - DNA, 22 bp, Homo sapiens
agggagaacagttgcagcagac

SEQ ID NO: 7481636 - DNA, 22 bp, Homo sapiens
agggagaaaattggatgcacaa

SEQ ID NO: 7481637 - DNA, 22 bp, Homo sapiens
agggagaaaattggatgcacaa

SEQ ID NO: 7481638 - DNA, 22 bp, Homo sapiens
agggagaaaattggatgcacaa

SEQ ID NO: 7481639 - DNA, 22 bp, Homo sapiens
agggagaacagttgcagcagac

SEQ ID NO: 7481640 - DNA, 22 bp, Homo sapiens
agggagaacagttgcagcagac

SEQ ID NO: 7481641 - DNA, 22 bp, Homo sapiens
agggagaacagttgcagcagac

SEQ ID NO: 7481642 - DNA, 22 bp, Homo sapiens
agggagaacagttgcagcagac

SEQ ID NO: 7481643 - DNA, 22 bp, Homo sapiens
agggagaacagttgcagcagac

SEQ ID NO: 7481644 - DNA, 22 bp, Homo sapiens
agggagaagagaacaaagccct

SEQ ID NO: 7481645 - DNA, 22 bp, Homo sapiens
agggagaacagttgcagcagac

SEQ ID NO: 7481646 - DNA, 22 bp, Homo sapiens
agggagaacagttgcagcagac

SEQ ID NO: 7481647 - DNA, 22 bp, Homo sapiens
agggagaagagaacaaagccct

SEQ ID NO: 7481648 - DNA, 22 bp, Homo sapiens
agggagaagagaacaaagccct

SEQ ID NO: 7481649 - DNA, 22 bp, Homo sapiens
agggactcggttgagtgcccct

SEQ ID NO: 7481650 - DNA, 22 bp, Homo sapiens
agggactgagctaggatctagt

SEQ ID NO: 7481651 - DNA, 22 bp, Homo sapiens
agggactgagctaggatctagt

SEQ ID NO: 7481652 - DNA, 22 bp, Homo sapiens
agggactgagctaggatctagt

SEQ ID NO: 7481653 - DNA, 22 bp, Homo sapiens
agggactcctctgctcggctgc

SEQ ID NO: 7481654 - DNA, 22 bp, Homo sapiens
agggactcctctgctcggctgc

SEQ ID NO: 7481655 - DNA, 22 bp, Homo sapiens
cccaggggtatccatggagaag

SEQ ID NO: 7481656 - DNA, 22 bp, Homo sapiens
cccaggggtatccatggagaag

SEQ ID NO: 7481657 - DNA, 22 bp, Homo sapiens
agggactggctctctgagcagg

SEQ ID NO: 7481658 - DNA, 22 bp, Homo sapiens
agggactggctctctgagcagg

SEQ ID NO: 7481659 - DNA, 22 bp, Homo sapiens
agggactggctctctgagcagg

SEQ ID NO: 7481660 - DNA, 22 bp, Homo sapiens
agggactggctctctgagcagg

SEQ ID NO: 7481661 - DNA, 22 bp, Homo sapiens
agggactggctctctgagcagg

SEQ ID NO: 7481662 - DNA, 22 bp, Homo sapiens
agggactggctctctgagcagg

SEQ ID NO: 7481663 - DNA, 22 bp, Homo sapiens
agggagaaaattggatgcacaa

SEQ ID NO: 7481664 - DNA, 22 bp, Homo sapiens
agggacttgatgtcagggagat

SEQ ID NO: 7481665 - DNA, 22 bp, Homo sapiens
agggacttgatgtcagggagat

SEQ ID NO: 7481666 - DNA, 22 bp, Homo sapiens
agggagaaggtttagctgtgag

SEQ ID NO: 7481667 - DNA, 22 bp, Homo sapiens
agggagaaggtttagctgtgag

SEQ ID NO: 7481668 - DNA, 22 bp, Homo sapiens
agggaggagtcctcaaagtcat

SEQ ID NO: 7481669 - DNA, 22 bp, Homo sapiens
agggagaaggtttagctgtgag

SEQ ID NO: 7481670 - DNA, 17 bp, Homo sapiens
agggagtcagaggatcg

SEQ ID NO: 7481671 - DNA, 17 bp, Homo sapiens
agggagtcagaggatcg

SEQ ID NO: 7481672 - DNA, 17 bp, Homo sapiens
agggagtcagaggatcg

SEQ ID NO: 7481673 - DNA, 17 bp, Homo sapiens
agggagtcagaggatcg

SEQ ID NO: 7481674 - DNA, 22 bp, Homo sapiens
agggaggagtcctcaaagtcat

SEQ ID NO: 7481675 - DNA, 22 bp, Homo sapiens
agggaggagtcctcaaagtcat

SEQ ID NO: 7481676 - DNA, 22 bp, Homo sapiens
agggaggagtcctcaaagtcat

SEQ ID NO: 7481677 - DNA, 22 bp, Homo sapiens
agggagaaggtccatgcctgtc

SEQ ID NO: 7481678 - DNA, 22 bp, Homo sapiens
agggagaaggtccatgcctgtc

SEQ ID NO: 7481679 - DNA, 22 bp, Homo sapiens
agggagaaggtccatgcctgtc

SEQ ID NO: 7481680 - DNA, 22 bp, Homo sapiens
agggagaaggtccatgcctgtc

SEQ ID NO: 7481681 - DNA, 22 bp, Homo sapiens
agggagaaggtttagctgtgag

SEQ ID NO: 7481682 - DNA, 22 bp, Homo sapiens
agggagaaggtttagctgtgag

SEQ ID NO: 7481683 - DNA, 22 bp, Homo sapiens
agggagaaggtccatgcctgtc

SEQ ID NO: 7481684 - DNA, 22 bp, Homo sapiens
agggagaaggtccatgcctgtc

SEQ ID NO: 7481685 - DNA, 22 bp, Homo sapiens
agggagaagagaacaaagccct

SEQ ID NO: 7481686 - DNA, 22 bp, Homo sapiens
agggagaagagaacaaagccct

SEQ ID NO: 7481687 - DNA, 22 bp, Homo sapiens
agggagaagagaacaaagccct

SEQ ID NO: 7481688 - DNA, 22 bp, Homo sapiens
agggagaagagaacaaagccct

SEQ ID NO: 7481689 - DNA, 21 bp, Homo sapiens
agggagtctggaggaagcgtt

SEQ ID NO: 7481690 - DNA, 21 bp, Homo sapiens
agggagtctggaggaagcgtt

SEQ ID NO: 7481691 - DNA, 21 bp, Homo sapiens
agggagtctggaggaagcgtt

SEQ ID NO: 7481692 - DNA, 22 bp, Homo sapiens
agggagtctagttgatgtggaa

SEQ ID NO: 7481693 - DNA, 17 bp, Homo sapiens
agggagtcagaggatcg

SEQ ID NO: 7481694 - DNA, 22 bp, Homo sapiens
agggagtccattttagaggtgg

SEQ ID NO: 7481695 - DNA, 22 bp, Homo sapiens
agggagtccattttagaggtgg

SEQ ID NO: 7481696 - DNA, 22 bp, Homo sapiens
agggagtccattttagaggtgg

SEQ ID NO: 7481697 - DNA, 22 bp, Homo sapiens
agggagtcatatatacctgcat

SEQ ID NO: 7481698 - DNA, 22 bp, Homo sapiens
agggagtccattttagaggtgg

SEQ ID NO: 7481699 - DNA, 17 bp, Homo sapiens
agggagtcagtaggagc

SEQ ID NO: 7481700 - DNA, 17 bp, Homo sapiens
agggagtcagtaggagc

SEQ ID NO: 7481701 - DNA, 17 bp, Homo sapiens
agggagtcagtaggagc

SEQ ID NO: 7481702 - DNA, 17 bp, Homo sapiens
agggagtcagtaggagc

SEQ ID NO: 7481703 - DNA, 17 bp, Homo sapiens
agggagtcagaggatcg

SEQ ID NO: 7481704 - DNA, 17 bp, Homo sapiens
agggagtcagtaggagc

SEQ ID NO: 7481705 - DNA, 17 bp, Homo sapiens
agggagtcagtaggagc

SEQ ID NO: 7481706 - DNA, 17 bp, Homo sapiens
agggagtcagtaggagc

SEQ ID NO: 7481707 - DNA, 22 bp, Homo sapiens
agggagtcatatatacctgcat

SEQ ID NO: 7481708 - DNA, 22 bp, Homo sapiens
agggagtggttaagaaggtgca

SEQ ID NO: 7481709 - DNA, 22 bp, Homo sapiens
agggagtggttaagaaggtgca

SEQ ID NO: 7481710 - DNA, 22 bp, Homo sapiens
agggagtggttaagaaggtgca

SEQ ID NO: 7481711 - DNA, 22 bp, Homo sapiens
agggagtggttaagaaggtgca

SEQ ID NO: 7481712 - DNA, 22 bp, Homo sapiens
agggagtggttaagaaggtgca

SEQ ID NO: 7481713 - DNA, 22 bp, Homo sapiens
agggagtctggtagtctaagtg

SEQ ID NO: 7481714 - DNA, 22 bp, Homo sapiens
agggagtctggcagtctaagag

SEQ ID NO: 7481715 - DNA, 22 bp, Homo sapiens
agggagtctagttgatgtggaa

SEQ ID NO: 7481716 - DNA, 22 bp, Homo sapiens
agggagtggttaagaaggtgca

SEQ ID NO: 7481717 - DNA, 22 bp, Homo sapiens
agggagtggttaagaaggtgca

SEQ ID NO: 7481718 - DNA, 22 bp, Homo sapiens
agggcagagacatgcttcctga

SEQ ID NO: 7481719 - DNA, 22 bp, Homo sapiens
agggcagagacatgcttcctga

SEQ ID NO: 7481720 - DNA, 22 bp, Homo sapiens
agggcagagacatgcttcctga

SEQ ID NO: 7481721 - DNA, 22 bp, Homo sapiens
agggcagagacatgcttcctga

SEQ ID NO: 7481722 - DNA, 22 bp, Homo sapiens
agggcagagagatgaatgggat

SEQ ID NO: 7481723 - DNA, 22 bp, Homo sapiens
agggcagagaaatgtagttgag

SEQ ID NO: 7481724 - DNA, 19 bp, Homo sapiens
ccctcttgcacaaagcaaa

SEQ ID NO: 7481725 - DNA, 18 bp, Homo sapiens
ccctcttgcacaaagcaa

SEQ ID NO: 7481726 - DNA, 22 bp, Homo sapiens
agggcagagagatgaatgggat

SEQ ID NO: 7481727 - DNA, 22 bp, Homo sapiens
agggcagagagatgaatgggat

SEQ ID NO: 7481728 - DNA, 22 bp, Homo sapiens
agggcagagagatgaatgggat

SEQ ID NO: 7481729 - DNA, 22 bp, Homo sapiens
agggcagagatctgagtgggca

SEQ ID NO: 7481730 - DNA, 22 bp, Homo sapiens
agggcagagatctgagtgggca

SEQ ID NO: 7481731 - DNA, 22 bp, Homo sapiens
agggcagagacatgcttcctga

SEQ ID NO: 7481732 - DNA, 22 bp, Homo sapiens
agggcagagagatgaatgggat

SEQ ID NO: 7481733 - DNA, 22 bp, Homo sapiens
agggcagagagatgaatgggat

SEQ ID NO: 7481734 - DNA, 22 bp, Homo sapiens
agggcagagagatgaatgggat

SEQ ID NO: 7481735 - DNA, 22 bp, Homo sapiens
agggcagagagatgaatgggat

SEQ ID NO: 7481736 - DNA, 22 bp, Homo sapiens
agggcagagacatgcttcctga

SEQ ID NO: 7481737 - DNA, 22 bp, Homo sapiens
agggcagagagatgaatgggat

SEQ ID NO: 7481738 - DNA, 22 bp, Homo sapiens
agggcagagctgtctaaatggc

SEQ ID NO: 7481739 - DNA, 22 bp, Homo sapiens
agggcagagctgtctaaatggc

SEQ ID NO: 7481740 - DNA, 22 bp, Homo sapiens
agggcagagctgtctaaatggc

SEQ ID NO: 7481741 - DNA, 22 bp, Homo sapiens
agggcagagcactgaattggga

SEQ ID NO: 7481742 - DNA, 22 bp, Homo sapiens
agggcagagcactgaattggga

SEQ ID NO: 7481743 - DNA, 22 bp, Homo sapiens
agggcagagcactgaattggga

SEQ ID NO: 7481744 - DNA, 22 bp, Homo sapiens
agggcagagcactgaattggga

SEQ ID NO: 7481745 - DNA, 22 bp, Homo sapiens
agggcagagcactgaattggga

SEQ ID NO: 7481746 - DNA, 22 bp, Homo sapiens
agggcagagcactgaattggga

SEQ ID NO: 7481747 - DNA, 22 bp, Homo sapiens
agggcagagattaattaagaca

SEQ ID NO: 7481748 - DNA, 22 bp, Homo sapiens
agggcagagattaattaagaca

SEQ ID NO: 7481749 - DNA, 22 bp, Homo sapiens
agggcagagatctgagtgggca

SEQ ID NO: 7481750 - DNA, 22 bp, Homo sapiens
agggcagagatctgagtgggca

SEQ ID NO: 7481751 - DNA, 22 bp, Homo sapiens
agggcagagatctgagtgggca

SEQ ID NO: 7481752 - DNA, 22 bp, Homo sapiens
agggcagagatctgagtgggca

SEQ ID NO: 7481753 - DNA, 22 bp, Homo sapiens
agggcagagatctgagtgggca

SEQ ID NO: 7481754 - DNA, 22 bp, Homo sapiens
agggcagagatctgagtgggca

SEQ ID NO: 7481755 - DNA, 22 bp, Homo sapiens
agggcagagatctgagtgggca

SEQ ID NO: 7481756 - DNA, 22 bp, Homo sapiens
agggcagagattaattaagaca

SEQ ID NO: 7481757 - DNA, 22 bp, Homo sapiens
agggcagagattaattaagaca

SEQ ID NO: 7481758 - DNA, 22 bp, Homo sapiens
agggcagagatctgagtgggca

SEQ ID NO: 7481759 - DNA, 22 bp, Homo sapiens
agggcagagatctgagtgggca

SEQ ID NO: 7481760 - DNA, 22 bp, Homo sapiens
agggcagagatctgagtgggca

SEQ ID NO: 7481761 - DNA, 22 bp, Homo sapiens
ccctggaggagcttagagcttg

SEQ ID NO: 7481762 - DNA, 22 bp, Homo sapiens
ccctggaggagcttagagcttg

SEQ ID NO: 7481763 - DNA, 19 bp, Homo sapiens
ccctggaggagtgttggct

SEQ ID NO: 7481764 - DNA, 19 bp, Homo sapiens
ccctggaggagtgttggct

SEQ ID NO: 7481765 - DNA, 19 bp, Homo sapiens
ccctggaggagtgttggct

SEQ ID NO: 7481766 - DNA, 19 bp, Homo sapiens
ccctggaggagtgttggct

SEQ ID NO: 7481767 - DNA, 22 bp, Homo sapiens
ccctggaggagcttagagcttg

SEQ ID NO: 7481768 - DNA, 22 bp, Homo sapiens
ccctggaggaccccaatgtggc

SEQ ID NO: 7481769 - DNA, 20 bp, Homo sapiens
ccctggactcctgagcaaac

SEQ ID NO: 7481770 - DNA, 20 bp, Homo sapiens
ccctggactcctgagcaaac

SEQ ID NO: 7481771 - DNA, 20 bp, Homo sapiens
ccctggactcctgagcaaac

SEQ ID NO: 7481772 - DNA, 22 bp, Homo sapiens
ccctggacacacacttttattc

SEQ ID NO: 7481773 - DNA, 22 bp, Homo sapiens
ccctggacacacacttttattc

SEQ ID NO: 7481774 - DNA, 22 bp, Homo sapiens
ccctggacggggaatatgactt

SEQ ID NO: 7481775 - DNA, 22 bp, Homo sapiens
ccctggaggaccccaatgtggc

SEQ ID NO: 7481776 - DNA, 22 bp, Homo sapiens
ccctggaggaccccaatgtggc

SEQ ID NO: 7481777 - DNA, 22 bp, Homo sapiens
ccctggaggaccccaatgtggc

SEQ ID NO: 7481778 - DNA, 22 bp, Homo sapiens
agggcagaggcggacacggaag

SEQ ID NO: 7481779 - DNA, 20 bp, Homo sapiens
agggcagagggattacaggc

SEQ ID NO: 7481780 - DNA, 22 bp, Homo sapiens
agggcagaggcggacacggaag

SEQ ID NO: 7481781 - DNA, 22 bp, Homo sapiens
agggcagaggcggacacggaag

SEQ ID NO: 7481782 - DNA, 22 bp, Homo sapiens
agggcagaggcggacacggaag

SEQ ID NO: 7481783 - DNA, 22 bp, Homo sapiens
agggcagaggcggacacggaag

SEQ ID NO: 7481784 - DNA, 22 bp, Homo sapiens
agggcagagctgtctaaatggc

SEQ ID NO: 7481785 - DNA, 22 bp, Homo sapiens
agggcagagattaattaagaca

SEQ ID NO: 7481786 - DNA, 22 bp, Homo sapiens
agggcagaggcggacacggaag

SEQ ID NO: 7481787 - DNA, 22 bp, Homo sapiens
agggcagaggcggacacggaag

SEQ ID NO: 7481788 - DNA, 22 bp, Homo sapiens
agggcagaggcggacacggaag

SEQ ID NO: 7481789 - DNA, 20 bp, Homo sapiens
agggcagagggattacaggc

SEQ ID NO: 7481790 - DNA, 20 bp, Homo sapiens
agggcagagggattacaggc

SEQ ID NO: 7481791 - DNA, 20 bp, Homo sapiens
agggcagagggattacaggc

SEQ ID NO: 7481792 - DNA, 20 bp, Homo sapiens
agggcagagggattacaggc

SEQ ID NO: 7481793 - DNA, 22 bp, Homo sapiens
ccctggaaggagatgggacatg

SEQ ID NO: 7481794 - DNA, 22 bp, Homo sapiens
ccctggaaggagatgggacatg

SEQ ID NO: 7481795 - DNA, 22 bp, Homo sapiens
ccctggaaggttctctggctca

SEQ ID NO: 7481796 - DNA, 21 bp, Homo sapiens
ccctggaatcctgagtgccag

SEQ ID NO: 7481797 - DNA, 21 bp, Homo sapiens
ccctggaatcctgagtgccag

SEQ ID NO: 7481798 - DNA, 21 bp, Homo sapiens
ccctggaatcctgagtgccag

SEQ ID NO: 7481799 - DNA, 21 bp, Homo sapiens
ccctggaatcctgagtgccag

SEQ ID NO: 7481800 - DNA, 18 bp, Homo sapiens
ccctcttgcacaaagcaa

SEQ ID NO: 7481801 - DNA, 18 bp, Homo sapiens
ccctcttgcacaaagcaa

SEQ ID NO: 7481802 - DNA, 18 bp, Homo sapiens
ccctcttgcacaaagcaa

SEQ ID NO: 7481803 - DNA, 18 bp, Homo sapiens
ccctcttgcacaaagcaa

SEQ ID NO: 7481804 - DNA, 22 bp, Homo sapiens
ccctctggctgtgtgttcttag

SEQ ID NO: 7481805 - DNA, 22 bp, Homo sapiens
ccctctggctgtgtgttcttag

SEQ ID NO: 7481806 - DNA, 22 bp, Homo sapiens
ccctctggtttgcccttgggtg

SEQ ID NO: 7481807 - DNA, 22 bp, Homo sapiens
ccctctggtttgcccttgggtg

SEQ ID NO: 7481808 - DNA, 17 bp, Homo sapiens
ccctctggggagggagg

SEQ ID NO: 7481809 - DNA, 22 bp, Homo sapiens
ccctctggctcttctcaggccg

SEQ ID NO: 7481810 - DNA, 22 bp, Homo sapiens
ccctctggctgtgtgttcttag

SEQ ID NO: 7481811 - DNA, 22 bp, Homo sapiens
ccctctggctcttctcaggccg

SEQ ID NO: 7481812 - DNA, 22 bp, Homo sapiens
ccctctgctgcctggctgggtc

SEQ ID NO: 7481813 - DNA, 22 bp, Homo sapiens
ccctctgctgcctggctgggtc

SEQ ID NO: 7481814 - DNA, 22 bp, Homo sapiens
ccctctgctgcctggctgggtc

SEQ ID NO: 7481815 - DNA, 22 bp, Homo sapiens
ccctctggctcttctcaggccg

SEQ ID NO: 7481816 - DNA, 22 bp, Homo sapiens
ccctctggctcttctcaggccg

SEQ ID NO: 7481817 - DNA, 22 bp, Homo sapiens
ccctctggctcttctcaggccg

SEQ ID NO: 7481818 - DNA, 22 bp, Homo sapiens
ccctctgcctgggaccaagtcc

SEQ ID NO: 7481819 - DNA, 20 bp, Homo sapiens
ccctctgctacactgggagc

SEQ ID NO: 7481820 - DNA, 20 bp, Homo sapiens
ccctctgctacactgggagc

SEQ ID NO: 7481821 - DNA, 20 bp, Homo sapiens
ccctctgctacactgggagc

SEQ ID NO: 7481822 - DNA, 22 bp, Homo sapiens
ccctctgcctgggaccaagtcc

SEQ ID NO: 7481823 - DNA, 22 bp, Homo sapiens
ccctctgcctgggaccaagtcc

SEQ ID NO: 7481824 - DNA, 22 bp, Homo sapiens
ccctctgcctgcgccctggtgt

SEQ ID NO: 7481825 - DNA, 22 bp, Homo sapiens
ccctctgcctgcgccctggtgt

SEQ ID NO: 7481826 - DNA, 22 bp, Homo sapiens
ccctctgctcaggtgcataggc

SEQ ID NO: 7481827 - DNA, 22 bp, Homo sapiens
ccctctgctcaggtgcataggc

SEQ ID NO: 7481828 - DNA, 22 bp, Homo sapiens
ccctctgctcaggtgcataggc

SEQ ID NO: 7481829 - DNA, 22 bp, Homo sapiens
ccctctgctcaggtgcataggc

SEQ ID NO: 7481830 - DNA, 22 bp, Homo sapiens
ccctctgctcaggtgcataggc

SEQ ID NO: 7481831 - DNA, 22 bp, Homo sapiens
ccctctgcaggctggacctgcc

SEQ ID NO: 7481832 - DNA, 22 bp, Homo sapiens
ccctctgcaggctggacctgcc

SEQ ID NO: 7481833 - DNA, 22 bp, Homo sapiens
ccctctgcaggctggacctgcc

SEQ ID NO: 7481834 - DNA, 20 bp, Homo sapiens
ccctctgcacatggctgtgg

SEQ ID NO: 7481835 - DNA, 22 bp, Homo sapiens
ccctctgcctgcgccctggtgt

SEQ ID NO: 7481836 - DNA, 22 bp, Homo sapiens
ccctctgcctgcgccctggtgt

SEQ ID NO: 7481837 - DNA, 22 bp, Homo sapiens
ccctctgcctctgagtaggaca

SEQ ID NO: 7481838 - DNA, 22 bp, Homo sapiens
ccctctgcatacaggcgaggag

SEQ ID NO: 7481839 - DNA, 22 bp, Homo sapiens
ccctctctcggttgctgtggtt

SEQ ID NO: 7481840 - DNA, 22 bp, Homo sapiens
ccctctctcggttgctgtggtt

SEQ ID NO: 7481841 - DNA, 22 bp, Homo sapiens
ccctctctcggttgctgtggtt

SEQ ID NO: 7481842 - DNA, 22 bp, Homo sapiens
ccctctctgacttctgaacttg

SEQ ID NO: 7481843 - DNA, 22 bp, Homo sapiens
ccctctctctatcgggccccag

SEQ ID NO: 7481844 - DNA, 22 bp, Homo sapiens
ccctctctctatcgggccccag

SEQ ID NO: 7481845 - DNA, 22 bp, Homo sapiens
ccctctctgctgcatagaggaa

SEQ ID NO: 7481846 - DNA, 22 bp, Homo sapiens
ccctctctgctgcatagaggaa

SEQ ID NO: 7481847 - DNA, 22 bp, Homo sapiens
ccctctctgacttctgaacttg

SEQ ID NO: 7481848 - DNA, 22 bp, Homo sapiens
ccctctctgacttctgaacttg

SEQ ID NO: 7481849 - DNA, 22 bp, Homo sapiens
ccctctgaacctggtagcagaa

SEQ ID NO: 7481850 - DNA, 22 bp, Homo sapiens
ccctctcttagaagaaacacag

SEQ ID NO: 7481851 - DNA, 22 bp, Homo sapiens
ccctctcttagaagaaacacag

SEQ ID NO: 7481852 - DNA, 20 bp, Homo sapiens
ccctctgcacatggctgtgg

SEQ ID NO: 7481853 - DNA, 20 bp, Homo sapiens
ccctctgcacatggctgtgg

SEQ ID NO: 7481854 - DNA, 22 bp, Homo sapiens
ccctctgagacaggtagctcac

SEQ ID NO: 7481855 - DNA, 20 bp, Homo sapiens
ccctctgcacatggctgtgg

SEQ ID NO: 7481856 - DNA, 20 bp, Homo sapiens
ccctctgcacatggctgtgg

SEQ ID NO: 7481857 - DNA, 22 bp, Homo sapiens
ccctctgactgggccagttctg

SEQ ID NO: 7481858 - DNA, 22 bp, Homo sapiens
ccctccccacaaagcttcacac

SEQ ID NO: 7481859 - DNA, 22 bp, Homo sapiens
ccctccccacaaagcttcacac

SEQ ID NO: 7481860 - DNA, 22 bp, Homo sapiens
ccctctctcggttgctgtggtt

SEQ ID NO: 7481861 - DNA, 22 bp, Homo sapiens
ccctctctcggttgctgtggtt

SEQ ID NO: 7481862 - DNA, 22 bp, Homo sapiens
agggatgggtctaacccagaac

SEQ ID NO: 7481863 - DNA, 22 bp, Homo sapiens
ccctcccaggagtggccagaga

SEQ ID NO: 7481864 - DNA, 22 bp, Homo sapiens
ccctcccaggagtggccagaga

SEQ ID NO: 7481865 - DNA, 22 bp, Homo sapiens
agggatgggtctaacccagaac

SEQ ID NO: 7481866 - DNA, 22 bp, Homo sapiens
ccctcccaggagtggccagaga

SEQ ID NO: 7481867 - DNA, 22 bp, Homo sapiens
ccctcccaggagtggccagaga

SEQ ID NO: 7481868 - DNA, 22 bp, Homo sapiens
agggatggcaagttaacctgag

SEQ ID NO: 7481869 - DNA, 22 bp, Homo sapiens
agggatggcaagttaacctgag

SEQ ID NO: 7481870 - DNA, 22 bp, Homo sapiens
agggatggcaagttaacctgag

SEQ ID NO: 7481871 - DNA, 22 bp, Homo sapiens
agggatgggaactcctccagca

SEQ ID NO: 7481872 - DNA, 22 bp, Homo sapiens
agggatgggaactcctccagca

SEQ ID NO: 7481873 - DNA, 22 bp, Homo sapiens
agggatgggaactcctccagca

SEQ ID NO: 7481874 - DNA, 22 bp, Homo sapiens
agggatgggtctaacccagaac

SEQ ID NO: 7481875 - DNA, 22 bp, Homo sapiens
agggatgggtctaacccagaac

SEQ ID NO: 7481876 - DNA, 22 bp, Homo sapiens
agggatgggaactcctccagca

SEQ ID NO: 7481877 - DNA, 22 bp, Homo sapiens
agggatgggaactcctccagca

SEQ ID NO: 7481878 - DNA, 22 bp, Homo sapiens
agggatgggaactcctccagca

SEQ ID NO: 7481879 - DNA, 22 bp, Homo sapiens
cctcctgcacctccaggaactc

SEQ ID NO: 7481880 - DNA, 22 bp, Homo sapiens
cctcctgcacctccaggaactc

SEQ ID NO: 7481881 - DNA, 22 bp, Homo sapiens
cctcctgcacctccaggaactc

SEQ ID NO: 7481882 - DNA, 22 bp, Homo sapiens
cctcctgcacctccaggaactc

SEQ ID NO: 7481883 - DNA, 22 bp, Homo sapiens
cctcctgcactgcaagcttgag

SEQ ID NO: 7481884 - DNA, 22 bp, Homo sapiens
cctcctgcacctccaggaactc

SEQ ID NO: 7481885 - DNA, 22 bp, Homo sapiens
cctcctgcacctccaggaactc

SEQ ID NO: 7481886 - DNA, 22 bp, Homo sapiens
cctcctgcacttgctttccttc

SEQ ID NO: 7481887 - DNA, 22 bp, Homo sapiens
cctcctgcactgcaagcttgag

SEQ ID NO: 7481888 - DNA, 22 bp, Homo sapiens
cctcctgcacttgctttccttc

SEQ ID NO: 7481889 - DNA, 22 bp, Homo sapiens
cctcctgcacttgctttccttc

SEQ ID NO: 7481890 - DNA, 22 bp, Homo sapiens
cctcctgcggcgtccgcgctct

SEQ ID NO: 7481891 - DNA, 22 bp, Homo sapiens
cctcctgcggcgtccgcgctct

SEQ ID NO: 7481892 - DNA, 22 bp, Homo sapiens
cctcctgcggcgtccgcgctct

SEQ ID NO: 7481893 - DNA, 19 bp, Homo sapiens
cctcctgctagatatgcaa

SEQ ID NO: 7481894 - DNA, 19 bp, Homo sapiens
cctcctgctagatatgcaa

SEQ ID NO: 7481895 - DNA, 21 bp, Homo sapiens
cctcctgcccgcaagctaggg

SEQ ID NO: 7481896 - DNA, 22 bp, Homo sapiens
cctcctggagcattggtgagga

SEQ ID NO: 7481897 - DNA, 22 bp, Homo sapiens
cctcctggaaaaattccctggc

SEQ ID NO: 7481898 - DNA, 22 bp, Homo sapiens
cctcctggaaaaattccctggc

SEQ ID NO: 7481899 - DNA, 22 bp, Homo sapiens
cctcctggaaaaattccctggc

SEQ ID NO: 7481900 - DNA, 22 bp, Homo sapiens
cctcctggaaaaattccctggc

SEQ ID NO: 7481901 - DNA, 22 bp, Homo sapiens
cctcctggaaaaattccctggc

SEQ ID NO: 7481902 - DNA, 22 bp, Homo sapiens
cctcctggaaaaattccctggc

SEQ ID NO: 7481903 - DNA, 22 bp, Homo sapiens
cctcctggaggctctaagggag

SEQ ID NO: 7481904 - DNA, 22 bp, Homo sapiens
cctcctggaggctctaagggag

SEQ ID NO: 7481905 - DNA, 22 bp, Homo sapiens
cctcctggaggctctaagggag

SEQ ID NO: 7481906 - DNA, 22 bp, Homo sapiens
cctcctggagcattggtgagga

SEQ ID NO: 7481907 - DNA, 22 bp, Homo sapiens
cctcctggagcattggtgagga

SEQ ID NO: 7481908 - DNA, 18 bp, Homo sapiens
agggctgatgagtttggg

SEQ ID NO: 7481909 - DNA, 18 bp, Homo sapiens
agggctgatgagtttggg

SEQ ID NO: 7481910 - DNA, 22 bp, Homo sapiens
agggctgagtggtgcagtcaaa

SEQ ID NO: 7481911 - DNA, 18 bp, Homo sapiens
agggctgatgagtttggg

SEQ ID NO: 7481912 - DNA, 22 bp, Homo sapiens
agggctgatgcaccatgtagcc

SEQ ID NO: 7481913 - DNA, 22 bp, Homo sapiens
agggctgatgcaccatgtagcc

SEQ ID NO: 7481914 - DNA, 18 bp, Homo sapiens
agggctgatgagtttggg

SEQ ID NO: 7481915 - DNA, 22 bp, Homo sapiens
agggctgatgcaccatgtagcc

SEQ ID NO: 7481916 - DNA, 22 bp, Homo sapiens
agggctgatgcaccatgtagcc

SEQ ID NO: 7481917 - DNA, 22 bp, Homo sapiens
agggctgatgcaccatgtagcc

SEQ ID NO: 7481918 - DNA, 23 bp, Homo sapiens
agggctgatgccattgcagctct

SEQ ID NO: 7481919 - DNA, 23 bp, Homo sapiens
agggctgatgccattgcagctct

SEQ ID NO: 7481920 - DNA, 23 bp, Homo sapiens
agggctgatgccattgcagctct

SEQ ID NO: 7481921 - DNA, 22 bp, Homo sapiens
agggctgcaatgggagataact

SEQ ID NO: 7481922 - DNA, 22 bp, Homo sapiens
agggctgcaatgggagataact

SEQ ID NO: 7481923 - DNA, 23 bp, Homo sapiens
agggctgatgccattgcagctct

SEQ ID NO: 7481924 - DNA, 23 bp, Homo sapiens
agggctgatgccattgcagctct

SEQ ID NO: 7481925 - DNA, 22 bp, Homo sapiens
cctcctggccctgggcctggaa

SEQ ID NO: 7481926 - DNA, 22 bp, Homo sapiens
cctcctggccctgggcctggaa

SEQ ID NO: 7481927 - DNA, 22 bp, Homo sapiens
agggctgagtgggagagagttg

SEQ ID NO: 7481928 - DNA, 22 bp, Homo sapiens
agggctgagtggtgcagtcaaa

SEQ ID NO: 7481929 - DNA, 22 bp, Homo sapiens
agggctgagtggtgcagtcaaa

SEQ ID NO: 7481930 - DNA, 22 bp, Homo sapiens
agggctgagtgggagagagttg

SEQ ID NO: 7481931 - DNA, 22 bp, Homo sapiens
agggctgagtgggagagagttg

SEQ ID NO: 7481932 - DNA, 22 bp, Homo sapiens
agggctgagtgggagagagttg

SEQ ID NO: 7481933 - DNA, 22 bp, Homo sapiens
cctcctggaggctctagggaaa

SEQ ID NO: 7481934 - DNA, 22 bp, Homo sapiens
cctcctggaggctctagggaaa

SEQ ID NO: 7481935 - DNA, 22 bp, Homo sapiens
cctcctggatggatttggtgga

SEQ ID NO: 7481936 - DNA, 22 bp, Homo sapiens
cctcctggaggctctagggaaa

SEQ ID NO: 7481937 - DNA, 22 bp, Homo sapiens
cctcctggaggctctagggaaa

SEQ ID NO: 7481938 - DNA, 22 bp, Homo sapiens
cctcctggaggctctagggaaa

SEQ ID NO: 7481939 - DNA, 22 bp, Homo sapiens
cctctggcttactgttgggttt

SEQ ID NO: 7481940 - DNA, 18 bp, Homo sapiens
cctctgccatagccagca

SEQ ID NO: 7481941 - DNA, 19 bp, Homo sapiens
cctctgccagcccgcctct

SEQ ID NO: 7481942 - DNA, 22 bp, Homo sapiens
agggctgcagtcctaaggtgct

SEQ ID NO: 7481943 - DNA, 22 bp, Homo sapiens
agggctgcagtcctaaggtgct

SEQ ID NO: 7481944 - DNA, 22 bp, Homo sapiens
agggctgcaggcaagatatggc

SEQ ID NO: 7481945 - DNA, 22 bp, Homo sapiens
agggctgcaggcaagatatggc

SEQ ID NO: 7481946 - DNA, 22 bp, Homo sapiens
agggctgcaccggggcttcgcg

SEQ ID NO: 7481947 - DNA, 22 bp, Homo sapiens
agggctgcaccggggcttcgcg

SEQ ID NO: 7481948 - DNA, 22 bp, Homo sapiens
cctctgggagactgctactgag

SEQ ID NO: 7481949 - DNA, 22 bp, Homo sapiens
cctctgggagactgctactgag

SEQ ID NO: 7481950 - DNA, 22 bp, Homo sapiens
cctctgggagactgctactgag

SEQ ID NO: 7481951 - DNA, 22 bp, Homo sapiens
cctctgggagactgctactgag

SEQ ID NO: 7481952 - DNA, 22 bp, Homo sapiens
cctctgggaagccagtcctgct

SEQ ID NO: 7481953 - DNA, 22 bp, Homo sapiens
cctctgggaagccagtcctgct

SEQ ID NO: 7481954 - DNA, 22 bp, Homo sapiens
cctctgggaagccagtcctgct

SEQ ID NO: 7481955 - DNA, 22 bp, Homo sapiens
cctctgggaagccagtcctgct

SEQ ID NO: 7481956 - DNA, 22 bp, Homo sapiens
cctctgggaagccagtcctgct

SEQ ID NO: 7481957 - DNA, 22 bp, Homo sapiens
cctctgggaagccagtcctgct

SEQ ID NO: 7481958 - DNA, 21 bp, Homo sapiens
cctctggcttgtgctgtgccc

SEQ ID NO: 7481959 - DNA, 21 bp, Homo sapiens
cctctggcttgtgctgtgccc

SEQ ID NO: 7481960 - DNA, 21 bp, Homo sapiens
cctctggcttgtgctgtgccc

SEQ ID NO: 7481961 - DNA, 21 bp, Homo sapiens
cctctggcttgtgctgtgccc

SEQ ID NO: 7481962 - DNA, 22 bp, Homo sapiens
cctctggcttactgttgggttt

SEQ ID NO: 7481963 - DNA, 22 bp, Homo sapiens
agggctgcaggcaagatatggc

SEQ ID NO: 7481964 - DNA, 21 bp, Homo sapiens
cctctggcttgtgctgtgccc

SEQ ID NO: 7481965 - DNA, 21 bp, Homo sapiens
cctctggcttgtgctgtgccc

SEQ ID NO: 7481966 - DNA, 16 bp, Homo sapiens
cctctgggcctgcaag

SEQ ID NO: 7481967 - DNA, 22 bp, Homo sapiens
cctctgggcctggaagggcagt

SEQ ID NO: 7481968 - DNA, 22 bp, Homo sapiens
cctctgggcctggaagggcagt

SEQ ID NO: 7481969 - DNA, 22 bp, Homo sapiens
cctctgggcctggaagggcagt

SEQ ID NO: 7481970 - DNA, 16 bp, Homo sapiens
cctctgggcctgcaag

SEQ ID NO: 7481971 - DNA, 22 bp, Homo sapiens
cctctgggcggagatctgctgc

SEQ ID NO: 7481972 - DNA, 22 bp, Homo sapiens
cctctgggcctggaagggcagt

SEQ ID NO: 7481973 - DNA, 22 bp, Homo sapiens
cctctgggcggagatctgctgc

SEQ ID NO: 7481974 - DNA, 22 bp, Homo sapiens
cctctgggcctggaagggcagt

SEQ ID NO: 7481975 - DNA, 22 bp, Homo sapiens
cctctgggcaggtagcagcagc

SEQ ID NO: 7481976 - DNA, 22 bp, Homo sapiens
cctctgggcaggtagcagcagc

SEQ ID NO: 7481977 - DNA, 22 bp, Homo sapiens
cctctgggccagcctggaccct

SEQ ID NO: 7481978 - DNA, 22 bp, Homo sapiens
cctctgggccagcctggaccct

SEQ ID NO: 7481979 - DNA, 22 bp, Homo sapiens
cctctgggccagcctggaccct

SEQ ID NO: 7481980 - DNA, 22 bp, Homo sapiens
cctctgggccagcctggaccct

SEQ ID NO: 7481981 - DNA, 22 bp, Homo sapiens
cctctgggccagcctggaccct

SEQ ID NO: 7481982 - DNA, 22 bp, Homo sapiens
cctctgggcaggtagcagcagc

SEQ ID NO: 7481983 - DNA, 22 bp, Homo sapiens
cctctgggcaggtagcagcagc

SEQ ID NO: 7481984 - DNA, 22 bp, Homo sapiens
cctctgggcaggtagcagcagc

SEQ ID NO: 7481985 - DNA, 22 bp, Homo sapiens
cctctgggcaggtagcagcagc

SEQ ID NO: 7481986 - DNA, 22 bp, Homo sapiens
cctctgggagactgctactgag

SEQ ID NO: 7481987 - DNA, 22 bp, Homo sapiens
cctgaggacagtgtgaccatgg

SEQ ID NO: 7481988 - DNA, 22 bp, Homo sapiens
cctgaggacagtgtgaccatgg

SEQ ID NO: 7481989 - DNA, 22 bp, Homo sapiens
cctgaggacagtgtgaccatgg

SEQ ID NO: 7481990 - DNA, 22 bp, Homo sapiens
cctgaggacatcagcatcacct

SEQ ID NO: 7481991 - DNA, 22 bp, Homo sapiens
cctgaggacacacgctgcagga

SEQ ID NO: 7481992 - DNA, 22 bp, Homo sapiens
cctgaggacacacgctgcagga

SEQ ID NO: 7481993 - DNA, 22 bp, Homo sapiens
cctgaggacacacgctgcagga

SEQ ID NO: 7481994 - DNA, 22 bp, Homo sapiens
cctgaggacacacgctgcagga

SEQ ID NO: 7481995 - DNA, 22 bp, Homo sapiens
cctgaggacacacgctgcagga

SEQ ID NO: 7481996 - DNA, 22 bp, Homo sapiens
cctgaggacacacgctgcagga

SEQ ID NO: 7481997 - DNA, 22 bp, Homo sapiens
cctgaggacacacgctgcagga

SEQ ID NO: 7481998 - DNA, 22 bp, Homo sapiens
cctgaggacacacgctgcagga

SEQ ID NO: 7481999 - DNA, 19 bp, Homo sapiens
cctgaggaaaagatgattg

SEQ ID NO: 7482000 - DNA, 22 bp, Homo sapiens
cctgagctttaaaagccatgta

SEQ ID NO: 7482001 - DNA, 19 bp, Homo sapiens
cctgaggaaaagatgattg

SEQ ID NO: 7482002 - DNA, 22 bp, Homo sapiens
cctgagctttaaaagccatgta

SEQ ID NO: 7482003 - DNA, 22 bp, Homo sapiens
cctgagagtgcgtgcctcctta

SEQ ID NO: 7482004 - DNA, 17 bp, Homo sapiens
aggggagagtgggaaga

SEQ ID NO: 7482005 - DNA, 22 bp, Homo sapiens
cctgagagtgcgtgcctcctta

SEQ ID NO: 7482006 - DNA, 22 bp, Homo sapiens
cctgagagtgcgtgcctcctta

SEQ ID NO: 7482007 - DNA, 22 bp, Homo sapiens
cctgagagtggtgtacaggaga

SEQ ID NO: 7482008 - DNA, 22 bp, Homo sapiens
cctgagagtggtgtacaggaga

SEQ ID NO: 7482009 - DNA, 22 bp, Homo sapiens
cctgagagtggtgtacaggaga

SEQ ID NO: 7482010 - DNA, 22 bp, Homo sapiens
cctgagatcagtgcatttggtg

SEQ ID NO: 7482011 - DNA, 22 bp, Homo sapiens
cctgagctttaaaagccatgta

SEQ ID NO: 7482012 - DNA, 22 bp, Homo sapiens
cctgagctttaaaagccatgta

SEQ ID NO: 7482013 - DNA, 17 bp, Homo sapiens
aggggagagtgggaaga

SEQ ID NO: 7482014 - DNA, 22 bp, Homo sapiens
aggggagagttaatgtgaatgt

SEQ ID NO: 7482015 - DNA, 22 bp, Homo sapiens
aggggagagttaatgtgaatgt

SEQ ID NO: 7482016 - DNA, 17 bp, Homo sapiens
aggggagagtgggaaga

SEQ ID NO: 7482017 - DNA, 17 bp, Homo sapiens
aggggagagtgggaaga

SEQ ID NO: 7482018 - DNA, 17 bp, Homo sapiens
aggggagagtgggaaga

SEQ ID NO: 7482019 - DNA, 22 bp, Homo sapiens
aggggagactggaatctaacat

SEQ ID NO: 7482020 - DNA, 22 bp, Homo sapiens
aggggagactggaatctaacat

SEQ ID NO: 7482021 - DNA, 22 bp, Homo sapiens
aggggagaatttcaactcaggt

SEQ ID NO: 7482022 - DNA, 22 bp, Homo sapiens
aggggagaatttcaactcaggt

SEQ ID NO: 7482023 - DNA, 22 bp, Homo sapiens
aggggagaatttcaactcaggt

SEQ ID NO: 7482024 - DNA, 22 bp, Homo sapiens
aggggagaatttcaactcaggt

SEQ ID NO: 7482025 - DNA, 22 bp, Homo sapiens
aggggagaaaaatgccttctgt

SEQ ID NO: 7482026 - DNA, 22 bp, Homo sapiens
aggggagaatttcaactcaggt

SEQ ID NO: 7482027 - DNA, 22 bp, Homo sapiens
aggggagaaaaatgccttctgt

SEQ ID NO: 7482028 - DNA, 22 bp, Homo sapiens
aggggagaaaaatgccttctgt

SEQ ID NO: 7482029 - DNA, 22 bp, Homo sapiens
aggggagagaacataaggaagt

SEQ ID NO: 7482030 - DNA, 22 bp, Homo sapiens
aggggagaatttcaactcaggt

SEQ ID NO: 7482031 - DNA, 22 bp, Homo sapiens
aggggagagaacataaggaagt

SEQ ID NO: 7482032 - DNA, 22 bp, Homo sapiens
aggggagagaacataaggaagt

SEQ ID NO: 7482033 - DNA, 22 bp, Homo sapiens
aggggagaggtgagcaacttct

SEQ ID NO: 7482034 - DNA, 22 bp, Homo sapiens
aggggagagaacataaggaagt

SEQ ID NO: 7482035 - DNA, 22 bp, Homo sapiens
aggggagagaacataaggaagt

SEQ ID NO: 7482036 - DNA, 22 bp, Homo sapiens
aggggagaggtgagcaacttct

SEQ ID NO: 7482037 - DNA, 22 bp, Homo sapiens
aggggagagaacataaggaagt

SEQ ID NO: 7482038 - DNA, 22 bp, Homo sapiens
aggggagagaacataaggaagt

SEQ ID NO: 7482039 - DNA, 22 bp, Homo sapiens
cctctgggctgcctgcacgggt

SEQ ID NO: 7482040 - DNA, 22 bp, Homo sapiens
aggggacacggcttctccaggg

SEQ ID NO: 7482041 - DNA, 22 bp, Homo sapiens
aggggacacggcttctccaggg

SEQ ID NO: 7482042 - DNA, 22 bp, Homo sapiens
aggggacacggcttctccaggg

SEQ ID NO: 7482043 - DNA, 22 bp, Homo sapiens
aggggacacggcttctccaggg

SEQ ID NO: 7482044 - DNA, 21 bp, Homo sapiens
aggggacagagtagctccagg

SEQ ID NO: 7482045 - DNA, 21 bp, Homo sapiens
aggggacagagtagctccagg

SEQ ID NO: 7482046 - DNA, 21 bp, Homo sapiens
aggggacagagtagctccagg

SEQ ID NO: 7482047 - DNA, 21 bp, Homo sapiens
aggggacagagtagctccagg

SEQ ID NO: 7482048 - DNA, 22 bp, Homo sapiens
aggggacacggcttctccaggg

SEQ ID NO: 7482049 - DNA, 21 bp, Homo sapiens
aggggacagagtagctccagg

SEQ ID NO: 7482050 - DNA, 21 bp, Homo sapiens
aggggacagagtagctccagg

SEQ ID NO: 7482051 - DNA, 21 bp, Homo sapiens
aggggacagagtagctccagg

SEQ ID NO: 7482052 - DNA, 22 bp, Homo sapiens
aggggacatttagcaatgacta

SEQ ID NO: 7482053 - DNA, 22 bp, Homo sapiens
aggggacatttagcaatgacta

SEQ ID NO: 7482054 - DNA, 22 bp, Homo sapiens
aggggagaaaaatgccttctgt

SEQ ID NO: 7482055 - DNA, 22 bp, Homo sapiens
aggggacatttagcaatgacta

SEQ ID NO: 7482056 - DNA, 22 bp, Homo sapiens
aggggaccaaaatgtcctgcct

SEQ ID NO: 7482057 - DNA, 22 bp, Homo sapiens
aggggaccaaaatgtcctgcct

SEQ ID NO: 7482058 - DNA, 22 bp, Homo sapiens
cctgaggaccagcacccatctg

SEQ ID NO: 7482059 - DNA, 22 bp, Homo sapiens
cctgaggagattgtggctgggg

SEQ ID NO: 7482060 - DNA, 22 bp, Homo sapiens
cctgaggagattgtggctgggg

SEQ ID NO: 7482061 - DNA, 22 bp, Homo sapiens
cctgaggaggtgaagtctccat

SEQ ID NO: 7482062 - DNA, 22 bp, Homo sapiens
cctgaggaggtgaagtctccat

SEQ ID NO: 7482063 - DNA, 22 bp, Homo sapiens
cctgaggaggtgaagtctccat

SEQ ID NO: 7482064 - DNA, 22 bp, Homo sapiens
cctgaggagattgtggctgggg

SEQ ID NO: 7482065 - DNA, 22 bp, Homo sapiens
cctgaggaccagcacccatctg

SEQ ID NO: 7482066 - DNA, 22 bp, Homo sapiens
cctgaggatgccagcatgggtg

SEQ ID NO: 7482067 - DNA, 22 bp, Homo sapiens
cctgaggatgccagcatgggtg

SEQ ID NO: 7482068 - DNA, 22 bp, Homo sapiens
cctgaggatgccagcatgggtg

SEQ ID NO: 7482069 - DNA, 22 bp, Homo sapiens
cctgaggatgccagcatgggtg

SEQ ID NO: 7482070 - DNA, 22 bp, Homo sapiens
cctgaggatattcaccagcatg

SEQ ID NO: 7482071 - DNA, 22 bp, Homo sapiens
cctgaggatattcaccagcatg

SEQ ID NO: 7482072 - DNA, 22 bp, Homo sapiens
cctgaggatattcaccagcatg

SEQ ID NO: 7482073 - DNA, 22 bp, Homo sapiens
cctgaggatattcaccagcatg

SEQ ID NO: 7482074 - DNA, 22 bp, Homo sapiens
cctgaggccctggctgtgctga

SEQ ID NO: 7482075 - DNA, 22 bp, Homo sapiens
cctgaggccctggctgtgctga

SEQ ID NO: 7482076 - DNA, 22 bp, Homo sapiens
aggggctgcctggcttggcact

SEQ ID NO: 7482077 - DNA, 22 bp, Homo sapiens
cctgaggcccctgaggatagca

SEQ ID NO: 7482078 - DNA, 22 bp, Homo sapiens
cctgaggcccctgaggatagca

SEQ ID NO: 7482079 - DNA, 22 bp, Homo sapiens
cctgaggcaaggacttggtggc

SEQ ID NO: 7482080 - DNA, 22 bp, Homo sapiens
cctgaggcccctgaggatagca

SEQ ID NO: 7482081 - DNA, 22 bp, Homo sapiens
cctgaggcaaggacttggtggc

SEQ ID NO: 7482082 - DNA, 22 bp, Homo sapiens
cctgaggcaaggacttggtggc

SEQ ID NO: 7482083 - DNA, 22 bp, Homo sapiens
cctgaggattgttggtgcttcc

SEQ ID NO: 7482084 - DNA, 22 bp, Homo sapiens
cctgaggattgttggtgcttcc

SEQ ID NO: 7482085 - DNA, 22 bp, Homo sapiens
cctgaggattgttggtgcttcc

SEQ ID NO: 7482086 - DNA, 22 bp, Homo sapiens
cctgaggattgttggtgcttcc

SEQ ID NO: 7482087 - DNA, 22 bp, Homo sapiens
cctgaggcaaggacttggtggc

SEQ ID NO: 7482088 - DNA, 22 bp, Homo sapiens
cctgaggcaaggacttggtggc

SEQ ID NO: 7482089 - DNA, 22 bp, Homo sapiens
cctgaggcaaggacttggtggc

SEQ ID NO: 7482090 - DNA, 22 bp, Homo sapiens
cctgaggcaaggacttggtggc

SEQ ID NO: 7482091 - DNA, 22 bp, Homo sapiens
aggggctgcctggcttggcact

SEQ ID NO: 7482092 - DNA, 22 bp, Homo sapiens
aggggctgctgggtccgcccct

SEQ ID NO: 7482093 - DNA, 22 bp, Homo sapiens
aggggctgctgggtccgcccct

SEQ ID NO: 7482094 - DNA, 22 bp, Homo sapiens
aggggctgctgggtccgcccct

SEQ ID NO: 7482095 - DNA, 22 bp, Homo sapiens
aggggctgctgggtccgcccct

SEQ ID NO: 7482096 - DNA, 22 bp, Homo sapiens
aggggctggagttcgaggttac

SEQ ID NO: 7482097 - DNA, 22 bp, Homo sapiens
aggggctggagttcgaggttac

SEQ ID NO: 7482098 - DNA, 22 bp, Homo sapiens
aggggctggagttcgaggttac

SEQ ID NO: 7482099 - DNA, 22 bp, Homo sapiens
aggggctggagttcgaggttac

SEQ ID NO: 7482100 - DNA, 22 bp, Homo sapiens
aggggctggcttatctgagagt

SEQ ID NO: 7482101 - DNA, 22 bp, Homo sapiens
aggggctggagttcgaggttac

SEQ ID NO: 7482102 - DNA, 22 bp, Homo sapiens
aggggctggagttcgaggttac

SEQ ID NO: 7482103 - DNA, 22 bp, Homo sapiens
aggggctggcttatctgagagt

SEQ ID NO: 7482104 - DNA, 22 bp, Homo sapiens
aggggctggcttatctgagagt

SEQ ID NO: 7482105 - DNA, 22 bp, Homo sapiens
aggggctggcttatctgagagt

SEQ ID NO: 7482106 - DNA, 22 bp, Homo sapiens
aggggctggcttatctgagagt

SEQ ID NO: 7482107 - DNA, 22 bp, Homo sapiens
aggggctggcttatctgagagt

SEQ ID NO: 7482108 - DNA, 22 bp, Homo sapiens
aggggctggcttatctgagagt

SEQ ID NO: 7482109 - DNA, 22 bp, Homo sapiens
aggggctggcttatctgagagt

SEQ ID NO: 7482110 - DNA, 22 bp, Homo sapiens
aggggctgggacagagccaagc

SEQ ID NO: 7482111 - DNA, 22 bp, Homo sapiens
aggggctgggacagagccaagc

SEQ ID NO: 7482112 - DNA, 22 bp, Homo sapiens
aggggctgggacagagccaagc

SEQ ID NO: 7482113 - DNA, 22 bp, Homo sapiens
aggggctgggacagagccaagc

SEQ ID NO: 7482114 - DNA, 22 bp, Homo sapiens
aggggctgggacagagccaagc

SEQ ID NO: 7482115 - DNA, 22 bp, Homo sapiens
aggggctgggacagagccaagc

SEQ ID NO: 7482116 - DNA, 22 bp, Homo sapiens
ccgaggacattgggcttctgtt

SEQ ID NO: 7482117 - DNA, 22 bp, Homo sapiens
ccgaggagcttttccaaggtgt

SEQ ID NO: 7482118 - DNA, 22 bp, Homo sapiens
ccgaggaagggacagggctctg

SEQ ID NO: 7482119 - DNA, 22 bp, Homo sapiens
ccgaggaatttttataagatct

SEQ ID NO: 7482120 - DNA, 22 bp, Homo sapiens
ccgaggcagggtggagccgcct

SEQ ID NO: 7482121 - DNA, 22 bp, Homo sapiens
ccgagacactgagcagggtggg

SEQ ID NO: 7482122 - DNA, 22 bp, Homo sapiens
ccgagatgggctcgcctgggaa

SEQ ID NO: 7482123 - DNA, 22 bp, Homo sapiens
cccttttttatgtcaagcattg

SEQ ID NO: 7482124 - DNA, 22 bp, Homo sapiens
ccgagaacttttcctgaaaagt

SEQ ID NO: 7482125 - DNA, 22 bp, Homo sapiens
cccttttttatgtcaagcattg

SEQ ID NO: 7482126 - DNA, 22 bp, Homo sapiens
cccttttttatgtcaagcattg

SEQ ID NO: 7482127 - DNA, 22 bp, Homo sapiens
ccgaggtcctggacttggccct

SEQ ID NO: 7482128 - DNA, 22 bp, Homo sapiens
ccgaggtcctggacttggccct

SEQ ID NO: 7482129 - DNA, 22 bp, Homo sapiens
ccgcaaggcagaggttgcagtg

SEQ ID NO: 7482130 - DNA, 22 bp, Homo sapiens
ccgaggtcctggacttggccct

SEQ ID NO: 7482131 - DNA, 22 bp, Homo sapiens
ccgaggtcctggacttggccct

SEQ ID NO: 7482132 - DNA, 22 bp, Homo sapiens
ccgaggtcctggacttggccct

SEQ ID NO: 7482133 - DNA, 22 bp, Homo sapiens
ccgaggctggcctcagggctgt

SEQ ID NO: 7482134 - DNA, 22 bp, Homo sapiens
ccgaggctggagtgcagtggcg

SEQ ID NO: 7482135 - DNA, 22 bp, Homo sapiens
ccgaggctcctccccgagtctg

SEQ ID NO: 7482136 - DNA, 22 bp, Homo sapiens
ccgaggagcttttccaaggtgt

SEQ ID NO: 7482137 - DNA, 22 bp, Homo sapiens
ccgaggctggagtgcagtggcg

SEQ ID NO: 7482138 - DNA, 22 bp, Homo sapiens
ccgccgtgcaggccgcgacgtg

SEQ ID NO: 7482139 - DNA, 22 bp, Homo sapiens
agggccctaaggaaggcacaca

SEQ ID NO: 7482140 - DNA, 22 bp, Homo sapiens
agggccctaaggaaggcacaca

SEQ ID NO: 7482141 - DNA, 22 bp, Homo sapiens
agggccctaaggaaggcacaca

SEQ ID NO: 7482142 - DNA, 22 bp, Homo sapiens
agggccctaaggaaggcacaca

SEQ ID NO: 7482143 - DNA, 22 bp, Homo sapiens
ccgcccacactaaatatgagcg

SEQ ID NO: 7482144 - DNA, 22 bp, Homo sapiens
ccgcccacactaaatatgagcg

SEQ ID NO: 7482145 - DNA, 21 bp, Homo sapiens
ccgccgctgatagctctgggc

SEQ ID NO: 7482146 - DNA, 21 bp, Homo sapiens
ccgccgctgatagctctgggc

SEQ ID NO: 7482147 - DNA, 21 bp, Homo sapiens
ccgccgctgatagctctgggc

SEQ ID NO: 7482148 - DNA, 22 bp, Homo sapiens
ccgcccacactaaatatgagcg

SEQ ID NO: 7482149 - DNA, 22 bp, Homo sapiens
ccgcagggaaagccccaggaag

SEQ ID NO: 7482150 - DNA, 22 bp, Homo sapiens
ccgcagggaaagccccaggaag

SEQ ID NO: 7482151 - DNA, 22 bp, Homo sapiens
ccctttcccttctggctcaggg

SEQ ID NO: 7482152 - DNA, 22 bp, Homo sapiens
ccctttcccttctggctcaggg

SEQ ID NO: 7482153 - DNA, 22 bp, Homo sapiens
ccctttcccttctggctcaggg

SEQ ID NO: 7482154 - DNA, 22 bp, Homo sapiens
ccctttccatggctctcctagg

SEQ ID NO: 7482155 - DNA, 22 bp, Homo sapiens
ccctttccatggctctcctagg

SEQ ID NO: 7482156 - DNA, 22 bp, Homo sapiens
ccctttcctgaagaatattttt

SEQ ID NO: 7482157 - DNA, 22 bp, Homo sapiens
ccctttcccttctggctcaggg

SEQ ID NO: 7482158 - DNA, 22 bp, Homo sapiens
ccctttctccagaactgtctga

SEQ ID NO: 7482159 - DNA, 22 bp, Homo sapiens
ccctttctccagaactgtctga

SEQ ID NO: 7482160 - DNA, 22 bp, Homo sapiens
ccctttctccagaactgtctga

SEQ ID NO: 7482161 - DNA, 22 bp, Homo sapiens
agggccagagtctgtgtagata

SEQ ID NO: 7482162 - DNA, 22 bp, Homo sapiens
cccttcagtgcgtgagaatgag

SEQ ID NO: 7482163 - DNA, 22 bp, Homo sapiens
cccttcagtgctaggctgcctg

SEQ ID NO: 7482164 - DNA, 22 bp, Homo sapiens
cccttcagtgcgtgagaatgag

SEQ ID NO: 7482165 - DNA, 22 bp, Homo sapiens
cccttcagtgctaggctgcctg

SEQ ID NO: 7482166 - DNA, 22 bp, Homo sapiens
cccttcccttctgggagatcca

SEQ ID NO: 7482167 - DNA, 22 bp, Homo sapiens
cccttcccttctgggagatcca

SEQ ID NO: 7482168 - DNA, 22 bp, Homo sapiens
cccttcagtgctaggctgcctg

SEQ ID NO: 7482169 - DNA, 22 bp, Homo sapiens
cccttcagtgctaggctgcctg

SEQ ID NO: 7482170 - DNA, 22 bp, Homo sapiens
cccttcagtgctaggctgcctg

SEQ ID NO: 7482171 - DNA, 22 bp, Homo sapiens
ccctttcttccgtgacttctgc

SEQ ID NO: 7482172 - DNA, 22 bp, Homo sapiens
ccctttgcccagtatattctag

SEQ ID NO: 7482173 - DNA, 22 bp, Homo sapiens
ccctttgcccagtatattctag

SEQ ID NO: 7482174 - DNA, 22 bp, Homo sapiens
ccctttggaagaggctcactga

SEQ ID NO: 7482175 - DNA, 22 bp, Homo sapiens
ccctttttcactctaccaaggt

SEQ ID NO: 7482176 - DNA, 20 bp, Homo sapiens
cccttttcacgaaaaggaga

SEQ ID NO: 7482177 - DNA, 20 bp, Homo sapiens
cccttttcacgaaaaggaga

SEQ ID NO: 7482178 - DNA, 22 bp, Homo sapiens
ccctttttcactctaccaaggt

SEQ ID NO: 7482179 - DNA, 22 bp, Homo sapiens
ccctttgggttccccaagcctg

SEQ ID NO: 7482180 - DNA, 22 bp, Homo sapiens
ccctttggaagaggctcactga

SEQ ID NO: 7482181 - DNA, 22 bp, Homo sapiens
ccctttggcatttccaggatat

SEQ ID NO: 7482182 - DNA, 22 bp, Homo sapiens
ccctttgggttccccaagcctg

SEQ ID NO: 7482183 - DNA, 20 bp, Homo sapiens
cccttttcacgaaaaggaga

SEQ ID NO: 7482184 - DNA, 21 bp, Homo sapiens
ccctttctccatacttcatcc

SEQ ID NO: 7482185 - DNA, 21 bp, Homo sapiens
ccctttctccatacttcatcc

SEQ ID NO: 7482186 - DNA, 22 bp, Homo sapiens
ccctttctgccttctaaaataa

SEQ ID NO: 7482187 - DNA, 21 bp, Homo sapiens
ccctttctccatacttcatcc

SEQ ID NO: 7482188 - DNA, 22 bp, Homo sapiens
ccctttctgccttctaaaataa

SEQ ID NO: 7482189 - DNA, 22 bp, Homo sapiens
ccctttctgccttctaaaataa

SEQ ID NO: 7482190 - DNA, 22 bp, Homo sapiens
ccctttctgggacccctgtctc

SEQ ID NO: 7482191 - DNA, 22 bp, Homo sapiens
ccctttctgggacccctgtctc

SEQ ID NO: 7482192 - DNA, 22 bp, Homo sapiens
ccctttctgggacccctgtctc

SEQ ID NO: 7482193 - DNA, 22 bp, Homo sapiens
ccctttctgggacccctgtctc

SEQ ID NO: 7482194 - DNA, 22 bp, Homo sapiens
ccctttcttccgtgacttctgc

SEQ ID NO: 7482195 - DNA, 22 bp, Homo sapiens
ccctttctgggacccctgtctc

SEQ ID NO: 7482196 - DNA, 22 bp, Homo sapiens
agggccagaatccctcagtcta

SEQ ID NO: 7482197 - DNA, 22 bp, Homo sapiens
agggccagaatccctcagtcta

SEQ ID NO: 7482198 - DNA, 22 bp, Homo sapiens
agggccagaatccctcagtcta

SEQ ID NO: 7482199 - DNA, 22 bp, Homo sapiens
agggccagaatccctcagtcta

SEQ ID NO: 7482200 - DNA, 22 bp, Homo sapiens
agggccagaatccctcagtcta

SEQ ID NO: 7482201 - DNA, 22 bp, Homo sapiens
agggccagaatccctcagtcta

SEQ ID NO: 7482202 - DNA, 22 bp, Homo sapiens
agggccagaggcaccttgcagc

SEQ ID NO: 7482203 - DNA, 22 bp, Homo sapiens
agggccagaggcaccttgcagc

SEQ ID NO: 7482204 - DNA, 22 bp, Homo sapiens
agggccagaatccctcagtcta

SEQ ID NO: 7482205 - DNA, 22 bp, Homo sapiens
agggccagaatccctcagtcta

SEQ ID NO: 7482206 - DNA, 22 bp, Homo sapiens
agggccagaggcaccttgcagc

SEQ ID NO: 7482207 - DNA, 22 bp, Homo sapiens
agggccagaggcaccttgcagc

SEQ ID NO: 7482208 - DNA, 22 bp, Homo sapiens
agggccagaggcaccttgcagc

SEQ ID NO: 7482209 - DNA, 22 bp, Homo sapiens
agggccagaggcaccttgcagc

SEQ ID NO: 7482210 - DNA, 22 bp, Homo sapiens
agggccagagtctgtgtagata

SEQ ID NO: 7482211 - DNA, 22 bp, Homo sapiens
agggccagagtctgtgtagata

SEQ ID NO: 7482212 - DNA, 22 bp, Homo sapiens
agggccagagtacatcagggct

SEQ ID NO: 7482213 - DNA, 22 bp, Homo sapiens
agggccagagtctgtgtagata

SEQ ID NO: 7482214 - DNA, 22 bp, Homo sapiens
agggccagagtctgtgtagata

SEQ ID NO: 7482215 - DNA, 22 bp, Homo sapiens
agggccagagtctgtgtagata

SEQ ID NO: 7482216 - DNA, 22 bp, Homo sapiens
agggccagagtctgtgtagata

SEQ ID NO: 7482217 - DNA, 22 bp, Homo sapiens
agggccagagtctgtgtagata

SEQ ID NO: 7482218 - DNA, 22 bp, Homo sapiens
agggccagagtctgtgtagata

SEQ ID NO: 7482219 - DNA, 22 bp, Homo sapiens
agggccagagtacatcagggct

SEQ ID NO: 7482220 - DNA, 22 bp, Homo sapiens
agggccagagtacatcagggct

SEQ ID NO: 7482221 - DNA, 22 bp, Homo sapiens
agggccagagtacatcagggct

SEQ ID NO: 7482222 - DNA, 22 bp, Homo sapiens
agggccagagtacatcagggct

SEQ ID NO: 7482223 - DNA, 22 bp, Homo sapiens
agggccagagtacatcagggct

SEQ ID NO: 7482224 - DNA, 22 bp, Homo sapiens
agggccagagtacatcagggct

SEQ ID NO: 7482225 - DNA, 22 bp, Homo sapiens
agggccagagtacatcagggct

SEQ ID NO: 7482226 - DNA, 22 bp, Homo sapiens
agggccagagtacatcagggct

SEQ ID NO: 7482227 - DNA, 22 bp, Homo sapiens
agggccagagtacatcagggct

SEQ ID NO: 7482228 - DNA, 22 bp, Homo sapiens
agggccagagtacatcagggct

SEQ ID NO: 7482229 - DNA, 22 bp, Homo sapiens
ccctggaggctggaggcagtag

SEQ ID NO: 7482230 - DNA, 22 bp, Homo sapiens
ccctggaggctggaggcagtag

SEQ ID NO: 7482231 - DNA, 22 bp, Homo sapiens
ccctggaggctggaggcagtag

SEQ ID NO: 7482232 - DNA, 22 bp, Homo sapiens
ccctggaggctggaggcagtag

SEQ ID NO: 7482233 - DNA, 22 bp, Homo sapiens
ccctggaggcggatgttgcagt

SEQ ID NO: 7482234 - DNA, 22 bp, Homo sapiens
ccctggaggcggatgttgcagt

SEQ ID NO: 7482235 - DNA, 22 bp, Homo sapiens
ccctggagggacagctgctcta

SEQ ID NO: 7482236 - DNA, 22 bp, Homo sapiens
ccctggagggacagctgctcta

SEQ ID NO: 7482237 - DNA, 22 bp, Homo sapiens
ccctggagggacagctgctcta

SEQ ID NO: 7482238 - DNA, 23 bp, Homo sapiens
agggccactgggaaggattactg

SEQ ID NO: 7482239 - DNA, 23 bp, Homo sapiens
agggccactgggaaggattactg

SEQ ID NO: 7482240 - DNA, 16 bp, Homo sapiens
agggccagaagcatca

SEQ ID NO: 7482241 - DNA, 16 bp, Homo sapiens
agggccagaagcatca

SEQ ID NO: 7482242 - DNA, 22 bp, Homo sapiens
agggccacttgtagactggtga

SEQ ID NO: 7482243 - DNA, 16 bp, Homo sapiens
agggccagaagcatca

SEQ ID NO: 7482244 - DNA, 22 bp, Homo sapiens
ccctggaggcaaaggttgcagt

SEQ ID NO: 7482245 - DNA, 22 bp, Homo sapiens
ccctggaggcaaaggttgcagt

SEQ ID NO: 7482246 - DNA, 22 bp, Homo sapiens
ccctggaggcaaaggttgcagt

SEQ ID NO: 7482247 - DNA, 22 bp, Homo sapiens
ccctggaggcaaaggttgcagt

SEQ ID NO: 7482248 - DNA, 22 bp, Homo sapiens
ccctggaggcaaaggttgcagt

SEQ ID NO: 7482249 - DNA, 22 bp, Homo sapiens
ccctggaggcaaaggttgcagt

SEQ ID NO: 7482250 - DNA, 22 bp, Homo sapiens
ccctggaggcaaaggttgcagt

SEQ ID NO: 7482251 - DNA, 22 bp, Homo sapiens
ccctggaggcggagcttgcagt

SEQ ID NO: 7482252 - DNA, 22 bp, Homo sapiens
ccctggaggcggagcttgcagt

SEQ ID NO: 7482253 - DNA, 22 bp, Homo sapiens
ccctggaggcggagcttgcagt

SEQ ID NO: 7482254 - DNA, 22 bp, Homo sapiens
ccctggaggcggagcttgcagt

SEQ ID NO: 7482255 - DNA, 22 bp, Homo sapiens
ccctggaggcggagcttgcagt

SEQ ID NO: 7482256 - DNA, 22 bp, Homo sapiens
ccctggaggcggagcttgcagt

SEQ ID NO: 7482257 - DNA, 22 bp, Homo sapiens
ccctggaggcggagcttgcagt

SEQ ID NO: 7482258 - DNA, 22 bp, Homo sapiens
cctccccacgggcagccggcgc

SEQ ID NO: 7482259 - DNA, 22 bp, Homo sapiens
cctccccacgggcagccggcgc

SEQ ID NO: 7482260 - DNA, 22 bp, Homo sapiens
cctccccacgggcagccggcgc

SEQ ID NO: 7482261 - DNA, 22 bp, Homo sapiens
cctccccacgggcagccggcgc

SEQ ID NO: 7482262 - DNA, 22 bp, Homo sapiens
cctccccacgggcagccggcgc

SEQ ID NO: 7482263 - DNA, 22 bp, Homo sapiens
cctcctctgtgcagctgtgggt

SEQ ID NO: 7482264 - DNA, 22 bp, Homo sapiens
cctcctctgtgcagctgtgggt

SEQ ID NO: 7482265 - DNA, 22 bp, Homo sapiens
cctccccatgacccggtgctgg

SEQ ID NO: 7482266 - DNA, 22 bp, Homo sapiens
cctccccatgacccggtgctgg

SEQ ID NO: 7482267 - DNA, 22 bp, Homo sapiens
cctccccatgacccggtgctgg

SEQ ID NO: 7482268 - DNA, 22 bp, Homo sapiens
cctccccacgggcagccggcgc

SEQ ID NO: 7482269 - DNA, 22 bp, Homo sapiens
cctccccacgggcagccggcgc

SEQ ID NO: 7482270 - DNA, 22 bp, Homo sapiens
agggctcttcctttgcctctca

SEQ ID NO: 7482271 - DNA, 22 bp, Homo sapiens
agggctcttcctttgcctctca

SEQ ID NO: 7482272 - DNA, 22 bp, Homo sapiens
agggctcttcctttgcctctca

SEQ ID NO: 7482273 - DNA, 22 bp, Homo sapiens
agggctcttcctttgcctctca

SEQ ID NO: 7482274 - DNA, 22 bp, Homo sapiens
agggctctgttggggtcagcac

SEQ ID NO: 7482275 - DNA, 22 bp, Homo sapiens
agggctctgttggggtcagcac

SEQ ID NO: 7482276 - DNA, 22 bp, Homo sapiens
agggctctgttggggtcagcac

SEQ ID NO: 7482277 - DNA, 22 bp, Homo sapiens
agggctctggggtggcagagat

SEQ ID NO: 7482278 - DNA, 22 bp, Homo sapiens
agggctctgagtgggaaagagg

SEQ ID NO: 7482279 - DNA, 20 bp, Homo sapiens
agggctctgccttgctgatg

SEQ ID NO: 7482280 - DNA, 22 bp, Homo sapiens
agggctctggggtggcagagat

SEQ ID NO: 7482281 - DNA, 22 bp, Homo sapiens
agggctctgtccccagaggccc

SEQ ID NO: 7482282 - DNA, 22 bp, Homo sapiens
agggctctgtccccagaggccc

SEQ ID NO: 7482283 - DNA, 22 bp, Homo sapiens
agggctctgtgactatcactgc

SEQ ID NO: 7482284 - DNA, 22 bp, Homo sapiens
agggctctgttggggtcagcac

SEQ ID NO: 7482285 - DNA, 22 bp, Homo sapiens
agggctctgtccccagaggccc

SEQ ID NO: 7482286 - DNA, 22 bp, Homo sapiens
agggctctgtccccagaggccc

SEQ ID NO: 7482287 - DNA, 22 bp, Homo sapiens
agggctctgtccccagaggccc

SEQ ID NO: 7482288 - DNA, 22 bp, Homo sapiens
agggctctcttggacaactgct

SEQ ID NO: 7482289 - DNA, 22 bp, Homo sapiens
agggctctcttggacaactgct

SEQ ID NO: 7482290 - DNA, 22 bp, Homo sapiens
agggctctcttggacaactgct

SEQ ID NO: 7482291 - DNA, 22 bp, Homo sapiens
agggctctgagctggaccacct

SEQ ID NO: 7482292 - DNA, 22 bp, Homo sapiens
agggctctcttcttggtttgca

SEQ ID NO: 7482293 - DNA, 22 bp, Homo sapiens
agggctcctgaggcccttctgg

SEQ ID NO: 7482294 - DNA, 23 bp, Homo sapiens
agggctccttgttgattagcatt

SEQ ID NO: 7482295 - DNA, 18 bp, Homo sapiens
agggctctctgctgggtt

SEQ ID NO: 7482296 - DNA, 22 bp, Homo sapiens
agggctcctccccggcctccac

SEQ ID NO: 7482297 - DNA, 22 bp, Homo sapiens
agggctcctccccggcctccac

SEQ ID NO: 7482298 - DNA, 22 bp, Homo sapiens
agggctcctatgatgctctgcc

SEQ ID NO: 7482299 - DNA, 22 bp, Homo sapiens
agggctcctatgatgctctgcc

SEQ ID NO: 7482300 - DNA, 22 bp, Homo sapiens
agggctcctatgatgctctgcc

SEQ ID NO: 7482301 - DNA, 22 bp, Homo sapiens
agggctcctatgatgctctgcc

SEQ ID NO: 7482302 - DNA, 22 bp, Homo sapiens
agggctcctatgatgctctgcc

SEQ ID NO: 7482303 - DNA, 22 bp, Homo sapiens
agggctccgggccaccggcctg

SEQ ID NO: 7482304 - DNA, 22 bp, Homo sapiens
agggctccgggccaccggcctg

SEQ ID NO: 7482305 - DNA, 22 bp, Homo sapiens
agggctccgggccaccggcctg

SEQ ID NO: 7482306 - DNA, 22 bp, Homo sapiens
agggctccgggccaccggcctg

SEQ ID NO: 7482307 - DNA, 22 bp, Homo sapiens
agggctccgggcaggcgatgga

SEQ ID NO: 7482308 - DNA, 22 bp, Homo sapiens
agggctccgggcaggcgatgga

SEQ ID NO: 7482309 - DNA, 22 bp, Homo sapiens
agggctcctatgccccatggac

SEQ ID NO: 7482310 - DNA, 22 bp, Homo sapiens
agggctcctatgccccatggac

SEQ ID NO: 7482311 - DNA, 22 bp, Homo sapiens
agggctcctccccggcctccac

SEQ ID NO: 7482312 - DNA, 22 bp, Homo sapiens
agggctcctatgccccatggac

SEQ ID NO: 7482313 - DNA, 22 bp, Homo sapiens
agggctcctatgccccatggac

SEQ ID NO: 7482314 - DNA, 22 bp, Homo sapiens
agggccctctggcaggccaggc

SEQ ID NO: 7482315 - DNA, 22 bp, Homo sapiens
agggccctctggcaggccaggc

SEQ ID NO: 7482316 - DNA, 22 bp, Homo sapiens
agggccctctggcaggccaggc

SEQ ID NO: 7482317 - DNA, 22 bp, Homo sapiens
agggccctgagttgcagccctg

SEQ ID NO: 7482318 - DNA, 22 bp, Homo sapiens
agggccctctgggcactgtggc

SEQ ID NO: 7482319 - DNA, 22 bp, Homo sapiens
agggccctctgggcactgtggc

SEQ ID NO: 7482320 - DNA, 22 bp, Homo sapiens
agggccctctggcaggccaggc

SEQ ID NO: 7482321 - DNA, 22 bp, Homo sapiens
agggccctccccgctcagggca

SEQ ID NO: 7482322 - DNA, 22 bp, Homo sapiens
agggccctagggaatgagacat

SEQ ID NO: 7482323 - DNA, 22 bp, Homo sapiens
agggccctagggaatgagacat

SEQ ID NO: 7482324 - DNA, 22 bp, Homo sapiens
agggccctccccgctcagggca

SEQ ID NO: 7482325 - DNA, 22 bp, Homo sapiens
agggccctccccgctcagggca

SEQ ID NO: 7482326 - DNA, 22 bp, Homo sapiens
agggccctggggtgcactgaca

SEQ ID NO: 7482327 - DNA, 22 bp, Homo sapiens
agggccctggggtgcactgaca

SEQ ID NO: 7482328 - DNA, 22 bp, Homo sapiens
agggccctggggtgcactgaca

SEQ ID NO: 7482329 - DNA, 22 bp, Homo sapiens
agggccctggggtgcactgaca

SEQ ID NO: 7482330 - DNA, 18 bp, Homo sapiens
agggccctggtggccatt

SEQ ID NO: 7482331 - DNA, 18 bp, Homo sapiens
agggccctggtggccatt

SEQ ID NO: 7482332 - DNA, 18 bp, Homo sapiens
agggccctggtggccatt

SEQ ID NO: 7482333 - DNA, 22 bp, Homo sapiens
agggcccttacgcaggcccttc

SEQ ID NO: 7482334 - DNA, 22 bp, Homo sapiens
agggcccttacgcaggcccttc

SEQ ID NO: 7482335 - DNA, 22 bp, Homo sapiens
agggccctggggtgcactgaca

SEQ ID NO: 7482336 - DNA, 22 bp, Homo sapiens
agggcccttacgcaggcccttc

SEQ ID NO: 7482337 - DNA, 22 bp, Homo sapiens
agggcccttacgcaggcccttc

SEQ ID NO: 7482338 - DNA, 19 bp, Homo sapiens
agggctaggcacatagggc

SEQ ID NO: 7482339 - DNA, 19 bp, Homo sapiens
agggctaggcacatagggc

SEQ ID NO: 7482340 - DNA, 22 bp, Homo sapiens
agggctaggaatggaactggag

SEQ ID NO: 7482341 - DNA, 22 bp, Homo sapiens
agggctaggaatggaactggag

SEQ ID NO: 7482342 - DNA, 22 bp, Homo sapiens
agggctaggaatggaactggag

SEQ ID NO: 7482343 - DNA, 22 bp, Homo sapiens
agggctaggaatggaactggag

SEQ ID NO: 7482344 - DNA, 23 bp, Homo sapiens
agggcctcaggagggctgcatgg

SEQ ID NO: 7482345 - DNA, 23 bp, Homo sapiens
agggcctcaggagggctgcatgg

SEQ ID NO: 7482346 - DNA, 22 bp, Homo sapiens
agggctcccgcggtgtccggga

SEQ ID NO: 7482347 - DNA, 22 bp, Homo sapiens
agggctcccgtgaggtgactgc

SEQ ID NO: 7482348 - DNA, 22 bp, Homo sapiens
agggctcccgtgaggtgactgc

SEQ ID NO: 7482349 - DNA, 22 bp, Homo sapiens
agggctccaaggaagtgtagct

SEQ ID NO: 7482350 - DNA, 22 bp, Homo sapiens
agggctccaaggaagtgtagct

SEQ ID NO: 7482351 - DNA, 22 bp, Homo sapiens
agggctccaggggaccatcagt

SEQ ID NO: 7482352 - DNA, 22 bp, Homo sapiens
agggctccaaggaagtgtagct

SEQ ID NO: 7482353 - DNA, 22 bp, Homo sapiens
agggctccaaggaagtgtagct

SEQ ID NO: 7482354 - DNA, 22 bp, Homo sapiens
agggctccaaggaagtgtagct

SEQ ID NO: 7482355 - DNA, 22 bp, Homo sapiens
agggctccaggggaccatcagt

SEQ ID NO: 7482356 - DNA, 22 bp, Homo sapiens
agggctccaggggctgggtgac

SEQ ID NO: 7482357 - DNA, 22 bp, Homo sapiens
agggctccaggggctgggtgac

SEQ ID NO: 7482358 - DNA, 22 bp, Homo sapiens
agggctccaggggctgggtgac

SEQ ID NO: 7482359 - DNA, 22 bp, Homo sapiens
agggctcataattcctgacttc

SEQ ID NO: 7482360 - DNA, 22 bp, Homo sapiens
agggctcagttgcctggagccc

SEQ ID NO: 7482361 - DNA, 22 bp, Homo sapiens
agggctcagttgcctggagccc

SEQ ID NO: 7482362 - DNA, 22 bp, Homo sapiens
agggctcataattcctgacttc

SEQ ID NO: 7482363 - DNA, 22 bp, Homo sapiens
agggctcataattcctgacttc

SEQ ID NO: 7482364 - DNA, 22 bp, Homo sapiens
agggctcataattcctgacttc

SEQ ID NO: 7482365 - DNA, 22 bp, Homo sapiens
agggctcatctgagactgacat

SEQ ID NO: 7482366 - DNA, 22 bp, Homo sapiens
agggctcatctgagactgacat

SEQ ID NO: 7482367 - DNA, 22 bp, Homo sapiens
agggctcattgacatggaaaag

SEQ ID NO: 7482368 - DNA, 22 bp, Homo sapiens
agggctcatctgagactgacat

SEQ ID NO: 7482369 - DNA, 22 bp, Homo sapiens
agggctcataattcctgacttc

SEQ ID NO: 7482370 - DNA, 22 bp, Homo sapiens
agggctcatctgagactgacat

SEQ ID NO: 7482371 - DNA, 22 bp, Homo sapiens
agggctccaaggaagtgtagct

SEQ ID NO: 7482372 - DNA, 22 bp, Homo sapiens
agggctcattgacatggaaaag

SEQ ID NO: 7482373 - DNA, 22 bp, Homo sapiens
agggctcattgacatggaaaag

SEQ ID NO: 7482374 - DNA, 22 bp, Homo sapiens
agggctccaaggaagtgtagct

SEQ ID NO: 7482375 - DNA, 22 bp, Homo sapiens
agggctccaaggaagtgtagct

SEQ ID NO: 7482376 - DNA, 22 bp, Homo sapiens
ccaggaggaaagaccagcccat

SEQ ID NO: 7482377 - DNA, 22 bp, Homo sapiens
ccaggaggaaagaccagcccat

SEQ ID NO: 7482378 - DNA, 22 bp, Homo sapiens
ccaggagctggcatgtggagag

SEQ ID NO: 7482379 - DNA, 22 bp, Homo sapiens
ccaggagctggcatgtggagag

SEQ ID NO: 7482380 - DNA, 22 bp, Homo sapiens
ccaggagctggcatgtggagag

SEQ ID NO: 7482381 - DNA, 22 bp, Homo sapiens
ccaggagctggcatgtggagag

SEQ ID NO: 7482382 - DNA, 22 bp, Homo sapiens
ccaggagctggcatgtggagag

SEQ ID NO: 7482383 - DNA, 22 bp, Homo sapiens
ccaggagctggcatgtggagag

SEQ ID NO: 7482384 - DNA, 22 bp, Homo sapiens
ccaggagctggcatgtggagag

SEQ ID NO: 7482385 - DNA, 22 bp, Homo sapiens
ccaggagctggagggtgcagtg

SEQ ID NO: 7482386 - DNA, 22 bp, Homo sapiens
ccaggagctggagggtgcagtg

SEQ ID NO: 7482387 - DNA, 22 bp, Homo sapiens
ccaggaggaaattctaaaggta

SEQ ID NO: 7482388 - DNA, 22 bp, Homo sapiens
ccaggaggaaagaccagcccat

SEQ ID NO: 7482389 - DNA, 22 bp, Homo sapiens
ccaggaggaaagaccagcccat

SEQ ID NO: 7482390 - DNA, 22 bp, Homo sapiens
ccaggaggaaattctaaaggta

SEQ ID NO: 7482391 - DNA, 22 bp, Homo sapiens
ccaggaggaaattctaaaggta

SEQ ID NO: 7482392 - DNA, 22 bp, Homo sapiens
ccaggaggaaattctaaaggta

SEQ ID NO: 7482393 - DNA, 22 bp, Homo sapiens
ccaggaggaaattctaaaggta

SEQ ID NO: 7482394 - DNA, 17 bp, Homo sapiens
ccaggagcgtgggtctc

SEQ ID NO: 7482395 - DNA, 17 bp, Homo sapiens
ccaggagcgtgggtctc

SEQ ID NO: 7482396 - DNA, 17 bp, Homo sapiens
ccaggagcgtgggtctc

SEQ ID NO: 7482397 - DNA, 22 bp, Homo sapiens
ccaggagctatgtacacactat

SEQ ID NO: 7482398 - DNA, 17 bp, Homo sapiens
ccaggagcgtgggtctc

SEQ ID NO: 7482399 - DNA, 17 bp, Homo sapiens
ccaggagcgtgggtctc

SEQ ID NO: 7482400 - DNA, 17 bp, Homo sapiens
ccaggagcgtgggtctc

SEQ ID NO: 7482401 - DNA, 17 bp, Homo sapiens
ccaggagcgtgggtctc

SEQ ID NO: 7482402 - DNA, 22 bp, Homo sapiens
ccaggagctggagggtgcagtg

SEQ ID NO: 7482403 - DNA, 22 bp, Homo sapiens
ccaggagctggagggtgcagtg

SEQ ID NO: 7482404 - DNA, 22 bp, Homo sapiens
ccaggagctatgtacacactat

SEQ ID NO: 7482405 - DNA, 22 bp, Homo sapiens
ccaggagctatgtacacactat

SEQ ID NO: 7482406 - DNA, 22 bp, Homo sapiens
ccaggagctggagggtgcagtg

SEQ ID NO: 7482407 - DNA, 22 bp, Homo sapiens
ccaggagctggagggtgcagtg

SEQ ID NO: 7482408 - DNA, 22 bp, Homo sapiens
ccaggagctggagggtgcagtg

SEQ ID NO: 7482409 - DNA, 22 bp, Homo sapiens
ccaggagctggagggtgcagtg

SEQ ID NO: 7482410 - DNA, 22 bp, Homo sapiens
ccaggaggatcatcctgttttc

SEQ ID NO: 7482411 - DNA, 22 bp, Homo sapiens
ccaggaggatcatcctgttttc

SEQ ID NO: 7482412 - DNA, 22 bp, Homo sapiens
ccaggaggatcatcctgttttc

SEQ ID NO: 7482413 - DNA, 22 bp, Homo sapiens
ccaggaggatcatcctgttttc

SEQ ID NO: 7482414 - DNA, 22 bp, Homo sapiens
aggctcagcctgggcctagagc

SEQ ID NO: 7482415 - DNA, 22 bp, Homo sapiens
ccaggaggaaattctaaaggta

SEQ ID NO: 7482416 - DNA, 22 bp, Homo sapiens
aggctcagcctgggcctagagc

SEQ ID NO: 7482417 - DNA, 22 bp, Homo sapiens
aggctcagcctgggcctagagc

SEQ ID NO: 7482418 - DNA, 22 bp, Homo sapiens
aggctcagcctgggcctagagc

SEQ ID NO: 7482419 - DNA, 22 bp, Homo sapiens
aggctcagtatagctggcaagt

SEQ ID NO: 7482420 - DNA, 22 bp, Homo sapiens
aggctcagtatagctggcaagt

SEQ ID NO: 7482421 - DNA, 22 bp, Homo sapiens
aggctcagtatagctggcaagt

SEQ ID NO: 7482422 - DNA, 22 bp, Homo sapiens
aggctcagtatagctggcaagt

SEQ ID NO: 7482423 - DNA, 22 bp, Homo sapiens
aggctcaggtgcctcattcaca

SEQ ID NO: 7482424 - DNA, 22 bp, Homo sapiens
aggctcaggtgcctcattcaca

SEQ ID NO: 7482425 - DNA, 22 bp, Homo sapiens
aggctcaggtgcctcattcaca

SEQ ID NO: 7482426 - DNA, 22 bp, Homo sapiens
aggctcaggtgcctcattcaca

SEQ ID NO: 7482427 - DNA, 20 bp, Homo sapiens
aggctcagctgagctcttgg

SEQ ID NO: 7482428 - DNA, 22 bp, Homo sapiens
aggctcaggtgcctcattcaca

SEQ ID NO: 7482429 - DNA, 22 bp, Homo sapiens
aggctcagtgatgtaaaatata

SEQ ID NO: 7482430 - DNA, 22 bp, Homo sapiens
aggctcagtgatgtaaaatata

SEQ ID NO: 7482431 - DNA, 22 bp, Homo sapiens
aggctcagtctgttcatgcact

SEQ ID NO: 7482432 - DNA, 22 bp, Homo sapiens
aggctcagtgcaaatcattctg

SEQ ID NO: 7482433 - DNA, 22 bp, Homo sapiens
aggctcagtgatgtaaaatata

SEQ ID NO: 7482434 - DNA, 22 bp, Homo sapiens
aggctcagtctgttcatgcact

SEQ ID NO: 7482435 - DNA, 22 bp, Homo sapiens
aggctcagtctgttcatgcact

SEQ ID NO: 7482436 - DNA, 22 bp, Homo sapiens
aggctcagtctgttcatgcact

SEQ ID NO: 7482437 - DNA, 22 bp, Homo sapiens
aggctcagtctgttcatgcact

SEQ ID NO: 7482438 - DNA, 22 bp, Homo sapiens
aggctcagtcccggcccgcgcc

SEQ ID NO: 7482439 - DNA, 22 bp, Homo sapiens
aggctcagtcccggcccgcgcc

SEQ ID NO: 7482440 - DNA, 22 bp, Homo sapiens
aggctcagtctgttcatgcact

SEQ ID NO: 7482441 - DNA, 22 bp, Homo sapiens
aggctcagtcccggcccgcgcc

SEQ ID NO: 7482442 - DNA, 22 bp, Homo sapiens
aggctcagtcccggcccgcgcc

SEQ ID NO: 7482443 - DNA, 22 bp, Homo sapiens
aggctcagtatagctggcaagt

SEQ ID NO: 7482444 - DNA, 22 bp, Homo sapiens
aggctcagtcccggcccgcgcc

SEQ ID NO: 7482445 - DNA, 22 bp, Homo sapiens
aggctcagtatagctggcaagt

SEQ ID NO: 7482446 - DNA, 22 bp, Homo sapiens
ccagggaaggctgctggctgtg

SEQ ID NO: 7482447 - DNA, 22 bp, Homo sapiens
ccagggaaggctgctggctgtg

SEQ ID NO: 7482448 - DNA, 22 bp, Homo sapiens
ccagggaaggctgctggctgtg

SEQ ID NO: 7482449 - DNA, 22 bp, Homo sapiens
ccagggaaggctctgcctgctt

SEQ ID NO: 7482450 - DNA, 22 bp, Homo sapiens
ccagggaaggctctgcctgctt

SEQ ID NO: 7482451 - DNA, 22 bp, Homo sapiens
ccaggctgtaagagtgatgttg

SEQ ID NO: 7482452 - DNA, 22 bp, Homo sapiens
ccaggctgtaagagtgatgttg

SEQ ID NO: 7482453 - DNA, 22 bp, Homo sapiens
ccaggctgtaagagtgatgttg

SEQ ID NO: 7482454 - DNA, 23 bp, Homo sapiens
ccagggaaggccatcttcaactg

SEQ ID NO: 7482455 - DNA, 22 bp, Homo sapiens
ccaggctgtaaacaccttcaaa

SEQ ID NO: 7482456 - DNA, 22 bp, Homo sapiens
ccaggctgtaaacaccttcaaa

SEQ ID NO: 7482457 - DNA, 22 bp, Homo sapiens
aggctccaccctacagagctcc

SEQ ID NO: 7482458 - DNA, 22 bp, Homo sapiens
aggctccaccctacagagctcc

SEQ ID NO: 7482459 - DNA, 22 bp, Homo sapiens
aggctccaccctacagagctcc

SEQ ID NO: 7482460 - DNA, 22 bp, Homo sapiens
aggctccaccctacagagctcc

SEQ ID NO: 7482461 - DNA, 22 bp, Homo sapiens
aggctccaccctacagagctcc

SEQ ID NO: 7482462 - DNA, 22 bp, Homo sapiens
aggctccaccctacagagctcc

SEQ ID NO: 7482463 - DNA, 22 bp, Homo sapiens
ccaggctgtaaacaccttcaaa

SEQ ID NO: 7482464 - DNA, 22 bp, Homo sapiens
aggctccaccccgccagacctt

SEQ ID NO: 7482465 - DNA, 22 bp, Homo sapiens
aggctccaccccgccagacctt

SEQ ID NO: 7482466 - DNA, 22 bp, Homo sapiens
aggctccaccagtcaggtgcat

SEQ ID NO: 7482467 - DNA, 22 bp, Homo sapiens
aggctccaccagtcaggtgcat

SEQ ID NO: 7482468 - DNA, 22 bp, Homo sapiens
aggctccaccccgccagacctt

SEQ ID NO: 7482469 - DNA, 22 bp, Homo sapiens
aggctccaccccgccagacctt

SEQ ID NO: 7482470 - DNA, 22 bp, Homo sapiens
aggctccaccccgccagacctt

SEQ ID NO: 7482471 - DNA, 22 bp, Homo sapiens
aggctccaccctacagagctcc

SEQ ID NO: 7482472 - DNA, 22 bp, Homo sapiens
aggctccaccagtcaggtgcat

SEQ ID NO: 7482473 - DNA, 23 bp, Homo sapiens
aggctccacatgggcactttgca

SEQ ID NO: 7482474 - DNA, 23 bp, Homo sapiens
aggctccacatgggcactttgca

SEQ ID NO: 7482475 - DNA, 22 bp, Homo sapiens
aggctccaccagtcaggtgcat

SEQ ID NO: 7482476 - DNA, 22 bp, Homo sapiens
aggctccaccagtcaggtgcat

SEQ ID NO: 7482477 - DNA, 22 bp, Homo sapiens
aggctccaccagtcaggtgcat

SEQ ID NO: 7482478 - DNA, 22 bp, Homo sapiens
aggctcagtttggtttccattg

SEQ ID NO: 7482479 - DNA, 22 bp, Homo sapiens
aggctcagtttggtttccattg

SEQ ID NO: 7482480 - DNA, 22 bp, Homo sapiens
aggctcagtttggtttccattg

SEQ ID NO: 7482481 - DNA, 22 bp, Homo sapiens
aggctcatccccacaaagcaaa

SEQ ID NO: 7482482 - DNA, 22 bp, Homo sapiens
aggctcatccccacaaagcaaa

SEQ ID NO: 7482483 - DNA, 22 bp, Homo sapiens
aggctcatctgagcagaaacct

SEQ ID NO: 7482484 - DNA, 22 bp, Homo sapiens
aggctcattcttgcctctgagc

SEQ ID NO: 7482485 - DNA, 22 bp, Homo sapiens
aggctccaaattaccaagctct

SEQ ID NO: 7482486 - DNA, 22 bp, Homo sapiens
aggctccaaattaccaagctct

SEQ ID NO: 7482487 - DNA, 22 bp, Homo sapiens
aggctcattcttgcctctgagc

SEQ ID NO: 7482488 - DNA, 23 bp, Homo sapiens
aggctccacatgggcactttgca

SEQ ID NO: 7482489 - DNA, 22 bp, Homo sapiens
aggctccaagaggttaagtcac

SEQ ID NO: 7482490 - DNA, 22 bp, Homo sapiens
aggctcagttcacgtcaacttt

SEQ ID NO: 7482491 - DNA, 22 bp, Homo sapiens
aggctcagttcacgtcaacttt

SEQ ID NO: 7482492 - DNA, 22 bp, Homo sapiens
aggctcagttcacgtcaacttt

SEQ ID NO: 7482493 - DNA, 22 bp, Homo sapiens
aggctcagtgcaaatcattctg

SEQ ID NO: 7482494 - DNA, 22 bp, Homo sapiens
aggctcagttcacgtcaacttt

SEQ ID NO: 7482495 - DNA, 22 bp, Homo sapiens
aggctcagtgcaaatcattctg

SEQ ID NO: 7482496 - DNA, 22 bp, Homo sapiens
aggctcagtgcaaatcattctg

SEQ ID NO: 7482497 - DNA, 22 bp, Homo sapiens
aggctcagtgcaaatcattctg

SEQ ID NO: 7482498 - DNA, 22 bp, Homo sapiens
aggctcagtgatgtaaaatata

SEQ ID NO: 7482499 - DNA, 22 bp, Homo sapiens
aggctcagttctgtggtgagcc

SEQ ID NO: 7482500 - DNA, 22 bp, Homo sapiens
aggctcagttctgtggtgagcc

SEQ ID NO: 7482501 - DNA, 22 bp, Homo sapiens
aggctcagttcacgtcaacttt

SEQ ID NO: 7482502 - DNA, 22 bp, Homo sapiens
aggctcagttctgtggtgagcc

SEQ ID NO: 7482503 - DNA, 22 bp, Homo sapiens
aggctcagttctgtggtgagcc

SEQ ID NO: 7482504 - DNA, 22 bp, Homo sapiens
aggctcagttctgtggtgagcc

SEQ ID NO: 7482505 - DNA, 22 bp, Homo sapiens
aggctcagttctgtggtgagcc

SEQ ID NO: 7482506 - DNA, 22 bp, Homo sapiens
aggctcagttctgtggtgagcc

SEQ ID NO: 7482507 - DNA, 22 bp, Homo sapiens
aggctcagttctgtggtgagcc

SEQ ID NO: 7482508 - DNA, 22 bp, Homo sapiens
aggctcagttctgtggtgagcc

SEQ ID NO: 7482509 - DNA, 22 bp, Homo sapiens
ccagggaggagcatttcatggt

SEQ ID NO: 7482510 - DNA, 18 bp, Homo sapiens
ccagggagcttattagga

SEQ ID NO: 7482511 - DNA, 22 bp, Homo sapiens
ccagggaggagcatttcatggt

SEQ ID NO: 7482512 - DNA, 22 bp, Homo sapiens
ccagggaggagcatttcatggt

SEQ ID NO: 7482513 - DNA, 22 bp, Homo sapiens
ccagggaggagcatttcatggt

SEQ ID NO: 7482514 - DNA, 22 bp, Homo sapiens
ccagggaggagcatttcatggt

SEQ ID NO: 7482515 - DNA, 22 bp, Homo sapiens
ccagggaggagcatttcatggt

SEQ ID NO: 7482516 - DNA, 22 bp, Homo sapiens
ccagggaggagcatttcatggt

SEQ ID NO: 7482517 - DNA, 17 bp, Homo sapiens
ccagggaggggccgcgc

SEQ ID NO: 7482518 - DNA, 22 bp, Homo sapiens
aggctccctgaatcgcccgttc

SEQ ID NO: 7482519 - DNA, 17 bp, Homo sapiens
ccagggaggggccgcgc

SEQ ID NO: 7482520 - DNA, 17 bp, Homo sapiens
ccagggaggggccgcgc

SEQ ID NO: 7482521 - DNA, 18 bp, Homo sapiens
ccagggagcttattagga

SEQ ID NO: 7482522 - DNA, 22 bp, Homo sapiens
ccagggagcggggctgggtctc

SEQ ID NO: 7482523 - DNA, 22 bp, Homo sapiens
ccagggagcggggctgggtctc

SEQ ID NO: 7482524 - DNA, 22 bp, Homo sapiens
ccagggagcggggctgggtctc

SEQ ID NO: 7482525 - DNA, 22 bp, Homo sapiens
ccagggagcggggctgggtctc

SEQ ID NO: 7482526 - DNA, 22 bp, Homo sapiens
ccagggagcggggctgggtctc

SEQ ID NO: 7482527 - DNA, 22 bp, Homo sapiens
ccagggagcggggctgggtctc

SEQ ID NO: 7482528 - DNA, 22 bp, Homo sapiens
ccagggagcggggctgggtctc

SEQ ID NO: 7482529 - DNA, 22 bp, Homo sapiens
ccagggagcggggctgggtctc

SEQ ID NO: 7482530 - DNA, 22 bp, Homo sapiens
ccagggagcggggctgggtctc

SEQ ID NO: 7482531 - DNA, 17 bp, Homo sapiens
ccagggaggggccgcgc

SEQ ID NO: 7482532 - DNA, 22 bp, Homo sapiens
aggctccgtccagtctcaggcc

SEQ ID NO: 7482533 - DNA, 22 bp, Homo sapiens
aggctccgtccagtctcaggcc

SEQ ID NO: 7482534 - DNA, 22 bp, Homo sapiens
aggctcctagcctgtggctggt

SEQ ID NO: 7482535 - DNA, 22 bp, Homo sapiens
aggctcctagcctgtggctggt

SEQ ID NO: 7482536 - DNA, 22 bp, Homo sapiens
aggctcctagcctgtggctggt

SEQ ID NO: 7482537 - DNA, 20 bp, Homo sapiens
aggctcctccaggatgtgtg

SEQ ID NO: 7482538 - DNA, 20 bp, Homo sapiens
aggctcctccaggatgtgtg

SEQ ID NO: 7482539 - DNA, 22 bp, Homo sapiens
aggctcctcggggctgacggcg

SEQ ID NO: 7482540 - DNA, 22 bp, Homo sapiens
aggctcctcggggctgacggcg

SEQ ID NO: 7482541 - DNA, 22 bp, Homo sapiens
aggctcctcggggctgacggcg

SEQ ID NO: 7482542 - DNA, 17 bp, Homo sapiens
aggctcctcctaaggtc

SEQ ID NO: 7482543 - DNA, 17 bp, Homo sapiens
aggctcctcctaaggtc

SEQ ID NO: 7482544 - DNA, 17 bp, Homo sapiens
aggctcctcctaaggtc

SEQ ID NO: 7482545 - DNA, 22 bp, Homo sapiens
aggctcctgagaggcagaggct

SEQ ID NO: 7482546 - DNA, 22 bp, Homo sapiens
aggctcctgagaggcagaggct

SEQ ID NO: 7482547 - DNA, 22 bp, Homo sapiens
aggctcctcggggctgacggcg

SEQ ID NO: 7482548 - DNA, 22 bp, Homo sapiens
aggctcctgagaggcagaggct

SEQ ID NO: 7482549 - DNA, 22 bp, Homo sapiens
aggctcctgagaggcagaggct

SEQ ID NO: 7482550 - DNA, 22 bp, Homo sapiens
ccagggaagtagttgtgagagc

SEQ ID NO: 7482551 - DNA, 22 bp, Homo sapiens
ccagggaagtagttgtgagagc

SEQ ID NO: 7482552 - DNA, 22 bp, Homo sapiens
ccagggaagtagttgtgagagc

SEQ ID NO: 7482553 - DNA, 22 bp, Homo sapiens
ccagggaagtagttgtgagagc

SEQ ID NO: 7482554 - DNA, 22 bp, Homo sapiens
ccagggaagtcacattgtctag

SEQ ID NO: 7482555 - DNA, 22 bp, Homo sapiens
ccagggaagtcacattgtctag

SEQ ID NO: 7482556 - DNA, 22 bp, Homo sapiens
ccagggaagtcacattgtctag

SEQ ID NO: 7482557 - DNA, 22 bp, Homo sapiens
ccagggaagtcacattgtctag

SEQ ID NO: 7482558 - DNA, 22 bp, Homo sapiens
ccagggaatcaggcagaagtca

SEQ ID NO: 7482559 - DNA, 22 bp, Homo sapiens
ccagggaatcaggcagaagtca

SEQ ID NO: 7482560 - DNA, 22 bp, Homo sapiens
ccagggaagtcacattgtctag

SEQ ID NO: 7482561 - DNA, 22 bp, Homo sapiens
ccagggaatcaggcagaagtca

SEQ ID NO: 7482562 - DNA, 22 bp, Homo sapiens
ccagggaatctctgagtgtgtt

SEQ ID NO: 7482563 - DNA, 22 bp, Homo sapiens
ccagggaatctctgagtgtgtt

SEQ ID NO: 7482564 - DNA, 22 bp, Homo sapiens
ccagggaatctctgagtgtgtt

SEQ ID NO: 7482565 - DNA, 22 bp, Homo sapiens
ccagggaatctctgagtgtgtt

SEQ ID NO: 7482566 - DNA, 22 bp, Homo sapiens
ccagggaatgtgggatgactct

SEQ ID NO: 7482567 - DNA, 22 bp, Homo sapiens
ccagggaatgtgggatgactct

SEQ ID NO: 7482568 - DNA, 22 bp, Homo sapiens
ccagggaatgtgggatgactct

SEQ ID NO: 7482569 - DNA, 22 bp, Homo sapiens
ccagggaatctctgagtgtgtt

SEQ ID NO: 7482570 - DNA, 22 bp, Homo sapiens
ccagggaatgatatttttgcct

SEQ ID NO: 7482571 - DNA, 22 bp, Homo sapiens
ccagggaatgatatttttgcct

SEQ ID NO: 7482572 - DNA, 22 bp, Homo sapiens
ccagggagcccacaggacaatg

SEQ ID NO: 7482573 - DNA, 22 bp, Homo sapiens
ccagggactttgcattgtttat

SEQ ID NO: 7482574 - DNA, 22 bp, Homo sapiens
ccagggagcccacaggacaatg

SEQ ID NO: 7482575 - DNA, 22 bp, Homo sapiens
ccagggagcccacaggacaatg

SEQ ID NO: 7482576 - DNA, 22 bp, Homo sapiens
ccagggagcccacaggacaatg

SEQ ID NO: 7482577 - DNA, 22 bp, Homo sapiens
ccagggaatgtgggatgactct

SEQ ID NO: 7482578 - DNA, 22 bp, Homo sapiens
ccagggagcccacaggacaatg

SEQ ID NO: 7482579 - DNA, 22 bp, Homo sapiens
ccagggagcccacaggacaatg

SEQ ID NO: 7482580 - DNA, 22 bp, Homo sapiens
ccagggagcccacaggacaatg

SEQ ID NO: 7482581 - DNA, 22 bp, Homo sapiens
ccagggagcctggtgtgtcagc

SEQ ID NO: 7482582 - DNA, 22 bp, Homo sapiens
ccagggagcctggtgtgtcagc

SEQ ID NO: 7482583 - DNA, 22 bp, Homo sapiens
ccagggagcctggtgtgtcagc

SEQ ID NO: 7482584 - DNA, 22 bp, Homo sapiens
ccagggagcccacaggacaatg

SEQ ID NO: 7482585 - DNA, 22 bp, Homo sapiens
ccagggagcggggctgggtctc

SEQ ID NO: 7482586 - DNA, 22 bp, Homo sapiens
ccagggagcggggctgggtctc

SEQ ID NO: 7482587 - DNA, 22 bp, Homo sapiens
ccagggagcctggtgtgtcagc

SEQ ID NO: 7482588 - DNA, 22 bp, Homo sapiens
aggctcctgatcctggggtctg

SEQ ID NO: 7482589 - DNA, 22 bp, Homo sapiens
aggctcctgatcctggggtctg

SEQ ID NO: 7482590 - DNA, 22 bp, Homo sapiens
aggctcctgatcctggggtctg

SEQ ID NO: 7482591 - DNA, 22 bp, Homo sapiens
aggctcctgcaggccttgtagg

SEQ ID NO: 7482592 - DNA, 22 bp, Homo sapiens
aggctcctgcaggccttgtagg

SEQ ID NO: 7482593 - DNA, 22 bp, Homo sapiens
aggctcctgagaggcagaggct

SEQ ID NO: 7482594 - DNA, 22 bp, Homo sapiens
aggctcctgagaggcagaggct

SEQ ID NO: 7482595 - DNA, 22 bp, Homo sapiens
aggctcctgagaggcagaggct

SEQ ID NO: 7482596 - DNA, 22 bp, Homo sapiens
aggctcctgagaggcagaggct

SEQ ID NO: 7482597 - DNA, 22 bp, Homo sapiens
aggctcctgagaggcagaggct

SEQ ID NO: 7482598 - DNA, 20 bp, Homo sapiens
aggctcctgtacctgaggaa

SEQ ID NO: 7482599 - DNA, 20 bp, Homo sapiens
aggctcctgtacctgaggaa

SEQ ID NO: 7482600 - DNA, 22 bp, Homo sapiens
aggctcctgggtgtggccgcca

SEQ ID NO: 7482601 - DNA, 20 bp, Homo sapiens
aggctcctgtacctgaggaa

SEQ ID NO: 7482602 - DNA, 20 bp, Homo sapiens
aggctcctgtacctgaggaa

SEQ ID NO: 7482603 - DNA, 20 bp, Homo sapiens
aggctcctgtacctgaggaa

SEQ ID NO: 7482604 - DNA, 20 bp, Homo sapiens
aggctcctgtacctgaggaa

SEQ ID NO: 7482605 - DNA, 22 bp, Homo sapiens
aggctcctgcaggtgaggtgct

SEQ ID NO: 7482606 - DNA, 22 bp, Homo sapiens
aggctcctgcaggtgaggtgct

SEQ ID NO: 7482607 - DNA, 22 bp, Homo sapiens
aggctcctgcaggtgaggtgct

SEQ ID NO: 7482608 - DNA, 22 bp, Homo sapiens
ccagggcttcagaggttttggc

SEQ ID NO: 7482609 - DNA, 22 bp, Homo sapiens
ccagggcttcagaggttttggc

SEQ ID NO: 7482610 - DNA, 22 bp, Homo sapiens
ccagggtcttggagaggagtgc

SEQ ID NO: 7482611 - DNA, 22 bp, Homo sapiens
ccagggtcttggagaggagtgc

SEQ ID NO: 7482612 - DNA, 22 bp, Homo sapiens
ccagggcttaacttttcaggag

SEQ ID NO: 7482613 - DNA, 22 bp, Homo sapiens
ccagggcttaacttttcaggag

SEQ ID NO: 7482614 - DNA, 22 bp, Homo sapiens
ccagggcttaacttttcaggag

SEQ ID NO: 7482615 - DNA, 22 bp, Homo sapiens
ccagggcttaacttttcaggag

SEQ ID NO: 7482616 - DNA, 22 bp, Homo sapiens
ccagggcttcagaggttttggc

SEQ ID NO: 7482617 - DNA, 22 bp, Homo sapiens
aggctccttatggctttggggt

SEQ ID NO: 7482618 - DNA, 22 bp, Homo sapiens
aggctccttcacagcactcgcc

SEQ ID NO: 7482619 - DNA, 22 bp, Homo sapiens
aggctccttcacagcactcgcc

SEQ ID NO: 7482620 - DNA, 20 bp, Homo sapiens
aggctcctgtacctgaggaa

SEQ ID NO: 7482621 - DNA, 20 bp, Homo sapiens
aggctcctgtacctgaggaa

SEQ ID NO: 7482622 - DNA, 22 bp, Homo sapiens
aggctccttcacagcactcgcc

SEQ ID NO: 7482623 - DNA, 22 bp, Homo sapiens
aggctccttgctcacaggctca

SEQ ID NO: 7482624 - DNA, 22 bp, Homo sapiens
aggctccttgctcacaggctca

SEQ ID NO: 7482625 - DNA, 22 bp, Homo sapiens
ccagggtgctctgtggcgtcgc

SEQ ID NO: 7482626 - DNA, 22 bp, Homo sapiens
ccagggtgctctgtggcgtcgc

SEQ ID NO: 7482627 - DNA, 22 bp, Homo sapiens
ccagggtgctctgtggcgtcgc

SEQ ID NO: 7482628 - DNA, 22 bp, Homo sapiens
ccagggtgctctgtggcgtcgc

SEQ ID NO: 7482629 - DNA, 22 bp, Homo sapiens
ccagggtgagtgtcatgggtta

SEQ ID NO: 7482630 - DNA, 22 bp, Homo sapiens
ccagggtgagtgtcatgggtta

SEQ ID NO: 7482631 - DNA, 22 bp, Homo sapiens
ccagggtgagtgtcatgggtta

SEQ ID NO: 7482632 - DNA, 22 bp, Homo sapiens
ccagggtgagtgtcatgggtta

SEQ ID NO: 7482633 - DNA, 22 bp, Homo sapiens
ccagggtgagtgtcatgggtta

SEQ ID NO: 7482634 - DNA, 22 bp, Homo sapiens
ccagggtgaggaggctcccacg

SEQ ID NO: 7482635 - DNA, 22 bp, Homo sapiens
ccagggtgaggaggctcccacg

SEQ ID NO: 7482636 - DNA, 22 bp, Homo sapiens
ccagggtgaggaggctcccacg

SEQ ID NO: 7482637 - DNA, 22 bp, Homo sapiens
ccagggtgaggaggctcccacg

SEQ ID NO: 7482638 - DNA, 22 bp, Homo sapiens
ccagggtgaggaggctcccacg

SEQ ID NO: 7482639 - DNA, 22 bp, Homo sapiens
ccagggtgaggaggctcccacg

SEQ ID NO: 7482640 - DNA, 22 bp, Homo sapiens
ccagggtgaggaggctcccacg

SEQ ID NO: 7482641 - DNA, 22 bp, Homo sapiens
ccagggtgagaaaaggctggat

SEQ ID NO: 7482642 - DNA, 22 bp, Homo sapiens
ccagggtgaccctcccggtggc

SEQ ID NO: 7482643 - DNA, 22 bp, Homo sapiens
ccagggtgagaaaaggctggat

SEQ ID NO: 7482644 - DNA, 22 bp, Homo sapiens
ccagggtgagaaaaggctggat

SEQ ID NO: 7482645 - DNA, 22 bp, Homo sapiens
ccagggtgagaaaaggctggat

SEQ ID NO: 7482646 - DNA, 22 bp, Homo sapiens
ccagggtgagaaaaggctggat

SEQ ID NO: 7482647 - DNA, 22 bp, Homo sapiens
ccagggtgaccctcccggtggc

SEQ ID NO: 7482648 - DNA, 22 bp, Homo sapiens
ccagggtgaccagctggcctag

SEQ ID NO: 7482649 - DNA, 22 bp, Homo sapiens
ccagggtgaccagctggcctag

SEQ ID NO: 7482650 - DNA, 22 bp, Homo sapiens
ccagggtgaccagctggcctag

SEQ ID NO: 7482651 - DNA, 22 bp, Homo sapiens
ccagggtgaccagctggcctag

SEQ ID NO: 7482652 - DNA, 22 bp, Homo sapiens
ccagggtgaccagctggcctag

SEQ ID NO: 7482653 - DNA, 22 bp, Homo sapiens
ccagggtgaccagctggcctag

SEQ ID NO: 7482654 - DNA, 22 bp, Homo sapiens
aggctgaggtgtgctgtgatcg

SEQ ID NO: 7482655 - DNA, 22 bp, Homo sapiens
aggctgaggtgtgctgtgatcg

SEQ ID NO: 7482656 - DNA, 22 bp, Homo sapiens
aggctgaggtgtgctgtgatcg

SEQ ID NO: 7482657 - DNA, 22 bp, Homo sapiens
aggctgaggtgtgctgtgatcg

SEQ ID NO: 7482658 - DNA, 22 bp, Homo sapiens
aggctgaggtgtgctgtgatcg

SEQ ID NO: 7482659 - DNA, 22 bp, Homo sapiens
aggctgaggtgtgctgtgatcg

SEQ ID NO: 7482660 - DNA, 22 bp, Homo sapiens
aggctgaggtgtgctgtgatcg

SEQ ID NO: 7482661 - DNA, 22 bp, Homo sapiens
aggctgaggtgtgctgtgatcg

SEQ ID NO: 7482662 - DNA, 22 bp, Homo sapiens
aggctgaggtgtgctgtgatcg

SEQ ID NO: 7482663 - DNA, 22 bp, Homo sapiens
aggctgaggtaggaggatcgct

SEQ ID NO: 7482664 - DNA, 22 bp, Homo sapiens
aggctgaggtaggaggatcgct

SEQ ID NO: 7482665 - DNA, 22 bp, Homo sapiens
aggctgaggtaggaggatcgct

SEQ ID NO: 7482666 - DNA, 22 bp, Homo sapiens
aggctgaggtaggaggatcgct

SEQ ID NO: 7482667 - DNA, 22 bp, Homo sapiens
aggctgaggtaggaggatcgct

SEQ ID NO: 7482668 - DNA, 22 bp, Homo sapiens
aggctgaggtaggaggatcgct

SEQ ID NO: 7482669 - DNA, 22 bp, Homo sapiens
aggctgaggtaggaggatcgct

SEQ ID NO: 7482670 - DNA, 22 bp, Homo sapiens
aggctgaggtaggaggatcgct

SEQ ID NO: 7482671 - DNA, 22 bp, Homo sapiens
aggctgagtcgggaggatcact

SEQ ID NO: 7482672 - DNA, 22 bp, Homo sapiens
aggctgagtcgggaggatcact

SEQ ID NO: 7482673 - DNA, 22 bp, Homo sapiens
aggctgagtcgggaggatcact

SEQ ID NO: 7482674 - DNA, 22 bp, Homo sapiens
aggctgagtcaagttagggtga

SEQ ID NO: 7482675 - DNA, 22 bp, Homo sapiens
aggctgagtcgggaggatcact

SEQ ID NO: 7482676 - DNA, 22 bp, Homo sapiens
aggctgagtcgggaggatcact

SEQ ID NO: 7482677 - DNA, 22 bp, Homo sapiens
aggctgagtcgggaggatcact

SEQ ID NO: 7482678 - DNA, 22 bp, Homo sapiens
aggctgagtcgggaggatcact

SEQ ID NO: 7482679 - DNA, 22 bp, Homo sapiens
aggctgagtcgggaggatcact

SEQ ID NO: 7482680 - DNA, 22 bp, Homo sapiens
aggctgagtcgggaggatcact

SEQ ID NO: 7482681 - DNA, 22 bp, Homo sapiens
aggctgagtcgggaggatcact

SEQ ID NO: 7482682 - DNA, 22 bp, Homo sapiens
aggctgaggtgtgctgtgatcg

SEQ ID NO: 7482683 - DNA, 22 bp, Homo sapiens
aggctgaggtgtgctgtgatcg

SEQ ID NO: 7482684 - DNA, 22 bp, Homo sapiens
aggctgaggtgtgctgtgatcg

SEQ ID NO: 7482685 - DNA, 22 bp, Homo sapiens
aggctgaggtgtgctgtgatcg

SEQ ID NO: 7482686 - DNA, 22 bp, Homo sapiens
aggctgagtcaagttagggtga

SEQ ID NO: 7482687 - DNA, 22 bp, Homo sapiens
aggctgagtcaagttagggtga

SEQ ID NO: 7482688 - DNA, 22 bp, Homo sapiens
aggctgagtcaagttagggtga

SEQ ID NO: 7482689 - DNA, 22 bp, Homo sapiens
aggctgagtcaagttagggtga

SEQ ID NO: 7482690 - DNA, 22 bp, Homo sapiens
aggctgagtcgggaggatcact

SEQ ID NO: 7482691 - DNA, 22 bp, Homo sapiens
aggctgagtcgggaggatcact

SEQ ID NO: 7482692 - DNA, 22 bp, Homo sapiens
aggctgagtcgggaggatcact

SEQ ID NO: 7482693 - DNA, 19 bp, Homo sapiens
ccatgcagcctgggggcag

SEQ ID NO: 7482694 - DNA, 19 bp, Homo sapiens
ccatgcagcctgggggcag

SEQ ID NO: 7482695 - DNA, 19 bp, Homo sapiens
ccatgcagcctgggggcag

SEQ ID NO: 7482696 - DNA, 19 bp, Homo sapiens
ccatgcagcctgggggcag

SEQ ID NO: 7482697 - DNA, 22 bp, Homo sapiens
ccatgcacaccagcaggcagac

SEQ ID NO: 7482698 - DNA, 22 bp, Homo sapiens
ccatgcagccacgtctagctaa

SEQ ID NO: 7482699 - DNA, 22 bp, Homo sapiens
ccatgcagccacgtctagctaa

SEQ ID NO: 7482700 - DNA, 18 bp, Homo sapiens
ccatggctccctcctgcc

SEQ ID NO: 7482701 - DNA, 18 bp, Homo sapiens
ccatggctccctcctgcc

SEQ ID NO: 7482702 - DNA, 18 bp, Homo sapiens
ccatggctccctcctgcc

SEQ ID NO: 7482703 - DNA, 18 bp, Homo sapiens
ccatggctccctcctgcc

SEQ ID NO: 7482704 - DNA, 19 bp, Homo sapiens
ccatgcagcctgggggcag

SEQ ID NO: 7482705 - DNA, 22 bp, Homo sapiens
ccatggctaagtatctgtagaa

SEQ ID NO: 7482706 - DNA, 18 bp, Homo sapiens
ccatggctccctcctgcc

SEQ ID NO: 7482707 - DNA, 18 bp, Homo sapiens
ccatggctccctcctgcc

SEQ ID NO: 7482708 - DNA, 22 bp, Homo sapiens
ccatggctccttgccctgtagc

SEQ ID NO: 7482709 - DNA, 22 bp, Homo sapiens
ccatggctccttgccctgtagc

SEQ ID NO: 7482710 - DNA, 22 bp, Homo sapiens
ccatggctccttgccctgtagc

SEQ ID NO: 7482711 - DNA, 22 bp, Homo sapiens
ccatggcttacagatggagcat

SEQ ID NO: 7482712 - DNA, 22 bp, Homo sapiens
ccatggcttacagatggagcat

SEQ ID NO: 7482713 - DNA, 22 bp, Homo sapiens
ccatggcttctttctctgccag

SEQ ID NO: 7482714 - DNA, 22 bp, Homo sapiens
ccatggcttacagatggagcat

SEQ ID NO: 7482715 - DNA, 22 bp, Homo sapiens
ccatggcttacagatggagcat

SEQ ID NO: 7482716 - DNA, 22 bp, Homo sapiens
ccatggcttacagatggagcat

SEQ ID NO: 7482717 - DNA, 22 bp, Homo sapiens
ccatggcttacagatggagcat

SEQ ID NO: 7482718 - DNA, 22 bp, Homo sapiens
ccatggctgcaattcttctgga

SEQ ID NO: 7482719 - DNA, 22 bp, Homo sapiens
ccatggctgcaattcttctgga

SEQ ID NO: 7482720 - DNA, 22 bp, Homo sapiens
ccatggctttctttcattgtaa

SEQ ID NO: 7482721 - DNA, 22 bp, Homo sapiens
ccatggctttctttcattgtaa

SEQ ID NO: 7482722 - DNA, 22 bp, Homo sapiens
ccatggcttggaaagggaggtg

SEQ ID NO: 7482723 - DNA, 22 bp, Homo sapiens
ccatggcttggaaagggaggtg

SEQ ID NO: 7482724 - DNA, 22 bp, Homo sapiens
ccatggcttggaaagggaggtg

SEQ ID NO: 7482725 - DNA, 22 bp, Homo sapiens
ccatggcttggaaagggaggtg

SEQ ID NO: 7482726 - DNA, 22 bp, Homo sapiens
ccatggcttctttctctgccag

SEQ ID NO: 7482727 - DNA, 22 bp, Homo sapiens
ccatggcttttgagtctcaaga

SEQ ID NO: 7482728 - DNA, 22 bp, Homo sapiens
ccatggcttttgagtctcaaga

SEQ ID NO: 7482729 - DNA, 22 bp, Homo sapiens
ccatggcttttgagtctcaaga

SEQ ID NO: 7482730 - DNA, 22 bp, Homo sapiens
ccatggcttttgagtctcaaga

SEQ ID NO: 7482731 - DNA, 22 bp, Homo sapiens
aggctctgtgacaatcaagctg

SEQ ID NO: 7482732 - DNA, 22 bp, Homo sapiens
aggctctgtgacaatcaagctg

SEQ ID NO: 7482733 - DNA, 22 bp, Homo sapiens
aggctctgtgacaatcaagctg

SEQ ID NO: 7482734 - DNA, 22 bp, Homo sapiens
aggctctgtgacaatcaagctg

SEQ ID NO: 7482735 - DNA, 22 bp, Homo sapiens
aggctctgtgacaatcaagctg

SEQ ID NO: 7482736 - DNA, 22 bp, Homo sapiens
aggctctgtgactaaagaggat

SEQ ID NO: 7482737 - DNA, 22 bp, Homo sapiens
aggctctgtgactaaagaggat

SEQ ID NO: 7482738 - DNA, 22 bp, Homo sapiens
ccagggtggaggctggatggag

SEQ ID NO: 7482739 - DNA, 22 bp, Homo sapiens
ccagggtggaggctggatggag

SEQ ID NO: 7482740 - DNA, 22 bp, Homo sapiens
ccagggtggaggctggatggag

SEQ ID NO: 7482741 - DNA, 22 bp, Homo sapiens
ccagggtggaggctggatggag

SEQ ID NO: 7482742 - DNA, 22 bp, Homo sapiens
aggctctgtcaggcggagcagc

SEQ ID NO: 7482743 - DNA, 22 bp, Homo sapiens
aggctctgtcaggcggagcagc

SEQ ID NO: 7482744 - DNA, 22 bp, Homo sapiens
aggctctgtcaggcggagcagc

SEQ ID NO: 7482745 - DNA, 21 bp, Homo sapiens
aggctctgtgaatatgtttcc

SEQ ID NO: 7482746 - DNA, 22 bp, Homo sapiens
aggctctgtgatgtgccaggca

SEQ ID NO: 7482747 - DNA, 22 bp, Homo sapiens
aggctctgtgactaaagaggat

SEQ ID NO: 7482748 - DNA, 22 bp, Homo sapiens
aggctctgtgatgtgccaggca

SEQ ID NO: 7482749 - DNA, 22 bp, Homo sapiens
aggctctgtgatgtgccaggca

SEQ ID NO: 7482750 - DNA, 22 bp, Homo sapiens
aggctctgtgatgtgccaggca

SEQ ID NO: 7482751 - DNA, 22 bp, Homo sapiens
aggctctgtgatccacaatgag

SEQ ID NO: 7482752 - DNA, 22 bp, Homo sapiens
aggctctgtgatgtgccaggca

SEQ ID NO: 7482753 - DNA, 22 bp, Homo sapiens
aggctctgtgatccacaatgag

SEQ ID NO: 7482754 - DNA, 22 bp, Homo sapiens
aggctctgtgatccacaatgag

SEQ ID NO: 7482755 - DNA, 22 bp, Homo sapiens
aggctctgtgatccacaatgag

SEQ ID NO: 7482756 - DNA, 22 bp, Homo sapiens
aggctctgtgatccacaatgag

SEQ ID NO: 7482757 - DNA, 22 bp, Homo sapiens
aggctctgtgcagcctgcatct

SEQ ID NO: 7482758 - DNA, 22 bp, Homo sapiens
aggctctgtgcagcctgcatct

SEQ ID NO: 7482759 - DNA, 22 bp, Homo sapiens
aggctctgtgcagcctgcatct

SEQ ID NO: 7482760 - DNA, 22 bp, Homo sapiens
aggctctgtgcagcctgcatct

SEQ ID NO: 7482761 - DNA, 22 bp, Homo sapiens
aggctctgtgatgtgccaggca

SEQ ID NO: 7482762 - DNA, 22 bp, Homo sapiens
aggctctgtgatgtgccaggca

SEQ ID NO: 7482763 - DNA, 22 bp, Homo sapiens
aggctctgtgatgtgccaggca

SEQ ID NO: 7482764 - DNA, 22 bp, Homo sapiens
aggctctgtgatgtgccaggca

SEQ ID NO: 7482765 - DNA, 22 bp, Homo sapiens
aggctctgtgcatcctccccaa

SEQ ID NO: 7482766 - DNA, 22 bp, Homo sapiens
aggctctgtgcatcctccccaa

SEQ ID NO: 7482767 - DNA, 22 bp, Homo sapiens
aggctctgtgcatcctccccaa

SEQ ID NO: 7482768 - DNA, 22 bp, Homo sapiens
aggctctgtgcatcctccccaa

SEQ ID NO: 7482769 - DNA, 22 bp, Homo sapiens
aggctctgttattctagagggc

SEQ ID NO: 7482770 - DNA, 22 bp, Homo sapiens
aggctctgtgcatcctccccaa

SEQ ID NO: 7482771 - DNA, 22 bp, Homo sapiens
aggctctgtgcatcctccccaa

SEQ ID NO: 7482772 - DNA, 22 bp, Homo sapiens
aggctctgtgcagcctgcatct

SEQ ID NO: 7482773 - DNA, 22 bp, Homo sapiens
aggctctgtgcagcctgcatct

SEQ ID NO: 7482774 - DNA, 22 bp, Homo sapiens
aggctgaggcgggtagatcacc

SEQ ID NO: 7482775 - DNA, 22 bp, Homo sapiens
aggctgaggcgggtagatcacc

SEQ ID NO: 7482776 - DNA, 22 bp, Homo sapiens
aggctgaggcgggtagatcacc

SEQ ID NO: 7482777 - DNA, 22 bp, Homo sapiens
aggctctgtgcatcctccccaa

SEQ ID NO: 7482778 - DNA, 22 bp, Homo sapiens
aggctgaggcgggtagatcacc

SEQ ID NO: 7482779 - DNA, 22 bp, Homo sapiens
aggctgaggggcgagggaccct

SEQ ID NO: 7482780 - DNA, 22 bp, Homo sapiens
aggctgaggggcgagggaccct

SEQ ID NO: 7482781 - DNA, 22 bp, Homo sapiens
aggctgaggcgggtagatcacc

SEQ ID NO: 7482782 - DNA, 22 bp, Homo sapiens
aggctgaggggcgagggaccct

SEQ ID NO: 7482783 - DNA, 22 bp, Homo sapiens
aggctgaggggcgagggaccct

SEQ ID NO: 7482784 - DNA, 22 bp, Homo sapiens
aggctgaggggcgagggaccct

SEQ ID NO: 7482785 - DNA, 22 bp, Homo sapiens
aggctgaggggcgagggaccct

SEQ ID NO: 7482786 - DNA, 22 bp, Homo sapiens
aggctgaggggcgagggaccct

SEQ ID NO: 7482787 - DNA, 22 bp, Homo sapiens
aggctgaggggcgagggaccct

SEQ ID NO: 7482788 - DNA, 20 bp, Homo sapiens
aggctgagggtgattgtgtc

SEQ ID NO: 7482789 - DNA, 20 bp, Homo sapiens
aggctgagggtgattgtgtc

SEQ ID NO: 7482790 - DNA, 20 bp, Homo sapiens
aggctgagggtgattgtgtc

SEQ ID NO: 7482791 - DNA, 20 bp, Homo sapiens
aggctgagggtgattgtgtc

SEQ ID NO: 7482792 - DNA, 20 bp, Homo sapiens
aggctgagggtgattgtgtc

SEQ ID NO: 7482793 - DNA, 22 bp, Homo sapiens
aggctgaggggcgagggaccct

SEQ ID NO: 7482794 - DNA, 20 bp, Homo sapiens
aggctgagggtgattgtgtc

SEQ ID NO: 7482795 - DNA, 22 bp, Homo sapiens
aggctgaggtaggaggatcgct

SEQ ID NO: 7482796 - DNA, 22 bp, Homo sapiens
aggctgaggtaggaggatcgct

SEQ ID NO: 7482797 - DNA, 22 bp, Homo sapiens
aggctgaggtaggaggatcgct

SEQ ID NO: 7482798 - DNA, 20 bp, Homo sapiens
aggctgagggtgattgtgtc

SEQ ID NO: 7482799 - DNA, 20 bp, Homo sapiens
aggctgagggtgattgtgtc

SEQ ID NO: 7482800 - DNA, 23 bp, Homo sapiens
cccagagcacagcctccagatgc

SEQ ID NO: 7482801 - DNA, 23 bp, Homo sapiens
cccagagcacagcctccagatgc

SEQ ID NO: 7482802 - DNA, 23 bp, Homo sapiens
cccagagcacagcctccagatgc

SEQ ID NO: 7482803 - DNA, 22 bp, Homo sapiens
cccagagatgtcctgagtgata

SEQ ID NO: 7482804 - DNA, 22 bp, Homo sapiens
cccactgtctgttcccagggcc

SEQ ID NO: 7482805 - DNA, 22 bp, Homo sapiens
cccagagatgtcctgagtgata

SEQ ID NO: 7482806 - DNA, 23 bp, Homo sapiens
cccagagcacagcctccagatgc

SEQ ID NO: 7482807 - DNA, 23 bp, Homo sapiens
cccagagcacagcctccagatgc

SEQ ID NO: 7482808 - DNA, 23 bp, Homo sapiens
cccagagcacagcctccagatgc

SEQ ID NO: 7482809 - DNA, 19 bp, Homo sapiens
cccagagcatcctgaactt

SEQ ID NO: 7482810 - DNA, 19 bp, Homo sapiens
cccagagcatcctgaactt

SEQ ID NO: 7482811 - DNA, 19 bp, Homo sapiens
cccagagcatcctgaactt

SEQ ID NO: 7482812 - DNA, 22 bp, Homo sapiens
cccagagcataacgtatcttga

SEQ ID NO: 7482813 - DNA, 22 bp, Homo sapiens
cccagagcatgtgctgcctttg

SEQ ID NO: 7482814 - DNA, 22 bp, Homo sapiens
cccagagcatgtgctgcctttg

SEQ ID NO: 7482815 - DNA, 22 bp, Homo sapiens
cccagagcatgtgctgcctttg

SEQ ID NO: 7482816 - DNA, 19 bp, Homo sapiens
cccagagcatcctgaactt

SEQ ID NO: 7482817 - DNA, 19 bp, Homo sapiens
cccagagcatcctgaactt

SEQ ID NO: 7482818 - DNA, 22 bp, Homo sapiens
cccagagcataacgtatcttga

SEQ ID NO: 7482819 - DNA, 22 bp, Homo sapiens
cccagagcataacgtatcttga

SEQ ID NO: 7482820 - DNA, 22 bp, Homo sapiens
cccagagcataacgtatcttga

SEQ ID NO: 7482821 - DNA, 19 bp, Homo sapiens
cccagagcatcctgaactt

SEQ ID NO: 7482822 - DNA, 20 bp, Homo sapiens
cccagagcactttttcatgt

SEQ ID NO: 7482823 - DNA, 20 bp, Homo sapiens
cccagagcactttttcatgt

SEQ ID NO: 7482824 - DNA, 20 bp, Homo sapiens
cccagagcactttttcatgt

SEQ ID NO: 7482825 - DNA, 23 bp, Homo sapiens
cccagagcacagcctccagatgc

SEQ ID NO: 7482826 - DNA, 22 bp, Homo sapiens
cccagagcatgtgctgcctttg

SEQ ID NO: 7482827 - DNA, 22 bp, Homo sapiens
cccagagcatgtgctgcctttg

SEQ ID NO: 7482828 - DNA, 22 bp, Homo sapiens
cccagagcatgtgctgcctttg

SEQ ID NO: 7482829 - DNA, 22 bp, Homo sapiens
cccagagcatgtgctgcctttg

SEQ ID NO: 7482830 - DNA, 22 bp, Homo sapiens
cccagagcatgtgctgcctttg

SEQ ID NO: 7482831 - DNA, 22 bp, Homo sapiens
cccagagcatgtgctgcctttg

SEQ ID NO: 7482832 - DNA, 20 bp, Homo sapiens
cccagagccatagccagaca

SEQ ID NO: 7482833 - DNA, 20 bp, Homo sapiens
cccagagccatagccagaca

SEQ ID NO: 7482834 - DNA, 20 bp, Homo sapiens
cccagagccatagccagaca

SEQ ID NO: 7482835 - DNA, 20 bp, Homo sapiens
cccagagccatagccagaca

SEQ ID NO: 7482836 - DNA, 20 bp, Homo sapiens
cccagagccatagccagaca

SEQ ID NO: 7482837 - DNA, 20 bp, Homo sapiens
cccagagccatagccagaca

SEQ ID NO: 7482838 - DNA, 20 bp, Homo sapiens
cccagagccatagccagaca

SEQ ID NO: 7482839 - DNA, 20 bp, Homo sapiens
cccagagccatagccagaca

SEQ ID NO: 7482840 - DNA, 22 bp, Homo sapiens
cccagagccggtggtgctcaca

SEQ ID NO: 7482841 - DNA, 22 bp, Homo sapiens
cccagagccggtggtgctcaca

SEQ ID NO: 7482842 - DNA, 22 bp, Homo sapiens
cccagagccgctcccctacttc

SEQ ID NO: 7482843 - DNA, 22 bp, Homo sapiens
cccagagccgctcccctacttc

SEQ ID NO: 7482844 - DNA, 22 bp, Homo sapiens
cccagagccgctcccctacttc

SEQ ID NO: 7482845 - DNA, 22 bp, Homo sapiens
cccagagccgctcccctacttc

SEQ ID NO: 7482846 - DNA, 22 bp, Homo sapiens
cccagagccgctcccctacttc

SEQ ID NO: 7482847 - DNA, 22 bp, Homo sapiens
cccagagccgctcccctacttc

SEQ ID NO: 7482848 - DNA, 20 bp, Homo sapiens
cccagagccatagccagaca

SEQ ID NO: 7482849 - DNA, 20 bp, Homo sapiens
cccagagccatagccagaca

SEQ ID NO: 7482850 - DNA, 21 bp, Homo sapiens
cccagagcctagggagggcac

SEQ ID NO: 7482851 - DNA, 21 bp, Homo sapiens
cccagagcctagggagggcac

SEQ ID NO: 7482852 - DNA, 21 bp, Homo sapiens
cccagagcctagggagggcac

SEQ ID NO: 7482853 - DNA, 21 bp, Homo sapiens
cccagagcctagggagggcac

SEQ ID NO: 7482854 - DNA, 21 bp, Homo sapiens
cccagagcctagggagggcac

SEQ ID NO: 7482855 - DNA, 21 bp, Homo sapiens
cccagagcctagggagggcac

SEQ ID NO: 7482856 - DNA, 21 bp, Homo sapiens
cccagagcctagggagggcac

SEQ ID NO: 7482857 - DNA, 21 bp, Homo sapiens
cccagagcctagggagggcac

SEQ ID NO: 7482858 - DNA, 21 bp, Homo sapiens
cccagagcctagggagggcac

SEQ ID NO: 7482859 - DNA, 22 bp, Homo sapiens
aggctggcgtcaggggctgtac

SEQ ID NO: 7482860 - DNA, 22 bp, Homo sapiens
aggctggcgtcaggggctgtac

SEQ ID NO: 7482861 - DNA, 22 bp, Homo sapiens
aggctggcgtcaggggctgtac

SEQ ID NO: 7482862 - DNA, 22 bp, Homo sapiens
cccagagccggtggtgctcaca

SEQ ID NO: 7482863 - DNA, 22 bp, Homo sapiens
cccagagccggtggtgctcaca

SEQ ID NO: 7482864 - DNA, 22 bp, Homo sapiens
cccagagccggtggtgctcaca

SEQ ID NO: 7482865 - DNA, 22 bp, Homo sapiens
cccagagccggtggtgctcaca

SEQ ID NO: 7482866 - DNA, 21 bp, Homo sapiens
cccagagcctagggagggcac

SEQ ID NO: 7482867 - DNA, 22 bp, Homo sapiens
cccagagccggtggtgctcaca

SEQ ID NO: 7482868 - DNA, 22 bp, Homo sapiens
cccagagccggtggtgctcaca

SEQ ID NO: 7482869 - DNA, 22 bp, Homo sapiens
cccagagccggtggtgctcaca

SEQ ID NO: 7482870 - DNA, 22 bp, Homo sapiens
cccagagccggtggtgctcaca

SEQ ID NO: 7482871 - DNA, 17 bp, Homo sapiens
aggctggctcacaggga

SEQ ID NO: 7482872 - DNA, 17 bp, Homo sapiens
aggctggctcacaggga

SEQ ID NO: 7482873 - DNA, 17 bp, Homo sapiens
aggctggctcacaggga

SEQ ID NO: 7482874 - DNA, 17 bp, Homo sapiens
aggctggctcacaggga

SEQ ID NO: 7482875 - DNA, 17 bp, Homo sapiens
aggctggctcacaggga

SEQ ID NO: 7482876 - DNA, 17 bp, Homo sapiens
aggctggctcacaggga

SEQ ID NO: 7482877 - DNA, 17 bp, Homo sapiens
aggctggctcacaggga

SEQ ID NO: 7482878 - DNA, 17 bp, Homo sapiens
aggctggctcacaggga

SEQ ID NO: 7482879 - DNA, 22 bp, Homo sapiens
aggctggctcggcttttctgtc

SEQ ID NO: 7482880 - DNA, 22 bp, Homo sapiens
aggctggctgaaaaacaccctt

SEQ ID NO: 7482881 - DNA, 22 bp, Homo sapiens
aggctggctgacttctgaagca

SEQ ID NO: 7482882 - DNA, 22 bp, Homo sapiens
aggctggctgacttctgaagca

SEQ ID NO: 7482883 - DNA, 22 bp, Homo sapiens
aggctggctgacttctgaagca

SEQ ID NO: 7482884 - DNA, 22 bp, Homo sapiens
aggctggctgaaaaacaccctt

SEQ ID NO: 7482885 - DNA, 22 bp, Homo sapiens
aggctgcctcttttgagagggt

SEQ ID NO: 7482886 - DNA, 22 bp, Homo sapiens
aggctgcctctgcaggatccct

SEQ ID NO: 7482887 - DNA, 22 bp, Homo sapiens
aggctgcctcttttgagagggt

SEQ ID NO: 7482888 - DNA, 22 bp, Homo sapiens
aggctgcctcttttgagagggt

SEQ ID NO: 7482889 - DNA, 22 bp, Homo sapiens
aggctgcctcttttgagagggt

SEQ ID NO: 7482890 - DNA, 22 bp, Homo sapiens
aggctgcctcttttgagagggt

SEQ ID NO: 7482891 - DNA, 22 bp, Homo sapiens
aggctgcctcttttgagagggt

SEQ ID NO: 7482892 - DNA, 22 bp, Homo sapiens
aggctgcctcttttgagagggt

SEQ ID NO: 7482893 - DNA, 22 bp, Homo sapiens
aggctgcctggctgtgagtgaa

SEQ ID NO: 7482894 - DNA, 22 bp, Homo sapiens
aggctgcctggctgtgagtgaa

SEQ ID NO: 7482895 - DNA, 22 bp, Homo sapiens
aggctgcctggctgtgagtgaa

SEQ ID NO: 7482896 - DNA, 22 bp, Homo sapiens
aggctgcctggctgtgagtgaa

SEQ ID NO: 7482897 - DNA, 22 bp, Homo sapiens
aggctgcctggctgtgagtgaa

SEQ ID NO: 7482898 - DNA, 22 bp, Homo sapiens
aggctgcctggctgtgagtgaa

SEQ ID NO: 7482899 - DNA, 22 bp, Homo sapiens
aggctgcctcgtgagctcgctg

SEQ ID NO: 7482900 - DNA, 22 bp, Homo sapiens
aggctgcctcgtgagctcgctg

SEQ ID NO: 7482901 - DNA, 22 bp, Homo sapiens
aggctgcctcgtgagctcgctg

SEQ ID NO: 7482902 - DNA, 22 bp, Homo sapiens
aggctgcctcgtgagctcgctg

SEQ ID NO: 7482903 - DNA, 22 bp, Homo sapiens
aggctgcctctgcaggatccct

SEQ ID NO: 7482904 - DNA, 22 bp, Homo sapiens
aggctgcctctgcaggatccct

SEQ ID NO: 7482905 - DNA, 22 bp, Homo sapiens
aggctgcctctgcaggatccct

SEQ ID NO: 7482906 - DNA, 22 bp, Homo sapiens
aggctgcctctgcaggatccct

SEQ ID NO: 7482907 - DNA, 22 bp, Homo sapiens
aggctgcctctgcaggatccct

SEQ ID NO: 7482908 - DNA, 22 bp, Homo sapiens
aggctgcctctgcaggatccct

SEQ ID NO: 7482909 - DNA, 22 bp, Homo sapiens
aggctgcctgttccaatctcct

SEQ ID NO: 7482910 - DNA, 22 bp, Homo sapiens
aggctgcctgttccaatctcct

SEQ ID NO: 7482911 - DNA, 22 bp, Homo sapiens
aggctgcgttagcctcactccc

SEQ ID NO: 7482912 - DNA, 22 bp, Homo sapiens
aggctgctataaacattcccgt

SEQ ID NO: 7482913 - DNA, 22 bp, Homo sapiens
aggctgctcacctccctgtctg

SEQ ID NO: 7482914 - DNA, 22 bp, Homo sapiens
aggctgctcacctccctgtctg

SEQ ID NO: 7482915 - DNA, 22 bp, Homo sapiens
aggctgcctgttccaatctcct

SEQ ID NO: 7482916 - DNA, 22 bp, Homo sapiens
aggctgctataaacattcccgt

SEQ ID NO: 7482917 - DNA, 22 bp, Homo sapiens
aggctgctataaacattcccgt

SEQ ID NO: 7482918 - DNA, 22 bp, Homo sapiens
cccactgctgctctccatggca

SEQ ID NO: 7482919 - DNA, 22 bp, Homo sapiens
cccactgctgctctccatggca

SEQ ID NO: 7482920 - DNA, 22 bp, Homo sapiens
aggctgctcagtagatggagct

SEQ ID NO: 7482921 - DNA, 22 bp, Homo sapiens
aggctgctcacctccctgtctg

SEQ ID NO: 7482922 - DNA, 22 bp, Homo sapiens
cccactggcaatattatgagac

SEQ ID NO: 7482923 - DNA, 22 bp, Homo sapiens
cccactgctgctctccatggca

SEQ ID NO: 7482924 - DNA, 18 bp, Homo sapiens
cccactgtccccacaggc

SEQ ID NO: 7482925 - DNA, 22 bp, Homo sapiens
ccatgggagatgatggggagtg

SEQ ID NO: 7482926 - DNA, 22 bp, Homo sapiens
ccatgggagatgatggggagtg

SEQ ID NO: 7482927 - DNA, 22 bp, Homo sapiens
ccatgggagatgatggggagtg

SEQ ID NO: 7482928 - DNA, 22 bp, Homo sapiens
ccatgggaattgggaggtccca

SEQ ID NO: 7482929 - DNA, 22 bp, Homo sapiens
ccatgggaattgggaggtccca

SEQ ID NO: 7482930 - DNA, 22 bp, Homo sapiens
ccatgggcgcacaggcctggag

SEQ ID NO: 7482931 - DNA, 22 bp, Homo sapiens
ccatgggcactgggtggaggta

SEQ ID NO: 7482932 - DNA, 22 bp, Homo sapiens
ccatgggcactgggtggaggta

SEQ ID NO: 7482933 - DNA, 22 bp, Homo sapiens
ccatgggcactgggtggaggta

SEQ ID NO: 7482934 - DNA, 22 bp, Homo sapiens
ccatgggctggctgccttatca

SEQ ID NO: 7482935 - DNA, 22 bp, Homo sapiens
ccatgggcgcacaggcctggag

SEQ ID NO: 7482936 - DNA, 22 bp, Homo sapiens
ccatgtacatgaacacggcggc

SEQ ID NO: 7482937 - DNA, 22 bp, Homo sapiens
ccatggtctctgtgaagcctgt

SEQ ID NO: 7482938 - DNA, 22 bp, Homo sapiens
ccatgggctggctgccttatca

SEQ ID NO: 7482939 - DNA, 20 bp, Homo sapiens
aggctgcctaaggctctgca

SEQ ID NO: 7482940 - DNA, 22 bp, Homo sapiens
ccatgtggcaggaaggtgtttc

SEQ ID NO: 7482941 - DNA, 22 bp, Homo sapiens
ccatgtggctagcgtgcctgca

SEQ ID NO: 7482942 - DNA, 22 bp, Homo sapiens
ccatgtacatgaacacggcggc

SEQ ID NO: 7482943 - DNA, 22 bp, Homo sapiens
ccatgtccagaatgtgtcacgt

SEQ ID NO: 7482944 - DNA, 22 bp, Homo sapiens
ccatgtccagaatgtgtcacgt

SEQ ID NO: 7482945 - DNA, 22 bp, Homo sapiens
ccatgtacatgaacacggcggc

SEQ ID NO: 7482946 - DNA, 22 bp, Homo sapiens
ccatgtgcttgctctggcacct

SEQ ID NO: 7482947 - DNA, 22 bp, Homo sapiens
ccatgtgcttgctctggcacct

SEQ ID NO: 7482948 - DNA, 19 bp, Homo sapiens
aggctgcctcaccctccct

SEQ ID NO: 7482949 - DNA, 22 bp, Homo sapiens
aggctgcctcgtgagctcgctg

SEQ ID NO: 7482950 - DNA, 22 bp, Homo sapiens
aggctgcctcgtgagctcgctg

SEQ ID NO: 7482951 - DNA, 19 bp, Homo sapiens
aggctgcctcaccctccct

SEQ ID NO: 7482952 - DNA, 22 bp, Homo sapiens
aggctgcctaggttcaacacct

SEQ ID NO: 7482953 - DNA, 22 bp, Homo sapiens
aggctgcctaggttcaacacct

SEQ ID NO: 7482954 - DNA, 22 bp, Homo sapiens
aggctgcctaggttcaacacct

SEQ ID NO: 7482955 - DNA, 22 bp, Homo sapiens
aggctgcctaggttcaacacct

SEQ ID NO: 7482956 - DNA, 20 bp, Homo sapiens
aggctgcctaaggctctgca

SEQ ID NO: 7482957 - DNA, 20 bp, Homo sapiens
aggctgcctaaggctctgca

SEQ ID NO: 7482958 - DNA, 20 bp, Homo sapiens
aggctgcctaaggctctgca

SEQ ID NO: 7482959 - DNA, 20 bp, Homo sapiens
aggctgcctaaggctctgca

SEQ ID NO: 7482960 - DNA, 22 bp, Homo sapiens
aggccctgggcagttctgtagc

SEQ ID NO: 7482961 - DNA, 22 bp, Homo sapiens
aggccctgggagcagagatgca

SEQ ID NO: 7482962 - DNA, 22 bp, Homo sapiens
aggccctgggcagttctgtagc

SEQ ID NO: 7482963 - DNA, 22 bp, Homo sapiens
aggccctgggcagttctgtagc

SEQ ID NO: 7482964 - DNA, 22 bp, Homo sapiens
aggccctgggcagttctgtagc

SEQ ID NO: 7482965 - DNA, 22 bp, Homo sapiens
aggccctgggcagttctgtagc

SEQ ID NO: 7482966 - DNA, 22 bp, Homo sapiens
aggccctgggttagggcccact

SEQ ID NO: 7482967 - DNA, 22 bp, Homo sapiens
aggccctgggttagggcccact

SEQ ID NO: 7482968 - DNA, 22 bp, Homo sapiens
aggccctggggtctgttaaatt

SEQ ID NO: 7482969 - DNA, 22 bp, Homo sapiens
aggccctgggttagggcccact

SEQ ID NO: 7482970 - DNA, 22 bp, Homo sapiens
aggccctgggttagggcccact

SEQ ID NO: 7482971 - DNA, 22 bp, Homo sapiens
aggccctgggttagggcccact

SEQ ID NO: 7482972 - DNA, 22 bp, Homo sapiens
aggccctggggtctgttaaatt

SEQ ID NO: 7482973 - DNA, 22 bp, Homo sapiens
aggccctggggtctgttaaatt

SEQ ID NO: 7482974 - DNA, 22 bp, Homo sapiens
ccaggacaattcgtcactttct

SEQ ID NO: 7482975 - DNA, 22 bp, Homo sapiens
ccaggacaattcgtcactttct

SEQ ID NO: 7482976 - DNA, 22 bp, Homo sapiens
ccaggacaattcgtcactttct

SEQ ID NO: 7482977 - DNA, 22 bp, Homo sapiens
ccaggacaattcgtcactttct

SEQ ID NO: 7482978 - DNA, 22 bp, Homo sapiens
ccaggacaagtgtggccatggc

SEQ ID NO: 7482979 - DNA, 22 bp, Homo sapiens
ccaggacaagtgtggccatggc

SEQ ID NO: 7482980 - DNA, 22 bp, Homo sapiens
ccaggacaagtgtggccatggc

SEQ ID NO: 7482981 - DNA, 22 bp, Homo sapiens
ccaggacaagtgtggccatggc

SEQ ID NO: 7482982 - DNA, 22 bp, Homo sapiens
ccaggacaagtgtggccatggc

SEQ ID NO: 7482983 - DNA, 22 bp, Homo sapiens
ccaggacaagtgtggccatggc

SEQ ID NO: 7482984 - DNA, 22 bp, Homo sapiens
ccaggacaagtgtggccatggc

SEQ ID NO: 7482985 - DNA, 22 bp, Homo sapiens
aggccctgggagcagagatgca

SEQ ID NO: 7482986 - DNA, 22 bp, Homo sapiens
aggccctgggagcagagatgca

SEQ ID NO: 7482987 - DNA, 22 bp, Homo sapiens
aggccctgggagcagagatgca

SEQ ID NO: 7482988 - DNA, 22 bp, Homo sapiens
aggccctgggagcagagatgca

SEQ ID NO: 7482989 - DNA, 22 bp, Homo sapiens
aggccctggctgggtttcttta

SEQ ID NO: 7482990 - DNA, 22 bp, Homo sapiens
aggccctggcctgactcaatgt

SEQ ID NO: 7482991 - DNA, 22 bp, Homo sapiens
aggccctggctgggtttcttta

SEQ ID NO: 7482992 - DNA, 22 bp, Homo sapiens
aggccctgggcagttctgtagc

SEQ ID NO: 7482993 - DNA, 22 bp, Homo sapiens
aggccctgggagcagagatgca

SEQ ID NO: 7482994 - DNA, 22 bp, Homo sapiens
aggccctgggagcagagatgca

SEQ ID NO: 7482995 - DNA, 22 bp, Homo sapiens
aggccctgggagcagagatgca

SEQ ID NO: 7482996 - DNA, 18 bp, Homo sapiens
aggccctggcctcgaaca

SEQ ID NO: 7482997 - DNA, 18 bp, Homo sapiens
aggccctggcctcgaaca

SEQ ID NO: 7482998 - DNA, 18 bp, Homo sapiens
aggccctggcctcgaaca

SEQ ID NO: 7482999 - DNA, 18 bp, Homo sapiens
aggccctggcctcgaaca

SEQ ID NO: 7483000 - DNA, 22 bp, Homo sapiens
aggccctggcctgactcaatgt

SEQ ID NO: 7483001 - DNA, 18 bp, Homo sapiens
aggccctggcctcgaaca

SEQ ID NO: 7483002 - DNA, 22 bp, Homo sapiens
ccagcttttcttatcattataa

SEQ ID NO: 7483003 - DNA, 22 bp, Homo sapiens
ccagctttctcagaggcttcta

SEQ ID NO: 7483004 - DNA, 22 bp, Homo sapiens
aggccctggcccccagagattc

SEQ ID NO: 7483005 - DNA, 22 bp, Homo sapiens
aggccctggcccccagagattc

SEQ ID NO: 7483006 - DNA, 22 bp, Homo sapiens
aggccctggcccccagagattc

SEQ ID NO: 7483007 - DNA, 22 bp, Homo sapiens
aggccctggcccccagagattc

SEQ ID NO: 7483008 - DNA, 22 bp, Homo sapiens
aggccctggcccccagagattc

SEQ ID NO: 7483009 - DNA, 22 bp, Homo sapiens
aggccctggcccccagagattc

SEQ ID NO: 7483010 - DNA, 22 bp, Homo sapiens
aggccctggcccccagagattc

SEQ ID NO: 7483011 - DNA, 22 bp, Homo sapiens
aggccctggcccccagagattc

SEQ ID NO: 7483012 - DNA, 22 bp, Homo sapiens
aggccctggcactgcctgggag

SEQ ID NO: 7483013 - DNA, 22 bp, Homo sapiens
aggccctggcactgcctgggag

SEQ ID NO: 7483014 - DNA, 22 bp, Homo sapiens
aggccctggcactgcctgggag

SEQ ID NO: 7483015 - DNA, 22 bp, Homo sapiens
aggccctggcactgcctgggag

SEQ ID NO: 7483016 - DNA, 22 bp, Homo sapiens
aggccctggcactgcctgggag

SEQ ID NO: 7483017 - DNA, 22 bp, Homo sapiens
aggccctggcactgcctgggag

SEQ ID NO: 7483018 - DNA, 22 bp, Homo sapiens
ccaggaaaaacacattgaagag

SEQ ID NO: 7483019 - DNA, 22 bp, Homo sapiens
ccaggaaaaacacattgaagag

SEQ ID NO: 7483020 - DNA, 22 bp, Homo sapiens
aggccctggcactgcctgggag

SEQ ID NO: 7483021 - DNA, 22 bp, Homo sapiens
aggccctggcactgcctgggag

SEQ ID NO: 7483022 - DNA, 22 bp, Homo sapiens
aggccctggcactgcctgggag

SEQ ID NO: 7483023 - DNA, 22 bp, Homo sapiens
ccaggagcaaagatcactggga

SEQ ID NO: 7483024 - DNA, 22 bp, Homo sapiens
ccaggagcaaagatcactggga

SEQ ID NO: 7483025 - DNA, 22 bp, Homo sapiens
ccaggagcaaagatcactggga

SEQ ID NO: 7483026 - DNA, 22 bp, Homo sapiens
ccaggagatttttccatagcac

SEQ ID NO: 7483027 - DNA, 22 bp, Homo sapiens
ccaggagcaaagatcactggga

SEQ ID NO: 7483028 - DNA, 22 bp, Homo sapiens
ccaggagcaaagatcactggga

SEQ ID NO: 7483029 - DNA, 22 bp, Homo sapiens
ccaggagatttttccatagcac

SEQ ID NO: 7483030 - DNA, 22 bp, Homo sapiens
ccaggagatttttccatagcac

SEQ ID NO: 7483031 - DNA, 22 bp, Homo sapiens
ccaggagatttttccatagcac

SEQ ID NO: 7483032 - DNA, 22 bp, Homo sapiens
ccaggagatttttccatagcac

SEQ ID NO: 7483033 - DNA, 22 bp, Homo sapiens
ccaggagatttttccatagcac

SEQ ID NO: 7483034 - DNA, 22 bp, Homo sapiens
ccaggagatttttccatagcac

SEQ ID NO: 7483035 - DNA, 22 bp, Homo sapiens
ccaggagcgcgtgaacaggctg

SEQ ID NO: 7483036 - DNA, 22 bp, Homo sapiens
ccaggagcgggaaaaggaagaa

SEQ ID NO: 7483037 - DNA, 17 bp, Homo sapiens
ccaggagcgtgggtctc

SEQ ID NO: 7483038 - DNA, 22 bp, Homo sapiens
ccaggagcgggaaaaggaagaa

SEQ ID NO: 7483039 - DNA, 22 bp, Homo sapiens
ccaggagcgggaaaaggaagaa

SEQ ID NO: 7483040 - DNA, 22 bp, Homo sapiens
ccaggagcgggaaaaggaagaa

SEQ ID NO: 7483041 - DNA, 22 bp, Homo sapiens
ccaggagcgggaaaaggaagaa

SEQ ID NO: 7483042 - DNA, 22 bp, Homo sapiens
ccaggagcgggaaaaggaagaa

SEQ ID NO: 7483043 - DNA, 22 bp, Homo sapiens
ccaggagatgggagcatctaaa

SEQ ID NO: 7483044 - DNA, 22 bp, Homo sapiens
ccaggagatgggagcatctaaa

SEQ ID NO: 7483045 - DNA, 22 bp, Homo sapiens
ccaggagatgggaaagtagcag

SEQ ID NO: 7483046 - DNA, 22 bp, Homo sapiens
ccaggagatgggaaagtagcag

SEQ ID NO: 7483047 - DNA, 22 bp, Homo sapiens
ccaggagatgggaaagtagcag

SEQ ID NO: 7483048 - DNA, 22 bp, Homo sapiens
ccaggagatgggaaagtagcag

SEQ ID NO: 7483049 - DNA, 22 bp, Homo sapiens
ccaggagatgggaaagtagcag

SEQ ID NO: 7483050 - DNA, 22 bp, Homo sapiens
ccaggagatgggaaagtagcag

SEQ ID NO: 7483051 - DNA, 22 bp, Homo sapiens
ccaggagatgggaaagtagcag

SEQ ID NO: 7483052 - DNA, 22 bp, Homo sapiens
ccaggagatgggaaagtagcag

SEQ ID NO: 7483053 - DNA, 22 bp, Homo sapiens
ccaggagatgggaaagtagcag

SEQ ID NO: 7483054 - DNA, 22 bp, Homo sapiens
ccaggagatgggaaagtagcag

SEQ ID NO: 7483055 - DNA, 22 bp, Homo sapiens
ccaggagatgatgttggggatt

SEQ ID NO: 7483056 - DNA, 22 bp, Homo sapiens
ccaggagatgatgttggggatt

SEQ ID NO: 7483057 - DNA, 22 bp, Homo sapiens
ccaggagataagctgagtttat

SEQ ID NO: 7483058 - DNA, 19 bp, Homo sapiens
ccaggagagcttggagaag

SEQ ID NO: 7483059 - DNA, 19 bp, Homo sapiens
ccaggagagcttggagaag

SEQ ID NO: 7483060 - DNA, 19 bp, Homo sapiens
ccaggagagcttggagaag

SEQ ID NO: 7483061 - DNA, 22 bp, Homo sapiens
ccaggagataagctgagtttat

SEQ ID NO: 7483062 - DNA, 22 bp, Homo sapiens
ccaggagataagctgagtttat

SEQ ID NO: 7483063 - DNA, 22 bp, Homo sapiens
ccaggagataagctgagtttat

SEQ ID NO: 7483064 - DNA, 22 bp, Homo sapiens
ccaggagagctctcgttcagtg

SEQ ID NO: 7483065 - DNA, 22 bp, Homo sapiens
ccaggagagctctcgttcagtg

SEQ ID NO: 7483066 - DNA, 22 bp, Homo sapiens
ccaggagagctctcgttcagtg

SEQ ID NO: 7483067 - DNA, 22 bp, Homo sapiens
ccaggagagctctaaatggctg

SEQ ID NO: 7483068 - DNA, 22 bp, Homo sapiens
ccaggagagctctaaatggctg

SEQ ID NO: 7483069 - DNA, 22 bp, Homo sapiens
ccaggagagctctaaatggctg

SEQ ID NO: 7483070 - DNA, 22 bp, Homo sapiens
ccaggagagctctaaatggctg

SEQ ID NO: 7483071 - DNA, 22 bp, Homo sapiens
ccaggagagctctaaatggctg

SEQ ID NO: 7483072 - DNA, 22 bp, Homo sapiens
ccaggagagcgccctcccggcc

SEQ ID NO: 7483073 - DNA, 22 bp, Homo sapiens
ccaggagagcgccctcccggcc

SEQ ID NO: 7483074 - DNA, 22 bp, Homo sapiens
ccaggagagcgccctcccggcc

SEQ ID NO: 7483075 - DNA, 22 bp, Homo sapiens
ccaggagagcattgcacagagg

SEQ ID NO: 7483076 - DNA, 22 bp, Homo sapiens
ccaggagagcgccctcccggcc

SEQ ID NO: 7483077 - DNA, 22 bp, Homo sapiens
ccaggagagcgccctcccggcc

SEQ ID NO: 7483078 - DNA, 22 bp, Homo sapiens
ccaggagagcattgcacagagg

SEQ ID NO: 7483079 - DNA, 22 bp, Homo sapiens
ccaggagagcattgcacagagg

SEQ ID NO: 7483080 - DNA, 22 bp, Homo sapiens
ccaggagagcattgcacagagg

SEQ ID NO: 7483081 - DNA, 22 bp, Homo sapiens
ccaggagagcattgcacagagg

SEQ ID NO: 7483082 - DNA, 22 bp, Homo sapiens
ccaggagagcattgcacagagg

SEQ ID NO: 7483083 - DNA, 22 bp, Homo sapiens
ccaggagagcattgcacagagg

SEQ ID NO: 7483084 - DNA, 22 bp, Homo sapiens
ccaggagagcattgcacagagg

SEQ ID NO: 7483085 - DNA, 22 bp, Homo sapiens
ccaggagagcattgcacagagg

SEQ ID NO: 7483086 - DNA, 22 bp, Homo sapiens
ccaggagagcagaagcccaggc

SEQ ID NO: 7483087 - DNA, 22 bp, Homo sapiens
ccaggagagcagaagcccaggc

SEQ ID NO: 7483088 - DNA, 22 bp, Homo sapiens
ccaggagagcagaagcccaggc

SEQ ID NO: 7483089 - DNA, 22 bp, Homo sapiens
ccaggagagcagaagcccaggc

SEQ ID NO: 7483090 - DNA, 22 bp, Homo sapiens
ccaggagagcagaagcccaggc

SEQ ID NO: 7483091 - DNA, 22 bp, Homo sapiens
ccaggagagcagaagcccaggc

SEQ ID NO: 7483092 - DNA, 22 bp, Homo sapiens
ccaggagagcagaagcccaggc

SEQ ID NO: 7483093 - DNA, 22 bp, Homo sapiens
ccaggagagcagaagcccaggc

SEQ ID NO: 7483094 - DNA, 22 bp, Homo sapiens
ccaggagagcaggcgtgcagct

SEQ ID NO: 7483095 - DNA, 22 bp, Homo sapiens
ccaggagagcaggcgtgcagct

SEQ ID NO: 7483096 - DNA, 22 bp, Homo sapiens
ccaggagagcaggcgtgcagct

SEQ ID NO: 7483097 - DNA, 22 bp, Homo sapiens
ccaggagagcaggcgtgcagct

SEQ ID NO: 7483098 - DNA, 22 bp, Homo sapiens
ccaggagagcaggcgtgcagct

SEQ ID NO: 7483099 - DNA, 22 bp, Homo sapiens
ccaggagagcaggcgtgcagct

SEQ ID NO: 7483100 - DNA, 22 bp, Homo sapiens
ccaggagagcattgcacagagg

SEQ ID NO: 7483101 - DNA, 22 bp, Homo sapiens
ccaggagagcattgcacagagg

SEQ ID NO: 7483102 - DNA, 22 bp, Homo sapiens
ccaggagagcattgcacagagg

SEQ ID NO: 7483103 - DNA, 22 bp, Homo sapiens
ccaggagagcaggcgtgcagct

SEQ ID NO: 7483104 - DNA, 22 bp, Homo sapiens
ccaggagagcaggcgtgcagct

SEQ ID NO: 7483105 - DNA, 22 bp, Homo sapiens
ccaggagagcaggcgtgcagct

SEQ ID NO: 7483106 - DNA, 22 bp, Homo sapiens
ccaggagagcaggcgtgcagct

SEQ ID NO: 7483107 - DNA, 22 bp, Homo sapiens
ccagcctgaaatgcctcatcct

SEQ ID NO: 7483108 - DNA, 22 bp, Homo sapiens
ccagcctgaaatgcctcatcct

SEQ ID NO: 7483109 - DNA, 22 bp, Homo sapiens
ccagcctgaaatgcctcatcct

SEQ ID NO: 7483110 - DNA, 22 bp, Homo sapiens
ccagcctgaaatgcctcatcct

SEQ ID NO: 7483111 - DNA, 23 bp, Homo sapiens
ccagcctctgggtcttcatccag

SEQ ID NO: 7483112 - DNA, 23 bp, Homo sapiens
ccagcctctgggtcttcatccag

SEQ ID NO: 7483113 - DNA, 23 bp, Homo sapiens
ccagcctctgggtcttcatccag

SEQ ID NO: 7483114 - DNA, 23 bp, Homo sapiens
ccagcctctgggtcttcatccag

SEQ ID NO: 7483115 - DNA, 23 bp, Homo sapiens
ccagcctctgggtcttcatccag

SEQ ID NO: 7483116 - DNA, 22 bp, Homo sapiens
ccagcctgaaatgcctcatcct

SEQ ID NO: 7483117 - DNA, 22 bp, Homo sapiens
ccagcctgaaatgcctcatcct

SEQ ID NO: 7483118 - DNA, 22 bp, Homo sapiens
ccagcctgaaatgcctcatcct

SEQ ID NO: 7483119 - DNA, 22 bp, Homo sapiens
ccagcctgaaatgcctcatcct

SEQ ID NO: 7483120 - DNA, 22 bp, Homo sapiens
ccagcctgaaatgcctcatcct

SEQ ID NO: 7483121 - DNA, 22 bp, Homo sapiens
ccagcctgaaatgcctcatcct

SEQ ID NO: 7483122 - DNA, 22 bp, Homo sapiens
ccagcctccatgtagatagctg

SEQ ID NO: 7483123 - DNA, 22 bp, Homo sapiens
ccagcctccatgtagatagctg

SEQ ID NO: 7483124 - DNA, 22 bp, Homo sapiens
ccagcctccatgtagatagctg

SEQ ID NO: 7483125 - DNA, 22 bp, Homo sapiens
ccagcctccatgtagatagctg

SEQ ID NO: 7483126 - DNA, 22 bp, Homo sapiens
ccagcctccatgtagatagctg

SEQ ID NO: 7483127 - DNA, 22 bp, Homo sapiens
ccagcctccatgtagatagctg

SEQ ID NO: 7483128 - DNA, 22 bp, Homo sapiens
ccagcctcatcgcctgcctgtc

SEQ ID NO: 7483129 - DNA, 22 bp, Homo sapiens
ccagcctcatcgcctgcctgtc

SEQ ID NO: 7483130 - DNA, 22 bp, Homo sapiens
ccagcctcatcgcctgcctgtc

SEQ ID NO: 7483131 - DNA, 22 bp, Homo sapiens
ccagcctcatcgcctgcctgtc

SEQ ID NO: 7483132 - DNA, 22 bp, Homo sapiens
ccagcctcatcgcctgcctgtc

SEQ ID NO: 7483133 - DNA, 22 bp, Homo sapiens
ccagcctccatgtagatagctg

SEQ ID NO: 7483134 - DNA, 22 bp, Homo sapiens
ccagcctccatgtagatagctg

SEQ ID NO: 7483135 - DNA, 19 bp, Homo sapiens
ccagcctctcttccacccc

SEQ ID NO: 7483136 - DNA, 22 bp, Homo sapiens
ccagcctccatgtagatagctg

SEQ ID NO: 7483137 - DNA, 19 bp, Homo sapiens
ccagcctctcttccacccc

SEQ ID NO: 7483138 - DNA, 22 bp, Homo sapiens
ccagcctccatgtagatagctg

SEQ ID NO: 7483139 - DNA, 19 bp, Homo sapiens
ccagcctctcttccacccc

SEQ ID NO: 7483140 - DNA, 22 bp, Homo sapiens
ccagcctcatcgcctgcctgtc

SEQ ID NO: 7483141 - DNA, 22 bp, Homo sapiens
ccagcctcatcgcctgcctgtc

SEQ ID NO: 7483142 - DNA, 22 bp, Homo sapiens
ccagcctcatcatattcctgct

SEQ ID NO: 7483143 - DNA, 22 bp, Homo sapiens
ccagcctcatcgcctgcctgtc

SEQ ID NO: 7483144 - DNA, 22 bp, Homo sapiens
ccagcctcatcgcctgcctgtc

SEQ ID NO: 7483145 - DNA, 22 bp, Homo sapiens
ccagcctcatcgcctgcctgtc

SEQ ID NO: 7483146 - DNA, 22 bp, Homo sapiens
ccagcctcatcgcctgcctgtc

SEQ ID NO: 7483147 - DNA, 22 bp, Homo sapiens
ccagcctcatcgcctgcctgtc

SEQ ID NO: 7483148 - DNA, 22 bp, Homo sapiens
ccagccctgccagagagagctg

SEQ ID NO: 7483149 - DNA, 22 bp, Homo sapiens
aggccagatgtcgggctagaag

SEQ ID NO: 7483150 - DNA, 22 bp, Homo sapiens
ccagccctgccagagagagctg

SEQ ID NO: 7483151 - DNA, 22 bp, Homo sapiens
aggccagatgtcgggctagaag

SEQ ID NO: 7483152 - DNA, 22 bp, Homo sapiens
aggccagatgtcgggctagaag

SEQ ID NO: 7483153 - DNA, 22 bp, Homo sapiens
ccagccctgccagagagagctg

SEQ ID NO: 7483154 - DNA, 22 bp, Homo sapiens
ccagccctgccagagagagctg

SEQ ID NO: 7483155 - DNA, 22 bp, Homo sapiens
ccagccctgccagagagagctg

SEQ ID NO: 7483156 - DNA, 17 bp, Homo sapiens
aggccagatgaggcaag

SEQ ID NO: 7483157 - DNA, 17 bp, Homo sapiens
aggccagatgaggcaag

SEQ ID NO: 7483158 - DNA, 17 bp, Homo sapiens
aggccagatgaggcaag

SEQ ID NO: 7483159 - DNA, 17 bp, Homo sapiens
aggccagatgaggcaag

SEQ ID NO: 7483160 - DNA, 17 bp, Homo sapiens
aggccagatgaggcaag

SEQ ID NO: 7483161 - DNA, 22 bp, Homo sapiens
aggccagatattgtgctaccca

SEQ ID NO: 7483162 - DNA, 22 bp, Homo sapiens
aggccagatattgtgctaccca

SEQ ID NO: 7483163 - DNA, 22 bp, Homo sapiens
aggccagatattgtgctaccca

SEQ ID NO: 7483164 - DNA, 17 bp, Homo sapiens
aggccagatgaggcaag

SEQ ID NO: 7483165 - DNA, 22 bp, Homo sapiens
aggccagagttaaggagaacag

SEQ ID NO: 7483166 - DNA, 22 bp, Homo sapiens
aggccagagttaaggagaacag

SEQ ID NO: 7483167 - DNA, 22 bp, Homo sapiens
aggccagagttaaggagaacag

SEQ ID NO: 7483168 - DNA, 22 bp, Homo sapiens
aggccagagttaaggagaacag

SEQ ID NO: 7483169 - DNA, 22 bp, Homo sapiens
aggccagagttaaggagaacag

SEQ ID NO: 7483170 - DNA, 22 bp, Homo sapiens
aggccagagttaaggagaacag

SEQ ID NO: 7483171 - DNA, 22 bp, Homo sapiens
aggcccagagagccagttagtg

SEQ ID NO: 7483172 - DNA, 22 bp, Homo sapiens
aggcccagagagccagttagtg

SEQ ID NO: 7483173 - DNA, 22 bp, Homo sapiens
aggcccagagagccagttagtg

SEQ ID NO: 7483174 - DNA, 22 bp, Homo sapiens
aggcccagagagccagttagtg

SEQ ID NO: 7483175 - DNA, 22 bp, Homo sapiens
ccagcctggactgggtcttgtg

SEQ ID NO: 7483176 - DNA, 22 bp, Homo sapiens
ccagcctggactgggtcttgtg

SEQ ID NO: 7483177 - DNA, 22 bp, Homo sapiens
ccagcctggactgggtcttgtg

SEQ ID NO: 7483178 - DNA, 22 bp, Homo sapiens
ccagcctggactgggtcttgtg

SEQ ID NO: 7483179 - DNA, 22 bp, Homo sapiens
ccagcctggactgggtcttgtg

SEQ ID NO: 7483180 - DNA, 22 bp, Homo sapiens
aggcccagagcaggaaagggtt

SEQ ID NO: 7483181 - DNA, 22 bp, Homo sapiens
aggcccagagcaggaaagggtt

SEQ ID NO: 7483182 - DNA, 22 bp, Homo sapiens
aggcccagagcaggaaagggtt

SEQ ID NO: 7483183 - DNA, 22 bp, Homo sapiens
aggcccagagagccagttagtg

SEQ ID NO: 7483184 - DNA, 21 bp, Homo sapiens
aggcccagagtcttgggggga

SEQ ID NO: 7483185 - DNA, 21 bp, Homo sapiens
aggcccagagtcttgggggga

SEQ ID NO: 7483186 - DNA, 22 bp, Homo sapiens
aggcccagagcaggaaagggtt

SEQ ID NO: 7483187 - DNA, 22 bp, Homo sapiens
aggcccagagcaggaaagggtt

SEQ ID NO: 7483188 - DNA, 19 bp, Homo sapiens
aggcccagcgctgggggct

SEQ ID NO: 7483189 - DNA, 19 bp, Homo sapiens
aggcccagcgctgggggct

SEQ ID NO: 7483190 - DNA, 19 bp, Homo sapiens
aggcccagcgctgggggct

SEQ ID NO: 7483191 - DNA, 19 bp, Homo sapiens
aggcccagcgctgggggct

SEQ ID NO: 7483192 - DNA, 19 bp, Homo sapiens
aggcccagcgctgggggct

SEQ ID NO: 7483193 - DNA, 22 bp, Homo sapiens
aggcccagcccgtcctcgtgct

SEQ ID NO: 7483194 - DNA, 19 bp, Homo sapiens
aggcccagcgctgggggct

SEQ ID NO: 7483195 - DNA, 22 bp, Homo sapiens
aggcccagctggacaaactgct

SEQ ID NO: 7483196 - DNA, 22 bp, Homo sapiens
aggcccagctggacaaactgct

SEQ ID NO: 7483197 - DNA, 22 bp, Homo sapiens
aggcccagctggacaaactgct

SEQ ID NO: 7483198 - DNA, 19 bp, Homo sapiens
aggcccagcgctgggggct

SEQ ID NO: 7483199 - DNA, 22 bp, Homo sapiens
aggcccagcccgtcctcgtgct

SEQ ID NO: 7483200 - DNA, 22 bp, Homo sapiens
aggcccagcccgtcctcgtgct

SEQ ID NO: 7483201 - DNA, 22 bp, Homo sapiens
aggcccagcccgtcctcgtgct

SEQ ID NO: 7483202 - DNA, 22 bp, Homo sapiens
aggcccagcccgtcctcgtgct

SEQ ID NO: 7483203 - DNA, 22 bp, Homo sapiens
aggcccagcccgtcctcgtgct

SEQ ID NO: 7483204 - DNA, 22 bp, Homo sapiens
aggcccagcccgtcctcgtgct

SEQ ID NO: 7483205 - DNA, 22 bp, Homo sapiens
aggcccagcccgtcctcgtgct

SEQ ID NO: 7483206 - DNA, 22 bp, Homo sapiens
aggcccagctggacaaactgct

SEQ ID NO: 7483207 - DNA, 22 bp, Homo sapiens
aggcccagctggacaaactgct

SEQ ID NO: 7483208 - DNA, 19 bp, Homo sapiens
ccagctggcctgggacctc

SEQ ID NO: 7483209 - DNA, 19 bp, Homo sapiens
ccagctggcctgggacctc

SEQ ID NO: 7483210 - DNA, 19 bp, Homo sapiens
ccagctggcctgggacctc

SEQ ID NO: 7483211 - DNA, 19 bp, Homo sapiens
ccagctggcctgggacctc

SEQ ID NO: 7483212 - DNA, 22 bp, Homo sapiens
ccagctggcccagctgtgctcc

SEQ ID NO: 7483213 - DNA, 22 bp, Homo sapiens
ccagctggcccagctgtgctcc

SEQ ID NO: 7483214 - DNA, 19 bp, Homo sapiens
ccagctggcctgggacctc

SEQ ID NO: 7483215 - DNA, 22 bp, Homo sapiens
ccagcttctctctgatgcagct

SEQ ID NO: 7483216 - DNA, 22 bp, Homo sapiens
ccagcttctctgttccagcccc

SEQ ID NO: 7483217 - DNA, 22 bp, Homo sapiens
ccagcttctctctgatgcagct

SEQ ID NO: 7483218 - DNA, 22 bp, Homo sapiens
ccagctttatagcttcaaagga

SEQ ID NO: 7483219 - DNA, 22 bp, Homo sapiens
ccagctttcatatcatgaggta

SEQ ID NO: 7483220 - DNA, 22 bp, Homo sapiens
ccagcttgttccttagactctg

SEQ ID NO: 7483221 - DNA, 22 bp, Homo sapiens
ccagcttgttccttagactctg

SEQ ID NO: 7483222 - DNA, 22 bp, Homo sapiens
ccagcttggagtaacaaatggt

SEQ ID NO: 7483223 - DNA, 22 bp, Homo sapiens
ccagcttgaagatgtgctggtt

SEQ ID NO: 7483224 - DNA, 22 bp, Homo sapiens
ccagcttggaatatgccattgt

SEQ ID NO: 7483225 - DNA, 22 bp, Homo sapiens
ccagcttggagtaacaaatggt

SEQ ID NO: 7483226 - DNA, 22 bp, Homo sapiens
ccagcttgtttgaagctcgtca

SEQ ID NO: 7483227 - DNA, 22 bp, Homo sapiens
ccagcttgtttgaagctcgtca

SEQ ID NO: 7483228 - DNA, 22 bp, Homo sapiens
aggcaggggagctggaagggta

SEQ ID NO: 7483229 - DNA, 22 bp, Homo sapiens
aggcaggggagctggaagggta

SEQ ID NO: 7483230 - DNA, 22 bp, Homo sapiens
aggcaggggagctggaagggta

SEQ ID NO: 7483231 - DNA, 22 bp, Homo sapiens
aggcaggggagctggaagggta

SEQ ID NO: 7483232 - DNA, 22 bp, Homo sapiens
aggcagggtcttgctatgttgc

SEQ ID NO: 7483233 - DNA, 22 bp, Homo sapiens
aggcagggtcttgctatgttgc

SEQ ID NO: 7483234 - DNA, 22 bp, Homo sapiens
aggcagggtcttgctatgttgc

SEQ ID NO: 7483235 - DNA, 22 bp, Homo sapiens
aggcagggtcttgctatgttgc

SEQ ID NO: 7483236 - DNA, 22 bp, Homo sapiens
aggcagggtcttgctatgttgc

SEQ ID NO: 7483237 - DNA, 22 bp, Homo sapiens
aggcagggtgatgataatgatt

SEQ ID NO: 7483238 - DNA, 22 bp, Homo sapiens
aggcagggtcttgctatgttgc

SEQ ID NO: 7483239 - DNA, 22 bp, Homo sapiens
aggcagggtgatgataatgatt

SEQ ID NO: 7483240 - DNA, 22 bp, Homo sapiens
aggcaggggagctggaagggta

SEQ ID NO: 7483241 - DNA, 22 bp, Homo sapiens
aggcaggggagctggaagggta

SEQ ID NO: 7483242 - DNA, 22 bp, Homo sapiens
aggcaggggagctggaagggta

SEQ ID NO: 7483243 - DNA, 22 bp, Homo sapiens
aggcaggggagctggaagggta

SEQ ID NO: 7483244 - DNA, 22 bp, Homo sapiens
aggcaggggagctggaagggta

SEQ ID NO: 7483245 - DNA, 22 bp, Homo sapiens
aggcaggggagctggaagggta

SEQ ID NO: 7483246 - DNA, 22 bp, Homo sapiens
aggcaggggagctggaagggta

SEQ ID NO: 7483247 - DNA, 22 bp, Homo sapiens
aggcaggggagctggaagggta

SEQ ID NO: 7483248 - DNA, 22 bp, Homo sapiens
aggcaggctggtctgaagagtg

SEQ ID NO: 7483249 - DNA, 22 bp, Homo sapiens
aggcaggggagctggaagggta

SEQ ID NO: 7483250 - DNA, 22 bp, Homo sapiens
aggcaggggagctggaagggta

SEQ ID NO: 7483251 - DNA, 22 bp, Homo sapiens
aggcaggggagctggaagggta

SEQ ID NO: 7483252 - DNA, 22 bp, Homo sapiens
ccaatactgttgattcatagtg

SEQ ID NO: 7483253 - DNA, 22 bp, Homo sapiens
ccacaggacacaactgctgacc

SEQ ID NO: 7483254 - DNA, 22 bp, Homo sapiens
ccacaggaagttatgagtacta

SEQ ID NO: 7483255 - DNA, 22 bp, Homo sapiens
ccacaggacacaactgctgacc

SEQ ID NO: 7483256 - DNA, 22 bp, Homo sapiens
ccacaggacacaactgctgacc

SEQ ID NO: 7483257 - DNA, 22 bp, Homo sapiens
ccacaggacagttaatgtgcag

SEQ ID NO: 7483258 - DNA, 22 bp, Homo sapiens
ccacaggacagttaatgtgcag

SEQ ID NO: 7483259 - DNA, 22 bp, Homo sapiens
ccacaggacagttaatgtgcag

SEQ ID NO: 7483260 - DNA, 22 bp, Homo sapiens
ccacaggacacaactgctgacc

SEQ ID NO: 7483261 - DNA, 22 bp, Homo sapiens
ccacaggaagttatgagtacta

SEQ ID NO: 7483262 - DNA, 22 bp, Homo sapiens
ccacagcttcttatatcactgg

SEQ ID NO: 7483263 - DNA, 22 bp, Homo sapiens
aggcagggtgatgataatgatt

SEQ ID NO: 7483264 - DNA, 22 bp, Homo sapiens
ccacagcttcgcagtctgctgc

SEQ ID NO: 7483265 - DNA, 22 bp, Homo sapiens
ccacagcttcgcagtctgctgc

SEQ ID NO: 7483266 - DNA, 22 bp, Homo sapiens
ccacagcttcgcagtctgctgc

SEQ ID NO: 7483267 - DNA, 21 bp, Homo sapiens
ccacagctggtctctgagccc

SEQ ID NO: 7483268 - DNA, 17 bp, Homo sapiens
ccacagctgggtgcctt

SEQ ID NO: 7483269 - DNA, 17 bp, Homo sapiens
ccacagctgggtgcctt

SEQ ID NO: 7483270 - DNA, 21 bp, Homo sapiens
ccacagctggtctctgagccc

SEQ ID NO: 7483271 - DNA, 21 bp, Homo sapiens
ccacagctggtctctgagccc

SEQ ID NO: 7483272 - DNA, 21 bp, Homo sapiens
ccacagctggtctctgagccc

SEQ ID NO: 7483273 - DNA, 22 bp, Homo sapiens
ccacagcttcgcagtctgctgc

SEQ ID NO: 7483274 - DNA, 17 bp, Homo sapiens
ccacagctgggtgcctt

SEQ ID NO: 7483275 - DNA, 17 bp, Homo sapiens
ccacagctgggtgcctt

SEQ ID NO: 7483276 - DNA, 17 bp, Homo sapiens
ccacagctgggtgcctt

SEQ ID NO: 7483277 - DNA, 22 bp, Homo sapiens
ccacagctgaccgcaggtgagc

SEQ ID NO: 7483278 - DNA, 17 bp, Homo sapiens
ccacagctgggtgcctt

SEQ ID NO: 7483279 - DNA, 22 bp, Homo sapiens
ccacagctgaccgcaggtgagc

SEQ ID NO: 7483280 - DNA, 22 bp, Homo sapiens
ccacagctgaccgcaggtgagc

SEQ ID NO: 7483281 - DNA, 22 bp, Homo sapiens
ccacagctgaccgcaggtgagc

SEQ ID NO: 7483282 - DNA, 17 bp, Homo sapiens
aggcaggtaagagttat

SEQ ID NO: 7483283 - DNA, 17 bp, Homo sapiens
aggcaggtaagagttat

SEQ ID NO: 7483284 - DNA, 17 bp, Homo sapiens
aggcaggtaagagttat

SEQ ID NO: 7483285 - DNA, 22 bp, Homo sapiens
aggcagggtgatgataatgatt

SEQ ID NO: 7483286 - DNA, 22 bp, Homo sapiens
aggcagggtgatgataatgatt

SEQ ID NO: 7483287 - DNA, 22 bp, Homo sapiens
aggcagggtgatgataatgatt

SEQ ID NO: 7483288 - DNA, 22 bp, Homo sapiens
aggcagggtgatgataatgatt

SEQ ID NO: 7483289 - DNA, 22 bp, Homo sapiens
aggcagggtgatgataatgatt

SEQ ID NO: 7483290 - DNA, 22 bp, Homo sapiens
aggcagggtgatgataatgatt

SEQ ID NO: 7483291 - DNA, 22 bp, Homo sapiens
aggcagggtgatgataatgatt

SEQ ID NO: 7483292 - DNA, 22 bp, Homo sapiens
aggcagggtgatgataatgatt

SEQ ID NO: 7483293 - DNA, 22 bp, Homo sapiens
ccacaggacggaggtctggccg

SEQ ID NO: 7483294 - DNA, 22 bp, Homo sapiens
ccacaggacggaggtctggccg

SEQ ID NO: 7483295 - DNA, 22 bp, Homo sapiens
ccacaggacggaggtctggccg

SEQ ID NO: 7483296 - DNA, 22 bp, Homo sapiens
ccacaggacggaggtctggccg

SEQ ID NO: 7483297 - DNA, 22 bp, Homo sapiens
ccacaggaccagaggagatcac

SEQ ID NO: 7483298 - DNA, 22 bp, Homo sapiens
ccacaggaccagaggagatcac

SEQ ID NO: 7483299 - DNA, 22 bp, Homo sapiens
ccacaggacggaggtctggccg

SEQ ID NO: 7483300 - DNA, 22 bp, Homo sapiens
ccacaggacggaggtctggccg

SEQ ID NO: 7483301 - DNA, 22 bp, Homo sapiens
ccacaggacggaggtctggccg

SEQ ID NO: 7483302 - DNA, 22 bp, Homo sapiens
ccacaggacagttaatgtgcag

SEQ ID NO: 7483303 - DNA, 22 bp, Homo sapiens
ccacaggaccagaggagatcac

SEQ ID NO: 7483304 - DNA, 22 bp, Homo sapiens
ccacaggaccagaggagatcac

SEQ ID NO: 7483305 - DNA, 20 bp, Homo sapiens
ccacaggagtccagtcgacc

SEQ ID NO: 7483306 - DNA, 20 bp, Homo sapiens
ccacaggagtccagtcgacc

SEQ ID NO: 7483307 - DNA, 20 bp, Homo sapiens
ccacaggagtccagtcgacc

SEQ ID NO: 7483308 - DNA, 23 bp, Homo sapiens
ccacaggagggttcatttattca

SEQ ID NO: 7483309 - DNA, 23 bp, Homo sapiens
ccacaggagggttcatttattca

SEQ ID NO: 7483310 - DNA, 22 bp, Homo sapiens
ccacaggaggatgttcagacaa

SEQ ID NO: 7483311 - DNA, 22 bp, Homo sapiens
ccacaggaggatgttcagacaa

SEQ ID NO: 7483312 - DNA, 22 bp, Homo sapiens
ccacaggaggaacaattagatg

SEQ ID NO: 7483313 - DNA, 22 bp, Homo sapiens
ccacaggaggaacaattagatg

SEQ ID NO: 7483314 - DNA, 22 bp, Homo sapiens
ccacaggaggaacaattagatg

SEQ ID NO: 7483315 - DNA, 22 bp, Homo sapiens
ccacaggaggaacaattagatg

SEQ ID NO: 7483316 - DNA, 22 bp, Homo sapiens
ccacaggacggaggtctggccg

SEQ ID NO: 7483317 - DNA, 23 bp, Homo sapiens
ccacaggcacagaggcttgcatc

SEQ ID NO: 7483318 - DNA, 23 bp, Homo sapiens
ccacaggcacagaggcttgcatc

SEQ ID NO: 7483319 - DNA, 23 bp, Homo sapiens
ccacaggcacagaggcttgcatc

SEQ ID NO: 7483320 - DNA, 23 bp, Homo sapiens
ccacaggcacagaggcttgcatc

SEQ ID NO: 7483321 - DNA, 23 bp, Homo sapiens
ccacaggcacagaggcttgcatc

SEQ ID NO: 7483322 - DNA, 22 bp, Homo sapiens
ccagagaaagctcacaggcagt

SEQ ID NO: 7483323 - DNA, 22 bp, Homo sapiens
ccagagaaaggtttgattcatt

SEQ ID NO: 7483324 - DNA, 22 bp, Homo sapiens
ccagagaaaggtttgattcatt

SEQ ID NO: 7483325 - DNA, 22 bp, Homo sapiens
ccagagaaaggtttgattcatt

SEQ ID NO: 7483326 - DNA, 22 bp, Homo sapiens
ccagagaaaggtttgattcatt

SEQ ID NO: 7483327 - DNA, 22 bp, Homo sapiens
ccacaggatccaagggaaggca

SEQ ID NO: 7483328 - DNA, 22 bp, Homo sapiens
ccacaggatccaagggaaggca

SEQ ID NO: 7483329 - DNA, 20 bp, Homo sapiens
ccacaggagtccagtcgacc

SEQ ID NO: 7483330 - DNA, 20 bp, Homo sapiens
ccacaggagtccagtcgacc

SEQ ID NO: 7483331 - DNA, 22 bp, Homo sapiens
ccagagagggcgccacctggag

SEQ ID NO: 7483332 - DNA, 22 bp, Homo sapiens
ccagagagggcgccacctggag

SEQ ID NO: 7483333 - DNA, 22 bp, Homo sapiens
ccagagaaagtgaagcaaatgt

SEQ ID NO: 7483334 - DNA, 22 bp, Homo sapiens
ccagagagggcgccacctggag

SEQ ID NO: 7483335 - DNA, 22 bp, Homo sapiens
ccagagaaagtgaagcaaatgt

SEQ ID NO: 7483336 - DNA, 22 bp, Homo sapiens
ccagagaaagtgaagcaaatgt

SEQ ID NO: 7483337 - DNA, 22 bp, Homo sapiens
ccagagaaaggtttgattcatt

SEQ ID NO: 7483338 - DNA, 22 bp, Homo sapiens
ccagagaaagtgaagcaaatgt

SEQ ID NO: 7483339 - DNA, 22 bp, Homo sapiens
ccagagaaagtgaagcaaatgt

SEQ ID NO: 7483340 - DNA, 22 bp, Homo sapiens
ccagagaaaggtttgattcatt

SEQ ID NO: 7483341 - DNA, 22 bp, Homo sapiens
ccagagaaagtgaagcaaatgt

SEQ ID NO: 7483342 - DNA, 22 bp, Homo sapiens
ccagagaaagtgaagcaaatgt

SEQ ID NO: 7483343 - DNA, 17 bp, Homo sapiens
ccagagagtagttagga

SEQ ID NO: 7483344 - DNA, 22 bp, Homo sapiens
ccagagagtatcatggagagta

SEQ ID NO: 7483345 - DNA, 22 bp, Homo sapiens
ccagagagtatcatggagagta

SEQ ID NO: 7483346 - DNA, 22 bp, Homo sapiens
ccagagagtatcatggagagta

SEQ ID NO: 7483347 - DNA, 22 bp, Homo sapiens
ccagagagtatcatggagagta

SEQ ID NO: 7483348 - DNA, 22 bp, Homo sapiens
ccagagagtatcatggagagta

SEQ ID NO: 7483349 - DNA, 22 bp, Homo sapiens
ccagagagtatcatggagagta

SEQ ID NO: 7483350 - DNA, 22 bp, Homo sapiens
ccagagagtatcatggagagta

SEQ ID NO: 7483351 - DNA, 22 bp, Homo sapiens
ccagagagtatcatggagagta

SEQ ID NO: 7483352 - DNA, 22 bp, Homo sapiens
ccagagagtatcatggagagta

SEQ ID NO: 7483353 - DNA, 22 bp, Homo sapiens
ccagagagtcgatgggggacac

SEQ ID NO: 7483354 - DNA, 22 bp, Homo sapiens
ccagagagtcgatgggggacac

SEQ ID NO: 7483355 - DNA, 22 bp, Homo sapiens
ccagagagtcgatgggggacac

SEQ ID NO: 7483356 - DNA, 22 bp, Homo sapiens
ccagagagtcgatgggggacac

SEQ ID NO: 7483357 - DNA, 22 bp, Homo sapiens
ccagagagtcgatgggggacac

SEQ ID NO: 7483358 - DNA, 22 bp, Homo sapiens
ccagagagtcgatgggggacac

SEQ ID NO: 7483359 - DNA, 22 bp, Homo sapiens
ccagagagtcgatgggggacac

SEQ ID NO: 7483360 - DNA, 22 bp, Homo sapiens
ccagagaggggaagggcttgcc

SEQ ID NO: 7483361 - DNA, 22 bp, Homo sapiens
ccagagaggtagcttaccctct

SEQ ID NO: 7483362 - DNA, 22 bp, Homo sapiens
ccagagaggtagcttaccctct

SEQ ID NO: 7483363 - DNA, 22 bp, Homo sapiens
ccagagaggtagcttaccctct

SEQ ID NO: 7483364 - DNA, 22 bp, Homo sapiens
ccagagagtaaacattttccgg

SEQ ID NO: 7483365 - DNA, 22 bp, Homo sapiens
ccagagagtaaacattttccgg

SEQ ID NO: 7483366 - DNA, 22 bp, Homo sapiens
ccagagaggggaagggcttgcc

SEQ ID NO: 7483367 - DNA, 22 bp, Homo sapiens
ccagagaggggaagggcttgcc

SEQ ID NO: 7483368 - DNA, 22 bp, Homo sapiens
ccagagaggggaagggcttgcc

SEQ ID NO: 7483369 - DNA, 22 bp, Homo sapiens
ccagagaggggaagggcttgcc

SEQ ID NO: 7483370 - DNA, 22 bp, Homo sapiens
ccagagaggggaagggcttgcc

SEQ ID NO: 7483371 - DNA, 22 bp, Homo sapiens
ccagagaggggaagggcttgcc

SEQ ID NO: 7483372 - DNA, 22 bp, Homo sapiens
ccagagaggggaagggcttgcc

SEQ ID NO: 7483373 - DNA, 22 bp, Homo sapiens
ccagagagtaggaggcattatt

SEQ ID NO: 7483374 - DNA, 22 bp, Homo sapiens
ccagagagtaggaggcattatt

SEQ ID NO: 7483375 - DNA, 22 bp, Homo sapiens
ccagagagtaggaggcattatt

SEQ ID NO: 7483376 - DNA, 20 bp, Homo sapiens
ccagagagtaggttagtgat

SEQ ID NO: 7483377 - DNA, 20 bp, Homo sapiens
ccagagagtaggttagtgat

SEQ ID NO: 7483378 - DNA, 22 bp, Homo sapiens
ccagagagtaggaggcattatt

SEQ ID NO: 7483379 - DNA, 20 bp, Homo sapiens
ccagagagtaggttagtgat

SEQ ID NO: 7483380 - DNA, 20 bp, Homo sapiens
ccagagagtaggttagtgat

SEQ ID NO: 7483381 - DNA, 17 bp, Homo sapiens
ccagagagtagttagga

SEQ ID NO: 7483382 - DNA, 22 bp, Homo sapiens
ccagcagacacacaggcgtggg

SEQ ID NO: 7483383 - DNA, 22 bp, Homo sapiens
ccagcagacacacaggcgtggg

SEQ ID NO: 7483384 - DNA, 22 bp, Homo sapiens
ccagcagacacacaggcgtggg

SEQ ID NO: 7483385 - DNA, 22 bp, Homo sapiens
ccagcagaagctcccgctgggt

SEQ ID NO: 7483386 - DNA, 22 bp, Homo sapiens
ccagcagaagctcccgctgggt

SEQ ID NO: 7483387 - DNA, 22 bp, Homo sapiens
ccagcagaagctcccgctgggt

SEQ ID NO: 7483388 - DNA, 22 bp, Homo sapiens
ccagcagaagctcccgctgggt

SEQ ID NO: 7483389 - DNA, 19 bp, Homo sapiens
ccagagttcttgccattct

SEQ ID NO: 7483390 - DNA, 19 bp, Homo sapiens
ccagagttcttgccattct

SEQ ID NO: 7483391 - DNA, 19 bp, Homo sapiens
ccagagttggcagagcagg

SEQ ID NO: 7483392 - DNA, 19 bp, Homo sapiens
ccagagttggcagagcagg

SEQ ID NO: 7483393 - DNA, 22 bp, Homo sapiens
ccagcactgttctaaggaaaca

SEQ ID NO: 7483394 - DNA, 22 bp, Homo sapiens
ccagcactgctctcagactgag

SEQ ID NO: 7483395 - DNA, 19 bp, Homo sapiens
ccagcagaagccactcctg

SEQ ID NO: 7483396 - DNA, 19 bp, Homo sapiens
ccagcagaagccactcctg

SEQ ID NO: 7483397 - DNA, 22 bp, Homo sapiens
ccagcactgttctaaggaaaca

SEQ ID NO: 7483398 - DNA, 22 bp, Homo sapiens
ccagcactgctctcagactgag

SEQ ID NO: 7483399 - DNA, 22 bp, Homo sapiens
ccagcactgttctaaggaaaca

SEQ ID NO: 7483400 - DNA, 19 bp, Homo sapiens
ccagcagaagccactcctg

SEQ ID NO: 7483401 - DNA, 22 bp, Homo sapiens
ccagcagagctcaaacttcctg

SEQ ID NO: 7483402 - DNA, 22 bp, Homo sapiens
ccagcagagctcaaacttcctg

SEQ ID NO: 7483403 - DNA, 22 bp, Homo sapiens
ccagcagagctggaagtgtgct

SEQ ID NO: 7483404 - DNA, 22 bp, Homo sapiens
ccagcagagcatggggaggaag

SEQ ID NO: 7483405 - DNA, 22 bp, Homo sapiens
ccagcagagctcaaacttcctg

SEQ ID NO: 7483406 - DNA, 22 bp, Homo sapiens
ccagcagagcatggggaggaag

SEQ ID NO: 7483407 - DNA, 22 bp, Homo sapiens
ccagcagagcatggggaggaag

SEQ ID NO: 7483408 - DNA, 22 bp, Homo sapiens
ccagcagagcatggggaggaag

SEQ ID NO: 7483409 - DNA, 22 bp, Homo sapiens
ccagcagagcatggggaggaag

SEQ ID NO: 7483410 - DNA, 22 bp, Homo sapiens
ccagcagagcatggggaggaag

SEQ ID NO: 7483411 - DNA, 19 bp, Homo sapiens
ccagcagacacagctgccc

SEQ ID NO: 7483412 - DNA, 22 bp, Homo sapiens
ccagcagagcatggggaggaag

SEQ ID NO: 7483413 - DNA, 19 bp, Homo sapiens
ccagcagacacagctgccc

SEQ ID NO: 7483414 - DNA, 19 bp, Homo sapiens
ccagcagacacagctgccc

SEQ ID NO: 7483415 - DNA, 19 bp, Homo sapiens
ccagcagacacagctgccc

SEQ ID NO: 7483416 - DNA, 19 bp, Homo sapiens
ccagcagacacagctgccc

SEQ ID NO: 7483417 - DNA, 19 bp, Homo sapiens
ccagcagacacagctgccc

SEQ ID NO: 7483418 - DNA, 19 bp, Homo sapiens
ccagcagacacagctgccc

SEQ ID NO: 7483419 - DNA, 22 bp, Homo sapiens
ccagcagaggggcggagtgcag

SEQ ID NO: 7483420 - DNA, 22 bp, Homo sapiens
ccagcagaggggcggagtgcag

SEQ ID NO: 7483421 - DNA, 22 bp, Homo sapiens
ccagcagaggggcggagtgcag

SEQ ID NO: 7483422 - DNA, 22 bp, Homo sapiens
ccagcagaggggcggagtgcag

SEQ ID NO: 7483423 - DNA, 22 bp, Homo sapiens
aggccagaaatttggagtatgt

SEQ ID NO: 7483424 - DNA, 22 bp, Homo sapiens
aggccagaaatttggagtatgt

SEQ ID NO: 7483425 - DNA, 22 bp, Homo sapiens
aggccagaaatgtcagggagtg

SEQ ID NO: 7483426 - DNA, 22 bp, Homo sapiens
ccagcagaggcatcatccttcc

SEQ ID NO: 7483427 - DNA, 22 bp, Homo sapiens
ccagcagagctggaagtgtgct

SEQ ID NO: 7483428 - DNA, 22 bp, Homo sapiens
ccagcagagctggaagtgtgct

SEQ ID NO: 7483429 - DNA, 22 bp, Homo sapiens
ccagcagagctggaagtgtgct

SEQ ID NO: 7483430 - DNA, 22 bp, Homo sapiens
ccagcagagctggaagtgtgct

SEQ ID NO: 7483431 - DNA, 22 bp, Homo sapiens
ccagcagagctggaagtgtgct

SEQ ID NO: 7483432 - DNA, 22 bp, Homo sapiens
ccagcagaggcatcatccttcc

SEQ ID NO: 7483433 - DNA, 22 bp, Homo sapiens
ccagcagagggcgcttcacacc

SEQ ID NO: 7483434 - DNA, 22 bp, Homo sapiens
ccagcagaggggcggagtgcag

SEQ ID NO: 7483435 - DNA, 22 bp, Homo sapiens
ccagcagagggcgcttcacacc

SEQ ID NO: 7483436 - DNA, 22 bp, Homo sapiens
aggccagaagtcaaaaactcta

SEQ ID NO: 7483437 - DNA, 22 bp, Homo sapiens
aggccagaagtcaaaaactcta

SEQ ID NO: 7483438 - DNA, 22 bp, Homo sapiens
aggccagaagtcaaaaactcta

SEQ ID NO: 7483439 - DNA, 22 bp, Homo sapiens
aggccagacagctagaaacagg

SEQ ID NO: 7483440 - DNA, 22 bp, Homo sapiens
aggccagacagctagaaacagg

SEQ ID NO: 7483441 - DNA, 22 bp, Homo sapiens
aggccagaacagctctgcacca

SEQ ID NO: 7483442 - DNA, 22 bp, Homo sapiens
aggccagaagccagaaatgctt

SEQ ID NO: 7483443 - DNA, 22 bp, Homo sapiens
aggccagaacagctctgcacca

SEQ ID NO: 7483444 - DNA, 22 bp, Homo sapiens
aggccagaacagctctgcacca

SEQ ID NO: 7483445 - DNA, 22 bp, Homo sapiens
aggccagacagctagaaacagg

SEQ ID NO: 7483446 - DNA, 22 bp, Homo sapiens
aggccagactttggccaaatcc

SEQ ID NO: 7483447 - DNA, 22 bp, Homo sapiens
aggccagacagctagaaacagg

SEQ ID NO: 7483448 - DNA, 22 bp, Homo sapiens
aggccagacagctagaaacagg

SEQ ID NO: 7483449 - DNA, 22 bp, Homo sapiens
aggccagacagctagaaacagg

SEQ ID NO: 7483450 - DNA, 22 bp, Homo sapiens
aggccagactttggccaaatcc

SEQ ID NO: 7483451 - DNA, 22 bp, Homo sapiens
aggccagagaggggaccagcct

SEQ ID NO: 7483452 - DNA, 22 bp, Homo sapiens
aggccagagaggggaccagcct

SEQ ID NO: 7483453 - DNA, 22 bp, Homo sapiens
aggccagagaggggaccagcct

SEQ ID NO: 7483454 - DNA, 22 bp, Homo sapiens
aggcatgcatcactattcttag

SEQ ID NO: 7483455 - DNA, 22 bp, Homo sapiens
aggcatgcaaacagtctagagt

SEQ ID NO: 7483456 - DNA, 20 bp, Homo sapiens
ccagagcagccactgaagtt

SEQ ID NO: 7483457 - DNA, 22 bp, Homo sapiens
ccagagcagatgtggccttggt

SEQ ID NO: 7483458 - DNA, 22 bp, Homo sapiens
aggcatgcgccaatttattaga

SEQ ID NO: 7483459 - DNA, 19 bp, Homo sapiens
aggcatgcccctgagtcca

SEQ ID NO: 7483460 - DNA, 21 bp, Homo sapiens
aggcatggaaatggcacactg

SEQ ID NO: 7483461 - DNA, 21 bp, Homo sapiens
aggcatggaaatggcacactg

SEQ ID NO: 7483462 - DNA, 21 bp, Homo sapiens
aggcatggaaatggcacactg

SEQ ID NO: 7483463 - DNA, 21 bp, Homo sapiens
aggcatggaaatggcacactg

SEQ ID NO: 7483464 - DNA, 22 bp, Homo sapiens
aggcatggacatttcggcagct

SEQ ID NO: 7483465 - DNA, 22 bp, Homo sapiens
aggcatggacatttcggcagct

SEQ ID NO: 7483466 - DNA, 22 bp, Homo sapiens
aggcatggacatttcggcagct

SEQ ID NO: 7483467 - DNA, 22 bp, Homo sapiens
aggcatggatggatccagggct

SEQ ID NO: 7483468 - DNA, 22 bp, Homo sapiens
aggcatggatggatccagggct

SEQ ID NO: 7483469 - DNA, 22 bp, Homo sapiens
aggcatggacatttcggcagct

SEQ ID NO: 7483470 - DNA, 22 bp, Homo sapiens
aggcatggacatttcggcagct

SEQ ID NO: 7483471 - DNA, 22 bp, Homo sapiens
aggcatggacatttcggcagct

SEQ ID NO: 7483472 - DNA, 22 bp, Homo sapiens
ccagagcagatgtggccttggt

SEQ ID NO: 7483473 - DNA, 22 bp, Homo sapiens
ccagagcagaaccggaacacca

SEQ ID NO: 7483474 - DNA, 22 bp, Homo sapiens
ccagagcagatgtggccttggt

SEQ ID NO: 7483475 - DNA, 22 bp, Homo sapiens
ccagagcagatgtggccttggt

SEQ ID NO: 7483476 - DNA, 23 bp, Homo sapiens
ccagagattgttacacagtaggc

SEQ ID NO: 7483477 - DNA, 22 bp, Homo sapiens
ccagagcagaaccggaacacca

SEQ ID NO: 7483478 - DNA, 22 bp, Homo sapiens
ccagagcagaaccggaacacca

SEQ ID NO: 7483479 - DNA, 22 bp, Homo sapiens
ccagagcagaaccggaacacca

SEQ ID NO: 7483480 - DNA, 22 bp, Homo sapiens
ccagagcagaaccggaacacca

SEQ ID NO: 7483481 - DNA, 22 bp, Homo sapiens
ccagagcaattctcacagaact

SEQ ID NO: 7483482 - DNA, 22 bp, Homo sapiens
ccagagcaattctcacagaact

SEQ ID NO: 7483483 - DNA, 23 bp, Homo sapiens
ccagagattgttacacagtaggc

SEQ ID NO: 7483484 - DNA, 22 bp, Homo sapiens
ccagagatgttcacattctaat

SEQ ID NO: 7483485 - DNA, 22 bp, Homo sapiens
ccagagatgttcacattctaat

SEQ ID NO: 7483486 - DNA, 22 bp, Homo sapiens
ccagagatgttcacattctaat

SEQ ID NO: 7483487 - DNA, 22 bp, Homo sapiens
ccagagcaattctcacagaact

SEQ ID NO: 7483488 - DNA, 22 bp, Homo sapiens
ccagagcaattctcacagaact

SEQ ID NO: 7483489 - DNA, 22 bp, Homo sapiens
ccagagcaattctcacagaact

SEQ ID NO: 7483490 - DNA, 22 bp, Homo sapiens
ccagagatggacagggaatttg

SEQ ID NO: 7483491 - DNA, 22 bp, Homo sapiens
ccagagatgctcagggtttgca

SEQ ID NO: 7483492 - DNA, 22 bp, Homo sapiens
ccagagatggacagggaatttg

SEQ ID NO: 7483493 - DNA, 22 bp, Homo sapiens
ccagagatgttcacattctaat

SEQ ID NO: 7483494 - DNA, 22 bp, Homo sapiens
ccagagatgtgaaaatgccgga

SEQ ID NO: 7483495 - DNA, 22 bp, Homo sapiens
ccagagatgtgaaaatgccgga

SEQ ID NO: 7483496 - DNA, 22 bp, Homo sapiens
ccagagatgctcagggtttgca

SEQ ID NO: 7483497 - DNA, 22 bp, Homo sapiens
ccagagagtcgatgggggacac

SEQ ID NO: 7483498 - DNA, 17 bp, Homo sapiens
ccagagatgcctcaggc

SEQ ID NO: 7483499 - DNA, 17 bp, Homo sapiens
ccagagatgcctcaggc

SEQ ID NO: 7483500 - DNA, 22 bp, Homo sapiens
aggcatggcactgagcagcttc

SEQ ID NO: 7483501 - DNA, 22 bp, Homo sapiens
aggcatggcactgagcagcttc

SEQ ID NO: 7483502 - DNA, 22 bp, Homo sapiens
aggcatggcactgagcagcttc

SEQ ID NO: 7483503 - DNA, 22 bp, Homo sapiens
aggcatggcactgagcagcttc

SEQ ID NO: 7483504 - DNA, 22 bp, Homo sapiens
aggcatggcactgagcagcttc

SEQ ID NO: 7483505 - DNA, 22 bp, Homo sapiens
aggcatggcactgagcagcttc

SEQ ID NO: 7483506 - DNA, 23 bp, Homo sapiens
aggcatggcatggatggtggctc

SEQ ID NO: 7483507 - DNA, 23 bp, Homo sapiens
aggcatggcatggatggtggctc

SEQ ID NO: 7483508 - DNA, 22 bp, Homo sapiens
aggcatggcactgagcagcttc

SEQ ID NO: 7483509 - DNA, 22 bp, Homo sapiens
aggcatggcactgagcagcttc

SEQ ID NO: 7483510 - DNA, 23 bp, Homo sapiens
aggcatggcatggatggtggctc

SEQ ID NO: 7483511 - DNA, 23 bp, Homo sapiens
aggcatggcatggatggtggctc

SEQ ID NO: 7483512 - DNA, 22 bp, Homo sapiens
aggcatggcatggggcagatgt

SEQ ID NO: 7483513 - DNA, 23 bp, Homo sapiens
aggcatggcatggatggtggctc

SEQ ID NO: 7483514 - DNA, 22 bp, Homo sapiens
ccagagtgacgtgaagtgtgaa

SEQ ID NO: 7483515 - DNA, 22 bp, Homo sapiens
ccagagtgacgtgaagtgtgaa

SEQ ID NO: 7483516 - DNA, 22 bp, Homo sapiens
ccagagtgacgtgaagtgtgaa

SEQ ID NO: 7483517 - DNA, 22 bp, Homo sapiens
ccagagtgacgtgaagtgtgaa

SEQ ID NO: 7483518 - DNA, 22 bp, Homo sapiens
aggcatggcactgagcagcttc

SEQ ID NO: 7483519 - DNA, 22 bp, Homo sapiens
aggcatggatgtagcagtgacc

SEQ ID NO: 7483520 - DNA, 22 bp, Homo sapiens
aggcatggcactgagcagcttc

SEQ ID NO: 7483521 - DNA, 22 bp, Homo sapiens
aggcatggatgtagcagtgacc

SEQ ID NO: 7483522 - DNA, 22 bp, Homo sapiens
aggcatggcactgagcagcttc

SEQ ID NO: 7483523 - DNA, 22 bp, Homo sapiens
aggcatggcactgagcagcttc

SEQ ID NO: 7483524 - DNA, 22 bp, Homo sapiens
aggcatggcactgagcagcttc

SEQ ID NO: 7483525 - DNA, 22 bp, Homo sapiens
aggcatggcactgagcagcttc

SEQ ID NO: 7483526 - DNA, 22 bp, Homo sapiens
aggcatggcactgagcagcttc

SEQ ID NO: 7483527 - DNA, 22 bp, Homo sapiens
aggcatggatgtagcagtgacc

SEQ ID NO: 7483528 - DNA, 22 bp, Homo sapiens
aggcatggatgtagcagtgacc

SEQ ID NO: 7483529 - DNA, 22 bp, Homo sapiens
aggcatggatggatccagggct

SEQ ID NO: 7483530 - DNA, 22 bp, Homo sapiens
aggcatggatgtagcagtgacc

SEQ ID NO: 7483531 - DNA, 22 bp, Homo sapiens
aggcatggatggatccagggct

SEQ ID NO: 7483532 - DNA, 22 bp, Homo sapiens
aggcatggatgtagcagtgacc

SEQ ID NO: 7483533 - DNA, 22 bp, Homo sapiens
aggcatggatgtagcagtgacc

SEQ ID NO: 7483534 - DNA, 22 bp, Homo sapiens
aggcatggatgtagcagtgacc

SEQ ID NO: 7483535 - DNA, 22 bp, Homo sapiens
aggcatggatgtagcagtgacc

SEQ ID NO: 7483536 - DNA, 22 bp, Homo sapiens
agctgcaccggctggaccactg

SEQ ID NO: 7483537 - DNA, 22 bp, Homo sapiens
agctgcactgacctgtatgaag

SEQ ID NO: 7483538 - DNA, 22 bp, Homo sapiens
agctgcactgacctgtatgaag

SEQ ID NO: 7483539 - DNA, 22 bp, Homo sapiens
agctgcactgtgaagttcatag

SEQ ID NO: 7483540 - DNA, 22 bp, Homo sapiens
agctgcactgtgaagttcatag

SEQ ID NO: 7483541 - DNA, 22 bp, Homo sapiens
agctgcagaaaggacaactaat

SEQ ID NO: 7483542 - DNA, 22 bp, Homo sapiens
agctgcactgacctgtatgaag

SEQ ID NO: 7483543 - DNA, 22 bp, Homo sapiens
agctgcaattctggacatagtc

SEQ ID NO: 7483544 - DNA, 22 bp, Homo sapiens
agctgcaccggctggaccactg

SEQ ID NO: 7483545 - DNA, 22 bp, Homo sapiens
agctgcaattctggacatagtc

SEQ ID NO: 7483546 - DNA, 22 bp, Homo sapiens
agctgcaattaaagactgtgaa

SEQ ID NO: 7483547 - DNA, 22 bp, Homo sapiens
agctgcaattaaagactgtgaa

SEQ ID NO: 7483548 - DNA, 22 bp, Homo sapiens
agctgcaagtccaaaggaatta

SEQ ID NO: 7483549 - DNA, 22 bp, Homo sapiens
agctgcaagtctgtgtggggag

SEQ ID NO: 7483550 - DNA, 22 bp, Homo sapiens
agctgcaagtgttgcctcctac

SEQ ID NO: 7483551 - DNA, 22 bp, Homo sapiens
agctgcaagtccaaaggaatta

SEQ ID NO: 7483552 - DNA, 22 bp, Homo sapiens
agctgcaagataaaagtgatgt

SEQ ID NO: 7483553 - DNA, 22 bp, Homo sapiens
agctgcaaaggcacacttgggc

SEQ ID NO: 7483554 - DNA, 22 bp, Homo sapiens
agctgcaaaccaggccggcgcg

SEQ ID NO: 7483555 - DNA, 22 bp, Homo sapiens
agctgcaacatctgcttgtccc

SEQ ID NO: 7483556 - DNA, 22 bp, Homo sapiens
agctgcaactgtccttgccttg

SEQ ID NO: 7483557 - DNA, 23 bp, Homo sapiens
agctgcaagactccctgtctgag

SEQ ID NO: 7483558 - DNA, 22 bp, Homo sapiens
cagctgagaaatggggaaaggg

SEQ ID NO: 7483559 - DNA, 22 bp, Homo sapiens
cagctgagaaatggggaaaggg

SEQ ID NO: 7483560 - DNA, 22 bp, Homo sapiens
cagctgagaaatggggaaaggg

SEQ ID NO: 7483561 - DNA, 22 bp, Homo sapiens
cagctgagaaggtctgatcagg

SEQ ID NO: 7483562 - DNA, 22 bp, Homo sapiens
cagctgagaaggtctgatcagg

SEQ ID NO: 7483563 - DNA, 22 bp, Homo sapiens
cagctgagaaggtctgatcagg

SEQ ID NO: 7483564 - DNA, 22 bp, Homo sapiens
cagctgagaaaggcaggctcac

SEQ ID NO: 7483565 - DNA, 22 bp, Homo sapiens
cagctgagaaaggcaggctcac

SEQ ID NO: 7483566 - DNA, 22 bp, Homo sapiens
cagctgagaaaggcaggctcac

SEQ ID NO: 7483567 - DNA, 22 bp, Homo sapiens
cagctgacccgtgggaggcggg

SEQ ID NO: 7483568 - DNA, 22 bp, Homo sapiens
cagctgagaaaggcaggctcac

SEQ ID NO: 7483569 - DNA, 22 bp, Homo sapiens
cagctgagaaaggcaggctcac

SEQ ID NO: 7483570 - DNA, 22 bp, Homo sapiens
cagctgagaaaggcaggctcac

SEQ ID NO: 7483571 - DNA, 22 bp, Homo sapiens
cagctgagaaaggcaggctcac

SEQ ID NO: 7483572 - DNA, 22 bp, Homo sapiens
cagctgagaagtgatagctgca

SEQ ID NO: 7483573 - DNA, 22 bp, Homo sapiens
cagctgagaagtgatagctgca

SEQ ID NO: 7483574 - DNA, 22 bp, Homo sapiens
cagctgagaagtgatagctgca

SEQ ID NO: 7483575 - DNA, 22 bp, Homo sapiens
cagctgagaagtgatagctgca

SEQ ID NO: 7483576 - DNA, 22 bp, Homo sapiens
cagctgagaccagaatgcaggt

SEQ ID NO: 7483577 - DNA, 22 bp, Homo sapiens
cagctgagaccagaatgcaggt

SEQ ID NO: 7483578 - DNA, 22 bp, Homo sapiens
cagctgagaagtgatagctgca

SEQ ID NO: 7483579 - DNA, 22 bp, Homo sapiens
cagctgagaccagaatgcaggt

SEQ ID NO: 7483580 - DNA, 22 bp, Homo sapiens
agctgagggcaggatggggtga

SEQ ID NO: 7483581 - DNA, 22 bp, Homo sapiens
agctgagggcaggatggggtga

SEQ ID NO: 7483582 - DNA, 22 bp, Homo sapiens
agctgagggcaggatggggtga

SEQ ID NO: 7483583 - DNA, 22 bp, Homo sapiens
agctgattccactttttcccca

SEQ ID NO: 7483584 - DNA, 22 bp, Homo sapiens
agctgagggcaggatggggtga

SEQ ID NO: 7483585 - DNA, 22 bp, Homo sapiens
agctgattccactttttcccca

SEQ ID NO: 7483586 - DNA, 22 bp, Homo sapiens
agctgattccactttttcccca

SEQ ID NO: 7483587 - DNA, 22 bp, Homo sapiens
agctgattccactttttcccca

SEQ ID NO: 7483588 - DNA, 22 bp, Homo sapiens
agctgattccactttttcccca

SEQ ID NO: 7483589 - DNA, 22 bp, Homo sapiens
agctgattccactttttcccca

SEQ ID NO: 7483590 - DNA, 22 bp, Homo sapiens
cagctgagaccagaatgcaggt

SEQ ID NO: 7483591 - DNA, 22 bp, Homo sapiens
cagctgagagacaatgagtcat

SEQ ID NO: 7483592 - DNA, 22 bp, Homo sapiens
cagctgagagacaatgagtcat

SEQ ID NO: 7483593 - DNA, 22 bp, Homo sapiens
cagctgagagacaatgagtcat

SEQ ID NO: 7483594 - DNA, 22 bp, Homo sapiens
cagctgagagacaatgagtcat

SEQ ID NO: 7483595 - DNA, 23 bp, Homo sapiens
agctgaggctgtgggtgtcagag

SEQ ID NO: 7483596 - DNA, 23 bp, Homo sapiens
agctgaggctgtgggtgtcagag

SEQ ID NO: 7483597 - DNA, 22 bp, Homo sapiens
cagctgagagtagaaatggagg

SEQ ID NO: 7483598 - DNA, 22 bp, Homo sapiens
cagctgagagtagaaatggagg

SEQ ID NO: 7483599 - DNA, 22 bp, Homo sapiens
cagctgagagtagaaatggagg

SEQ ID NO: 7483600 - DNA, 22 bp, Homo sapiens
cagctgacaagagtccttggag

SEQ ID NO: 7483601 - DNA, 22 bp, Homo sapiens
cagctgacactttgacctagag

SEQ ID NO: 7483602 - DNA, 22 bp, Homo sapiens
cagctgacaagagtccttggag

SEQ ID NO: 7483603 - DNA, 22 bp, Homo sapiens
cagctgacaaactctgagctta

SEQ ID NO: 7483604 - DNA, 22 bp, Homo sapiens
cagctgacaaactctgagctta

SEQ ID NO: 7483605 - DNA, 22 bp, Homo sapiens
cagctgaattcttcagactcca

SEQ ID NO: 7483606 - DNA, 22 bp, Homo sapiens
cagctgaatggctccctgctaa

SEQ ID NO: 7483607 - DNA, 22 bp, Homo sapiens
cagctgaattcttcagactcca

SEQ ID NO: 7483608 - DNA, 22 bp, Homo sapiens
cagctgacccagtgaggaggca

SEQ ID NO: 7483609 - DNA, 22 bp, Homo sapiens
cagctgacccagtgaggaggca

SEQ ID NO: 7483610 - DNA, 22 bp, Homo sapiens
cagctgacccgtgggaggcggg

SEQ ID NO: 7483611 - DNA, 22 bp, Homo sapiens
cagctgacccgtgggaggcggg

SEQ ID NO: 7483612 - DNA, 22 bp, Homo sapiens
cagctgacagtgaggtgggggc

SEQ ID NO: 7483613 - DNA, 22 bp, Homo sapiens
cagctgacagtgaggtgggggc

SEQ ID NO: 7483614 - DNA, 22 bp, Homo sapiens
cagctgacatggtatttgtgcc

SEQ ID NO: 7483615 - DNA, 22 bp, Homo sapiens
cagctgacccagtgaggaggca

SEQ ID NO: 7483616 - DNA, 22 bp, Homo sapiens
cagctgagaaaggcaggctcac

SEQ ID NO: 7483617 - DNA, 22 bp, Homo sapiens
cagctgacgccagagtggaatt

SEQ ID NO: 7483618 - DNA, 22 bp, Homo sapiens
cagctgacctggctaagggagc

SEQ ID NO: 7483619 - DNA, 22 bp, Homo sapiens
cagctgacctggctaagggagc

SEQ ID NO: 7483620 - DNA, 22 bp, Homo sapiens
cagctctgtctgtagaaacttc

SEQ ID NO: 7483621 - DNA, 22 bp, Homo sapiens
cagctctgtctgtagaaacttc

SEQ ID NO: 7483622 - DNA, 22 bp, Homo sapiens
cagctctgtctgtagaaacttc

SEQ ID NO: 7483623 - DNA, 22 bp, Homo sapiens
cagctctgtctgtagaaacttc

SEQ ID NO: 7483624 - DNA, 22 bp, Homo sapiens
cagctgaatcagtgagtggaaa

SEQ ID NO: 7483625 - DNA, 22 bp, Homo sapiens
cagctgaatcagtgagtggaaa

SEQ ID NO: 7483626 - DNA, 22 bp, Homo sapiens
cagctgaagcccaggcagaacc

SEQ ID NO: 7483627 - DNA, 22 bp, Homo sapiens
cagctgaagctcttgtcaaagg

SEQ ID NO: 7483628 - DNA, 22 bp, Homo sapiens
cagctgaaggtaggaaccagga

SEQ ID NO: 7483629 - DNA, 22 bp, Homo sapiens
cagctgaaggtaggaaccagga

SEQ ID NO: 7483630 - DNA, 22 bp, Homo sapiens
cagctctggttcctgggcccag

SEQ ID NO: 7483631 - DNA, 22 bp, Homo sapiens
cagctctggttcctgggcccag

SEQ ID NO: 7483632 - DNA, 22 bp, Homo sapiens
cagctctggttcctgggcccag

SEQ ID NO: 7483633 - DNA, 22 bp, Homo sapiens
cagctctgtaaattccttcatc

SEQ ID NO: 7483634 - DNA, 22 bp, Homo sapiens
cagctctgtaaattccttcatc

SEQ ID NO: 7483635 - DNA, 22 bp, Homo sapiens
cagctctgtaaattccttcatc

SEQ ID NO: 7483636 - DNA, 22 bp, Homo sapiens
cagctctgtaaattccttcatc

SEQ ID NO: 7483637 - DNA, 22 bp, Homo sapiens
cagctctgtaaattccttcatc

SEQ ID NO: 7483638 - DNA, 22 bp, Homo sapiens
cagctctgtaaattccttcatc

SEQ ID NO: 7483639 - DNA, 22 bp, Homo sapiens
cagctctgtaaattccttcatc

SEQ ID NO: 7483640 - DNA, 22 bp, Homo sapiens
cagctctggggcagagtgacta

SEQ ID NO: 7483641 - DNA, 22 bp, Homo sapiens
cagctctggggcagagtgacta

SEQ ID NO: 7483642 - DNA, 20 bp, Homo sapiens
cagctctgggcaggtcgagg

SEQ ID NO: 7483643 - DNA, 22 bp, Homo sapiens
cagctctggggcagagtgacta

SEQ ID NO: 7483644 - DNA, 22 bp, Homo sapiens
cagctctggggcagagtgacta

SEQ ID NO: 7483645 - DNA, 20 bp, Homo sapiens
cagctctgggcaggtcgagg

SEQ ID NO: 7483646 - DNA, 20 bp, Homo sapiens
cagctctgggcaggtcgagg

SEQ ID NO: 7483647 - DNA, 20 bp, Homo sapiens
cagctctgggcaggtcgagg

SEQ ID NO: 7483648 - DNA, 20 bp, Homo sapiens
cagctctgggcaggtcgagg

SEQ ID NO: 7483649 - DNA, 20 bp, Homo sapiens
cagctctgggcaggtcgagg

SEQ ID NO: 7483650 - DNA, 22 bp, Homo sapiens
cagctctgggtaggaggaatct

SEQ ID NO: 7483651 - DNA, 22 bp, Homo sapiens
cagctctggggcagagtgacta

SEQ ID NO: 7483652 - DNA, 22 bp, Homo sapiens
cagctctggggcagagtgacta

SEQ ID NO: 7483653 - DNA, 22 bp, Homo sapiens
cagctctgggtaggaggaatct

SEQ ID NO: 7483654 - DNA, 22 bp, Homo sapiens
cagctctgggtaggaggaatct

SEQ ID NO: 7483655 - DNA, 22 bp, Homo sapiens
cagctctgggtaggaggaatct

SEQ ID NO: 7483656 - DNA, 22 bp, Homo sapiens
cagctctgggtaggaggaatct

SEQ ID NO: 7483657 - DNA, 22 bp, Homo sapiens
cagctctgggtgacaggagggc

SEQ ID NO: 7483658 - DNA, 22 bp, Homo sapiens
cagctctgggtgacaggagggc

SEQ ID NO: 7483659 - DNA, 22 bp, Homo sapiens
cagctctgggtgacaggagggc

SEQ ID NO: 7483660 - DNA, 22 bp, Homo sapiens
cagctctgggtgacaggagggc

SEQ ID NO: 7483661 - DNA, 22 bp, Homo sapiens
cagctctgggtgacaggagggc

SEQ ID NO: 7483662 - DNA, 22 bp, Homo sapiens
cagctctgggtgacaggagggc

SEQ ID NO: 7483663 - DNA, 22 bp, Homo sapiens
cagctctgggtgacaggagggc

SEQ ID NO: 7483664 - DNA, 22 bp, Homo sapiens
cagctctgggtgacaggagggc

SEQ ID NO: 7483665 - DNA, 22 bp, Homo sapiens
cagctctgggtgacaggagggc

SEQ ID NO: 7483666 - DNA, 22 bp, Homo sapiens
cagctctggtccagggagggca

SEQ ID NO: 7483667 - DNA, 22 bp, Homo sapiens
cagctctggttcctgggcccag

SEQ ID NO: 7483668 - DNA, 22 bp, Homo sapiens
cagctctggttcctgggcccag

SEQ ID NO: 7483669 - DNA, 22 bp, Homo sapiens
cagctctggttcctgggcccag

SEQ ID NO: 7483670 - DNA, 22 bp, Homo sapiens
cagctctggttcctgggcccag

SEQ ID NO: 7483671 - DNA, 22 bp, Homo sapiens
cagctctggttcctgggcccag

SEQ ID NO: 7483672 - DNA, 20 bp, Homo sapiens
agctgcatatttatgtgtac

SEQ ID NO: 7483673 - DNA, 20 bp, Homo sapiens
agctgcatatttatgtgtac

SEQ ID NO: 7483674 - DNA, 22 bp, Homo sapiens
agctgcagttcgttccagctct

SEQ ID NO: 7483675 - DNA, 22 bp, Homo sapiens
agctgcatgtcttattgagctg

SEQ ID NO: 7483676 - DNA, 22 bp, Homo sapiens
agctgcagttcgttccagctct

SEQ ID NO: 7483677 - DNA, 22 bp, Homo sapiens
agctgccaagttggagtagcaa

SEQ ID NO: 7483678 - DNA, 22 bp, Homo sapiens
agctgccaagttggagtagcaa

SEQ ID NO: 7483679 - DNA, 22 bp, Homo sapiens
agctgcatgtcttattgagctg

SEQ ID NO: 7483680 - DNA, 22 bp, Homo sapiens
agctgcatttcagctgtgacct

SEQ ID NO: 7483681 - DNA, 22 bp, Homo sapiens
agctgccaagttggagtagcaa

SEQ ID NO: 7483682 - DNA, 22 bp, Homo sapiens
agctgccacatggtgtcactgt

SEQ ID NO: 7483683 - DNA, 22 bp, Homo sapiens
agctgccacatgcccaagggca

SEQ ID NO: 7483684 - DNA, 22 bp, Homo sapiens
agctgccacatgcccaagggca

SEQ ID NO: 7483685 - DNA, 22 bp, Homo sapiens
agctgccacagagcctggccag

SEQ ID NO: 7483686 - DNA, 22 bp, Homo sapiens
agctgccacagagcctggccag

SEQ ID NO: 7483687 - DNA, 22 bp, Homo sapiens
agctgccaagtttctcagttta

SEQ ID NO: 7483688 - DNA, 22 bp, Homo sapiens
agctgccaagtttctcagttta

SEQ ID NO: 7483689 - DNA, 22 bp, Homo sapiens
agctgccaagtttctcagttta

SEQ ID NO: 7483690 - DNA, 22 bp, Homo sapiens
agctgcagtgaactgttttgtc

SEQ ID NO: 7483691 - DNA, 22 bp, Homo sapiens
agctgcagtgaactgttttgtc

SEQ ID NO: 7483692 - DNA, 22 bp, Homo sapiens
caggaaggggctcactctggcc

SEQ ID NO: 7483693 - DNA, 22 bp, Homo sapiens
agctgcagtcaagctgggccac

SEQ ID NO: 7483694 - DNA, 22 bp, Homo sapiens
caggaaggggctcactctggcc

SEQ ID NO: 7483695 - DNA, 22 bp, Homo sapiens
caggaaggggctcactctggcc

SEQ ID NO: 7483696 - DNA, 22 bp, Homo sapiens
caggaaggggctcactctggcc

SEQ ID NO: 7483697 - DNA, 22 bp, Homo sapiens
caggaaggggctcactctggcc

SEQ ID NO: 7483698 - DNA, 22 bp, Homo sapiens
caggaaggggctcactctggcc

SEQ ID NO: 7483699 - DNA, 22 bp, Homo sapiens
caggaaggggctcactctggcc

SEQ ID NO: 7483700 - DNA, 22 bp, Homo sapiens
agctgcagttagccccagatga

SEQ ID NO: 7483701 - DNA, 22 bp, Homo sapiens
agctgcagttagccccagatga

SEQ ID NO: 7483702 - DNA, 22 bp, Homo sapiens
agctgcagttcgttccagctct

SEQ ID NO: 7483703 - DNA, 22 bp, Homo sapiens
agctgcagttcgttccagctct

SEQ ID NO: 7483704 - DNA, 22 bp, Homo sapiens
agctgcagttagccccagatga

SEQ ID NO: 7483705 - DNA, 22 bp, Homo sapiens
agctgcagttagccccagatga

SEQ ID NO: 7483706 - DNA, 22 bp, Homo sapiens
agctgcagtgaattcgctaact

SEQ ID NO: 7483707 - DNA, 22 bp, Homo sapiens
agctgcagtgaattcgctaact

SEQ ID NO: 7483708 - DNA, 22 bp, Homo sapiens
agctgcagtgaattcgctaact

SEQ ID NO: 7483709 - DNA, 22 bp, Homo sapiens
agctgcagtgaactgttttgtc

SEQ ID NO: 7483710 - DNA, 22 bp, Homo sapiens
caggaaggcgcggctgtgcctg

SEQ ID NO: 7483711 - DNA, 22 bp, Homo sapiens
caggaaggcgcggctgtgcctg

SEQ ID NO: 7483712 - DNA, 22 bp, Homo sapiens
caggaaggcgcggctgtgcctg

SEQ ID NO: 7483713 - DNA, 22 bp, Homo sapiens
caggaaggcgcggctgtgcctg

SEQ ID NO: 7483714 - DNA, 22 bp, Homo sapiens
caggaaggcgcggctgtgcctg

SEQ ID NO: 7483715 - DNA, 22 bp, Homo sapiens
caggaaggcgcggctgtgcctg

SEQ ID NO: 7483716 - DNA, 22 bp, Homo sapiens
caggaaggggctcactctggcc

SEQ ID NO: 7483717 - DNA, 22 bp, Homo sapiens
caggaaggggctcactctggcc

SEQ ID NO: 7483718 - DNA, 22 bp, Homo sapiens
caggaaggggctcactctggcc

SEQ ID NO: 7483719 - DNA, 19 bp, Homo sapiens
caggaaggggcgaatctgg

SEQ ID NO: 7483720 - DNA, 22 bp, Homo sapiens
caggaaggggctcactctggcc

SEQ ID NO: 7483721 - DNA, 22 bp, Homo sapiens
caggaaggggctcactctggcc

SEQ ID NO: 7483722 - DNA, 19 bp, Homo sapiens
caggaaggggcgaatctgg

SEQ ID NO: 7483723 - DNA, 19 bp, Homo sapiens
caggaaggggcgaatctgg

SEQ ID NO: 7483724 - DNA, 22 bp, Homo sapiens
caggaaggcgcggctgtgcctg

SEQ ID NO: 7483725 - DNA, 22 bp, Homo sapiens
caggaaggggctcactctggcc

SEQ ID NO: 7483726 - DNA, 19 bp, Homo sapiens
caggaaggggcgaatctgg

SEQ ID NO: 7483727 - DNA, 22 bp, Homo sapiens
caggaaggcccacctgtcctgt

SEQ ID NO: 7483728 - DNA, 22 bp, Homo sapiens
caggaaggcccacctgtcctgt

SEQ ID NO: 7483729 - DNA, 22 bp, Homo sapiens
caggaaggcccacctgtcctgt

SEQ ID NO: 7483730 - DNA, 22 bp, Homo sapiens
caggaaggcccacctgtcctgt

SEQ ID NO: 7483731 - DNA, 22 bp, Homo sapiens
caggaaggcccacctgtcctgt

SEQ ID NO: 7483732 - DNA, 22 bp, Homo sapiens
caggaaggcccacctgtcctgt

SEQ ID NO: 7483733 - DNA, 22 bp, Homo sapiens
caggaaggcccacctgtcctgt

SEQ ID NO: 7483734 - DNA, 22 bp, Homo sapiens
caggaaggcccacctgtcctgt

SEQ ID NO: 7483735 - DNA, 22 bp, Homo sapiens
caggaaggcccacctgtcctgt

SEQ ID NO: 7483736 - DNA, 22 bp, Homo sapiens
caggaaggcccacctgtcctgt

SEQ ID NO: 7483737 - DNA, 22 bp, Homo sapiens
caggaaggcgcggctgtgcctg

SEQ ID NO: 7483738 - DNA, 22 bp, Homo sapiens
caggaaggcgcggctgtgcctg

SEQ ID NO: 7483739 - DNA, 22 bp, Homo sapiens
caggaaggcgcggctgtgcctg

SEQ ID NO: 7483740 - DNA, 22 bp, Homo sapiens
caggaaggcccacctgtcctgt

SEQ ID NO: 7483741 - DNA, 22 bp, Homo sapiens
caggaaggcgcggctgtgcctg

SEQ ID NO: 7483742 - DNA, 22 bp, Homo sapiens
caggaaggcccacctgtcctgt

SEQ ID NO: 7483743 - DNA, 22 bp, Homo sapiens
caggaaggcgcggctgtgcctg

SEQ ID NO: 7483744 - DNA, 22 bp, Homo sapiens
caggaaggcccacctgtcctgt

SEQ ID NO: 7483745 - DNA, 22 bp, Homo sapiens
agctgcagcactccagtagccg

SEQ ID NO: 7483746 - DNA, 22 bp, Homo sapiens
agctgcagcactccagtagccg

SEQ ID NO: 7483747 - DNA, 22 bp, Homo sapiens
agctgcagcactccagtagccg

SEQ ID NO: 7483748 - DNA, 22 bp, Homo sapiens
agctgcagcactccagtagccg

SEQ ID NO: 7483749 - DNA, 22 bp, Homo sapiens
agctgcagcactccagtagccg

SEQ ID NO: 7483750 - DNA, 22 bp, Homo sapiens
agctgcagattctatctagaag

SEQ ID NO: 7483751 - DNA, 22 bp, Homo sapiens
agctgcagattctatctagaag

SEQ ID NO: 7483752 - DNA, 22 bp, Homo sapiens
agctgcagattctctacttcat

SEQ ID NO: 7483753 - DNA, 22 bp, Homo sapiens
agctgcagcactccagtagccg

SEQ ID NO: 7483754 - DNA, 22 bp, Homo sapiens
agctgcagattctctacttcat

SEQ ID NO: 7483755 - DNA, 17 bp, Homo sapiens
agctgcagatgaagttg

SEQ ID NO: 7483756 - DNA, 22 bp, Homo sapiens
agctgcagatcaataggctcac

SEQ ID NO: 7483757 - DNA, 17 bp, Homo sapiens
agctgcagatgaagttg

SEQ ID NO: 7483758 - DNA, 23 bp, Homo sapiens
agctgcagatgctcagcgggcag

SEQ ID NO: 7483759 - DNA, 23 bp, Homo sapiens
agctgcagatgctcagcgggcag

SEQ ID NO: 7483760 - DNA, 23 bp, Homo sapiens
agctgcagatgctcagcgggcag

SEQ ID NO: 7483761 - DNA, 22 bp, Homo sapiens
agctgcagattctatctagaag

SEQ ID NO: 7483762 - DNA, 22 bp, Homo sapiens
agctgcagattctatctagaag

SEQ ID NO: 7483763 - DNA, 23 bp, Homo sapiens
agctgcagatgctcagcgggcag

SEQ ID NO: 7483764 - DNA, 22 bp, Homo sapiens
caggaaggcccacctgtcctgt

SEQ ID NO: 7483765 - DNA, 22 bp, Homo sapiens
caggaaggaccgtccagatcag

SEQ ID NO: 7483766 - DNA, 22 bp, Homo sapiens
caggaaggaccgtccagatcag

SEQ ID NO: 7483767 - DNA, 22 bp, Homo sapiens
caggaaggaccgtccagatcag

SEQ ID NO: 7483768 - DNA, 22 bp, Homo sapiens
caggaaggaccgtccagatcag

SEQ ID NO: 7483769 - DNA, 22 bp, Homo sapiens
caggaaggaccgtccagatcag

SEQ ID NO: 7483770 - DNA, 22 bp, Homo sapiens
caggaaggaccgtccagatcag

SEQ ID NO: 7483771 - DNA, 22 bp, Homo sapiens
caggaaggaccgtccagatcag

SEQ ID NO: 7483772 - DNA, 22 bp, Homo sapiens
caggaagagaacatggaggctg

SEQ ID NO: 7483773 - DNA, 22 bp, Homo sapiens
caggaagagaacatggaggctg

SEQ ID NO: 7483774 - DNA, 22 bp, Homo sapiens
caggaagagaacatggaggctg

SEQ ID NO: 7483775 - DNA, 22 bp, Homo sapiens
caggaagagaacatggaggctg

SEQ ID NO: 7483776 - DNA, 22 bp, Homo sapiens
caggaagagaacatggaggctg

SEQ ID NO: 7483777 - DNA, 22 bp, Homo sapiens
caggaagagaacatggaggctg

SEQ ID NO: 7483778 - DNA, 22 bp, Homo sapiens
caggaagagaacatggaggctg

SEQ ID NO: 7483779 - DNA, 21 bp, Homo sapiens
agctgcagccatgtacatggc

SEQ ID NO: 7483780 - DNA, 21 bp, Homo sapiens
agctgcagccatgtacatggc

SEQ ID NO: 7483781 - DNA, 22 bp, Homo sapiens
agctgcagcactccagtagccg

SEQ ID NO: 7483782 - DNA, 22 bp, Homo sapiens
agctgcagcactccagtagccg

SEQ ID NO: 7483783 - DNA, 22 bp, Homo sapiens
agctgcagcactccagtagccg

SEQ ID NO: 7483784 - DNA, 19 bp, Homo sapiens
agctgcagaccagaagtgc

SEQ ID NO: 7483785 - DNA, 19 bp, Homo sapiens
agctgcagaccagaagtgc

SEQ ID NO: 7483786 - DNA, 19 bp, Homo sapiens
agctgcagaccagaagtgc

SEQ ID NO: 7483787 - DNA, 19 bp, Homo sapiens
agctgcagaccagaagtgc

SEQ ID NO: 7483788 - DNA, 18 bp, Homo sapiens
agctgcagaccaggaggt

SEQ ID NO: 7483789 - DNA, 18 bp, Homo sapiens
agctgcagaccaggaggt

SEQ ID NO: 7483790 - DNA, 18 bp, Homo sapiens
agctgcagaccaggaggt

SEQ ID NO: 7483791 - DNA, 18 bp, Homo sapiens
agctgcagaccaggaggt

SEQ ID NO: 7483792 - DNA, 19 bp, Homo sapiens
agctgcagaccagaagtgc

SEQ ID NO: 7483793 - DNA, 19 bp, Homo sapiens
agctgcagaccagaagtgc

SEQ ID NO: 7483794 - DNA, 19 bp, Homo sapiens
agctgcagaccagaagtgc

SEQ ID NO: 7483795 - DNA, 20 bp, Homo sapiens
agctgcagaacccactggac

SEQ ID NO: 7483796 - DNA, 20 bp, Homo sapiens
agctgcagaacccactggac

SEQ ID NO: 7483797 - DNA, 20 bp, Homo sapiens
agctgcagaacccactggac

SEQ ID NO: 7483798 - DNA, 20 bp, Homo sapiens
agctgcagaacccactggac

SEQ ID NO: 7483799 - DNA, 22 bp, Homo sapiens
agctgcagaaaggacaactaat

SEQ ID NO: 7483800 - DNA, 18 bp, Homo sapiens
agctgcagaccaggaggt

SEQ ID NO: 7483801 - DNA, 18 bp, Homo sapiens
agctgcagaccaggaggt

SEQ ID NO: 7483802 - DNA, 18 bp, Homo sapiens
agctgcagaccaggaggt

SEQ ID NO: 7483803 - DNA, 22 bp, Homo sapiens
agctgcagagaaaagaggctgg

SEQ ID NO: 7483804 - DNA, 22 bp, Homo sapiens
agctgcagagaaaagaggctgg

SEQ ID NO: 7483805 - DNA, 22 bp, Homo sapiens
agctgcagagaaaagaggctgg

SEQ ID NO: 7483806 - DNA, 22 bp, Homo sapiens
agctgcagagaaaagaggctgg

SEQ ID NO: 7483807 - DNA, 22 bp, Homo sapiens
agctgcagagaaaagaggctgg

SEQ ID NO: 7483808 - DNA, 22 bp, Homo sapiens
agctgcagaggtttgtgcaaca

SEQ ID NO: 7483809 - DNA, 22 bp, Homo sapiens
agctgcagataggatgttattt

SEQ ID NO: 7483810 - DNA, 22 bp, Homo sapiens
agctgcagatcaataggctcac

SEQ ID NO: 7483811 - DNA, 22 bp, Homo sapiens
agctgcagaggtttgtgcaaca

SEQ ID NO: 7483812 - DNA, 22 bp, Homo sapiens
agctgcagaggtttgtgcaaca

SEQ ID NO: 7483813 - DNA, 22 bp, Homo sapiens
agctgcagaggtttgtgcaaca

SEQ ID NO: 7483814 - DNA, 22 bp, Homo sapiens
caggcactgtgttaggcactgt

SEQ ID NO: 7483815 - DNA, 22 bp, Homo sapiens
caggcactgtgttaggcactgt

SEQ ID NO: 7483816 - DNA, 22 bp, Homo sapiens
caggcactgtgctgagctctgc

SEQ ID NO: 7483817 - DNA, 22 bp, Homo sapiens
caggcactgtgttaggcactgt

SEQ ID NO: 7483818 - DNA, 22 bp, Homo sapiens
caggcactgtgttaggcactgt

SEQ ID NO: 7483819 - DNA, 22 bp, Homo sapiens
caggcactgtgctgagctctgc

SEQ ID NO: 7483820 - DNA, 22 bp, Homo sapiens
caggcactgtgctgagctctgc

SEQ ID NO: 7483821 - DNA, 22 bp, Homo sapiens
caggcactgtgctgagctctgc

SEQ ID NO: 7483822 - DNA, 22 bp, Homo sapiens
caggcacttctgctgcttgtct

SEQ ID NO: 7483823 - DNA, 22 bp, Homo sapiens
caggcacttctgctgcttgtct

SEQ ID NO: 7483824 - DNA, 22 bp, Homo sapiens
caggcactttgctgggggcgca

SEQ ID NO: 7483825 - DNA, 22 bp, Homo sapiens
agctggccattgtgagtggcct

SEQ ID NO: 7483826 - DNA, 22 bp, Homo sapiens
caggcactgtgttaggcactgt

SEQ ID NO: 7483827 - DNA, 22 bp, Homo sapiens
agctggccattgtgagtggcct

SEQ ID NO: 7483828 - DNA, 22 bp, Homo sapiens
caggcactgtgttaggcactgt

SEQ ID NO: 7483829 - DNA, 22 bp, Homo sapiens
caggcacttctgctgcttgtct

SEQ ID NO: 7483830 - DNA, 22 bp, Homo sapiens
caggcacttctgctgcttgtct

SEQ ID NO: 7483831 - DNA, 22 bp, Homo sapiens
caggcacttctgctgcttgtct

SEQ ID NO: 7483832 - DNA, 22 bp, Homo sapiens
caggcactgtgttaggcactgt

SEQ ID NO: 7483833 - DNA, 22 bp, Homo sapiens
agctggccattgtgagtggcct

SEQ ID NO: 7483834 - DNA, 20 bp, Homo sapiens
agctggcccacaggtgtggg

SEQ ID NO: 7483835 - DNA, 20 bp, Homo sapiens
agctggcccacaggtgtggg

SEQ ID NO: 7483836 - DNA, 20 bp, Homo sapiens
agctggcccacaggtgtggg

SEQ ID NO: 7483837 - DNA, 20 bp, Homo sapiens
agctggcccacaggtgtggg

SEQ ID NO: 7483838 - DNA, 22 bp, Homo sapiens
agctggccattgtgagtggcct

SEQ ID NO: 7483839 - DNA, 22 bp, Homo sapiens
agctggcccactgtgtggtcca

SEQ ID NO: 7483840 - DNA, 20 bp, Homo sapiens
agctggcccacaggtgtggg

SEQ ID NO: 7483841 - DNA, 20 bp, Homo sapiens
agctggcccacaggtgtggg

SEQ ID NO: 7483842 - DNA, 20 bp, Homo sapiens
agctggcccccggtggcctg

SEQ ID NO: 7483843 - DNA, 22 bp, Homo sapiens
agctggccctcgagagccaatt

SEQ ID NO: 7483844 - DNA, 20 bp, Homo sapiens
agctggcccccggtggcctg

SEQ ID NO: 7483845 - DNA, 20 bp, Homo sapiens
agctggcccccggtggcctg

SEQ ID NO: 7483846 - DNA, 20 bp, Homo sapiens
agctggcccccggtggcctg

SEQ ID NO: 7483847 - DNA, 22 bp, Homo sapiens
agctggcccactgtgtggtcca

SEQ ID NO: 7483848 - DNA, 22 bp, Homo sapiens
agctggcccactgtgtggtcca

SEQ ID NO: 7483849 - DNA, 22 bp, Homo sapiens
agctggcccactgtgtggtcca

SEQ ID NO: 7483850 - DNA, 22 bp, Homo sapiens
agctggcccactgtgtggtcca

SEQ ID NO: 7483851 - DNA, 22 bp, Homo sapiens
agctggcccactgtgtggtcca

SEQ ID NO: 7483852 - DNA, 22 bp, Homo sapiens
caggcatagaagggcaagaata

SEQ ID NO: 7483853 - DNA, 22 bp, Homo sapiens
caggcataatctcatcttgttt

SEQ ID NO: 7483854 - DNA, 22 bp, Homo sapiens
caggcataatctcatcttgttt

SEQ ID NO: 7483855 - DNA, 22 bp, Homo sapiens
caggcatagaagggcaagaata

SEQ ID NO: 7483856 - DNA, 22 bp, Homo sapiens
caggcataggtaggatgtttct

SEQ ID NO: 7483857 - DNA, 22 bp, Homo sapiens
caggcatatctacattatccaa

SEQ ID NO: 7483858 - DNA, 22 bp, Homo sapiens
caggccagaggctgttgttgcg

SEQ ID NO: 7483859 - DNA, 20 bp, Homo sapiens
caggccagaggtttgatggc

SEQ ID NO: 7483860 - DNA, 20 bp, Homo sapiens
caggccagaggtttgatggc

SEQ ID NO: 7483861 - DNA, 22 bp, Homo sapiens
caggccagaggctgttgttgcg

SEQ ID NO: 7483862 - DNA, 22 bp, Homo sapiens
caggccagaggctgttgttgcg

SEQ ID NO: 7483863 - DNA, 20 bp, Homo sapiens
caggccagaggtttgatggc

SEQ ID NO: 7483864 - DNA, 22 bp, Homo sapiens
agctggcctccgggtgcctggg

SEQ ID NO: 7483865 - DNA, 22 bp, Homo sapiens
agctggcctccgggtgcctggg

SEQ ID NO: 7483866 - DNA, 22 bp, Homo sapiens
agctggcctcactgcagaatgc

SEQ ID NO: 7483867 - DNA, 22 bp, Homo sapiens
agctggcctcactgcagaatgc

SEQ ID NO: 7483868 - DNA, 20 bp, Homo sapiens
caggcagtttgtggttaggg

SEQ ID NO: 7483869 - DNA, 22 bp, Homo sapiens
agctggcctccgggtgcctggg

SEQ ID NO: 7483870 - DNA, 22 bp, Homo sapiens
agctggcctccgggtgcctggg

SEQ ID NO: 7483871 - DNA, 22 bp, Homo sapiens
caggcataagtaatgttttatg

SEQ ID NO: 7483872 - DNA, 18 bp, Homo sapiens
agctggccctggctgccg

SEQ ID NO: 7483873 - DNA, 18 bp, Homo sapiens
agctggccctggctgccg

SEQ ID NO: 7483874 - DNA, 18 bp, Homo sapiens
agctggccctggctgccg

SEQ ID NO: 7483875 - DNA, 18 bp, Homo sapiens
agctggccctggctgccg

SEQ ID NO: 7483876 - DNA, 18 bp, Homo sapiens
agctggccctggctgccg

SEQ ID NO: 7483877 - DNA, 18 bp, Homo sapiens
agctggccctggctgccg

SEQ ID NO: 7483878 - DNA, 22 bp, Homo sapiens
agctggccggcctccaggtgga

SEQ ID NO: 7483879 - DNA, 22 bp, Homo sapiens
agctggccggcctccaggtgga

SEQ ID NO: 7483880 - DNA, 18 bp, Homo sapiens
agctggccctggctgccg

SEQ ID NO: 7483881 - DNA, 18 bp, Homo sapiens
agctggccctggctgccg

SEQ ID NO: 7483882 - DNA, 22 bp, Homo sapiens
agctggccggcctccaggtgga

SEQ ID NO: 7483883 - DNA, 22 bp, Homo sapiens
agctggccggcctccaggtgga

SEQ ID NO: 7483884 - DNA, 22 bp, Homo sapiens
agctggccggcctccaggtgga

SEQ ID NO: 7483885 - DNA, 22 bp, Homo sapiens
agctggccggcctccaggtgga

SEQ ID NO: 7483886 - DNA, 22 bp, Homo sapiens
agctgggctgggctgagctgag

SEQ ID NO: 7483887 - DNA, 22 bp, Homo sapiens
agctgggctggagctccaagcg

SEQ ID NO: 7483888 - DNA, 22 bp, Homo sapiens
agctgggctgggctgagctgag

SEQ ID NO: 7483889 - DNA, 22 bp, Homo sapiens
agctgggctgggctgagctgag

SEQ ID NO: 7483890 - DNA, 22 bp, Homo sapiens
agctgggctgggctgagctgag

SEQ ID NO: 7483891 - DNA, 22 bp, Homo sapiens
agctgggctgggctgagctgag

SEQ ID NO: 7483892 - DNA, 22 bp, Homo sapiens
agctgggctgggctgagctgag

SEQ ID NO: 7483893 - DNA, 22 bp, Homo sapiens
agctgggctgggctgagctgag

SEQ ID NO: 7483894 - DNA, 22 bp, Homo sapiens
caggccaggctgcatttgcccc

SEQ ID NO: 7483895 - DNA, 22 bp, Homo sapiens
caggccagggagaatatgaagc

SEQ ID NO: 7483896 - DNA, 22 bp, Homo sapiens
caggccagggagaatatgaagc

SEQ ID NO: 7483897 - DNA, 22 bp, Homo sapiens
caggccagggagaatatgaagc

SEQ ID NO: 7483898 - DNA, 22 bp, Homo sapiens
caggccagggagaatatgaagc

SEQ ID NO: 7483899 - DNA, 22 bp, Homo sapiens
agctgggctggagctccaagcg

SEQ ID NO: 7483900 - DNA, 22 bp, Homo sapiens
agctgggctggagctccaagcg

SEQ ID NO: 7483901 - DNA, 22 bp, Homo sapiens
agctgggctggagctccaagcg

SEQ ID NO: 7483902 - DNA, 22 bp, Homo sapiens
agctgggctggagctccaagcg

SEQ ID NO: 7483903 - DNA, 22 bp, Homo sapiens
agctgggctggagctccaagcg

SEQ ID NO: 7483904 - DNA, 19 bp, Homo sapiens
agctgggctgtcacagtga

SEQ ID NO: 7483905 - DNA, 19 bp, Homo sapiens
agctgggctgtcacagtga

SEQ ID NO: 7483906 - DNA, 19 bp, Homo sapiens
agctgggctgtcacagtga

SEQ ID NO: 7483907 - DNA, 19 bp, Homo sapiens
agctgggctgtcacagtga

SEQ ID NO: 7483908 - DNA, 19 bp, Homo sapiens
agctgggcttactcactcg

SEQ ID NO: 7483909 - DNA, 19 bp, Homo sapiens
agctgggctgtcacagtga

SEQ ID NO: 7483910 - DNA, 19 bp, Homo sapiens
agctgggctgtcacagtga

SEQ ID NO: 7483911 - DNA, 19 bp, Homo sapiens
agctgggcttactcactcg

SEQ ID NO: 7483912 - DNA, 22 bp, Homo sapiens
agctgggcttggccaggtcgct

SEQ ID NO: 7483913 - DNA, 19 bp, Homo sapiens
agctgggcttactcactcg

SEQ ID NO: 7483914 - DNA, 19 bp, Homo sapiens
agctgggctgtcacagtga

SEQ ID NO: 7483915 - DNA, 19 bp, Homo sapiens
agctgggcttactcactcg

SEQ ID NO: 7483916 - DNA, 19 bp, Homo sapiens
agctgggcttactcactcg

SEQ ID NO: 7483917 - DNA, 19 bp, Homo sapiens
agctgggcttactcactcg

SEQ ID NO: 7483918 - DNA, 22 bp, Homo sapiens
agctgggcttggccaggtcgct

SEQ ID NO: 7483919 - DNA, 22 bp, Homo sapiens
agctgggcttggccaggtcgct

SEQ ID NO: 7483920 - DNA, 22 bp, Homo sapiens
agctgggcttggccaggtcgct

SEQ ID NO: 7483921 - DNA, 22 bp, Homo sapiens
agctgggcttggccaggtcgct

SEQ ID NO: 7483922 - DNA, 22 bp, Homo sapiens
agctgggcttggccaggtcgct

SEQ ID NO: 7483923 - DNA, 22 bp, Homo sapiens
agctgggcttggccaggtcgct

SEQ ID NO: 7483924 - DNA, 22 bp, Homo sapiens
caggccagcagggcctccgtgg

SEQ ID NO: 7483925 - DNA, 22 bp, Homo sapiens
caggccagcagggcctccgtgg

SEQ ID NO: 7483926 - DNA, 22 bp, Homo sapiens
caggccagcagggcctccgtgg

SEQ ID NO: 7483927 - DNA, 22 bp, Homo sapiens
caggccagcggcccgcgcgttc

SEQ ID NO: 7483928 - DNA, 22 bp, Homo sapiens
caggccagcagggcctccgtgg

SEQ ID NO: 7483929 - DNA, 22 bp, Homo sapiens
caggccagcggcccgcgcgttc

SEQ ID NO: 7483930 - DNA, 22 bp, Homo sapiens
caggccagcggcccgcgcgttc

SEQ ID NO: 7483931 - DNA, 22 bp, Homo sapiens
caggccagcggcccgcgcgttc

SEQ ID NO: 7483932 - DNA, 22 bp, Homo sapiens
caggccagagtccaactccaga

SEQ ID NO: 7483933 - DNA, 22 bp, Homo sapiens
caggccagcagggcctccgtgg

SEQ ID NO: 7483934 - DNA, 22 bp, Homo sapiens
caggccagcagggcctccgtgg

SEQ ID NO: 7483935 - DNA, 22 bp, Homo sapiens
caggccagcagggcctccgtgg

SEQ ID NO: 7483936 - DNA, 22 bp, Homo sapiens
caggccagagtccaactccaga

SEQ ID NO: 7483937 - DNA, 20 bp, Homo sapiens
caggccagaggtttgatggc

SEQ ID NO: 7483938 - DNA, 22 bp, Homo sapiens
caggccagagtccaactccaga

SEQ ID NO: 7483939 - DNA, 22 bp, Homo sapiens
caggccagagtccaactccaga

SEQ ID NO: 7483940 - DNA, 22 bp, Homo sapiens
caggccaggctgcatttgcccc

SEQ ID NO: 7483941 - DNA, 22 bp, Homo sapiens
caggccagcttcctgacatcct

SEQ ID NO: 7483942 - DNA, 22 bp, Homo sapiens
caggccagcttcctgacatcct

SEQ ID NO: 7483943 - DNA, 22 bp, Homo sapiens
caggccagcttcctgacatcct

SEQ ID NO: 7483944 - DNA, 22 bp, Homo sapiens
caggccagcttcctgacatcct

SEQ ID NO: 7483945 - DNA, 22 bp, Homo sapiens
caggccagcgtccagaacaagc

SEQ ID NO: 7483946 - DNA, 22 bp, Homo sapiens
caggccagcgtccagaacaagc

SEQ ID NO: 7483947 - DNA, 22 bp, Homo sapiens
caggccagcgtccagaacaagc

SEQ ID NO: 7483948 - DNA, 22 bp, Homo sapiens
caggccagcgtccagaacaagc

SEQ ID NO: 7483949 - DNA, 22 bp, Homo sapiens
caggccagcgtccagaacaagc

SEQ ID NO: 7483950 - DNA, 22 bp, Homo sapiens
caggccagcgtccagaacaagc

SEQ ID NO: 7483951 - DNA, 22 bp, Homo sapiens
caggccagcgtccagaacaagc

SEQ ID NO: 7483952 - DNA, 22 bp, Homo sapiens
caggaggagcattagcgtctca

SEQ ID NO: 7483953 - DNA, 22 bp, Homo sapiens
caggaggagcattagcgtctca

SEQ ID NO: 7483954 - DNA, 23 bp, Homo sapiens
caggaggagaaggcttggttggc

SEQ ID NO: 7483955 - DNA, 22 bp, Homo sapiens
caggaggacatactggctcaca

SEQ ID NO: 7483956 - DNA, 22 bp, Homo sapiens
caggaggagcattagcgtctca

SEQ ID NO: 7483957 - DNA, 22 bp, Homo sapiens
caggaggagcattagcgtctca

SEQ ID NO: 7483958 - DNA, 22 bp, Homo sapiens
caggaggagcattagcgtctca

SEQ ID NO: 7483959 - DNA, 22 bp, Homo sapiens
caggaggagccagcgcccttca

SEQ ID NO: 7483960 - DNA, 22 bp, Homo sapiens
caggaggagcattagcgtctca

SEQ ID NO: 7483961 - DNA, 22 bp, Homo sapiens
caggaggagcattagcgtctca

SEQ ID NO: 7483962 - DNA, 22 bp, Homo sapiens
caggaggacatactggctcaca

SEQ ID NO: 7483963 - DNA, 22 bp, Homo sapiens
caggaggacatactggctcaca

SEQ ID NO: 7483964 - DNA, 22 bp, Homo sapiens
caggaggacatactggctcaca

SEQ ID NO: 7483965 - DNA, 22 bp, Homo sapiens
caggaggacatactggctcaca

SEQ ID NO: 7483966 - DNA, 22 bp, Homo sapiens
caggaggacatactggctcaca

SEQ ID NO: 7483967 - DNA, 22 bp, Homo sapiens
caggaggacatactggctcaca

SEQ ID NO: 7483968 - DNA, 22 bp, Homo sapiens
caggaggacatactggctcaca

SEQ ID NO: 7483969 - DNA, 22 bp, Homo sapiens
caggaggacatactggctcaca

SEQ ID NO: 7483970 - DNA, 22 bp, Homo sapiens
caggaggacatactggctcaca

SEQ ID NO: 7483971 - DNA, 22 bp, Homo sapiens
caggagccccaggctgacaata

SEQ ID NO: 7483972 - DNA, 22 bp, Homo sapiens
caggaggacatactggctcaca

SEQ ID NO: 7483973 - DNA, 22 bp, Homo sapiens
caggaggacatactggctcaca

SEQ ID NO: 7483974 - DNA, 22 bp, Homo sapiens
caggagccccaggctgacaata

SEQ ID NO: 7483975 - DNA, 22 bp, Homo sapiens
caggagccccaggctgacaata

SEQ ID NO: 7483976 - DNA, 22 bp, Homo sapiens
caggagccccaggctgacaata

SEQ ID NO: 7483977 - DNA, 22 bp, Homo sapiens
caggagccccaggctgacaata

SEQ ID NO: 7483978 - DNA, 22 bp, Homo sapiens
agctgccacctctgcctttggg

SEQ ID NO: 7483979 - DNA, 22 bp, Homo sapiens
agctgccactgagggtgcacag

SEQ ID NO: 7483980 - DNA, 21 bp, Homo sapiens
agctgccaccctagcttctga

SEQ ID NO: 7483981 - DNA, 21 bp, Homo sapiens
agctgccaccctagcttctga

SEQ ID NO: 7483982 - DNA, 22 bp, Homo sapiens
agctgccacatggtgtcactgt

SEQ ID NO: 7483983 - DNA, 22 bp, Homo sapiens
caggaggattgcttgaggccag

SEQ ID NO: 7483984 - DNA, 22 bp, Homo sapiens
caggaggattgcttgaggccag

SEQ ID NO: 7483985 - DNA, 22 bp, Homo sapiens
caggaggattgcttgaggccag

SEQ ID NO: 7483986 - DNA, 22 bp, Homo sapiens
caggaggattgcttgaggccag

SEQ ID NO: 7483987 - DNA, 22 bp, Homo sapiens
caggaggattgcttgaggccag

SEQ ID NO: 7483988 - DNA, 22 bp, Homo sapiens
caggaggaggtgaggtagaact

SEQ ID NO: 7483989 - DNA, 22 bp, Homo sapiens
caggaggaggtgaggtagaact

SEQ ID NO: 7483990 - DNA, 22 bp, Homo sapiens
caggaggattgcttgaggccag

SEQ ID NO: 7483991 - DNA, 22 bp, Homo sapiens
caggaggattgcttgaggccag

SEQ ID NO: 7483992 - DNA, 22 bp, Homo sapiens
caggaggattgcttgaggccag

SEQ ID NO: 7483993 - DNA, 22 bp, Homo sapiens
caggaggattgcttgaggccag

SEQ ID NO: 7483994 - DNA, 22 bp, Homo sapiens
agctgctgagccatgtcctgct

SEQ ID NO: 7483995 - DNA, 22 bp, Homo sapiens
agctgctgagccatgtcctgct

SEQ ID NO: 7483996 - DNA, 19 bp, Homo sapiens
agctgctgattggtggagg

SEQ ID NO: 7483997 - DNA, 22 bp, Homo sapiens
agctgctgagccatgtcctgct

SEQ ID NO: 7483998 - DNA, 22 bp, Homo sapiens
caggaggattgcttgaggccag

SEQ ID NO: 7483999 - DNA, 22 bp, Homo sapiens
agctgctgagccatgtcctgct

SEQ ID NO: 7484000 - DNA, 22 bp, Homo sapiens
agctgctgagccatgtcctgct

SEQ ID NO: 7484001 - DNA, 22 bp, Homo sapiens
caggaggattgcttgaggccag

SEQ ID NO: 7484002 - DNA, 22 bp, Homo sapiens
agctgctgagccatgtcctgct

SEQ ID NO: 7484003 - DNA, 22 bp, Homo sapiens
agctgctgagccatgtcctgct

SEQ ID NO: 7484004 - DNA, 22 bp, Homo sapiens
agctgctgagccatgtcctgct

SEQ ID NO: 7484005 - DNA, 22 bp, Homo sapiens
caggaggagggtacaccatcag

SEQ ID NO: 7484006 - DNA, 22 bp, Homo sapiens
caggaggagggtacaccatcag

SEQ ID NO: 7484007 - DNA, 22 bp, Homo sapiens
caggaggagggtacaccatcag

SEQ ID NO: 7484008 - DNA, 22 bp, Homo sapiens
caggaggagggtacaccatcag

SEQ ID NO: 7484009 - DNA, 22 bp, Homo sapiens
caggaggagggtacaccatcag

SEQ ID NO: 7484010 - DNA, 22 bp, Homo sapiens
caggaggaggtgaggtagaact

SEQ ID NO: 7484011 - DNA, 22 bp, Homo sapiens
caggaggagggtacaccatcag

SEQ ID NO: 7484012 - DNA, 22 bp, Homo sapiens
caggaggaggtgaggtagaact

SEQ ID NO: 7484013 - DNA, 22 bp, Homo sapiens
caggaggaggtgaggtagaact

SEQ ID NO: 7484014 - DNA, 22 bp, Homo sapiens
caggaggaggtgaggtagaact

SEQ ID NO: 7484015 - DNA, 22 bp, Homo sapiens
caggaggaggtgaggtagaact

SEQ ID NO: 7484016 - DNA, 22 bp, Homo sapiens
caggaggagggtacaccatcag

SEQ ID NO: 7484017 - DNA, 22 bp, Homo sapiens
caggaggagggcagccgcctcc

SEQ ID NO: 7484018 - DNA, 22 bp, Homo sapiens
caggaggagggtacaccatcag

SEQ ID NO: 7484019 - DNA, 22 bp, Homo sapiens
caggaggagctggccgcctcat

SEQ ID NO: 7484020 - DNA, 22 bp, Homo sapiens
caggaggagctggccgcctcat

SEQ ID NO: 7484021 - DNA, 22 bp, Homo sapiens
caggaggagctggccgcctcat

SEQ ID NO: 7484022 - DNA, 22 bp, Homo sapiens
caggaggagggcagccgcctcc

SEQ ID NO: 7484023 - DNA, 22 bp, Homo sapiens
caggaggagggcagccgcctcc

SEQ ID NO: 7484024 - DNA, 22 bp, Homo sapiens
caggaggagctggccgcctcat

SEQ ID NO: 7484025 - DNA, 22 bp, Homo sapiens
caggcactgtgctgagctctgc

SEQ ID NO: 7484026 - DNA, 22 bp, Homo sapiens
caggcactgtgctgagctctgc

SEQ ID NO: 7484027 - DNA, 22 bp, Homo sapiens
caggcactgtgctgagctctgc

SEQ ID NO: 7484028 - DNA, 22 bp, Homo sapiens
caggcactgtgctagatccttg

SEQ ID NO: 7484029 - DNA, 22 bp, Homo sapiens
caggcactgtgctagatccttg

SEQ ID NO: 7484030 - DNA, 22 bp, Homo sapiens
caggcactgtgctagatccttg

SEQ ID NO: 7484031 - DNA, 22 bp, Homo sapiens
caggcactgtgcctcgctccct

SEQ ID NO: 7484032 - DNA, 22 bp, Homo sapiens
caggcactgtgcaagggtctcg

SEQ ID NO: 7484033 - DNA, 22 bp, Homo sapiens
caggcactgtgcaagggtctcg

SEQ ID NO: 7484034 - DNA, 22 bp, Homo sapiens
caggcactgtgcctcgctccct

SEQ ID NO: 7484035 - DNA, 22 bp, Homo sapiens
caggcactgtgctagatccttg

SEQ ID NO: 7484036 - DNA, 22 bp, Homo sapiens
caggcactgtgcctcgctccct

SEQ ID NO: 7484037 - DNA, 22 bp, Homo sapiens
caggcactgtgcaagggtctcg

SEQ ID NO: 7484038 - DNA, 22 bp, Homo sapiens
caggcactgtgcaagggtctcg

SEQ ID NO: 7484039 - DNA, 22 bp, Homo sapiens
caggcactggggatgctgggat

SEQ ID NO: 7484040 - DNA, 22 bp, Homo sapiens
caggcactggggatgctgggat

SEQ ID NO: 7484041 - DNA, 22 bp, Homo sapiens
caggcactggggatgctgggat

SEQ ID NO: 7484042 - DNA, 22 bp, Homo sapiens
caggcactggggatgctgggat

SEQ ID NO: 7484043 - DNA, 22 bp, Homo sapiens
caggcactggccagtcagcaca

SEQ ID NO: 7484044 - DNA, 22 bp, Homo sapiens
caggcactggccagtcagcaca

SEQ ID NO: 7484045 - DNA, 22 bp, Homo sapiens
caggcactggggatgctgggat

SEQ ID NO: 7484046 - DNA, 22 bp, Homo sapiens
caggcactgcactaccactttt

SEQ ID NO: 7484047 - DNA, 22 bp, Homo sapiens
caggcactcattcagagaggtg

SEQ ID NO: 7484048 - DNA, 22 bp, Homo sapiens
caggcactgcactaccactttt

SEQ ID NO: 7484049 - DNA, 22 bp, Homo sapiens
caggcactggccagtcagcaca

SEQ ID NO: 7484050 - DNA, 22 bp, Homo sapiens
caggcactggccagtcagcaca

SEQ ID NO: 7484051 - DNA, 22 bp, Homo sapiens
caggcactgcactaccactttt

SEQ ID NO: 7484052 - DNA, 22 bp, Homo sapiens
caggcactggccagtcagcaca

SEQ ID NO: 7484053 - DNA, 22 bp, Homo sapiens
caggcactggccagtcagcaca

SEQ ID NO: 7484054 - DNA, 22 bp, Homo sapiens
caggcactggccagtcagcaca

SEQ ID NO: 7484055 - DNA, 22 bp, Homo sapiens
caggcactggccagtcagcaca

SEQ ID NO: 7484056 - DNA, 22 bp, Homo sapiens
caggcactggccagtcagcaca

SEQ ID NO: 7484057 - DNA, 22 bp, Homo sapiens
caggcactggccagtcagcaca

SEQ ID NO: 7484058 - DNA, 22 bp, Homo sapiens
caggcactcattcagagaggtg

SEQ ID NO: 7484059 - DNA, 22 bp, Homo sapiens
caggcactcattcagagaggtg

SEQ ID NO: 7484060 - DNA, 22 bp, Homo sapiens
caggcactcattcagagaggtg

SEQ ID NO: 7484061 - DNA, 22 bp, Homo sapiens
caggcacactgtctacactgag

SEQ ID NO: 7484062 - DNA, 22 bp, Homo sapiens
caggcacactgtctacactgag

SEQ ID NO: 7484063 - DNA, 22 bp, Homo sapiens
caggcacactgtctacactgag

SEQ ID NO: 7484064 - DNA, 22 bp, Homo sapiens
caggcactcattcagagaggtg

SEQ ID NO: 7484065 - DNA, 22 bp, Homo sapiens
caggcactcattcagagaggtg

SEQ ID NO: 7484066 - DNA, 22 bp, Homo sapiens
caggcactcattcagagaggtg

SEQ ID NO: 7484067 - DNA, 22 bp, Homo sapiens
caggcactcattcagagaggtg

SEQ ID NO: 7484068 - DNA, 22 bp, Homo sapiens
caggcactcattcagagaggtg

SEQ ID NO: 7484069 - DNA, 22 bp, Homo sapiens
caggcactgcactaccactttt

SEQ ID NO: 7484070 - DNA, 19 bp, Homo sapiens
agctgctggcccagggacc

SEQ ID NO: 7484071 - DNA, 19 bp, Homo sapiens
agctgctggcccagggacc

SEQ ID NO: 7484072 - DNA, 19 bp, Homo sapiens
agctgctggcccagggacc

SEQ ID NO: 7484073 - DNA, 19 bp, Homo sapiens
agctgctggcccagggacc

SEQ ID NO: 7484074 - DNA, 19 bp, Homo sapiens
agctgctggcccagggacc

SEQ ID NO: 7484075 - DNA, 19 bp, Homo sapiens
agctgctggcccagggacc

SEQ ID NO: 7484076 - DNA, 22 bp, Homo sapiens
agctgctgcggaaagatgccac

SEQ ID NO: 7484077 - DNA, 22 bp, Homo sapiens
agctgctgcggaaagatgccac

SEQ ID NO: 7484078 - DNA, 22 bp, Homo sapiens
agctgctgcggaaagatgccac

SEQ ID NO: 7484079 - DNA, 22 bp, Homo sapiens
agctgctgggaccccagatcca

SEQ ID NO: 7484080 - DNA, 22 bp, Homo sapiens
agctgctgggaccccagatcca

SEQ ID NO: 7484081 - DNA, 22 bp, Homo sapiens
agctgctgggaccccagatcca

SEQ ID NO: 7484082 - DNA, 19 bp, Homo sapiens
agctgctggcccagggacc

SEQ ID NO: 7484083 - DNA, 19 bp, Homo sapiens
agctgctggcccagggacc

SEQ ID NO: 7484084 - DNA, 22 bp, Homo sapiens
caggcacactgtctacactgag

SEQ ID NO: 7484085 - DNA, 22 bp, Homo sapiens
caggcacactgtctacactgag

SEQ ID NO: 7484086 - DNA, 22 bp, Homo sapiens
caggcacactgtctacactgag

SEQ ID NO: 7484087 - DNA, 22 bp, Homo sapiens
caggcacactgtctacactgag

SEQ ID NO: 7484088 - DNA, 22 bp, Homo sapiens
caggcacactgtctacactgag

SEQ ID NO: 7484089 - DNA, 22 bp, Homo sapiens
agctgctgccggtggccaccct

SEQ ID NO: 7484090 - DNA, 22 bp, Homo sapiens
agctgctgcctcactggtctgt

SEQ ID NO: 7484091 - DNA, 22 bp, Homo sapiens
agctgctgcctcactggtctgt

SEQ ID NO: 7484092 - DNA, 22 bp, Homo sapiens
agctgctgcgcctcaccctggc

SEQ ID NO: 7484093 - DNA, 22 bp, Homo sapiens
agctgctgcctcactggtctgt

SEQ ID NO: 7484094 - DNA, 22 bp, Homo sapiens
agctgctgcgcctcaccctggc

SEQ ID NO: 7484095 - DNA, 22 bp, Homo sapiens
agctgctgcgcctcaccctggc

SEQ ID NO: 7484096 - DNA, 22 bp, Homo sapiens
agctgctgcgcctcaccctggc

SEQ ID NO: 7484097 - DNA, 22 bp, Homo sapiens
agctgctgcgcctcaccctggc

SEQ ID NO: 7484098 - DNA, 19 bp, Homo sapiens
agctgctgattggtggagg

SEQ ID NO: 7484099 - DNA, 19 bp, Homo sapiens
agctgctgattggtggagg

SEQ ID NO: 7484100 - DNA, 19 bp, Homo sapiens
agctgctgattggtggagg

SEQ ID NO: 7484101 - DNA, 22 bp, Homo sapiens
agctgctgcccataggtgacat

SEQ ID NO: 7484102 - DNA, 22 bp, Homo sapiens
agctgctgcaagtggtgctaac

SEQ ID NO: 7484103 - DNA, 22 bp, Homo sapiens
agctgctgcaagtggtgctaac

SEQ ID NO: 7484104 - DNA, 22 bp, Homo sapiens
agctgctgcaagtggtgctaac

SEQ ID NO: 7484105 - DNA, 22 bp, Homo sapiens
agctgctgcccataggtgacat

SEQ ID NO: 7484106 - DNA, 22 bp, Homo sapiens
agctgctgcccataggtgacat

SEQ ID NO: 7484107 - DNA, 22 bp, Homo sapiens
agctgctgccggtggccaccct

SEQ ID NO: 7484108 - DNA, 22 bp, Homo sapiens
agctgctgccggtggccaccct

SEQ ID NO: 7484109 - DNA, 22 bp, Homo sapiens
cagggagaaatctccaggaggt

SEQ ID NO: 7484110 - DNA, 22 bp, Homo sapiens
cagggagaaatctccaggaggt

SEQ ID NO: 7484111 - DNA, 22 bp, Homo sapiens
cagggagaaatctccaggaggt

SEQ ID NO: 7484112 - DNA, 22 bp, Homo sapiens
cagggagaaatctccaggaggt

SEQ ID NO: 7484113 - DNA, 22 bp, Homo sapiens
caggctggagttacctttaggg

SEQ ID NO: 7484114 - DNA, 22 bp, Homo sapiens
caggctggagttacctttaggg

SEQ ID NO: 7484115 - DNA, 22 bp, Homo sapiens
caggctggagttacctttaggg

SEQ ID NO: 7484116 - DNA, 22 bp, Homo sapiens
caggctggagttacctttaggg

SEQ ID NO: 7484117 - DNA, 22 bp, Homo sapiens
caggctggagttacctttaggg

SEQ ID NO: 7484118 - DNA, 22 bp, Homo sapiens
caggctggagttacctttaggg

SEQ ID NO: 7484119 - DNA, 22 bp, Homo sapiens
caggctggagttacctttaggg

SEQ ID NO: 7484120 - DNA, 22 bp, Homo sapiens
cagggagcggagtcccatgcct

SEQ ID NO: 7484121 - DNA, 22 bp, Homo sapiens
cagggagcggagtcccatgcct

SEQ ID NO: 7484122 - DNA, 22 bp, Homo sapiens
cagggagcggagtcccatgcct

SEQ ID NO: 7484123 - DNA, 22 bp, Homo sapiens
cagggagctattagggttagtg

SEQ ID NO: 7484124 - DNA, 22 bp, Homo sapiens
cagggagaaatctccaggaggt

SEQ ID NO: 7484125 - DNA, 22 bp, Homo sapiens
caggctggagtgcagttgtgca

SEQ ID NO: 7484126 - DNA, 22 bp, Homo sapiens
caggctggagtgcagttgtgca

SEQ ID NO: 7484127 - DNA, 22 bp, Homo sapiens
caggctggagtgcagttgtgca

SEQ ID NO: 7484128 - DNA, 22 bp, Homo sapiens
caggctggagtgcagttgtgca

SEQ ID NO: 7484129 - DNA, 22 bp, Homo sapiens
caggctggagtgcagttgtgca

SEQ ID NO: 7484130 - DNA, 22 bp, Homo sapiens
caggctggagtgcagttgtgca

SEQ ID NO: 7484131 - DNA, 22 bp, Homo sapiens
caggctggagtgcagttgtgca

SEQ ID NO: 7484132 - DNA, 22 bp, Homo sapiens
caggctggagtgcagttgtgca

SEQ ID NO: 7484133 - DNA, 22 bp, Homo sapiens
caggctggagtgcagttgtgca

SEQ ID NO: 7484134 - DNA, 22 bp, Homo sapiens
caggctggagtgcagttgtgca

SEQ ID NO: 7484135 - DNA, 22 bp, Homo sapiens
caggctggagtgcagtgtcgcc

SEQ ID NO: 7484136 - DNA, 22 bp, Homo sapiens
caggctggagtgcagttgtgca

SEQ ID NO: 7484137 - DNA, 22 bp, Homo sapiens
caggctggagttacctttaggg

SEQ ID NO: 7484138 - DNA, 22 bp, Homo sapiens
caggctggagttacctttaggg

SEQ ID NO: 7484139 - DNA, 22 bp, Homo sapiens
caggctggagttacctttaggg

SEQ ID NO: 7484140 - DNA, 22 bp, Homo sapiens
caggctggagtgcagttgtgca

SEQ ID NO: 7484141 - DNA, 22 bp, Homo sapiens
caggctggacattagatacata

SEQ ID NO: 7484142 - DNA, 22 bp, Homo sapiens
caggctggacattagatacata

SEQ ID NO: 7484143 - DNA, 22 bp, Homo sapiens
caggctggagtacaattgtgtg

SEQ ID NO: 7484144 - DNA, 22 bp, Homo sapiens
caggctggagtacaattgtgtg

SEQ ID NO: 7484145 - DNA, 22 bp, Homo sapiens
caggctggagtacaattgtgtg

SEQ ID NO: 7484146 - DNA, 22 bp, Homo sapiens
caggctggacattagatacata

SEQ ID NO: 7484147 - DNA, 22 bp, Homo sapiens
caggctgctgcctagaatgaca

SEQ ID NO: 7484148 - DNA, 22 bp, Homo sapiens
caggctgctgacaggcttggag

SEQ ID NO: 7484149 - DNA, 22 bp, Homo sapiens
caggctgctgcctagaatgaca

SEQ ID NO: 7484150 - DNA, 22 bp, Homo sapiens
caggctgctgcctagaatgaca

SEQ ID NO: 7484151 - DNA, 22 bp, Homo sapiens
caggctgctgtccacaaagcat

SEQ ID NO: 7484152 - DNA, 22 bp, Homo sapiens
caggctgctgtccacaaagcat

SEQ ID NO: 7484153 - DNA, 22 bp, Homo sapiens
caggctgctgtccacaaagcat

SEQ ID NO: 7484154 - DNA, 22 bp, Homo sapiens
caggctgctgtccacaaagcat

SEQ ID NO: 7484155 - DNA, 22 bp, Homo sapiens
caggctggacattagatacata

SEQ ID NO: 7484156 - DNA, 22 bp, Homo sapiens
caggctggacattagatacata

SEQ ID NO: 7484157 - DNA, 22 bp, Homo sapiens
caggctggacattagatacata

SEQ ID NO: 7484158 - DNA, 22 bp, Homo sapiens
caggctggagtgcagtggtgcc

SEQ ID NO: 7484159 - DNA, 22 bp, Homo sapiens
caggctggagtgcagtggtgcc

SEQ ID NO: 7484160 - DNA, 22 bp, Homo sapiens
caggctggagtgcagtggtgcc

SEQ ID NO: 7484161 - DNA, 22 bp, Homo sapiens
caggctggagtgcagtggtgcc

SEQ ID NO: 7484162 - DNA, 22 bp, Homo sapiens
caggctggagtacaattgtgtg

SEQ ID NO: 7484163 - DNA, 22 bp, Homo sapiens
caggctggagtgcagtggtgcc

SEQ ID NO: 7484164 - DNA, 22 bp, Homo sapiens
caggctggagtgcagtggtgcc

SEQ ID NO: 7484165 - DNA, 22 bp, Homo sapiens
caggctggagtgcagtgtcgcc

SEQ ID NO: 7484166 - DNA, 22 bp, Homo sapiens
caggctggagtgcagtgtcgcc

SEQ ID NO: 7484167 - DNA, 22 bp, Homo sapiens
caggctggagtgcagtgtcgcc

SEQ ID NO: 7484168 - DNA, 22 bp, Homo sapiens
caggctggagtgcagtgtcgcc

SEQ ID NO: 7484169 - DNA, 22 bp, Homo sapiens
caggctggagtgcagtgtcgcc

SEQ ID NO: 7484170 - DNA, 22 bp, Homo sapiens
caggctggagtgcagtgtcgcc

SEQ ID NO: 7484171 - DNA, 22 bp, Homo sapiens
caggctggagtgcagtgtcgcc

SEQ ID NO: 7484172 - DNA, 22 bp, Homo sapiens
caggctggagtgcagtgtcgcc

SEQ ID NO: 7484173 - DNA, 22 bp, Homo sapiens
caggctggagtgcagtgtcgcc

SEQ ID NO: 7484174 - DNA, 22 bp, Homo sapiens
caggctggagtgcagtgtcgcc

SEQ ID NO: 7484175 - DNA, 22 bp, Homo sapiens
caggctggagtgcagtgtcgcc

SEQ ID NO: 7484176 - DNA, 22 bp, Homo sapiens
cagggagctggctggctgtgcc

SEQ ID NO: 7484177 - DNA, 22 bp, Homo sapiens
cagggagctggctggctgtgcc

SEQ ID NO: 7484178 - DNA, 22 bp, Homo sapiens
cagggagctggctggctgtgcc

SEQ ID NO: 7484179 - DNA, 22 bp, Homo sapiens
cagggagctggctggctgtgcc

SEQ ID NO: 7484180 - DNA, 22 bp, Homo sapiens
cagggagctggctggctgtgcc

SEQ ID NO: 7484181 - DNA, 22 bp, Homo sapiens
cagggagctggctggctgtgcc

SEQ ID NO: 7484182 - DNA, 22 bp, Homo sapiens
cagggagctggctggctgtgcc

SEQ ID NO: 7484183 - DNA, 22 bp, Homo sapiens
cagggagctggctggctgtgcc

SEQ ID NO: 7484184 - DNA, 22 bp, Homo sapiens
cagggagctggctggctgtgcc

SEQ ID NO: 7484185 - DNA, 22 bp, Homo sapiens
cagggagctggctggctgtgcc

SEQ ID NO: 7484186 - DNA, 22 bp, Homo sapiens
cagggagctggctggctgtgcc

SEQ ID NO: 7484187 - DNA, 22 bp, Homo sapiens
cagggagctggctggcgtgagt

SEQ ID NO: 7484188 - DNA, 22 bp, Homo sapiens
cagggagctggctggcgtgagt

SEQ ID NO: 7484189 - DNA, 22 bp, Homo sapiens
cagggagctggctggcgtgagt

SEQ ID NO: 7484190 - DNA, 22 bp, Homo sapiens
cagggagctggctggctgtgcc

SEQ ID NO: 7484191 - DNA, 22 bp, Homo sapiens
cagggagctggctggcgtgagt

SEQ ID NO: 7484192 - DNA, 22 bp, Homo sapiens
cagggagctggctggcgtgagt

SEQ ID NO: 7484193 - DNA, 22 bp, Homo sapiens
cagggagctggctggcgtgagt

SEQ ID NO: 7484194 - DNA, 22 bp, Homo sapiens
cagggagctggctggcgtgagt

SEQ ID NO: 7484195 - DNA, 22 bp, Homo sapiens
cagggagctggctggcgtgagt

SEQ ID NO: 7484196 - DNA, 22 bp, Homo sapiens
cagggagctggagttggagtac

SEQ ID NO: 7484197 - DNA, 22 bp, Homo sapiens
cagggagctctgggccggactc

SEQ ID NO: 7484198 - DNA, 22 bp, Homo sapiens
cagggagctctgggccggactc

SEQ ID NO: 7484199 - DNA, 22 bp, Homo sapiens
cagggagctctgggccggactc

SEQ ID NO: 7484200 - DNA, 22 bp, Homo sapiens
cagggagctctgggccggactc

SEQ ID NO: 7484201 - DNA, 22 bp, Homo sapiens
cagggagctctgggccggactc

SEQ ID NO: 7484202 - DNA, 22 bp, Homo sapiens
cagggagctctgggccggactc

SEQ ID NO: 7484203 - DNA, 22 bp, Homo sapiens
cagggagctctgggccggactc

SEQ ID NO: 7484204 - DNA, 22 bp, Homo sapiens
cagggagctattagggttagtg

SEQ ID NO: 7484205 - DNA, 22 bp, Homo sapiens
cagggagctattagggttagtg

SEQ ID NO: 7484206 - DNA, 22 bp, Homo sapiens
cagggagctattagggttagtg

SEQ ID NO: 7484207 - DNA, 22 bp, Homo sapiens
cagggagctctgggccggactc

SEQ ID NO: 7484208 - DNA, 22 bp, Homo sapiens
cagggagctggagttggagtac

SEQ ID NO: 7484209 - DNA, 22 bp, Homo sapiens
cagggagctggagttggagtac

SEQ ID NO: 7484210 - DNA, 22 bp, Homo sapiens
cagggagctggagttggagtac

SEQ ID NO: 7484211 - DNA, 22 bp, Homo sapiens
cagggagctgacaaccaaggag

SEQ ID NO: 7484212 - DNA, 22 bp, Homo sapiens
cagggagctgacaaccaaggag

SEQ ID NO: 7484213 - DNA, 22 bp, Homo sapiens
cagggagctgacaaccaaggag

SEQ ID NO: 7484214 - DNA, 22 bp, Homo sapiens
cagggagctgacaaccaaggag

SEQ ID NO: 7484215 - DNA, 22 bp, Homo sapiens
cagggagctctgggccggactc

SEQ ID NO: 7484216 - DNA, 22 bp, Homo sapiens
cagggagctggtgccagccgac

SEQ ID NO: 7484217 - DNA, 22 bp, Homo sapiens
cagggagctggctggctgtgcc

SEQ ID NO: 7484218 - DNA, 22 bp, Homo sapiens
cagggagctggtgccagccgac

SEQ ID NO: 7484219 - DNA, 22 bp, Homo sapiens
cagggagctggtgccagccgac

SEQ ID NO: 7484220 - DNA, 22 bp, Homo sapiens
cagggagctggtgccagccgac

SEQ ID NO: 7484221 - DNA, 22 bp, Homo sapiens
cagggagctttcccaggaccct

SEQ ID NO: 7484222 - DNA, 22 bp, Homo sapiens
cagggagctttcccaggaccct

SEQ ID NO: 7484223 - DNA, 22 bp, Homo sapiens
cagggagctggtgccagccgac

SEQ ID NO: 7484224 - DNA, 22 bp, Homo sapiens
cagggagctttcccaggaccct

SEQ ID NO: 7484225 - DNA, 22 bp, Homo sapiens
cagggatgggatggagtcagtt

SEQ ID NO: 7484226 - DNA, 22 bp, Homo sapiens
cagggatgggatggagtcagtt

SEQ ID NO: 7484227 - DNA, 22 bp, Homo sapiens
cagggatgggatggagtcagtt

SEQ ID NO: 7484228 - DNA, 22 bp, Homo sapiens
cagggatgggatggagtcagtt

SEQ ID NO: 7484229 - DNA, 22 bp, Homo sapiens
cagggatgggatggagtcagtt

SEQ ID NO: 7484230 - DNA, 22 bp, Homo sapiens
cagggagctttcccaggaccct

SEQ ID NO: 7484231 - DNA, 22 bp, Homo sapiens
cagggatggcgctggctgcccg

SEQ ID NO: 7484232 - DNA, 22 bp, Homo sapiens
cagggatggcgctggctgcccg

SEQ ID NO: 7484233 - DNA, 19 bp, Homo sapiens
cagggatgggtagggactc

SEQ ID NO: 7484234 - DNA, 22 bp, Homo sapiens
cagggatgggatggagtcagtt

SEQ ID NO: 7484235 - DNA, 22 bp, Homo sapiens
cagggatgggatggagtcagtt

SEQ ID NO: 7484236 - DNA, 22 bp, Homo sapiens
cagggatgggatggagtcagtt

SEQ ID NO: 7484237 - DNA, 22 bp, Homo sapiens
cagggatgggatggagtcagtt

SEQ ID NO: 7484238 - DNA, 22 bp, Homo sapiens
cagggatgggatggagtcagtt

SEQ ID NO: 7484239 - DNA, 22 bp, Homo sapiens
cagggatgggatggagtcagtt

SEQ ID NO: 7484240 - DNA, 22 bp, Homo sapiens
cagggatggttgagaattggta

SEQ ID NO: 7484241 - DNA, 22 bp, Homo sapiens
cagggatggtaaatatgtaaag

SEQ ID NO: 7484242 - DNA, 22 bp, Homo sapiens
cagggatggtaaatatgtaaag

SEQ ID NO: 7484243 - DNA, 19 bp, Homo sapiens
cagggatgggtagggactc

SEQ ID NO: 7484244 - DNA, 19 bp, Homo sapiens
cagggatgggtagggactc

SEQ ID NO: 7484245 - DNA, 19 bp, Homo sapiens
cagggatgggtagggactc

SEQ ID NO: 7484246 - DNA, 19 bp, Homo sapiens
cagggatgggtagggactc

SEQ ID NO: 7484247 - DNA, 22 bp, Homo sapiens
caggctgcggccgtgtgagcat

SEQ ID NO: 7484248 - DNA, 22 bp, Homo sapiens
caggctgcggccgtgtgagcat

SEQ ID NO: 7484249 - DNA, 22 bp, Homo sapiens
caggctgcggccgtgtgagcat

SEQ ID NO: 7484250 - DNA, 22 bp, Homo sapiens
caggctgcggccgtgtgagcat

SEQ ID NO: 7484251 - DNA, 22 bp, Homo sapiens
caggctgcggccgtgtgagcat

SEQ ID NO: 7484252 - DNA, 22 bp, Homo sapiens
caggctgcggccgtgtgagcat

SEQ ID NO: 7484253 - DNA, 22 bp, Homo sapiens
caggctgcggtcggctctggtc

SEQ ID NO: 7484254 - DNA, 22 bp, Homo sapiens
caggctgcggtcggctctggtc

SEQ ID NO: 7484255 - DNA, 22 bp, Homo sapiens
caggctgcggtcggctctggtc

SEQ ID NO: 7484256 - DNA, 22 bp, Homo sapiens
caggctgcggtcggctctggtc

SEQ ID NO: 7484257 - DNA, 22 bp, Homo sapiens
caggctgcggtcggctctggtc

SEQ ID NO: 7484258 - DNA, 22 bp, Homo sapiens
caggctgcggccgtgtgagcat

SEQ ID NO: 7484259 - DNA, 22 bp, Homo sapiens
caggctgcggccgtgtgagcat

SEQ ID NO: 7484260 - DNA, 22 bp, Homo sapiens
caggctgcggccgtgtgagcat

SEQ ID NO: 7484261 - DNA, 22 bp, Homo sapiens
caggctgcggccgtgtgagcat

SEQ ID NO: 7484262 - DNA, 22 bp, Homo sapiens
caggctgcggccgtgtgagcat

SEQ ID NO: 7484263 - DNA, 22 bp, Homo sapiens
caggctgcggccgtgtgagcat

SEQ ID NO: 7484264 - DNA, 22 bp, Homo sapiens
agctgtggcaaccttgtcagac

SEQ ID NO: 7484265 - DNA, 22 bp, Homo sapiens
agctgtggcagcactttggagt

SEQ ID NO: 7484266 - DNA, 22 bp, Homo sapiens
caggctgagctctggcctgggc

SEQ ID NO: 7484267 - DNA, 22 bp, Homo sapiens
caggctgaggcagtagggtttg

SEQ ID NO: 7484268 - DNA, 22 bp, Homo sapiens
caggctgagctctggcctgggc

SEQ ID NO: 7484269 - DNA, 22 bp, Homo sapiens
caggctgagctctggcctgggc

SEQ ID NO: 7484270 - DNA, 22 bp, Homo sapiens
caggctgcggtcggctctggtc

SEQ ID NO: 7484271 - DNA, 22 bp, Homo sapiens
caggctgcgtttgtgaaaggta

SEQ ID NO: 7484272 - DNA, 22 bp, Homo sapiens
caggctgcgtttgtgaaaggta

SEQ ID NO: 7484273 - DNA, 22 bp, Homo sapiens
caggctgcggtcggctctggtc

SEQ ID NO: 7484274 - DNA, 22 bp, Homo sapiens
caggctgcggtcggctctggtc

SEQ ID NO: 7484275 - DNA, 22 bp, Homo sapiens
caggctgcggtcggctctggtc

SEQ ID NO: 7484276 - DNA, 22 bp, Homo sapiens
caggctgcggtcggctctggtc

SEQ ID NO: 7484277 - DNA, 22 bp, Homo sapiens
caggctgcggtcggctctggtc

SEQ ID NO: 7484278 - DNA, 22 bp, Homo sapiens
caggctgcggtcggctctggtc

SEQ ID NO: 7484279 - DNA, 22 bp, Homo sapiens
caggctgctgacaggcttggag

SEQ ID NO: 7484280 - DNA, 22 bp, Homo sapiens
caggctgctgacaggcttggag

SEQ ID NO: 7484281 - DNA, 22 bp, Homo sapiens
caggctgctgacaggcttggag

SEQ ID NO: 7484282 - DNA, 22 bp, Homo sapiens
caggctgctccagggtaggaaa

SEQ ID NO: 7484283 - DNA, 22 bp, Homo sapiens
caggctgctccagggtaggaaa

SEQ ID NO: 7484284 - DNA, 22 bp, Homo sapiens
caggctgctccagggtaggaaa

SEQ ID NO: 7484285 - DNA, 22 bp, Homo sapiens
caggctgctccagggtaggaaa

SEQ ID NO: 7484286 - DNA, 22 bp, Homo sapiens
caggctgctccagggtaggaaa

SEQ ID NO: 7484287 - DNA, 22 bp, Homo sapiens
caggctgctccagggtaggaaa

SEQ ID NO: 7484288 - DNA, 22 bp, Homo sapiens
caggctgcgtttgtgaaaggta

SEQ ID NO: 7484289 - DNA, 22 bp, Homo sapiens
caggctgcgtttgtgaaaggta

SEQ ID NO: 7484290 - DNA, 22 bp, Homo sapiens
agctgtggcaaccttgtcagac

SEQ ID NO: 7484291 - DNA, 22 bp, Homo sapiens
agctgtggattgggtactttct

SEQ ID NO: 7484292 - DNA, 22 bp, Homo sapiens
agctgtggagtagggggttgga

SEQ ID NO: 7484293 - DNA, 19 bp, Homo sapiens
agctgtggatgtgggattt

SEQ ID NO: 7484294 - DNA, 19 bp, Homo sapiens
agctgtggatgtgggattt

SEQ ID NO: 7484295 - DNA, 22 bp, Homo sapiens
agctgtggcagcactttggagt

SEQ ID NO: 7484296 - DNA, 22 bp, Homo sapiens
agctgtggcagcactttggagt

SEQ ID NO: 7484297 - DNA, 22 bp, Homo sapiens
agctgtggcaaccttgtcagac

SEQ ID NO: 7484298 - DNA, 22 bp, Homo sapiens
agctgtggcaaccttgtcagac

SEQ ID NO: 7484299 - DNA, 22 bp, Homo sapiens
agctgtggcaaccttgtcagac

SEQ ID NO: 7484300 - DNA, 22 bp, Homo sapiens
agctgtggcagcagccgtggca

SEQ ID NO: 7484301 - DNA, 22 bp, Homo sapiens
agctgtggaagactgtcagggt

SEQ ID NO: 7484302 - DNA, 22 bp, Homo sapiens
agctgtggaagactgtcagggt

SEQ ID NO: 7484303 - DNA, 22 bp, Homo sapiens
agctgtggaagactgtcagggt

SEQ ID NO: 7484304 - DNA, 22 bp, Homo sapiens
agctgtggaagactgtcagggt

SEQ ID NO: 7484305 - DNA, 19 bp, Homo sapiens
agctgtggatgtgggattt

SEQ ID NO: 7484306 - DNA, 22 bp, Homo sapiens
agctgtggagtagggggttgga

SEQ ID NO: 7484307 - DNA, 22 bp, Homo sapiens
agctgtggagtagggggttgga

SEQ ID NO: 7484308 - DNA, 22 bp, Homo sapiens
agctgtggagtagggggttgga

SEQ ID NO: 7484309 - DNA, 22 bp, Homo sapiens
agctgtggaagactgtcagggt

SEQ ID NO: 7484310 - DNA, 22 bp, Homo sapiens
agctgtggaagactgtcagggt

SEQ ID NO: 7484311 - DNA, 22 bp, Homo sapiens
agctgtggaagactgtcagggt

SEQ ID NO: 7484312 - DNA, 22 bp, Homo sapiens
agctgtggaaatcaggcaatga

SEQ ID NO: 7484313 - DNA, 22 bp, Homo sapiens
agctgtgctgccaagttgctga

SEQ ID NO: 7484314 - DNA, 22 bp, Homo sapiens
agctgtgctgtggtcatctggg

SEQ ID NO: 7484315 - DNA, 22 bp, Homo sapiens
agctgtgcacactgtgaagtag

SEQ ID NO: 7484316 - DNA, 22 bp, Homo sapiens
agctgtgcctattcgtggcaag

SEQ ID NO: 7484317 - DNA, 22 bp, Homo sapiens
agctgtgcctattcgtggcaag

SEQ ID NO: 7484318 - DNA, 22 bp, Homo sapiens
agctgtgccttgctgcacggtg

SEQ ID NO: 7484319 - DNA, 22 bp, Homo sapiens
agctgtgccttgctgcacggtg

SEQ ID NO: 7484320 - DNA, 22 bp, Homo sapiens
caggctcagatgccctgcgctg

SEQ ID NO: 7484321 - DNA, 22 bp, Homo sapiens
caggctcagaagccagtggagc

SEQ ID NO: 7484322 - DNA, 22 bp, Homo sapiens
caggctcagatgccctgcgctg

SEQ ID NO: 7484323 - DNA, 22 bp, Homo sapiens
caggctcagatgccctgcgctg

SEQ ID NO: 7484324 - DNA, 22 bp, Homo sapiens
caggctcagatgccctgcgctg

SEQ ID NO: 7484325 - DNA, 22 bp, Homo sapiens
caggctcagcaggagcctgacc

SEQ ID NO: 7484326 - DNA, 22 bp, Homo sapiens
caggctcagatgccctgcgctg

SEQ ID NO: 7484327 - DNA, 22 bp, Homo sapiens
caggctcagctctggccagtgc

SEQ ID NO: 7484328 - DNA, 22 bp, Homo sapiens
caggctcagcaggagcctgacc

SEQ ID NO: 7484329 - DNA, 22 bp, Homo sapiens
caggctcagcaggagcctgacc

SEQ ID NO: 7484330 - DNA, 22 bp, Homo sapiens
caggctcagctctggccagtgc

SEQ ID NO: 7484331 - DNA, 22 bp, Homo sapiens
caggctcagccacaggggaagg

SEQ ID NO: 7484332 - DNA, 22 bp, Homo sapiens
caggctcagccacaggggaagg

SEQ ID NO: 7484333 - DNA, 22 bp, Homo sapiens
caggctcagctctggccagtgc

SEQ ID NO: 7484334 - DNA, 22 bp, Homo sapiens
caggctcagctctggccagtgc

SEQ ID NO: 7484335 - DNA, 22 bp, Homo sapiens
caggctcagtcagaaaatgtat

SEQ ID NO: 7484336 - DNA, 22 bp, Homo sapiens
caggctccaagccctctgatgt

SEQ ID NO: 7484337 - DNA, 22 bp, Homo sapiens
caggctcagcaggagcctgacc

SEQ ID NO: 7484338 - DNA, 22 bp, Homo sapiens
caggctcagtcagaaaatgtat

SEQ ID NO: 7484339 - DNA, 22 bp, Homo sapiens
caggctccactgtaggcagctc

SEQ ID NO: 7484340 - DNA, 22 bp, Homo sapiens
caggctccactgtaggcagctc

SEQ ID NO: 7484341 - DNA, 22 bp, Homo sapiens
caggctccactgtaggcagctc

SEQ ID NO: 7484342 - DNA, 22 bp, Homo sapiens
caggctccactgtaggcagctc

SEQ ID NO: 7484343 - DNA, 22 bp, Homo sapiens
caggctccactgtaggcagctc

SEQ ID NO: 7484344 - DNA, 22 bp, Homo sapiens
agctgtgaattttatgctagtg

SEQ ID NO: 7484345 - DNA, 22 bp, Homo sapiens
agctgtctttggagagggagag

SEQ ID NO: 7484346 - DNA, 22 bp, Homo sapiens
caggctccactgtaggcagctc

SEQ ID NO: 7484347 - DNA, 22 bp, Homo sapiens
agctgtgaccttcaagagctac

SEQ ID NO: 7484348 - DNA, 22 bp, Homo sapiens
agctgtgattatccactggaat

SEQ ID NO: 7484349 - DNA, 22 bp, Homo sapiens
agctgtgattatccactggaat

SEQ ID NO: 7484350 - DNA, 22 bp, Homo sapiens
agctgtgaccttcaagagctac

SEQ ID NO: 7484351 - DNA, 22 bp, Homo sapiens
agctgtgaccttcaagagctac

SEQ ID NO: 7484352 - DNA, 22 bp, Homo sapiens
caggctcactttctcagtcaca

SEQ ID NO: 7484353 - DNA, 22 bp, Homo sapiens
caggctcactttctcagtcaca

SEQ ID NO: 7484354 - DNA, 22 bp, Homo sapiens
caggctcactgtaaggtcagct

SEQ ID NO: 7484355 - DNA, 22 bp, Homo sapiens
caggctcactttctcagtcaca

SEQ ID NO: 7484356 - DNA, 22 bp, Homo sapiens
caggctcagaagccagtggagc

SEQ ID NO: 7484357 - DNA, 22 bp, Homo sapiens
caggctcactttctcagtcaca

SEQ ID NO: 7484358 - DNA, 22 bp, Homo sapiens
caggctcactttctcagtcaca

SEQ ID NO: 7484359 - DNA, 22 bp, Homo sapiens
caggctcactttctcagtcaca

SEQ ID NO: 7484360 - DNA, 22 bp, Homo sapiens
caggcctgtctgcacatgaggc

SEQ ID NO: 7484361 - DNA, 22 bp, Homo sapiens
caggctcactgtaaggtcagct

SEQ ID NO: 7484362 - DNA, 22 bp, Homo sapiens
caggctcactgtaaggtcagct

SEQ ID NO: 7484363 - DNA, 22 bp, Homo sapiens
caggctcactgtaaggtcagct

SEQ ID NO: 7484364 - DNA, 22 bp, Homo sapiens
caggcctgtctgcacatgaggc

SEQ ID NO: 7484365 - DNA, 22 bp, Homo sapiens
caggcctgtctgcacatgaggc

SEQ ID NO: 7484366 - DNA, 22 bp, Homo sapiens
caggcctgtctgcacatgaggc

SEQ ID NO: 7484367 - DNA, 22 bp, Homo sapiens
caggctcactgtaaggtcagct

SEQ ID NO: 7484368 - DNA, 22 bp, Homo sapiens
caggctcactgtaaggtcagct

SEQ ID NO: 7484369 - DNA, 22 bp, Homo sapiens
caggctcactgtaaggtcagct

SEQ ID NO: 7484370 - DNA, 22 bp, Homo sapiens
agctggggcatttatccactaa

SEQ ID NO: 7484371 - DNA, 18 bp, Homo sapiens
agctggggcctctggtcc

SEQ ID NO: 7484372 - DNA, 18 bp, Homo sapiens
agctggggcctctggtcc

SEQ ID NO: 7484373 - DNA, 18 bp, Homo sapiens
agctggggcctctggtcc

SEQ ID NO: 7484374 - DNA, 18 bp, Homo sapiens
agctggggcctctggtcc

SEQ ID NO: 7484375 - DNA, 22 bp, Homo sapiens
agctggggcatttatccactaa

SEQ ID NO: 7484376 - DNA, 22 bp, Homo sapiens
agctggggcatttatccactaa

SEQ ID NO: 7484377 - DNA, 22 bp, Homo sapiens
agctggggcatttatccactaa

SEQ ID NO: 7484378 - DNA, 22 bp, Homo sapiens
agctggggcatttatccactaa

SEQ ID NO: 7484379 - DNA, 18 bp, Homo sapiens
agctggggcctctggtcc

SEQ ID NO: 7484380 - DNA, 19 bp, Homo sapiens
agctggggcggtgtgtgtt

SEQ ID NO: 7484381 - DNA, 19 bp, Homo sapiens
agctggggcggtgtgtgtt

SEQ ID NO: 7484382 - DNA, 18 bp, Homo sapiens
agctggggcctctggtcc

SEQ ID NO: 7484383 - DNA, 18 bp, Homo sapiens
agctggggcctctggtcc

SEQ ID NO: 7484384 - DNA, 20 bp, Homo sapiens
caggtgagcagatctgggtg

SEQ ID NO: 7484385 - DNA, 22 bp, Homo sapiens
caggtgagctctatctagggag

SEQ ID NO: 7484386 - DNA, 22 bp, Homo sapiens
caggtgagctctatctagggag

SEQ ID NO: 7484387 - DNA, 22 bp, Homo sapiens
caggtgagctctatctagggag

SEQ ID NO: 7484388 - DNA, 22 bp, Homo sapiens
caggtgaggctgaacagatgaa

SEQ ID NO: 7484389 - DNA, 22 bp, Homo sapiens
caggtgaggctgaacagatgaa

SEQ ID NO: 7484390 - DNA, 22 bp, Homo sapiens
caggtgaggctgaacagatgaa

SEQ ID NO: 7484391 - DNA, 22 bp, Homo sapiens
caggtgagctctatctagggag

SEQ ID NO: 7484392 - DNA, 20 bp, Homo sapiens
caggtgagcagatctgggtg

SEQ ID NO: 7484393 - DNA, 20 bp, Homo sapiens
caggtgagcagatctgggtg

SEQ ID NO: 7484394 - DNA, 20 bp, Homo sapiens
caggtgagcagatctgggtg

SEQ ID NO: 7484395 - DNA, 22 bp, Homo sapiens
caggtgagaggcggtcctgcat

SEQ ID NO: 7484396 - DNA, 22 bp, Homo sapiens
caggtgagaggcggtcctgcat

SEQ ID NO: 7484397 - DNA, 22 bp, Homo sapiens
caggtgagaggcggtcctgcat

SEQ ID NO: 7484398 - DNA, 22 bp, Homo sapiens
caggtgacttctgaggccttca

SEQ ID NO: 7484399 - DNA, 22 bp, Homo sapiens
caggtgacttctgaggccttca

SEQ ID NO: 7484400 - DNA, 22 bp, Homo sapiens
caggtgagttttcctccttggt

SEQ ID NO: 7484401 - DNA, 22 bp, Homo sapiens
caggtgcaatgagacagctctg

SEQ ID NO: 7484402 - DNA, 22 bp, Homo sapiens
caggtgaggctgaacagatgaa

SEQ ID NO: 7484403 - DNA, 22 bp, Homo sapiens
caggtgagtaacaatgggtgat

SEQ ID NO: 7484404 - DNA, 22 bp, Homo sapiens
caggtgagtaacaatgggtgat

SEQ ID NO: 7484405 - DNA, 22 bp, Homo sapiens
caggtgagtaacaatgggtgat

SEQ ID NO: 7484406 - DNA, 22 bp, Homo sapiens
caggtgagtaacaatgggtgat

SEQ ID NO: 7484407 - DNA, 22 bp, Homo sapiens
caggtgagtaacaatgggtgat

SEQ ID NO: 7484408 - DNA, 22 bp, Homo sapiens
caggtgaggctgaacagatgaa

SEQ ID NO: 7484409 - DNA, 22 bp, Homo sapiens
caggtgaggctgaacagatgaa

SEQ ID NO: 7484410 - DNA, 22 bp, Homo sapiens
caggtgagctctatctagggag

SEQ ID NO: 7484411 - DNA, 22 bp, Homo sapiens
caggtgaggctgaacagatgaa

SEQ ID NO: 7484412 - DNA, 22 bp, Homo sapiens
caggtgaggctgaacagatgaa

SEQ ID NO: 7484413 - DNA, 17 bp, Homo sapiens
caggtgacctggtgatg

SEQ ID NO: 7484414 - DNA, 17 bp, Homo sapiens
caggtgacctggtgatg

SEQ ID NO: 7484415 - DNA, 22 bp, Homo sapiens
caggtgacctttgtcctaagtt

SEQ ID NO: 7484416 - DNA, 22 bp, Homo sapiens
caggtgacctgggatccgctgc

SEQ ID NO: 7484417 - DNA, 22 bp, Homo sapiens
caggtgacctgggatccgctgc

SEQ ID NO: 7484418 - DNA, 22 bp, Homo sapiens
caggtgacctcagcgcctgcag

SEQ ID NO: 7484419 - DNA, 22 bp, Homo sapiens
caggtgacctcagcgcctgcag

SEQ ID NO: 7484420 - DNA, 22 bp, Homo sapiens
caggtgaccctctcacctgctt

SEQ ID NO: 7484421 - DNA, 22 bp, Homo sapiens
caggtgaccctctcacctgctt

SEQ ID NO: 7484422 - DNA, 22 bp, Homo sapiens
caggtgaccctctcacctgctt

SEQ ID NO: 7484423 - DNA, 22 bp, Homo sapiens
caggtgacctatggtcactaca

SEQ ID NO: 7484424 - DNA, 22 bp, Homo sapiens
caggtgacctatggtcactaca

SEQ ID NO: 7484425 - DNA, 22 bp, Homo sapiens
caggtgacatcaacaggaccac

SEQ ID NO: 7484426 - DNA, 22 bp, Homo sapiens
caggtgacatcaacaggaccac

SEQ ID NO: 7484427 - DNA, 22 bp, Homo sapiens
caggtgaccctcagtgtggact

SEQ ID NO: 7484428 - DNA, 22 bp, Homo sapiens
caggtgaccctcagtgtggact

SEQ ID NO: 7484429 - DNA, 22 bp, Homo sapiens
caggtcctttagtgtccagaac

SEQ ID NO: 7484430 - DNA, 22 bp, Homo sapiens
caggtcctttagtgtccagaac

SEQ ID NO: 7484431 - DNA, 22 bp, Homo sapiens
caggtcctttagtgtccagaac

SEQ ID NO: 7484432 - DNA, 22 bp, Homo sapiens
caggtgacatcaacaggaccac

SEQ ID NO: 7484433 - DNA, 22 bp, Homo sapiens
caggtcctttagtgtccagaac

SEQ ID NO: 7484434 - DNA, 22 bp, Homo sapiens
caggtcctttagtgtccagaac

SEQ ID NO: 7484435 - DNA, 22 bp, Homo sapiens
caggtccttgtttgtaaagcag

SEQ ID NO: 7484436 - DNA, 22 bp, Homo sapiens
caggtcctttagtgtccagaac

SEQ ID NO: 7484437 - DNA, 22 bp, Homo sapiens
caggtcctttagtgtccagaac

SEQ ID NO: 7484438 - DNA, 22 bp, Homo sapiens
caggtcctttagtgtccagaac

SEQ ID NO: 7484439 - DNA, 22 bp, Homo sapiens
cagggtgcctctgctcccacca

SEQ ID NO: 7484440 - DNA, 22 bp, Homo sapiens
cagggtgcctctgctcccacca

SEQ ID NO: 7484441 - DNA, 22 bp, Homo sapiens
cagggtgcctctgctcccacca

SEQ ID NO: 7484442 - DNA, 22 bp, Homo sapiens
cagggtgcctgtcctcagcaaa

SEQ ID NO: 7484443 - DNA, 22 bp, Homo sapiens
cagggtgcctgtcctcagcaaa

SEQ ID NO: 7484444 - DNA, 22 bp, Homo sapiens
cagggtgcctcccgctcgccgg

SEQ ID NO: 7484445 - DNA, 22 bp, Homo sapiens
cagggtgcctcccgctcgccgg

SEQ ID NO: 7484446 - DNA, 22 bp, Homo sapiens
cagggtgcctcccgctcgccgg

SEQ ID NO: 7484447 - DNA, 22 bp, Homo sapiens
cagggtgcctcccgctcgccgg

SEQ ID NO: 7484448 - DNA, 22 bp, Homo sapiens
cagggtgcctcccgctcgccgg

SEQ ID NO: 7484449 - DNA, 22 bp, Homo sapiens
cagggtgcctgtcctcagcaaa

SEQ ID NO: 7484450 - DNA, 22 bp, Homo sapiens
cagggtgcctgtcctcagcaaa

SEQ ID NO: 7484451 - DNA, 22 bp, Homo sapiens
cagggtgcgccactcagatgta

SEQ ID NO: 7484452 - DNA, 22 bp, Homo sapiens
cagggtgcgccactcagatgta

SEQ ID NO: 7484453 - DNA, 22 bp, Homo sapiens
cagggtgcgggagatgtgcacc

SEQ ID NO: 7484454 - DNA, 22 bp, Homo sapiens
cagggtgcgccactcagatgta

SEQ ID NO: 7484455 - DNA, 22 bp, Homo sapiens
cagggtgcagtgtcgctgctag

SEQ ID NO: 7484456 - DNA, 22 bp, Homo sapiens
cagggtgcatacccatgcatac

SEQ ID NO: 7484457 - DNA, 22 bp, Homo sapiens
cagggtgcatacccatgcatac

SEQ ID NO: 7484458 - DNA, 22 bp, Homo sapiens
cagggtgcagagctagggtagt

SEQ ID NO: 7484459 - DNA, 22 bp, Homo sapiens
cagggtgcagtgtcgctgctag

SEQ ID NO: 7484460 - DNA, 22 bp, Homo sapiens
cagggtgcagtgtcgctgctag

SEQ ID NO: 7484461 - DNA, 22 bp, Homo sapiens
cagggtgcagtgtcgctgctag

SEQ ID NO: 7484462 - DNA, 22 bp, Homo sapiens
cagggtgagcctctggagccct

SEQ ID NO: 7484463 - DNA, 22 bp, Homo sapiens
cagggtgactgccctggccact

SEQ ID NO: 7484464 - DNA, 22 bp, Homo sapiens
cagggtgagcctctggagccct

SEQ ID NO: 7484465 - DNA, 22 bp, Homo sapiens
cagggtgagcctctggagccct

SEQ ID NO: 7484466 - DNA, 22 bp, Homo sapiens
cagggtgagtgggaagcagcgt

SEQ ID NO: 7484467 - DNA, 22 bp, Homo sapiens
cagggtgagtgggaagcagcgt

SEQ ID NO: 7484468 - DNA, 22 bp, Homo sapiens
cagggtgagtgggaagcagcgt

SEQ ID NO: 7484469 - DNA, 22 bp, Homo sapiens
cagggtgagcctctggagccct

SEQ ID NO: 7484470 - DNA, 22 bp, Homo sapiens
caggggctgtttgcctcaggcc

SEQ ID NO: 7484471 - DNA, 22 bp, Homo sapiens
caggggctgtttgcctcaggcc

SEQ ID NO: 7484472 - DNA, 22 bp, Homo sapiens
caggggctgtttgcctcaggcc

SEQ ID NO: 7484473 - DNA, 22 bp, Homo sapiens
caggggctgtttgcctcaggcc

SEQ ID NO: 7484474 - DNA, 22 bp, Homo sapiens
caggggctgtgggcggagcctc

SEQ ID NO: 7484475 - DNA, 22 bp, Homo sapiens
caggggctgtgggcggagcctc

SEQ ID NO: 7484476 - DNA, 22 bp, Homo sapiens
caggggctgtgggcggagcctc

SEQ ID NO: 7484477 - DNA, 22 bp, Homo sapiens
caggggctgtgggcggagcctc

SEQ ID NO: 7484478 - DNA, 22 bp, Homo sapiens
caggggctgtgggcggagcctc

SEQ ID NO: 7484479 - DNA, 22 bp, Homo sapiens
caggggctgtgggcggagcctc

SEQ ID NO: 7484480 - DNA, 22 bp, Homo sapiens
cagggtgactgccctggccact

SEQ ID NO: 7484481 - DNA, 23 bp, Homo sapiens
cagggtgaccaatgtggccatca

SEQ ID NO: 7484482 - DNA, 23 bp, Homo sapiens
cagggtgaccaatgtggccatca

SEQ ID NO: 7484483 - DNA, 23 bp, Homo sapiens
cagggtgaccaatgtggccatca

SEQ ID NO: 7484484 - DNA, 22 bp, Homo sapiens
caggggctgtttgcctcaggcc

SEQ ID NO: 7484485 - DNA, 22 bp, Homo sapiens
caggggctgtttgcctcaggcc

SEQ ID NO: 7484486 - DNA, 22 bp, Homo sapiens
caggggctgtttgcctcaggcc

SEQ ID NO: 7484487 - DNA, 22 bp, Homo sapiens
cagggtgacaagtggcaaggag

SEQ ID NO: 7484488 - DNA, 22 bp, Homo sapiens
caggggctgagaaggaacgtcc

SEQ ID NO: 7484489 - DNA, 22 bp, Homo sapiens
caggggctgtggcacatggtgt

SEQ ID NO: 7484490 - DNA, 22 bp, Homo sapiens
caggggctgtggcacatggtgt

SEQ ID NO: 7484491 - DNA, 22 bp, Homo sapiens
caggggctgtggcacatggtgt

SEQ ID NO: 7484492 - DNA, 22 bp, Homo sapiens
caggggctgtgggcggagcctc

SEQ ID NO: 7484493 - DNA, 22 bp, Homo sapiens
caggggctgtggcacatggtgt

SEQ ID NO: 7484494 - DNA, 22 bp, Homo sapiens
caggggctgtggcacatggtgt

SEQ ID NO: 7484495 - DNA, 22 bp, Homo sapiens
caggggctgagaaggaacgtcc

SEQ ID NO: 7484496 - DNA, 22 bp, Homo sapiens
caggggctgagaaggaacgtcc

SEQ ID NO: 7484497 - DNA, 22 bp, Homo sapiens
caggggctgaaatgttggggtt

SEQ ID NO: 7484498 - DNA, 22 bp, Homo sapiens
caggggctgaaatgttggggtt

SEQ ID NO: 7484499 - DNA, 22 bp, Homo sapiens
caggggctgaaatgttggggtt

SEQ ID NO: 7484500 - DNA, 22 bp, Homo sapiens
caggggctgaaatgttggggtt

SEQ ID NO: 7484501 - DNA, 22 bp, Homo sapiens
caggggctgaaatgttggggtt

SEQ ID NO: 7484502 - DNA, 22 bp, Homo sapiens
caggggctctaatgcatgatca

SEQ ID NO: 7484503 - DNA, 22 bp, Homo sapiens
caggggctctgagattgtctaa

SEQ ID NO: 7484504 - DNA, 22 bp, Homo sapiens
caggggctctgagattgtctaa

SEQ ID NO: 7484505 - DNA, 22 bp, Homo sapiens
caggggctctgagattgtctaa

SEQ ID NO: 7484506 - DNA, 22 bp, Homo sapiens
caggggctgaaatgttggggtt

SEQ ID NO: 7484507 - DNA, 22 bp, Homo sapiens
caggggctctgggtgatgtgag

SEQ ID NO: 7484508 - DNA, 22 bp, Homo sapiens
caggggctctgggtgatgtgag

SEQ ID NO: 7484509 - DNA, 22 bp, Homo sapiens
caggggctctgggtgatgtgag

SEQ ID NO: 7484510 - DNA, 22 bp, Homo sapiens
caggggctccctgggtgccagt

SEQ ID NO: 7484511 - DNA, 22 bp, Homo sapiens
caggggctccctgggtgccagt

SEQ ID NO: 7484512 - DNA, 22 bp, Homo sapiens
caggggctctaatgcatgatca

SEQ ID NO: 7484513 - DNA, 22 bp, Homo sapiens
caggggctctaatgcatgatca

SEQ ID NO: 7484514 - DNA, 22 bp, Homo sapiens
caggggctctaatgcatgatca

SEQ ID NO: 7484515 - DNA, 22 bp, Homo sapiens
caggggctctaatgcatgatca

SEQ ID NO: 7484516 - DNA, 22 bp, Homo sapiens
caggggctctaatgcatgatca

SEQ ID NO: 7484517 - DNA, 22 bp, Homo sapiens
cagggctcgctgccagcttcag

SEQ ID NO: 7484518 - DNA, 22 bp, Homo sapiens
cagggctcgctgccagcttcag

SEQ ID NO: 7484519 - DNA, 22 bp, Homo sapiens
cagggctcgctgccagcttcag

SEQ ID NO: 7484520 - DNA, 22 bp, Homo sapiens
cagggctcgctgccagcttcag

SEQ ID NO: 7484521 - DNA, 22 bp, Homo sapiens
cagggctcgctcttgcccttcg

SEQ ID NO: 7484522 - DNA, 22 bp, Homo sapiens
cagggctcgctcttgcccttcg

SEQ ID NO: 7484523 - DNA, 22 bp, Homo sapiens
cagggctcgctcgctcgctcgc

SEQ ID NO: 7484524 - DNA, 22 bp, Homo sapiens
cagggctcgctcgctcgctcgc

SEQ ID NO: 7484525 - DNA, 22 bp, Homo sapiens
cagggctcgctcgctcgctcgc

SEQ ID NO: 7484526 - DNA, 22 bp, Homo sapiens
cagggctcccttgcaaggaggg

SEQ ID NO: 7484527 - DNA, 22 bp, Homo sapiens
cagggctcgctcttgcccttcg

SEQ ID NO: 7484528 - DNA, 22 bp, Homo sapiens
cagggctcgctcttgcccttcg

SEQ ID NO: 7484529 - DNA, 22 bp, Homo sapiens
cagggctcgctcgctcgctcgc

SEQ ID NO: 7484530 - DNA, 22 bp, Homo sapiens
caggggctccctgggtgccagt

SEQ ID NO: 7484531 - DNA, 22 bp, Homo sapiens
caggggctccctgggtgccagt

SEQ ID NO: 7484532 - DNA, 22 bp, Homo sapiens
caggggctagcacttaatgttt

SEQ ID NO: 7484533 - DNA, 22 bp, Homo sapiens
caggggctccctgggtgccagt

SEQ ID NO: 7484534 - DNA, 22 bp, Homo sapiens
caggggctccctgggtgccagt

SEQ ID NO: 7484535 - DNA, 22 bp, Homo sapiens
caggggctccctgggtgccagt

SEQ ID NO: 7484536 - DNA, 22 bp, Homo sapiens
caggggctccctgggtgccagt

SEQ ID NO: 7484537 - DNA, 22 bp, Homo sapiens
cagggctctgccttgagggatg

SEQ ID NO: 7484538 - DNA, 22 bp, Homo sapiens
cagggctctgccttgagggatg

SEQ ID NO: 7484539 - DNA, 22 bp, Homo sapiens
cagggctctgccttgagggatg

SEQ ID NO: 7484540 - DNA, 22 bp, Homo sapiens
cagggctctgccttgagggatg

SEQ ID NO: 7484541 - DNA, 22 bp, Homo sapiens
cagggcttgatctgcatcctgc

SEQ ID NO: 7484542 - DNA, 22 bp, Homo sapiens
cagggcttgatctgcatcctgc

SEQ ID NO: 7484543 - DNA, 22 bp, Homo sapiens
cagggcttgccttgccccggcg

SEQ ID NO: 7484544 - DNA, 22 bp, Homo sapiens
cagggcttggatctgtggtcag

SEQ ID NO: 7484545 - DNA, 22 bp, Homo sapiens
cagggctctgccttgagggatg

SEQ ID NO: 7484546 - DNA, 22 bp, Homo sapiens
cagggcttgcaggagaaagttt

SEQ ID NO: 7484547 - DNA, 22 bp, Homo sapiens
cagggcttgcaggagaaagttt

SEQ ID NO: 7484548 - DNA, 22 bp, Homo sapiens
cagggcctgcctggttcctgga

SEQ ID NO: 7484549 - DNA, 22 bp, Homo sapiens
cagggcctgcctggttcctgga

SEQ ID NO: 7484550 - DNA, 22 bp, Homo sapiens
cagggcctgcctggttcctgga

SEQ ID NO: 7484551 - DNA, 22 bp, Homo sapiens
cagggctccccagagagcctct

SEQ ID NO: 7484552 - DNA, 22 bp, Homo sapiens
cagggctccccagagagcctct

SEQ ID NO: 7484553 - DNA, 22 bp, Homo sapiens
cagggctccccagagagcctct

SEQ ID NO: 7484554 - DNA, 22 bp, Homo sapiens
cagggctcccaaatatctcttc

SEQ ID NO: 7484555 - DNA, 22 bp, Homo sapiens
cagggctcccaaatatctcttc

SEQ ID NO: 7484556 - DNA, 22 bp, Homo sapiens
cagggctcccaaatatctcttc

SEQ ID NO: 7484557 - DNA, 22 bp, Homo sapiens
cagggctcccaaatatctcttc

SEQ ID NO: 7484558 - DNA, 22 bp, Homo sapiens
cagggctccccagagagcctct

SEQ ID NO: 7484559 - DNA, 22 bp, Homo sapiens
cagggctccccagagagcctct

SEQ ID NO: 7484560 - DNA, 22 bp, Homo sapiens
cagggctccccagagagcctct

SEQ ID NO: 7484561 - DNA, 22 bp, Homo sapiens
cagggctccccagagagcctct

SEQ ID NO: 7484562 - DNA, 22 bp, Homo sapiens
cagggctccccagagagcctct

SEQ ID NO: 7484563 - DNA, 22 bp, Homo sapiens
cagggctccccagagagcctct

SEQ ID NO: 7484564 - DNA, 22 bp, Homo sapiens
cagggctccccgcaccgcagcc

SEQ ID NO: 7484565 - DNA, 22 bp, Homo sapiens
cagggctccctctggctcccag

SEQ ID NO: 7484566 - DNA, 22 bp, Homo sapiens
cagggctccctctggctcccag

SEQ ID NO: 7484567 - DNA, 22 bp, Homo sapiens
cagggctccccgcaccgcagcc

SEQ ID NO: 7484568 - DNA, 22 bp, Homo sapiens
cagggctccccgcaccgcagcc

SEQ ID NO: 7484569 - DNA, 22 bp, Homo sapiens
cagggctccctgcagcctctgt

SEQ ID NO: 7484570 - DNA, 22 bp, Homo sapiens
cagggctccctgcagcctctgt

SEQ ID NO: 7484571 - DNA, 22 bp, Homo sapiens
cagggctccctgcagcctctgt

SEQ ID NO: 7484572 - DNA, 22 bp, Homo sapiens
cagggctccctctggctcccag

SEQ ID NO: 7484573 - DNA, 22 bp, Homo sapiens
cagggctccctctggctcccag

SEQ ID NO: 7484574 - DNA, 22 bp, Homo sapiens
cagggctccctctggctcccag

SEQ ID NO: 7484575 - DNA, 22 bp, Homo sapiens
cagggctcccttgcaaggaggg

SEQ ID NO: 7484576 - DNA, 22 bp, Homo sapiens
cagggctccctgcagcctctgt

SEQ ID NO: 7484577 - DNA, 22 bp, Homo sapiens
cagggctcccttgcaaggaggg

SEQ ID NO: 7484578 - DNA, 22 bp, Homo sapiens
cagggctcccttgcaaggaggg

SEQ ID NO: 7484579 - DNA, 22 bp, Homo sapiens
cagggctcccttgcaaggaggg

SEQ ID NO: 7484580 - DNA, 22 bp, Homo sapiens
cagggctcccttgcaaggaggg

SEQ ID NO: 7484581 - DNA, 22 bp, Homo sapiens
cagggctccctgcagcctctgt

SEQ ID NO: 7484582 - DNA, 22 bp, Homo sapiens
cagggctccctgcagcctctgt

SEQ ID NO: 7484583 - DNA, 22 bp, Homo sapiens
cagggctccctgcagcctctgt

SEQ ID NO: 7484584 - DNA, 22 bp, Homo sapiens
cagggcctgcaagagacctggg

SEQ ID NO: 7484585 - DNA, 22 bp, Homo sapiens
cagggcctgcaagagacctggg

SEQ ID NO: 7484586 - DNA, 22 bp, Homo sapiens
cagggcctgcaagagacctggg

SEQ ID NO: 7484587 - DNA, 22 bp, Homo sapiens
cagggcctgcaagagacctggg

SEQ ID NO: 7484588 - DNA, 22 bp, Homo sapiens
cagggcctgcaagagacctggg

SEQ ID NO: 7484589 - DNA, 22 bp, Homo sapiens
cagggcctgcaagagacctggg

SEQ ID NO: 7484590 - DNA, 22 bp, Homo sapiens
cagggcctctgtgggctctctc

SEQ ID NO: 7484591 - DNA, 22 bp, Homo sapiens
cagggcctctgtgggctctctc

SEQ ID NO: 7484592 - DNA, 22 bp, Homo sapiens
cagggcctctgtgggctctctc

SEQ ID NO: 7484593 - DNA, 22 bp, Homo sapiens
cagggcctctgtgggctctctc

SEQ ID NO: 7484594 - DNA, 22 bp, Homo sapiens
cagggcctctgtgggctctctc

SEQ ID NO: 7484595 - DNA, 22 bp, Homo sapiens
cagggcctgagggctgctctgc

SEQ ID NO: 7484596 - DNA, 22 bp, Homo sapiens
cagggcctgagggctgctctgc

SEQ ID NO: 7484597 - DNA, 22 bp, Homo sapiens
cagggcctgagggctgctctgc

SEQ ID NO: 7484598 - DNA, 22 bp, Homo sapiens
cagggcctgagggctgctctgc

SEQ ID NO: 7484599 - DNA, 22 bp, Homo sapiens
cagggcctgagggctgctctgc

SEQ ID NO: 7484600 - DNA, 22 bp, Homo sapiens
cagggcctcgaagcctctgggc

SEQ ID NO: 7484601 - DNA, 22 bp, Homo sapiens
cagggcctcgaagcctctgggc

SEQ ID NO: 7484602 - DNA, 22 bp, Homo sapiens
cagggcctcgaagcctctgggc

SEQ ID NO: 7484603 - DNA, 22 bp, Homo sapiens
cagggcctcgaagcctctgggc

SEQ ID NO: 7484604 - DNA, 22 bp, Homo sapiens
cagggcctcgaagcctctgggc

SEQ ID NO: 7484605 - DNA, 22 bp, Homo sapiens
cagggcctcgaagcctctgggc

SEQ ID NO: 7484606 - DNA, 22 bp, Homo sapiens
cagggcctcgaagcctctgggc

SEQ ID NO: 7484607 - DNA, 22 bp, Homo sapiens
cagggcctcgaagcctctgggc

SEQ ID NO: 7484608 - DNA, 22 bp, Homo sapiens
cagggcctctcatcccacgggc

SEQ ID NO: 7484609 - DNA, 22 bp, Homo sapiens
cagggcctctcatcccacgggc

SEQ ID NO: 7484610 - DNA, 22 bp, Homo sapiens
cagggcctctcatcccacgggc

SEQ ID NO: 7484611 - DNA, 22 bp, Homo sapiens
cagggcctctcatcccacgggc

SEQ ID NO: 7484612 - DNA, 22 bp, Homo sapiens
cagggcctctcatcccacgggc

SEQ ID NO: 7484613 - DNA, 22 bp, Homo sapiens
cagggcctctcctccaggaact

SEQ ID NO: 7484614 - DNA, 22 bp, Homo sapiens
cagggcctctcctccaggaact

SEQ ID NO: 7484615 - DNA, 22 bp, Homo sapiens
cagggatgtctctggaagggag

SEQ ID NO: 7484616 - DNA, 22 bp, Homo sapiens
cagggatgtctctggaagggag

SEQ ID NO: 7484617 - DNA, 22 bp, Homo sapiens
cagggatgtctctggaagggag

SEQ ID NO: 7484618 - DNA, 22 bp, Homo sapiens
cagggatgtctctggaagggag

SEQ ID NO: 7484619 - DNA, 22 bp, Homo sapiens
cagggatgtctctggaagggag

SEQ ID NO: 7484620 - DNA, 22 bp, Homo sapiens
cagggatgtgatgagctgagcc

SEQ ID NO: 7484621 - DNA, 22 bp, Homo sapiens
cagggatgtgatgagctgagcc

SEQ ID NO: 7484622 - DNA, 22 bp, Homo sapiens
cagggatgtgatgagctgagcc

SEQ ID NO: 7484623 - DNA, 22 bp, Homo sapiens
cagggatgtgatgagctgagcc

SEQ ID NO: 7484624 - DNA, 22 bp, Homo sapiens
cagggatgtctctggaagggag

SEQ ID NO: 7484625 - DNA, 22 bp, Homo sapiens
cagggatggttgagaattggta

SEQ ID NO: 7484626 - DNA, 22 bp, Homo sapiens
cagggatgtctctggaagggag

SEQ ID NO: 7484627 - DNA, 22 bp, Homo sapiens
cagggatggttgagaattggta

SEQ ID NO: 7484628 - DNA, 22 bp, Homo sapiens
cagggatgtctctggaagggag

SEQ ID NO: 7484629 - DNA, 22 bp, Homo sapiens
cagggatgtctctggaagggag

SEQ ID NO: 7484630 - DNA, 22 bp, Homo sapiens
cagggatgtctctggaagggag

SEQ ID NO: 7484631 - DNA, 23 bp, Homo sapiens
cagggccaggcagcagctgtcac

SEQ ID NO: 7484632 - DNA, 23 bp, Homo sapiens
cagggccaggcagcagctgtcac

SEQ ID NO: 7484633 - DNA, 23 bp, Homo sapiens
cagggccaggcagcagctgtcac

SEQ ID NO: 7484634 - DNA, 23 bp, Homo sapiens
cagggccaggcagcagctgtcac

SEQ ID NO: 7484635 - DNA, 23 bp, Homo sapiens
cagggccaggcagcagctgtcac

SEQ ID NO: 7484636 - DNA, 22 bp, Homo sapiens
cagggccaggctgatggcctgg

SEQ ID NO: 7484637 - DNA, 22 bp, Homo sapiens
cagggcctccccggcagtcttt

SEQ ID NO: 7484638 - DNA, 22 bp, Homo sapiens
cagggcctccccggcagtcttt

SEQ ID NO: 7484639 - DNA, 22 bp, Homo sapiens
cagggcctccccggcagtcttt

SEQ ID NO: 7484640 - DNA, 22 bp, Homo sapiens
cagggcctcctaaggcatctaa

SEQ ID NO: 7484641 - DNA, 22 bp, Homo sapiens
cagggcctcctaaggcatctaa

SEQ ID NO: 7484642 - DNA, 22 bp, Homo sapiens
cagggcctcctaaggcatctaa

SEQ ID NO: 7484643 - DNA, 22 bp, Homo sapiens
cagggcctcctaaggcatctaa

SEQ ID NO: 7484644 - DNA, 22 bp, Homo sapiens
cagggcctcctaaggcatctaa

SEQ ID NO: 7484645 - DNA, 22 bp, Homo sapiens
cagggcctcctaaggcatctaa

SEQ ID NO: 7484646 - DNA, 21 bp, Homo sapiens
aggatttactattaactgtgt

SEQ ID NO: 7484647 - DNA, 22 bp, Homo sapiens
aggatttagcatgaaatgtgaa

SEQ ID NO: 7484648 - DNA, 20 bp, Homo sapiens
aggatttactactacctgct

SEQ ID NO: 7484649 - DNA, 22 bp, Homo sapiens
aggatttattccagaaatgcaa

SEQ ID NO: 7484650 - DNA, 22 bp, Homo sapiens
aggattgtgcctccagtcagaa

SEQ ID NO: 7484651 - DNA, 22 bp, Homo sapiens
aggattgtgcctccagtcagaa

SEQ ID NO: 7484652 - DNA, 22 bp, Homo sapiens
aggattgttgcagggcttcgtt

SEQ ID NO: 7484653 - DNA, 22 bp, Homo sapiens
aggattgtttggcttcaaaggc

SEQ ID NO: 7484654 - DNA, 22 bp, Homo sapiens
aggattgtttggcttcaaaggc

SEQ ID NO: 7484655 - DNA, 23 bp, Homo sapiens
aggatttaaaggcaatgcatttt

SEQ ID NO: 7484656 - DNA, 23 bp, Homo sapiens
aggatttaaaggcaatgcatttt

SEQ ID NO: 7484657 - DNA, 22 bp, Homo sapiens
aggatttaaatccttaaccact

SEQ ID NO: 7484658 - DNA, 22 bp, Homo sapiens
aggatttaatcagttggcattt

SEQ ID NO: 7484659 - DNA, 22 bp, Homo sapiens
aggatttaatcagttggcattt

SEQ ID NO: 7484660 - DNA, 22 bp, Homo sapiens
aggatttacaatgattctaggt

SEQ ID NO: 7484661 - DNA, 22 bp, Homo sapiens
aggatttaccgtcatttagtct

SEQ ID NO: 7484662 - DNA, 22 bp, Homo sapiens
aggatttctgtgcctggaaaat

SEQ ID NO: 7484663 - DNA, 22 bp, Homo sapiens
aggatttctgtgcctggaaaat

SEQ ID NO: 7484664 - DNA, 22 bp, Homo sapiens
aggatttcccatatagctccat

SEQ ID NO: 7484665 - DNA, 22 bp, Homo sapiens
aggatttctgtgcctggaaaat

SEQ ID NO: 7484666 - DNA, 22 bp, Homo sapiens
aggatttctgtgcctggaaaat

SEQ ID NO: 7484667 - DNA, 22 bp, Homo sapiens
aggatttctgtgcctggaaaat

SEQ ID NO: 7484668 - DNA, 21 bp, Homo sapiens
aggatttctgtcatttcagat

SEQ ID NO: 7484669 - DNA, 21 bp, Homo sapiens
aggatttctgtcatttcagat

SEQ ID NO: 7484670 - DNA, 22 bp, Homo sapiens
catgggctgaaaatctgcaaac

SEQ ID NO: 7484671 - DNA, 22 bp, Homo sapiens
catgggctgaaaatctgcaaac

SEQ ID NO: 7484672 - DNA, 22 bp, Homo sapiens
catgggctgaaaatctgcaaac

SEQ ID NO: 7484673 - DNA, 22 bp, Homo sapiens
catggctgaacactcagtgact

SEQ ID NO: 7484674 - DNA, 22 bp, Homo sapiens
catggctgaacactcagtgact

SEQ ID NO: 7484675 - DNA, 22 bp, Homo sapiens
catggctgaaattcttcgcttg

SEQ ID NO: 7484676 - DNA, 22 bp, Homo sapiens
catggctgaaattcttcgcttg

SEQ ID NO: 7484677 - DNA, 22 bp, Homo sapiens
catggctgaaattcttcgcttg

SEQ ID NO: 7484678 - DNA, 22 bp, Homo sapiens
catggctcggggacaggaggta

SEQ ID NO: 7484679 - DNA, 22 bp, Homo sapiens
catggctgaaattcttcgcttg

SEQ ID NO: 7484680 - DNA, 22 bp, Homo sapiens
catggctgaaattcttcgcttg

SEQ ID NO: 7484681 - DNA, 22 bp, Homo sapiens
aggatttgaacctaggcaatca

SEQ ID NO: 7484682 - DNA, 22 bp, Homo sapiens
catggctcggggacaggaggta

SEQ ID NO: 7484683 - DNA, 23 bp, Homo sapiens
catggggagcagtgctcctgacc

SEQ ID NO: 7484684 - DNA, 23 bp, Homo sapiens
catggggagcagtgctcctgacc

SEQ ID NO: 7484685 - DNA, 23 bp, Homo sapiens
catggggagcagtgctcctgacc

SEQ ID NO: 7484686 - DNA, 22 bp, Homo sapiens
catggggatgaggctgagactt

SEQ ID NO: 7484687 - DNA, 22 bp, Homo sapiens
catggggatgaggctgagactt

SEQ ID NO: 7484688 - DNA, 22 bp, Homo sapiens
catggggatgaggctgagactt

SEQ ID NO: 7484689 - DNA, 22 bp, Homo sapiens
catggggcccatgtgctccaag

SEQ ID NO: 7484690 - DNA, 22 bp, Homo sapiens
catgggggtctggacaacaggc

SEQ ID NO: 7484691 - DNA, 22 bp, Homo sapiens
catggggcccatgtgctccaag

SEQ ID NO: 7484692 - DNA, 22 bp, Homo sapiens
catgggggctgaggctgctgta

SEQ ID NO: 7484693 - DNA, 22 bp, Homo sapiens
catgggggctgaggctgctgta

SEQ ID NO: 7484694 - DNA, 22 bp, Homo sapiens
catgggggctgaggctgctgta

SEQ ID NO: 7484695 - DNA, 22 bp, Homo sapiens
catgggggctgaggctgctgta

SEQ ID NO: 7484696 - DNA, 22 bp, Homo sapiens
catggggagacacctagggaaa

SEQ ID NO: 7484697 - DNA, 22 bp, Homo sapiens
catgggctttggaggctggagg

SEQ ID NO: 7484698 - DNA, 22 bp, Homo sapiens
catgggctttggaggctggagg

SEQ ID NO: 7484699 - DNA, 22 bp, Homo sapiens
catgggctttggaggctggagg

SEQ ID NO: 7484700 - DNA, 22 bp, Homo sapiens
catgggcttgctctctgagctc

SEQ ID NO: 7484701 - DNA, 22 bp, Homo sapiens
catgggctttggaggctggagg

SEQ ID NO: 7484702 - DNA, 22 bp, Homo sapiens
catggggagacacctagggaaa

SEQ ID NO: 7484703 - DNA, 22 bp, Homo sapiens
catggggagacacctagggaaa

SEQ ID NO: 7484704 - DNA, 22 bp, Homo sapiens
catgggctgtgaacccaggctg

SEQ ID NO: 7484705 - DNA, 22 bp, Homo sapiens
catgggctgctgacaggggctc

SEQ ID NO: 7484706 - DNA, 22 bp, Homo sapiens
catgggctgctgacaggggctc

SEQ ID NO: 7484707 - DNA, 22 bp, Homo sapiens
catgggctgctgacaggggctc

SEQ ID NO: 7484708 - DNA, 22 bp, Homo sapiens
catgggctgctgacaggggctc

SEQ ID NO: 7484709 - DNA, 22 bp, Homo sapiens
catgggctgctgacaggggctc

SEQ ID NO: 7484710 - DNA, 22 bp, Homo sapiens
catgggctgctgacaggggctc

SEQ ID NO: 7484711 - DNA, 22 bp, Homo sapiens
catgggcttgctctctgagctc

SEQ ID NO: 7484712 - DNA, 22 bp, Homo sapiens
catgggctgtgaacccaggctg

SEQ ID NO: 7484713 - DNA, 22 bp, Homo sapiens
catgggctttggaggctggagg

SEQ ID NO: 7484714 - DNA, 22 bp, Homo sapiens
catgggcttgctctctgagctc

SEQ ID NO: 7484715 - DNA, 22 bp, Homo sapiens
catgggcttgctctctgagctc

SEQ ID NO: 7484716 - DNA, 19 bp, Homo sapiens
catggtgaaaccccgtctc

SEQ ID NO: 7484717 - DNA, 19 bp, Homo sapiens
catggtgaaaccccgtctc

SEQ ID NO: 7484718 - DNA, 19 bp, Homo sapiens
catggtgaaaccccgtctc

SEQ ID NO: 7484719 - DNA, 19 bp, Homo sapiens
catggtgaaaccccgtctc

SEQ ID NO: 7484720 - DNA, 22 bp, Homo sapiens
catggtcatgctgagctacaaa

SEQ ID NO: 7484721 - DNA, 22 bp, Homo sapiens
catgtacattctgtagatggag

SEQ ID NO: 7484722 - DNA, 19 bp, Homo sapiens
catggtgaaaccccgtctc

SEQ ID NO: 7484723 - DNA, 19 bp, Homo sapiens
catggtgaaaccccgtctc

SEQ ID NO: 7484724 - DNA, 22 bp, Homo sapiens
catggtcatgctgagctacaaa

SEQ ID NO: 7484725 - DNA, 18 bp, Homo sapiens
catgggtgacaggtggat

SEQ ID NO: 7484726 - DNA, 22 bp, Homo sapiens
catggtactgccacagaagagt

SEQ ID NO: 7484727 - DNA, 22 bp, Homo sapiens
catggtactgccacagaagagt

SEQ ID NO: 7484728 - DNA, 18 bp, Homo sapiens
catgggtgacaggtggat

SEQ ID NO: 7484729 - DNA, 22 bp, Homo sapiens
catgggtagtaacagagggata

SEQ ID NO: 7484730 - DNA, 18 bp, Homo sapiens
catgggtgacaggtggat

SEQ ID NO: 7484731 - DNA, 18 bp, Homo sapiens
catgggtgacaggtggat

SEQ ID NO: 7484732 - DNA, 22 bp, Homo sapiens
catggggtggtgggcaacctca

SEQ ID NO: 7484733 - DNA, 22 bp, Homo sapiens
catggggtggtgggcaacctca

SEQ ID NO: 7484734 - DNA, 21 bp, Homo sapiens
catggggttgctatagcaaaa

SEQ ID NO: 7484735 - DNA, 21 bp, Homo sapiens
catggggttgctatagcaaaa

SEQ ID NO: 7484736 - DNA, 22 bp, Homo sapiens
catgggtaagactcttttgccc

SEQ ID NO: 7484737 - DNA, 22 bp, Homo sapiens
catgtagtcctaatgctggtga

SEQ ID NO: 7484738 - DNA, 22 bp, Homo sapiens
catgtatacagtagaatactat

SEQ ID NO: 7484739 - DNA, 22 bp, Homo sapiens
catgtatagacactcatacagt

SEQ ID NO: 7484740 - DNA, 22 bp, Homo sapiens
catgtatacagtagaatactat

SEQ ID NO: 7484741 - DNA, 22 bp, Homo sapiens
catgtacattctgtagatggag

SEQ ID NO: 7484742 - DNA, 22 bp, Homo sapiens
catgtacattctgtagatggag

SEQ ID NO: 7484743 - DNA, 22 bp, Homo sapiens
catgtacattctgtagatggag

SEQ ID NO: 7484744 - DNA, 22 bp, Homo sapiens
catgtacattctgtagatggag

SEQ ID NO: 7484745 - DNA, 22 bp, Homo sapiens
catgtacattctgtagatggag

SEQ ID NO: 7484746 - DNA, 22 bp, Homo sapiens
catgtatagacactcatacagt

SEQ ID NO: 7484747 - DNA, 22 bp, Homo sapiens
catgtatagcaaatatttgttc

SEQ ID NO: 7484748 - DNA, 22 bp, Homo sapiens
catgtataggtccatagtgaat

SEQ ID NO: 7484749 - DNA, 22 bp, Homo sapiens
catgtatagttggaactacatc

SEQ ID NO: 7484750 - DNA, 22 bp, Homo sapiens
catgtatagttggaactacatc

SEQ ID NO: 7484751 - DNA, 22 bp, Homo sapiens
aggcactgcagattacaggcgc

SEQ ID NO: 7484752 - DNA, 22 bp, Homo sapiens
aggcactgcagattacaggcgc

SEQ ID NO: 7484753 - DNA, 22 bp, Homo sapiens
catgtccatttatgcacagaaa

SEQ ID NO: 7484754 - DNA, 22 bp, Homo sapiens
catgtccacagttctgagaggc

SEQ ID NO: 7484755 - DNA, 22 bp, Homo sapiens
catgtccacagttctgagaggc

SEQ ID NO: 7484756 - DNA, 22 bp, Homo sapiens
catgtcccaaatgcaggcaaag

SEQ ID NO: 7484757 - DNA, 22 bp, Homo sapiens
catgtccatttatgcacagaaa

SEQ ID NO: 7484758 - DNA, 22 bp, Homo sapiens
catgtccttctcattgcctcat

SEQ ID NO: 7484759 - DNA, 22 bp, Homo sapiens
aggcactgcagattacaggcgc

SEQ ID NO: 7484760 - DNA, 22 bp, Homo sapiens
aggcactgcagattacaggcgc

SEQ ID NO: 7484761 - DNA, 22 bp, Homo sapiens
aggcactgcagattacaggcgc

SEQ ID NO: 7484762 - DNA, 22 bp, Homo sapiens
aggcactggtctaccccttagt

SEQ ID NO: 7484763 - DNA, 22 bp, Homo sapiens
catgtcaataaatataactgca

SEQ ID NO: 7484764 - DNA, 22 bp, Homo sapiens
catgtcaataaatataactgca

SEQ ID NO: 7484765 - DNA, 22 bp, Homo sapiens
catgtcaataaatataactgca

SEQ ID NO: 7484766 - DNA, 22 bp, Homo sapiens
catgtcactttaacaaattagt

SEQ ID NO: 7484767 - DNA, 22 bp, Homo sapiens
catgtcagggaagagagtcagt

SEQ ID NO: 7484768 - DNA, 22 bp, Homo sapiens
catgtcagggaagagagtcagt

SEQ ID NO: 7484769 - DNA, 22 bp, Homo sapiens
catgtcacaattcttaatggga

SEQ ID NO: 7484770 - DNA, 22 bp, Homo sapiens
catgtcaacaggcccagaaaat

SEQ ID NO: 7484771 - DNA, 22 bp, Homo sapiens
catgtcaaccaagatgagatat

SEQ ID NO: 7484772 - DNA, 22 bp, Homo sapiens
catgtcaaccaagatgagatat

SEQ ID NO: 7484773 - DNA, 22 bp, Homo sapiens
catgtattgaagtgtgcatctg

SEQ ID NO: 7484774 - DNA, 17 bp, Homo sapiens
catgtatttgaaacaga

SEQ ID NO: 7484775 - DNA, 17 bp, Homo sapiens
catgtatttgaaacaga

SEQ ID NO: 7484776 - DNA, 17 bp, Homo sapiens
catgtatttgaaacaga

SEQ ID NO: 7484777 - DNA, 22 bp, Homo sapiens
catgtcaagactgaagatccag

SEQ ID NO: 7484778 - DNA, 22 bp, Homo sapiens
catgtcaagcttatctctgtgg

SEQ ID NO: 7484779 - DNA, 22 bp, Homo sapiens
catgtcaaccagttgtttgaat

SEQ ID NO: 7484780 - DNA, 22 bp, Homo sapiens
catgtcaaccagttgtttgaat

SEQ ID NO: 7484781 - DNA, 22 bp, Homo sapiens
catgtatagttggaactacatc

SEQ ID NO: 7484782 - DNA, 22 bp, Homo sapiens
catgtatatttctgtatgtgca

SEQ ID NO: 7484783 - DNA, 22 bp, Homo sapiens
catgtattgaagtgtgcatctg

SEQ ID NO: 7484784 - DNA, 22 bp, Homo sapiens
catgtatcttaattgctttgga

SEQ ID NO: 7484785 - DNA, 22 bp, Homo sapiens
catgtatccctaattgtgttaa

SEQ ID NO: 7484786 - DNA, 22 bp, Homo sapiens
catgtatattttatgtggagag

SEQ ID NO: 7484787 - DNA, 22 bp, Homo sapiens
catggcaataggaatgatgtga

SEQ ID NO: 7484788 - DNA, 22 bp, Homo sapiens
catggcaatttcataaacaggt

SEQ ID NO: 7484789 - DNA, 22 bp, Homo sapiens
catggcaatttcataaacaggt

SEQ ID NO: 7484790 - DNA, 22 bp, Homo sapiens
catggcaatttcataaacaggt

SEQ ID NO: 7484791 - DNA, 22 bp, Homo sapiens
catggatatattgtacagtagc

SEQ ID NO: 7484792 - DNA, 22 bp, Homo sapiens
catggaggaggaagggcgttgt

SEQ ID NO: 7484793 - DNA, 22 bp, Homo sapiens
catggaggaggaagggcgttgt

SEQ ID NO: 7484794 - DNA, 22 bp, Homo sapiens
catggaggaccctcagggagct

SEQ ID NO: 7484795 - DNA, 22 bp, Homo sapiens
catggaggaccctcagggagct

SEQ ID NO: 7484796 - DNA, 22 bp, Homo sapiens
catggaggaccctcagggagct

SEQ ID NO: 7484797 - DNA, 22 bp, Homo sapiens
catggaggccaggaaacagcct

SEQ ID NO: 7484798 - DNA, 22 bp, Homo sapiens
catggatagatgaatgcttaaa

SEQ ID NO: 7484799 - DNA, 22 bp, Homo sapiens
catggaggccaggaaacagcct

SEQ ID NO: 7484800 - DNA, 22 bp, Homo sapiens
catggaggaggaagggcgttgt

SEQ ID NO: 7484801 - DNA, 22 bp, Homo sapiens
catggaggagttaggtgtgagt

SEQ ID NO: 7484802 - DNA, 22 bp, Homo sapiens
catggaggagttaggtgtgagt

SEQ ID NO: 7484803 - DNA, 22 bp, Homo sapiens
catggaggagttaggtgtgagt

SEQ ID NO: 7484804 - DNA, 22 bp, Homo sapiens
catggaggaccctcagggagct

SEQ ID NO: 7484805 - DNA, 22 bp, Homo sapiens
catggaggaccctcagggagct

SEQ ID NO: 7484806 - DNA, 22 bp, Homo sapiens
catggacatatgagacctttcc

SEQ ID NO: 7484807 - DNA, 22 bp, Homo sapiens
catggactctggtttggggagc

SEQ ID NO: 7484808 - DNA, 22 bp, Homo sapiens
catggacagtgggacagtgtgt

SEQ ID NO: 7484809 - DNA, 22 bp, Homo sapiens
catggacagtgggacagtgtgt

SEQ ID NO: 7484810 - DNA, 22 bp, Homo sapiens
catggaatgtgagttgtttagt

SEQ ID NO: 7484811 - DNA, 22 bp, Homo sapiens
catgctaaccagagacataaag

SEQ ID NO: 7484812 - DNA, 22 bp, Homo sapiens
catggacaacctccattcgagt

SEQ ID NO: 7484813 - DNA, 22 bp, Homo sapiens
aggatgttgctattggcagtct

SEQ ID NO: 7484814 - DNA, 22 bp, Homo sapiens
aggatgttgctattggcagtct

SEQ ID NO: 7484815 - DNA, 22 bp, Homo sapiens
aggatgtttggtgcagggaaga

SEQ ID NO: 7484816 - DNA, 22 bp, Homo sapiens
aggattcatggtgcagacaaag

SEQ ID NO: 7484817 - DNA, 22 bp, Homo sapiens
aggattaactgacctagtgttt

SEQ ID NO: 7484818 - DNA, 19 bp, Homo sapiens
aggattccagaacagtgtt

SEQ ID NO: 7484819 - DNA, 22 bp, Homo sapiens
aggattgtgcctccagtcagaa

SEQ ID NO: 7484820 - DNA, 22 bp, Homo sapiens
aggattgtatacctaagtgtta

SEQ ID NO: 7484821 - DNA, 22 bp, Homo sapiens
aggattgtgcctccagtcagaa

SEQ ID NO: 7484822 - DNA, 22 bp, Homo sapiens
aggattgtgcctccagtcagaa

SEQ ID NO: 7484823 - DNA, 22 bp, Homo sapiens
aggattcagaatgtatgcagtg

SEQ ID NO: 7484824 - DNA, 22 bp, Homo sapiens
aggattgtatacctaagtgtta

SEQ ID NO: 7484825 - DNA, 22 bp, Homo sapiens
aggattctgtaatctgtgaaat

SEQ ID NO: 7484826 - DNA, 22 bp, Homo sapiens
aggattgtgcctccagtcagaa

SEQ ID NO: 7484827 - DNA, 22 bp, Homo sapiens
aggattctgatctgagctgttt

SEQ ID NO: 7484828 - DNA, 21 bp, Homo sapiens
aggattccagcacactgcttc

SEQ ID NO: 7484829 - DNA, 22 bp, Homo sapiens
aggattctagaaatttgatact

SEQ ID NO: 7484830 - DNA, 23 bp, Homo sapiens
aggattctgcttttcagaaataa

SEQ ID NO: 7484831 - DNA, 23 bp, Homo sapiens
aggattctgcttttcagaaataa

SEQ ID NO: 7484832 - DNA, 22 bp, Homo sapiens
aggattctgtaatctgtgaaat

SEQ ID NO: 7484833 - DNA, 22 bp, Homo sapiens
aggatgttcgggtcacatagcc

SEQ ID NO: 7484834 - DNA, 22 bp, Homo sapiens
aggatgttcgggtcacatagcc

SEQ ID NO: 7484835 - DNA, 22 bp, Homo sapiens
aggatgttatctgtgcaggtgg

SEQ ID NO: 7484836 - DNA, 22 bp, Homo sapiens
aggatgtgttttgagctgacta

SEQ ID NO: 7484837 - DNA, 22 bp, Homo sapiens
catggcagagaaggggaactgg

SEQ ID NO: 7484838 - DNA, 22 bp, Homo sapiens
catggcagagaaggggaactgg

SEQ ID NO: 7484839 - DNA, 22 bp, Homo sapiens
aggatgtgttcatagctgacgc

SEQ ID NO: 7484840 - DNA, 22 bp, Homo sapiens
aggatgtggtctgttttctgag

SEQ ID NO: 7484841 - DNA, 22 bp, Homo sapiens
aggatgtgtgtaggctggttaa

SEQ ID NO: 7484842 - DNA, 22 bp, Homo sapiens
catggcagaaacctgagctgct

SEQ ID NO: 7484843 - DNA, 22 bp, Homo sapiens
catggcactgagcaggtatgca

SEQ ID NO: 7484844 - DNA, 22 bp, Homo sapiens
catggcactgagcaggtatgca

SEQ ID NO: 7484845 - DNA, 22 bp, Homo sapiens
catggcagaaacctgagctgct

SEQ ID NO: 7484846 - DNA, 22 bp, Homo sapiens
catggcagaaacctgagctgct

SEQ ID NO: 7484847 - DNA, 22 bp, Homo sapiens
catggcagaaacctgagctgct

SEQ ID NO: 7484848 - DNA, 22 bp, Homo sapiens
catggcagaaacctgagctgct

SEQ ID NO: 7484849 - DNA, 20 bp, Homo sapiens
aggaggggatagaatcaaag

SEQ ID NO: 7484850 - DNA, 20 bp, Homo sapiens
aggaggggatagaatcaaag

SEQ ID NO: 7484851 - DNA, 20 bp, Homo sapiens
aggaggggatagaatcaaag

SEQ ID NO: 7484852 - DNA, 20 bp, Homo sapiens
aggaggggatagaatcaaag

SEQ ID NO: 7484853 - DNA, 20 bp, Homo sapiens
aggaggggatagaatcaaag

SEQ ID NO: 7484854 - DNA, 20 bp, Homo sapiens
aggaggggatagaatcaaag

SEQ ID NO: 7484855 - DNA, 20 bp, Homo sapiens
aggaggggatagaatcaaag

SEQ ID NO: 7484856 - DNA, 20 bp, Homo sapiens
aggaggggatagaatcaaag

SEQ ID NO: 7484857 - DNA, 20 bp, Homo sapiens
aggaggggatagaatcaaag

SEQ ID NO: 7484858 - DNA, 20 bp, Homo sapiens
aggaggggatagaatcaaag

SEQ ID NO: 7484859 - DNA, 20 bp, Homo sapiens
aggaggggatagaatcaaag

SEQ ID NO: 7484860 - DNA, 16 bp, Homo sapiens
aggaggggaattagga

SEQ ID NO: 7484861 - DNA, 16 bp, Homo sapiens
aggaggggaattagga

SEQ ID NO: 7484862 - DNA, 16 bp, Homo sapiens
aggaggggaattagga

SEQ ID NO: 7484863 - DNA, 16 bp, Homo sapiens
aggaggggaattagga

SEQ ID NO: 7484864 - DNA, 16 bp, Homo sapiens
aggaggggaattagga

SEQ ID NO: 7484865 - DNA, 22 bp, Homo sapiens
aggagggctaggaaaaccagga

SEQ ID NO: 7484866 - DNA, 16 bp, Homo sapiens
aggaggggaattagga

SEQ ID NO: 7484867 - DNA, 16 bp, Homo sapiens
aggaggggaattagga

SEQ ID NO: 7484868 - DNA, 22 bp, Homo sapiens
catgcgggttccaggctgcact

SEQ ID NO: 7484869 - DNA, 22 bp, Homo sapiens
catgctaaaccagaacatagga

SEQ ID NO: 7484870 - DNA, 22 bp, Homo sapiens
catgctaaaccagaacatagga

SEQ ID NO: 7484871 - DNA, 22 bp, Homo sapiens
catgctaaaatatctgaagatt

SEQ ID NO: 7484872 - DNA, 22 bp, Homo sapiens
aggaggggcaatgatagtctgg

SEQ ID NO: 7484873 - DNA, 22 bp, Homo sapiens
catgcggctctttccaaaccgg

SEQ ID NO: 7484874 - DNA, 22 bp, Homo sapiens
aggaggggcaatgatagtctgg

SEQ ID NO: 7484875 - DNA, 22 bp, Homo sapiens
aggaggggcaatgatagtctgg

SEQ ID NO: 7484876 - DNA, 22 bp, Homo sapiens
aggaggggcaatgatagtctgg

SEQ ID NO: 7484877 - DNA, 22 bp, Homo sapiens
aggaggggcaatgatagtctgg

SEQ ID NO: 7484878 - DNA, 22 bp, Homo sapiens
aggaggggcaatgatagtctgg

SEQ ID NO: 7484879 - DNA, 20 bp, Homo sapiens
aggaggggatagaatcaaag

SEQ ID NO: 7484880 - DNA, 20 bp, Homo sapiens
aggaggggatagaatcaaag

SEQ ID NO: 7484881 - DNA, 22 bp, Homo sapiens
aggaggggcaatgatagtctgg

SEQ ID NO: 7484882 - DNA, 22 bp, Homo sapiens
aggaggggcaatgatagtctgg

SEQ ID NO: 7484883 - DNA, 22 bp, Homo sapiens
aggaggggcaatgatagtctgg

SEQ ID NO: 7484884 - DNA, 20 bp, Homo sapiens
aggaggggatagaatcaaag

SEQ ID NO: 7484885 - DNA, 22 bp, Homo sapiens
aggaggggcaatgatagtctgg

SEQ ID NO: 7484886 - DNA, 22 bp, Homo sapiens
aggagggatagaaaaatacttg

SEQ ID NO: 7484887 - DNA, 21 bp, Homo sapiens
aggagggcacaaggccaggaa

SEQ ID NO: 7484888 - DNA, 21 bp, Homo sapiens
aggagggcacaaggccaggaa

SEQ ID NO: 7484889 - DNA, 21 bp, Homo sapiens
aggagggcacaaggccaggaa

SEQ ID NO: 7484890 - DNA, 21 bp, Homo sapiens
aggagggcacaaggccaggaa

SEQ ID NO: 7484891 - DNA, 21 bp, Homo sapiens
aggagggcacaaggccaggaa

SEQ ID NO: 7484892 - DNA, 21 bp, Homo sapiens
aggagggcacaaggccaggaa

SEQ ID NO: 7484893 - DNA, 21 bp, Homo sapiens
aggagggcacaaggccaggaa

SEQ ID NO: 7484894 - DNA, 21 bp, Homo sapiens
aggagggcacaaggccaggaa

SEQ ID NO: 7484895 - DNA, 21 bp, Homo sapiens
aggagggcacaaggccaggaa

SEQ ID NO: 7484896 - DNA, 22 bp, Homo sapiens
aggagggatagaaaaatacttg

SEQ ID NO: 7484897 - DNA, 22 bp, Homo sapiens
aggagggatagaaaaatacttg

SEQ ID NO: 7484898 - DNA, 22 bp, Homo sapiens
aggagggatagaaaaatacttg

SEQ ID NO: 7484899 - DNA, 22 bp, Homo sapiens
aggagggagcttaagccaggca

SEQ ID NO: 7484900 - DNA, 22 bp, Homo sapiens
aggagggagcttaagccaggca

SEQ ID NO: 7484901 - DNA, 22 bp, Homo sapiens
aggagggatagaaaaatacttg

SEQ ID NO: 7484902 - DNA, 21 bp, Homo sapiens
aggagggcacaaggccaggaa

SEQ ID NO: 7484903 - DNA, 21 bp, Homo sapiens
aggagggcacaaggccaggaa

SEQ ID NO: 7484904 - DNA, 22 bp, Homo sapiens
aggagggcaggctggctgccta

SEQ ID NO: 7484905 - DNA, 22 bp, Homo sapiens
aggagggcaggctggctgccta

SEQ ID NO: 7484906 - DNA, 22 bp, Homo sapiens
aggagggcaggctggctgccta

SEQ ID NO: 7484907 - DNA, 21 bp, Homo sapiens
aggagggcacaaggccaggaa

SEQ ID NO: 7484908 - DNA, 21 bp, Homo sapiens
aggagggcacaaggccaggaa

SEQ ID NO: 7484909 - DNA, 22 bp, Homo sapiens
aggagggcaggctggctgccta

SEQ ID NO: 7484910 - DNA, 22 bp, Homo sapiens
aggagggcaggctggctgccta

SEQ ID NO: 7484911 - DNA, 22 bp, Homo sapiens
aggagggcaggctggctgccta

SEQ ID NO: 7484912 - DNA, 22 bp, Homo sapiens
aggagggcaggctggctgccta

SEQ ID NO: 7484913 - DNA, 22 bp, Homo sapiens
aggagggcaggctggctgccta

SEQ ID NO: 7484914 - DNA, 22 bp, Homo sapiens
aggagggcaggctggctgccta

SEQ ID NO: 7484915 - DNA, 22 bp, Homo sapiens
aggagggcaggctggctgccta

SEQ ID NO: 7484916 - DNA, 22 bp, Homo sapiens
aggagggctaggaaaaccagga

SEQ ID NO: 7484917 - DNA, 22 bp, Homo sapiens
aggagggcaggctggctgccta

SEQ ID NO: 7484918 - DNA, 22 bp, Homo sapiens
aggagggcaggctggctgccta

SEQ ID NO: 7484919 - DNA, 22 bp, Homo sapiens
aggagggctaggaaaaccagga

SEQ ID NO: 7484920 - DNA, 22 bp, Homo sapiens
aggagggctaggaaaaccagga

SEQ ID NO: 7484921 - DNA, 22 bp, Homo sapiens
aggagggctaggaaaaccagga

SEQ ID NO: 7484922 - DNA, 22 bp, Homo sapiens
aggagggctaggaaaaccagga

SEQ ID NO: 7484923 - DNA, 22 bp, Homo sapiens
aggagggctaggaaaaccagga

SEQ ID NO: 7484924 - DNA, 22 bp, Homo sapiens
catttgttaattactattatct

SEQ ID NO: 7484925 - DNA, 22 bp, Homo sapiens
catttgttaattactattatct

SEQ ID NO: 7484926 - DNA, 22 bp, Homo sapiens
catttgttaattactattatct

SEQ ID NO: 7484927 - DNA, 22 bp, Homo sapiens
catttgttaatgctgcttttaa

SEQ ID NO: 7484928 - DNA, 22 bp, Homo sapiens
catttgttaatgctgcttttaa

SEQ ID NO: 7484929 - DNA, 22 bp, Homo sapiens
catttgttaattactattatct

SEQ ID NO: 7484930 - DNA, 20 bp, Homo sapiens
catttgttagctttctactg

SEQ ID NO: 7484931 - DNA, 22 bp, Homo sapiens
catttgttaattactattatct

SEQ ID NO: 7484932 - DNA, 22 bp, Homo sapiens
catttgttaattactattatct

SEQ ID NO: 7484933 - DNA, 22 bp, Homo sapiens
catttgttaattactattatct

SEQ ID NO: 7484934 - DNA, 22 bp, Homo sapiens
catttgttctgatttcaaaagg

SEQ ID NO: 7484935 - DNA, 22 bp, Homo sapiens
catttgttctgatttcaaaagg

SEQ ID NO: 7484936 - DNA, 22 bp, Homo sapiens
catttgttctgatttcaaaagg

SEQ ID NO: 7484937 - DNA, 22 bp, Homo sapiens
catttgttctgatttcaaaagg

SEQ ID NO: 7484938 - DNA, 18 bp, Homo sapiens
catttgttattgtgtgtg

SEQ ID NO: 7484939 - DNA, 20 bp, Homo sapiens
catttgttagctttctactg

SEQ ID NO: 7484940 - DNA, 18 bp, Homo sapiens
catttgttattgtgtgtg

SEQ ID NO: 7484941 - DNA, 22 bp, Homo sapiens
catttgttcaaccattctcgct

SEQ ID NO: 7484942 - DNA, 18 bp, Homo sapiens
catttgttattgtgtgtg

SEQ ID NO: 7484943 - DNA, 22 bp, Homo sapiens
catttgttaagaaggaaaaagg

SEQ ID NO: 7484944 - DNA, 22 bp, Homo sapiens
catttgttaagaaggaaaaagg

SEQ ID NO: 7484945 - DNA, 22 bp, Homo sapiens
catttgttaatgctgcttttaa

SEQ ID NO: 7484946 - DNA, 22 bp, Homo sapiens
catttgttaatgctgcttttaa

SEQ ID NO: 7484947 - DNA, 22 bp, Homo sapiens
catttgttaatgctgcttttaa

SEQ ID NO: 7484948 - DNA, 22 bp, Homo sapiens
catttgaaattcttagaacaaa

SEQ ID NO: 7484949 - DNA, 22 bp, Homo sapiens
cattaacaatgactgcttgact

SEQ ID NO: 7484950 - DNA, 22 bp, Homo sapiens
cattaacaattgtttatgctgt

SEQ ID NO: 7484951 - DNA, 22 bp, Homo sapiens
cattaacaattgtttatgctgt

SEQ ID NO: 7484952 - DNA, 22 bp, Homo sapiens
cattaacaattgtttatgctgt

SEQ ID NO: 7484953 - DNA, 22 bp, Homo sapiens
catttgaaattcttagaacaaa

SEQ ID NO: 7484954 - DNA, 22 bp, Homo sapiens
catttgaaattcttagaacaaa

SEQ ID NO: 7484955 - DNA, 22 bp, Homo sapiens
catttgaaatagttcattcttg

SEQ ID NO: 7484956 - DNA, 22 bp, Homo sapiens
catttgaaattcttagaacaaa

SEQ ID NO: 7484957 - DNA, 22 bp, Homo sapiens
cattaacaattgtttatgctgt

SEQ ID NO: 7484958 - DNA, 22 bp, Homo sapiens
catttgttgggacaatgaaaag

SEQ ID NO: 7484959 - DNA, 17 bp, Homo sapiens
catttgttgatcagttg

SEQ ID NO: 7484960 - DNA, 17 bp, Homo sapiens
catttgttgatcagttg

SEQ ID NO: 7484961 - DNA, 17 bp, Homo sapiens
catttgttgatcagttg

SEQ ID NO: 7484962 - DNA, 22 bp, Homo sapiens
catttgttctgatttcaaaagg

SEQ ID NO: 7484963 - DNA, 17 bp, Homo sapiens
catttgttgatcagttg

SEQ ID NO: 7484964 - DNA, 22 bp, Homo sapiens
catttgttggtcagattgtagt

SEQ ID NO: 7484965 - DNA, 22 bp, Homo sapiens
catttgttggtcagattgtagt

SEQ ID NO: 7484966 - DNA, 22 bp, Homo sapiens
catttgttgggacaatgaaaag

SEQ ID NO: 7484967 - DNA, 22 bp, Homo sapiens
catttgttgggacaatgaaaag

SEQ ID NO: 7484968 - DNA, 22 bp, Homo sapiens
catttgttgggacaatgaaaag

SEQ ID NO: 7484969 - DNA, 22 bp, Homo sapiens
catttgtttagaagtctttata

SEQ ID NO: 7484970 - DNA, 22 bp, Homo sapiens
catttgtttagaagtctttata

SEQ ID NO: 7484971 - DNA, 22 bp, Homo sapiens
catttgtttagaagtctttata

SEQ ID NO: 7484972 - DNA, 22 bp, Homo sapiens
catttgttggtcagattgtagt

SEQ ID NO: 7484973 - DNA, 22 bp, Homo sapiens
catttgttggttgctgtcttat

SEQ ID NO: 7484974 - DNA, 22 bp, Homo sapiens
catttgttggtcagattgtagt

SEQ ID NO: 7484975 - DNA, 22 bp, Homo sapiens
catttgttggttgctgtcttat

SEQ ID NO: 7484976 - DNA, 22 bp, Homo sapiens
catttgtttagaagtctttata

SEQ ID NO: 7484977 - DNA, 22 bp, Homo sapiens
catttgtttataagttccccag

SEQ ID NO: 7484978 - DNA, 22 bp, Homo sapiens
catttgttggttgctgtcttat

SEQ ID NO: 7484979 - DNA, 22 bp, Homo sapiens
catttgtttagaagtctttata

SEQ ID NO: 7484980 - DNA, 21 bp, Homo sapiens
aggcagcaggatccagggaca

SEQ ID NO: 7484981 - DNA, 19 bp, Homo sapiens
aggcagcaggccagggatg

SEQ ID NO: 7484982 - DNA, 19 bp, Homo sapiens
aggcagcaggccagggatg

SEQ ID NO: 7484983 - DNA, 19 bp, Homo sapiens
aggcagcaggccagggatg

SEQ ID NO: 7484984 - DNA, 19 bp, Homo sapiens
aggcagcaggccagggatg

SEQ ID NO: 7484985 - DNA, 19 bp, Homo sapiens
aggcagcaggccagggatg

SEQ ID NO: 7484986 - DNA, 21 bp, Homo sapiens
aggcagcaggatccagggaca

SEQ ID NO: 7484987 - DNA, 21 bp, Homo sapiens
aggcagcaggatccagggaca

SEQ ID NO: 7484988 - DNA, 21 bp, Homo sapiens
aggcagcaggatccagggaca

SEQ ID NO: 7484989 - DNA, 21 bp, Homo sapiens
aggcagcaggatccagggaca

SEQ ID NO: 7484990 - DNA, 22 bp, Homo sapiens
cattttaaatgatttaagccaa

SEQ ID NO: 7484991 - DNA, 22 bp, Homo sapiens
cattttaaatgatttaagccaa

SEQ ID NO: 7484992 - DNA, 22 bp, Homo sapiens
aggcactgtactaggtacaggg

SEQ ID NO: 7484993 - DNA, 22 bp, Homo sapiens
aggcactgtactaggtacaggg

SEQ ID NO: 7484994 - DNA, 22 bp, Homo sapiens
aggcactgtactaggtacaggg

SEQ ID NO: 7484995 - DNA, 22 bp, Homo sapiens
aggcactgtactaggtacaggg

SEQ ID NO: 7484996 - DNA, 22 bp, Homo sapiens
aggcactgtactaggtacaggg

SEQ ID NO: 7484997 - DNA, 22 bp, Homo sapiens
aggcactggtctaccccttagt

SEQ ID NO: 7484998 - DNA, 22 bp, Homo sapiens
aggcactgtactaggtacaggg

SEQ ID NO: 7484999 - DNA, 22 bp, Homo sapiens
aggcactggtctaccccttagt

SEQ ID NO: 7485000 - DNA, 22 bp, Homo sapiens
aggcactggtctaccccttagt

SEQ ID NO: 7485001 - DNA, 22 bp, Homo sapiens
aggcactgcagattacaggcgc

SEQ ID NO: 7485002 - DNA, 22 bp, Homo sapiens
aggcactgtgctgatgtcttat

SEQ ID NO: 7485003 - DNA, 22 bp, Homo sapiens
aggcactgtgctgatgtcttat

SEQ ID NO: 7485004 - DNA, 22 bp, Homo sapiens
aggcactgtgcagtcccaagca

SEQ ID NO: 7485005 - DNA, 22 bp, Homo sapiens
aggcactgtgctgatgtcttat

SEQ ID NO: 7485006 - DNA, 22 bp, Homo sapiens
aggcactgtgcagtcccaagca

SEQ ID NO: 7485007 - DNA, 22 bp, Homo sapiens
aggcactgtgcagtcccaagca

SEQ ID NO: 7485008 - DNA, 22 bp, Homo sapiens
aggcactgtgcagtcccaagca

SEQ ID NO: 7485009 - DNA, 22 bp, Homo sapiens
aggcactgtgctgatgtcttat

SEQ ID NO: 7485010 - DNA, 22 bp, Homo sapiens
aggcactgtgcttcttatatgt

SEQ ID NO: 7485011 - DNA, 22 bp, Homo sapiens
aggcactgtgcttcttatatgt

SEQ ID NO: 7485012 - DNA, 22 bp, Homo sapiens
aggcactgtgcttcttatatgt

SEQ ID NO: 7485013 - DNA, 22 bp, Homo sapiens
aggcactgtggaagacatggtt

SEQ ID NO: 7485014 - DNA, 22 bp, Homo sapiens
aggcactgtggaagacatggtt

SEQ ID NO: 7485015 - DNA, 22 bp, Homo sapiens
aggcactgtggaagacatggtt

SEQ ID NO: 7485016 - DNA, 22 bp, Homo sapiens
aggcactgtggaagacatggtt

SEQ ID NO: 7485017 - DNA, 22 bp, Homo sapiens
aggcactgtggaagacatggtt

SEQ ID NO: 7485018 - DNA, 22 bp, Homo sapiens
aggcactgtggaagacatggtt

SEQ ID NO: 7485019 - DNA, 22 bp, Homo sapiens
aggcactgtggaagacatggtt

SEQ ID NO: 7485020 - DNA, 22 bp, Homo sapiens
aggcactgtggaagacatggtt

SEQ ID NO: 7485021 - DNA, 22 bp, Homo sapiens
aggcactgtggaagacatggtt

SEQ ID NO: 7485022 - DNA, 15 bp, Homo sapiens
aggcactgtgggacc

SEQ ID NO: 7485023 - DNA, 22 bp, Homo sapiens
aggcactgtggaagacatggtt

SEQ ID NO: 7485024 - DNA, 22 bp, Homo sapiens
aggcactgtggaagacatggtt

SEQ ID NO: 7485025 - DNA, 15 bp, Homo sapiens
aggcactgtgggacc

SEQ ID NO: 7485026 - DNA, 22 bp, Homo sapiens
cattaaatcttccagacctcac

SEQ ID NO: 7485027 - DNA, 22 bp, Homo sapiens
cattaaatcttccagacctcac

SEQ ID NO: 7485028 - DNA, 22 bp, Homo sapiens
cattaaatcttccagacctcac

SEQ ID NO: 7485029 - DNA, 22 bp, Homo sapiens
cattaaatatcaacctagacta

SEQ ID NO: 7485030 - DNA, 22 bp, Homo sapiens
cattaaatatcaacctagacta

SEQ ID NO: 7485031 - DNA, 22 bp, Homo sapiens
cattaaacaaccttgaatcaat

SEQ ID NO: 7485032 - DNA, 22 bp, Homo sapiens
cattaaacaaccttgaatcaat

SEQ ID NO: 7485033 - DNA, 22 bp, Homo sapiens
cattaaattccttgttctcaaa

SEQ ID NO: 7485034 - DNA, 22 bp, Homo sapiens
cattaaattccttgttctcaaa

SEQ ID NO: 7485035 - DNA, 22 bp, Homo sapiens
cattaaattccttgttctcaaa

SEQ ID NO: 7485036 - DNA, 22 bp, Homo sapiens
cattaaattccttgttctcaaa

SEQ ID NO: 7485037 - DNA, 22 bp, Homo sapiens
cattaaattccttgttctcaaa

SEQ ID NO: 7485038 - DNA, 22 bp, Homo sapiens
cattaacaaatggaagcatgaa

SEQ ID NO: 7485039 - DNA, 22 bp, Homo sapiens
cattaacaatgactgcttgact

SEQ ID NO: 7485040 - DNA, 22 bp, Homo sapiens
cattaacaaatggaagcatgaa

SEQ ID NO: 7485041 - DNA, 22 bp, Homo sapiens
catgttttgtgtacagaatatt

SEQ ID NO: 7485042 - DNA, 22 bp, Homo sapiens
catgttttgtgtacagaatatt

SEQ ID NO: 7485043 - DNA, 22 bp, Homo sapiens
aggcactgtgggtgtggccgga

SEQ ID NO: 7485044 - DNA, 22 bp, Homo sapiens
cattaaaatatctcatggtgtt

SEQ ID NO: 7485045 - DNA, 23 bp, Homo sapiens
catgtttttctatctcagcgtgt

SEQ ID NO: 7485046 - DNA, 22 bp, Homo sapiens
cattaaaatatctcatggtgtt

SEQ ID NO: 7485047 - DNA, 22 bp, Homo sapiens
cattaaaatatctcatggtgtt

SEQ ID NO: 7485048 - DNA, 22 bp, Homo sapiens
cattaaaatatctcatggtgtt

SEQ ID NO: 7485049 - DNA, 22 bp, Homo sapiens
cattaaaatatctcatggtgtt

SEQ ID NO: 7485050 - DNA, 22 bp, Homo sapiens
cattaaaatatctcatggtgtt

SEQ ID NO: 7485051 - DNA, 22 bp, Homo sapiens
cattaaaatatctcatggtgtt

SEQ ID NO: 7485052 - DNA, 22 bp, Homo sapiens
cattaaaatatctcatggtgtt

SEQ ID NO: 7485053 - DNA, 22 bp, Homo sapiens
cattaaacaaccttgaatcaat

SEQ ID NO: 7485054 - DNA, 22 bp, Homo sapiens
cattaaaatatctcatggtgtt

SEQ ID NO: 7485055 - DNA, 22 bp, Homo sapiens
cattaaaatatctcatggtgtt

SEQ ID NO: 7485056 - DNA, 22 bp, Homo sapiens
cattaaaatatctcatggtgtt

SEQ ID NO: 7485057 - DNA, 22 bp, Homo sapiens
ccaagcagagcagcctctctgg

SEQ ID NO: 7485058 - DNA, 16 bp, Homo sapiens
ccaagcagcagcagct

SEQ ID NO: 7485059 - DNA, 22 bp, Homo sapiens
ccaagcagaaccattcaggcac

SEQ ID NO: 7485060 - DNA, 22 bp, Homo sapiens
ccaagcagaaccattcaggcac

SEQ ID NO: 7485061 - DNA, 22 bp, Homo sapiens
ccaagcagagcagcctctctgg

SEQ ID NO: 7485062 - DNA, 22 bp, Homo sapiens
ccaagcagagcagcctctctgg

SEQ ID NO: 7485063 - DNA, 22 bp, Homo sapiens
ccaagcaggatattctgtgtca

SEQ ID NO: 7485064 - DNA, 16 bp, Homo sapiens
ccaagcagcagcagct

SEQ ID NO: 7485065 - DNA, 22 bp, Homo sapiens
ccaagcaggatattctgtgtca

SEQ ID NO: 7485066 - DNA, 22 bp, Homo sapiens
ccaagcaggatattctgtgtca

SEQ ID NO: 7485067 - DNA, 22 bp, Homo sapiens
ccaagcaggatattctgtgtca

SEQ ID NO: 7485068 - DNA, 22 bp, Homo sapiens
ccaagcaggatattctgtgtca

SEQ ID NO: 7485069 - DNA, 22 bp, Homo sapiens
ccaagcagtctgctaggagttt

SEQ ID NO: 7485070 - DNA, 22 bp, Homo sapiens
ccaagcaaggctaattcacttg

SEQ ID NO: 7485071 - DNA, 22 bp, Homo sapiens
ccaagcaaggctaattcacttg

SEQ ID NO: 7485072 - DNA, 22 bp, Homo sapiens
ccaagattactttcttaattgc

SEQ ID NO: 7485073 - DNA, 22 bp, Homo sapiens
ccaagcaaataatcacccacta

SEQ ID NO: 7485074 - DNA, 22 bp, Homo sapiens
ccaagcaaataatcacccacta

SEQ ID NO: 7485075 - DNA, 22 bp, Homo sapiens
ccaagatgatctttacagtgtt

SEQ ID NO: 7485076 - DNA, 22 bp, Homo sapiens
ccaagatgagctggctccatgg

SEQ ID NO: 7485077 - DNA, 17 bp, Homo sapiens
ccaagatgatagaggga

SEQ ID NO: 7485078 - DNA, 22 bp, Homo sapiens
ccaagattactttcttaattgc

SEQ ID NO: 7485079 - DNA, 22 bp, Homo sapiens
ccaagattaagaaaccccttgt

SEQ ID NO: 7485080 - DNA, 22 bp, Homo sapiens
ccaagattagaaaatttgagga

SEQ ID NO: 7485081 - DNA, 22 bp, Homo sapiens
ccaagattagaaaatttgagga

SEQ ID NO: 7485082 - DNA, 22 bp, Homo sapiens
ccaagatttatattgaataata

SEQ ID NO: 7485083 - DNA, 22 bp, Homo sapiens
ccaagccgcggctcctcctgcg

SEQ ID NO: 7485084 - DNA, 22 bp, Homo sapiens
ccaagcctagtcgtgcacacag

SEQ ID NO: 7485085 - DNA, 22 bp, Homo sapiens
ccaagcgggaatgcaatggcgt

SEQ ID NO: 7485086 - DNA, 22 bp, Homo sapiens
ccaagctacttaggagtctgag

SEQ ID NO: 7485087 - DNA, 22 bp, Homo sapiens
ccaagctacttaggagtctgag

SEQ ID NO: 7485088 - DNA, 22 bp, Homo sapiens
ccaagctacttaggagtctgag

SEQ ID NO: 7485089 - DNA, 22 bp, Homo sapiens
ccaagcatttctagccagtcac

SEQ ID NO: 7485090 - DNA, 22 bp, Homo sapiens
ccaagcatttctagccagtcac

SEQ ID NO: 7485091 - DNA, 22 bp, Homo sapiens
ccaagcatttctagccagtcac

SEQ ID NO: 7485092 - DNA, 22 bp, Homo sapiens
ccaagcatggggttcagtagga

SEQ ID NO: 7485093 - DNA, 22 bp, Homo sapiens
ccaagcagtctgctaggagttt

SEQ ID NO: 7485094 - DNA, 22 bp, Homo sapiens
ccaagctacttaggagtctgag

SEQ ID NO: 7485095 - DNA, 22 bp, Homo sapiens
ccaagctacttaggagtctgag

SEQ ID NO: 7485096 - DNA, 22 bp, Homo sapiens
ccaagctgactgtgctgttgtg

SEQ ID NO: 7485097 - DNA, 22 bp, Homo sapiens
ccaagctgagcaccatctgatc

SEQ ID NO: 7485098 - DNA, 22 bp, Homo sapiens
ccaagctggacagcagcaagga

SEQ ID NO: 7485099 - DNA, 22 bp, Homo sapiens
ccaagctggacagcagcaagga

SEQ ID NO: 7485100 - DNA, 22 bp, Homo sapiens
ccaagctggacagcagcaagga

SEQ ID NO: 7485101 - DNA, 19 bp, Homo sapiens
aggcagcaggccagggatg

SEQ ID NO: 7485102 - DNA, 19 bp, Homo sapiens
aggcagcaggccagggatg

SEQ ID NO: 7485103 - DNA, 22 bp, Homo sapiens
aggcagcagggccactggctga

SEQ ID NO: 7485104 - DNA, 22 bp, Homo sapiens
aggcagcagggccactggctga

SEQ ID NO: 7485105 - DNA, 22 bp, Homo sapiens
aggcagcagggccactggctga

SEQ ID NO: 7485106 - DNA, 22 bp, Homo sapiens
aggcagcagggccactggctga

SEQ ID NO: 7485107 - DNA, 22 bp, Homo sapiens
aggcagcagggccactggctga

SEQ ID NO: 7485108 - DNA, 22 bp, Homo sapiens
aggcagcagggccactggctga

SEQ ID NO: 7485109 - DNA, 22 bp, Homo sapiens
aggcagcagggccactggctga

SEQ ID NO: 7485110 - DNA, 23 bp, Homo sapiens
aggcagcaggttgtccagggtga

SEQ ID NO: 7485111 - DNA, 22 bp, Homo sapiens
aggcagcagggccactggctga

SEQ ID NO: 7485112 - DNA, 22 bp, Homo sapiens
aggcagcagggccactggctga

SEQ ID NO: 7485113 - DNA, 23 bp, Homo sapiens
aggcagcaggttgtccagggtga

SEQ ID NO: 7485114 - DNA, 23 bp, Homo sapiens
aggcagcaggttgtccagggtga

SEQ ID NO: 7485115 - DNA, 23 bp, Homo sapiens
aggcagcaggttgtccagggtga

SEQ ID NO: 7485116 - DNA, 23 bp, Homo sapiens
aggcagcaggttgtccagggtga

SEQ ID NO: 7485117 - DNA, 22 bp, Homo sapiens
aggcagcagtcatgaggaaaga

SEQ ID NO: 7485118 - DNA, 23 bp, Homo sapiens
aggcagcaggttgtccagggtga

SEQ ID NO: 7485119 - DNA, 23 bp, Homo sapiens
aggcagcaggttgtccagggtga

SEQ ID NO: 7485120 - DNA, 23 bp, Homo sapiens
aggcagcaggttgtccagggtga

SEQ ID NO: 7485121 - DNA, 23 bp, Homo sapiens
aggcagcaggttgtccagggtga

SEQ ID NO: 7485122 - DNA, 23 bp, Homo sapiens
aggcagcaggttgtccagggtga

SEQ ID NO: 7485123 - DNA, 21 bp, Homo sapiens
ccaagatgaataataatgagg

SEQ ID NO: 7485124 - DNA, 21 bp, Homo sapiens
ccaagatgaataataatgagg

SEQ ID NO: 7485125 - DNA, 22 bp, Homo sapiens
ccaagataagagacaagattta

SEQ ID NO: 7485126 - DNA, 22 bp, Homo sapiens
ccaaaggggcttaggatgaagg

SEQ ID NO: 7485127 - DNA, 22 bp, Homo sapiens
ccaagagtaaattcatgatgcc

SEQ ID NO: 7485128 - DNA, 22 bp, Homo sapiens
ccaagataagagacaagattta

SEQ ID NO: 7485129 - DNA, 21 bp, Homo sapiens
ccaaaggctatgtatcttctg

SEQ ID NO: 7485130 - DNA, 22 bp, Homo sapiens
ccaaaggcggaactgagtctct

SEQ ID NO: 7485131 - DNA, 22 bp, Homo sapiens
ccaaaggcggaactgagtctct

SEQ ID NO: 7485132 - DNA, 22 bp, Homo sapiens
ccaatacactttatagaagaaa

SEQ ID NO: 7485133 - DNA, 20 bp, Homo sapiens
ccaataaagctctataggga

SEQ ID NO: 7485134 - DNA, 22 bp, Homo sapiens
ccaatacactttatagaagaaa

SEQ ID NO: 7485135 - DNA, 22 bp, Homo sapiens
ccaatagagtgctgtaagaatt

SEQ ID NO: 7485136 - DNA, 22 bp, Homo sapiens
ccaatacttagattaaaatagt

SEQ ID NO: 7485137 - DNA, 22 bp, Homo sapiens
ccaatactgaacttaaaagtat

SEQ ID NO: 7485138 - DNA, 22 bp, Homo sapiens
ccaatacactttatagaagaaa

SEQ ID NO: 7485139 - DNA, 18 bp, Homo sapiens
aggcaggctggagtgact

SEQ ID NO: 7485140 - DNA, 22 bp, Homo sapiens
aggcaggctggtctgaagagtg

SEQ ID NO: 7485141 - DNA, 22 bp, Homo sapiens
ccaatcttatctttattttcta

SEQ ID NO: 7485142 - DNA, 18 bp, Homo sapiens
aggcaggctggagtgact

SEQ ID NO: 7485143 - DNA, 22 bp, Homo sapiens
ccaatattatgaaagtgtgaca

SEQ ID NO: 7485144 - DNA, 22 bp, Homo sapiens
ccaatacttagattaaaatagt

SEQ ID NO: 7485145 - DNA, 22 bp, Homo sapiens
ccaatcctcatgttcaacaacc

SEQ ID NO: 7485146 - DNA, 22 bp, Homo sapiens
ccaagtgatacacccgcctcgg

SEQ ID NO: 7485147 - DNA, 22 bp, Homo sapiens
ccaagtcctgtctctcaatcat

SEQ ID NO: 7485148 - DNA, 22 bp, Homo sapiens
ccaagtcctgctgccactctac

SEQ ID NO: 7485149 - DNA, 22 bp, Homo sapiens
ccaagtctgtaacctctgcgta

SEQ ID NO: 7485150 - DNA, 22 bp, Homo sapiens
ccaagtcctgctgccactctac

SEQ ID NO: 7485151 - DNA, 22 bp, Homo sapiens
ccaagtcctgctgccactctac

SEQ ID NO: 7485152 - DNA, 22 bp, Homo sapiens
ccaagtcctgctgccactctac

SEQ ID NO: 7485153 - DNA, 18 bp, Homo sapiens
ccaagtatggcagaggct

SEQ ID NO: 7485154 - DNA, 18 bp, Homo sapiens
ccaagtatggcagaggct

SEQ ID NO: 7485155 - DNA, 19 bp, Homo sapiens
ccaaggttggcagctgggc

SEQ ID NO: 7485156 - DNA, 20 bp, Homo sapiens
ccaaggttggaggcagggtg

SEQ ID NO: 7485157 - DNA, 22 bp, Homo sapiens
ccaaggtttattttgatacatt

SEQ ID NO: 7485158 - DNA, 22 bp, Homo sapiens
ccaagtcctgctgccactctac

SEQ ID NO: 7485159 - DNA, 23 bp, Homo sapiens
ccaagtccctctccaagcctttg

SEQ ID NO: 7485160 - DNA, 22 bp, Homo sapiens
ccaagtccccaagcatgccagg

SEQ ID NO: 7485161 - DNA, 22 bp, Homo sapiens
ccaagtcctctaccattcctgg

SEQ ID NO: 7485162 - DNA, 22 bp, Homo sapiens
ccaagtcctctaccattcctgg

SEQ ID NO: 7485163 - DNA, 22 bp, Homo sapiens
ccaagctggatttagctgcaca

SEQ ID NO: 7485164 - DNA, 22 bp, Homo sapiens
ccaagctggatttagctgcaca

SEQ ID NO: 7485165 - DNA, 23 bp, Homo sapiens
ccaagcttctaatgctgctgagc

SEQ ID NO: 7485166 - DNA, 22 bp, Homo sapiens
ccaagctggatttagctgcaca

SEQ ID NO: 7485167 - DNA, 23 bp, Homo sapiens
ccaagcttctaatgctgctgagc

SEQ ID NO: 7485168 - DNA, 20 bp, Homo sapiens
ccaaggacatctatgactgt

SEQ ID NO: 7485169 - DNA, 22 bp, Homo sapiens
ccaaggacccgagcctgcggga

SEQ ID NO: 7485170 - DNA, 22 bp, Homo sapiens
ccaaggacccgagcctgcggga

SEQ ID NO: 7485171 - DNA, 22 bp, Homo sapiens
ccaagcttctttcctactacag

SEQ ID NO: 7485172 - DNA, 23 bp, Homo sapiens
ccaagcttgtccctgcctgcttt

SEQ ID NO: 7485173 - DNA, 20 bp, Homo sapiens
ccaaggacactggctcctgg

SEQ ID NO: 7485174 - DNA, 20 bp, Homo sapiens
ccaaggacactggctcctgg

SEQ ID NO: 7485175 - DNA, 23 bp, Homo sapiens
ccaagcttgtccctgcctgcttt

SEQ ID NO: 7485176 - DNA, 22 bp, Homo sapiens
ccaagcttctttcctactacag

SEQ ID NO: 7485177 - DNA, 22 bp, Homo sapiens
ccaagggctctgacttgcctgc

SEQ ID NO: 7485178 - DNA, 22 bp, Homo sapiens
ccaagggctctgacttgcctgc

SEQ ID NO: 7485179 - DNA, 22 bp, Homo sapiens
ccaagggctctgacttgcctgc

SEQ ID NO: 7485180 - DNA, 22 bp, Homo sapiens
ccaaggagaatgacaccatgga

SEQ ID NO: 7485181 - DNA, 22 bp, Homo sapiens
ccaaggagaatgacaccatgga

SEQ ID NO: 7485182 - DNA, 22 bp, Homo sapiens
ccaaggagaaatgctgtgcttt

SEQ ID NO: 7485183 - DNA, 22 bp, Homo sapiens
ccaagggctatttacagaacag

SEQ ID NO: 7485184 - DNA, 22 bp, Homo sapiens
ccaaggactggacacacaggtt

SEQ ID NO: 7485185 - DNA, 22 bp, Homo sapiens
ccaaggagaaatgctgtgcttt

SEQ ID NO: 7485186 - DNA, 22 bp, Homo sapiens
ccaaggactggacacacaggtt

SEQ ID NO: 7485187 - DNA, 22 bp, Homo sapiens
ccaaggacgtacaggagataat

SEQ ID NO: 7485188 - DNA, 22 bp, Homo sapiens
ccaaggtgggcagatcacgagg

SEQ ID NO: 7485189 - DNA, 22 bp, Homo sapiens
ccaaggttagaaaaggtacttt

SEQ ID NO: 7485190 - DNA, 22 bp, Homo sapiens
ccaaggttgcaggcctcagaga

SEQ ID NO: 7485191 - DNA, 22 bp, Homo sapiens
ccaaggtggctacagccctgca

SEQ ID NO: 7485192 - DNA, 22 bp, Homo sapiens
ccaaggtggctacagccctgca

SEQ ID NO: 7485193 - DNA, 22 bp, Homo sapiens
ccaaggggattgcagaagcagc

SEQ ID NO: 7485194 - DNA, 22 bp, Homo sapiens
ccaaggggcctttagacactat

SEQ ID NO: 7485195 - DNA, 22 bp, Homo sapiens
ccaaggggcctttagacactat

SEQ ID NO: 7485196 - DNA, 22 bp, Homo sapiens
ccaaggggcctttagacactat

SEQ ID NO: 7485197 - DNA, 22 bp, Homo sapiens
ccaagggctgctgaggtgtcca

SEQ ID NO: 7485198 - DNA, 22 bp, Homo sapiens
ccaagggctgagatacatctag

SEQ ID NO: 7485199 - DNA, 22 bp, Homo sapiens
ccaagggctgctgaggtgtcca

SEQ ID NO: 7485200 - DNA, 22 bp, Homo sapiens
ccaagggctgctgaggtgtcca

SEQ ID NO: 7485201 - DNA, 22 bp, Homo sapiens
ccaagggctgctgaggtgtcca

SEQ ID NO: 7485202 - DNA, 22 bp, Homo sapiens
ccaagggctgctgaggtgtcca

SEQ ID NO: 7485203 - DNA, 22 bp, Homo sapiens
ccaagggctgctgaggtgtcca

SEQ ID NO: 7485204 - DNA, 22 bp, Homo sapiens
ccaagggctctggacagagtgg

SEQ ID NO: 7485205 - DNA, 22 bp, Homo sapiens
ccaagggctctggacagagtgg

SEQ ID NO: 7485206 - DNA, 22 bp, Homo sapiens
ccaagggctctggacagagtgg

SEQ ID NO: 7485207 - DNA, 22 bp, Homo sapiens
ccaagggctctgacttgcctgc

SEQ ID NO: 7485208 - DNA, 22 bp, Homo sapiens
ccaagggctctggacagagtgg

SEQ ID NO: 7485209 - DNA, 22 bp, Homo sapiens
ccaagggctgagatacatctag

SEQ ID NO: 7485210 - DNA, 22 bp, Homo sapiens
ccaagggctctggacagagtgg

SEQ ID NO: 7485211 - DNA, 22 bp, Homo sapiens
ccaagggctgagatacatctag

SEQ ID NO: 7485212 - DNA, 22 bp, Homo sapiens
cagttttagggcaatgtgaaga

SEQ ID NO: 7485213 - DNA, 22 bp, Homo sapiens
cagttttagggcaatgtgaaga

SEQ ID NO: 7485214 - DNA, 22 bp, Homo sapiens
cagttttatacactgcagctcc

SEQ ID NO: 7485215 - DNA, 22 bp, Homo sapiens
cagttttatacactgcagctcc

SEQ ID NO: 7485216 - DNA, 22 bp, Homo sapiens
cagttttagggcaatgtgaaga

SEQ ID NO: 7485217 - DNA, 22 bp, Homo sapiens
cagttttagggcaatgtgaaga

SEQ ID NO: 7485218 - DNA, 22 bp, Homo sapiens
cagttttagggcaatgtgaaga

SEQ ID NO: 7485219 - DNA, 22 bp, Homo sapiens
cagttttaggacatgtggatgt

SEQ ID NO: 7485220 - DNA, 22 bp, Homo sapiens
cagttttaggacatgtggatgt

SEQ ID NO: 7485221 - DNA, 22 bp, Homo sapiens
cagttttaggacatgtggatgt

SEQ ID NO: 7485222 - DNA, 22 bp, Homo sapiens
cagttttagctagagcaaacca

SEQ ID NO: 7485223 - DNA, 22 bp, Homo sapiens
cagttttaggacatgtggatgt

SEQ ID NO: 7485224 - DNA, 22 bp, Homo sapiens
cagttttagctagagcaaacca

SEQ ID NO: 7485225 - DNA, 22 bp, Homo sapiens
cagttttagctagagcaaacca

SEQ ID NO: 7485226 - DNA, 22 bp, Homo sapiens
cagttttagctagagcaaacca

SEQ ID NO: 7485227 - DNA, 22 bp, Homo sapiens
cagttttagctagagcaaacca

SEQ ID NO: 7485228 - DNA, 22 bp, Homo sapiens
cagttttagctagagcaaacca

SEQ ID NO: 7485229 - DNA, 22 bp, Homo sapiens
cagttttagctagagcaaacca

SEQ ID NO: 7485230 - DNA, 22 bp, Homo sapiens
cagttttacccaagcttatttt

SEQ ID NO: 7485231 - DNA, 22 bp, Homo sapiens
cagttttacccaagcttatttt

SEQ ID NO: 7485232 - DNA, 22 bp, Homo sapiens
cagttttacccaagcttatttt

SEQ ID NO: 7485233 - DNA, 22 bp, Homo sapiens
cagttttacccaagcttatttt

SEQ ID NO: 7485234 - DNA, 22 bp, Homo sapiens
cagttttacccaagcttatttt

SEQ ID NO: 7485235 - DNA, 22 bp, Homo sapiens
cagttttacccaagcttatttt

SEQ ID NO: 7485236 - DNA, 22 bp, Homo sapiens
cagtttctctcatacatatttg

SEQ ID NO: 7485237 - DNA, 22 bp, Homo sapiens
cagtttctctcatacatatttg

SEQ ID NO: 7485238 - DNA, 22 bp, Homo sapiens
cagtttctctcaataagcatcg

SEQ ID NO: 7485239 - DNA, 22 bp, Homo sapiens
cagtttctctcaataagcatcg

SEQ ID NO: 7485240 - DNA, 22 bp, Homo sapiens
cagttttaaattgttagataat

SEQ ID NO: 7485241 - DNA, 22 bp, Homo sapiens
cagttttaaattgttagataat

SEQ ID NO: 7485242 - DNA, 22 bp, Homo sapiens
cagttttaaattgttagataat

SEQ ID NO: 7485243 - DNA, 22 bp, Homo sapiens
cagtttctctcaataagcatcg

SEQ ID NO: 7485244 - DNA, 22 bp, Homo sapiens
cagtttctctcaataagcatcg

SEQ ID NO: 7485245 - DNA, 22 bp, Homo sapiens
cagtttctctcaataagcatcg

SEQ ID NO: 7485246 - DNA, 22 bp, Homo sapiens
cagttttaaattgttagataat

SEQ ID NO: 7485247 - DNA, 22 bp, Homo sapiens
cagttttaaattgttagataat

SEQ ID NO: 7485248 - DNA, 22 bp, Homo sapiens
cagttttaaattgttagataat

SEQ ID NO: 7485249 - DNA, 22 bp, Homo sapiens
cagttttaaattttgaatgtct

SEQ ID NO: 7485250 - DNA, 22 bp, Homo sapiens
cagttttaaattttgaatgtct

SEQ ID NO: 7485251 - DNA, 22 bp, Homo sapiens
cagttttaaattgttagataat

SEQ ID NO: 7485252 - DNA, 16 bp, Homo sapiens
cagttttaaggcccaa

SEQ ID NO: 7485253 - DNA, 22 bp, Homo sapiens
cagttttaaattttgaatgtct

SEQ ID NO: 7485254 - DNA, 22 bp, Homo sapiens
cagttttaaattttgaatgtct

SEQ ID NO: 7485255 - DNA, 22 bp, Homo sapiens
cagttttaaattttgaatgtct

SEQ ID NO: 7485256 - DNA, 22 bp, Homo sapiens
cagttttaaattttgaatgtct

SEQ ID NO: 7485257 - DNA, 22 bp, Homo sapiens
cagttttaaattttgaatgtct

SEQ ID NO: 7485258 - DNA, 22 bp, Homo sapiens
cagttttaaattttgaatgtct

SEQ ID NO: 7485259 - DNA, 22 bp, Homo sapiens
cagtttctacgacttaagcaca

SEQ ID NO: 7485260 - DNA, 22 bp, Homo sapiens
cagtttctacgacttaagcaca

SEQ ID NO: 7485261 - DNA, 22 bp, Homo sapiens
cagtttctacgaaggtcaaccc

SEQ ID NO: 7485262 - DNA, 22 bp, Homo sapiens
cagtttctacgacttaagcaca

SEQ ID NO: 7485263 - DNA, 22 bp, Homo sapiens
cagtttctacgacttaagcaca

SEQ ID NO: 7485264 - DNA, 22 bp, Homo sapiens
cagtttctacgacttaagcaca

SEQ ID NO: 7485265 - DNA, 22 bp, Homo sapiens
cagtttcctgaagagaaagaat

SEQ ID NO: 7485266 - DNA, 22 bp, Homo sapiens
cagtttctacgaaggtcaaccc

SEQ ID NO: 7485267 - DNA, 22 bp, Homo sapiens
cagtttctctcaataagcatcg

SEQ ID NO: 7485268 - DNA, 22 bp, Homo sapiens
cagtttctctcaataagcatcg

SEQ ID NO: 7485269 - DNA, 22 bp, Homo sapiens
cagtttctccaaacgcaggctg

SEQ ID NO: 7485270 - DNA, 22 bp, Homo sapiens
cagtttctcaggcctctcccag

SEQ ID NO: 7485271 - DNA, 22 bp, Homo sapiens
cagtttctcagacttcccttgt

SEQ ID NO: 7485272 - DNA, 22 bp, Homo sapiens
cagtttctatggctgggctctg

SEQ ID NO: 7485273 - DNA, 22 bp, Homo sapiens
cagtttctcagacttcccttgt

SEQ ID NO: 7485274 - DNA, 22 bp, Homo sapiens
cagtttctatggctgggctctg

SEQ ID NO: 7485275 - DNA, 22 bp, Homo sapiens
cagtttctacgacttaagcaca

SEQ ID NO: 7485276 - DNA, 22 bp, Homo sapiens
cagtttctacgacttaagcaca

SEQ ID NO: 7485277 - DNA, 22 bp, Homo sapiens
cagtttcagaatcaaaacatca

SEQ ID NO: 7485278 - DNA, 22 bp, Homo sapiens
cagtttcagaatcaaaacatca

SEQ ID NO: 7485279 - DNA, 22 bp, Homo sapiens
cagtttcagaatcaaaacatca

SEQ ID NO: 7485280 - DNA, 22 bp, Homo sapiens
cagtttatttccaagatgacaa

SEQ ID NO: 7485281 - DNA, 22 bp, Homo sapiens
cagtttcagctcaagcactcag

SEQ ID NO: 7485282 - DNA, 22 bp, Homo sapiens
cagtttcagctcaagcactcag

SEQ ID NO: 7485283 - DNA, 22 bp, Homo sapiens
cagtttcagaatcaaaacatca

SEQ ID NO: 7485284 - DNA, 22 bp, Homo sapiens
cagtttcagctcaagcactcag

SEQ ID NO: 7485285 - DNA, 22 bp, Homo sapiens
cagtttcaggacatcccattac

SEQ ID NO: 7485286 - DNA, 22 bp, Homo sapiens
cagtttccctgcttgaaaacgt

SEQ ID NO: 7485287 - DNA, 22 bp, Homo sapiens
cagtttattgttgcgttcacat

SEQ ID NO: 7485288 - DNA, 22 bp, Homo sapiens
cagtttattgttgcgttcacat

SEQ ID NO: 7485289 - DNA, 22 bp, Homo sapiens
cagtttattgttgcgttcacat

SEQ ID NO: 7485290 - DNA, 22 bp, Homo sapiens
cagtttatttccaagatgacaa

SEQ ID NO: 7485291 - DNA, 22 bp, Homo sapiens
cagtttatttccaagatgacaa

SEQ ID NO: 7485292 - DNA, 22 bp, Homo sapiens
cagtttatttccaagatgacaa

SEQ ID NO: 7485293 - DNA, 22 bp, Homo sapiens
cagtttatttccaagatgacaa

SEQ ID NO: 7485294 - DNA, 22 bp, Homo sapiens
cagtttatttccaagatgacaa

SEQ ID NO: 7485295 - DNA, 23 bp, Homo sapiens
cagtggtcagaacgtgggagggt

SEQ ID NO: 7485296 - DNA, 22 bp, Homo sapiens
cagtggtatttgagagaatgga

SEQ ID NO: 7485297 - DNA, 22 bp, Homo sapiens
cagtggtatttgagagaatgga

SEQ ID NO: 7485298 - DNA, 22 bp, Homo sapiens
cagtggtactctcagatgttta

SEQ ID NO: 7485299 - DNA, 22 bp, Homo sapiens
cagtggtagaagccaagtagat

SEQ ID NO: 7485300 - DNA, 22 bp, Homo sapiens
cagtggtccctgaggttgctgg

SEQ ID NO: 7485301 - DNA, 23 bp, Homo sapiens
cagtggtcagaacgtgggagggt

SEQ ID NO: 7485302 - DNA, 23 bp, Homo sapiens
cagtggtcagaacgtgggagggt

SEQ ID NO: 7485303 - DNA, 23 bp, Homo sapiens
cagtggtcagaacgtgggagggt

SEQ ID NO: 7485304 - DNA, 23 bp, Homo sapiens
cagtggtcagaacgtgggagggt

SEQ ID NO: 7485305 - DNA, 22 bp, Homo sapiens
cagtgggtggctaagtggctga

SEQ ID NO: 7485306 - DNA, 22 bp, Homo sapiens
cagtggtactctcagatgttta

SEQ ID NO: 7485307 - DNA, 22 bp, Homo sapiens
cagtggtactctcagatgttta

SEQ ID NO: 7485308 - DNA, 22 bp, Homo sapiens
cagtggtacttatatgaagcat

SEQ ID NO: 7485309 - DNA, 22 bp, Homo sapiens
cagtggcgtgatctctgctcac

SEQ ID NO: 7485310 - DNA, 22 bp, Homo sapiens
cagtggcgtgatctctgctcac

SEQ ID NO: 7485311 - DNA, 22 bp, Homo sapiens
cagtggcgtgatctctgctcac

SEQ ID NO: 7485312 - DNA, 22 bp, Homo sapiens
cagtggcgtgatctctgctcac

SEQ ID NO: 7485313 - DNA, 22 bp, Homo sapiens
cagtggcctttcctgctgctca

SEQ ID NO: 7485314 - DNA, 22 bp, Homo sapiens
cagtggccttgatgcctcattc

SEQ ID NO: 7485315 - DNA, 22 bp, Homo sapiens
cagtggcctttcctgctgctca

SEQ ID NO: 7485316 - DNA, 22 bp, Homo sapiens
cagtggcctttcctgctgctca

SEQ ID NO: 7485317 - DNA, 22 bp, Homo sapiens
cagtggcctttcctgctgctca

SEQ ID NO: 7485318 - DNA, 22 bp, Homo sapiens
cagtggcgtgatctctgctcac

SEQ ID NO: 7485319 - DNA, 22 bp, Homo sapiens
cagtggcgtgatctctgctcac

SEQ ID NO: 7485320 - DNA, 22 bp, Homo sapiens
cagtggcgtgatctctgctcac

SEQ ID NO: 7485321 - DNA, 22 bp, Homo sapiens
cagtggcgtgatctctgctcac

SEQ ID NO: 7485322 - DNA, 22 bp, Homo sapiens
cagtggcgtgatctctgctcac

SEQ ID NO: 7485323 - DNA, 22 bp, Homo sapiens
cagtggctcatgcctataatcc

SEQ ID NO: 7485324 - DNA, 22 bp, Homo sapiens
cagtggcgtgatctctgctcac

SEQ ID NO: 7485325 - DNA, 22 bp, Homo sapiens
cagtggcgtgatctctgctcac

SEQ ID NO: 7485326 - DNA, 22 bp, Homo sapiens
cagtggctgagagtggacactg

SEQ ID NO: 7485327 - DNA, 22 bp, Homo sapiens
cagtggctgagagtggacactg

SEQ ID NO: 7485328 - DNA, 22 bp, Homo sapiens
cagtgggtgccatcgtgccctt

SEQ ID NO: 7485329 - DNA, 22 bp, Homo sapiens
cagtgggtgccatcgtgccctt

SEQ ID NO: 7485330 - DNA, 22 bp, Homo sapiens
cagtgggtgccatcgtgccctt

SEQ ID NO: 7485331 - DNA, 22 bp, Homo sapiens
cagtttatgcagctggaataga

SEQ ID NO: 7485332 - DNA, 22 bp, Homo sapiens
cagtttatgcagctggaataga

SEQ ID NO: 7485333 - DNA, 20 bp, Homo sapiens
cagtttatctttccggagct

SEQ ID NO: 7485334 - DNA, 20 bp, Homo sapiens
cagtttatctttccggagct

SEQ ID NO: 7485335 - DNA, 20 bp, Homo sapiens
cagtttatctttccggagct

SEQ ID NO: 7485336 - DNA, 20 bp, Homo sapiens
cagtttatctttccggagct

SEQ ID NO: 7485337 - DNA, 22 bp, Homo sapiens
cagtttatattctagtgctgtt

SEQ ID NO: 7485338 - DNA, 22 bp, Homo sapiens
cagtttatgcagctggaataga

SEQ ID NO: 7485339 - DNA, 19 bp, Homo sapiens
cagtttatgctttggggac

SEQ ID NO: 7485340 - DNA, 19 bp, Homo sapiens
cagtttatgctttggggac

SEQ ID NO: 7485341 - DNA, 19 bp, Homo sapiens
cagtttatgctttggggac

SEQ ID NO: 7485342 - DNA, 22 bp, Homo sapiens
cagtttatgcagctggaataga

SEQ ID NO: 7485343 - DNA, 22 bp, Homo sapiens
cagttctggaggctccacatct

SEQ ID NO: 7485344 - DNA, 22 bp, Homo sapiens
cagtttatattctagtgctgtt

SEQ ID NO: 7485345 - DNA, 22 bp, Homo sapiens
cagtttatatgtcagagctgta

SEQ ID NO: 7485346 - DNA, 22 bp, Homo sapiens
cagtttatattctagtgctgtt

SEQ ID NO: 7485347 - DNA, 22 bp, Homo sapiens
cagtttatattctagtgctgtt

SEQ ID NO: 7485348 - DNA, 22 bp, Homo sapiens
cagtttatattctagtgctgtt

SEQ ID NO: 7485349 - DNA, 22 bp, Homo sapiens
cagttctgagctttcccagaag

SEQ ID NO: 7485350 - DNA, 22 bp, Homo sapiens
cagttctggaggatagaagtct

SEQ ID NO: 7485351 - DNA, 22 bp, Homo sapiens
cagttctggaggatagaagtct

SEQ ID NO: 7485352 - DNA, 17 bp, Homo sapiens
cagtggtctgaggtatg

SEQ ID NO: 7485353 - DNA, 21 bp, Homo sapiens
cagtggtctgtctccattttt

SEQ ID NO: 7485354 - DNA, 21 bp, Homo sapiens
cagtggtctgtctccattttt

SEQ ID NO: 7485355 - DNA, 22 bp, Homo sapiens
cagtggtgaagagcaggggctc

SEQ ID NO: 7485356 - DNA, 22 bp, Homo sapiens
cagtggtgaagagcaggggctc

SEQ ID NO: 7485357 - DNA, 18 bp, Homo sapiens
cagtggtgctgggatgtg

SEQ ID NO: 7485358 - DNA, 22 bp, Homo sapiens
cagtggtgaagagcaggggctc

SEQ ID NO: 7485359 - DNA, 22 bp, Homo sapiens
cagtggtgaagagcaggggctc

SEQ ID NO: 7485360 - DNA, 18 bp, Homo sapiens
cagtggtgctgggatgtg

SEQ ID NO: 7485361 - DNA, 18 bp, Homo sapiens
cagtggtgctgggatgtg

SEQ ID NO: 7485362 - DNA, 18 bp, Homo sapiens
cagtggtgctgggatgtg

SEQ ID NO: 7485363 - DNA, 22 bp, Homo sapiens
cagtggtggaatgaggaattgt

SEQ ID NO: 7485364 - DNA, 22 bp, Homo sapiens
cagtggtggaatgaggaattgt

SEQ ID NO: 7485365 - DNA, 22 bp, Homo sapiens
cagtggttatacttactgtttc

SEQ ID NO: 7485366 - DNA, 22 bp, Homo sapiens
cagtggttcctgttcttctggg

SEQ ID NO: 7485367 - DNA, 22 bp, Homo sapiens
cagtggttatacttactgtttc

SEQ ID NO: 7485368 - DNA, 22 bp, Homo sapiens
cagtggttatacttactgtttc

SEQ ID NO: 7485369 - DNA, 22 bp, Homo sapiens
cagttctgactttcataatgtc

SEQ ID NO: 7485370 - DNA, 22 bp, Homo sapiens
catatttatagatctggcattt

SEQ ID NO: 7485371 - DNA, 22 bp, Homo sapiens
catatttatagatctggcattt

SEQ ID NO: 7485372 - DNA, 22 bp, Homo sapiens
catatttagtgtttggagatcg

SEQ ID NO: 7485373 - DNA, 22 bp, Homo sapiens
catatttagtgtttggagatcg

SEQ ID NO: 7485374 - DNA, 22 bp, Homo sapiens
catatttattcttctgccagtg

SEQ ID NO: 7485375 - DNA, 22 bp, Homo sapiens
catatttattcttctgccagtg

SEQ ID NO: 7485376 - DNA, 22 bp, Homo sapiens
catatttatagatctggcattt

SEQ ID NO: 7485377 - DNA, 22 bp, Homo sapiens
catatttatagatctggcattt

SEQ ID NO: 7485378 - DNA, 22 bp, Homo sapiens
catatttatagatctggcattt

SEQ ID NO: 7485379 - DNA, 22 bp, Homo sapiens
catatttagtgtttggagatcg

SEQ ID NO: 7485380 - DNA, 22 bp, Homo sapiens
catatttagtgtttggagatcg

SEQ ID NO: 7485381 - DNA, 22 bp, Homo sapiens
catatttagtgtttggagatcg

SEQ ID NO: 7485382 - DNA, 22 bp, Homo sapiens
catatttagtgtttggagatcg

SEQ ID NO: 7485383 - DNA, 22 bp, Homo sapiens
catatttagtgtttggagatcg

SEQ ID NO: 7485384 - DNA, 22 bp, Homo sapiens
catattgtctattgctgttttt

SEQ ID NO: 7485385 - DNA, 22 bp, Homo sapiens
catattgtaaaaggttgaatcc

SEQ ID NO: 7485386 - DNA, 19 bp, Homo sapiens
catattgtgcttgcatttt

SEQ ID NO: 7485387 - DNA, 22 bp, Homo sapiens
catattcaaggggtaaggcaaa

SEQ ID NO: 7485388 - DNA, 22 bp, Homo sapiens
catattcaaggggtaaggcaaa

SEQ ID NO: 7485389 - DNA, 22 bp, Homo sapiens
catattaaggtctgtaaggggt

SEQ ID NO: 7485390 - DNA, 22 bp, Homo sapiens
catattaaggtctgtaaggggt

SEQ ID NO: 7485391 - DNA, 22 bp, Homo sapiens
catattagacacttatgtccac

SEQ ID NO: 7485392 - DNA, 22 bp, Homo sapiens
catattagcctccactgggaca

SEQ ID NO: 7485393 - DNA, 22 bp, Homo sapiens
catattaaggtctgtaaggggt

SEQ ID NO: 7485394 - DNA, 22 bp, Homo sapiens
catattaaggtctgtaaggggt

SEQ ID NO: 7485395 - DNA, 22 bp, Homo sapiens
catataaatacaacatgtgtta

SEQ ID NO: 7485396 - DNA, 22 bp, Homo sapiens
catataaatacaacatgtgtta

SEQ ID NO: 7485397 - DNA, 22 bp, Homo sapiens
catattgctgtcattgtccctc

SEQ ID NO: 7485398 - DNA, 22 bp, Homo sapiens
catattctttaagcaatgctct

SEQ ID NO: 7485399 - DNA, 22 bp, Homo sapiens
catattctttaagcaatgctct

SEQ ID NO: 7485400 - DNA, 22 bp, Homo sapiens
catattctgttggtcacataga

SEQ ID NO: 7485401 - DNA, 22 bp, Homo sapiens
catattctgttggtcacataga

SEQ ID NO: 7485402 - DNA, 22 bp, Homo sapiens
catattctgttggtcacataga

SEQ ID NO: 7485403 - DNA, 22 bp, Homo sapiens
catattcaaggggtaaggcaaa

SEQ ID NO: 7485404 - DNA, 22 bp, Homo sapiens
catattcaaggggtaaggcaaa

SEQ ID NO: 7485405 - DNA, 22 bp, Homo sapiens
catatttcagtctaagatgtgt

SEQ ID NO: 7485406 - DNA, 22 bp, Homo sapiens
catatttcagtctaagatgtgt

SEQ ID NO: 7485407 - DNA, 22 bp, Homo sapiens
catatttcagtctaagatgtgt

SEQ ID NO: 7485408 - DNA, 22 bp, Homo sapiens
catatttattcttctgccagtg

SEQ ID NO: 7485409 - DNA, 22 bp, Homo sapiens
catatttattcttctgccagtg

SEQ ID NO: 7485410 - DNA, 22 bp, Homo sapiens
catatttattcttctgccagtg

SEQ ID NO: 7485411 - DNA, 22 bp, Homo sapiens
catatttattcttctgccagtg

SEQ ID NO: 7485412 - DNA, 22 bp, Homo sapiens
catatttattcttctgccagtg

SEQ ID NO: 7485413 - DNA, 22 bp, Homo sapiens
catattttagttgctgaacagc

SEQ ID NO: 7485414 - DNA, 22 bp, Homo sapiens
catattttagttgctgaacagc

SEQ ID NO: 7485415 - DNA, 22 bp, Homo sapiens
catattttagttgctgaacagc

SEQ ID NO: 7485416 - DNA, 22 bp, Homo sapiens
catatttggtataacttaagca

SEQ ID NO: 7485417 - DNA, 22 bp, Homo sapiens
catattttagttgctgaacagc

SEQ ID NO: 7485418 - DNA, 22 bp, Homo sapiens
catattttagttgctgaacagc

SEQ ID NO: 7485419 - DNA, 21 bp, Homo sapiens
aggaggctgtctctttcagct

SEQ ID NO: 7485420 - DNA, 21 bp, Homo sapiens
aggaggctgtctctttcagct

SEQ ID NO: 7485421 - DNA, 22 bp, Homo sapiens
aggagggagcactatatgggga

SEQ ID NO: 7485422 - DNA, 22 bp, Homo sapiens
aggagggagcactatatgggga

SEQ ID NO: 7485423 - DNA, 22 bp, Homo sapiens
aggaggctgtggagcactccat

SEQ ID NO: 7485424 - DNA, 22 bp, Homo sapiens
aggagggagcactatatgggga

SEQ ID NO: 7485425 - DNA, 22 bp, Homo sapiens
aggagggagcactatatgggga

SEQ ID NO: 7485426 - DNA, 22 bp, Homo sapiens
aggaggctgtggagcactccat

SEQ ID NO: 7485427 - DNA, 21 bp, Homo sapiens
aggaggctgtctctttcagct

SEQ ID NO: 7485428 - DNA, 22 bp, Homo sapiens
aggagggagcttaagccaggca

SEQ ID NO: 7485429 - DNA, 22 bp, Homo sapiens
aggagggagcttaagccaggca

SEQ ID NO: 7485430 - DNA, 22 bp, Homo sapiens
aggagggagcttaagccaggca

SEQ ID NO: 7485431 - DNA, 22 bp, Homo sapiens
aggagggagcttaagccaggca

SEQ ID NO: 7485432 - DNA, 22 bp, Homo sapiens
aggagggagcttaagccaggca

SEQ ID NO: 7485433 - DNA, 22 bp, Homo sapiens
aggagggagcttaagccaggca

SEQ ID NO: 7485434 - DNA, 22 bp, Homo sapiens
aggagggagcttaagccaggca

SEQ ID NO: 7485435 - DNA, 22 bp, Homo sapiens
aggagggagcactatatgggga

SEQ ID NO: 7485436 - DNA, 22 bp, Homo sapiens
aggagggagcactatatgggga

SEQ ID NO: 7485437 - DNA, 22 bp, Homo sapiens
aggagggagcttaagccaggca

SEQ ID NO: 7485438 - DNA, 22 bp, Homo sapiens
aggagggagcttaagccaggca

SEQ ID NO: 7485439 - DNA, 22 bp, Homo sapiens
aggagggagcttaagccaggca

SEQ ID NO: 7485440 - DNA, 22 bp, Homo sapiens
aggagggagcttaagccaggca

SEQ ID NO: 7485441 - DNA, 22 bp, Homo sapiens
aggagggagcttaagccaggca

SEQ ID NO: 7485442 - DNA, 22 bp, Homo sapiens
aggagggagcttaagccaggca

SEQ ID NO: 7485443 - DNA, 22 bp, Homo sapiens
aggagggagcttaagccaggca

SEQ ID NO: 7485444 - DNA, 22 bp, Homo sapiens
aggagggagcttaagccaggca

SEQ ID NO: 7485445 - DNA, 22 bp, Homo sapiens
catagattcttatttccatctt

SEQ ID NO: 7485446 - DNA, 22 bp, Homo sapiens
catagattcttatttccatctt

SEQ ID NO: 7485447 - DNA, 22 bp, Homo sapiens
catagattcttatttccatctt

SEQ ID NO: 7485448 - DNA, 22 bp, Homo sapiens
catagcaacagcatcaagtcaa

SEQ ID NO: 7485449 - DNA, 22 bp, Homo sapiens
catagattttaggttagatcga

SEQ ID NO: 7485450 - DNA, 18 bp, Homo sapiens
catagcacttcagcacat

SEQ ID NO: 7485451 - DNA, 22 bp, Homo sapiens
catagccagccattgctcccaa

SEQ ID NO: 7485452 - DNA, 22 bp, Homo sapiens
catagacattgataggttatat

SEQ ID NO: 7485453 - DNA, 22 bp, Homo sapiens
catagaggcaaaatggctgtac

SEQ ID NO: 7485454 - DNA, 22 bp, Homo sapiens
catacattacctaacttaatgc

SEQ ID NO: 7485455 - DNA, 22 bp, Homo sapiens
catacattacctaacttaatgc

SEQ ID NO: 7485456 - DNA, 22 bp, Homo sapiens
catagacattcagcactcacta

SEQ ID NO: 7485457 - DNA, 22 bp, Homo sapiens
catagaggctaaaattatttgg

SEQ ID NO: 7485458 - DNA, 22 bp, Homo sapiens
catagaggctaaaattatttgg

SEQ ID NO: 7485459 - DNA, 22 bp, Homo sapiens
catagagtgatgtaaggtatgt

SEQ ID NO: 7485460 - DNA, 22 bp, Homo sapiens
catagaggtgtcagggacatct

SEQ ID NO: 7485461 - DNA, 22 bp, Homo sapiens
catagaggtgtcagggacatct

SEQ ID NO: 7485462 - DNA, 22 bp, Homo sapiens
catagagtgatgtaaggtatgt

SEQ ID NO: 7485463 - DNA, 22 bp, Homo sapiens
cagttttatgaatgcttattag

SEQ ID NO: 7485464 - DNA, 22 bp, Homo sapiens
cagttttatcatctgtgaaatg

SEQ ID NO: 7485465 - DNA, 22 bp, Homo sapiens
cagttttatgaatgcttattag

SEQ ID NO: 7485466 - DNA, 22 bp, Homo sapiens
cagttttatgtcgaatgtatac

SEQ ID NO: 7485467 - DNA, 22 bp, Homo sapiens
cagttttatgaatgcttattag

SEQ ID NO: 7485468 - DNA, 22 bp, Homo sapiens
cagttttatgaatgcttattag

SEQ ID NO: 7485469 - DNA, 22 bp, Homo sapiens
cagttttatgaatgcttattag

SEQ ID NO: 7485470 - DNA, 22 bp, Homo sapiens
cagttttatgaatgcttattag

SEQ ID NO: 7485471 - DNA, 22 bp, Homo sapiens
cagttttatcatctgtgaaatg

SEQ ID NO: 7485472 - DNA, 22 bp, Homo sapiens
cagttttatcatctgtgaaatg

SEQ ID NO: 7485473 - DNA, 22 bp, Homo sapiens
cagttttatacactgcagctcc

SEQ ID NO: 7485474 - DNA, 22 bp, Homo sapiens
cagttttatacactgcagctcc

SEQ ID NO: 7485475 - DNA, 22 bp, Homo sapiens
cagttttatacactgcagctcc

SEQ ID NO: 7485476 - DNA, 22 bp, Homo sapiens
cagttttatgtcgaatgtatac

SEQ ID NO: 7485477 - DNA, 22 bp, Homo sapiens
cagttttatgtcgaatgtatac

SEQ ID NO: 7485478 - DNA, 22 bp, Homo sapiens
cagttttatgtcgaatgtatac

SEQ ID NO: 7485479 - DNA, 22 bp, Homo sapiens
cagttttatgtcgaatgtatac

SEQ ID NO: 7485480 - DNA, 22 bp, Homo sapiens
cagttttatgtcgaatgtatac

SEQ ID NO: 7485481 - DNA, 22 bp, Homo sapiens
cagttttatgtcgaatgtatac

SEQ ID NO: 7485482 - DNA, 22 bp, Homo sapiens
cagttttatgtcgaatgtatac

SEQ ID NO: 7485483 - DNA, 22 bp, Homo sapiens
catacatatgtggatgtcatat

SEQ ID NO: 7485484 - DNA, 22 bp, Homo sapiens
catacatatgtggatgtcatat

SEQ ID NO: 7485485 - DNA, 22 bp, Homo sapiens
catacatatgtggatgtcatat

SEQ ID NO: 7485486 - DNA, 22 bp, Homo sapiens
catacattacctaacttaatgc

SEQ ID NO: 7485487 - DNA, 22 bp, Homo sapiens
catacattacctaacttaatgc

SEQ ID NO: 7485488 - DNA, 22 bp, Homo sapiens
catagcttaggggttaaactca

SEQ ID NO: 7485489 - DNA, 22 bp, Homo sapiens
catagcttaggggttaaactca

SEQ ID NO: 7485490 - DNA, 22 bp, Homo sapiens
cataggaagccatctcagtcac

SEQ ID NO: 7485491 - DNA, 22 bp, Homo sapiens
cataggaagccatctcagtcac

SEQ ID NO: 7485492 - DNA, 22 bp, Homo sapiens
cataggaatgaggacaattagc

SEQ ID NO: 7485493 - DNA, 22 bp, Homo sapiens
catagctgtgtgccatgtaaaa

SEQ ID NO: 7485494 - DNA, 22 bp, Homo sapiens
catagctgtgtgccatgtaaaa

SEQ ID NO: 7485495 - DNA, 22 bp, Homo sapiens
catagcttaggggttaaactca

SEQ ID NO: 7485496 - DNA, 22 bp, Homo sapiens
catagcggtattccacgtggtt

SEQ ID NO: 7485497 - DNA, 22 bp, Homo sapiens
catagccatctttagcttccag

SEQ ID NO: 7485498 - DNA, 22 bp, Homo sapiens
catagcggtattccacgtggtt

SEQ ID NO: 7485499 - DNA, 22 bp, Homo sapiens
catagtaagtgcataataaatg

SEQ ID NO: 7485500 - DNA, 22 bp, Homo sapiens
cataggtcactaaatcagcaaa

SEQ ID NO: 7485501 - DNA, 22 bp, Homo sapiens
cataggtgttcccgtgggtcac

SEQ ID NO: 7485502 - DNA, 22 bp, Homo sapiens
cataggctcttcagagaactga

SEQ ID NO: 7485503 - DNA, 22 bp, Homo sapiens
cataggctcttcagagaactga

SEQ ID NO: 7485504 - DNA, 22 bp, Homo sapiens
cataggccacggtcagcccaca

SEQ ID NO: 7485505 - DNA, 22 bp, Homo sapiens
cataggtcactgtacaggttaa

SEQ ID NO: 7485506 - DNA, 22 bp, Homo sapiens
cataggtcactgtacaggttaa

SEQ ID NO: 7485507 - DNA, 22 bp, Homo sapiens
catataaatacaacatgtgtta

SEQ ID NO: 7485508 - DNA, 22 bp, Homo sapiens
catataaatacaacatgtgtta

SEQ ID NO: 7485509 - DNA, 22 bp, Homo sapiens
catataaatacaacatgtgtta

SEQ ID NO: 7485510 - DNA, 22 bp, Homo sapiens
catagttcctacctaagcataa

SEQ ID NO: 7485511 - DNA, 22 bp, Homo sapiens
catagttttaggtagaaactgg

SEQ ID NO: 7485512 - DNA, 22 bp, Homo sapiens
catagttttaggtagaaactgg

SEQ ID NO: 7485513 - DNA, 22 bp, Homo sapiens
catagttttaggtagaaactgg

SEQ ID NO: 7485514 - DNA, 22 bp, Homo sapiens
catagttttaggtagaaactgg

SEQ ID NO: 7485515 - DNA, 22 bp, Homo sapiens
catagtgtctggtaacatagta

SEQ ID NO: 7485516 - DNA, 22 bp, Homo sapiens
catagtgactcatgcctataat

SEQ ID NO: 7485517 - DNA, 22 bp, Homo sapiens
catagttagtggttcagagcaa

SEQ ID NO: 7485518 - DNA, 22 bp, Homo sapiens
catagttataaggcaacactgt

SEQ ID NO: 7485519 - DNA, 22 bp, Homo sapiens
catataaatacaacatgtgtta

SEQ ID NO: 7485520 - DNA, 22 bp, Homo sapiens
catataaatacaacatgtgtta

SEQ ID NO: 7485521 - DNA, 22 bp, Homo sapiens
catataaatacaacatgtgtta

SEQ ID NO: 7485522 - DNA, 22 bp, Homo sapiens
catataaatacaacatgtgtta

SEQ ID NO: 7485523 - DNA, 22 bp, Homo sapiens
catataaatacaacatgtgtta

SEQ ID NO: 7485524 - DNA, 22 bp, Homo sapiens
catataaatacaacatgtgtta

SEQ ID NO: 7485525 - DNA, 22 bp, Homo sapiens
catataaatacaacatgtgtta

SEQ ID NO: 7485526 - DNA, 22 bp, Homo sapiens
catataaatacaacatgtgtta

SEQ ID NO: 7485527 - DNA, 22 bp, Homo sapiens
caggtgcaatgagacagctctg

SEQ ID NO: 7485528 - DNA, 22 bp, Homo sapiens
caggtgcagctggatggaagcc

SEQ ID NO: 7485529 - DNA, 22 bp, Homo sapiens
caggtgcagctggatggaagcc

SEQ ID NO: 7485530 - DNA, 22 bp, Homo sapiens
caggtgccatagacgggcctgg

SEQ ID NO: 7485531 - DNA, 22 bp, Homo sapiens
caggtggcttattagggtcagt

SEQ ID NO: 7485532 - DNA, 22 bp, Homo sapiens
caggtggcttattagggtcagt

SEQ ID NO: 7485533 - DNA, 22 bp, Homo sapiens
caggtgccatagacgggcctgg

SEQ ID NO: 7485534 - DNA, 22 bp, Homo sapiens
caggtgcagggagttcaggatg

SEQ ID NO: 7485535 - DNA, 22 bp, Homo sapiens
caggtgccatagacgggcctgg

SEQ ID NO: 7485536 - DNA, 22 bp, Homo sapiens
caggtggcttctccctaggcca

SEQ ID NO: 7485537 - DNA, 22 bp, Homo sapiens
caggtggcttctccctaggcca

SEQ ID NO: 7485538 - DNA, 22 bp, Homo sapiens
caggtggcttctccctaggcca

SEQ ID NO: 7485539 - DNA, 22 bp, Homo sapiens
caggtggcttctccctaggcca

SEQ ID NO: 7485540 - DNA, 22 bp, Homo sapiens
caggtggcttctccctaggcca

SEQ ID NO: 7485541 - DNA, 22 bp, Homo sapiens
caggtggcttctccctaggcca

SEQ ID NO: 7485542 - DNA, 22 bp, Homo sapiens
caggtggcttctccctaggcca

SEQ ID NO: 7485543 - DNA, 22 bp, Homo sapiens
caggtggcttctccctaggcca

SEQ ID NO: 7485544 - DNA, 22 bp, Homo sapiens
caggtggcttctccctaggcca

SEQ ID NO: 7485545 - DNA, 22 bp, Homo sapiens
caggtgggagccacagcgtaca

SEQ ID NO: 7485546 - DNA, 22 bp, Homo sapiens
caggtgggagccacagcgtaca

SEQ ID NO: 7485547 - DNA, 22 bp, Homo sapiens
caggtgggagccacagcgtaca

SEQ ID NO: 7485548 - DNA, 22 bp, Homo sapiens
caggtgggagccacagcgtaca

SEQ ID NO: 7485549 - DNA, 22 bp, Homo sapiens
caggtgggaccatgatagggca

SEQ ID NO: 7485550 - DNA, 22 bp, Homo sapiens
caggtgggaccatgatagggca

SEQ ID NO: 7485551 - DNA, 22 bp, Homo sapiens
caggtgggaccatgatagggca

SEQ ID NO: 7485552 - DNA, 22 bp, Homo sapiens
caggtgggaccatgatagggca

SEQ ID NO: 7485553 - DNA, 22 bp, Homo sapiens
caggtgggaccatgatagggca

SEQ ID NO: 7485554 - DNA, 22 bp, Homo sapiens
caggtgggaccatgatagggca

SEQ ID NO: 7485555 - DNA, 22 bp, Homo sapiens
caggtggcttctctgcagcctt

SEQ ID NO: 7485556 - DNA, 22 bp, Homo sapiens
caggtggcttctctgcagcctt

SEQ ID NO: 7485557 - DNA, 22 bp, Homo sapiens
caggtggcttctctgcagcctt

SEQ ID NO: 7485558 - DNA, 22 bp, Homo sapiens
caggtggcttctctgcagcctt

SEQ ID NO: 7485559 - DNA, 22 bp, Homo sapiens
caggtggcttctctgcagcctt

SEQ ID NO: 7485560 - DNA, 22 bp, Homo sapiens
caggtggcttctccctaggcca

SEQ ID NO: 7485561 - DNA, 22 bp, Homo sapiens
caggtggcttctctgcagcctt

SEQ ID NO: 7485562 - DNA, 22 bp, Homo sapiens
caggtggcttctctgcagcctt

SEQ ID NO: 7485563 - DNA, 22 bp, Homo sapiens
caggtggcttctctgcagcctt

SEQ ID NO: 7485564 - DNA, 22 bp, Homo sapiens
caggtggcttctctgcagcctt

SEQ ID NO: 7485565 - DNA, 22 bp, Homo sapiens
aggacaggattgagctgaactg

SEQ ID NO: 7485566 - DNA, 22 bp, Homo sapiens
aggacaggattgagctgaactg

SEQ ID NO: 7485567 - DNA, 22 bp, Homo sapiens
aggacaggattgagctgaactg

SEQ ID NO: 7485568 - DNA, 22 bp, Homo sapiens
aggacaggattgagctgaactg

SEQ ID NO: 7485569 - DNA, 22 bp, Homo sapiens
aggacaggattccttgccttgc

SEQ ID NO: 7485570 - DNA, 22 bp, Homo sapiens
aggacatgtaaatggagaggga

SEQ ID NO: 7485571 - DNA, 22 bp, Homo sapiens
aggacatgtaaatggagaggga

SEQ ID NO: 7485572 - DNA, 22 bp, Homo sapiens
aggacaggattgagctgaactg

SEQ ID NO: 7485573 - DNA, 22 bp, Homo sapiens
aggacaggattgagctgaactg

SEQ ID NO: 7485574 - DNA, 22 bp, Homo sapiens
aggacaggattgagctgaactg

SEQ ID NO: 7485575 - DNA, 22 bp, Homo sapiens
aggacatgtaaatggagaggga

SEQ ID NO: 7485576 - DNA, 22 bp, Homo sapiens
aggacatgtaaatggagaggga

SEQ ID NO: 7485577 - DNA, 22 bp, Homo sapiens
aggacatgtttgtatcttcctt

SEQ ID NO: 7485578 - DNA, 22 bp, Homo sapiens
aggacatgtgcctccagggcag

SEQ ID NO: 7485579 - DNA, 22 bp, Homo sapiens
aggacatgtttgtatcttcctt

SEQ ID NO: 7485580 - DNA, 22 bp, Homo sapiens
aggacatgtgcctccagggcag

SEQ ID NO: 7485581 - DNA, 22 bp, Homo sapiens
aggacatgtgcctccagggcag

SEQ ID NO: 7485582 - DNA, 22 bp, Homo sapiens
aggacatgtgcctccagggcag

SEQ ID NO: 7485583 - DNA, 22 bp, Homo sapiens
caggtgggagcgaggagctact

SEQ ID NO: 7485584 - DNA, 22 bp, Homo sapiens
caggtgggagcgaggagctact

SEQ ID NO: 7485585 - DNA, 22 bp, Homo sapiens
caggtgggagcgaggagctact

SEQ ID NO: 7485586 - DNA, 22 bp, Homo sapiens
caggtgggagcgaggagctact

SEQ ID NO: 7485587 - DNA, 22 bp, Homo sapiens
caggtgggagcgaggagctact

SEQ ID NO: 7485588 - DNA, 22 bp, Homo sapiens
caggtgggagcgaggagctact

SEQ ID NO: 7485589 - DNA, 22 bp, Homo sapiens
caggtgggagcgaggagctact

SEQ ID NO: 7485590 - DNA, 22 bp, Homo sapiens
caggtgggagcgaggagctact

SEQ ID NO: 7485591 - DNA, 22 bp, Homo sapiens
aggacaggattccttgccttgc

SEQ ID NO: 7485592 - DNA, 22 bp, Homo sapiens
caggtgggagcggagactgatt

SEQ ID NO: 7485593 - DNA, 22 bp, Homo sapiens
caggtgggagcggagactgatt

SEQ ID NO: 7485594 - DNA, 22 bp, Homo sapiens
caggtgggagcggagactgatt

SEQ ID NO: 7485595 - DNA, 22 bp, Homo sapiens
caggtgggagcggagactgatt

SEQ ID NO: 7485596 - DNA, 22 bp, Homo sapiens
caggtgggagcggagactgatt

SEQ ID NO: 7485597 - DNA, 22 bp, Homo sapiens
caggtgggagcgaggagctact

SEQ ID NO: 7485598 - DNA, 22 bp, Homo sapiens
caggtgggagcgaggagctact

SEQ ID NO: 7485599 - DNA, 22 bp, Homo sapiens
caggtgggagcgaggagctact

SEQ ID NO: 7485600 - DNA, 22 bp, Homo sapiens
caggtgggagcgaggagctact

SEQ ID NO: 7485601 - DNA, 22 bp, Homo sapiens
caggtgggagcgaggagctact

SEQ ID NO: 7485602 - DNA, 22 bp, Homo sapiens
aggaccaccggtccatccaccc

SEQ ID NO: 7485603 - DNA, 22 bp, Homo sapiens
aggaccagaccgaactagctaa

SEQ ID NO: 7485604 - DNA, 22 bp, Homo sapiens
aggaccagaccgaactagctaa

SEQ ID NO: 7485605 - DNA, 22 bp, Homo sapiens
aggaccagaccgaactagctaa

SEQ ID NO: 7485606 - DNA, 22 bp, Homo sapiens
aggaccagaccgaactagctaa

SEQ ID NO: 7485607 - DNA, 22 bp, Homo sapiens
aggaccagaggccagagtcagc

SEQ ID NO: 7485608 - DNA, 22 bp, Homo sapiens
aggaccagaggccagagtcagc

SEQ ID NO: 7485609 - DNA, 22 bp, Homo sapiens
aggaccagaggccagagtcagc

SEQ ID NO: 7485610 - DNA, 22 bp, Homo sapiens
aggaccaggtctaatgaagaca

SEQ ID NO: 7485611 - DNA, 22 bp, Homo sapiens
aggaccaggtctaatgaagaca

SEQ ID NO: 7485612 - DNA, 22 bp, Homo sapiens
aggaccaggtctaatgaagaca

SEQ ID NO: 7485613 - DNA, 22 bp, Homo sapiens
aggaccagcctccaggtctctt

SEQ ID NO: 7485614 - DNA, 22 bp, Homo sapiens
aggaccagcctccaggtctctt

SEQ ID NO: 7485615 - DNA, 22 bp, Homo sapiens
aggaccagcctccaggtctctt

SEQ ID NO: 7485616 - DNA, 22 bp, Homo sapiens
aggaccagcctccaggtctctt

SEQ ID NO: 7485617 - DNA, 22 bp, Homo sapiens
aggaccagcctccaggtctctt

SEQ ID NO: 7485618 - DNA, 22 bp, Homo sapiens
aggaccagaggccagagtcagc

SEQ ID NO: 7485619 - DNA, 22 bp, Homo sapiens
aggaccagaggccagagtcagc

SEQ ID NO: 7485620 - DNA, 22 bp, Homo sapiens
aggaccagaggccagagtcagc

SEQ ID NO: 7485621 - DNA, 22 bp, Homo sapiens
aggaccagcctccaggtctctt

SEQ ID NO: 7485622 - DNA, 22 bp, Homo sapiens
aggaccagtatgagagcatctg

SEQ ID NO: 7485623 - DNA, 22 bp, Homo sapiens
aggaccagtatgagagcatctg

SEQ ID NO: 7485624 - DNA, 22 bp, Homo sapiens
aggaccagtatgagagcatctg

SEQ ID NO: 7485625 - DNA, 22 bp, Homo sapiens
aggaccagtatgagagcatctg

SEQ ID NO: 7485626 - DNA, 22 bp, Homo sapiens
aggaccagtatgagagcatctg

SEQ ID NO: 7485627 - DNA, 22 bp, Homo sapiens
aggaccagtatgagagcatctg

SEQ ID NO: 7485628 - DNA, 23 bp, Homo sapiens
aggaccaggttcccaaaagtcaa

SEQ ID NO: 7485629 - DNA, 22 bp, Homo sapiens
aggaccaggtctaatgaagaca

SEQ ID NO: 7485630 - DNA, 23 bp, Homo sapiens
aggaccaggttcccaaaagtcaa

SEQ ID NO: 7485631 - DNA, 22 bp, Homo sapiens
aggaccagtatgagagcatctg

SEQ ID NO: 7485632 - DNA, 22 bp, Homo sapiens
aggaccagtgagtctggcaagt

SEQ ID NO: 7485633 - DNA, 22 bp, Homo sapiens
aggaccagtatgagagcatctg

SEQ ID NO: 7485634 - DNA, 22 bp, Homo sapiens
aggaccagtatgagagcatctg

SEQ ID NO: 7485635 - DNA, 22 bp, Homo sapiens
aggaccagtgagtctggcaagt

SEQ ID NO: 7485636 - DNA, 22 bp, Homo sapiens
aggaccagtgagtctggcaagt

SEQ ID NO: 7485637 - DNA, 22 bp, Homo sapiens
aggaccagtgagtctggcaagt

SEQ ID NO: 7485638 - DNA, 22 bp, Homo sapiens
aggaccattgtgtagcagacat

SEQ ID NO: 7485639 - DNA, 22 bp, Homo sapiens
aggacccaagcacagttcctgg

SEQ ID NO: 7485640 - DNA, 22 bp, Homo sapiens
aggaccttggaataacaaattc

SEQ ID NO: 7485641 - DNA, 22 bp, Homo sapiens
aggacctttggcaaggctgctc

SEQ ID NO: 7485642 - DNA, 22 bp, Homo sapiens
aggaccttggaataacaaattc

SEQ ID NO: 7485643 - DNA, 22 bp, Homo sapiens
aggacctgtgttttccttgaat

SEQ ID NO: 7485644 - DNA, 22 bp, Homo sapiens
aggacctgtgttttccttgaat

SEQ ID NO: 7485645 - DNA, 22 bp, Homo sapiens
aggacctggatcacagagatct

SEQ ID NO: 7485646 - DNA, 22 bp, Homo sapiens
aggacctgtagggcctgcatcc

SEQ ID NO: 7485647 - DNA, 22 bp, Homo sapiens
aggacctgtagggcctgcatcc

SEQ ID NO: 7485648 - DNA, 22 bp, Homo sapiens
aggacctggatcacagagatct

SEQ ID NO: 7485649 - DNA, 22 bp, Homo sapiens
aggacctggatcacagagatct

SEQ ID NO: 7485650 - DNA, 22 bp, Homo sapiens
aggacctgctaatgtgccaagt

SEQ ID NO: 7485651 - DNA, 22 bp, Homo sapiens
aggacctgctaatgtgccaagt

SEQ ID NO: 7485652 - DNA, 22 bp, Homo sapiens
aggacctggatcacagagatct

SEQ ID NO: 7485653 - DNA, 22 bp, Homo sapiens
aggacctgtacctcagcatcta

SEQ ID NO: 7485654 - DNA, 22 bp, Homo sapiens
aggacctgtacctcagcatcta

SEQ ID NO: 7485655 - DNA, 22 bp, Homo sapiens
aggacctgtacctcagcatcta

SEQ ID NO: 7485656 - DNA, 22 bp, Homo sapiens
aggacctgactggctcctgctt

SEQ ID NO: 7485657 - DNA, 22 bp, Homo sapiens
aggacctgactggctcctgctt

SEQ ID NO: 7485658 - DNA, 22 bp, Homo sapiens
aggacctgactggctcctgctt

SEQ ID NO: 7485659 - DNA, 22 bp, Homo sapiens
aggacctgagagttggaaatcc

SEQ ID NO: 7485660 - DNA, 22 bp, Homo sapiens
aggacctgagagttggaaatcc

SEQ ID NO: 7485661 - DNA, 22 bp, Homo sapiens
aggacctgccaggtgcaaagca

SEQ ID NO: 7485662 - DNA, 22 bp, Homo sapiens
aggacccagaaggtgcagcaga

SEQ ID NO: 7485663 - DNA, 22 bp, Homo sapiens
aggaccctgagcgggcatgccg

SEQ ID NO: 7485664 - DNA, 22 bp, Homo sapiens
aggaccctgagcgggcatgccg

SEQ ID NO: 7485665 - DNA, 22 bp, Homo sapiens
aggacccagaaggtgcagcaga

SEQ ID NO: 7485666 - DNA, 22 bp, Homo sapiens
aggacccacgcacaggaacccc

SEQ ID NO: 7485667 - DNA, 22 bp, Homo sapiens
aggacccacgcacaggaacccc

SEQ ID NO: 7485668 - DNA, 22 bp, Homo sapiens
aggacccaagcacagttcctgg

SEQ ID NO: 7485669 - DNA, 22 bp, Homo sapiens
aggacctgaaattcttgctttt

SEQ ID NO: 7485670 - DNA, 22 bp, Homo sapiens
aggacctgacattgtgttttct

SEQ ID NO: 7485671 - DNA, 22 bp, Homo sapiens
aggacctgacattgtgttttct

SEQ ID NO: 7485672 - DNA, 22 bp, Homo sapiens
aggacctactgatatcttagca

SEQ ID NO: 7485673 - DNA, 22 bp, Homo sapiens
aggaccctgctcaagcatctcc

SEQ ID NO: 7485674 - DNA, 19 bp, Homo sapiens
aggacccttatcctggctt

SEQ ID NO: 7485675 - DNA, 19 bp, Homo sapiens
aggacccttatcctggctt

SEQ ID NO: 7485676 - DNA, 19 bp, Homo sapiens
aggacccttatcctggctt

SEQ ID NO: 7485677 - DNA, 22 bp, Homo sapiens
aggaccctgctcaagcatctcc

SEQ ID NO: 7485678 - DNA, 22 bp, Homo sapiens
aggaccctgctcaagcatctcc

SEQ ID NO: 7485679 - DNA, 22 bp, Homo sapiens
aggaccctgaggtctcctgtga

SEQ ID NO: 7485680 - DNA, 22 bp, Homo sapiens
aggaccctgaggtctcctgtga

SEQ ID NO: 7485681 - DNA, 19 bp, Homo sapiens
aggagaagtagcagaaatt

SEQ ID NO: 7485682 - DNA, 19 bp, Homo sapiens
aggagaagtagcagaaatt

SEQ ID NO: 7485683 - DNA, 19 bp, Homo sapiens
aggagaagtagcagaaatt

SEQ ID NO: 7485684 - DNA, 22 bp, Homo sapiens
cagtggagagacttttactctt

SEQ ID NO: 7485685 - DNA, 22 bp, Homo sapiens
aggagaattaggaactcaagat

SEQ ID NO: 7485686 - DNA, 19 bp, Homo sapiens
aggagaagtagcagaaatt

SEQ ID NO: 7485687 - DNA, 19 bp, Homo sapiens
aggagaagtagcagaaatt

SEQ ID NO: 7485688 - DNA, 19 bp, Homo sapiens
aggagaagtagcagaaatt

SEQ ID NO: 7485689 - DNA, 19 bp, Homo sapiens
aggagaagtagcagaaatt

SEQ ID NO: 7485690 - DNA, 19 bp, Homo sapiens
aggagaagtagcagaaatt

SEQ ID NO: 7485691 - DNA, 19 bp, Homo sapiens
aggagaagtagcagaaatt

SEQ ID NO: 7485692 - DNA, 19 bp, Homo sapiens
aggagaagtagcagaaatt

SEQ ID NO: 7485693 - DNA, 19 bp, Homo sapiens
aggagaagtagcagaaatt

SEQ ID NO: 7485694 - DNA, 19 bp, Homo sapiens
aggagaagtagcagaaatt

SEQ ID NO: 7485695 - DNA, 19 bp, Homo sapiens
aggagaagtagcagaaatt

SEQ ID NO: 7485696 - DNA, 22 bp, Homo sapiens
aggagaagtaaggctagatgat

SEQ ID NO: 7485697 - DNA, 22 bp, Homo sapiens
aggagaagtaaggctagatgat

SEQ ID NO: 7485698 - DNA, 22 bp, Homo sapiens
aggagaaggaggcccctcacac

SEQ ID NO: 7485699 - DNA, 22 bp, Homo sapiens
aggagaaggaggcccctcacac

SEQ ID NO: 7485700 - DNA, 22 bp, Homo sapiens
aggagaaggaagtgcatcacta

SEQ ID NO: 7485701 - DNA, 22 bp, Homo sapiens
cagtgctcctgatgtacccttg

SEQ ID NO: 7485702 - DNA, 22 bp, Homo sapiens
aggagaaggaagtgcatcacta

SEQ ID NO: 7485703 - DNA, 22 bp, Homo sapiens
aggagaaggaagtgcatcacta

SEQ ID NO: 7485704 - DNA, 22 bp, Homo sapiens
aggagaaggaagtgcatcacta

SEQ ID NO: 7485705 - DNA, 22 bp, Homo sapiens
aggagaaggaagtgcatcacta

SEQ ID NO: 7485706 - DNA, 22 bp, Homo sapiens
aggagaaggaagtgcatcacta

SEQ ID NO: 7485707 - DNA, 22 bp, Homo sapiens
aggagaaggaagtgcatcacta

SEQ ID NO: 7485708 - DNA, 22 bp, Homo sapiens
aggagaagtaaggctagatgat

SEQ ID NO: 7485709 - DNA, 22 bp, Homo sapiens
aggagaagtaaggctagatgat

SEQ ID NO: 7485710 - DNA, 22 bp, Homo sapiens
aggagaagtaaggctagatgat

SEQ ID NO: 7485711 - DNA, 22 bp, Homo sapiens
aggagaagtaaggctagatgat

SEQ ID NO: 7485712 - DNA, 22 bp, Homo sapiens
aggagaagtaaggctagatgat

SEQ ID NO: 7485713 - DNA, 22 bp, Homo sapiens
aggagaagtaaggctagatgat

SEQ ID NO: 7485714 - DNA, 22 bp, Homo sapiens
aggagaagtaaggctagatgat

SEQ ID NO: 7485715 - DNA, 22 bp, Homo sapiens
aggagaaggaggcccctcacac

SEQ ID NO: 7485716 - DNA, 22 bp, Homo sapiens
aggagaaggaggcccctcacac

SEQ ID NO: 7485717 - DNA, 22 bp, Homo sapiens
aggagaaggaggcccctcacac

SEQ ID NO: 7485718 - DNA, 22 bp, Homo sapiens
aggagaaggaggcccctcacac

SEQ ID NO: 7485719 - DNA, 22 bp, Homo sapiens
cagtggccatggtggcaggggt

SEQ ID NO: 7485720 - DNA, 22 bp, Homo sapiens
cagtggccgcggggctgtgggt

SEQ ID NO: 7485721 - DNA, 22 bp, Homo sapiens
cagtggccatggtggcaggggt

SEQ ID NO: 7485722 - DNA, 22 bp, Homo sapiens
cagtggccatggtggcaggggt

SEQ ID NO: 7485723 - DNA, 17 bp, Homo sapiens
cagtggcctatggcttt

SEQ ID NO: 7485724 - DNA, 17 bp, Homo sapiens
cagtggcctatggcttt

SEQ ID NO: 7485725 - DNA, 22 bp, Homo sapiens
cagtggccgcggggctgtgggt

SEQ ID NO: 7485726 - DNA, 22 bp, Homo sapiens
cagtggcctttcctgctgctca

SEQ ID NO: 7485727 - DNA, 22 bp, Homo sapiens
cagtggccttgatgcctcattc

SEQ ID NO: 7485728 - DNA, 22 bp, Homo sapiens
cagtggcctctggctttgctgt

SEQ ID NO: 7485729 - DNA, 22 bp, Homo sapiens
cagtggcctgagccaggcttcc

SEQ ID NO: 7485730 - DNA, 19 bp, Homo sapiens
cagtggcctggaggtctct

SEQ ID NO: 7485731 - DNA, 18 bp, Homo sapiens
cagtggcatagttgagta

SEQ ID NO: 7485732 - DNA, 18 bp, Homo sapiens
cagtggcatagttgagta

SEQ ID NO: 7485733 - DNA, 18 bp, Homo sapiens
cagtggcatagttgagta

SEQ ID NO: 7485734 - DNA, 22 bp, Homo sapiens
cagtggagaggcatgcttggca

SEQ ID NO: 7485735 - DNA, 22 bp, Homo sapiens
cagtggagaggcatgcttggca

SEQ ID NO: 7485736 - DNA, 22 bp, Homo sapiens
cagtggcatacttggctgatat

SEQ ID NO: 7485737 - DNA, 22 bp, Homo sapiens
cagtggcatacttggctgatat

SEQ ID NO: 7485738 - DNA, 22 bp, Homo sapiens
cagtggcatggttgactgcagt

SEQ ID NO: 7485739 - DNA, 22 bp, Homo sapiens
cagtggcatggttgactgcagt

SEQ ID NO: 7485740 - DNA, 22 bp, Homo sapiens
cagtggcatggttgactgcagt

SEQ ID NO: 7485741 - DNA, 22 bp, Homo sapiens
cagtggcatggttgactgcagt

SEQ ID NO: 7485742 - DNA, 22 bp, Homo sapiens
cagtggcatggttgactgcagt

SEQ ID NO: 7485743 - DNA, 22 bp, Homo sapiens
cagtggcatggttgactgcagt

SEQ ID NO: 7485744 - DNA, 22 bp, Homo sapiens
cagtggccaacttcctgcctct

SEQ ID NO: 7485745 - DNA, 22 bp, Homo sapiens
cagtggccaacttcctgcctct

SEQ ID NO: 7485746 - DNA, 22 bp, Homo sapiens
cagtggccatggtggcaggggt

SEQ ID NO: 7485747 - DNA, 20 bp, Homo sapiens
cagtgcctgccccttgggtt

SEQ ID NO: 7485748 - DNA, 20 bp, Homo sapiens
cagtgcctgccccttgggtt

SEQ ID NO: 7485749 - DNA, 22 bp, Homo sapiens
cagtgcctgccttttattttgt

SEQ ID NO: 7485750 - DNA, 22 bp, Homo sapiens
cagtgcctggatagcaacatga

SEQ ID NO: 7485751 - DNA, 22 bp, Homo sapiens
cagtgcctgccttttattttgt

SEQ ID NO: 7485752 - DNA, 22 bp, Homo sapiens
cagtgcctggatagcaacatga

SEQ ID NO: 7485753 - DNA, 20 bp, Homo sapiens
cagtgcctgccccttgggtt

SEQ ID NO: 7485754 - DNA, 22 bp, Homo sapiens
cagtgcctcttaagtgtcaccc

SEQ ID NO: 7485755 - DNA, 22 bp, Homo sapiens
cagtgcctcttaagtgtcaccc

SEQ ID NO: 7485756 - DNA, 22 bp, Homo sapiens
cagtgcctcttaagtgtcaccc

SEQ ID NO: 7485757 - DNA, 22 bp, Homo sapiens
cagtgcctgggacccggctgtg

SEQ ID NO: 7485758 - DNA, 22 bp, Homo sapiens
cagtgcctggcatagaggcggc

SEQ ID NO: 7485759 - DNA, 22 bp, Homo sapiens
cagtgcctggccggcttccatt

SEQ ID NO: 7485760 - DNA, 22 bp, Homo sapiens
cagtgcctgggacccggctgtg

SEQ ID NO: 7485761 - DNA, 22 bp, Homo sapiens
cagtgcctgggacccggctgtg

SEQ ID NO: 7485762 - DNA, 22 bp, Homo sapiens
cagtgcctgtcttattcttaca

SEQ ID NO: 7485763 - DNA, 22 bp, Homo sapiens
cagtgcctgtgggcttcttcca

SEQ ID NO: 7485764 - DNA, 22 bp, Homo sapiens
cagtgcctggcatagaggcggc

SEQ ID NO: 7485765 - DNA, 22 bp, Homo sapiens
cagtgcctggccggcttccatt

SEQ ID NO: 7485766 - DNA, 22 bp, Homo sapiens
cagtgcctggcatagaggcggc

SEQ ID NO: 7485767 - DNA, 22 bp, Homo sapiens
cagtgcctggccggcttccatt

SEQ ID NO: 7485768 - DNA, 22 bp, Homo sapiens
cagtgcctggccggcttccatt

SEQ ID NO: 7485769 - DNA, 22 bp, Homo sapiens
cagtgctcctgatgtacccttg

SEQ ID NO: 7485770 - DNA, 22 bp, Homo sapiens
cagtgctcccgctgccgctgtg

SEQ ID NO: 7485771 - DNA, 22 bp, Homo sapiens
aggagaaggaagtgcatcacta

SEQ ID NO: 7485772 - DNA, 22 bp, Homo sapiens
cagtgctcatagctgttcctcc

SEQ ID NO: 7485773 - DNA, 22 bp, Homo sapiens
cagtgctagaatgtaactctag

SEQ ID NO: 7485774 - DNA, 22 bp, Homo sapiens
cagtgctagggcagagcactcc

SEQ ID NO: 7485775 - DNA, 22 bp, Homo sapiens
cagtgctaccccggaagttggt

SEQ ID NO: 7485776 - DNA, 22 bp, Homo sapiens
cagtgctataatccagtgtcgt

SEQ ID NO: 7485777 - DNA, 22 bp, Homo sapiens
cagtgctaggtcgtgtgctggg

SEQ ID NO: 7485778 - DNA, 22 bp, Homo sapiens
cagtgctataatccagtgtcgt

SEQ ID NO: 7485779 - DNA, 22 bp, Homo sapiens
cagtgctatgttggttttctgg

SEQ ID NO: 7485780 - DNA, 22 bp, Homo sapiens
cagtgctatttggacacaggga

SEQ ID NO: 7485781 - DNA, 21 bp, Homo sapiens
cagtgctcaatctgacagtgg

SEQ ID NO: 7485782 - DNA, 21 bp, Homo sapiens
cagtgctcaatctgacagtgg

SEQ ID NO: 7485783 - DNA, 21 bp, Homo sapiens
cagtgctcaatctgacagtgg

SEQ ID NO: 7485784 - DNA, 20 bp, Homo sapiens
cagtgcctatcattaattcc

SEQ ID NO: 7485785 - DNA, 22 bp, Homo sapiens
cagtgcctcaggccagcctgca

SEQ ID NO: 7485786 - DNA, 22 bp, Homo sapiens
cagtgcctcaggccagcctgca

SEQ ID NO: 7485787 - DNA, 22 bp, Homo sapiens
cagtgcctcttaagtgtcaccc

SEQ ID NO: 7485788 - DNA, 22 bp, Homo sapiens
cagtgcccttccaggactgcag

SEQ ID NO: 7485789 - DNA, 22 bp, Homo sapiens
cagtgcccttccaggactgcag

SEQ ID NO: 7485790 - DNA, 22 bp, Homo sapiens
cagtgccctcatctatgaaatc

SEQ ID NO: 7485791 - DNA, 22 bp, Homo sapiens
cagtgcctcaggccagcctgca

SEQ ID NO: 7485792 - DNA, 22 bp, Homo sapiens
cagtgccgagctgggggctcct

SEQ ID NO: 7485793 - DNA, 22 bp, Homo sapiens
cagtgcccgccgccgttcctgg

SEQ ID NO: 7485794 - DNA, 22 bp, Homo sapiens
cagtgcccgccgccgttcctgg

SEQ ID NO: 7485795 - DNA, 19 bp, Homo sapiens
cagtgcccgacgcaggtct

SEQ ID NO: 7485796 - DNA, 19 bp, Homo sapiens
cagtgcccgacgcaggtct

SEQ ID NO: 7485797 - DNA, 19 bp, Homo sapiens
cagtgcccgacgcaggtct

SEQ ID NO: 7485798 - DNA, 22 bp, Homo sapiens
cagtgcccttccaggactgcag

SEQ ID NO: 7485799 - DNA, 22 bp, Homo sapiens
cagtgcccttccaggactgcag

SEQ ID NO: 7485800 - DNA, 22 bp, Homo sapiens
cagtgcccttccaggactgcag

SEQ ID NO: 7485801 - DNA, 22 bp, Homo sapiens
cagtgccctcatctatgaaatc

SEQ ID NO: 7485802 - DNA, 22 bp, Homo sapiens
cagtgcccgccgccgttcctgg

SEQ ID NO: 7485803 - DNA, 20 bp, Homo sapiens
cagtgcccgtggaaaagatg

SEQ ID NO: 7485804 - DNA, 20 bp, Homo sapiens
cagtgcccgtggaaaagatg

SEQ ID NO: 7485805 - DNA, 20 bp, Homo sapiens
cagtgcccgtggaaaagatg

SEQ ID NO: 7485806 - DNA, 22 bp, Homo sapiens
aggactccatgtgtcctggaga

SEQ ID NO: 7485807 - DNA, 22 bp, Homo sapiens
aggactcatccctgcttgtcag

SEQ ID NO: 7485808 - DNA, 22 bp, Homo sapiens
aggactcatccctgcttgtcag

SEQ ID NO: 7485809 - DNA, 22 bp, Homo sapiens
aggacggggacgcaagtcagca

SEQ ID NO: 7485810 - DNA, 22 bp, Homo sapiens
aggactaaggaacagctgattc

SEQ ID NO: 7485811 - DNA, 22 bp, Homo sapiens
aggactaatttcaggggatata

SEQ ID NO: 7485812 - DNA, 22 bp, Homo sapiens
aggacggggacgcaagtcagca

SEQ ID NO: 7485813 - DNA, 22 bp, Homo sapiens
aggacgctctcgctgaacttct

SEQ ID NO: 7485814 - DNA, 22 bp, Homo sapiens
aggacggggacgcaagtcagca

SEQ ID NO: 7485815 - DNA, 18 bp, Homo sapiens
aggactctgctaccgtat

SEQ ID NO: 7485816 - DNA, 22 bp, Homo sapiens
aggactgaaaatgagttcttct

SEQ ID NO: 7485817 - DNA, 22 bp, Homo sapiens
aggactgaaaatgagttcttct

SEQ ID NO: 7485818 - DNA, 22 bp, Homo sapiens
cagtgcaggtggcagaggacag

SEQ ID NO: 7485819 - DNA, 21 bp, Homo sapiens
cagtgcaggggttagcgtgta

SEQ ID NO: 7485820 - DNA, 21 bp, Homo sapiens
cagtgcaggggttagcgtgta

SEQ ID NO: 7485821 - DNA, 22 bp, Homo sapiens
aggactgacttttgccatgaaa

SEQ ID NO: 7485822 - DNA, 17 bp, Homo sapiens
aggcagctcagaacatc

SEQ ID NO: 7485823 - DNA, 17 bp, Homo sapiens
aggcagctcagaacatc

SEQ ID NO: 7485824 - DNA, 17 bp, Homo sapiens
aggcagctcagaacatc

SEQ ID NO: 7485825 - DNA, 17 bp, Homo sapiens
aggcagctcagaacatc

SEQ ID NO: 7485826 - DNA, 17 bp, Homo sapiens
aggcagctcagaacatc

SEQ ID NO: 7485827 - DNA, 22 bp, Homo sapiens
aggcagctagagagtgaaactg

SEQ ID NO: 7485828 - DNA, 22 bp, Homo sapiens
aggcagctagagagtgaaactg

SEQ ID NO: 7485829 - DNA, 22 bp, Homo sapiens
aggcagctagagagtgaaactg

SEQ ID NO: 7485830 - DNA, 17 bp, Homo sapiens
aggcagctcagaacatc

SEQ ID NO: 7485831 - DNA, 17 bp, Homo sapiens
aggcagctcagaacatc

SEQ ID NO: 7485832 - DNA, 17 bp, Homo sapiens
aggcagctcagaacatc

SEQ ID NO: 7485833 - DNA, 17 bp, Homo sapiens
aggcagctcagaacatc

SEQ ID NO: 7485834 - DNA, 22 bp, Homo sapiens
aggcagctaagatggataatga

SEQ ID NO: 7485835 - DNA, 22 bp, Homo sapiens
acatagttagcttagagatact

SEQ ID NO: 7485836 - DNA, 22 bp, Homo sapiens
aggcagctagagagtgaaactg

SEQ ID NO: 7485837 - DNA, 22 bp, Homo sapiens
aggcagctaagatggataatga

SEQ ID NO: 7485838 - DNA, 22 bp, Homo sapiens
acatagtgttttgagagacagc

SEQ ID NO: 7485839 - DNA, 22 bp, Homo sapiens
acatagcagaggactgagcaga

SEQ ID NO: 7485840 - DNA, 22 bp, Homo sapiens
acatagtaagtgctcagtaaat

SEQ ID NO: 7485841 - DNA, 22 bp, Homo sapiens
acatagtgagagaaagatcagc

SEQ ID NO: 7485842 - DNA, 22 bp, Homo sapiens
acatagtaagtgctcagtaaat

SEQ ID NO: 7485843 - DNA, 22 bp, Homo sapiens
acatagtaagtgctcagtaaat

SEQ ID NO: 7485844 - DNA, 22 bp, Homo sapiens
acatagtaagtgctcagtaaat

SEQ ID NO: 7485845 - DNA, 22 bp, Homo sapiens
acatagctcagtatcacttact

SEQ ID NO: 7485846 - DNA, 20 bp, Homo sapiens
acatagctatagaaagtcga

SEQ ID NO: 7485847 - DNA, 22 bp, Homo sapiens
acatagctcagcataatcgtgg

SEQ ID NO: 7485848 - DNA, 22 bp, Homo sapiens
acatagcatgtttggacacatg

SEQ ID NO: 7485849 - DNA, 22 bp, Homo sapiens
acatagcttaaatgagaagata

SEQ ID NO: 7485850 - DNA, 22 bp, Homo sapiens
acatagctcagtatcacttact

SEQ ID NO: 7485851 - DNA, 19 bp, Homo sapiens
acatagctggctacactgt

SEQ ID NO: 7485852 - DNA, 19 bp, Homo sapiens
acatagctggctacactgt

SEQ ID NO: 7485853 - DNA, 22 bp, Homo sapiens
acatagcttaaatgagaagata

SEQ ID NO: 7485854 - DNA, 22 bp, Homo sapiens
acataggcagagctttaaagct

SEQ ID NO: 7485855 - DNA, 22 bp, Homo sapiens
acataggccaatatccagagct

SEQ ID NO: 7485856 - DNA, 21 bp, Homo sapiens
acataggcgaatgttcgggag

SEQ ID NO: 7485857 - DNA, 22 bp, Homo sapiens
acatagcataaagaatgactct

SEQ ID NO: 7485858 - DNA, 22 bp, Homo sapiens
acatagcataaagaatgactct

SEQ ID NO: 7485859 - DNA, 22 bp, Homo sapiens
acatagcataaagaatgactct

SEQ ID NO: 7485860 - DNA, 22 bp, Homo sapiens
acatagcataaagaatgactct

SEQ ID NO: 7485861 - DNA, 22 bp, Homo sapiens
acatagcacgtctcaatttgga

SEQ ID NO: 7485862 - DNA, 22 bp, Homo sapiens
acatagcacgtctcaatttgga

SEQ ID NO: 7485863 - DNA, 22 bp, Homo sapiens
acatagcacgtctcaatttgga

SEQ ID NO: 7485864 - DNA, 22 bp, Homo sapiens
acatagcagaggactgagcaga

SEQ ID NO: 7485865 - DNA, 22 bp, Homo sapiens
acatagcagaggactgagcaga

SEQ ID NO: 7485866 - DNA, 22 bp, Homo sapiens
acatagaacttcgatgtctttt

SEQ ID NO: 7485867 - DNA, 22 bp, Homo sapiens
acatagaacttcgatgtctttt

SEQ ID NO: 7485868 - DNA, 22 bp, Homo sapiens
acatagaacttcgatgtctttt

SEQ ID NO: 7485869 - DNA, 22 bp, Homo sapiens
acatagaacttcgatgtctttt

SEQ ID NO: 7485870 - DNA, 22 bp, Homo sapiens
acatagaaggaagagtagtagg

SEQ ID NO: 7485871 - DNA, 22 bp, Homo sapiens
acatagaaggaagagtagtagg

SEQ ID NO: 7485872 - DNA, 22 bp, Homo sapiens
acatagaaggaagagtagtagg

SEQ ID NO: 7485873 - DNA, 22 bp, Homo sapiens
acatagaaggaagagtagtagg

SEQ ID NO: 7485874 - DNA, 21 bp, Homo sapiens
acatacattatctttttaaaa

SEQ ID NO: 7485875 - DNA, 21 bp, Homo sapiens
acatacattatctttttaaaa

SEQ ID NO: 7485876 - DNA, 18 bp, Homo sapiens
acatacattctgtctgca

SEQ ID NO: 7485877 - DNA, 21 bp, Homo sapiens
acatacattatctttttaaaa

SEQ ID NO: 7485878 - DNA, 21 bp, Homo sapiens
acatacattatctttttaaaa

SEQ ID NO: 7485879 - DNA, 22 bp, Homo sapiens
acatagaacttcccagtgagca

SEQ ID NO: 7485880 - DNA, 22 bp, Homo sapiens
acatagaacttcccagtgagca

SEQ ID NO: 7485881 - DNA, 22 bp, Homo sapiens
acatagaacttcccagtgagca

SEQ ID NO: 7485882 - DNA, 22 bp, Homo sapiens
acatagaacttcccagtgagca

SEQ ID NO: 7485883 - DNA, 22 bp, Homo sapiens
acatagcaagtgctcaataaat

SEQ ID NO: 7485884 - DNA, 22 bp, Homo sapiens
acatagcaagtgctcaataaat

SEQ ID NO: 7485885 - DNA, 22 bp, Homo sapiens
acatagcaagtgctcaataaat

SEQ ID NO: 7485886 - DNA, 22 bp, Homo sapiens
acatagcaagtgctcaataaat

SEQ ID NO: 7485887 - DNA, 22 bp, Homo sapiens
acatagcaagtgctcaataaat

SEQ ID NO: 7485888 - DNA, 22 bp, Homo sapiens
acatagatggggtgtcatgtca

SEQ ID NO: 7485889 - DNA, 22 bp, Homo sapiens
acatagatttaagagcaattag

SEQ ID NO: 7485890 - DNA, 20 bp, Homo sapiens
acatagatcagtgattgaca

SEQ ID NO: 7485891 - DNA, 20 bp, Homo sapiens
acatagatcagtgattgaca

SEQ ID NO: 7485892 - DNA, 22 bp, Homo sapiens
acatagatctgtgattcattct

SEQ ID NO: 7485893 - DNA, 22 bp, Homo sapiens
acatagatgaggggctgatggg

SEQ ID NO: 7485894 - DNA, 22 bp, Homo sapiens
acatagatgcctctgctgcttc

SEQ ID NO: 7485895 - DNA, 22 bp, Homo sapiens
acatagatgcctctgctgcttc

SEQ ID NO: 7485896 - DNA, 22 bp, Homo sapiens
acatagatgcctctgctgcttc

SEQ ID NO: 7485897 - DNA, 22 bp, Homo sapiens
acatagatgcctctgctgcttc

SEQ ID NO: 7485898 - DNA, 22 bp, Homo sapiens
acatagagtatcatactggatg

SEQ ID NO: 7485899 - DNA, 22 bp, Homo sapiens
acatagagtatcatactggatg

SEQ ID NO: 7485900 - DNA, 20 bp, Homo sapiens
acatagatcagtgattgaca

SEQ ID NO: 7485901 - DNA, 22 bp, Homo sapiens
acatagagttcaattttcagtc

SEQ ID NO: 7485902 - DNA, 22 bp, Homo sapiens
acatagagttcaattttcagtc

SEQ ID NO: 7485903 - DNA, 22 bp, Homo sapiens
acatagaaggaggctggcagct

SEQ ID NO: 7485904 - DNA, 22 bp, Homo sapiens
acatagaagtgatgcttatcca

SEQ ID NO: 7485905 - DNA, 22 bp, Homo sapiens
acatagaagtgatgcttatcca

SEQ ID NO: 7485906 - DNA, 22 bp, Homo sapiens
acatagagagcacttagaagtt

SEQ ID NO: 7485907 - DNA, 22 bp, Homo sapiens
acatagagatgtgtttctatac

SEQ ID NO: 7485908 - DNA, 22 bp, Homo sapiens
acatagagcattggatatggga

SEQ ID NO: 7485909 - DNA, 22 bp, Homo sapiens
acatatttccatgcagcatgtc

SEQ ID NO: 7485910 - DNA, 22 bp, Homo sapiens
acatatttccatgcagcatgtc

SEQ ID NO: 7485911 - DNA, 22 bp, Homo sapiens
acatatttccatgcagcatgtc

SEQ ID NO: 7485912 - DNA, 22 bp, Homo sapiens
acatatttccatgcagcatgtc

SEQ ID NO: 7485913 - DNA, 22 bp, Homo sapiens
acatattggcaaactggaggca

SEQ ID NO: 7485914 - DNA, 23 bp, Homo sapiens
acatattgaatgctgagaatttt

SEQ ID NO: 7485915 - DNA, 22 bp, Homo sapiens
acatattggcttagctctgtga

SEQ ID NO: 7485916 - DNA, 22 bp, Homo sapiens
acatattgagctctaaaagtac

SEQ ID NO: 7485917 - DNA, 22 bp, Homo sapiens
acatattgagctctaaaagtac

SEQ ID NO: 7485918 - DNA, 22 bp, Homo sapiens
acatattgagctctaaaagtac

SEQ ID NO: 7485919 - DNA, 22 bp, Homo sapiens
acatattaactgcactacacta

SEQ ID NO: 7485920 - DNA, 22 bp, Homo sapiens
acatattaactgcactacacta

SEQ ID NO: 7485921 - DNA, 22 bp, Homo sapiens
acatattaactgcactacacta

SEQ ID NO: 7485922 - DNA, 22 bp, Homo sapiens
acatattaactgcactacacta

SEQ ID NO: 7485923 - DNA, 22 bp, Homo sapiens
acatattaactgcactacacta

SEQ ID NO: 7485924 - DNA, 22 bp, Homo sapiens
acatattaactgcactacacta

SEQ ID NO: 7485925 - DNA, 22 bp, Homo sapiens
acatattaactgcactacacta

SEQ ID NO: 7485926 - DNA, 20 bp, Homo sapiens
acatatcatggtagagtcct

SEQ ID NO: 7485927 - DNA, 22 bp, Homo sapiens
acatatattttcacacatggtt

SEQ ID NO: 7485928 - DNA, 22 bp, Homo sapiens
acatatctgtgaggttttgttg

SEQ ID NO: 7485929 - DNA, 22 bp, Homo sapiens
aggcagctggacataactaacc

SEQ ID NO: 7485930 - DNA, 22 bp, Homo sapiens
aggcagctggaggcagagacta

SEQ ID NO: 7485931 - DNA, 21 bp, Homo sapiens
aggcagctggaaggcctggct

SEQ ID NO: 7485932 - DNA, 22 bp, Homo sapiens
aggcagctggacataactaacc

SEQ ID NO: 7485933 - DNA, 22 bp, Homo sapiens
acatatattttcacacatggtt

SEQ ID NO: 7485934 - DNA, 22 bp, Homo sapiens
acatatattttcacacatggtt

SEQ ID NO: 7485935 - DNA, 22 bp, Homo sapiens
aggcagctggaggcagagacta

SEQ ID NO: 7485936 - DNA, 22 bp, Homo sapiens
aggcagctggaggcagagacta

SEQ ID NO: 7485937 - DNA, 22 bp, Homo sapiens
aggcagctggaggcagagacta

SEQ ID NO: 7485938 - DNA, 22 bp, Homo sapiens
aggcagctgccctctccttcct

SEQ ID NO: 7485939 - DNA, 22 bp, Homo sapiens
aggcagctgccctctccttcct

SEQ ID NO: 7485940 - DNA, 22 bp, Homo sapiens
aggcagctgccctctccttcct

SEQ ID NO: 7485941 - DNA, 22 bp, Homo sapiens
aggcagctgccctctccttcct

SEQ ID NO: 7485942 - DNA, 22 bp, Homo sapiens
aggcagctggaaaactccaggc

SEQ ID NO: 7485943 - DNA, 22 bp, Homo sapiens
aggcagctggaaaactccaggc

SEQ ID NO: 7485944 - DNA, 22 bp, Homo sapiens
aggcagctggaaaactccaggc

SEQ ID NO: 7485945 - DNA, 22 bp, Homo sapiens
aggcagctgaggtctggcgccc

SEQ ID NO: 7485946 - DNA, 22 bp, Homo sapiens
aggcagctgaggtctggcgccc

SEQ ID NO: 7485947 - DNA, 22 bp, Homo sapiens
aggcagctgccctctccttcct

SEQ ID NO: 7485948 - DNA, 22 bp, Homo sapiens
aggcagctgccctctccttcct

SEQ ID NO: 7485949 - DNA, 22 bp, Homo sapiens
aggcagctgccctctccttcct

SEQ ID NO: 7485950 - DNA, 22 bp, Homo sapiens
aggcagctggaaaactccaggc

SEQ ID NO: 7485951 - DNA, 22 bp, Homo sapiens
aggcagctggaaaactccaggc

SEQ ID NO: 7485952 - DNA, 22 bp, Homo sapiens
aggcagctggaaaactccaggc

SEQ ID NO: 7485953 - DNA, 22 bp, Homo sapiens
aggcagctggaaaactccaggc

SEQ ID NO: 7485954 - DNA, 22 bp, Homo sapiens
aggcagctggaaaactccaggc

SEQ ID NO: 7485955 - DNA, 22 bp, Homo sapiens
aggcagctggaaaactccaggc

SEQ ID NO: 7485956 - DNA, 21 bp, Homo sapiens
aggcagctggaaggcctggct

SEQ ID NO: 7485957 - DNA, 21 bp, Homo sapiens
aggcagctggaaggcctggct

SEQ ID NO: 7485958 - DNA, 21 bp, Homo sapiens
aggcagctggaaggcctggct

SEQ ID NO: 7485959 - DNA, 21 bp, Homo sapiens
aggcagctggaaggcctggct

SEQ ID NO: 7485960 - DNA, 21 bp, Homo sapiens
aggcagctggaaggcctggct

SEQ ID NO: 7485961 - DNA, 21 bp, Homo sapiens
aggcagctggaaggcctggct

SEQ ID NO: 7485962 - DNA, 22 bp, Homo sapiens
aggcagctgaggtctggcgccc

SEQ ID NO: 7485963 - DNA, 22 bp, Homo sapiens
aggcagctgaggtctggcgccc

SEQ ID NO: 7485964 - DNA, 22 bp, Homo sapiens
aggcagctgaggtctggcgccc

SEQ ID NO: 7485965 - DNA, 22 bp, Homo sapiens
aggcagctgaggtctggcgccc

SEQ ID NO: 7485966 - DNA, 22 bp, Homo sapiens
aggcagctgaggtctggcgccc

SEQ ID NO: 7485967 - DNA, 22 bp, Homo sapiens
aggcagctgaggtctggcgccc

SEQ ID NO: 7485968 - DNA, 22 bp, Homo sapiens
aggcagctgaccacagtatgat

SEQ ID NO: 7485969 - DNA, 22 bp, Homo sapiens
aggcagctgaccacagtatgat

SEQ ID NO: 7485970 - DNA, 22 bp, Homo sapiens
aggcagctgaccacagtatgat

SEQ ID NO: 7485971 - DNA, 22 bp, Homo sapiens
aggcagctgaccacagtatgat

SEQ ID NO: 7485972 - DNA, 22 bp, Homo sapiens
aggcagctgaccacagtatgat

SEQ ID NO: 7485973 - DNA, 22 bp, Homo sapiens
aggcagctctgtggcctcccag

SEQ ID NO: 7485974 - DNA, 22 bp, Homo sapiens
aggcagctctgtggcctcccag

SEQ ID NO: 7485975 - DNA, 21 bp, Homo sapiens
aggcagctcaggcccagagag

SEQ ID NO: 7485976 - DNA, 21 bp, Homo sapiens
aggcagctcaggcccagagag

SEQ ID NO: 7485977 - DNA, 21 bp, Homo sapiens
aggcagctcaggcccagagag

SEQ ID NO: 7485978 - DNA, 21 bp, Homo sapiens
aggcagctcaggcccagagag

SEQ ID NO: 7485979 - DNA, 22 bp, Homo sapiens
aggcagctctgtggcctcccag

SEQ ID NO: 7485980 - DNA, 22 bp, Homo sapiens
aggcagctctgtggcctcccag

SEQ ID NO: 7485981 - DNA, 22 bp, Homo sapiens
aggcagctctgtggcctcccag

SEQ ID NO: 7485982 - DNA, 22 bp, Homo sapiens
aggcagctctgtggcctcccag

SEQ ID NO: 7485983 - DNA, 22 bp, Homo sapiens
aggcagctctgtggcctcccag

SEQ ID NO: 7485984 - DNA, 21 bp, Homo sapiens
aggcagctcaggcccagagag

SEQ ID NO: 7485985 - DNA, 22 bp, Homo sapiens
acagttcccgtcttgcacagct

SEQ ID NO: 7485986 - DNA, 22 bp, Homo sapiens
acagttcccgtcttgcacagct

SEQ ID NO: 7485987 - DNA, 22 bp, Homo sapiens
acagtttagagcatgatgacca

SEQ ID NO: 7485988 - DNA, 22 bp, Homo sapiens
acagtttagaatgccacatagt

SEQ ID NO: 7485989 - DNA, 22 bp, Homo sapiens
acagtttagaatgccacatagt

SEQ ID NO: 7485990 - DNA, 22 bp, Homo sapiens
acagtttagagcatgatgacca

SEQ ID NO: 7485991 - DNA, 22 bp, Homo sapiens
acagtttagagcatgatgacca

SEQ ID NO: 7485992 - DNA, 22 bp, Homo sapiens
acagtttagagcatgatgacca

SEQ ID NO: 7485993 - DNA, 22 bp, Homo sapiens
aggatggaattaggtagcaagt

SEQ ID NO: 7485994 - DNA, 19 bp, Homo sapiens
aggatggagcaggcggtga

SEQ ID NO: 7485995 - DNA, 19 bp, Homo sapiens
aggatggagcaggcggtga

SEQ ID NO: 7485996 - DNA, 21 bp, Homo sapiens
acagttcatgataactccatc

SEQ ID NO: 7485997 - DNA, 22 bp, Homo sapiens
aggatggattctgtatgtggga

SEQ ID NO: 7485998 - DNA, 22 bp, Homo sapiens
acagtttataaaaataatgagg

SEQ ID NO: 7485999 - DNA, 22 bp, Homo sapiens
acagtttaggatgagagaacac

SEQ ID NO: 7486000 - DNA, 22 bp, Homo sapiens
acagtttaggatgagagaacac

SEQ ID NO: 7486001 - DNA, 22 bp, Homo sapiens
acagtttaggatgagagaacac

SEQ ID NO: 7486002 - DNA, 22 bp, Homo sapiens
acagtttataaaaataatgagg

SEQ ID NO: 7486003 - DNA, 22 bp, Homo sapiens
acagtttataaaaataatgagg

SEQ ID NO: 7486004 - DNA, 22 bp, Homo sapiens
acagtttaggatgagagaacac

SEQ ID NO: 7486005 - DNA, 22 bp, Homo sapiens
acagtttagagcatgatgacca

SEQ ID NO: 7486006 - DNA, 22 bp, Homo sapiens
acagtttaggatgagagaacac

SEQ ID NO: 7486007 - DNA, 22 bp, Homo sapiens
acagtttataaaaataatgagg

SEQ ID NO: 7486008 - DNA, 20 bp, Homo sapiens
acagtttatccagttagcag

SEQ ID NO: 7486009 - DNA, 22 bp, Homo sapiens
acagtttataaaaataatgagg

SEQ ID NO: 7486010 - DNA, 22 bp, Homo sapiens
acagtttataaaaataatgagg

SEQ ID NO: 7486011 - DNA, 22 bp, Homo sapiens
acagtttatcgattcacctacc

SEQ ID NO: 7486012 - DNA, 22 bp, Homo sapiens
acagtttatcgattcacctacc

SEQ ID NO: 7486013 - DNA, 22 bp, Homo sapiens
acagtttatcgattcacctacc

SEQ ID NO: 7486014 - DNA, 20 bp, Homo sapiens
acagtttatccagttagcag

SEQ ID NO: 7486015 - DNA, 20 bp, Homo sapiens
acagtttatccagttagcag

SEQ ID NO: 7486016 - DNA, 20 bp, Homo sapiens
acagtttatccagttagcag

SEQ ID NO: 7486017 - DNA, 22 bp, Homo sapiens
aggatgaggctggcaggtcttg

SEQ ID NO: 7486018 - DNA, 22 bp, Homo sapiens
aggatgaggctggacacttctt

SEQ ID NO: 7486019 - DNA, 22 bp, Homo sapiens
aggatgagccgcgcaagctgac

SEQ ID NO: 7486020 - DNA, 22 bp, Homo sapiens
aggatgaggctggcaggtcttg

SEQ ID NO: 7486021 - DNA, 22 bp, Homo sapiens
aggatgaggctggcaggtcttg

SEQ ID NO: 7486022 - DNA, 20 bp, Homo sapiens
aggatgcagggagtctgcag

SEQ ID NO: 7486023 - DNA, 22 bp, Homo sapiens
aggatgaggctggcaggtcttg

SEQ ID NO: 7486024 - DNA, 21 bp, Homo sapiens
aggatggaaaggactaggggt

SEQ ID NO: 7486025 - DNA, 22 bp, Homo sapiens
aggatggaattaggtagcaagt

SEQ ID NO: 7486026 - DNA, 21 bp, Homo sapiens
aggatggaaaggactaggggt

SEQ ID NO: 7486027 - DNA, 22 bp, Homo sapiens
aggatgccccgtgtcttcctga

SEQ ID NO: 7486028 - DNA, 20 bp, Homo sapiens
aggatgcagggagtctgcag

SEQ ID NO: 7486029 - DNA, 20 bp, Homo sapiens
aggatgcagggagtctgcag

SEQ ID NO: 7486030 - DNA, 22 bp, Homo sapiens
aggatgagattccagggtcaat

SEQ ID NO: 7486031 - DNA, 22 bp, Homo sapiens
aggatgagagatacatggagca

SEQ ID NO: 7486032 - DNA, 22 bp, Homo sapiens
acagtgtgtgggaaatgtgact

SEQ ID NO: 7486033 - DNA, 22 bp, Homo sapiens
acagtgtgttggaggagactgt

SEQ ID NO: 7486034 - DNA, 22 bp, Homo sapiens
acagtgtgtgggaaatgtgact

SEQ ID NO: 7486035 - DNA, 22 bp, Homo sapiens
acagtgtgttctgggacctcca

SEQ ID NO: 7486036 - DNA, 22 bp, Homo sapiens
acagtgtgttggaggagactgt

SEQ ID NO: 7486037 - DNA, 22 bp, Homo sapiens
aggatgagccgcgcaagctgac

SEQ ID NO: 7486038 - DNA, 22 bp, Homo sapiens
aggatgagccgcgcaagctgac

SEQ ID NO: 7486039 - DNA, 22 bp, Homo sapiens
aggatgagattgctgtgttgta

SEQ ID NO: 7486040 - DNA, 22 bp, Homo sapiens
aggatgagattccagggtcaat

SEQ ID NO: 7486041 - DNA, 22 bp, Homo sapiens
aggatgagattgctgtgttgta

SEQ ID NO: 7486042 - DNA, 22 bp, Homo sapiens
aggatgagattccagggtcaat

SEQ ID NO: 7486043 - DNA, 22 bp, Homo sapiens
aggatgagattccagggtcaat

SEQ ID NO: 7486044 - DNA, 22 bp, Homo sapiens
aggcactgcttctaagtaggaa

SEQ ID NO: 7486045 - DNA, 18 bp, Homo sapiens
aggcactggaattaaggg

SEQ ID NO: 7486046 - DNA, 20 bp, Homo sapiens
aggcactggatttcttatat

SEQ ID NO: 7486047 - DNA, 22 bp, Homo sapiens
aggcactgcttctaagtaggaa

SEQ ID NO: 7486048 - DNA, 18 bp, Homo sapiens
aggcactggaattaaggg

SEQ ID NO: 7486049 - DNA, 20 bp, Homo sapiens
aggcactggatttcttatat

SEQ ID NO: 7486050 - DNA, 22 bp, Homo sapiens
aggcactgggaatatgctgagg

SEQ ID NO: 7486051 - DNA, 20 bp, Homo sapiens
aggcactggatttcttatat

SEQ ID NO: 7486052 - DNA, 22 bp, Homo sapiens
aggcactgggaatatgctgagg

SEQ ID NO: 7486053 - DNA, 22 bp, Homo sapiens
aggcactgggaatatgctgagg

SEQ ID NO: 7486054 - DNA, 22 bp, Homo sapiens
aggcactgggaatatgctgagg

SEQ ID NO: 7486055 - DNA, 22 bp, Homo sapiens
aggcactgggaatatgctgagg

SEQ ID NO: 7486056 - DNA, 20 bp, Homo sapiens
aggcactggggataggtaag

SEQ ID NO: 7486057 - DNA, 22 bp, Homo sapiens
aggcactgggaatatgctgagg

SEQ ID NO: 7486058 - DNA, 22 bp, Homo sapiens
aggcactgggaatatgctgagg

SEQ ID NO: 7486059 - DNA, 22 bp, Homo sapiens
aggcactgggaatatgctgagg

SEQ ID NO: 7486060 - DNA, 20 bp, Homo sapiens
aggcactggggataggtaag

SEQ ID NO: 7486061 - DNA, 22 bp, Homo sapiens
aggcactgggggatgagcaagg

SEQ ID NO: 7486062 - DNA, 22 bp, Homo sapiens
aggcactgggggatgagcaagg

SEQ ID NO: 7486063 - DNA, 22 bp, Homo sapiens
aggcactgggggatgagcaagg

SEQ ID NO: 7486064 - DNA, 22 bp, Homo sapiens
aggcactgggggatgagcaagg

SEQ ID NO: 7486065 - DNA, 22 bp, Homo sapiens
aggcactgggggatgagcaagg

SEQ ID NO: 7486066 - DNA, 22 bp, Homo sapiens
aggcactgggggatgagcaagg

SEQ ID NO: 7486067 - DNA, 22 bp, Homo sapiens
aggcactgggtaattagtagct

SEQ ID NO: 7486068 - DNA, 22 bp, Homo sapiens
aggcactgggtaattagtagct

SEQ ID NO: 7486069 - DNA, 21 bp, Homo sapiens
acatacattatctttttaaaa

SEQ ID NO: 7486070 - DNA, 22 bp, Homo sapiens
aggcactgggtaattagtagct

SEQ ID NO: 7486071 - DNA, 22 bp, Homo sapiens
aggcactgggtaattagtagct

SEQ ID NO: 7486072 - DNA, 21 bp, Homo sapiens
acagtttattagagtaagtgc

SEQ ID NO: 7486073 - DNA, 22 bp, Homo sapiens
acagtttatggtgttttatata

SEQ ID NO: 7486074 - DNA, 22 bp, Homo sapiens
acagtttatgtaaagctgccaa

SEQ ID NO: 7486075 - DNA, 22 bp, Homo sapiens
acagtttatgtaaagctgccaa

SEQ ID NO: 7486076 - DNA, 22 bp, Homo sapiens
acagtttattgcacaggtaacc

SEQ ID NO: 7486077 - DNA, 21 bp, Homo sapiens
acagtttattagagtaagtgc

SEQ ID NO: 7486078 - DNA, 21 bp, Homo sapiens
acagtttattagagtaagtgc

SEQ ID NO: 7486079 - DNA, 21 bp, Homo sapiens
acagtttattagagtaagtgc

SEQ ID NO: 7486080 - DNA, 21 bp, Homo sapiens
acagtttattagagtaagtgc

SEQ ID NO: 7486081 - DNA, 22 bp, Homo sapiens
acagtttatgcctctgagcctg

SEQ ID NO: 7486082 - DNA, 22 bp, Homo sapiens
acagtttatgcctctgagcctg

SEQ ID NO: 7486083 - DNA, 22 bp, Homo sapiens
acagtttatcgattcacctacc

SEQ ID NO: 7486084 - DNA, 22 bp, Homo sapiens
acagtttatcgattcacctacc

SEQ ID NO: 7486085 - DNA, 22 bp, Homo sapiens
acagtttatcgattcacctacc

SEQ ID NO: 7486086 - DNA, 22 bp, Homo sapiens
acagtttatggtgttttatata

SEQ ID NO: 7486087 - DNA, 22 bp, Homo sapiens
acagtttatggtgttttatata

SEQ ID NO: 7486088 - DNA, 22 bp, Homo sapiens
acagtttatggtgttttatata

SEQ ID NO: 7486089 - DNA, 22 bp, Homo sapiens
acagtttatggtgttttatata

SEQ ID NO: 7486090 - DNA, 17 bp, Homo sapiens
acagtttgattttagca

SEQ ID NO: 7486091 - DNA, 22 bp, Homo sapiens
acagtttgcactgttcatcaaa

SEQ ID NO: 7486092 - DNA, 22 bp, Homo sapiens
acagtttgcactgttcatcaaa

SEQ ID NO: 7486093 - DNA, 22 bp, Homo sapiens
aggcactgcttctaagtaggaa

SEQ ID NO: 7486094 - DNA, 22 bp, Homo sapiens
acagtttgagaaccactagcct

SEQ ID NO: 7486095 - DNA, 22 bp, Homo sapiens
acagtttgaataatttagatag

SEQ ID NO: 7486096 - DNA, 22 bp, Homo sapiens
acagtttgaataatttagatag

SEQ ID NO: 7486097 - DNA, 20 bp, Homo sapiens
acagtttattttacttggtt

SEQ ID NO: 7486098 - DNA, 22 bp, Homo sapiens
acagtttattgcacaggtaacc

SEQ ID NO: 7486099 - DNA, 22 bp, Homo sapiens
acagtttattgcacaggtaacc

SEQ ID NO: 7486100 - DNA, 22 bp, Homo sapiens
acagtttattgcacaggtaacc

SEQ ID NO: 7486101 - DNA, 22 bp, Homo sapiens
acagtttgaagtttagaagtct

SEQ ID NO: 7486102 - DNA, 22 bp, Homo sapiens
acagtttctccatttacacctt

SEQ ID NO: 7486103 - DNA, 22 bp, Homo sapiens
acagtttccccctagggcagca

SEQ ID NO: 7486104 - DNA, 20 bp, Homo sapiens
acagtttattttacttggtt

SEQ ID NO: 7486105 - DNA, 20 bp, Homo sapiens
acagtttattttacttggtt

SEQ ID NO: 7486106 - DNA, 22 bp, Homo sapiens
acagtttctccatttacacctt

SEQ ID NO: 7486107 - DNA, 22 bp, Homo sapiens
acagtttctccatttacacctt

SEQ ID NO: 7486108 - DNA, 22 bp, Homo sapiens
aggagcagaactgattctgact

SEQ ID NO: 7486109 - DNA, 22 bp, Homo sapiens
aggagcagaactgattctgact

SEQ ID NO: 7486110 - DNA, 22 bp, Homo sapiens
aggagcagaactgattctgact

SEQ ID NO: 7486111 - DNA, 22 bp, Homo sapiens
aggagcagaactgattctgact

SEQ ID NO: 7486112 - DNA, 22 bp, Homo sapiens
aggagcagaactgattctgact

SEQ ID NO: 7486113 - DNA, 22 bp, Homo sapiens
aggagcagaactgttgtggagg

SEQ ID NO: 7486114 - DNA, 22 bp, Homo sapiens
aggagcagaactgttgtggagg

SEQ ID NO: 7486115 - DNA, 22 bp, Homo sapiens
aggagcagaactgttgtggagg

SEQ ID NO: 7486116 - DNA, 22 bp, Homo sapiens
aggagcagaactgttgtggagg

SEQ ID NO: 7486117 - DNA, 22 bp, Homo sapiens
aggagcagaactgttgtggagg

SEQ ID NO: 7486118 - DNA, 22 bp, Homo sapiens
aggagcagaactgttgtggagg

SEQ ID NO: 7486119 - DNA, 22 bp, Homo sapiens
aggagcagaactgttgtggagg

SEQ ID NO: 7486120 - DNA, 22 bp, Homo sapiens
aggagcactgagccagcatggg

SEQ ID NO: 7486121 - DNA, 22 bp, Homo sapiens
aggagcactgagccagcatggg

SEQ ID NO: 7486122 - DNA, 22 bp, Homo sapiens
aggagcactaattcctgcagag

SEQ ID NO: 7486123 - DNA, 19 bp, Homo sapiens
aggagcactgccagcacca

SEQ ID NO: 7486124 - DNA, 22 bp, Homo sapiens
aggagcagaactgattctgact

SEQ ID NO: 7486125 - DNA, 22 bp, Homo sapiens
aggagcagaactgattctgact

SEQ ID NO: 7486126 - DNA, 22 bp, Homo sapiens
aggagcagaactgattctgact

SEQ ID NO: 7486127 - DNA, 22 bp, Homo sapiens
aggagcagaactgattctgact

SEQ ID NO: 7486128 - DNA, 22 bp, Homo sapiens
aggagcagaactgattctgact

SEQ ID NO: 7486129 - DNA, 22 bp, Homo sapiens
acagtaaatcaacagaatatct

SEQ ID NO: 7486130 - DNA, 22 bp, Homo sapiens
acagtaaatcaacagaatatct

SEQ ID NO: 7486131 - DNA, 22 bp, Homo sapiens
acagtaaatcaacagaatatct

SEQ ID NO: 7486132 - DNA, 22 bp, Homo sapiens
acagtaaatcaacagaatatct

SEQ ID NO: 7486133 - DNA, 22 bp, Homo sapiens
acagtaaatcaacagaatatct

SEQ ID NO: 7486134 - DNA, 22 bp, Homo sapiens
acagtaaatcaacagaatatct

SEQ ID NO: 7486135 - DNA, 22 bp, Homo sapiens
aggagatggagctcagtgggca

SEQ ID NO: 7486136 - DNA, 22 bp, Homo sapiens
aggagattggctgaaaaatatt

SEQ ID NO: 7486137 - DNA, 22 bp, Homo sapiens
aggagcaaatgatgagacagca

SEQ ID NO: 7486138 - DNA, 22 bp, Homo sapiens
aggagcaaatgatgagacagca

SEQ ID NO: 7486139 - DNA, 22 bp, Homo sapiens
aggagcaaatgatgagacagca

SEQ ID NO: 7486140 - DNA, 22 bp, Homo sapiens
aggagcaaatgatgagacagca

SEQ ID NO: 7486141 - DNA, 22 bp, Homo sapiens
aggagcaaatgatgagacagca

SEQ ID NO: 7486142 - DNA, 22 bp, Homo sapiens
aggagcaaggaagctacagttt

SEQ ID NO: 7486143 - DNA, 22 bp, Homo sapiens
aggagcaaatgatgagacagca

SEQ ID NO: 7486144 - DNA, 22 bp, Homo sapiens
aggagcaaatgatgagacagca

SEQ ID NO: 7486145 - DNA, 22 bp, Homo sapiens
aggagcaaatgatgagacagca

SEQ ID NO: 7486146 - DNA, 22 bp, Homo sapiens
aggagcagaatttaatgtgcag

SEQ ID NO: 7486147 - DNA, 22 bp, Homo sapiens
aggagcagaatttaatgtgcag

SEQ ID NO: 7486148 - DNA, 22 bp, Homo sapiens
aggagcagaatttaatgtgcag

SEQ ID NO: 7486149 - DNA, 22 bp, Homo sapiens
aggagcagaatttaatgtgcag

SEQ ID NO: 7486150 - DNA, 22 bp, Homo sapiens
aggagcagaatttaatgtgcag

SEQ ID NO: 7486151 - DNA, 22 bp, Homo sapiens
aggagcagaatttaatgtgcag

SEQ ID NO: 7486152 - DNA, 22 bp, Homo sapiens
aggagcagaatttaatgtgcag

SEQ ID NO: 7486153 - DNA, 22 bp, Homo sapiens
aggagcagaatttaatgtgcag

SEQ ID NO: 7486154 - DNA, 22 bp, Homo sapiens
aggagcagaccgtagtcctgca

SEQ ID NO: 7486155 - DNA, 22 bp, Homo sapiens
aggagcagaccgtagtcctgca

SEQ ID NO: 7486156 - DNA, 22 bp, Homo sapiens
aggagcagaccgtagtcctgca

SEQ ID NO: 7486157 - DNA, 22 bp, Homo sapiens
acagtacagctaatgtcattag

SEQ ID NO: 7486158 - DNA, 22 bp, Homo sapiens
acagtacaccactgtgtacagt

SEQ ID NO: 7486159 - DNA, 22 bp, Homo sapiens
acagtacaccactgtgtacagt

SEQ ID NO: 7486160 - DNA, 22 bp, Homo sapiens
acagtacaccactgtgtacagt

SEQ ID NO: 7486161 - DNA, 22 bp, Homo sapiens
acagtacaccactgtgtacagt

SEQ ID NO: 7486162 - DNA, 22 bp, Homo sapiens
aggagcagaccgtagtcctgca

SEQ ID NO: 7486163 - DNA, 22 bp, Homo sapiens
aggagcagaccgtagtcctgca

SEQ ID NO: 7486164 - DNA, 22 bp, Homo sapiens
aggagcagaccgtagtcctgca

SEQ ID NO: 7486165 - DNA, 22 bp, Homo sapiens
aggagcagaccgtagtcctgca

SEQ ID NO: 7486166 - DNA, 22 bp, Homo sapiens
aggagcagaccgtagtcctgca

SEQ ID NO: 7486167 - DNA, 22 bp, Homo sapiens
acagtatatatggttatctgat

SEQ ID NO: 7486168 - DNA, 21 bp, Homo sapiens
acagtatattagatatttgaa

SEQ ID NO: 7486169 - DNA, 22 bp, Homo sapiens
acagtatatatggttatctgat

SEQ ID NO: 7486170 - DNA, 22 bp, Homo sapiens
acagtatatatagtctaaaagc

SEQ ID NO: 7486171 - DNA, 22 bp, Homo sapiens
acagtatatatggttatctgat

SEQ ID NO: 7486172 - DNA, 22 bp, Homo sapiens
acagtatattttcttgattgtt

SEQ ID NO: 7486173 - DNA, 21 bp, Homo sapiens
acagtatattagatatttgaa

SEQ ID NO: 7486174 - DNA, 22 bp, Homo sapiens
acagtatgaatgcagaatgtag

SEQ ID NO: 7486175 - DNA, 22 bp, Homo sapiens
acagtatattttcttgattgtt

SEQ ID NO: 7486176 - DNA, 22 bp, Homo sapiens
acagtatgaatgtctgaaaaat

SEQ ID NO: 7486177 - DNA, 22 bp, Homo sapiens
acagtatgaatgcagaatgtag

SEQ ID NO: 7486178 - DNA, 22 bp, Homo sapiens
acagtatgaatgcagaatgtag

SEQ ID NO: 7486179 - DNA, 22 bp, Homo sapiens
acagtatatatagtctaaaagc

SEQ ID NO: 7486180 - DNA, 22 bp, Homo sapiens
acagtatatatagtctaaaagc

SEQ ID NO: 7486181 - DNA, 22 bp, Homo sapiens
acagtatagggcttatattgta

SEQ ID NO: 7486182 - DNA, 22 bp, Homo sapiens
acagtacagctaatgtcattag

SEQ ID NO: 7486183 - DNA, 22 bp, Homo sapiens
acagtacagctaatgtcattag

SEQ ID NO: 7486184 - DNA, 22 bp, Homo sapiens
acagtacagctaatgtcattag

SEQ ID NO: 7486185 - DNA, 22 bp, Homo sapiens
acagtacagctaatgtcattag

SEQ ID NO: 7486186 - DNA, 22 bp, Homo sapiens
acagtatagggcttatattgta

SEQ ID NO: 7486187 - DNA, 22 bp, Homo sapiens
acagtatatatagtctaaaagc

SEQ ID NO: 7486188 - DNA, 22 bp, Homo sapiens
acagtatatatagtctaaaagc

SEQ ID NO: 7486189 - DNA, 22 bp, Homo sapiens
aggacacagacttagatttaaa

SEQ ID NO: 7486190 - DNA, 22 bp, Homo sapiens
aggacacagactgattgcagca

SEQ ID NO: 7486191 - DNA, 22 bp, Homo sapiens
aggacacagactgattgcagca

SEQ ID NO: 7486192 - DNA, 22 bp, Homo sapiens
aggacacacttctgaggtcttt

SEQ ID NO: 7486193 - DNA, 21 bp, Homo sapiens
aggacacagagacacctattg

SEQ ID NO: 7486194 - DNA, 21 bp, Homo sapiens
aggacacagagacacctattg

SEQ ID NO: 7486195 - DNA, 22 bp, Homo sapiens
aggacacagctcttcagtaaga

SEQ ID NO: 7486196 - DNA, 22 bp, Homo sapiens
aggacacagctcttcagtaaga

SEQ ID NO: 7486197 - DNA, 22 bp, Homo sapiens
aggacacagctgctctgcagag

SEQ ID NO: 7486198 - DNA, 22 bp, Homo sapiens
aggacacagctcttcagtaaga

SEQ ID NO: 7486199 - DNA, 22 bp, Homo sapiens
aggacacaggcaggaggagatc

SEQ ID NO: 7486200 - DNA, 22 bp, Homo sapiens
acaggtttgctgctgttttagg

SEQ ID NO: 7486201 - DNA, 22 bp, Homo sapiens
acaggtttgcagcttgttacct

SEQ ID NO: 7486202 - DNA, 22 bp, Homo sapiens
acaggtttagctcttagtagtc

SEQ ID NO: 7486203 - DNA, 20 bp, Homo sapiens
acaggttcattctgtgtgac

SEQ ID NO: 7486204 - DNA, 20 bp, Homo sapiens
acaggttcattctgtgtgac

SEQ ID NO: 7486205 - DNA, 22 bp, Homo sapiens
acaggtgttgactcacaggccc

SEQ ID NO: 7486206 - DNA, 22 bp, Homo sapiens
acaggtgttgactcacaggccc

SEQ ID NO: 7486207 - DNA, 22 bp, Homo sapiens
acaggtgttgaatgatgtcaca

SEQ ID NO: 7486208 - DNA, 22 bp, Homo sapiens
acaggtgttgaatgatgtcaca

SEQ ID NO: 7486209 - DNA, 22 bp, Homo sapiens
acaggtgtaatttgcccgaggt

SEQ ID NO: 7486210 - DNA, 22 bp, Homo sapiens
acaggtgtaatttgcccgaggt

SEQ ID NO: 7486211 - DNA, 22 bp, Homo sapiens
acagtaaaacatttttattagg

SEQ ID NO: 7486212 - DNA, 22 bp, Homo sapiens
acagtaaaacatttttattagg

SEQ ID NO: 7486213 - DNA, 22 bp, Homo sapiens
acagtaaaacatttttattagg

SEQ ID NO: 7486214 - DNA, 22 bp, Homo sapiens
acagtaaaacatttttattagg

SEQ ID NO: 7486215 - DNA, 22 bp, Homo sapiens
acagtaaacaatgcagcaaatt

SEQ ID NO: 7486216 - DNA, 22 bp, Homo sapiens
acagtaaacaatgcagcaaatt

SEQ ID NO: 7486217 - DNA, 22 bp, Homo sapiens
acagtaaaattaagggcagtta

SEQ ID NO: 7486218 - DNA, 22 bp, Homo sapiens
acagtaaacaatgcagcaaatt

SEQ ID NO: 7486219 - DNA, 22 bp, Homo sapiens
acagtaaacaatgcagcaaatt

SEQ ID NO: 7486220 - DNA, 22 bp, Homo sapiens
acagtaaaaagccttagaattt

SEQ ID NO: 7486221 - DNA, 22 bp, Homo sapiens
acagtaaaaagccttagaattt

SEQ ID NO: 7486222 - DNA, 22 bp, Homo sapiens
acagtaaaaagccttagaattt

SEQ ID NO: 7486223 - DNA, 22 bp, Homo sapiens
acagtaaaaagccttagaattt

SEQ ID NO: 7486224 - DNA, 22 bp, Homo sapiens
acaggtttttggataatccttt

SEQ ID NO: 7486225 - DNA, 22 bp, Homo sapiens
acaggtttttgtggatatatgt

SEQ ID NO: 7486226 - DNA, 22 bp, Homo sapiens
acaggtttttgtggatatatgt

SEQ ID NO: 7486227 - DNA, 22 bp, Homo sapiens
acaggttttggactccagattt

SEQ ID NO: 7486228 - DNA, 22 bp, Homo sapiens
acaggttttggactccagattt

SEQ ID NO: 7486229 - DNA, 22 bp, Homo sapiens
acaggtttgtctgatgtaatga

SEQ ID NO: 7486230 - DNA, 22 bp, Homo sapiens
acagtaaacaatgcagcaaatt

SEQ ID NO: 7486231 - DNA, 22 bp, Homo sapiens
acagtaaacaatgcagcaaatt

SEQ ID NO: 7486232 - DNA, 22 bp, Homo sapiens
acagtaaacaatgcagcaaatt

SEQ ID NO: 7486233 - DNA, 18 bp, Homo sapiens
acagtaaagaaaggaatt

SEQ ID NO: 7486234 - DNA, 18 bp, Homo sapiens
acagtaaagaaaggaatt

SEQ ID NO: 7486235 - DNA, 18 bp, Homo sapiens
acagtaaagaaaggaatt

SEQ ID NO: 7486236 - DNA, 22 bp, Homo sapiens
acagtaaagccttctggttgac

SEQ ID NO: 7486237 - DNA, 18 bp, Homo sapiens
acagtaaagaaaggaatt

SEQ ID NO: 7486238 - DNA, 18 bp, Homo sapiens
acagtaaagaaaggaatt

SEQ ID NO: 7486239 - DNA, 22 bp, Homo sapiens
acagtaaataatgcatgttgat

SEQ ID NO: 7486240 - DNA, 16 bp, Homo sapiens
acagtaaagctggaca

SEQ ID NO: 7486241 - DNA, 22 bp, Homo sapiens
acagtaaagccttctggttgac

SEQ ID NO: 7486242 - DNA, 16 bp, Homo sapiens
acagtaaagctggaca

SEQ ID NO: 7486243 - DNA, 22 bp, Homo sapiens
acagtaaatcaacagaatatct

SEQ ID NO: 7486244 - DNA, 22 bp, Homo sapiens
acagtaaatcaacagaatatct

SEQ ID NO: 7486245 - DNA, 22 bp, Homo sapiens
acagtaaatattaagcctgagt

SEQ ID NO: 7486246 - DNA, 22 bp, Homo sapiens
acagtaaataatgcatgttgat

SEQ ID NO: 7486247 - DNA, 20 bp, Homo sapiens
acagtgggtggggagcactg

SEQ ID NO: 7486248 - DNA, 22 bp, Homo sapiens
acagtggggtcttaatagaaca

SEQ ID NO: 7486249 - DNA, 22 bp, Homo sapiens
acagtggggtcttaatagaaca

SEQ ID NO: 7486250 - DNA, 22 bp, Homo sapiens
acagtgggatgaggctggcccc

SEQ ID NO: 7486251 - DNA, 22 bp, Homo sapiens
acagtgggatgaggctggcccc

SEQ ID NO: 7486252 - DNA, 20 bp, Homo sapiens
acagtgggtggggagcactg

SEQ ID NO: 7486253 - DNA, 20 bp, Homo sapiens
acagtgggtggggagcactg

SEQ ID NO: 7486254 - DNA, 20 bp, Homo sapiens
acagtgggtggggagcactg

SEQ ID NO: 7486255 - DNA, 22 bp, Homo sapiens
acagtgtctcactgctgaaatc

SEQ ID NO: 7486256 - DNA, 22 bp, Homo sapiens
acagtgtctcctggtacccagt

SEQ ID NO: 7486257 - DNA, 23 bp, Homo sapiens
acagtgtctgctgcaagatatct

SEQ ID NO: 7486258 - DNA, 22 bp, Homo sapiens
acagtgtctgacacgtaggaag

SEQ ID NO: 7486259 - DNA, 23 bp, Homo sapiens
acagtgtctgctgcaagatatct

SEQ ID NO: 7486260 - DNA, 23 bp, Homo sapiens
acagtgtctgctgcaagatatct

SEQ ID NO: 7486261 - DNA, 23 bp, Homo sapiens
acagtgtctgctgcaagatatct

SEQ ID NO: 7486262 - DNA, 22 bp, Homo sapiens
acagtgtctcctggtacccagt

SEQ ID NO: 7486263 - DNA, 22 bp, Homo sapiens
acagtgtctgacacattgtagc

SEQ ID NO: 7486264 - DNA, 22 bp, Homo sapiens
acagtgtctgacacattgtagc

SEQ ID NO: 7486265 - DNA, 22 bp, Homo sapiens
acagtgtctgacacgtaggaag

SEQ ID NO: 7486266 - DNA, 22 bp, Homo sapiens
acagtgtctgacacgtaggaag

SEQ ID NO: 7486267 - DNA, 22 bp, Homo sapiens
acagtgggatgaggctggcccc

SEQ ID NO: 7486268 - DNA, 22 bp, Homo sapiens
acagtgggacagtgacggggga

SEQ ID NO: 7486269 - DNA, 22 bp, Homo sapiens
acagtctggaagcagggggcaa

SEQ ID NO: 7486270 - DNA, 22 bp, Homo sapiens
acagtctggaagcagggggcaa

SEQ ID NO: 7486271 - DNA, 22 bp, Homo sapiens
acagtctgcttgtctccatggt

SEQ ID NO: 7486272 - DNA, 22 bp, Homo sapiens
acagtctgcctctcagagcagc

SEQ ID NO: 7486273 - DNA, 22 bp, Homo sapiens
acagtctgcctctcagagcagc

SEQ ID NO: 7486274 - DNA, 22 bp, Homo sapiens
acagtctgcttgtctccatggt

SEQ ID NO: 7486275 - DNA, 17 bp, Homo sapiens
acagtctgcctgacagt

SEQ ID NO: 7486276 - DNA, 17 bp, Homo sapiens
acagtctgcctgacagt

SEQ ID NO: 7486277 - DNA, 22 bp, Homo sapiens
acagtctgcagggtgaacatgt

SEQ ID NO: 7486278 - DNA, 22 bp, Homo sapiens
acagtctgcagggtgaacatgt

SEQ ID NO: 7486279 - DNA, 22 bp, Homo sapiens
acagtctgcctctcagagcagc

SEQ ID NO: 7486280 - DNA, 22 bp, Homo sapiens
acagtctgcctctcagagcagc

SEQ ID NO: 7486281 - DNA, 22 bp, Homo sapiens
acagtctgcatatgacctgtag

SEQ ID NO: 7486282 - DNA, 22 bp, Homo sapiens
acagtctgcagggtgaacatgt

SEQ ID NO: 7486283 - DNA, 22 bp, Homo sapiens
acagtctgcagggtgaacatgt

SEQ ID NO: 7486284 - DNA, 22 bp, Homo sapiens
acagtctgcaggcaagttctac

SEQ ID NO: 7486285 - DNA, 22 bp, Homo sapiens
acagtctgcaggcaagttctac

SEQ ID NO: 7486286 - DNA, 22 bp, Homo sapiens
acagtctcttggaattttcaga

SEQ ID NO: 7486287 - DNA, 22 bp, Homo sapiens
acagtctcttggaattttcaga

SEQ ID NO: 7486288 - DNA, 22 bp, Homo sapiens
acagtctgagaattactgctct

SEQ ID NO: 7486289 - DNA, 22 bp, Homo sapiens
acagtgtggtttgagcactggg

SEQ ID NO: 7486290 - DNA, 22 bp, Homo sapiens
acagtgtggttgtttctggtta

SEQ ID NO: 7486291 - DNA, 22 bp, Homo sapiens
acagtgtggtttgagcactggg

SEQ ID NO: 7486292 - DNA, 22 bp, Homo sapiens
acagtgtggtttgagcactggg

SEQ ID NO: 7486293 - DNA, 23 bp, Homo sapiens
acagtgtggtggacaaggagcag

SEQ ID NO: 7486294 - DNA, 22 bp, Homo sapiens
acagtgtggtgatggcacttgc

SEQ ID NO: 7486295 - DNA, 23 bp, Homo sapiens
acagtgtggtggacaaggagcag

SEQ ID NO: 7486296 - DNA, 23 bp, Homo sapiens
acagtgtggtggacaaggagcag

SEQ ID NO: 7486297 - DNA, 22 bp, Homo sapiens
acagtgtggttgtttctggtta

SEQ ID NO: 7486298 - DNA, 22 bp, Homo sapiens
acagtgtgtcctaaaggtctgg

SEQ ID NO: 7486299 - DNA, 22 bp, Homo sapiens
acagtgtgtgctttcccttacg

SEQ ID NO: 7486300 - DNA, 22 bp, Homo sapiens
acagtgtgtgggaaatgtgact

SEQ ID NO: 7486301 - DNA, 22 bp, Homo sapiens
acagtgtgtgctttcccttacg

SEQ ID NO: 7486302 - DNA, 22 bp, Homo sapiens
acagtgtggtttgagcactggg

SEQ ID NO: 7486303 - DNA, 22 bp, Homo sapiens
acagtgtggtttgagcactggg

SEQ ID NO: 7486304 - DNA, 22 bp, Homo sapiens
acagtgtggggtgagatggaac

SEQ ID NO: 7486305 - DNA, 22 bp, Homo sapiens
acagtgtggggtgagatggaac

SEQ ID NO: 7486306 - DNA, 22 bp, Homo sapiens
acagtgtgggacattaggaaat

SEQ ID NO: 7486307 - DNA, 21 bp, Homo sapiens
acagtgtgcttctctccctcc

SEQ ID NO: 7486308 - DNA, 22 bp, Homo sapiens
acagtgtggaaagtcaacttga

SEQ ID NO: 7486309 - DNA, 22 bp, Homo sapiens
acagtgtggggtgagatggaac

SEQ ID NO: 7486310 - DNA, 22 bp, Homo sapiens
acagtgtggggtgagatggaac

SEQ ID NO: 7486311 - DNA, 22 bp, Homo sapiens
acagtgtgggacattaggaaat

SEQ ID NO: 7486312 - DNA, 22 bp, Homo sapiens
acagtgtggggtgagatggaac

SEQ ID NO: 7486313 - DNA, 19 bp, Homo sapiens
acagtgtctgtatataaat

SEQ ID NO: 7486314 - DNA, 19 bp, Homo sapiens
acagtgtctgtatataaat

SEQ ID NO: 7486315 - DNA, 19 bp, Homo sapiens
acagtgtctgtatataaat

SEQ ID NO: 7486316 - DNA, 22 bp, Homo sapiens
acagtgtgacaattgtgtcaga

SEQ ID NO: 7486317 - DNA, 16 bp, Homo sapiens
acagtgtgctaagcat

SEQ ID NO: 7486318 - DNA, 22 bp, Homo sapiens
acagtgtgcaagaaatggggga

SEQ ID NO: 7486319 - DNA, 22 bp, Homo sapiens
acagtgtgcaagaaatggggga

SEQ ID NO: 7486320 - DNA, 22 bp, Homo sapiens
acagtgtgatgggcctgcctga

SEQ ID NO: 7486321 - DNA, 22 bp, Homo sapiens
acagtgtgacaattgtgtcaga

SEQ ID NO: 7486322 - DNA, 22 bp, Homo sapiens
acagtcaatgagtgagtgaatg

SEQ ID NO: 7486323 - DNA, 22 bp, Homo sapiens
acagtcaatcagaacagcatgt

SEQ ID NO: 7486324 - DNA, 21 bp, Homo sapiens
acagtcacaaaaccaaggcag

SEQ ID NO: 7486325 - DNA, 22 bp, Homo sapiens
acagtcaatgagtgagtgaatg

SEQ ID NO: 7486326 - DNA, 22 bp, Homo sapiens
acagtcaatcagaacagcatgt

SEQ ID NO: 7486327 - DNA, 22 bp, Homo sapiens
acagtcaatgagtgagtgaatg

SEQ ID NO: 7486328 - DNA, 22 bp, Homo sapiens
acagtcaggccgagatgggcct

SEQ ID NO: 7486329 - DNA, 22 bp, Homo sapiens
acagtcaggaatttgtaaaacg

SEQ ID NO: 7486330 - DNA, 21 bp, Homo sapiens
acagtcacaaaaccaaggcag

SEQ ID NO: 7486331 - DNA, 22 bp, Homo sapiens
acagtcagacagttaataacct

SEQ ID NO: 7486332 - DNA, 22 bp, Homo sapiens
acagtatttgcgatactgatga

SEQ ID NO: 7486333 - DNA, 22 bp, Homo sapiens
acagtcaatcagaacagcatgt

SEQ ID NO: 7486334 - DNA, 22 bp, Homo sapiens
acagtcaatcagaacagcatgt

SEQ ID NO: 7486335 - DNA, 22 bp, Homo sapiens
acagtcaagaaatggcagagcc

SEQ ID NO: 7486336 - DNA, 22 bp, Homo sapiens
acagtcaatcagaacagcatgt

SEQ ID NO: 7486337 - DNA, 22 bp, Homo sapiens
acagtcatagcagcctttgtta

SEQ ID NO: 7486338 - DNA, 22 bp, Homo sapiens
acagtcattagatacaatgtct

SEQ ID NO: 7486339 - DNA, 22 bp, Homo sapiens
acagtcattagatacaatgtct

SEQ ID NO: 7486340 - DNA, 22 bp, Homo sapiens
acagtcattagatacaatgtct

SEQ ID NO: 7486341 - DNA, 22 bp, Homo sapiens
acagtccagcctagtatgtata

SEQ ID NO: 7486342 - DNA, 22 bp, Homo sapiens
acagtccagcctagtatgtata

SEQ ID NO: 7486343 - DNA, 22 bp, Homo sapiens
acagtccagcctagtatgtata

SEQ ID NO: 7486344 - DNA, 22 bp, Homo sapiens
acagtcctaagataattgtctc

SEQ ID NO: 7486345 - DNA, 22 bp, Homo sapiens
acagtccccataccacctgtcc

SEQ ID NO: 7486346 - DNA, 19 bp, Homo sapiens
acagtccagctgtttgtac

SEQ ID NO: 7486347 - DNA, 19 bp, Homo sapiens
acagtccagctgtttgtac

SEQ ID NO: 7486348 - DNA, 19 bp, Homo sapiens
acagtccagctgtttgtac

SEQ ID NO: 7486349 - DNA, 22 bp, Homo sapiens
acagtccagcctagtatgtata

SEQ ID NO: 7486350 - DNA, 22 bp, Homo sapiens
acagtccagcctagtatgtata

SEQ ID NO: 7486351 - DNA, 22 bp, Homo sapiens
acagtcagtatcccaggcaaat

SEQ ID NO: 7486352 - DNA, 22 bp, Homo sapiens
acagtcatagcagcctttgtta

SEQ ID NO: 7486353 - DNA, 19 bp, Homo sapiens
acagtcagggaataaagac

SEQ ID NO: 7486354 - DNA, 19 bp, Homo sapiens
acagtcagggaataaagac

SEQ ID NO: 7486355 - DNA, 22 bp, Homo sapiens
acagtcagggcttactcaggga

SEQ ID NO: 7486356 - DNA, 22 bp, Homo sapiens
acagtcagggcttactcaggga

SEQ ID NO: 7486357 - DNA, 20 bp, Homo sapiens
acagtcagggaatagaaaaa

SEQ ID NO: 7486358 - DNA, 22 bp, Homo sapiens
acagtctctgttgctgctgttt

SEQ ID NO: 7486359 - DNA, 22 bp, Homo sapiens
acagtctctccacactgcaggg

SEQ ID NO: 7486360 - DNA, 21 bp, Homo sapiens
acagtctccccagatctctcc

SEQ ID NO: 7486361 - DNA, 22 bp, Homo sapiens
acagtctctccacactgcaggg

SEQ ID NO: 7486362 - DNA, 22 bp, Homo sapiens
acagtctctccacactgcaggg

SEQ ID NO: 7486363 - DNA, 22 bp, Homo sapiens
acagtctcttgcttgaatacta

SEQ ID NO: 7486364 - DNA, 22 bp, Homo sapiens
acagtctcttggaattttcaga

SEQ ID NO: 7486365 - DNA, 22 bp, Homo sapiens
acagtctcttggaattttcaga

SEQ ID NO: 7486366 - DNA, 22 bp, Homo sapiens
acagtctctgttgctgctgttt

SEQ ID NO: 7486367 - DNA, 22 bp, Homo sapiens
acagtctcttgcttgaatacta

SEQ ID NO: 7486368 - DNA, 22 bp, Homo sapiens
acagtctacttgagcttgtata

SEQ ID NO: 7486369 - DNA, 22 bp, Homo sapiens
acagtctaggcctaggtcaaaa

SEQ ID NO: 7486370 - DNA, 22 bp, Homo sapiens
acagtctaggcctaggtcaaaa

SEQ ID NO: 7486371 - DNA, 22 bp, Homo sapiens
acagtctaggcctaggtcaaaa

SEQ ID NO: 7486372 - DNA, 22 bp, Homo sapiens
acagtctacttgagcttgtata

SEQ ID NO: 7486373 - DNA, 21 bp, Homo sapiens
acagtctccccagatctctcc

SEQ ID NO: 7486374 - DNA, 22 bp, Homo sapiens
acagtctcaagatggcctctct

SEQ ID NO: 7486375 - DNA, 20 bp, Homo sapiens
acagtcctgcactggtgttt

SEQ ID NO: 7486376 - DNA, 22 bp, Homo sapiens
acagtcctgtacaggccatatc

SEQ ID NO: 7486377 - DNA, 22 bp, Homo sapiens
acagtcctagctgcaaagaagt

SEQ ID NO: 7486378 - DNA, 22 bp, Homo sapiens
acagtcctagctgcaaagaagt

SEQ ID NO: 7486379 - DNA, 22 bp, Homo sapiens
acagtcctgttgtcaaagcaat

SEQ ID NO: 7486380 - DNA, 22 bp, Homo sapiens
acagtcctgttgtcaaagcaat

SEQ ID NO: 7486381 - DNA, 22 bp, Homo sapiens
acagtcctgttgtcaaagcaat

SEQ ID NO: 7486382 - DNA, 22 bp, Homo sapiens
acagtccttgtgtggaacatta

SEQ ID NO: 7486383 - DNA, 22 bp, Homo sapiens
acagtctaatcttgtgttctgt

SEQ ID NO: 7486384 - DNA, 22 bp, Homo sapiens
acagtctacaaagtgatgtgtg

SEQ ID NO: 7486385 - DNA, 22 bp, Homo sapiens
acagtctactaaacatcatcag

SEQ ID NO: 7486386 - DNA, 22 bp, Homo sapiens
acagtccttgtttcggtcagat

SEQ ID NO: 7486387 - DNA, 22 bp, Homo sapiens
acagtccttgtgtggaacatta

SEQ ID NO: 7486388 - DNA, 22 bp, Homo sapiens
acagtcctgtacaggccatatc

SEQ ID NO: 7486389 - DNA, 22 bp, Homo sapiens
acagtccttgtttcggtcagat

SEQ ID NO: 7486390 - DNA, 22 bp, Homo sapiens
agctgagagctgtgtcaagata

SEQ ID NO: 7486391 - DNA, 22 bp, Homo sapiens
agctgagagctgtgtcaagata

SEQ ID NO: 7486392 - DNA, 22 bp, Homo sapiens
agctgagagctgtgtcaagata

SEQ ID NO: 7486393 - DNA, 22 bp, Homo sapiens
agctgagagctgtgtcaagata

SEQ ID NO: 7486394 - DNA, 22 bp, Homo sapiens
agctgagagcccctgccctgtg

SEQ ID NO: 7486395 - DNA, 22 bp, Homo sapiens
agctgagacacttgagagacta

SEQ ID NO: 7486396 - DNA, 22 bp, Homo sapiens
agctgagacacttgagagacta

SEQ ID NO: 7486397 - DNA, 22 bp, Homo sapiens
agctgagacacttgagagacta

SEQ ID NO: 7486398 - DNA, 22 bp, Homo sapiens
agctgagacacttgagagacta

SEQ ID NO: 7486399 - DNA, 22 bp, Homo sapiens
agctgagaatcttccccagtgt

SEQ ID NO: 7486400 - DNA, 22 bp, Homo sapiens
agctgagacacttgagagacta

SEQ ID NO: 7486401 - DNA, 22 bp, Homo sapiens
agctgacctggaagggggcacg

SEQ ID NO: 7486402 - DNA, 22 bp, Homo sapiens
agctgaccatgtttccagtggt

SEQ ID NO: 7486403 - DNA, 17 bp, Homo sapiens
agctgacatcaaaactt

SEQ ID NO: 7486404 - DNA, 22 bp, Homo sapiens
agctgaccaaatgcctacagtt

SEQ ID NO: 7486405 - DNA, 22 bp, Homo sapiens
agctgaccagcatcttctggag

SEQ ID NO: 7486406 - DNA, 22 bp, Homo sapiens
agctgacctggaagggggcacg

SEQ ID NO: 7486407 - DNA, 22 bp, Homo sapiens
agctgactgatgaagaggcctt

SEQ ID NO: 7486408 - DNA, 23 bp, Homo sapiens
agctgagaataaggagccgtttg

SEQ ID NO: 7486409 - DNA, 23 bp, Homo sapiens
agctgagaataaggagccgtttg

SEQ ID NO: 7486410 - DNA, 22 bp, Homo sapiens
agctgagaatcttccccagtgt

SEQ ID NO: 7486411 - DNA, 22 bp, Homo sapiens
agctgaagtcctcgcggtgcta

SEQ ID NO: 7486412 - DNA, 22 bp, Homo sapiens
agctgaagtcctcgcggtgcta

SEQ ID NO: 7486413 - DNA, 22 bp, Homo sapiens
agctgaaggctagaacagctgg

SEQ ID NO: 7486414 - DNA, 22 bp, Homo sapiens
agctgaagtttagaattgtgaa

SEQ ID NO: 7486415 - DNA, 22 bp, Homo sapiens
agctgaagttcagtccagagaa

SEQ ID NO: 7486416 - DNA, 22 bp, Homo sapiens
agctgaagttcagtccagagaa

SEQ ID NO: 7486417 - DNA, 22 bp, Homo sapiens
agctgaagttcagtccagagaa

SEQ ID NO: 7486418 - DNA, 22 bp, Homo sapiens
agctgacagtgcatggagggac

SEQ ID NO: 7486419 - DNA, 22 bp, Homo sapiens
agctgaatgttctcagaccaga

SEQ ID NO: 7486420 - DNA, 22 bp, Homo sapiens
agctgacaggatggcattatta

SEQ ID NO: 7486421 - DNA, 22 bp, Homo sapiens
agctgaatgttctcagaccaga

SEQ ID NO: 7486422 - DNA, 22 bp, Homo sapiens
agctgaatcttgactaggaaga

SEQ ID NO: 7486423 - DNA, 22 bp, Homo sapiens
agctgaatcttgactaggaaga

SEQ ID NO: 7486424 - DNA, 22 bp, Homo sapiens
agctgaatcttgactaggaaga

SEQ ID NO: 7486425 - DNA, 22 bp, Homo sapiens
agctgaagtttagaattgtgaa

SEQ ID NO: 7486426 - DNA, 22 bp, Homo sapiens
agctgaatcgaatggcccagtg

SEQ ID NO: 7486427 - DNA, 22 bp, Homo sapiens
agctctggttattgaagcaggg

SEQ ID NO: 7486428 - DNA, 22 bp, Homo sapiens
agctctggttattgaagcaggg

SEQ ID NO: 7486429 - DNA, 22 bp, Homo sapiens
agctctggttattgaagcaggg

SEQ ID NO: 7486430 - DNA, 22 bp, Homo sapiens
agctctggtgagatgttattca

SEQ ID NO: 7486431 - DNA, 22 bp, Homo sapiens
agctctggtgagatgttattca

SEQ ID NO: 7486432 - DNA, 22 bp, Homo sapiens
agctctgggtcacggctgccga

SEQ ID NO: 7486433 - DNA, 22 bp, Homo sapiens
agctctggtactgctgaccgaa

SEQ ID NO: 7486434 - DNA, 22 bp, Homo sapiens
agctctggtactgctgaccgaa

SEQ ID NO: 7486435 - DNA, 22 bp, Homo sapiens
agctctggtatttctttaatcc

SEQ ID NO: 7486436 - DNA, 22 bp, Homo sapiens
agctctggtatttctttaatcc

SEQ ID NO: 7486437 - DNA, 22 bp, Homo sapiens
agctctggtatttctttaatcc

SEQ ID NO: 7486438 - DNA, 22 bp, Homo sapiens
agctctgggtcacggctgccga

SEQ ID NO: 7486439 - DNA, 22 bp, Homo sapiens
agctctggggtggagcccagga

SEQ ID NO: 7486440 - DNA, 22 bp, Homo sapiens
agctctggggtggagcccagga

SEQ ID NO: 7486441 - DNA, 22 bp, Homo sapiens
agctctggggtggagcccagga

SEQ ID NO: 7486442 - DNA, 22 bp, Homo sapiens
agctctggggtggagcccagga

SEQ ID NO: 7486443 - DNA, 22 bp, Homo sapiens
agctctggggtggagcccagga

SEQ ID NO: 7486444 - DNA, 22 bp, Homo sapiens
agctctgggtcacggctgccga

SEQ ID NO: 7486445 - DNA, 22 bp, Homo sapiens
agctctgggtcacggctgccga

SEQ ID NO: 7486446 - DNA, 22 bp, Homo sapiens
agctctgggtcacggctgccga

SEQ ID NO: 7486447 - DNA, 22 bp, Homo sapiens
agctctgggtcacggctgccga

SEQ ID NO: 7486448 - DNA, 22 bp, Homo sapiens
agctctgggtcacggctgccga

SEQ ID NO: 7486449 - DNA, 22 bp, Homo sapiens
agctctgggtcacggctgccga

SEQ ID NO: 7486450 - DNA, 22 bp, Homo sapiens
agctctgggtcacggctgccga

SEQ ID NO: 7486451 - DNA, 20 bp, Homo sapiens
agctgaagcccttggggaaa

SEQ ID NO: 7486452 - DNA, 22 bp, Homo sapiens
agctgaagcagtcagttcagct

SEQ ID NO: 7486453 - DNA, 22 bp, Homo sapiens
agctgaagggaggatatgtaca

SEQ ID NO: 7486454 - DNA, 22 bp, Homo sapiens
agctgaagcagtcagttcagct

SEQ ID NO: 7486455 - DNA, 22 bp, Homo sapiens
agctgaaggctagaacagctgg

SEQ ID NO: 7486456 - DNA, 22 bp, Homo sapiens
agctctggttattgaagcaggg

SEQ ID NO: 7486457 - DNA, 22 bp, Homo sapiens
agctctggttattgaagcaggg

SEQ ID NO: 7486458 - DNA, 22 bp, Homo sapiens
agctctggttattgaagcaggg

SEQ ID NO: 7486459 - DNA, 22 bp, Homo sapiens
agctctggttattgaagcaggg

SEQ ID NO: 7486460 - DNA, 22 bp, Homo sapiens
agctctggttattgaagcaggg

SEQ ID NO: 7486461 - DNA, 22 bp, Homo sapiens
agctgaagcactgggatggaag

SEQ ID NO: 7486462 - DNA, 22 bp, Homo sapiens
agctgaagcactgggatggaag

SEQ ID NO: 7486463 - DNA, 22 bp, Homo sapiens
agctgaagcactgggatggaag

SEQ ID NO: 7486464 - DNA, 22 bp, Homo sapiens
agctgaagcaacaacaggatgg

SEQ ID NO: 7486465 - DNA, 22 bp, Homo sapiens
agctgaagcaacaacaggatgg

SEQ ID NO: 7486466 - DNA, 22 bp, Homo sapiens
acagctgtatccccagagctca

SEQ ID NO: 7486467 - DNA, 21 bp, Homo sapiens
acagctggtgcagggcgggga

SEQ ID NO: 7486468 - DNA, 22 bp, Homo sapiens
acagctgtattcaagttgcaag

SEQ ID NO: 7486469 - DNA, 22 bp, Homo sapiens
agctggaggggccagcaggtgt

SEQ ID NO: 7486470 - DNA, 22 bp, Homo sapiens
agctggaggggccagcaggtgt

SEQ ID NO: 7486471 - DNA, 22 bp, Homo sapiens
agctggaggggccagcaggtgt

SEQ ID NO: 7486472 - DNA, 22 bp, Homo sapiens
agctggaggggccagcaggtgt

SEQ ID NO: 7486473 - DNA, 23 bp, Homo sapiens
agctggaggctgtctactcccaa

SEQ ID NO: 7486474 - DNA, 22 bp, Homo sapiens
agctggattaaatatagctttc

SEQ ID NO: 7486475 - DNA, 22 bp, Homo sapiens
agctggattaaatatagctttc

SEQ ID NO: 7486476 - DNA, 22 bp, Homo sapiens
agctggatgaatttggaacact

SEQ ID NO: 7486477 - DNA, 22 bp, Homo sapiens
agctggatgaatttggaacact

SEQ ID NO: 7486478 - DNA, 22 bp, Homo sapiens
agctggaggggccagcaggtgt

SEQ ID NO: 7486479 - DNA, 22 bp, Homo sapiens
agctggaggggccagcaggtgt

SEQ ID NO: 7486480 - DNA, 22 bp, Homo sapiens
agctggaggggccagcaggtgt

SEQ ID NO: 7486481 - DNA, 22 bp, Homo sapiens
agctggaggggccagcaggtgt

SEQ ID NO: 7486482 - DNA, 22 bp, Homo sapiens
agctggaggggccagcaggtgt

SEQ ID NO: 7486483 - DNA, 22 bp, Homo sapiens
agctggaggggccagcaggtgt

SEQ ID NO: 7486484 - DNA, 21 bp, Homo sapiens
acagctggtgcagggcgggga

SEQ ID NO: 7486485 - DNA, 21 bp, Homo sapiens
acagctggtgcagggcgggga

SEQ ID NO: 7486486 - DNA, 21 bp, Homo sapiens
acagctggtgcagggcgggga

SEQ ID NO: 7486487 - DNA, 22 bp, Homo sapiens
acagctgtatccccagagctca

SEQ ID NO: 7486488 - DNA, 22 bp, Homo sapiens
acagctgtatccccagagctca

SEQ ID NO: 7486489 - DNA, 22 bp, Homo sapiens
acagctgtatccccagagctca

SEQ ID NO: 7486490 - DNA, 22 bp, Homo sapiens
acagctgggtgctgctcagagc

SEQ ID NO: 7486491 - DNA, 22 bp, Homo sapiens
acagctgggtgtcccacttctg

SEQ ID NO: 7486492 - DNA, 22 bp, Homo sapiens
acagctgggtgtcccacttctg

SEQ ID NO: 7486493 - DNA, 22 bp, Homo sapiens
acagctgggtgctgctcagagc

SEQ ID NO: 7486494 - DNA, 22 bp, Homo sapiens
acagctgggtgctgctcagagc

SEQ ID NO: 7486495 - DNA, 22 bp, Homo sapiens
acagctgggtgtcccacttctg

SEQ ID NO: 7486496 - DNA, 22 bp, Homo sapiens
acagctgggtgtcccacttctg

SEQ ID NO: 7486497 - DNA, 22 bp, Homo sapiens
acagctgggtgtcccacttctg

SEQ ID NO: 7486498 - DNA, 22 bp, Homo sapiens
acagctgggtgtcccacttctg

SEQ ID NO: 7486499 - DNA, 22 bp, Homo sapiens
acagctggtgaatgttctctgt

SEQ ID NO: 7486500 - DNA, 22 bp, Homo sapiens
acagctggtgaatgttctctgt

SEQ ID NO: 7486501 - DNA, 22 bp, Homo sapiens
acagctggcaggggggcatgaa

SEQ ID NO: 7486502 - DNA, 22 bp, Homo sapiens
acagctggcaggggggcatgaa

SEQ ID NO: 7486503 - DNA, 22 bp, Homo sapiens
acagctggcaggggggcatgaa

SEQ ID NO: 7486504 - DNA, 22 bp, Homo sapiens
acagctggcaggggggcatgaa

SEQ ID NO: 7486505 - DNA, 22 bp, Homo sapiens
acagctggcaggggggcatgaa

SEQ ID NO: 7486506 - DNA, 22 bp, Homo sapiens
acagctggcaggggggcatgaa

SEQ ID NO: 7486507 - DNA, 22 bp, Homo sapiens
acagctggcaggggggcatgaa

SEQ ID NO: 7486508 - DNA, 22 bp, Homo sapiens
acagctggcaggggggcatgaa

SEQ ID NO: 7486509 - DNA, 22 bp, Homo sapiens
acagctgctctacaggttattt

SEQ ID NO: 7486510 - DNA, 22 bp, Homo sapiens
acagctgctcacctgtgagccc

SEQ ID NO: 7486511 - DNA, 22 bp, Homo sapiens
acagctgctcacctgtgagccc

SEQ ID NO: 7486512 - DNA, 22 bp, Homo sapiens
acagctgctcacctgtgagccc

SEQ ID NO: 7486513 - DNA, 22 bp, Homo sapiens
acagctgctcacctgtgagccc

SEQ ID NO: 7486514 - DNA, 22 bp, Homo sapiens
acagctgccaagacagagcagg

SEQ ID NO: 7486515 - DNA, 21 bp, Homo sapiens
acagctgcctgccatgggggt

SEQ ID NO: 7486516 - DNA, 21 bp, Homo sapiens
acagctgcctgccatgggggt

SEQ ID NO: 7486517 - DNA, 21 bp, Homo sapiens
acagctgcctgccatgggggt

SEQ ID NO: 7486518 - DNA, 22 bp, Homo sapiens
agctgagaggtggcaagctgta

SEQ ID NO: 7486519 - DNA, 22 bp, Homo sapiens
agctgagaggtggcaagctgta

SEQ ID NO: 7486520 - DNA, 22 bp, Homo sapiens
acagctgggtgctgctcagagc

SEQ ID NO: 7486521 - DNA, 22 bp, Homo sapiens
acagctgggtgctgctcagagc

SEQ ID NO: 7486522 - DNA, 22 bp, Homo sapiens
acagctgggaatcagctgggga

SEQ ID NO: 7486523 - DNA, 22 bp, Homo sapiens
acagctgggaatcagctgggga

SEQ ID NO: 7486524 - DNA, 22 bp, Homo sapiens
acagctgggaatcagctgggga

SEQ ID NO: 7486525 - DNA, 22 bp, Homo sapiens
acagctgggaatcagctgggga

SEQ ID NO: 7486526 - DNA, 22 bp, Homo sapiens
acagctgggaatcagctgggga

SEQ ID NO: 7486527 - DNA, 22 bp, Homo sapiens
acagctgggaatcagctgggga

SEQ ID NO: 7486528 - DNA, 22 bp, Homo sapiens
acagctgggaatcagctgggga

SEQ ID NO: 7486529 - DNA, 22 bp, Homo sapiens
acagctggccgaggctcaggga

SEQ ID NO: 7486530 - DNA, 22 bp, Homo sapiens
acagctggccgaggctcaggga

SEQ ID NO: 7486531 - DNA, 22 bp, Homo sapiens
acagctggccgaggctcaggga

SEQ ID NO: 7486532 - DNA, 22 bp, Homo sapiens
acagctggccgaggctcaggga

SEQ ID NO: 7486533 - DNA, 22 bp, Homo sapiens
acagctggccgaggctcaggga

SEQ ID NO: 7486534 - DNA, 22 bp, Homo sapiens
acagctgggaactcacacagca

SEQ ID NO: 7486535 - DNA, 22 bp, Homo sapiens
acagctgggaactcacacagca

SEQ ID NO: 7486536 - DNA, 21 bp, Homo sapiens
acagctggccgcgcgggtcgg

SEQ ID NO: 7486537 - DNA, 21 bp, Homo sapiens
acagctggccgcgcgggtcgg

SEQ ID NO: 7486538 - DNA, 21 bp, Homo sapiens
acagctggccgcgcgggtcgg

SEQ ID NO: 7486539 - DNA, 21 bp, Homo sapiens
acagctggccgcgcgggtcgg

SEQ ID NO: 7486540 - DNA, 23 bp, Homo sapiens
acaggaggggacaggtggccgtg

SEQ ID NO: 7486541 - DNA, 23 bp, Homo sapiens
acaggaggggacaggtggccgtg

SEQ ID NO: 7486542 - DNA, 23 bp, Homo sapiens
acaggaggggacaggtggccgtg

SEQ ID NO: 7486543 - DNA, 22 bp, Homo sapiens
acaggagggacaccttcctgct

SEQ ID NO: 7486544 - DNA, 22 bp, Homo sapiens
acaggagggacaccttcctgct

SEQ ID NO: 7486545 - DNA, 23 bp, Homo sapiens
acaggaggggacaggtggccgtg

SEQ ID NO: 7486546 - DNA, 23 bp, Homo sapiens
acaggaggggacaggtggccgtg

SEQ ID NO: 7486547 - DNA, 23 bp, Homo sapiens
acaggaggggacaggtggccgtg

SEQ ID NO: 7486548 - DNA, 23 bp, Homo sapiens
acaggaggggacaggtggccgtg

SEQ ID NO: 7486549 - DNA, 23 bp, Homo sapiens
acaggaggggacaggtggccgtg

SEQ ID NO: 7486550 - DNA, 22 bp, Homo sapiens
acaggagggacaccttcctgct

SEQ ID NO: 7486551 - DNA, 22 bp, Homo sapiens
acaggagggacaccttcctgct

SEQ ID NO: 7486552 - DNA, 22 bp, Homo sapiens
acaggagggacaccttcctgct

SEQ ID NO: 7486553 - DNA, 22 bp, Homo sapiens
acaggagggacaccttcctgct

SEQ ID NO: 7486554 - DNA, 22 bp, Homo sapiens
acaggagaattatctggaacaa

SEQ ID NO: 7486555 - DNA, 22 bp, Homo sapiens
acaggaggagctgtttcaggga

SEQ ID NO: 7486556 - DNA, 22 bp, Homo sapiens
acaggagggacaccttcctgct

SEQ ID NO: 7486557 - DNA, 22 bp, Homo sapiens
acaggagggacaccttcctgct

SEQ ID NO: 7486558 - DNA, 22 bp, Homo sapiens
acaggagaattatctggaacaa

SEQ ID NO: 7486559 - DNA, 22 bp, Homo sapiens
acaggagaattatctggaacaa

SEQ ID NO: 7486560 - DNA, 22 bp, Homo sapiens
acaggagaattatctggaacaa

SEQ ID NO: 7486561 - DNA, 22 bp, Homo sapiens
acaggagaattatctggaacaa

SEQ ID NO: 7486562 - DNA, 22 bp, Homo sapiens
acaggaggggcatgaaagacgg

SEQ ID NO: 7486563 - DNA, 22 bp, Homo sapiens
acaggaggggcatgaaagacgg

SEQ ID NO: 7486564 - DNA, 22 bp, Homo sapiens
acaggaggggcatgaaagacgg

SEQ ID NO: 7486565 - DNA, 23 bp, Homo sapiens
acaggaggggacaggtggccgtg

SEQ ID NO: 7486566 - DNA, 22 bp, Homo sapiens
acaggaggggcatgaaagacgg

SEQ ID NO: 7486567 - DNA, 22 bp, Homo sapiens
acaggaggggcatgaaagacgg

SEQ ID NO: 7486568 - DNA, 22 bp, Homo sapiens
acaggagtagggctggtggaga

SEQ ID NO: 7486569 - DNA, 22 bp, Homo sapiens
acaggagtagggctggtggaga

SEQ ID NO: 7486570 - DNA, 22 bp, Homo sapiens
acaggagtagggctggtggaga

SEQ ID NO: 7486571 - DNA, 22 bp, Homo sapiens
acaggaggggcatgaaagacgg

SEQ ID NO: 7486572 - DNA, 22 bp, Homo sapiens
acaggaggggcatgaaagacgg

SEQ ID NO: 7486573 - DNA, 22 bp, Homo sapiens
acaggagtgaatctggcactta

SEQ ID NO: 7486574 - DNA, 22 bp, Homo sapiens
acaggagtagggctggtggaga

SEQ ID NO: 7486575 - DNA, 22 bp, Homo sapiens
acaggagtgaatctggcactta

SEQ ID NO: 7486576 - DNA, 22 bp, Homo sapiens
acaggagtggctctaccagacc

SEQ ID NO: 7486577 - DNA, 22 bp, Homo sapiens
acaggagtggctctaccagacc

SEQ ID NO: 7486578 - DNA, 22 bp, Homo sapiens
acaggagtggctctaccagacc

SEQ ID NO: 7486579 - DNA, 22 bp, Homo sapiens
acaggagtggagaggtgcctct

SEQ ID NO: 7486580 - DNA, 22 bp, Homo sapiens
acaggagtggctctaccagacc

SEQ ID NO: 7486581 - DNA, 22 bp, Homo sapiens
acaggagtggagaggtgcctct

SEQ ID NO: 7486582 - DNA, 22 bp, Homo sapiens
acaggagtggagaggtgcctct

SEQ ID NO: 7486583 - DNA, 22 bp, Homo sapiens
agctggatgaatttggaacact

SEQ ID NO: 7486584 - DNA, 22 bp, Homo sapiens
agctggattccagtgcagtcac

SEQ ID NO: 7486585 - DNA, 22 bp, Homo sapiens
agctggcaaaactaatgggaag

SEQ ID NO: 7486586 - DNA, 22 bp, Homo sapiens
agctggcaaacagcttacggcc

SEQ ID NO: 7486587 - DNA, 22 bp, Homo sapiens
agctggcaaaactaatgggaag

SEQ ID NO: 7486588 - DNA, 22 bp, Homo sapiens
agctggcaaggcaatttggatt

SEQ ID NO: 7486589 - DNA, 22 bp, Homo sapiens
agctggcaaggcaatttggatt

SEQ ID NO: 7486590 - DNA, 22 bp, Homo sapiens
agctggcaagttgaaggtggct

SEQ ID NO: 7486591 - DNA, 22 bp, Homo sapiens
agctggcaaggctttagattca

SEQ ID NO: 7486592 - DNA, 22 bp, Homo sapiens
agctggcaatgtaagtccctgg

SEQ ID NO: 7486593 - DNA, 22 bp, Homo sapiens
agctggcaatgtaagtccctgg

SEQ ID NO: 7486594 - DNA, 22 bp, Homo sapiens
agctggcaatctttctaaatac

SEQ ID NO: 7486595 - DNA, 22 bp, Homo sapiens
agctggcaagttgaaggtggct

SEQ ID NO: 7486596 - DNA, 22 bp, Homo sapiens
agctggcaagttgaaggtggct

SEQ ID NO: 7486597 - DNA, 21 bp, Homo sapiens
agctggcaatgttgtcctctt

SEQ ID NO: 7486598 - DNA, 21 bp, Homo sapiens
agctggcaatgttgtcctctt

SEQ ID NO: 7486599 - DNA, 22 bp, Homo sapiens
agctggcacagaccaggagatc

SEQ ID NO: 7486600 - DNA, 22 bp, Homo sapiens
agctggcacagaccaggagatc

SEQ ID NO: 7486601 - DNA, 22 bp, Homo sapiens
agctggcacagaccaggagatc

SEQ ID NO: 7486602 - DNA, 22 bp, Homo sapiens
agctggcaccaaatatagtaaa

SEQ ID NO: 7486603 - DNA, 22 bp, Homo sapiens
agctggcacagaccaggagatc

SEQ ID NO: 7486604 - DNA, 22 bp, Homo sapiens
agctggcaccaaatatagtaaa

SEQ ID NO: 7486605 - DNA, 22 bp, Homo sapiens
agctggcacagaccaggagatc

SEQ ID NO: 7486606 - DNA, 22 bp, Homo sapiens
agctggcagaaagctttgcccg

SEQ ID NO: 7486607 - DNA, 22 bp, Homo sapiens
agctggcactagcgtttccaag

SEQ ID NO: 7486608 - DNA, 19 bp, Homo sapiens
agctggcactagaatccag

SEQ ID NO: 7486609 - DNA, 19 bp, Homo sapiens
agctggcactagaatccag

SEQ ID NO: 7486610 - DNA, 22 bp, Homo sapiens
agctggcaccaaatatagtaaa

SEQ ID NO: 7486611 - DNA, 22 bp, Homo sapiens
agctggcagagcatttgtggcc

SEQ ID NO: 7486612 - DNA, 21 bp, Homo sapiens
agctggcagatatggtgtctg

SEQ ID NO: 7486613 - DNA, 21 bp, Homo sapiens
agctggcagatatggtgtctg

SEQ ID NO: 7486614 - DNA, 22 bp, Homo sapiens
agctggcagctctcaggggtac

SEQ ID NO: 7486615 - DNA, 22 bp, Homo sapiens
agctggcagctctcaggggtac

SEQ ID NO: 7486616 - DNA, 22 bp, Homo sapiens
agctggtgtcacctccagtcca

SEQ ID NO: 7486617 - DNA, 22 bp, Homo sapiens
agctggtgtcacctccagtcca

SEQ ID NO: 7486618 - DNA, 22 bp, Homo sapiens
agctggtgtcacctccagtcca

SEQ ID NO: 7486619 - DNA, 18 bp, Homo sapiens
agctggtggggagacagc

SEQ ID NO: 7486620 - DNA, 18 bp, Homo sapiens
agctggtggggagacagc

SEQ ID NO: 7486621 - DNA, 18 bp, Homo sapiens
agctggtggggagacagc

SEQ ID NO: 7486622 - DNA, 18 bp, Homo sapiens
agctggtggggagacagc

SEQ ID NO: 7486623 - DNA, 18 bp, Homo sapiens
agctggtggggagacagc

SEQ ID NO: 7486624 - DNA, 22 bp, Homo sapiens
agctggtggggaagctgcaggt

SEQ ID NO: 7486625 - DNA, 22 bp, Homo sapiens
agctggtggattatgctgtaca

SEQ ID NO: 7486626 - DNA, 22 bp, Homo sapiens
agctggtggattatgctgtaca

SEQ ID NO: 7486627 - DNA, 22 bp, Homo sapiens
agctggtggattatgctgtaca

SEQ ID NO: 7486628 - DNA, 22 bp, Homo sapiens
agctggtggagcctttctgttt

SEQ ID NO: 7486629 - DNA, 22 bp, Homo sapiens
agctggtggggaagctgcaggt

SEQ ID NO: 7486630 - DNA, 22 bp, Homo sapiens
agctggtggggaagctgcaggt

SEQ ID NO: 7486631 - DNA, 22 bp, Homo sapiens
agctggtggggaagctgcaggt

SEQ ID NO: 7486632 - DNA, 22 bp, Homo sapiens
agctggtggattatgctgtaca

SEQ ID NO: 7486633 - DNA, 22 bp, Homo sapiens
agctggtggggaagctgcaggt

SEQ ID NO: 7486634 - DNA, 22 bp, Homo sapiens
agctggtggggaagctgcaggt

SEQ ID NO: 7486635 - DNA, 22 bp, Homo sapiens
agctggtggattatgctgtaca

SEQ ID NO: 7486636 - DNA, 21 bp, Homo sapiens
acaggataggacagtgttcct

SEQ ID NO: 7486637 - DNA, 22 bp, Homo sapiens
acaggagtttctgacagagaca

SEQ ID NO: 7486638 - DNA, 21 bp, Homo sapiens
acaggataggacagtgttcct

SEQ ID NO: 7486639 - DNA, 22 bp, Homo sapiens
acaggatccgctggctttatat

SEQ ID NO: 7486640 - DNA, 22 bp, Homo sapiens
acaggatagtttttaatcttcc

SEQ ID NO: 7486641 - DNA, 19 bp, Homo sapiens
acaggatatatcaggaaat

SEQ ID NO: 7486642 - DNA, 19 bp, Homo sapiens
acaggatatatcaggaaat

SEQ ID NO: 7486643 - DNA, 22 bp, Homo sapiens
agctggtggagcctttctgttt

SEQ ID NO: 7486644 - DNA, 22 bp, Homo sapiens
agctggtggagaagcagacctc

SEQ ID NO: 7486645 - DNA, 22 bp, Homo sapiens
acaggatcgccctgttgcccag

SEQ ID NO: 7486646 - DNA, 22 bp, Homo sapiens
acaggatcgccctgttgcccag

SEQ ID NO: 7486647 - DNA, 22 bp, Homo sapiens
acaggatcgccctgttgcccag

SEQ ID NO: 7486648 - DNA, 22 bp, Homo sapiens
acaggagtttaagaaatatttc

SEQ ID NO: 7486649 - DNA, 22 bp, Homo sapiens
acaggagttaaggctgagttga

SEQ ID NO: 7486650 - DNA, 22 bp, Homo sapiens
acaggagttcagaggacacccc

SEQ ID NO: 7486651 - DNA, 22 bp, Homo sapiens
acaggagttaaccatgggaagt

SEQ ID NO: 7486652 - DNA, 22 bp, Homo sapiens
acaggagtttctgacagagaca

SEQ ID NO: 7486653 - DNA, 22 bp, Homo sapiens
acaggagtttaagaaatatttc

SEQ ID NO: 7486654 - DNA, 22 bp, Homo sapiens
acaggagttcagaggacacccc

SEQ ID NO: 7486655 - DNA, 22 bp, Homo sapiens
acaggagttaaggctgagttga

SEQ ID NO: 7486656 - DNA, 22 bp, Homo sapiens
acaggagttaaccatgggaagt

SEQ ID NO: 7486657 - DNA, 22 bp, Homo sapiens
acaggagttaaggctgagttga

SEQ ID NO: 7486658 - DNA, 22 bp, Homo sapiens
agctggtgtgccagttccagtt

SEQ ID NO: 7486659 - DNA, 22 bp, Homo sapiens
agctggtgtgccagttccagtt

SEQ ID NO: 7486660 - DNA, 22 bp, Homo sapiens
agctggtgtgccagttccagtt

SEQ ID NO: 7486661 - DNA, 22 bp, Homo sapiens
agctggtgtgccagttccagtt

SEQ ID NO: 7486662 - DNA, 22 bp, Homo sapiens
agctggtgtgccagttccagtt

SEQ ID NO: 7486663 - DNA, 22 bp, Homo sapiens
agctggtgtgccagttccagtt

SEQ ID NO: 7486664 - DNA, 22 bp, Homo sapiens
agctggtgtgccagttccagtt

SEQ ID NO: 7486665 - DNA, 22 bp, Homo sapiens
acaggcacaggtgtgccccacc

SEQ ID NO: 7486666 - DNA, 22 bp, Homo sapiens
acaggcacaggtgtgccccacc

SEQ ID NO: 7486667 - DNA, 22 bp, Homo sapiens
agctggtgtgctctggaatcct

SEQ ID NO: 7486668 - DNA, 22 bp, Homo sapiens
agctggtgtgctctggaatcct

SEQ ID NO: 7486669 - DNA, 22 bp, Homo sapiens
agctggtgtgctctggaatcct

SEQ ID NO: 7486670 - DNA, 22 bp, Homo sapiens
agctggtgtggatttttgaatg

SEQ ID NO: 7486671 - DNA, 22 bp, Homo sapiens
acaggcacaccttcctgcaggc

SEQ ID NO: 7486672 - DNA, 21 bp, Homo sapiens
acaggcaccatgcctgtgcct

SEQ ID NO: 7486673 - DNA, 22 bp, Homo sapiens
acaggcacctgccaccacatct

SEQ ID NO: 7486674 - DNA, 22 bp, Homo sapiens
acaggcacctccaggggtatgt

SEQ ID NO: 7486675 - DNA, 22 bp, Homo sapiens
acaggcagagtcaggttgggtt

SEQ ID NO: 7486676 - DNA, 22 bp, Homo sapiens
acaggcagagtcaggttgggtt

SEQ ID NO: 7486677 - DNA, 22 bp, Homo sapiens
acaggcagagtcaggttgggtt

SEQ ID NO: 7486678 - DNA, 22 bp, Homo sapiens
acaggcacctgccaccacatct

SEQ ID NO: 7486679 - DNA, 22 bp, Homo sapiens
acaggcagagtcaggttgggtt

SEQ ID NO: 7486680 - DNA, 22 bp, Homo sapiens
agctggtgtcctcctggagctg

SEQ ID NO: 7486681 - DNA, 22 bp, Homo sapiens
agctggtgtcctcctggagctg

SEQ ID NO: 7486682 - DNA, 22 bp, Homo sapiens
agctggtgtcctcctggagctg

SEQ ID NO: 7486683 - DNA, 22 bp, Homo sapiens
agctggtgtcctcctggagctg

SEQ ID NO: 7486684 - DNA, 22 bp, Homo sapiens
agctggtgtcctcctggagctg

SEQ ID NO: 7486685 - DNA, 21 bp, Homo sapiens
agctggtgtcagagctctggg

SEQ ID NO: 7486686 - DNA, 21 bp, Homo sapiens
agctggtgtcagagctctggg

SEQ ID NO: 7486687 - DNA, 21 bp, Homo sapiens
agctggtgtcagagctctggg

SEQ ID NO: 7486688 - DNA, 21 bp, Homo sapiens
agctggtgtcagagctctggg

SEQ ID NO: 7486689 - DNA, 21 bp, Homo sapiens
agctggtgtcagagctctggg

SEQ ID NO: 7486690 - DNA, 22 bp, Homo sapiens
agctggtgtgccactgttgggg

SEQ ID NO: 7486691 - DNA, 22 bp, Homo sapiens
agctggtgtgccactgttgggg

SEQ ID NO: 7486692 - DNA, 22 bp, Homo sapiens
agctggtgtgccactgttgggg

SEQ ID NO: 7486693 - DNA, 22 bp, Homo sapiens
agctggtgtcctcctggagctg

SEQ ID NO: 7486694 - DNA, 22 bp, Homo sapiens
acaggcagcaaaatcagcctca

SEQ ID NO: 7486695 - DNA, 22 bp, Homo sapiens
acaggcagcaaaatcagcctca

SEQ ID NO: 7486696 - DNA, 22 bp, Homo sapiens
acaggcagattaagggtaggca

SEQ ID NO: 7486697 - DNA, 14 bp, Homo sapiens
acaggcagatttct

SEQ ID NO: 7486698 - DNA, 14 bp, Homo sapiens
acaggcagatttct

SEQ ID NO: 7486699 - DNA, 22 bp, Homo sapiens
acaggcagcaaaatcagcctca

SEQ ID NO: 7486700 - DNA, 22 bp, Homo sapiens
acaggcagcaaaatcagcctca

SEQ ID NO: 7486701 - DNA, 22 bp, Homo sapiens
acaggcagcaaaatcagcctca

SEQ ID NO: 7486702 - DNA, 22 bp, Homo sapiens
acaggcagcaaaatcagcctca

SEQ ID NO: 7486703 - DNA, 22 bp, Homo sapiens
acaggcagcaaaatcagcctca

SEQ ID NO: 7486704 - DNA, 22 bp, Homo sapiens
acaggcagcaaaatcagcctca

SEQ ID NO: 7486705 - DNA, 22 bp, Homo sapiens
acaggcagcactaatctctggt

SEQ ID NO: 7486706 - DNA, 22 bp, Homo sapiens
acaggcagcactaatctctggt

SEQ ID NO: 7486707 - DNA, 22 bp, Homo sapiens
acaggcagcactaatctctggt

SEQ ID NO: 7486708 - DNA, 22 bp, Homo sapiens
acaggcagcactaatctctggt

SEQ ID NO: 7486709 - DNA, 22 bp, Homo sapiens
acaggcagcaaaatcagcctca

SEQ ID NO: 7486710 - DNA, 22 bp, Homo sapiens
acaggcagcactaatctctggt

SEQ ID NO: 7486711 - DNA, 22 bp, Homo sapiens
acaggcagcactaatctctggt

SEQ ID NO: 7486712 - DNA, 22 bp, Homo sapiens
acaggcagcactaatctctggt

SEQ ID NO: 7486713 - DNA, 22 bp, Homo sapiens
acaggcagatgttttagttgta

SEQ ID NO: 7486714 - DNA, 22 bp, Homo sapiens
acaggcagattaagggtaggca

SEQ ID NO: 7486715 - DNA, 22 bp, Homo sapiens
acaggcagatgttttagttgta

SEQ ID NO: 7486716 - DNA, 22 bp, Homo sapiens
acaggcagatgttttagttgta

SEQ ID NO: 7486717 - DNA, 22 bp, Homo sapiens
acaggcagatgttttagttgta

SEQ ID NO: 7486718 - DNA, 17 bp, Homo sapiens
acaggcagatcacctga

SEQ ID NO: 7486719 - DNA, 17 bp, Homo sapiens
acaggcagatcacctga

SEQ ID NO: 7486720 - DNA, 17 bp, Homo sapiens
acaggcagatcacctga

SEQ ID NO: 7486721 - DNA, 22 bp, Homo sapiens
acaggcagattaagggtaggca

SEQ ID NO: 7486722 - DNA, 22 bp, Homo sapiens
acaggcagattaagggtaggca

SEQ ID NO: 7486723 - DNA, 22 bp, Homo sapiens
acaggcagattaagggtaggca

SEQ ID NO: 7486724 - DNA, 22 bp, Homo sapiens
acaggcagattaagggtaggca

SEQ ID NO: 7486725 - DNA, 22 bp, Homo sapiens
acaggcagattaagggtaggca

SEQ ID NO: 7486726 - DNA, 22 bp, Homo sapiens
acaggcagattaagggtaggca

SEQ ID NO: 7486727 - DNA, 22 bp, Homo sapiens
acaggcagattaagggtaggca

SEQ ID NO: 7486728 - DNA, 22 bp, Homo sapiens
acaggcagattaagggtaggca

SEQ ID NO: 7486729 - DNA, 22 bp, Homo sapiens
acaggcagattaagggtaggca

SEQ ID NO: 7486730 - DNA, 22 bp, Homo sapiens
acaggcagccctctccctggtt

SEQ ID NO: 7486731 - DNA, 22 bp, Homo sapiens
acaggcagccctctccctggtt

SEQ ID NO: 7486732 - DNA, 22 bp, Homo sapiens
acaggcagcgtcattgctgctc

SEQ ID NO: 7486733 - DNA, 22 bp, Homo sapiens
acaggcagcgtcattgctgctc

SEQ ID NO: 7486734 - DNA, 22 bp, Homo sapiens
acaggcagcgtcattgctgctc

SEQ ID NO: 7486735 - DNA, 22 bp, Homo sapiens
acaggcagcgtcattgctgctc

SEQ ID NO: 7486736 - DNA, 22 bp, Homo sapiens
acaggcagccctctccctggtt

SEQ ID NO: 7486737 - DNA, 22 bp, Homo sapiens
acaggcagccctctccctggtt

SEQ ID NO: 7486738 - DNA, 22 bp, Homo sapiens
acaggcagccctctccctggtt

SEQ ID NO: 7486739 - DNA, 22 bp, Homo sapiens
acaggcagccctctccctggtt

SEQ ID NO: 7486740 - DNA, 22 bp, Homo sapiens
acaggcagcactaatctctggt

SEQ ID NO: 7486741 - DNA, 22 bp, Homo sapiens
acaggcagcactaatctctggt

SEQ ID NO: 7486742 - DNA, 22 bp, Homo sapiens
acaggcagccctctccctggtt

SEQ ID NO: 7486743 - DNA, 22 bp, Homo sapiens
acaggcagccctctccctggtt

SEQ ID NO: 7486744 - DNA, 22 bp, Homo sapiens
acaggcaggagctccccattcc

SEQ ID NO: 7486745 - DNA, 22 bp, Homo sapiens
acaggcaggagctccccattcc

SEQ ID NO: 7486746 - DNA, 22 bp, Homo sapiens
acaggcaggagctccccattcc

SEQ ID NO: 7486747 - DNA, 22 bp, Homo sapiens
acaggcagcgtcattgctgctc

SEQ ID NO: 7486748 - DNA, 22 bp, Homo sapiens
acaggcaggagctccccattcc

SEQ ID NO: 7486749 - DNA, 22 bp, Homo sapiens
acaggcaggagctccccattcc

SEQ ID NO: 7486750 - DNA, 22 bp, Homo sapiens
acaggcagcgtcattgctgctc

SEQ ID NO: 7486751 - DNA, 22 bp, Homo sapiens
acaggcagcgtcattgctgctc

SEQ ID NO: 7486752 - DNA, 22 bp, Homo sapiens
acaggcaggcttcggccagagc

SEQ ID NO: 7486753 - DNA, 22 bp, Homo sapiens
acaggcaggcttcggccagagc

SEQ ID NO: 7486754 - DNA, 22 bp, Homo sapiens
acaggcaggcttcggccagagc

SEQ ID NO: 7486755 - DNA, 22 bp, Homo sapiens
acaggcaggcttcggccagagc

SEQ ID NO: 7486756 - DNA, 22 bp, Homo sapiens
acaggcaggcttcggccagagc

SEQ ID NO: 7486757 - DNA, 22 bp, Homo sapiens
acaggcaggcttcggccagagc

SEQ ID NO: 7486758 - DNA, 22 bp, Homo sapiens
acaggcaggcttcggccagagc

SEQ ID NO: 7486759 - DNA, 22 bp, Homo sapiens
acaggcaggcgggacagcccga

SEQ ID NO: 7486760 - DNA, 22 bp, Homo sapiens
acaggcaggcgggacagcccga

SEQ ID NO: 7486761 - DNA, 22 bp, Homo sapiens
acaggcaggcgggacagcccga

SEQ ID NO: 7486762 - DNA, 22 bp, Homo sapiens
acaggcaggcgggacagcccga

SEQ ID NO: 7486763 - DNA, 22 bp, Homo sapiens
acaggcaggcgggacagcccga

SEQ ID NO: 7486764 - DNA, 22 bp, Homo sapiens
acaggcaggcgggacagcccga

SEQ ID NO: 7486765 - DNA, 22 bp, Homo sapiens
acaggcaggcgggacagcccga

SEQ ID NO: 7486766 - DNA, 22 bp, Homo sapiens
acaggcaggcgggacagcccga

SEQ ID NO: 7486767 - DNA, 22 bp, Homo sapiens
acaggcaggcgggacagcccga

SEQ ID NO: 7486768 - DNA, 23 bp, Homo sapiens
acaggcaggcatggccaaatgtg

SEQ ID NO: 7486769 - DNA, 22 bp, Homo sapiens
acaggcaggagctccccattcc

SEQ ID NO: 7486770 - DNA, 23 bp, Homo sapiens
acaggcaggcatggccaaatgtg

SEQ ID NO: 7486771 - DNA, 23 bp, Homo sapiens
acaggcaggcatggccaaatgtg

SEQ ID NO: 7486772 - DNA, 23 bp, Homo sapiens
acaggcaggcatggccaaatgtg

SEQ ID NO: 7486773 - DNA, 22 bp, Homo sapiens
acagggagatgggtgaaagcgg

SEQ ID NO: 7486774 - DNA, 22 bp, Homo sapiens
acagggagatgggtgaaagcgg

SEQ ID NO: 7486775 - DNA, 22 bp, Homo sapiens
acagggagatgggtgaaagcgg

SEQ ID NO: 7486776 - DNA, 22 bp, Homo sapiens
acagggagatgggtgaaagcgg

SEQ ID NO: 7486777 - DNA, 22 bp, Homo sapiens
acagggagatgggtgaaagcgg

SEQ ID NO: 7486778 - DNA, 22 bp, Homo sapiens
acagggagatgggtgaaagcgg

SEQ ID NO: 7486779 - DNA, 22 bp, Homo sapiens
acagggagatatcttcaatatc

SEQ ID NO: 7486780 - DNA, 22 bp, Homo sapiens
acagggagatatcttcaatatc

SEQ ID NO: 7486781 - DNA, 22 bp, Homo sapiens
acagggaccttggaagctggaa

SEQ ID NO: 7486782 - DNA, 22 bp, Homo sapiens
acagggacctgtgagctccata

SEQ ID NO: 7486783 - DNA, 19 bp, Homo sapiens
acagggaatttccacagaa

SEQ ID NO: 7486784 - DNA, 22 bp, Homo sapiens
acagggaatggagggatcagta

SEQ ID NO: 7486785 - DNA, 19 bp, Homo sapiens
acagggaatttccacagaa

SEQ ID NO: 7486786 - DNA, 19 bp, Homo sapiens
acagggaatttccacagaa

SEQ ID NO: 7486787 - DNA, 19 bp, Homo sapiens
acagggaatttccacagaa

SEQ ID NO: 7486788 - DNA, 19 bp, Homo sapiens
acagggaatttccacagaa

SEQ ID NO: 7486789 - DNA, 22 bp, Homo sapiens
acagggaagttctgcaacagga

SEQ ID NO: 7486790 - DNA, 22 bp, Homo sapiens
acagggaagttctgcaacagga

SEQ ID NO: 7486791 - DNA, 22 bp, Homo sapiens
acagggaagttctgcaacagga

SEQ ID NO: 7486792 - DNA, 22 bp, Homo sapiens
acagggaagttctgcaacagga

SEQ ID NO: 7486793 - DNA, 22 bp, Homo sapiens
acagggaatggagggatcagta

SEQ ID NO: 7486794 - DNA, 22 bp, Homo sapiens
acagggaatggagggatcagta

SEQ ID NO: 7486795 - DNA, 22 bp, Homo sapiens
acagggaagttctgcaacagga

SEQ ID NO: 7486796 - DNA, 22 bp, Homo sapiens
acagggaatggagggatcagta

SEQ ID NO: 7486797 - DNA, 22 bp, Homo sapiens
acagggaatggagggatcagta

SEQ ID NO: 7486798 - DNA, 22 bp, Homo sapiens
acagggaatggagggatcagta

SEQ ID NO: 7486799 - DNA, 22 bp, Homo sapiens
acagggaatggagggatcagta

SEQ ID NO: 7486800 - DNA, 22 bp, Homo sapiens
acagggaagttctgcaacagga

SEQ ID NO: 7486801 - DNA, 22 bp, Homo sapiens
acagggaagttctgcaacagga

SEQ ID NO: 7486802 - DNA, 22 bp, Homo sapiens
acagggaaggcatccgcgaatg

SEQ ID NO: 7486803 - DNA, 22 bp, Homo sapiens
acagggaaggcatccgcgaatg

SEQ ID NO: 7486804 - DNA, 22 bp, Homo sapiens
acagggaaggcatccgcgaatg

SEQ ID NO: 7486805 - DNA, 22 bp, Homo sapiens
acagggaaggatttagtgggaa

SEQ ID NO: 7486806 - DNA, 22 bp, Homo sapiens
acagggaaggatttagtgggaa

SEQ ID NO: 7486807 - DNA, 22 bp, Homo sapiens
acagggaaggatttagtgggaa

SEQ ID NO: 7486808 - DNA, 22 bp, Homo sapiens
acagggaaggatttagtgggaa

SEQ ID NO: 7486809 - DNA, 22 bp, Homo sapiens
acagggaaggagcatagaaaaa

SEQ ID NO: 7486810 - DNA, 22 bp, Homo sapiens
acagggaaggagcatagaaaaa

SEQ ID NO: 7486811 - DNA, 22 bp, Homo sapiens
acagggaaggagcatagaaaaa

SEQ ID NO: 7486812 - DNA, 22 bp, Homo sapiens
acagggaaggagcatagaaaaa

SEQ ID NO: 7486813 - DNA, 22 bp, Homo sapiens
acagggaaggatttagtgggaa

SEQ ID NO: 7486814 - DNA, 22 bp, Homo sapiens
acaggcagggaccttggctaag

SEQ ID NO: 7486815 - DNA, 22 bp, Homo sapiens
acaggcagggaccttggctaag

SEQ ID NO: 7486816 - DNA, 22 bp, Homo sapiens
acaggcagggaccttggctaag

SEQ ID NO: 7486817 - DNA, 22 bp, Homo sapiens
acaggcagggacctcttgagtt

SEQ ID NO: 7486818 - DNA, 22 bp, Homo sapiens
acaggcagggaccttggctaag

SEQ ID NO: 7486819 - DNA, 22 bp, Homo sapiens
acaggcagggacctcttgagtt

SEQ ID NO: 7486820 - DNA, 22 bp, Homo sapiens
acaggcagggacctcttgagtt

SEQ ID NO: 7486821 - DNA, 22 bp, Homo sapiens
acaggcagggacctcttgagtt

SEQ ID NO: 7486822 - DNA, 22 bp, Homo sapiens
acaggcaggcttcggccagagc

SEQ ID NO: 7486823 - DNA, 22 bp, Homo sapiens
acaggcaggcttcggccagagc

SEQ ID NO: 7486824 - DNA, 22 bp, Homo sapiens
acaggcagggacctcttgagtt

SEQ ID NO: 7486825 - DNA, 22 bp, Homo sapiens
acaggcagggacctcttgagtt

SEQ ID NO: 7486826 - DNA, 22 bp, Homo sapiens
acaggcaggcttcggccagagc

SEQ ID NO: 7486827 - DNA, 22 bp, Homo sapiens
acaggcagggacctcttgagtt

SEQ ID NO: 7486828 - DNA, 22 bp, Homo sapiens
acaggcaggcttcggccagagc

SEQ ID NO: 7486829 - DNA, 22 bp, Homo sapiens
acaggcaggcttcggccagagc

SEQ ID NO: 7486830 - DNA, 22 bp, Homo sapiens
acaggcaggcttcggccagagc

SEQ ID NO: 7486831 - DNA, 22 bp, Homo sapiens
acaggctgttggggtccagggt

SEQ ID NO: 7486832 - DNA, 22 bp, Homo sapiens
acaggctgttggggtccagggt

SEQ ID NO: 7486833 - DNA, 22 bp, Homo sapiens
acaggctgttggggtccagggt

SEQ ID NO: 7486834 - DNA, 22 bp, Homo sapiens
acaggcaggtaatttacatatt

SEQ ID NO: 7486835 - DNA, 22 bp, Homo sapiens
acaggctgttggggtccagggt

SEQ ID NO: 7486836 - DNA, 22 bp, Homo sapiens
acaggcagggaccttggctaag

SEQ ID NO: 7486837 - DNA, 22 bp, Homo sapiens
acaggcagggaccttggctaag

SEQ ID NO: 7486838 - DNA, 22 bp, Homo sapiens
acaggcagggaccttggctaag

SEQ ID NO: 7486839 - DNA, 22 bp, Homo sapiens
acaggcagggaccttggctaag

SEQ ID NO: 7486840 - DNA, 22 bp, Homo sapiens
acagggaagctcaggggctctg

SEQ ID NO: 7486841 - DNA, 22 bp, Homo sapiens
acagggaagctcaggggctctg

SEQ ID NO: 7486842 - DNA, 22 bp, Homo sapiens
acagggaagctcaggggctctg

SEQ ID NO: 7486843 - DNA, 22 bp, Homo sapiens
acaggctgttggggtccagggt

SEQ ID NO: 7486844 - DNA, 22 bp, Homo sapiens
acaggctgttggggtccagggt

SEQ ID NO: 7486845 - DNA, 22 bp, Homo sapiens
acagggaaggacatgacttggc

SEQ ID NO: 7486846 - DNA, 22 bp, Homo sapiens
acagggaaggacatgacttggc

SEQ ID NO: 7486847 - DNA, 22 bp, Homo sapiens
acagggaaggacatgacttggc

SEQ ID NO: 7486848 - DNA, 22 bp, Homo sapiens
acagggaaggacatgacttggc

SEQ ID NO: 7486849 - DNA, 22 bp, Homo sapiens
acagggaaggagcatagaaaaa

SEQ ID NO: 7486850 - DNA, 22 bp, Homo sapiens
acagggaaggagcatagaaaaa

SEQ ID NO: 7486851 - DNA, 23 bp, Homo sapiens
aggaagagagagtgcctctttct

SEQ ID NO: 7486852 - DNA, 23 bp, Homo sapiens
aggaagagagagtgcctctttct

SEQ ID NO: 7486853 - DNA, 23 bp, Homo sapiens
aggaagagagagtgcctctttct

SEQ ID NO: 7486854 - DNA, 22 bp, Homo sapiens
aggaagagcatctttgggtctg

SEQ ID NO: 7486855 - DNA, 23 bp, Homo sapiens
aggaagagagagtgcctctttct

SEQ ID NO: 7486856 - DNA, 22 bp, Homo sapiens
aggaagacaatctgtgtgctgt

SEQ ID NO: 7486857 - DNA, 18 bp, Homo sapiens
aggaagaccatcagatat

SEQ ID NO: 7486858 - DNA, 18 bp, Homo sapiens
aggaagaccatcagatat

SEQ ID NO: 7486859 - DNA, 22 bp, Homo sapiens
aggaagacaatctgtgtgctgt

SEQ ID NO: 7486860 - DNA, 22 bp, Homo sapiens
aggaagacaatctgtgtgctgt

SEQ ID NO: 7486861 - DNA, 22 bp, Homo sapiens
aggaagacaatctgtgtgctgt

SEQ ID NO: 7486862 - DNA, 22 bp, Homo sapiens
aggaagaatgtttacatatcaa

SEQ ID NO: 7486863 - DNA, 22 bp, Homo sapiens
aggaagaatgtttacatatcaa

SEQ ID NO: 7486864 - DNA, 22 bp, Homo sapiens
aggaagaacctaagaaagtctc

SEQ ID NO: 7486865 - DNA, 22 bp, Homo sapiens
aggaagaacctaagaaagtctc

SEQ ID NO: 7486866 - DNA, 22 bp, Homo sapiens
aggaagaacctaagaaagtctc

SEQ ID NO: 7486867 - DNA, 22 bp, Homo sapiens
aggaagaatgtttacatatcaa

SEQ ID NO: 7486868 - DNA, 22 bp, Homo sapiens
aggaagaatgtttacatatcaa

SEQ ID NO: 7486869 - DNA, 22 bp, Homo sapiens
aggaagaatgtttacatatcaa

SEQ ID NO: 7486870 - DNA, 22 bp, Homo sapiens
aggaagaatgtttacatatcaa

SEQ ID NO: 7486871 - DNA, 22 bp, Homo sapiens
aggaagaatgtttacatatcaa

SEQ ID NO: 7486872 - DNA, 22 bp, Homo sapiens
aggaagaatgtttacatatcaa

SEQ ID NO: 7486873 - DNA, 22 bp, Homo sapiens
aggaagaatgtttacatatcaa

SEQ ID NO: 7486874 - DNA, 22 bp, Homo sapiens
aggaagaatgtttacatatcaa

SEQ ID NO: 7486875 - DNA, 22 bp, Homo sapiens
aggaagaatgtttacatatcaa

SEQ ID NO: 7486876 - DNA, 22 bp, Homo sapiens
aggaagaatgtttacatatcaa

SEQ ID NO: 7486877 - DNA, 21 bp, Homo sapiens
acagggcttcagggagggtta

SEQ ID NO: 7486878 - DNA, 19 bp, Homo sapiens
acagggcttggcctgacat

SEQ ID NO: 7486879 - DNA, 19 bp, Homo sapiens
acagggcttggcctgacat

SEQ ID NO: 7486880 - DNA, 19 bp, Homo sapiens
acagggcttggcctgacat

SEQ ID NO: 7486881 - DNA, 19 bp, Homo sapiens
acagggcttggcctgacat

SEQ ID NO: 7486882 - DNA, 19 bp, Homo sapiens
acagggcttggcctgacat

SEQ ID NO: 7486883 - DNA, 22 bp, Homo sapiens
acagggctcccagcaggtctgt

SEQ ID NO: 7486884 - DNA, 22 bp, Homo sapiens
acagggctatattcctcagagt

SEQ ID NO: 7486885 - DNA, 22 bp, Homo sapiens
acagggctcccagcaggtctgt

SEQ ID NO: 7486886 - DNA, 21 bp, Homo sapiens
acagggcttcagggagggtta

SEQ ID NO: 7486887 - DNA, 22 bp, Homo sapiens
aggaagagcatctttgggtctg

SEQ ID NO: 7486888 - DNA, 22 bp, Homo sapiens
aggaagagcatctttgggtctg

SEQ ID NO: 7486889 - DNA, 22 bp, Homo sapiens
aggaagagcatctttgggtctg

SEQ ID NO: 7486890 - DNA, 22 bp, Homo sapiens
aggaagagcatctttgggtctg

SEQ ID NO: 7486891 - DNA, 22 bp, Homo sapiens
aggaagagcatctttgggtctg

SEQ ID NO: 7486892 - DNA, 22 bp, Homo sapiens
aggaagagcatctttgggtctg

SEQ ID NO: 7486893 - DNA, 22 bp, Homo sapiens
aggaagagcatctttgggtctg

SEQ ID NO: 7486894 - DNA, 22 bp, Homo sapiens
acagggctatattcctcagagt

SEQ ID NO: 7486895 - DNA, 22 bp, Homo sapiens
acagggctatattcctcagagt

SEQ ID NO: 7486896 - DNA, 22 bp, Homo sapiens
aggaagagcatctttgggtctg

SEQ ID NO: 7486897 - DNA, 22 bp, Homo sapiens
aggaagagcattcacatggtag

SEQ ID NO: 7486898 - DNA, 22 bp, Homo sapiens
acagggctatattcctcagagt

SEQ ID NO: 7486899 - DNA, 22 bp, Homo sapiens
aggaagaaactgagctctgaca

SEQ ID NO: 7486900 - DNA, 21 bp, Homo sapiens
aggaagaaaggttggaggttg

SEQ ID NO: 7486901 - DNA, 21 bp, Homo sapiens
aggaagaaaggttggaggttg

SEQ ID NO: 7486902 - DNA, 21 bp, Homo sapiens
aggaagaaaggttggaggttg

SEQ ID NO: 7486903 - DNA, 21 bp, Homo sapiens
aggaagaaaggttggaggttg

SEQ ID NO: 7486904 - DNA, 21 bp, Homo sapiens
aggaagaaaggttggaggttg

SEQ ID NO: 7486905 - DNA, 21 bp, Homo sapiens
aggaagaaaggttggaggttg

SEQ ID NO: 7486906 - DNA, 18 bp, Homo sapiens
acagggagggcgctgggg

SEQ ID NO: 7486907 - DNA, 22 bp, Homo sapiens
aggaagaaactgagctctgaca

SEQ ID NO: 7486908 - DNA, 22 bp, Homo sapiens
aggaagaaactgagctctgaca

SEQ ID NO: 7486909 - DNA, 22 bp, Homo sapiens
aggaagaaactgagctctgaca

SEQ ID NO: 7486910 - DNA, 22 bp, Homo sapiens
acagggagccccagcatttcca

SEQ ID NO: 7486911 - DNA, 22 bp, Homo sapiens
acagggagccccagcatttcca

SEQ ID NO: 7486912 - DNA, 22 bp, Homo sapiens
acagggagatgggtgaaagcgg

SEQ ID NO: 7486913 - DNA, 22 bp, Homo sapiens
acagggagatgggtgaaagcgg

SEQ ID NO: 7486914 - DNA, 22 bp, Homo sapiens
acagggagccccagcatttcca

SEQ ID NO: 7486915 - DNA, 18 bp, Homo sapiens
acagggagggcgctgggg

SEQ ID NO: 7486916 - DNA, 22 bp, Homo sapiens
acagggagccccagcatttcca

SEQ ID NO: 7486917 - DNA, 22 bp, Homo sapiens
acagggagccccagcatttcca

SEQ ID NO: 7486918 - DNA, 22 bp, Homo sapiens
aggaagaacagataatggacgc

SEQ ID NO: 7486919 - DNA, 22 bp, Homo sapiens
aggaagaacagataatggacgc

SEQ ID NO: 7486920 - DNA, 22 bp, Homo sapiens
aggaagaacagataatggacgc

SEQ ID NO: 7486921 - DNA, 22 bp, Homo sapiens
aggaagaacagataatggacgc

SEQ ID NO: 7486922 - DNA, 22 bp, Homo sapiens
aggaagaaatgtgacttcaaac

SEQ ID NO: 7486923 - DNA, 22 bp, Homo sapiens
aggaagaaatgtgacttcaaac

SEQ ID NO: 7486924 - DNA, 21 bp, Homo sapiens
aggaagaaaggttggaggttg

SEQ ID NO: 7486925 - DNA, 21 bp, Homo sapiens
aggaagaaaggttggaggttg

SEQ ID NO: 7486926 - DNA, 22 bp, Homo sapiens
aggaagaaatgtgacttcaaac

SEQ ID NO: 7486927 - DNA, 22 bp, Homo sapiens
aggaagaaatgtgacttcaaac

SEQ ID NO: 7486928 - DNA, 22 bp, Homo sapiens
aggaagaaatgtgacttcaaac

SEQ ID NO: 7486929 - DNA, 22 bp, Homo sapiens
aggaagaaatgtgacttcaaac

SEQ ID NO: 7486930 - DNA, 22 bp, Homo sapiens
aggaagaaatgtgacttcaaac

SEQ ID NO: 7486931 - DNA, 22 bp, Homo sapiens
aggaagaaatgtgacttcaaac

SEQ ID NO: 7486932 - DNA, 22 bp, Homo sapiens
aggaagaaatgtgacttcaaac

SEQ ID NO: 7486933 - DNA, 22 bp, Homo sapiens
aggaagaacctaagaaagtctc

SEQ ID NO: 7486934 - DNA, 22 bp, Homo sapiens
aggaagaacctaagaaagtctc

SEQ ID NO: 7486935 - DNA, 22 bp, Homo sapiens
aggaagaacctaagaaagtctc

SEQ ID NO: 7486936 - DNA, 22 bp, Homo sapiens
aggaagaacctaagaaagtctc

SEQ ID NO: 7486937 - DNA, 22 bp, Homo sapiens
aggaagaacctaagaaagtctc

SEQ ID NO: 7486938 - DNA, 22 bp, Homo sapiens
aggaagaacctaagaaagtctc

SEQ ID NO: 7486939 - DNA, 22 bp, Homo sapiens
aggaagaacctaagaaagtctc

SEQ ID NO: 7486940 - DNA, 22 bp, Homo sapiens
aggaagaacctaagaaagtctc

SEQ ID NO: 7486941 - DNA, 22 bp, Homo sapiens
aggaagaacagataatggacgc

SEQ ID NO: 7486942 - DNA, 22 bp, Homo sapiens
aggaagaacagataatggacgc

SEQ ID NO: 7486943 - DNA, 22 bp, Homo sapiens
aggaagaacagataatggacgc

SEQ ID NO: 7486944 - DNA, 22 bp, Homo sapiens
aggaagaacagataatggacgc

SEQ ID NO: 7486945 - DNA, 22 bp, Homo sapiens
aggacacacaaagagtgagaac

SEQ ID NO: 7486946 - DNA, 22 bp, Homo sapiens
aggacaattttggcatagttct

SEQ ID NO: 7486947 - DNA, 22 bp, Homo sapiens
aggacacacaaagagtgagaac

SEQ ID NO: 7486948 - DNA, 22 bp, Homo sapiens
aggacacacaaagagtgagaac

SEQ ID NO: 7486949 - DNA, 22 bp, Homo sapiens
aggacacacagaatacaaatcc

SEQ ID NO: 7486950 - DNA, 22 bp, Homo sapiens
aggacacacagaatacaaatcc

SEQ ID NO: 7486951 - DNA, 22 bp, Homo sapiens
aggacaattgagagtttgttga

SEQ ID NO: 7486952 - DNA, 22 bp, Homo sapiens
aggacaattagtctggcttggc

SEQ ID NO: 7486953 - DNA, 22 bp, Homo sapiens
aggacaattagtctggcttggc

SEQ ID NO: 7486954 - DNA, 22 bp, Homo sapiens
aggacaattagactctttgttt

SEQ ID NO: 7486955 - DNA, 22 bp, Homo sapiens
aggacaattttggcatagttct

SEQ ID NO: 7486956 - DNA, 22 bp, Homo sapiens
aggacaattttggcatagttct

SEQ ID NO: 7486957 - DNA, 22 bp, Homo sapiens
aggacaattagactctttgttt

SEQ ID NO: 7486958 - DNA, 19 bp, Homo sapiens
acaggggctagcggaagca

SEQ ID NO: 7486959 - DNA, 19 bp, Homo sapiens
acaggggctagcggaagca

SEQ ID NO: 7486960 - DNA, 19 bp, Homo sapiens
acaggggctagcggaagca

SEQ ID NO: 7486961 - DNA, 19 bp, Homo sapiens
acaggggctagcggaagca

SEQ ID NO: 7486962 - DNA, 19 bp, Homo sapiens
acaggggctagcggaagca

SEQ ID NO: 7486963 - DNA, 19 bp, Homo sapiens
acaggggcctttccagggt

SEQ ID NO: 7486964 - DNA, 19 bp, Homo sapiens
acaggggctagcggaagca

SEQ ID NO: 7486965 - DNA, 19 bp, Homo sapiens
acaggggcctttccagggt

SEQ ID NO: 7486966 - DNA, 19 bp, Homo sapiens
acaggggcctttccagggt

SEQ ID NO: 7486967 - DNA, 19 bp, Homo sapiens
acaggggcctttccagggt

SEQ ID NO: 7486968 - DNA, 22 bp, Homo sapiens
aggacacacttctgaggtcttt

SEQ ID NO: 7486969 - DNA, 22 bp, Homo sapiens
aggacacactgttctcacgtaa

SEQ ID NO: 7486970 - DNA, 22 bp, Homo sapiens
aggacacactgcaagagcctgg

SEQ ID NO: 7486971 - DNA, 22 bp, Homo sapiens
aggacacactgcaagagcctgg

SEQ ID NO: 7486972 - DNA, 22 bp, Homo sapiens
aggacacactgcaagagcctgg

SEQ ID NO: 7486973 - DNA, 22 bp, Homo sapiens
aggacacaccaggtccagctgt

SEQ ID NO: 7486974 - DNA, 22 bp, Homo sapiens
aggacacaccaggtccagctgt

SEQ ID NO: 7486975 - DNA, 22 bp, Homo sapiens
aggacacaccaggtccagctgt

SEQ ID NO: 7486976 - DNA, 22 bp, Homo sapiens
aggacacacagaatacaaatcc

SEQ ID NO: 7486977 - DNA, 22 bp, Homo sapiens
aggacacaccaggtccagctgt

SEQ ID NO: 7486978 - DNA, 22 bp, Homo sapiens
aggacacacccagctcacgggg

SEQ ID NO: 7486979 - DNA, 22 bp, Homo sapiens
aggacacacccagctcacgggg

SEQ ID NO: 7486980 - DNA, 22 bp, Homo sapiens
aggacacacccagctcacgggg

SEQ ID NO: 7486981 - DNA, 22 bp, Homo sapiens
acaggggcaggcaggacccttt

SEQ ID NO: 7486982 - DNA, 19 bp, Homo sapiens
acaggggcctttccagggt

SEQ ID NO: 7486983 - DNA, 19 bp, Homo sapiens
acaggggcctttccagggt

SEQ ID NO: 7486984 - DNA, 22 bp, Homo sapiens
acaggggcaggcaggacccttt

SEQ ID NO: 7486985 - DNA, 22 bp, Homo sapiens
acaggggcaggcaggacccttt

SEQ ID NO: 7486986 - DNA, 22 bp, Homo sapiens
acaggggcaggcaggacccttt

SEQ ID NO: 7486987 - DNA, 22 bp, Homo sapiens
acaggggcaggcaggacccttt

SEQ ID NO: 7486988 - DNA, 20 bp, Homo sapiens
acaggggcagcacaataatg

SEQ ID NO: 7486989 - DNA, 22 bp, Homo sapiens
acaggggcaagggctcacggcc

SEQ ID NO: 7486990 - DNA, 20 bp, Homo sapiens
acaggggcagcacaataatg

SEQ ID NO: 7486991 - DNA, 20 bp, Homo sapiens
acaggggcagcacaataatg

SEQ ID NO: 7486992 - DNA, 22 bp, Homo sapiens
acaggggcaagggctcacggcc

SEQ ID NO: 7486993 - DNA, 22 bp, Homo sapiens
acaggggcaagggctcacggcc

SEQ ID NO: 7486994 - DNA, 22 bp, Homo sapiens
acaggggcaagggctcacggcc

SEQ ID NO: 7486995 - DNA, 22 bp, Homo sapiens
acaggggcaagggctcacggcc

SEQ ID NO: 7486996 - DNA, 22 bp, Homo sapiens
acagggcttttaatcagtagtt

SEQ ID NO: 7486997 - DNA, 22 bp, Homo sapiens
acagggcttttaatcagtagtt

SEQ ID NO: 7486998 - DNA, 22 bp, Homo sapiens
acagggcttttaatcagtagtt

SEQ ID NO: 7486999 - DNA, 22 bp, Homo sapiens
acagggcttttaatcagtagtt

SEQ ID NO: 7487000 - DNA, 22 bp, Homo sapiens
acagggcttgtgacaactttaa

SEQ ID NO: 7487001 - DNA, 22 bp, Homo sapiens
acagggcttttaatcagtagtt

SEQ ID NO: 7487002 - DNA, 22 bp, Homo sapiens
acaggggacctaggaccctcgg

SEQ ID NO: 7487003 - DNA, 22 bp, Homo sapiens
acaggggaatttactgtcatta

SEQ ID NO: 7487004 - DNA, 22 bp, Homo sapiens
acaggggacctaggaccctcgg

SEQ ID NO: 7487005 - DNA, 22 bp, Homo sapiens
acaggggcaagggctcacggcc

SEQ ID NO: 7487006 - DNA, 22 bp, Homo sapiens
acaggggattgattggaagtct

SEQ ID NO: 7487007 - DNA, 22 bp, Homo sapiens
acaggggattgattggaagtct

SEQ ID NO: 7487008 - DNA, 22 bp, Homo sapiens
acaggggacctaggaccctcgg

SEQ ID NO: 7487009 - DNA, 22 bp, Homo sapiens
acagggcttttaatcagtagtt

SEQ ID NO: 7487010 - DNA, 22 bp, Homo sapiens
acaggggaatttactgtcatta

SEQ ID NO: 7487011 - DNA, 22 bp, Homo sapiens
agggggcaggagagacctgctg

SEQ ID NO: 7487012 - DNA, 22 bp, Homo sapiens
agggggcaggagagacctgctg

SEQ ID NO: 7487013 - DNA, 22 bp, Homo sapiens
agggggcaggagagacctgctg

SEQ ID NO: 7487014 - DNA, 22 bp, Homo sapiens
agggggcaggagagacctgctg

SEQ ID NO: 7487015 - DNA, 22 bp, Homo sapiens
agggggcaggagagacctgctg

SEQ ID NO: 7487016 - DNA, 22 bp, Homo sapiens
agggggcaggagagacctgctg

SEQ ID NO: 7487017 - DNA, 22 bp, Homo sapiens
agggggcaggagagacctgctg

SEQ ID NO: 7487018 - DNA, 22 bp, Homo sapiens
agggggcaggagagacctgctg

SEQ ID NO: 7487019 - DNA, 22 bp, Homo sapiens
agggggcatcaggtcctggctc

SEQ ID NO: 7487020 - DNA, 22 bp, Homo sapiens
agggggcatcaggtcctggctc

SEQ ID NO: 7487021 - DNA, 22 bp, Homo sapiens
agggggcatcaggtcctggctc

SEQ ID NO: 7487022 - DNA, 22 bp, Homo sapiens
agggggcatcaggtcctggctc

SEQ ID NO: 7487023 - DNA, 22 bp, Homo sapiens
agggggcatcaggtcctggctc

SEQ ID NO: 7487024 - DNA, 22 bp, Homo sapiens
agggggcattatgaggcttttc

SEQ ID NO: 7487025 - DNA, 22 bp, Homo sapiens
agggggcattatgaggcttttc

SEQ ID NO: 7487026 - DNA, 22 bp, Homo sapiens
agggggcatcaggtcctggctc

SEQ ID NO: 7487027 - DNA, 22 bp, Homo sapiens
agggggaggctgtgctgcgtct

SEQ ID NO: 7487028 - DNA, 22 bp, Homo sapiens
agggggaggctgtgctgcgtct

SEQ ID NO: 7487029 - DNA, 22 bp, Homo sapiens
agggggaggctgtgctgcgtct

SEQ ID NO: 7487030 - DNA, 22 bp, Homo sapiens
aggggcctggttggcctctgtt

SEQ ID NO: 7487031 - DNA, 22 bp, Homo sapiens
agggggagtttcagttagaaag

SEQ ID NO: 7487032 - DNA, 22 bp, Homo sapiens
agggggagtttcagttagaaag

SEQ ID NO: 7487033 - DNA, 22 bp, Homo sapiens
agggggaggctgtgctgcgtct

SEQ ID NO: 7487034 - DNA, 22 bp, Homo sapiens
agggggaggctgtgctgcgtct

SEQ ID NO: 7487035 - DNA, 22 bp, Homo sapiens
acccaggctggcgtgcagtggc

SEQ ID NO: 7487036 - DNA, 22 bp, Homo sapiens
acccaggctggcagaggctcct

SEQ ID NO: 7487037 - DNA, 22 bp, Homo sapiens
acccaggctggcagaggctcct

SEQ ID NO: 7487038 - DNA, 22 bp, Homo sapiens
acccaggctggcgtgcagtggc

SEQ ID NO: 7487039 - DNA, 22 bp, Homo sapiens
acccaggctggcgtgcagtggc

SEQ ID NO: 7487040 - DNA, 22 bp, Homo sapiens
aggggcctggcactgagctggc

SEQ ID NO: 7487041 - DNA, 22 bp, Homo sapiens
aggggcctggacatggacgcgc

SEQ ID NO: 7487042 - DNA, 22 bp, Homo sapiens
acccaggctggcgtgcagtggc

SEQ ID NO: 7487043 - DNA, 22 bp, Homo sapiens
aggggcctggcactgagctggc

SEQ ID NO: 7487044 - DNA, 22 bp, Homo sapiens
aggggcctggcactgagctggc

SEQ ID NO: 7487045 - DNA, 22 bp, Homo sapiens
aggggcctggcactgagctggc

SEQ ID NO: 7487046 - DNA, 22 bp, Homo sapiens
aggggcctggcactgagctggc

SEQ ID NO: 7487047 - DNA, 22 bp, Homo sapiens
agggggcattatgaggcttttc

SEQ ID NO: 7487048 - DNA, 22 bp, Homo sapiens
agggggcattatgaggcttttc

SEQ ID NO: 7487049 - DNA, 22 bp, Homo sapiens
agggggcccttgcaggtgagcg

SEQ ID NO: 7487050 - DNA, 22 bp, Homo sapiens
agggggcccttgcaggtgagcg

SEQ ID NO: 7487051 - DNA, 22 bp, Homo sapiens
agggggcattatgaggcttttc

SEQ ID NO: 7487052 - DNA, 22 bp, Homo sapiens
agggggctcagcaggctctgga

SEQ ID NO: 7487053 - DNA, 22 bp, Homo sapiens
agggggctcagcaggctctgga

SEQ ID NO: 7487054 - DNA, 22 bp, Homo sapiens
agggggctcagcatggatggag

SEQ ID NO: 7487055 - DNA, 22 bp, Homo sapiens
agggggctcagcatggatggag

SEQ ID NO: 7487056 - DNA, 22 bp, Homo sapiens
agggggctcagcatggatggag

SEQ ID NO: 7487057 - DNA, 22 bp, Homo sapiens
agggggctcagcatggatggag

SEQ ID NO: 7487058 - DNA, 22 bp, Homo sapiens
agggggctcagcatggatggag

SEQ ID NO: 7487059 - DNA, 22 bp, Homo sapiens
agggggctcagcaggctctgga

SEQ ID NO: 7487060 - DNA, 22 bp, Homo sapiens
agggggctcagcaggctctgga

SEQ ID NO: 7487061 - DNA, 22 bp, Homo sapiens
agggggctcagcaggctctgga

SEQ ID NO: 7487062 - DNA, 22 bp, Homo sapiens
agggggctcagcatggatggag

SEQ ID NO: 7487063 - DNA, 22 bp, Homo sapiens
agggggctcagcaggctctgga

SEQ ID NO: 7487064 - DNA, 22 bp, Homo sapiens
agggggctcagcatggatggag

SEQ ID NO: 7487065 - DNA, 22 bp, Homo sapiens
agggggctcagcatggatggag

SEQ ID NO: 7487066 - DNA, 22 bp, Homo sapiens
agggggctcagtgactgaagtg

SEQ ID NO: 7487067 - DNA, 22 bp, Homo sapiens
agggggctcagtgactgaagtg

SEQ ID NO: 7487068 - DNA, 22 bp, Homo sapiens
agggggctcagtgactgaagtg

SEQ ID NO: 7487069 - DNA, 22 bp, Homo sapiens
agggggctcagtgactgaagtg

SEQ ID NO: 7487070 - DNA, 22 bp, Homo sapiens
agggggctcagcatggatggag

SEQ ID NO: 7487071 - DNA, 22 bp, Homo sapiens
accctcagtaatcgtgcagttt

SEQ ID NO: 7487072 - DNA, 22 bp, Homo sapiens
accctcagtaatcgtgcagttt

SEQ ID NO: 7487073 - DNA, 22 bp, Homo sapiens
agggggctcctccggtgcttcc

SEQ ID NO: 7487074 - DNA, 22 bp, Homo sapiens
agggggctcctccggtgcttcc

SEQ ID NO: 7487075 - DNA, 22 bp, Homo sapiens
agggggctcctccggtgcttcc

SEQ ID NO: 7487076 - DNA, 20 bp, Homo sapiens
accctccactgttcactgtg

SEQ ID NO: 7487077 - DNA, 22 bp, Homo sapiens
accctcatgaagctggcctgga

SEQ ID NO: 7487078 - DNA, 20 bp, Homo sapiens
accctccactgttcactgtg

SEQ ID NO: 7487079 - DNA, 22 bp, Homo sapiens
accctcatgaagctggcctgga

SEQ ID NO: 7487080 - DNA, 22 bp, Homo sapiens
accctccacaccagtcttattt

SEQ ID NO: 7487081 - DNA, 22 bp, Homo sapiens
accctccacaccagtcttattt

SEQ ID NO: 7487082 - DNA, 22 bp, Homo sapiens
accctccactttatctgtcttt

SEQ ID NO: 7487083 - DNA, 22 bp, Homo sapiens
accctccaggcgggcttgtgac

SEQ ID NO: 7487084 - DNA, 22 bp, Homo sapiens
accctccactttatctgtcttt

SEQ ID NO: 7487085 - DNA, 22 bp, Homo sapiens
accctccactttatctgtcttt

SEQ ID NO: 7487086 - DNA, 22 bp, Homo sapiens
acccaggctggagtgcagtgtc

SEQ ID NO: 7487087 - DNA, 22 bp, Homo sapiens
acccaggctggagtgcagtgtc

SEQ ID NO: 7487088 - DNA, 22 bp, Homo sapiens
acccaggctggagtgcagtggt

SEQ ID NO: 7487089 - DNA, 22 bp, Homo sapiens
acccaggctggagtgcagtggt

SEQ ID NO: 7487090 - DNA, 22 bp, Homo sapiens
acccaggctggagtgcagtggt

SEQ ID NO: 7487091 - DNA, 22 bp, Homo sapiens
acccaggctggagtgcagtggt

SEQ ID NO: 7487092 - DNA, 22 bp, Homo sapiens
acccaggctggagtgcagtggt

SEQ ID NO: 7487093 - DNA, 22 bp, Homo sapiens
acccaggctggagtgcagtggt

SEQ ID NO: 7487094 - DNA, 22 bp, Homo sapiens
acccaggctggagtgcagtgtc

SEQ ID NO: 7487095 - DNA, 22 bp, Homo sapiens
acccaggctggcgtgcagtggc

SEQ ID NO: 7487096 - DNA, 22 bp, Homo sapiens
acccaggctggagtgcagtgtc

SEQ ID NO: 7487097 - DNA, 22 bp, Homo sapiens
acccaggctggagtgcagtgtc

SEQ ID NO: 7487098 - DNA, 22 bp, Homo sapiens
acccaggctggagtgcagtgtc

SEQ ID NO: 7487099 - DNA, 22 bp, Homo sapiens
acccaggctggagtgcagtggg

SEQ ID NO: 7487100 - DNA, 22 bp, Homo sapiens
acccaggctggagtgcagtggg

SEQ ID NO: 7487101 - DNA, 22 bp, Homo sapiens
acccaggctggagtgcagtggg

SEQ ID NO: 7487102 - DNA, 22 bp, Homo sapiens
acccaggctggagtgcagtggc

SEQ ID NO: 7487103 - DNA, 22 bp, Homo sapiens
acccaggctggagtgcagtggg

SEQ ID NO: 7487104 - DNA, 22 bp, Homo sapiens
acccaggctggagtgcagtggg

SEQ ID NO: 7487105 - DNA, 22 bp, Homo sapiens
acccaggctggagtgcagtggg

SEQ ID NO: 7487106 - DNA, 22 bp, Homo sapiens
acccaggctggagtgcagtggc

SEQ ID NO: 7487107 - DNA, 22 bp, Homo sapiens
acccaggctggagtgcagtggc

SEQ ID NO: 7487108 - DNA, 22 bp, Homo sapiens
acccaggctggagtgcagtggc

SEQ ID NO: 7487109 - DNA, 22 bp, Homo sapiens
acccaggctggagtgcagtggc

SEQ ID NO: 7487110 - DNA, 22 bp, Homo sapiens
acccaggctggagtgcagtggc

SEQ ID NO: 7487111 - DNA, 22 bp, Homo sapiens
acccaggctggagtgcagtgat

SEQ ID NO: 7487112 - DNA, 22 bp, Homo sapiens
acccaggctggagtgcagtgat

SEQ ID NO: 7487113 - DNA, 22 bp, Homo sapiens
acccaggctggagtgcagtgat

SEQ ID NO: 7487114 - DNA, 22 bp, Homo sapiens
acccaggctggagtgcagtgat

SEQ ID NO: 7487115 - DNA, 22 bp, Homo sapiens
acccaggctggagtgcagtgat

SEQ ID NO: 7487116 - DNA, 22 bp, Homo sapiens
acccaggctggagtgcagtgat

SEQ ID NO: 7487117 - DNA, 22 bp, Homo sapiens
acccaggctggagtgcagtgac

SEQ ID NO: 7487118 - DNA, 22 bp, Homo sapiens
acccaggctggagtgcagtgac

SEQ ID NO: 7487119 - DNA, 22 bp, Homo sapiens
agggctgctgaggaagccttgc

SEQ ID NO: 7487120 - DNA, 22 bp, Homo sapiens
acccaggctggagtgcagtgac

SEQ ID NO: 7487121 - DNA, 22 bp, Homo sapiens
agggctgctcctccttcaggcc

SEQ ID NO: 7487122 - DNA, 22 bp, Homo sapiens
agggctgctcctccttcaggcc

SEQ ID NO: 7487123 - DNA, 22 bp, Homo sapiens
agggctgctcctccttcaggcc

SEQ ID NO: 7487124 - DNA, 22 bp, Homo sapiens
agggctgctcctccttcaggcc

SEQ ID NO: 7487125 - DNA, 22 bp, Homo sapiens
agggctgctcctccttcaggcc

SEQ ID NO: 7487126 - DNA, 19 bp, Homo sapiens
agggctgctctggcctggg

SEQ ID NO: 7487127 - DNA, 19 bp, Homo sapiens
agggctgctctggcctggg

SEQ ID NO: 7487128 - DNA, 19 bp, Homo sapiens
agggctgctctggcctggg

SEQ ID NO: 7487129 - DNA, 22 bp, Homo sapiens
agggctgctaccttaatcagtt

SEQ ID NO: 7487130 - DNA, 22 bp, Homo sapiens
agggctgctaccttaatcagtt

SEQ ID NO: 7487131 - DNA, 22 bp, Homo sapiens
agggctgctatgttgattcaga

SEQ ID NO: 7487132 - DNA, 22 bp, Homo sapiens
agggctgctatgttgattcaga

SEQ ID NO: 7487133 - DNA, 22 bp, Homo sapiens
agggctgcctgctctgcattga

SEQ ID NO: 7487134 - DNA, 22 bp, Homo sapiens
agggctgcctgctctgcattga

SEQ ID NO: 7487135 - DNA, 22 bp, Homo sapiens
agggctgcctgctctgcattga

SEQ ID NO: 7487136 - DNA, 22 bp, Homo sapiens
agggctgcctgactccagagcc

SEQ ID NO: 7487137 - DNA, 22 bp, Homo sapiens
agggctgcctgactccagagcc

SEQ ID NO: 7487138 - DNA, 22 bp, Homo sapiens
agggctgcctgactccagagcc

SEQ ID NO: 7487139 - DNA, 22 bp, Homo sapiens
agggctgccccagtccagccgg

SEQ ID NO: 7487140 - DNA, 22 bp, Homo sapiens
agggctgcctgactccagagcc

SEQ ID NO: 7487141 - DNA, 22 bp, Homo sapiens
agggctgccccagtccagccgg

SEQ ID NO: 7487142 - DNA, 22 bp, Homo sapiens
agggctgcctgactccagagcc

SEQ ID NO: 7487143 - DNA, 22 bp, Homo sapiens
agggctgcctgactccagagcc

SEQ ID NO: 7487144 - DNA, 22 bp, Homo sapiens
agggctgcctgactccagagcc

SEQ ID NO: 7487145 - DNA, 22 bp, Homo sapiens
agggctgccccagtccagccgg

SEQ ID NO: 7487146 - DNA, 22 bp, Homo sapiens
agggctgcctgactccagagcc

SEQ ID NO: 7487147 - DNA, 22 bp, Homo sapiens
acccagccatgttcagttctct

SEQ ID NO: 7487148 - DNA, 22 bp, Homo sapiens
acccagccacagcattgaggga

SEQ ID NO: 7487149 - DNA, 22 bp, Homo sapiens
acccagccacagcattgaggga

SEQ ID NO: 7487150 - DNA, 22 bp, Homo sapiens
acccagccacagcattgaggga

SEQ ID NO: 7487151 - DNA, 22 bp, Homo sapiens
acccagcatgacacctgcacat

SEQ ID NO: 7487152 - DNA, 22 bp, Homo sapiens
acccagcatgacacctgcacat

SEQ ID NO: 7487153 - DNA, 22 bp, Homo sapiens
acccagcatgacacctgcacat

SEQ ID NO: 7487154 - DNA, 22 bp, Homo sapiens
acccagcaaagataaacttatg

SEQ ID NO: 7487155 - DNA, 22 bp, Homo sapiens
acccagcatgacacctgcacat

SEQ ID NO: 7487156 - DNA, 22 bp, Homo sapiens
acccagcatgacacctgcacat

SEQ ID NO: 7487157 - DNA, 22 bp, Homo sapiens
acccagcatgacacctgcacat

SEQ ID NO: 7487158 - DNA, 22 bp, Homo sapiens
acccagagtgtctgtctcagtc

SEQ ID NO: 7487159 - DNA, 22 bp, Homo sapiens
acccagagcccttagcacagac

SEQ ID NO: 7487160 - DNA, 22 bp, Homo sapiens
acccagagcccttagcacagac

SEQ ID NO: 7487161 - DNA, 22 bp, Homo sapiens
acccagagcccttagcacagac

SEQ ID NO: 7487162 - DNA, 22 bp, Homo sapiens
acccagcaaagataaacttatg

SEQ ID NO: 7487163 - DNA, 22 bp, Homo sapiens
acccagagccagggtcaggagc

SEQ ID NO: 7487164 - DNA, 22 bp, Homo sapiens
acccagataaatgacagggctt

SEQ ID NO: 7487165 - DNA, 22 bp, Homo sapiens
acccagcctacaaagctcacct

SEQ ID NO: 7487166 - DNA, 22 bp, Homo sapiens
acccagcctacaaagctcacct

SEQ ID NO: 7487167 - DNA, 22 bp, Homo sapiens
acccagcctacaaagctcacct

SEQ ID NO: 7487168 - DNA, 22 bp, Homo sapiens
acccagcctacaaagctcacct

SEQ ID NO: 7487169 - DNA, 19 bp, Homo sapiens
acccagcccaggagtggca

SEQ ID NO: 7487170 - DNA, 22 bp, Homo sapiens
acccagcctacaaagctcacct

SEQ ID NO: 7487171 - DNA, 19 bp, Homo sapiens
acccagcccaggagtggca

SEQ ID NO: 7487172 - DNA, 19 bp, Homo sapiens
acccagcccaggagtggca

SEQ ID NO: 7487173 - DNA, 22 bp, Homo sapiens
acccagcccagaatctggggcc

SEQ ID NO: 7487174 - DNA, 22 bp, Homo sapiens
acccagccatgttcagttctct

SEQ ID NO: 7487175 - DNA, 22 bp, Homo sapiens
acccagccatgttcagttctct

SEQ ID NO: 7487176 - DNA, 22 bp, Homo sapiens
acccagcccagaatctggggcc

SEQ ID NO: 7487177 - DNA, 22 bp, Homo sapiens
acccagcccagaatctggggcc

SEQ ID NO: 7487178 - DNA, 22 bp, Homo sapiens
acccagcccagaatctggggcc

SEQ ID NO: 7487179 - DNA, 19 bp, Homo sapiens
acccagcccaggagtggca

SEQ ID NO: 7487180 - DNA, 22 bp, Homo sapiens
acccagcccagaatctggggcc

SEQ ID NO: 7487181 - DNA, 22 bp, Homo sapiens
acccagcccagaatctggggcc

SEQ ID NO: 7487182 - DNA, 22 bp, Homo sapiens
agggcagcagctcctcctagct

SEQ ID NO: 7487183 - DNA, 22 bp, Homo sapiens
accaggcctggctgggcagcca

SEQ ID NO: 7487184 - DNA, 22 bp, Homo sapiens
accaggcctggctgggcagcca

SEQ ID NO: 7487185 - DNA, 22 bp, Homo sapiens
accaggctccccttggatcctg

SEQ ID NO: 7487186 - DNA, 22 bp, Homo sapiens
accaggctccccttggatcctg

SEQ ID NO: 7487187 - DNA, 22 bp, Homo sapiens
accaggcctggctgggcagcca

SEQ ID NO: 7487188 - DNA, 22 bp, Homo sapiens
accaggcctggctgggcagcca

SEQ ID NO: 7487189 - DNA, 22 bp, Homo sapiens
accaggctccccttggatcctg

SEQ ID NO: 7487190 - DNA, 22 bp, Homo sapiens
accaggctctgccagtgtttac

SEQ ID NO: 7487191 - DNA, 22 bp, Homo sapiens
accaggctggagtgcagtggcg

SEQ ID NO: 7487192 - DNA, 22 bp, Homo sapiens
accaggctggagtgcagtggcg

SEQ ID NO: 7487193 - DNA, 22 bp, Homo sapiens
accaggctctgccagtgtttac

SEQ ID NO: 7487194 - DNA, 22 bp, Homo sapiens
accaggctccccttggatcctg

SEQ ID NO: 7487195 - DNA, 22 bp, Homo sapiens
accaggctccccttggatcctg

SEQ ID NO: 7487196 - DNA, 22 bp, Homo sapiens
accaggctggagtgcagtggcg

SEQ ID NO: 7487197 - DNA, 22 bp, Homo sapiens
accaggctggagtgcagtggcg

SEQ ID NO: 7487198 - DNA, 22 bp, Homo sapiens
accaggctggagtgcagtggcg

SEQ ID NO: 7487199 - DNA, 22 bp, Homo sapiens
accaggctggagtgcagtggcg

SEQ ID NO: 7487200 - DNA, 22 bp, Homo sapiens
accaggctggagtgcagtggcg

SEQ ID NO: 7487201 - DNA, 22 bp, Homo sapiens
accaggctgtgaagtgagacta

SEQ ID NO: 7487202 - DNA, 22 bp, Homo sapiens
accaggctggagtgcagtggcg

SEQ ID NO: 7487203 - DNA, 22 bp, Homo sapiens
accaggctggagtgcagtggcg

SEQ ID NO: 7487204 - DNA, 22 bp, Homo sapiens
accaggctggagtgcagtggcg

SEQ ID NO: 7487205 - DNA, 22 bp, Homo sapiens
acccagagccagggtcaggagc

SEQ ID NO: 7487206 - DNA, 22 bp, Homo sapiens
acccagagccagggtcaggagc

SEQ ID NO: 7487207 - DNA, 22 bp, Homo sapiens
acccagagccagggtcaggagc

SEQ ID NO: 7487208 - DNA, 22 bp, Homo sapiens
acccagagccagggtcaggagc

SEQ ID NO: 7487209 - DNA, 22 bp, Homo sapiens
acccagagcagagcttggcttc

SEQ ID NO: 7487210 - DNA, 22 bp, Homo sapiens
accaggctggagtgcagtggcg

SEQ ID NO: 7487211 - DNA, 22 bp, Homo sapiens
accaggctgtgaagtgagacta

SEQ ID NO: 7487212 - DNA, 22 bp, Homo sapiens
accaggctgtgaagtgagacta

SEQ ID NO: 7487213 - DNA, 22 bp, Homo sapiens
acccagagcagagcttggcttc

SEQ ID NO: 7487214 - DNA, 22 bp, Homo sapiens
acccagagcagagcttggcttc

SEQ ID NO: 7487215 - DNA, 22 bp, Homo sapiens
acccaggaaaacatggtgcaga

SEQ ID NO: 7487216 - DNA, 22 bp, Homo sapiens
acccaggaaaacatggtgcaga

SEQ ID NO: 7487217 - DNA, 22 bp, Homo sapiens
acccaggaaaacatggtgcaga

SEQ ID NO: 7487218 - DNA, 22 bp, Homo sapiens
acccaggaaaacatggtgcaga

SEQ ID NO: 7487219 - DNA, 22 bp, Homo sapiens
acccagctgtttcccgtgtcat

SEQ ID NO: 7487220 - DNA, 22 bp, Homo sapiens
acccagctgtttcccgtgtcat

SEQ ID NO: 7487221 - DNA, 22 bp, Homo sapiens
acccaggacaaaataaccaggt

SEQ ID NO: 7487222 - DNA, 22 bp, Homo sapiens
acccaggaaaacatggtgcaga

SEQ ID NO: 7487223 - DNA, 22 bp, Homo sapiens
acccaggaaaacatggtgcaga

SEQ ID NO: 7487224 - DNA, 22 bp, Homo sapiens
acccaggaaaacatggtgcaga

SEQ ID NO: 7487225 - DNA, 22 bp, Homo sapiens
acccaggacacagagatgaccc

SEQ ID NO: 7487226 - DNA, 22 bp, Homo sapiens
acccaggacatgggcacccgtg

SEQ ID NO: 7487227 - DNA, 22 bp, Homo sapiens
acccaggacacagagatgaccc

SEQ ID NO: 7487228 - DNA, 22 bp, Homo sapiens
acccaggacacagagatgaccc

SEQ ID NO: 7487229 - DNA, 22 bp, Homo sapiens
acccaggacacagagatgaccc

SEQ ID NO: 7487230 - DNA, 22 bp, Homo sapiens
acccaggacaaaataaccaggt

SEQ ID NO: 7487231 - DNA, 22 bp, Homo sapiens
acccaggacaaaataaccaggt

SEQ ID NO: 7487232 - DNA, 22 bp, Homo sapiens
acccaggacaaaataaccaggt

SEQ ID NO: 7487233 - DNA, 22 bp, Homo sapiens
acccaggacacagagatgaccc

SEQ ID NO: 7487234 - DNA, 22 bp, Homo sapiens
acccaggacacagagatgaccc

SEQ ID NO: 7487235 - DNA, 20 bp, Homo sapiens
acccagctctgtgccctggg

SEQ ID NO: 7487236 - DNA, 20 bp, Homo sapiens
acccagctctgtgccctggg

SEQ ID NO: 7487237 - DNA, 22 bp, Homo sapiens
acccagctaaccctaccctgga

SEQ ID NO: 7487238 - DNA, 22 bp, Homo sapiens
acccagcctacaaagctcacct

SEQ ID NO: 7487239 - DNA, 22 bp, Homo sapiens
acccagctaaccctaccctgga

SEQ ID NO: 7487240 - DNA, 22 bp, Homo sapiens
acccagctaaccctaccctgga

SEQ ID NO: 7487241 - DNA, 22 bp, Homo sapiens
acccagctctttgatggtcttg

SEQ ID NO: 7487242 - DNA, 22 bp, Homo sapiens
acccagctctttgatggtcttg

SEQ ID NO: 7487243 - DNA, 22 bp, Homo sapiens
acccagctctttgatggtcttg

SEQ ID NO: 7487244 - DNA, 20 bp, Homo sapiens
acccagctctgtgccctggg

SEQ ID NO: 7487245 - DNA, 20 bp, Homo sapiens
acccagctctgtgccctggg

SEQ ID NO: 7487246 - DNA, 22 bp, Homo sapiens
acccagctggatgcatggaggc

SEQ ID NO: 7487247 - DNA, 22 bp, Homo sapiens
acccagctggatgcatggaggc

SEQ ID NO: 7487248 - DNA, 22 bp, Homo sapiens
acccagctctttgatggtcttg

SEQ ID NO: 7487249 - DNA, 22 bp, Homo sapiens
acccagctctttgatggtcttg

SEQ ID NO: 7487250 - DNA, 22 bp, Homo sapiens
acccagctgtttcccgtgtcat

SEQ ID NO: 7487251 - DNA, 22 bp, Homo sapiens
acccagctgtttcccgtgtcat

SEQ ID NO: 7487252 - DNA, 22 bp, Homo sapiens
acccagctggatgcatggaggc

SEQ ID NO: 7487253 - DNA, 22 bp, Homo sapiens
acccagctggatgcatggaggc

SEQ ID NO: 7487254 - DNA, 22 bp, Homo sapiens
acccaggagacaggttgcagtg

SEQ ID NO: 7487255 - DNA, 22 bp, Homo sapiens
acccaggagacggaggtgcagt

SEQ ID NO: 7487256 - DNA, 22 bp, Homo sapiens
acccaggagacggaggtgcagt

SEQ ID NO: 7487257 - DNA, 22 bp, Homo sapiens
acccaggagacggaggtgcagt

SEQ ID NO: 7487258 - DNA, 22 bp, Homo sapiens
acccaggagagagctataaaat

SEQ ID NO: 7487259 - DNA, 22 bp, Homo sapiens
acccaggagagagctataaaat

SEQ ID NO: 7487260 - DNA, 22 bp, Homo sapiens
acccaggagacggaggtgcagt

SEQ ID NO: 7487261 - DNA, 22 bp, Homo sapiens
acccaggagacggaggtgcagt

SEQ ID NO: 7487262 - DNA, 22 bp, Homo sapiens
acccaggacttggcaacctcat

SEQ ID NO: 7487263 - DNA, 22 bp, Homo sapiens
acccaggacttggcaacctcat

SEQ ID NO: 7487264 - DNA, 22 bp, Homo sapiens
acccaggactctcttccagtag

SEQ ID NO: 7487265 - DNA, 22 bp, Homo sapiens
acccaggactctcttccagtag

SEQ ID NO: 7487266 - DNA, 22 bp, Homo sapiens
acccaggacatgggcacccgtg

SEQ ID NO: 7487267 - DNA, 22 bp, Homo sapiens
acccaggacatgggcacccgtg

SEQ ID NO: 7487268 - DNA, 22 bp, Homo sapiens
acccaggagacaggttgcagtg

SEQ ID NO: 7487269 - DNA, 22 bp, Homo sapiens
acccaggagacaggttgcagtg

SEQ ID NO: 7487270 - DNA, 22 bp, Homo sapiens
acccaggacttggcaacctcat

SEQ ID NO: 7487271 - DNA, 22 bp, Homo sapiens
acccaggactctcttccagtag

SEQ ID NO: 7487272 - DNA, 22 bp, Homo sapiens
acccaggacttggcaacctcat

SEQ ID NO: 7487273 - DNA, 22 bp, Homo sapiens
acccaggacttggcaacctcat

SEQ ID NO: 7487274 - DNA, 22 bp, Homo sapiens
agggctgacagtgaggagtcaa

SEQ ID NO: 7487275 - DNA, 22 bp, Homo sapiens
agggctgccatttctggcccaa

SEQ ID NO: 7487276 - DNA, 22 bp, Homo sapiens
acccaggagagagctataaaat

SEQ ID NO: 7487277 - DNA, 22 bp, Homo sapiens
agggctgacagtgaggagtcaa

SEQ ID NO: 7487278 - DNA, 22 bp, Homo sapiens
agggctgacagtgaggagtcaa

SEQ ID NO: 7487279 - DNA, 22 bp, Homo sapiens
agggctgccccagtccagccgg

SEQ ID NO: 7487280 - DNA, 22 bp, Homo sapiens
agggctgccccagtccagccgg

SEQ ID NO: 7487281 - DNA, 22 bp, Homo sapiens
agggctgcccagtgtgagagct

SEQ ID NO: 7487282 - DNA, 22 bp, Homo sapiens
agggctgcccagtgtgagagct

SEQ ID NO: 7487283 - DNA, 22 bp, Homo sapiens
agggctgcccagtgtgagagct

SEQ ID NO: 7487284 - DNA, 22 bp, Homo sapiens
agggctgcccagtgtgagagct

SEQ ID NO: 7487285 - DNA, 22 bp, Homo sapiens
agggctgcccagtgtgagagct

SEQ ID NO: 7487286 - DNA, 22 bp, Homo sapiens
agggctgcccagtgtgagagct

SEQ ID NO: 7487287 - DNA, 22 bp, Homo sapiens
aggcttgggactgcttaggagc

SEQ ID NO: 7487288 - DNA, 18 bp, Homo sapiens
aggcttgggcccagcagc

SEQ ID NO: 7487289 - DNA, 18 bp, Homo sapiens
aggcttgggcccagcagc

SEQ ID NO: 7487290 - DNA, 18 bp, Homo sapiens
aggcttgggcccagcagc

SEQ ID NO: 7487291 - DNA, 18 bp, Homo sapiens
aggcttgggcccagcagc

SEQ ID NO: 7487292 - DNA, 22 bp, Homo sapiens
aggcttgggactgcttaggagc

SEQ ID NO: 7487293 - DNA, 20 bp, Homo sapiens
aggcttggcttggcaggaac

SEQ ID NO: 7487294 - DNA, 20 bp, Homo sapiens
aggcttggcttggcaggaac

SEQ ID NO: 7487295 - DNA, 20 bp, Homo sapiens
aggcttggcttggcaggaac

SEQ ID NO: 7487296 - DNA, 20 bp, Homo sapiens
aggcttggcttggcaggaac

SEQ ID NO: 7487297 - DNA, 22 bp, Homo sapiens
accagccccaccgggactgcag

SEQ ID NO: 7487298 - DNA, 20 bp, Homo sapiens
aggcttggcttggcaggaac

SEQ ID NO: 7487299 - DNA, 20 bp, Homo sapiens
aggcttggcttggcaggaac

SEQ ID NO: 7487300 - DNA, 20 bp, Homo sapiens
aggcttggcttggcaggaac

SEQ ID NO: 7487301 - DNA, 22 bp, Homo sapiens
accagccccaccgggactgcag

SEQ ID NO: 7487302 - DNA, 22 bp, Homo sapiens
accagccccaccgggactgcag

SEQ ID NO: 7487303 - DNA, 19 bp, Homo sapiens
accagcccactcccagttt

SEQ ID NO: 7487304 - DNA, 22 bp, Homo sapiens
accagccccaccgggactgcag

SEQ ID NO: 7487305 - DNA, 22 bp, Homo sapiens
accagccccaccgggactgcag

SEQ ID NO: 7487306 - DNA, 22 bp, Homo sapiens
accagccccaccgggactgcag

SEQ ID NO: 7487307 - DNA, 22 bp, Homo sapiens
accagccccaccgggactgcag

SEQ ID NO: 7487308 - DNA, 22 bp, Homo sapiens
accagccccaccgggactgcag

SEQ ID NO: 7487309 - DNA, 19 bp, Homo sapiens
aggcttggttgcagcaagc

SEQ ID NO: 7487310 - DNA, 22 bp, Homo sapiens
aggcttggttaattctgtgtga

SEQ ID NO: 7487311 - DNA, 22 bp, Homo sapiens
aggcttggttaattctgtgtga

SEQ ID NO: 7487312 - DNA, 22 bp, Homo sapiens
aggcttggtttatagaagtaat

SEQ ID NO: 7487313 - DNA, 19 bp, Homo sapiens
aggcttggttgcagcaagc

SEQ ID NO: 7487314 - DNA, 20 bp, Homo sapiens
aggcttgtgaagtatggcac

SEQ ID NO: 7487315 - DNA, 22 bp, Homo sapiens
aggcttgtgccaggcggggtgg

SEQ ID NO: 7487316 - DNA, 20 bp, Homo sapiens
aggcttgtgctttgtcactc

SEQ ID NO: 7487317 - DNA, 22 bp, Homo sapiens
aggcttgtctcagaagatgctg

SEQ ID NO: 7487318 - DNA, 22 bp, Homo sapiens
aggcttgtctcagaagatgctg

SEQ ID NO: 7487319 - DNA, 22 bp, Homo sapiens
aggcttgtcagaatggattaga

SEQ ID NO: 7487320 - DNA, 22 bp, Homo sapiens
aggcttgtaggattgagggggc

SEQ ID NO: 7487321 - DNA, 21 bp, Homo sapiens
aggcttgtaatatctcaggca

SEQ ID NO: 7487322 - DNA, 21 bp, Homo sapiens
aggcttgtaatatctcaggca

SEQ ID NO: 7487323 - DNA, 22 bp, Homo sapiens
aggcttggtgccaaggagcctg

SEQ ID NO: 7487324 - DNA, 22 bp, Homo sapiens
aggcttggtgccaaggagcctg

SEQ ID NO: 7487325 - DNA, 19 bp, Homo sapiens
aggcttggtgttgaatggg

SEQ ID NO: 7487326 - DNA, 19 bp, Homo sapiens
aggcttggtgttgaatggg

SEQ ID NO: 7487327 - DNA, 22 bp, Homo sapiens
aggcttggtgccaaggagcctg

SEQ ID NO: 7487328 - DNA, 18 bp, Homo sapiens
aggcttgggcccagcagc

SEQ ID NO: 7487329 - DNA, 21 bp, Homo sapiens
aggcttgggtaaaaaggtcat

SEQ ID NO: 7487330 - DNA, 21 bp, Homo sapiens
aggcttgggtaaaaaggtcat

SEQ ID NO: 7487331 - DNA, 21 bp, Homo sapiens
aggcttgggtaaaaaggtcat

SEQ ID NO: 7487332 - DNA, 22 bp, Homo sapiens
aggcttgggtcagaaggcttgt

SEQ ID NO: 7487333 - DNA, 22 bp, Homo sapiens
aggcttgggtcagaaggcttgt

SEQ ID NO: 7487334 - DNA, 23 bp, Homo sapiens
aggctttaatctgatattcagat

SEQ ID NO: 7487335 - DNA, 22 bp, Homo sapiens
aggctttaagtggcctacagct

SEQ ID NO: 7487336 - DNA, 22 bp, Homo sapiens
aggctttaattatctacaggag

SEQ ID NO: 7487337 - DNA, 22 bp, Homo sapiens
aggctttaagtggcctacagct

SEQ ID NO: 7487338 - DNA, 22 bp, Homo sapiens
aggctttaagcaagcatattgt

SEQ ID NO: 7487339 - DNA, 22 bp, Homo sapiens
aggctttaagcaagcatattgt

SEQ ID NO: 7487340 - DNA, 22 bp, Homo sapiens
aggcttgttttactaaaagcaa

SEQ ID NO: 7487341 - DNA, 22 bp, Homo sapiens
aggcttgttttactaaaagcaa

SEQ ID NO: 7487342 - DNA, 22 bp, Homo sapiens
aggcttgtggattggagcgagt

SEQ ID NO: 7487343 - DNA, 22 bp, Homo sapiens
aggcttgtggggaatctgtgtg

SEQ ID NO: 7487344 - DNA, 22 bp, Homo sapiens
aggcttgtggattggagcgagt

SEQ ID NO: 7487345 - DNA, 22 bp, Homo sapiens
aggcttgtttgaggatagtaat

SEQ ID NO: 7487346 - DNA, 22 bp, Homo sapiens
aggctttaattatctacaggag

SEQ ID NO: 7487347 - DNA, 21 bp, Homo sapiens
aggctttacctctgggtaggt

SEQ ID NO: 7487348 - DNA, 21 bp, Homo sapiens
aggctttacctctgggtaggt

SEQ ID NO: 7487349 - DNA, 22 bp, Homo sapiens
aggctttacgtcttcccctggg

SEQ ID NO: 7487350 - DNA, 22 bp, Homo sapiens
agggacagtatccatctcacag

SEQ ID NO: 7487351 - DNA, 22 bp, Homo sapiens
agggacagtctactgttcactg

SEQ ID NO: 7487352 - DNA, 22 bp, Homo sapiens
agggacagtatccatctcacag

SEQ ID NO: 7487353 - DNA, 22 bp, Homo sapiens
agggacagtatccatctcacag

SEQ ID NO: 7487354 - DNA, 22 bp, Homo sapiens
agggacagtctactgttcactg

SEQ ID NO: 7487355 - DNA, 22 bp, Homo sapiens
agggacagtctactgttcactg

SEQ ID NO: 7487356 - DNA, 22 bp, Homo sapiens
agggagacacatgaggaagtca

SEQ ID NO: 7487357 - DNA, 22 bp, Homo sapiens
agggagacacatgaggaagtca

SEQ ID NO: 7487358 - DNA, 22 bp, Homo sapiens
agggagacaaaagcagctgcca

SEQ ID NO: 7487359 - DNA, 22 bp, Homo sapiens
agggagacaaaagcagctgcca

SEQ ID NO: 7487360 - DNA, 22 bp, Homo sapiens
agggagacaaaagcagctgcca

SEQ ID NO: 7487361 - DNA, 22 bp, Homo sapiens
agggagacacatgaggaagtca

SEQ ID NO: 7487362 - DNA, 22 bp, Homo sapiens
agggagacacatgaggaagtca

SEQ ID NO: 7487363 - DNA, 22 bp, Homo sapiens
agggagagaagttatacaagat

SEQ ID NO: 7487364 - DNA, 22 bp, Homo sapiens
agggagagaagttatacaagat

SEQ ID NO: 7487365 - DNA, 22 bp, Homo sapiens
agggagagaagttatacaagat

SEQ ID NO: 7487366 - DNA, 22 bp, Homo sapiens
agggagagaagttatacaagat

SEQ ID NO: 7487367 - DNA, 22 bp, Homo sapiens
agggagacaaaagcagctgcca

SEQ ID NO: 7487368 - DNA, 22 bp, Homo sapiens
agggagacaaaagcagctgcca

SEQ ID NO: 7487369 - DNA, 22 bp, Homo sapiens
agggagacaaaagcagctgcca

SEQ ID NO: 7487370 - DNA, 22 bp, Homo sapiens
agggagacaaaagcagctgcca

SEQ ID NO: 7487371 - DNA, 22 bp, Homo sapiens
agggagacaaaagcagctgcca

SEQ ID NO: 7487372 - DNA, 19 bp, Homo sapiens
agggagaattccaagagga

SEQ ID NO: 7487373 - DNA, 22 bp, Homo sapiens
agggagacaaaagcagctgcca

SEQ ID NO: 7487374 - DNA, 22 bp, Homo sapiens
agggacagtctactgttcactg

SEQ ID NO: 7487375 - DNA, 19 bp, Homo sapiens
agggagaattccaagagga

SEQ ID NO: 7487376 - DNA, 22 bp, Homo sapiens
accagcatcacctggaggcctg

SEQ ID NO: 7487377 - DNA, 22 bp, Homo sapiens
accagcagttatgaggccagga

SEQ ID NO: 7487378 - DNA, 22 bp, Homo sapiens
accagcagttatgaggccagga

SEQ ID NO: 7487379 - DNA, 21 bp, Homo sapiens
accagcattccacactgtccc

SEQ ID NO: 7487380 - DNA, 22 bp, Homo sapiens
accagcatccttcctattaaca

SEQ ID NO: 7487381 - DNA, 22 bp, Homo sapiens
accagcatccttcctattaaca

SEQ ID NO: 7487382 - DNA, 22 bp, Homo sapiens
accagcattggacttagaatgc

SEQ ID NO: 7487383 - DNA, 21 bp, Homo sapiens
accagcattccacactgtccc

SEQ ID NO: 7487384 - DNA, 22 bp, Homo sapiens
accagcattgctttgggttata

SEQ ID NO: 7487385 - DNA, 22 bp, Homo sapiens
accagccaccaccaggagatcg

SEQ ID NO: 7487386 - DNA, 22 bp, Homo sapiens
accagccaagactgcctggaat

SEQ ID NO: 7487387 - DNA, 22 bp, Homo sapiens
accagcatttgcagaaatggag

SEQ ID NO: 7487388 - DNA, 22 bp, Homo sapiens
accagccagccacagtggctcc

SEQ ID NO: 7487389 - DNA, 22 bp, Homo sapiens
accagccagccacagtggctcc

SEQ ID NO: 7487390 - DNA, 22 bp, Homo sapiens
accagccaccaccaggagatcg

SEQ ID NO: 7487391 - DNA, 22 bp, Homo sapiens
accagccaccaccaggagatcg

SEQ ID NO: 7487392 - DNA, 22 bp, Homo sapiens
accagccaccaccaggagatcg

SEQ ID NO: 7487393 - DNA, 19 bp, Homo sapiens
accagcccactcccagttt

SEQ ID NO: 7487394 - DNA, 19 bp, Homo sapiens
accagcccactcccagttt

SEQ ID NO: 7487395 - DNA, 19 bp, Homo sapiens
accagcccactcccagttt

SEQ ID NO: 7487396 - DNA, 19 bp, Homo sapiens
accagcccactcccagttt

SEQ ID NO: 7487397 - DNA, 22 bp, Homo sapiens
accagcaggtggcagtatgtat

SEQ ID NO: 7487398 - DNA, 22 bp, Homo sapiens
accagcaggtggcagtatgtat

SEQ ID NO: 7487399 - DNA, 22 bp, Homo sapiens
accagcagttatgaggccagga

SEQ ID NO: 7487400 - DNA, 22 bp, Homo sapiens
accagcagttatgaggccagga

SEQ ID NO: 7487401 - DNA, 22 bp, Homo sapiens
accagcagttatgaggccagga

SEQ ID NO: 7487402 - DNA, 22 bp, Homo sapiens
accagcagttatgaggccagga

SEQ ID NO: 7487403 - DNA, 22 bp, Homo sapiens
accagcagttatgaggccagga

SEQ ID NO: 7487404 - DNA, 22 bp, Homo sapiens
accagcagttatgaggccagga

SEQ ID NO: 7487405 - DNA, 22 bp, Homo sapiens
accagcagttatgaggccagga

SEQ ID NO: 7487406 - DNA, 22 bp, Homo sapiens
accagcagttatgaggccagga

SEQ ID NO: 7487407 - DNA, 22 bp, Homo sapiens
accagcagttatgaggccagga

SEQ ID NO: 7487408 - DNA, 22 bp, Homo sapiens
accagcagttatgaggccagga

SEQ ID NO: 7487409 - DNA, 22 bp, Homo sapiens
accagcagggctgggccaatgg

SEQ ID NO: 7487410 - DNA, 22 bp, Homo sapiens
accagcaggccaggggcactgc

SEQ ID NO: 7487411 - DNA, 22 bp, Homo sapiens
accagcaggccaggggcactgc

SEQ ID NO: 7487412 - DNA, 22 bp, Homo sapiens
accagcagggctgggccaatgg

SEQ ID NO: 7487413 - DNA, 22 bp, Homo sapiens
accagcagggctgggccaatgg

SEQ ID NO: 7487414 - DNA, 22 bp, Homo sapiens
accagcaggtggcagtatgtat

SEQ ID NO: 7487415 - DNA, 22 bp, Homo sapiens
accagcagcctagagcgttctt

SEQ ID NO: 7487416 - DNA, 22 bp, Homo sapiens
accagcagcctagagcgttctt

SEQ ID NO: 7487417 - DNA, 22 bp, Homo sapiens
accagagctggcagagtatcaa

SEQ ID NO: 7487418 - DNA, 22 bp, Homo sapiens
accagcagctgccagagtggag

SEQ ID NO: 7487419 - DNA, 22 bp, Homo sapiens
accagcagcctagagcgttctt

SEQ ID NO: 7487420 - DNA, 22 bp, Homo sapiens
accagcagctgccagagtggag

SEQ ID NO: 7487421 - DNA, 22 bp, Homo sapiens
accagcagctgccagagtggag

SEQ ID NO: 7487422 - DNA, 21 bp, Homo sapiens
accagcaggagatcagaagga

SEQ ID NO: 7487423 - DNA, 21 bp, Homo sapiens
accagcaggagatcagaagga

SEQ ID NO: 7487424 - DNA, 22 bp, Homo sapiens
accagcagctgcgggccactgc

SEQ ID NO: 7487425 - DNA, 22 bp, Homo sapiens
accagcagctgcgggccactgc

SEQ ID NO: 7487426 - DNA, 22 bp, Homo sapiens
accagcagctgcgggccactgc

SEQ ID NO: 7487427 - DNA, 22 bp, Homo sapiens
accagcagctgccagagtggag

SEQ ID NO: 7487428 - DNA, 22 bp, Homo sapiens
accagcagctgccagagtggag

SEQ ID NO: 7487429 - DNA, 22 bp, Homo sapiens
acatttgtctggctagaaagtt

SEQ ID NO: 7487430 - DNA, 22 bp, Homo sapiens
accagagctcttcagcacagga

SEQ ID NO: 7487431 - DNA, 22 bp, Homo sapiens
accagagctggctctgagcacc

SEQ ID NO: 7487432 - DNA, 22 bp, Homo sapiens
accagagctggcagagtatcaa

SEQ ID NO: 7487433 - DNA, 22 bp, Homo sapiens
acatttgtctggctagaaagtt

SEQ ID NO: 7487434 - DNA, 22 bp, Homo sapiens
acatttgtatgcgtttttactg

SEQ ID NO: 7487435 - DNA, 22 bp, Homo sapiens
acatttgtatgcgtttttactg

SEQ ID NO: 7487436 - DNA, 22 bp, Homo sapiens
agggagaggagcgtttcacatc

SEQ ID NO: 7487437 - DNA, 22 bp, Homo sapiens
agggagaggagcgtttcacatc

SEQ ID NO: 7487438 - DNA, 22 bp, Homo sapiens
agggagaggagcgtttcacatc

SEQ ID NO: 7487439 - DNA, 22 bp, Homo sapiens
agggagaggagcgtttcacatc

SEQ ID NO: 7487440 - DNA, 16 bp, Homo sapiens
agggagagaggaacat

SEQ ID NO: 7487441 - DNA, 16 bp, Homo sapiens
agggagagaggaacat

SEQ ID NO: 7487442 - DNA, 18 bp, Homo sapiens
agggagagaccgcgggtc

SEQ ID NO: 7487443 - DNA, 16 bp, Homo sapiens
agggagagaggaacat

SEQ ID NO: 7487444 - DNA, 18 bp, Homo sapiens
agggagagaccgcgggtc

SEQ ID NO: 7487445 - DNA, 18 bp, Homo sapiens
agggagagaccgcgggtc

SEQ ID NO: 7487446 - DNA, 22 bp, Homo sapiens
agggagaggagggtcttgttga

SEQ ID NO: 7487447 - DNA, 22 bp, Homo sapiens
agggagaggagcgtttcacatc

SEQ ID NO: 7487448 - DNA, 22 bp, Homo sapiens
agggagaggagcgtttcacatc

SEQ ID NO: 7487449 - DNA, 22 bp, Homo sapiens
agggagaggagcgtttcacatc

SEQ ID NO: 7487450 - DNA, 22 bp, Homo sapiens
agggagaggagggtcttgttga

SEQ ID NO: 7487451 - DNA, 22 bp, Homo sapiens
agggagaggctgaactatccta

SEQ ID NO: 7487452 - DNA, 16 bp, Homo sapiens
agggagagaggaacat

SEQ ID NO: 7487453 - DNA, 22 bp, Homo sapiens
agggagaggagggtcttgttga

SEQ ID NO: 7487454 - DNA, 22 bp, Homo sapiens
agggagagaagttatacaagat

SEQ ID NO: 7487455 - DNA, 22 bp, Homo sapiens
agggagagaagttatacaagat

SEQ ID NO: 7487456 - DNA, 22 bp, Homo sapiens
agggagagaagttatacaagat

SEQ ID NO: 7487457 - DNA, 22 bp, Homo sapiens
agggagagaagttatacaagat

SEQ ID NO: 7487458 - DNA, 22 bp, Homo sapiens
agggagagacatttccttcttg

SEQ ID NO: 7487459 - DNA, 22 bp, Homo sapiens
agggagagacatttccttcttg

SEQ ID NO: 7487460 - DNA, 22 bp, Homo sapiens
agggagagacatttccttcttg

SEQ ID NO: 7487461 - DNA, 22 bp, Homo sapiens
agggagagacatttccttcttg

SEQ ID NO: 7487462 - DNA, 22 bp, Homo sapiens
agggagagacatttccttcttg

SEQ ID NO: 7487463 - DNA, 22 bp, Homo sapiens
agggagagacatttccttcttg

SEQ ID NO: 7487464 - DNA, 18 bp, Homo sapiens
agggagagaccgcgggtc

SEQ ID NO: 7487465 - DNA, 18 bp, Homo sapiens
agggagagaccgcgggtc

SEQ ID NO: 7487466 - DNA, 18 bp, Homo sapiens
agggagagaccgcgggtc

SEQ ID NO: 7487467 - DNA, 18 bp, Homo sapiens
agggagagaccgcgggtc

SEQ ID NO: 7487468 - DNA, 18 bp, Homo sapiens
agggagagaccgcgggtc

SEQ ID NO: 7487469 - DNA, 18 bp, Homo sapiens
agggagagaccgcgggtc

SEQ ID NO: 7487470 - DNA, 18 bp, Homo sapiens
agggagagaccgcgggtc

SEQ ID NO: 7487471 - DNA, 17 bp, Homo sapiens
accagcctctcctgggg

SEQ ID NO: 7487472 - DNA, 17 bp, Homo sapiens
accagcctctcctgggg

SEQ ID NO: 7487473 - DNA, 22 bp, Homo sapiens
accagcctggccaacatggcaa

SEQ ID NO: 7487474 - DNA, 22 bp, Homo sapiens
accagcctggccaacatggcaa

SEQ ID NO: 7487475 - DNA, 22 bp, Homo sapiens
accagcctggccaacatggcaa

SEQ ID NO: 7487476 - DNA, 22 bp, Homo sapiens
accagcctggccaacatggcaa

SEQ ID NO: 7487477 - DNA, 22 bp, Homo sapiens
accagcctggccaacatggcaa

SEQ ID NO: 7487478 - DNA, 22 bp, Homo sapiens
accagcctggccaacatggcaa

SEQ ID NO: 7487479 - DNA, 22 bp, Homo sapiens
agggagaggctgaactatccta

SEQ ID NO: 7487480 - DNA, 22 bp, Homo sapiens
accagccccaccgggactgcag

SEQ ID NO: 7487481 - DNA, 22 bp, Homo sapiens
accagccctcaggtcagatact

SEQ ID NO: 7487482 - DNA, 22 bp, Homo sapiens
accagccctcaggtcagatact

SEQ ID NO: 7487483 - DNA, 22 bp, Homo sapiens
agggagaggctgaactatccta

SEQ ID NO: 7487484 - DNA, 22 bp, Homo sapiens
accagccctcaggtcagatact

SEQ ID NO: 7487485 - DNA, 22 bp, Homo sapiens
accagccctcaggtcagatact

SEQ ID NO: 7487486 - DNA, 17 bp, Homo sapiens
accagcctctcctgggg

SEQ ID NO: 7487487 - DNA, 17 bp, Homo sapiens
accagcctctcctgggg

SEQ ID NO: 7487488 - DNA, 22 bp, Homo sapiens
accagcctcctagctgctcctg

SEQ ID NO: 7487489 - DNA, 22 bp, Homo sapiens
accagcctcctagctgctcctg

SEQ ID NO: 7487490 - DNA, 22 bp, Homo sapiens
accagcctcctagctgctcctg

SEQ ID NO: 7487491 - DNA, 22 bp, Homo sapiens
accagctcagaagccagaaaga

SEQ ID NO: 7487492 - DNA, 22 bp, Homo sapiens
accagctagggtagcacatctc

SEQ ID NO: 7487493 - DNA, 22 bp, Homo sapiens
accagcctgtctgagtcgtggg

SEQ ID NO: 7487494 - DNA, 22 bp, Homo sapiens
accagctagggtagcacatctc

SEQ ID NO: 7487495 - DNA, 22 bp, Homo sapiens
accagcctgtctgagtcgtggg

SEQ ID NO: 7487496 - DNA, 22 bp, Homo sapiens
accagctcagagcaggctcctg

SEQ ID NO: 7487497 - DNA, 22 bp, Homo sapiens
accagctcagaagccagaaaga

SEQ ID NO: 7487498 - DNA, 22 bp, Homo sapiens
accagctcagaagccagaaaga

SEQ ID NO: 7487499 - DNA, 22 bp, Homo sapiens
accagctcagaagccagaaaga

SEQ ID NO: 7487500 - DNA, 22 bp, Homo sapiens
accagctcataattttcaaaac

SEQ ID NO: 7487501 - DNA, 22 bp, Homo sapiens
accagctcagagcaggctcctg

SEQ ID NO: 7487502 - DNA, 22 bp, Homo sapiens
accagctcagagcaggctcctg

SEQ ID NO: 7487503 - DNA, 22 bp, Homo sapiens
accagctcagagcaggctcctg

SEQ ID NO: 7487504 - DNA, 22 bp, Homo sapiens
accagcctggccaacatggtga

SEQ ID NO: 7487505 - DNA, 22 bp, Homo sapiens
accagcctggccaacatggcaa

SEQ ID NO: 7487506 - DNA, 22 bp, Homo sapiens
accagcctggccaacatggtga

SEQ ID NO: 7487507 - DNA, 22 bp, Homo sapiens
accagcctggccaacatggtga

SEQ ID NO: 7487508 - DNA, 22 bp, Homo sapiens
accagcctggccaacatggtga

SEQ ID NO: 7487509 - DNA, 22 bp, Homo sapiens
accagcctgtctgagtcgtggg

SEQ ID NO: 7487510 - DNA, 22 bp, Homo sapiens
accagcctggccaacatggtga

SEQ ID NO: 7487511 - DNA, 22 bp, Homo sapiens
accagcctgtctgagtcgtggg

SEQ ID NO: 7487512 - DNA, 22 bp, Homo sapiens
agggcagcaatgcagctgctgc

SEQ ID NO: 7487513 - DNA, 22 bp, Homo sapiens
agggcagcaatgcagctgctgc

SEQ ID NO: 7487514 - DNA, 22 bp, Homo sapiens
agggcagcaatgcagctgctgc

SEQ ID NO: 7487515 - DNA, 22 bp, Homo sapiens
agggcagcaatttggttcctgg

SEQ ID NO: 7487516 - DNA, 22 bp, Homo sapiens
agggcagcaatttggttcctgg

SEQ ID NO: 7487517 - DNA, 22 bp, Homo sapiens
agggcagcaatttggttcctgg

SEQ ID NO: 7487518 - DNA, 22 bp, Homo sapiens
agggcagcaatttggttcctgg

SEQ ID NO: 7487519 - DNA, 22 bp, Homo sapiens
agggcagcaatttggttcctgg

SEQ ID NO: 7487520 - DNA, 22 bp, Homo sapiens
agggcagcacaaggcatggact

SEQ ID NO: 7487521 - DNA, 22 bp, Homo sapiens
agggcagcacaaggcatggact

SEQ ID NO: 7487522 - DNA, 22 bp, Homo sapiens
agggcagcacaaggcatggact

SEQ ID NO: 7487523 - DNA, 22 bp, Homo sapiens
agggcagcacaaggcatggact

SEQ ID NO: 7487524 - DNA, 22 bp, Homo sapiens
agggcagcacaaggcatggact

SEQ ID NO: 7487525 - DNA, 22 bp, Homo sapiens
agggcagcacaaggcatggact

SEQ ID NO: 7487526 - DNA, 22 bp, Homo sapiens
agggcagcacaaggcatggact

SEQ ID NO: 7487527 - DNA, 22 bp, Homo sapiens
agggcagcacagctgtgctcct

SEQ ID NO: 7487528 - DNA, 22 bp, Homo sapiens
agggcagcacagctgtgctcct

SEQ ID NO: 7487529 - DNA, 22 bp, Homo sapiens
agggcagcacagctgtgctcct

SEQ ID NO: 7487530 - DNA, 22 bp, Homo sapiens
agggcagcacaaggcatggact

SEQ ID NO: 7487531 - DNA, 22 bp, Homo sapiens
agggcagcacaaggcatggact

SEQ ID NO: 7487532 - DNA, 22 bp, Homo sapiens
agggcagcagctcctcctagct

SEQ ID NO: 7487533 - DNA, 19 bp, Homo sapiens
accaggcctcagaggccct

SEQ ID NO: 7487534 - DNA, 19 bp, Homo sapiens
accaggcctcagaggccct

SEQ ID NO: 7487535 - DNA, 22 bp, Homo sapiens
agggcagcagcggcccaggcct

SEQ ID NO: 7487536 - DNA, 22 bp, Homo sapiens
agggcagcagcggcccaggcct

SEQ ID NO: 7487537 - DNA, 22 bp, Homo sapiens
agggcagcagcccatggctctg

SEQ ID NO: 7487538 - DNA, 22 bp, Homo sapiens
agggcagcagcggcccaggcct

SEQ ID NO: 7487539 - DNA, 22 bp, Homo sapiens
agggcagcagcggcccaggcct

SEQ ID NO: 7487540 - DNA, 22 bp, Homo sapiens
agggcagcacagctgtgctcct

SEQ ID NO: 7487541 - DNA, 22 bp, Homo sapiens
agggcagcacagctgtgctcct

SEQ ID NO: 7487542 - DNA, 22 bp, Homo sapiens
agggcagcagcccatggctctg

SEQ ID NO: 7487543 - DNA, 22 bp, Homo sapiens
agggcagcacagctgtgctcct

SEQ ID NO: 7487544 - DNA, 22 bp, Homo sapiens
agggcagcacagctgtgctcct

SEQ ID NO: 7487545 - DNA, 22 bp, Homo sapiens
agggcagcagcccatggctctg

SEQ ID NO: 7487546 - DNA, 22 bp, Homo sapiens
agggcagcagcccatggctctg

SEQ ID NO: 7487547 - DNA, 22 bp, Homo sapiens
agggcagcagcccatggctctg

SEQ ID NO: 7487548 - DNA, 22 bp, Homo sapiens
agggcagcagcccatggctctg

SEQ ID NO: 7487549 - DNA, 22 bp, Homo sapiens
agggcagcagcccatggctctg

SEQ ID NO: 7487550 - DNA, 22 bp, Homo sapiens
agggcagcaaagtttgacctca

SEQ ID NO: 7487551 - DNA, 22 bp, Homo sapiens
agggcagcaaagtttgacctca

SEQ ID NO: 7487552 - DNA, 22 bp, Homo sapiens
agggcagcaatgcagctgctgc

SEQ ID NO: 7487553 - DNA, 22 bp, Homo sapiens
agggcagcaatgcagctgctgc

SEQ ID NO: 7487554 - DNA, 22 bp, Homo sapiens
agggcagcaatgcagctgctgc

SEQ ID NO: 7487555 - DNA, 22 bp, Homo sapiens
agggcagcaaagtttgacctca

SEQ ID NO: 7487556 - DNA, 22 bp, Homo sapiens
agggcagcaatgcagctgctgc

SEQ ID NO: 7487557 - DNA, 22 bp, Homo sapiens
agggcagcaatgcagctgctgc

SEQ ID NO: 7487558 - DNA, 22 bp, Homo sapiens
agggcagcaatgcagctgctgc

SEQ ID NO: 7487559 - DNA, 22 bp, Homo sapiens
agggcagcaatgcagctgctgc

SEQ ID NO: 7487560 - DNA, 22 bp, Homo sapiens
agggcagcaatgcagctgctgc

SEQ ID NO: 7487561 - DNA, 21 bp, Homo sapiens
agggcagattagctgtaagag

SEQ ID NO: 7487562 - DNA, 21 bp, Homo sapiens
agggcagattagctgtaagag

SEQ ID NO: 7487563 - DNA, 22 bp, Homo sapiens
agggcagatggaacttccccga

SEQ ID NO: 7487564 - DNA, 22 bp, Homo sapiens
agggcactttacccatagcttg

SEQ ID NO: 7487565 - DNA, 22 bp, Homo sapiens
agggcagcaaagtttgacctca

SEQ ID NO: 7487566 - DNA, 22 bp, Homo sapiens
agggcagcaaagtttgacctca

SEQ ID NO: 7487567 - DNA, 21 bp, Homo sapiens
agggcagattagctgtaagag

SEQ ID NO: 7487568 - DNA, 22 bp, Homo sapiens
accagctctctagccctggtcc

SEQ ID NO: 7487569 - DNA, 22 bp, Homo sapiens
accagctccaggcccctgctgg

SEQ ID NO: 7487570 - DNA, 22 bp, Homo sapiens
accagctctggacaggcatttc

SEQ ID NO: 7487571 - DNA, 22 bp, Homo sapiens
accagctctctagccctggtcc

SEQ ID NO: 7487572 - DNA, 22 bp, Homo sapiens
accagctccaggcccctgctgg

SEQ ID NO: 7487573 - DNA, 22 bp, Homo sapiens
accagctccaggcccctgctgg

SEQ ID NO: 7487574 - DNA, 22 bp, Homo sapiens
accagctccaggcccctgctgg

SEQ ID NO: 7487575 - DNA, 22 bp, Homo sapiens
accagctccaggcccctgctga

SEQ ID NO: 7487576 - DNA, 22 bp, Homo sapiens
accagctccaggcccctgctga

SEQ ID NO: 7487577 - DNA, 22 bp, Homo sapiens
accagctccaggcccctgctga

SEQ ID NO: 7487578 - DNA, 22 bp, Homo sapiens
accagctccaggcccctgctga

SEQ ID NO: 7487579 - DNA, 22 bp, Homo sapiens
accagctcttctgctctagttg

SEQ ID NO: 7487580 - DNA, 22 bp, Homo sapiens
accagctctggacaggcatttc

SEQ ID NO: 7487581 - DNA, 22 bp, Homo sapiens
accagctctggacaggcatttc

SEQ ID NO: 7487582 - DNA, 22 bp, Homo sapiens
agggcacttcagtcagactgag

SEQ ID NO: 7487583 - DNA, 22 bp, Homo sapiens
agggcacttcagtcagactgag

SEQ ID NO: 7487584 - DNA, 22 bp, Homo sapiens
agggcacttcctctgggtccct

SEQ ID NO: 7487585 - DNA, 22 bp, Homo sapiens
agggcacttcctctgggtccct

SEQ ID NO: 7487586 - DNA, 22 bp, Homo sapiens
agggcacttgaggctgggcctg

SEQ ID NO: 7487587 - DNA, 22 bp, Homo sapiens
agggcacttgaggctgggcctg

SEQ ID NO: 7487588 - DNA, 22 bp, Homo sapiens
acattggtcactgaagaatgag

SEQ ID NO: 7487589 - DNA, 22 bp, Homo sapiens
acattgcaattaggtacctatg

SEQ ID NO: 7487590 - DNA, 19 bp, Homo sapiens
acattggacatggatcttg

SEQ ID NO: 7487591 - DNA, 22 bp, Homo sapiens
acattgtaaatacctttatcac

SEQ ID NO: 7487592 - DNA, 22 bp, Homo sapiens
acattgtaaatacctttatcac

SEQ ID NO: 7487593 - DNA, 22 bp, Homo sapiens
acattgtaaatacctttatcac

SEQ ID NO: 7487594 - DNA, 22 bp, Homo sapiens
acattgtaagcatattagctga

SEQ ID NO: 7487595 - DNA, 22 bp, Homo sapiens
acattgtagacttttcatatgt

SEQ ID NO: 7487596 - DNA, 22 bp, Homo sapiens
acattgtagacttttcatatgt

SEQ ID NO: 7487597 - DNA, 22 bp, Homo sapiens
acattgtagacttttcatatgt

SEQ ID NO: 7487598 - DNA, 22 bp, Homo sapiens
acattgtagttgttctgcagca

SEQ ID NO: 7487599 - DNA, 22 bp, Homo sapiens
acattgtagttgttctgcagca

SEQ ID NO: 7487600 - DNA, 22 bp, Homo sapiens
acattgtataatgattatcaca

SEQ ID NO: 7487601 - DNA, 22 bp, Homo sapiens
acattgtataatgattatcaca

SEQ ID NO: 7487602 - DNA, 22 bp, Homo sapiens
acattgtatacagacttagtca

SEQ ID NO: 7487603 - DNA, 22 bp, Homo sapiens
acattgtatacagacttagtca

SEQ ID NO: 7487604 - DNA, 22 bp, Homo sapiens
acattgtataatgattatcaca

SEQ ID NO: 7487605 - DNA, 22 bp, Homo sapiens
acattgtataatgattatcaca

SEQ ID NO: 7487606 - DNA, 22 bp, Homo sapiens
acattgtataatgattatcaca

SEQ ID NO: 7487607 - DNA, 22 bp, Homo sapiens
acattgtataatgattatcaca

SEQ ID NO: 7487608 - DNA, 22 bp, Homo sapiens
acattgtataatgattatcaca

SEQ ID NO: 7487609 - DNA, 22 bp, Homo sapiens
acatttcagaatcacacagctt

SEQ ID NO: 7487610 - DNA, 22 bp, Homo sapiens
acatttcagaatcacacagctt

SEQ ID NO: 7487611 - DNA, 22 bp, Homo sapiens
acatttcactgttcacagcagg

SEQ ID NO: 7487612 - DNA, 22 bp, Homo sapiens
acatttcagaatcacacagctt

SEQ ID NO: 7487613 - DNA, 22 bp, Homo sapiens
acatttcctaacgtatacactg

SEQ ID NO: 7487614 - DNA, 22 bp, Homo sapiens
acatttcctaacgtatacactg

SEQ ID NO: 7487615 - DNA, 22 bp, Homo sapiens
acatttcatttgcagtatggat

SEQ ID NO: 7487616 - DNA, 22 bp, Homo sapiens
acatttctaatttaatgtaaca

SEQ ID NO: 7487617 - DNA, 22 bp, Homo sapiens
acatttcgtgctctgttttgtt

SEQ ID NO: 7487618 - DNA, 17 bp, Homo sapiens
acatttcctaactgaag

SEQ ID NO: 7487619 - DNA, 22 bp, Homo sapiens
acatttccacagactgaggtca

SEQ ID NO: 7487620 - DNA, 17 bp, Homo sapiens
acatttcctaactgaag

SEQ ID NO: 7487621 - DNA, 22 bp, Homo sapiens
acatttctaatttaatgtaaca

SEQ ID NO: 7487622 - DNA, 22 bp, Homo sapiens
acatttctaatttaatgtaaca

SEQ ID NO: 7487623 - DNA, 22 bp, Homo sapiens
acatttctaatttaatgtaaca

SEQ ID NO: 7487624 - DNA, 22 bp, Homo sapiens
acatttctaatttaatgtaaca

SEQ ID NO: 7487625 - DNA, 22 bp, Homo sapiens
acatttctaatttaatgtaaca

SEQ ID NO: 7487626 - DNA, 22 bp, Homo sapiens
acatttctaatttaatgtaaca

SEQ ID NO: 7487627 - DNA, 22 bp, Homo sapiens
acatttctaatttaatgtaaca

SEQ ID NO: 7487628 - DNA, 18 bp, Homo sapiens
acatttctaggtgaaagc

SEQ ID NO: 7487629 - DNA, 18 bp, Homo sapiens
acatttctaggtgaaagc

SEQ ID NO: 7487630 - DNA, 18 bp, Homo sapiens
acatttctaggtgaaagc

SEQ ID NO: 7487631 - DNA, 18 bp, Homo sapiens
acatttctaggtgaaagc

SEQ ID NO: 7487632 - DNA, 18 bp, Homo sapiens
acatttctaggtgaaagc

SEQ ID NO: 7487633 - DNA, 22 bp, Homo sapiens
acatttctaatttaatgtaaca

SEQ ID NO: 7487634 - DNA, 22 bp, Homo sapiens
acatttctaatttaatgtaaca

SEQ ID NO: 7487635 - DNA, 22 bp, Homo sapiens
acatttctaatttaatgtaaca

SEQ ID NO: 7487636 - DNA, 18 bp, Homo sapiens
acatttctatgcttctgg

SEQ ID NO: 7487637 - DNA, 18 bp, Homo sapiens
acatttctatgcttctgg

SEQ ID NO: 7487638 - DNA, 18 bp, Homo sapiens
acatttctatgcttctgg

SEQ ID NO: 7487639 - DNA, 22 bp, Homo sapiens
acatttctatcatcctgtaatg

SEQ ID NO: 7487640 - DNA, 22 bp, Homo sapiens
acatttctatcatcctgtaatg

SEQ ID NO: 7487641 - DNA, 22 bp, Homo sapiens
acatttctatcatcctgtaatg

SEQ ID NO: 7487642 - DNA, 22 bp, Homo sapiens
acatttctatagtgcatctgtt

SEQ ID NO: 7487643 - DNA, 22 bp, Homo sapiens
acatttctatagtgcatctgtt

SEQ ID NO: 7487644 - DNA, 22 bp, Homo sapiens
acatttctatagtgcatctgtt

SEQ ID NO: 7487645 - DNA, 22 bp, Homo sapiens
acatttctatagtgcatctgtt

SEQ ID NO: 7487646 - DNA, 22 bp, Homo sapiens
acatttctatagtgcatctgtt

SEQ ID NO: 7487647 - DNA, 22 bp, Homo sapiens
acatttctagttgttcatctcc

SEQ ID NO: 7487648 - DNA, 22 bp, Homo sapiens
acatttctagttgttcatctcc

SEQ ID NO: 7487649 - DNA, 22 bp, Homo sapiens
acatttctagttgttcatctcc

SEQ ID NO: 7487650 - DNA, 22 bp, Homo sapiens
acatttctagttgttcatctcc

SEQ ID NO: 7487651 - DNA, 22 bp, Homo sapiens
acatttctagttgttcatctcc

SEQ ID NO: 7487652 - DNA, 22 bp, Homo sapiens
acatttctagttgttcatctcc

SEQ ID NO: 7487653 - DNA, 22 bp, Homo sapiens
acatttctagttgttcatctcc

SEQ ID NO: 7487654 - DNA, 22 bp, Homo sapiens
acatttctagttgttcatctcc

SEQ ID NO: 7487655 - DNA, 22 bp, Homo sapiens
aggctgagaaagtgggaagatg

SEQ ID NO: 7487656 - DNA, 22 bp, Homo sapiens
aggctgagaaagtgggaagatg

SEQ ID NO: 7487657 - DNA, 22 bp, Homo sapiens
aggctgagaaagtgggaagatg

SEQ ID NO: 7487658 - DNA, 22 bp, Homo sapiens
aggctgagaaagtgggaagatg

SEQ ID NO: 7487659 - DNA, 22 bp, Homo sapiens
aggctgagaaagtgggaagatg

SEQ ID NO: 7487660 - DNA, 22 bp, Homo sapiens
aggctgagaaagtgggaagatg

SEQ ID NO: 7487661 - DNA, 22 bp, Homo sapiens
aggctgagaaagtgggaagatg

SEQ ID NO: 7487662 - DNA, 22 bp, Homo sapiens
aggctgagaaagtgggaagatg

SEQ ID NO: 7487663 - DNA, 22 bp, Homo sapiens
aggctgagaaagtgggaagatg

SEQ ID NO: 7487664 - DNA, 22 bp, Homo sapiens
aggctgagaaagtgggaagatg

SEQ ID NO: 7487665 - DNA, 22 bp, Homo sapiens
aggctgagactgtgcattagtg

SEQ ID NO: 7487666 - DNA, 22 bp, Homo sapiens
aggctgagactgtgcattagtg

SEQ ID NO: 7487667 - DNA, 22 bp, Homo sapiens
aggctgagaaagtgggaagatg

SEQ ID NO: 7487668 - DNA, 22 bp, Homo sapiens
aggctgagactgtgcattagtg

SEQ ID NO: 7487669 - DNA, 22 bp, Homo sapiens
aggctgagactgtgcattagtg

SEQ ID NO: 7487670 - DNA, 22 bp, Homo sapiens
acattgatatttcaaatacagg

SEQ ID NO: 7487671 - DNA, 22 bp, Homo sapiens
acattgatatttcaaatacagg

SEQ ID NO: 7487672 - DNA, 22 bp, Homo sapiens
acattgcaataataattctctt

SEQ ID NO: 7487673 - DNA, 20 bp, Homo sapiens
acattgattatgtttgtaga

SEQ ID NO: 7487674 - DNA, 22 bp, Homo sapiens
acattgcaattaggtacctatg

SEQ ID NO: 7487675 - DNA, 22 bp, Homo sapiens
acattgcaattaggtacctatg

SEQ ID NO: 7487676 - DNA, 22 bp, Homo sapiens
acattgctgatatcaatttttg

SEQ ID NO: 7487677 - DNA, 22 bp, Homo sapiens
acattgatgatcccacttacag

SEQ ID NO: 7487678 - DNA, 22 bp, Homo sapiens
acattgatgaaaaggtatcatt

SEQ ID NO: 7487679 - DNA, 22 bp, Homo sapiens
acattgatcagcctcccatgca

SEQ ID NO: 7487680 - DNA, 20 bp, Homo sapiens
acattgattatgtttgtaga

SEQ ID NO: 7487681 - DNA, 22 bp, Homo sapiens
acattgatgtgatgcagaagtg

SEQ ID NO: 7487682 - DNA, 22 bp, Homo sapiens
acattgatgtgatgcagaagtg

SEQ ID NO: 7487683 - DNA, 18 bp, Homo sapiens
acattgatggctttaagc

SEQ ID NO: 7487684 - DNA, 18 bp, Homo sapiens
acattgatggctttaagc

SEQ ID NO: 7487685 - DNA, 18 bp, Homo sapiens
acattgatggctttaagc

SEQ ID NO: 7487686 - DNA, 22 bp, Homo sapiens
aggcctgaggttcctgtgctca

SEQ ID NO: 7487687 - DNA, 22 bp, Homo sapiens
aggcctgaggttcctgtgctca

SEQ ID NO: 7487688 - DNA, 22 bp, Homo sapiens
aggcctgcagcaggagcaaacc

SEQ ID NO: 7487689 - DNA, 18 bp, Homo sapiens
aggcctgcccagcactgt

SEQ ID NO: 7487690 - DNA, 18 bp, Homo sapiens
aggcctgcccagcactgt

SEQ ID NO: 7487691 - DNA, 18 bp, Homo sapiens
aggcctgcccagcactgt

SEQ ID NO: 7487692 - DNA, 22 bp, Homo sapiens
aggcctgcccgtgggacctgtg

SEQ ID NO: 7487693 - DNA, 22 bp, Homo sapiens
aggcctgcccgtgggacctgtg

SEQ ID NO: 7487694 - DNA, 22 bp, Homo sapiens
aggcctgcccgtgggacctgtg

SEQ ID NO: 7487695 - DNA, 22 bp, Homo sapiens
aggctctggctactacagagct

SEQ ID NO: 7487696 - DNA, 22 bp, Homo sapiens
aggctctgggaacagacgggtg

SEQ ID NO: 7487697 - DNA, 22 bp, Homo sapiens
aggctctgttattctagagggc

SEQ ID NO: 7487698 - DNA, 22 bp, Homo sapiens
aggctctgttattctagagggc

SEQ ID NO: 7487699 - DNA, 22 bp, Homo sapiens
aggcctgcccgtgggacctgtg

SEQ ID NO: 7487700 - DNA, 22 bp, Homo sapiens
aggcctgcccgtgggacctgtg

SEQ ID NO: 7487701 - DNA, 22 bp, Homo sapiens
aggcctgcccgtgggacctgtg

SEQ ID NO: 7487702 - DNA, 22 bp, Homo sapiens
aggctctgttattctagagggc

SEQ ID NO: 7487703 - DNA, 22 bp, Homo sapiens
aggctctgttattctagagggc

SEQ ID NO: 7487704 - DNA, 22 bp, Homo sapiens
aggctctgtttgctgtggtacc

SEQ ID NO: 7487705 - DNA, 22 bp, Homo sapiens
aggctctgtttgctgtggtacc

SEQ ID NO: 7487706 - DNA, 22 bp, Homo sapiens
aggctctgtttgctgtggtacc

SEQ ID NO: 7487707 - DNA, 22 bp, Homo sapiens
aggctcttcttttattaactga

SEQ ID NO: 7487708 - DNA, 22 bp, Homo sapiens
aggctgaaaacgagatggcaat

SEQ ID NO: 7487709 - DNA, 22 bp, Homo sapiens
aggctgaaaacgagatggcaat

SEQ ID NO: 7487710 - DNA, 22 bp, Homo sapiens
aggctgacaagttcgtctaaag

SEQ ID NO: 7487711 - DNA, 22 bp, Homo sapiens
aggctgacaagttcgtctaaag

SEQ ID NO: 7487712 - DNA, 22 bp, Homo sapiens
aggctgacggcttgcttgtatc

SEQ ID NO: 7487713 - DNA, 22 bp, Homo sapiens
aggctgaaaacgagatggcaat

SEQ ID NO: 7487714 - DNA, 22 bp, Homo sapiens
aggctgaaaacgagatggcaat

SEQ ID NO: 7487715 - DNA, 22 bp, Homo sapiens
aggctgaaaacgagatggcaat

SEQ ID NO: 7487716 - DNA, 22 bp, Homo sapiens
aggctctttgagactacctgga

SEQ ID NO: 7487717 - DNA, 22 bp, Homo sapiens
aggctctttgagactacctgga

SEQ ID NO: 7487718 - DNA, 22 bp, Homo sapiens
aggctctttgagactacctgga

SEQ ID NO: 7487719 - DNA, 22 bp, Homo sapiens
aggctctttccactctggtgca

SEQ ID NO: 7487720 - DNA, 22 bp, Homo sapiens
acatttctcagggagttttgct

SEQ ID NO: 7487721 - DNA, 22 bp, Homo sapiens
acatttctcagggagttttgct

SEQ ID NO: 7487722 - DNA, 22 bp, Homo sapiens
acatttctcagggagttttgct

SEQ ID NO: 7487723 - DNA, 22 bp, Homo sapiens
aggctgagctgacctggtttgg

SEQ ID NO: 7487724 - DNA, 22 bp, Homo sapiens
aggctgagctggcccttgaaat

SEQ ID NO: 7487725 - DNA, 22 bp, Homo sapiens
aggctgagctggcccttgaaat

SEQ ID NO: 7487726 - DNA, 22 bp, Homo sapiens
aggctgagctggcccttgaaat

SEQ ID NO: 7487727 - DNA, 22 bp, Homo sapiens
aggctgagctggcccttgaaat

SEQ ID NO: 7487728 - DNA, 22 bp, Homo sapiens
aggctgagctggcccttgaaat

SEQ ID NO: 7487729 - DNA, 22 bp, Homo sapiens
acatttctcagggagttttgct

SEQ ID NO: 7487730 - DNA, 22 bp, Homo sapiens
aggctgagctggcccttgaaat

SEQ ID NO: 7487731 - DNA, 22 bp, Homo sapiens
aggctgagctggcccttgaaat

SEQ ID NO: 7487732 - DNA, 18 bp, Homo sapiens
acatttctatgcttctgg

SEQ ID NO: 7487733 - DNA, 18 bp, Homo sapiens
acatttctatgcttctgg

SEQ ID NO: 7487734 - DNA, 18 bp, Homo sapiens
acatttctatgcttctgg

SEQ ID NO: 7487735 - DNA, 18 bp, Homo sapiens
acatttctatgcttctgg

SEQ ID NO: 7487736 - DNA, 18 bp, Homo sapiens
acatttctatgcttctgg

SEQ ID NO: 7487737 - DNA, 18 bp, Homo sapiens
acatttctatgcttctgg

SEQ ID NO: 7487738 - DNA, 18 bp, Homo sapiens
acatttctatgcttctgg

SEQ ID NO: 7487739 - DNA, 18 bp, Homo sapiens
acatttctatgcttctgg

SEQ ID NO: 7487740 - DNA, 22 bp, Homo sapiens
acatttctcagggagttttgct

SEQ ID NO: 7487741 - DNA, 22 bp, Homo sapiens
acatttctcagggagttttgct

SEQ ID NO: 7487742 - DNA, 18 bp, Homo sapiens
acatttctatgcttctgg

SEQ ID NO: 7487743 - DNA, 22 bp, Homo sapiens
aggctgaggagggatgttgctt

SEQ ID NO: 7487744 - DNA, 22 bp, Homo sapiens
aggctgaggagggatgttgctt

SEQ ID NO: 7487745 - DNA, 22 bp, Homo sapiens
aggctgaggagggatgttgctt

SEQ ID NO: 7487746 - DNA, 22 bp, Homo sapiens
aggctgaggagggatgttgctt

SEQ ID NO: 7487747 - DNA, 22 bp, Homo sapiens
aggctgagctggtagtgagtac

SEQ ID NO: 7487748 - DNA, 22 bp, Homo sapiens
aggctgagctggtagtgagtac

SEQ ID NO: 7487749 - DNA, 22 bp, Homo sapiens
aggctgaggagggatgttgctt

SEQ ID NO: 7487750 - DNA, 22 bp, Homo sapiens
aggctgagctggtagtgagtac

SEQ ID NO: 7487751 - DNA, 22 bp, Homo sapiens
aggctgagctggtagtgagtac

SEQ ID NO: 7487752 - DNA, 22 bp, Homo sapiens
aggctgagctggtagtgagtac

SEQ ID NO: 7487753 - DNA, 22 bp, Homo sapiens
aggctgagctggcccttgaaat

SEQ ID NO: 7487754 - DNA, 22 bp, Homo sapiens
aggctgagctggtagtgagtac

SEQ ID NO: 7487755 - DNA, 22 bp, Homo sapiens
aggctgagctggtagtgagtac

SEQ ID NO: 7487756 - DNA, 22 bp, Homo sapiens
aggctgagctggtagtgagtac

SEQ ID NO: 7487757 - DNA, 22 bp, Homo sapiens
aggctgagctggtagtgagtac

SEQ ID NO: 7487758 - DNA, 22 bp, Homo sapiens
aggctgagctggtagtgagtac

SEQ ID NO: 7487759 - DNA, 22 bp, Homo sapiens
aggctgagctggtagtgagtac

SEQ ID NO: 7487760 - DNA, 22 bp, Homo sapiens
aggctgagctggtagtgagtac

SEQ ID NO: 7487761 - DNA, 22 bp, Homo sapiens
acatttcttttcatctctatat

SEQ ID NO: 7487762 - DNA, 22 bp, Homo sapiens
acatttctttgctagacagcag

SEQ ID NO: 7487763 - DNA, 22 bp, Homo sapiens
acatttcttttcatctctatat

SEQ ID NO: 7487764 - DNA, 22 bp, Homo sapiens
acatttcttttcatctctatat

SEQ ID NO: 7487765 - DNA, 22 bp, Homo sapiens
acatttctttgctagacagcag

SEQ ID NO: 7487766 - DNA, 22 bp, Homo sapiens
acatttctttgctagacagcag

SEQ ID NO: 7487767 - DNA, 22 bp, Homo sapiens
acatttctttgctagacagcag

SEQ ID NO: 7487768 - DNA, 22 bp, Homo sapiens
acatttctttctattcagtagc

SEQ ID NO: 7487769 - DNA, 22 bp, Homo sapiens
acatttctttgctagacagcag

SEQ ID NO: 7487770 - DNA, 22 bp, Homo sapiens
acatttctttgctagacagcag

SEQ ID NO: 7487771 - DNA, 22 bp, Homo sapiens
acatttctttctattcagtagc

SEQ ID NO: 7487772 - DNA, 22 bp, Homo sapiens
acatttctttctattcagtagc

SEQ ID NO: 7487773 - DNA, 22 bp, Homo sapiens
acatttctttctattcagtagc

SEQ ID NO: 7487774 - DNA, 22 bp, Homo sapiens
acatttctttctattcagtagc

SEQ ID NO: 7487775 - DNA, 22 bp, Homo sapiens
acatttctttctattcagtagc

SEQ ID NO: 7487776 - DNA, 22 bp, Homo sapiens
acatttctcttgatgtctctat

SEQ ID NO: 7487777 - DNA, 22 bp, Homo sapiens
acatttctcttagagttggact

SEQ ID NO: 7487778 - DNA, 22 bp, Homo sapiens
aggctgaggatccctgtgttct

SEQ ID NO: 7487779 - DNA, 22 bp, Homo sapiens
acatttctcttgatgtctctat

SEQ ID NO: 7487780 - DNA, 22 bp, Homo sapiens
acatttctcttagagttggact

SEQ ID NO: 7487781 - DNA, 22 bp, Homo sapiens
acatttctcttgatgtctctat

SEQ ID NO: 7487782 - DNA, 22 bp, Homo sapiens
acatttctcttgatgtctctat

SEQ ID NO: 7487783 - DNA, 22 bp, Homo sapiens
aggctgaggagggatgttgctt

SEQ ID NO: 7487784 - DNA, 22 bp, Homo sapiens
aggctgaggagggatgttgctt

SEQ ID NO: 7487785 - DNA, 22 bp, Homo sapiens
acatttctcttagagttggact

SEQ ID NO: 7487786 - DNA, 22 bp, Homo sapiens
acatttctcttagagttggact

SEQ ID NO: 7487787 - DNA, 22 bp, Homo sapiens
acatttctcttagagttggact

SEQ ID NO: 7487788 - DNA, 22 bp, Homo sapiens
acatttcttgatgcctctgtga

SEQ ID NO: 7487789 - DNA, 22 bp, Homo sapiens
acatttcttcctaattatccct

SEQ ID NO: 7487790 - DNA, 22 bp, Homo sapiens
acatttcttgatgcctctgtga

SEQ ID NO: 7487791 - DNA, 22 bp, Homo sapiens
acatttcttcctaattatccct

SEQ ID NO: 7487792 - DNA, 22 bp, Homo sapiens
acatttctttctattcagtagc

SEQ ID NO: 7487793 - DNA, 22 bp, Homo sapiens
acatttctttctattcagtagc

SEQ ID NO: 7487794 - DNA, 22 bp, Homo sapiens
acatttcttgatgcctctgtga

SEQ ID NO: 7487795 - DNA, 22 bp, Homo sapiens
acatttcttgatgcctctgtga

SEQ ID NO: 7487796 - DNA, 22 bp, Homo sapiens
acatttcttgatgcctctgtga

SEQ ID NO: 7487797 - DNA, 22 bp, Homo sapiens
acatttgggaccctctcttcac

SEQ ID NO: 7487798 - DNA, 18 bp, Homo sapiens
acatttggggagttaagt

SEQ ID NO: 7487799 - DNA, 22 bp, Homo sapiens
acatttggtaacacttgagcat

SEQ ID NO: 7487800 - DNA, 22 bp, Homo sapiens
acatttggtaacacttgagcat

SEQ ID NO: 7487801 - DNA, 22 bp, Homo sapiens
acatttggttgagctgttgtca

SEQ ID NO: 7487802 - DNA, 22 bp, Homo sapiens
acatttggcttttggagtaaga

SEQ ID NO: 7487803 - DNA, 22 bp, Homo sapiens
acatttggcttttggagtaaga

SEQ ID NO: 7487804 - DNA, 22 bp, Homo sapiens
acatttgggaccctctcttcac

SEQ ID NO: 7487805 - DNA, 22 bp, Homo sapiens
acatttgggaccctctcttcac

SEQ ID NO: 7487806 - DNA, 23 bp, Homo sapiens
acatttggccaaaaattatttct

SEQ ID NO: 7487807 - DNA, 22 bp, Homo sapiens
acatttggcaagaaagagaaac

SEQ ID NO: 7487808 - DNA, 22 bp, Homo sapiens
acatttggcaagaaagagaaac

SEQ ID NO: 7487809 - DNA, 22 bp, Homo sapiens
acatttggcatcttgtaacact

SEQ ID NO: 7487810 - DNA, 22 bp, Homo sapiens
acatttggcatcttgtaacact

SEQ ID NO: 7487811 - DNA, 19 bp, Homo sapiens
acatttggcattttctctt

SEQ ID NO: 7487812 - DNA, 22 bp, Homo sapiens
acatttggacaatagtagacaa

SEQ ID NO: 7487813 - DNA, 17 bp, Homo sapiens
acatttgcaaaggtctg

SEQ ID NO: 7487814 - DNA, 17 bp, Homo sapiens
acatttgcaaaggtctg

SEQ ID NO: 7487815 - DNA, 17 bp, Homo sapiens
acatttgcaaaggtctg

SEQ ID NO: 7487816 - DNA, 20 bp, Homo sapiens
acatttgagtatcatctact

SEQ ID NO: 7487817 - DNA, 20 bp, Homo sapiens
acatttgagtatcatctact

SEQ ID NO: 7487818 - DNA, 20 bp, Homo sapiens
acatttgagtatcatctact

SEQ ID NO: 7487819 - DNA, 20 bp, Homo sapiens
acatttgagtatcatctact

SEQ ID NO: 7487820 - DNA, 22 bp, Homo sapiens
acatttgagcatctactaagtg

SEQ ID NO: 7487821 - DNA, 22 bp, Homo sapiens
acatttgaggatgttaagaatg

SEQ ID NO: 7487822 - DNA, 22 bp, Homo sapiens
acatttgaggatgttaagaatg

SEQ ID NO: 7487823 - DNA, 22 bp, Homo sapiens
acatttgaggatgttaagaatg

SEQ ID NO: 7487824 - DNA, 22 bp, Homo sapiens
acatttgaggatgttaagaatg

SEQ ID NO: 7487825 - DNA, 22 bp, Homo sapiens
acatttgataattataaagaca

SEQ ID NO: 7487826 - DNA, 22 bp, Homo sapiens
acatttgatatggagttgtgta

SEQ ID NO: 7487827 - DNA, 22 bp, Homo sapiens
acatttgattccatcctctact

SEQ ID NO: 7487828 - DNA, 22 bp, Homo sapiens
acatttgattgatgaatcaaat

SEQ ID NO: 7487829 - DNA, 22 bp, Homo sapiens
acatttgattgatgaatcaaat

SEQ ID NO: 7487830 - DNA, 22 bp, Homo sapiens
acatttgattgatgaatcaaat

SEQ ID NO: 7487831 - DNA, 22 bp, Homo sapiens
acatttgataattataaagaca

SEQ ID NO: 7487832 - DNA, 22 bp, Homo sapiens
acatttgagtcatatttgctta

SEQ ID NO: 7487833 - DNA, 22 bp, Homo sapiens
acatttgagtcatatttgctta

SEQ ID NO: 7487834 - DNA, 22 bp, Homo sapiens
acatttgatatggagttgtgta

SEQ ID NO: 7487835 - DNA, 22 bp, Homo sapiens
acatttgacatttagtatcagc

SEQ ID NO: 7487836 - DNA, 22 bp, Homo sapiens
acatttgacatttagtatcagc

SEQ ID NO: 7487837 - DNA, 22 bp, Homo sapiens
acatttgacatttagtatcagc

SEQ ID NO: 7487838 - DNA, 22 bp, Homo sapiens
acatttgacatttagtatcagc

SEQ ID NO: 7487839 - DNA, 22 bp, Homo sapiens
acatttgaaatgccatgtgagg

SEQ ID NO: 7487840 - DNA, 22 bp, Homo sapiens
acatttgaaattctgaacagat

SEQ ID NO: 7487841 - DNA, 22 bp, Homo sapiens
acatttgaaattctgaacagat

SEQ ID NO: 7487842 - DNA, 22 bp, Homo sapiens
acatttcttttcatctctatat

SEQ ID NO: 7487843 - DNA, 22 bp, Homo sapiens
acatttcttttcatctctatat

SEQ ID NO: 7487844 - DNA, 22 bp, Homo sapiens
acatttcttttcatctctatat

SEQ ID NO: 7487845 - DNA, 22 bp, Homo sapiens
acatttcttttcatctctatat

SEQ ID NO: 7487846 - DNA, 22 bp, Homo sapiens
acatttcttttcatctctatat

SEQ ID NO: 7487847 - DNA, 22 bp, Homo sapiens
acatttcttttcatctctatat

SEQ ID NO: 7487848 - DNA, 22 bp, Homo sapiens
acatttcttttcatctctatat

SEQ ID NO: 7487849 - DNA, 22 bp, Homo sapiens
acatttcttttcatctctatat

SEQ ID NO: 7487850 - DNA, 22 bp, Homo sapiens
acatttgaaaaagttgatggag

SEQ ID NO: 7487851 - DNA, 22 bp, Homo sapiens
acatttgaaataaactcaagtg

SEQ ID NO: 7487852 - DNA, 22 bp, Homo sapiens
acatttgactacatttatatat

SEQ ID NO: 7487853 - DNA, 22 bp, Homo sapiens
acatttgacatttagtatcagc

SEQ ID NO: 7487854 - DNA, 22 bp, Homo sapiens
acatttgacatttagtatcagc

SEQ ID NO: 7487855 - DNA, 22 bp, Homo sapiens
acatttgactctgttcatatta

SEQ ID NO: 7487856 - DNA, 22 bp, Homo sapiens
acatttgactacatttatatat

SEQ ID NO: 7487857 - DNA, 22 bp, Homo sapiens
acatttgactctgttcatatta

SEQ ID NO: 7487858 - DNA, 22 bp, Homo sapiens
acatttgagcatatttcttgtc

SEQ ID NO: 7487859 - DNA, 22 bp, Homo sapiens
acatttgagcatctactaagtg

SEQ ID NO: 7487860 - DNA, 22 bp, Homo sapiens
acatttgactgtagatacttgc

SEQ ID NO: 7487861 - DNA, 22 bp, Homo sapiens
acatttgactgtagatacttgc

SEQ ID NO: 7487862 - DNA, 22 bp, Homo sapiens
acatttgagatgccttttaggt

SEQ ID NO: 7487863 - DNA, 22 bp, Homo sapiens
acatttgagatgccttttaggt

SEQ ID NO: 7487864 - DNA, 22 bp, Homo sapiens
acatgttagggacagagtatgt

SEQ ID NO: 7487865 - DNA, 22 bp, Homo sapiens
acatgttagaaatgcagaatct

SEQ ID NO: 7487866 - DNA, 22 bp, Homo sapiens
acatgttagctactattgttat

SEQ ID NO: 7487867 - DNA, 22 bp, Homo sapiens
acatgttagctactattgttat

SEQ ID NO: 7487868 - DNA, 22 bp, Homo sapiens
acatgttagaaatgcagaatct

SEQ ID NO: 7487869 - DNA, 22 bp, Homo sapiens
acatgttagaaatgcagaatct

SEQ ID NO: 7487870 - DNA, 22 bp, Homo sapiens
acatgttaaacatcatggaatg

SEQ ID NO: 7487871 - DNA, 22 bp, Homo sapiens
acatgttcatgcatgcacaggt

SEQ ID NO: 7487872 - DNA, 22 bp, Homo sapiens
acatgttcatgcatgcacaggt

SEQ ID NO: 7487873 - DNA, 22 bp, Homo sapiens
acatgttcatgcatgcacaggt

SEQ ID NO: 7487874 - DNA, 22 bp, Homo sapiens
acatgtttaagtttaatgaaaa

SEQ ID NO: 7487875 - DNA, 22 bp, Homo sapiens
acatgtttaagtttaatgaaaa

SEQ ID NO: 7487876 - DNA, 22 bp, Homo sapiens
acatgtttaagtttaatgaaaa

SEQ ID NO: 7487877 - DNA, 22 bp, Homo sapiens
acatgtttaagtttaatgaaaa

SEQ ID NO: 7487878 - DNA, 22 bp, Homo sapiens
aggccagggtcccacactcgca

SEQ ID NO: 7487879 - DNA, 22 bp, Homo sapiens
aggccagggtcccacactcgca

SEQ ID NO: 7487880 - DNA, 22 bp, Homo sapiens
aggccagggtcccacactcgca

SEQ ID NO: 7487881 - DNA, 22 bp, Homo sapiens
aggccagggtcccacactcgca

SEQ ID NO: 7487882 - DNA, 22 bp, Homo sapiens
aggccagggtcccacactcgca

SEQ ID NO: 7487883 - DNA, 22 bp, Homo sapiens
aggccagggtcccacactcgca

SEQ ID NO: 7487884 - DNA, 22 bp, Homo sapiens
aggccagggtcccacactcgca

SEQ ID NO: 7487885 - DNA, 22 bp, Homo sapiens
aggccagggtagggcccattgt

SEQ ID NO: 7487886 - DNA, 22 bp, Homo sapiens
acatgttaaacatcatggaatg

SEQ ID NO: 7487887 - DNA, 22 bp, Homo sapiens
acatgttaaacatcatggaatg

SEQ ID NO: 7487888 - DNA, 22 bp, Homo sapiens
acatgtgtaaggtctctcagtc

SEQ ID NO: 7487889 - DNA, 22 bp, Homo sapiens
aggccagggtcccacactcgca

SEQ ID NO: 7487890 - DNA, 22 bp, Homo sapiens
aggccagggtagggcccattgt

SEQ ID NO: 7487891 - DNA, 22 bp, Homo sapiens
aggccagggtagggcccattgt

SEQ ID NO: 7487892 - DNA, 22 bp, Homo sapiens
aggccagggtagggcccattgt

SEQ ID NO: 7487893 - DNA, 22 bp, Homo sapiens
aggccaggggtgagcacttctg

SEQ ID NO: 7487894 - DNA, 22 bp, Homo sapiens
aggccaggggtgagcacttctg

SEQ ID NO: 7487895 - DNA, 22 bp, Homo sapiens
aggccagggtagggcccattgt

SEQ ID NO: 7487896 - DNA, 22 bp, Homo sapiens
aggccaggggtgagcacttctg

SEQ ID NO: 7487897 - DNA, 22 bp, Homo sapiens
aggccaggggtgagcacttctg

SEQ ID NO: 7487898 - DNA, 22 bp, Homo sapiens
aggccaggggtgagcacttctg

SEQ ID NO: 7487899 - DNA, 22 bp, Homo sapiens
aggccaggggtgagcacttctg

SEQ ID NO: 7487900 - DNA, 22 bp, Homo sapiens
aggccagggccagattagccac

SEQ ID NO: 7487901 - DNA, 22 bp, Homo sapiens
aggccagggccagattagccac

SEQ ID NO: 7487902 - DNA, 22 bp, Homo sapiens
aggccagggccagattagccac

SEQ ID NO: 7487903 - DNA, 22 bp, Homo sapiens
aggccaggggtgagcacttctg

SEQ ID NO: 7487904 - DNA, 22 bp, Homo sapiens
aggccagggccagattagccac

SEQ ID NO: 7487905 - DNA, 22 bp, Homo sapiens
aggccagggccagattagccac

SEQ ID NO: 7487906 - DNA, 22 bp, Homo sapiens
aggccagggccagattagccac

SEQ ID NO: 7487907 - DNA, 22 bp, Homo sapiens
aggccagggccagattagccac

SEQ ID NO: 7487908 - DNA, 22 bp, Homo sapiens
aggccaggcgagacacccggct

SEQ ID NO: 7487909 - DNA, 22 bp, Homo sapiens
aggccaggcgagacacccggct

SEQ ID NO: 7487910 - DNA, 22 bp, Homo sapiens
aggccaggcgagacacccggct

SEQ ID NO: 7487911 - DNA, 22 bp, Homo sapiens
aggccaggcgagacacccggct

SEQ ID NO: 7487912 - DNA, 22 bp, Homo sapiens
aggccaggcgagacacccggct

SEQ ID NO: 7487913 - DNA, 22 bp, Homo sapiens
aggccaggcctttctccattcc

SEQ ID NO: 7487914 - DNA, 22 bp, Homo sapiens
aggccaggcctttctccattcc

SEQ ID NO: 7487915 - DNA, 22 bp, Homo sapiens
aggccaggcctttctccattcc

SEQ ID NO: 7487916 - DNA, 22 bp, Homo sapiens
aggccaggcctttctccattcc

SEQ ID NO: 7487917 - DNA, 22 bp, Homo sapiens
aggccaggcctttctccattcc

SEQ ID NO: 7487918 - DNA, 22 bp, Homo sapiens
aggccaggcctttctccattcc

SEQ ID NO: 7487919 - DNA, 22 bp, Homo sapiens
aggccaggcgagacacccggct

SEQ ID NO: 7487920 - DNA, 22 bp, Homo sapiens
aggccaggcgagacacccggct

SEQ ID NO: 7487921 - DNA, 22 bp, Homo sapiens
aggccagggcactgctctttag

SEQ ID NO: 7487922 - DNA, 22 bp, Homo sapiens
aggccagggcactgctctttag

SEQ ID NO: 7487923 - DNA, 22 bp, Homo sapiens
aggccagggcactgctctttag

SEQ ID NO: 7487924 - DNA, 22 bp, Homo sapiens
aggccagggcactgctctttag

SEQ ID NO: 7487925 - DNA, 22 bp, Homo sapiens
aggccagggcactgctctttag

SEQ ID NO: 7487926 - DNA, 22 bp, Homo sapiens
aggccagggcactgctctttag

SEQ ID NO: 7487927 - DNA, 22 bp, Homo sapiens
aggccagggcactgctctttag

SEQ ID NO: 7487928 - DNA, 22 bp, Homo sapiens
acatgtttaagtttaatgaaaa

SEQ ID NO: 7487929 - DNA, 22 bp, Homo sapiens
acatgtttaagtttaatgaaaa

SEQ ID NO: 7487930 - DNA, 22 bp, Homo sapiens
acatgtttaagtttaatgaaaa

SEQ ID NO: 7487931 - DNA, 22 bp, Homo sapiens
acatgtttaagtttaatgaaaa

SEQ ID NO: 7487932 - DNA, 22 bp, Homo sapiens
acatgtttaagtttgttatatg

SEQ ID NO: 7487933 - DNA, 22 bp, Homo sapiens
acatgtttaagtttaatgaaaa

SEQ ID NO: 7487934 - DNA, 22 bp, Homo sapiens
acatgtttgataaatatttggg

SEQ ID NO: 7487935 - DNA, 22 bp, Homo sapiens
acatgtttgataaatatttggg

SEQ ID NO: 7487936 - DNA, 22 bp, Homo sapiens
acatgtttgataaatatttggg

SEQ ID NO: 7487937 - DNA, 22 bp, Homo sapiens
acatgtttaagtttgttatatg

SEQ ID NO: 7487938 - DNA, 22 bp, Homo sapiens
acatgtttaagtttgttatatg

SEQ ID NO: 7487939 - DNA, 22 bp, Homo sapiens
acatgtttacattaggtgatat

SEQ ID NO: 7487940 - DNA, 22 bp, Homo sapiens
acatgtttaagtttgttatatg

SEQ ID NO: 7487941 - DNA, 22 bp, Homo sapiens
acatgtttaagtttgttatatg

SEQ ID NO: 7487942 - DNA, 22 bp, Homo sapiens
acatgtttaagtttgttatatg

SEQ ID NO: 7487943 - DNA, 22 bp, Homo sapiens
acatgtttaagtttgttatatg

SEQ ID NO: 7487944 - DNA, 22 bp, Homo sapiens
acatgtttaagtttgttatatg

SEQ ID NO: 7487945 - DNA, 22 bp, Homo sapiens
acatgtttaagtttgttatatg

SEQ ID NO: 7487946 - DNA, 22 bp, Homo sapiens
acatgtttggctctatgctata

SEQ ID NO: 7487947 - DNA, 22 bp, Homo sapiens
acatgtttggctctatgctata

SEQ ID NO: 7487948 - DNA, 22 bp, Homo sapiens
acatgtttggctctatgctata

SEQ ID NO: 7487949 - DNA, 22 bp, Homo sapiens
acatgtttgcctgcaggcttag

SEQ ID NO: 7487950 - DNA, 22 bp, Homo sapiens
acatgtttggctctatgctata

SEQ ID NO: 7487951 - DNA, 22 bp, Homo sapiens
acatgtttggctctatgctata

SEQ ID NO: 7487952 - DNA, 22 bp, Homo sapiens
acatgtttgataaatatttggg

SEQ ID NO: 7487953 - DNA, 22 bp, Homo sapiens
acatgtttgcctgcaggcttag

SEQ ID NO: 7487954 - DNA, 22 bp, Homo sapiens
acatgtttgcctgcaggcttag

SEQ ID NO: 7487955 - DNA, 22 bp, Homo sapiens
acatgtttgataaatatttggg

SEQ ID NO: 7487956 - DNA, 22 bp, Homo sapiens
acatgtttgataaatatttggg

SEQ ID NO: 7487957 - DNA, 22 bp, Homo sapiens
aggcctctgggtctcctctgac

SEQ ID NO: 7487958 - DNA, 19 bp, Homo sapiens
acatgttttgcagaacagc

SEQ ID NO: 7487959 - DNA, 22 bp, Homo sapiens
aggcctctgggtctcctctgac

SEQ ID NO: 7487960 - DNA, 22 bp, Homo sapiens
aggcctctgggtctcctctgac

SEQ ID NO: 7487961 - DNA, 22 bp, Homo sapiens
acatgtttggctctatgctata

SEQ ID NO: 7487962 - DNA, 22 bp, Homo sapiens
acatgtttggctctatgctata

SEQ ID NO: 7487963 - DNA, 22 bp, Homo sapiens
acatgtttggctctatgctata

SEQ ID NO: 7487964 - DNA, 22 bp, Homo sapiens
acatgtttggctctatgctata

SEQ ID NO: 7487965 - DNA, 22 bp, Homo sapiens
aggcctctgtagggccctgaag

SEQ ID NO: 7487966 - DNA, 22 bp, Homo sapiens
aggcctctgggtctcctctgac

SEQ ID NO: 7487967 - DNA, 22 bp, Homo sapiens
aggcctctgtagggccctgaag

SEQ ID NO: 7487968 - DNA, 22 bp, Homo sapiens
aggcctctgtctttatatgact

SEQ ID NO: 7487969 - DNA, 22 bp, Homo sapiens
aggcctctgttccccatgtttt

SEQ ID NO: 7487970 - DNA, 18 bp, Homo sapiens
aggcctctgtgtgcccag

SEQ ID NO: 7487971 - DNA, 18 bp, Homo sapiens
aggcctctgtgtgcccag

SEQ ID NO: 7487972 - DNA, 18 bp, Homo sapiens
aggcctctgtgtgcccag

SEQ ID NO: 7487973 - DNA, 21 bp, Homo sapiens
aggcctcttcatggccatgat

SEQ ID NO: 7487974 - DNA, 20 bp, Homo sapiens
aggcctcttcatgacagctg

SEQ ID NO: 7487975 - DNA, 20 bp, Homo sapiens
aggcctcttcatgacagctg

SEQ ID NO: 7487976 - DNA, 21 bp, Homo sapiens
aggcctcttcatggccatgat

SEQ ID NO: 7487977 - DNA, 22 bp, Homo sapiens
aggcctcttcagggagcatgga

SEQ ID NO: 7487978 - DNA, 22 bp, Homo sapiens
aggcctcttcagggagcatgga

SEQ ID NO: 7487979 - DNA, 22 bp, Homo sapiens
aggcctcttcagggagcatgga

SEQ ID NO: 7487980 - DNA, 22 bp, Homo sapiens
aggcctcttcagggagcatgga

SEQ ID NO: 7487981 - DNA, 19 bp, Homo sapiens
acatgttttgcagaacagc

SEQ ID NO: 7487982 - DNA, 22 bp, Homo sapiens
aggcctgagcagaggagtggac

SEQ ID NO: 7487983 - DNA, 20 bp, Homo sapiens
aggcctgagagatgactggg

SEQ ID NO: 7487984 - DNA, 22 bp, Homo sapiens
aggcctgagcagaggagtggac

SEQ ID NO: 7487985 - DNA, 22 bp, Homo sapiens
aggcctgagcagaggagtggac

SEQ ID NO: 7487986 - DNA, 22 bp, Homo sapiens
aggcctgagcagaggagtggac

SEQ ID NO: 7487987 - DNA, 22 bp, Homo sapiens
aggcctgaggaccttctggagg

SEQ ID NO: 7487988 - DNA, 22 bp, Homo sapiens
aggcctgagccccaggtttgtt

SEQ ID NO: 7487989 - DNA, 22 bp, Homo sapiens
aggcctgaagtgtggagtgggg

SEQ ID NO: 7487990 - DNA, 22 bp, Homo sapiens
aggcctgaaggaagatgagctg

SEQ ID NO: 7487991 - DNA, 22 bp, Homo sapiens
aggcctgaagtgtggagtgggg

SEQ ID NO: 7487992 - DNA, 22 bp, Homo sapiens
aggcctgaagtgtggagtgggg

SEQ ID NO: 7487993 - DNA, 22 bp, Homo sapiens
aggcctgaagtgtggagtgggg

SEQ ID NO: 7487994 - DNA, 22 bp, Homo sapiens
aggcctgacttgaatttagggc

SEQ ID NO: 7487995 - DNA, 22 bp, Homo sapiens
aggcctgacttgaatttagggc

SEQ ID NO: 7487996 - DNA, 22 bp, Homo sapiens
aggcctgaaggaagatgagctg

SEQ ID NO: 7487997 - DNA, 22 bp, Homo sapiens
aggcctgaaggaagatgagctg

SEQ ID NO: 7487998 - DNA, 22 bp, Homo sapiens
aggcctcttgtcttcctcacat

SEQ ID NO: 7487999 - DNA, 22 bp, Homo sapiens
aggcctcttgtcttcctcacat

SEQ ID NO: 7488000 - DNA, 22 bp, Homo sapiens
aggcctcttgtcttcctcacat

SEQ ID NO: 7488001 - DNA, 23 bp, Homo sapiens
acatcatgatagccaacttggga

SEQ ID NO: 7488002 - DNA, 22 bp, Homo sapiens
acatcatgagagacttaaattg

SEQ ID NO: 7488003 - DNA, 23 bp, Homo sapiens
acatcatgatagccaacttggga

SEQ ID NO: 7488004 - DNA, 22 bp, Homo sapiens
acatcattcagggcctcgttgg

SEQ ID NO: 7488005 - DNA, 22 bp, Homo sapiens
acatcatcgtgcacatacataa

SEQ ID NO: 7488006 - DNA, 23 bp, Homo sapiens
acatcatgatagccaacttggga

SEQ ID NO: 7488007 - DNA, 22 bp, Homo sapiens
acatcattcagggcctcgttgg

SEQ ID NO: 7488008 - DNA, 22 bp, Homo sapiens
acatcattgtccgttgtcatga

SEQ ID NO: 7488009 - DNA, 22 bp, Homo sapiens
acatcattgtccgttgtcatga

SEQ ID NO: 7488010 - DNA, 22 bp, Homo sapiens
acatcattgtccgttgtcatga

SEQ ID NO: 7488011 - DNA, 22 bp, Homo sapiens
acatcattgtccgttgtcatga

SEQ ID NO: 7488012 - DNA, 22 bp, Homo sapiens
acatcattgtttataaagggag

SEQ ID NO: 7488013 - DNA, 22 bp, Homo sapiens
acatcattgtttataaagggag

SEQ ID NO: 7488014 - DNA, 22 bp, Homo sapiens
acatcagtccaccactgcagtt

SEQ ID NO: 7488015 - DNA, 22 bp, Homo sapiens
acatcagtcttttgcatacata

SEQ ID NO: 7488016 - DNA, 22 bp, Homo sapiens
acatcatgagagacttaaattg

SEQ ID NO: 7488017 - DNA, 22 bp, Homo sapiens
acatcatcgtgcacatacataa

SEQ ID NO: 7488018 - DNA, 22 bp, Homo sapiens
acatccatcttatgagataggt

SEQ ID NO: 7488019 - DNA, 22 bp, Homo sapiens
acatccagtatcagaagcatca

SEQ ID NO: 7488020 - DNA, 22 bp, Homo sapiens
acatccagtatcagaagcatca

SEQ ID NO: 7488021 - DNA, 21 bp, Homo sapiens
acatccagggtcctcactgcc

SEQ ID NO: 7488022 - DNA, 21 bp, Homo sapiens
acatccagggtcctcactgcc

SEQ ID NO: 7488023 - DNA, 21 bp, Homo sapiens
acatccagggtcctcactgcc

SEQ ID NO: 7488024 - DNA, 21 bp, Homo sapiens
acatccagggtcctcactgcc

SEQ ID NO: 7488025 - DNA, 21 bp, Homo sapiens
acatccagggtcctcactgcc

SEQ ID NO: 7488026 - DNA, 17 bp, Homo sapiens
acatccagcttatgtgg

SEQ ID NO: 7488027 - DNA, 22 bp, Homo sapiens
acatccagatctcagcatggct

SEQ ID NO: 7488028 - DNA, 22 bp, Homo sapiens
acatccagatctcagcatggct

SEQ ID NO: 7488029 - DNA, 22 bp, Homo sapiens
acatccactatccttgcttgtt

SEQ ID NO: 7488030 - DNA, 22 bp, Homo sapiens
acatccagaggcgtggaaggct

SEQ ID NO: 7488031 - DNA, 22 bp, Homo sapiens
acatcattttcttcagtgtttg

SEQ ID NO: 7488032 - DNA, 22 bp, Homo sapiens
acatccacatttattcagtcat

SEQ ID NO: 7488033 - DNA, 22 bp, Homo sapiens
acatccaccacatgccaggctc

SEQ ID NO: 7488034 - DNA, 22 bp, Homo sapiens
acatcatttgtctgtagctgaa

SEQ ID NO: 7488035 - DNA, 22 bp, Homo sapiens
acatcatttgtctgtagctgaa

SEQ ID NO: 7488036 - DNA, 22 bp, Homo sapiens
acatcatttctagttcctgtca

SEQ ID NO: 7488037 - DNA, 22 bp, Homo sapiens
acatcatttctagttcctgtca

SEQ ID NO: 7488038 - DNA, 22 bp, Homo sapiens
acatcatttctagttcctgtca

SEQ ID NO: 7488039 - DNA, 22 bp, Homo sapiens
acatcatttctagttcctgtca

SEQ ID NO: 7488040 - DNA, 22 bp, Homo sapiens
acatcacagtagttaagccaga

SEQ ID NO: 7488041 - DNA, 22 bp, Homo sapiens
acatcagagggctcacatgatc

SEQ ID NO: 7488042 - DNA, 22 bp, Homo sapiens
acatcagagggctcacatgatc

SEQ ID NO: 7488043 - DNA, 22 bp, Homo sapiens
acatcagagggctcacatgatc

SEQ ID NO: 7488044 - DNA, 22 bp, Homo sapiens
acatcagacaattaattattaa

SEQ ID NO: 7488045 - DNA, 22 bp, Homo sapiens
acatcacggtccagcacggctg

SEQ ID NO: 7488046 - DNA, 22 bp, Homo sapiens
acatcactttacagttactagt

SEQ ID NO: 7488047 - DNA, 22 bp, Homo sapiens
acatcagtaactgtaaaacagg

SEQ ID NO: 7488048 - DNA, 22 bp, Homo sapiens
acatcagtaattaagtctcaag

SEQ ID NO: 7488049 - DNA, 23 bp, Homo sapiens
acatcagagttagttcaatcagg

SEQ ID NO: 7488050 - DNA, 23 bp, Homo sapiens
acatcagagttagttcaatcagg

SEQ ID NO: 7488051 - DNA, 21 bp, Homo sapiens
acatcagagttgtgaaggtag

SEQ ID NO: 7488052 - DNA, 21 bp, Homo sapiens
acatcagagttgtgaaggtag

SEQ ID NO: 7488053 - DNA, 20 bp, Homo sapiens
acatcaactagtcacagaca

SEQ ID NO: 7488054 - DNA, 20 bp, Homo sapiens
acatcaactagtcacagaca

SEQ ID NO: 7488055 - DNA, 22 bp, Homo sapiens
acatcacacgccttccaggagg

SEQ ID NO: 7488056 - DNA, 22 bp, Homo sapiens
acatcacacgccttccaggagg

SEQ ID NO: 7488057 - DNA, 22 bp, Homo sapiens
acatattttgaaagctttctaa

SEQ ID NO: 7488058 - DNA, 22 bp, Homo sapiens
acatattttgaaagctttctaa

SEQ ID NO: 7488059 - DNA, 22 bp, Homo sapiens
acatattttgaaagctttctaa

SEQ ID NO: 7488060 - DNA, 22 bp, Homo sapiens
acatattttgaaagctttctaa

SEQ ID NO: 7488061 - DNA, 22 bp, Homo sapiens
acatattttgaaagctttctaa

SEQ ID NO: 7488062 - DNA, 22 bp, Homo sapiens
acatcacagagcccagataaag

SEQ ID NO: 7488063 - DNA, 22 bp, Homo sapiens
acatcacagagcccagataaag

SEQ ID NO: 7488064 - DNA, 22 bp, Homo sapiens
acatcacagagcccagataaag

SEQ ID NO: 7488065 - DNA, 22 bp, Homo sapiens
acatcacagagcccagataaag

SEQ ID NO: 7488066 - DNA, 22 bp, Homo sapiens
acatcacagagcccagataaag

SEQ ID NO: 7488067 - DNA, 22 bp, Homo sapiens
acatcacagagcccagataaag

SEQ ID NO: 7488068 - DNA, 22 bp, Homo sapiens
acatcacagagcccagataaag

SEQ ID NO: 7488069 - DNA, 22 bp, Homo sapiens
acatcacagagcccagataaag

SEQ ID NO: 7488070 - DNA, 22 bp, Homo sapiens
acatgcttctgtttcaagaact

SEQ ID NO: 7488071 - DNA, 22 bp, Homo sapiens
acatgcttctgtttcaagaact

SEQ ID NO: 7488072 - DNA, 22 bp, Homo sapiens
acatgcttccaaattatgttgg

SEQ ID NO: 7488073 - DNA, 22 bp, Homo sapiens
acatgcttccaaattatgttgg

SEQ ID NO: 7488074 - DNA, 22 bp, Homo sapiens
acatgcttgtttttcacaacct

SEQ ID NO: 7488075 - DNA, 22 bp, Homo sapiens
acatgcttgtttttcacaacct

SEQ ID NO: 7488076 - DNA, 22 bp, Homo sapiens
acatgctaggtacagatctaaa

SEQ ID NO: 7488077 - DNA, 22 bp, Homo sapiens
acatgctctcctaaggccctgt

SEQ ID NO: 7488078 - DNA, 22 bp, Homo sapiens
acatgctctcctaaggccctgt

SEQ ID NO: 7488079 - DNA, 22 bp, Homo sapiens
acatgctgggtttctttaatgg

SEQ ID NO: 7488080 - DNA, 22 bp, Homo sapiens
acatgctgggcaatgttgtttt

SEQ ID NO: 7488081 - DNA, 22 bp, Homo sapiens
acatgctgggcaatgttgtttt

SEQ ID NO: 7488082 - DNA, 22 bp, Homo sapiens
acatgcttttcccacaattata

SEQ ID NO: 7488083 - DNA, 22 bp, Homo sapiens
acatgcttttcccacaattata

SEQ ID NO: 7488084 - DNA, 22 bp, Homo sapiens
acatgcttttcccacaattata

SEQ ID NO: 7488085 - DNA, 22 bp, Homo sapiens
acatgctttgcacttacatcat

SEQ ID NO: 7488086 - DNA, 22 bp, Homo sapiens
acatgctttgcacttacatcat

SEQ ID NO: 7488087 - DNA, 22 bp, Homo sapiens
acatgcttttcccacaattata

SEQ ID NO: 7488088 - DNA, 22 bp, Homo sapiens
aggccaggcaacattctgaagt

SEQ ID NO: 7488089 - DNA, 22 bp, Homo sapiens
aggccaggcctttctccattcc

SEQ ID NO: 7488090 - DNA, 22 bp, Homo sapiens
acatgctttaacttattttgat

SEQ ID NO: 7488091 - DNA, 22 bp, Homo sapiens
acatgctttatcggattgacac

SEQ ID NO: 7488092 - DNA, 22 bp, Homo sapiens
acatgctttaacttattttgat

SEQ ID NO: 7488093 - DNA, 22 bp, Homo sapiens
acatgctttctaggtccttctg

SEQ ID NO: 7488094 - DNA, 22 bp, Homo sapiens
acatgctttatcggattgacac

SEQ ID NO: 7488095 - DNA, 22 bp, Homo sapiens
acatgctttctaggtccttctg

SEQ ID NO: 7488096 - DNA, 22 bp, Homo sapiens
acatgctttgatgtattttgca

SEQ ID NO: 7488097 - DNA, 22 bp, Homo sapiens
acatgctttctaggtccttctg

SEQ ID NO: 7488098 - DNA, 22 bp, Homo sapiens
acatgctttctaggtccttctg

SEQ ID NO: 7488099 - DNA, 22 bp, Homo sapiens
acatgctttgcacttacatcat

SEQ ID NO: 7488100 - DNA, 22 bp, Homo sapiens
acatgctttgatgtattttgca

SEQ ID NO: 7488101 - DNA, 22 bp, Homo sapiens
acatgcatacaagcacatgtag

SEQ ID NO: 7488102 - DNA, 22 bp, Homo sapiens
acatgcataagcctagccatca

SEQ ID NO: 7488103 - DNA, 22 bp, Homo sapiens
acatgcataagcctagccatca

SEQ ID NO: 7488104 - DNA, 22 bp, Homo sapiens
acatccagtatcagaagcatca

SEQ ID NO: 7488105 - DNA, 22 bp, Homo sapiens
acatccatcttatgagataggt

SEQ ID NO: 7488106 - DNA, 22 bp, Homo sapiens
acatccatcttatgagataggt

SEQ ID NO: 7488107 - DNA, 22 bp, Homo sapiens
acatccatcttctgcctgtgaa

SEQ ID NO: 7488108 - DNA, 22 bp, Homo sapiens
acatgccagcccatttaaatgg

SEQ ID NO: 7488109 - DNA, 22 bp, Homo sapiens
acatgccagcctcagcagcagt

SEQ ID NO: 7488110 - DNA, 22 bp, Homo sapiens
acatgccagcccatttaaatgg

SEQ ID NO: 7488111 - DNA, 22 bp, Homo sapiens
acatgccagcctcagcagcagt

SEQ ID NO: 7488112 - DNA, 22 bp, Homo sapiens
acatgccaatttggttagttca

SEQ ID NO: 7488113 - DNA, 22 bp, Homo sapiens
acatgcatacaagcacatgtag

SEQ ID NO: 7488114 - DNA, 22 bp, Homo sapiens
acatgcatacaagcacatgtag

SEQ ID NO: 7488115 - DNA, 22 bp, Homo sapiens
acatgccagaacttgtaccaat

SEQ ID NO: 7488116 - DNA, 22 bp, Homo sapiens
acatgctacagtgaaggaggaa

SEQ ID NO: 7488117 - DNA, 22 bp, Homo sapiens
acatgctaatggagatgccaag

SEQ ID NO: 7488118 - DNA, 20 bp, Homo sapiens
acatgcgcaggccagtgggc

SEQ ID NO: 7488119 - DNA, 22 bp, Homo sapiens
acatgctaggtacagatctaaa

SEQ ID NO: 7488120 - DNA, 22 bp, Homo sapiens
acatgctagactttctttatga

SEQ ID NO: 7488121 - DNA, 22 bp, Homo sapiens
acatgctagactttctttatga

SEQ ID NO: 7488122 - DNA, 22 bp, Homo sapiens
acatgctatgagagattacttc

SEQ ID NO: 7488123 - DNA, 22 bp, Homo sapiens
acatgctatgagagattacttc

SEQ ID NO: 7488124 - DNA, 22 bp, Homo sapiens
acatgctaaatctgagatgctt

SEQ ID NO: 7488125 - DNA, 22 bp, Homo sapiens
acatgccagcccatttaaatgg

SEQ ID NO: 7488126 - DNA, 22 bp, Homo sapiens
acatgccatctttgtcaggagt

SEQ ID NO: 7488127 - DNA, 22 bp, Homo sapiens
acatgccatcactttcattcct

SEQ ID NO: 7488128 - DNA, 22 bp, Homo sapiens
agaaaggtggatgctctggaat

SEQ ID NO: 7488129 - DNA, 22 bp, Homo sapiens
agaaaggtggatgctctggaat

SEQ ID NO: 7488130 - DNA, 22 bp, Homo sapiens
agaaaggtggatgctctggaat

SEQ ID NO: 7488131 - DNA, 22 bp, Homo sapiens
agaaagtacagatgagacactt

SEQ ID NO: 7488132 - DNA, 22 bp, Homo sapiens
agaaagtacagatgagacactt

SEQ ID NO: 7488133 - DNA, 22 bp, Homo sapiens
agaaagtacagatgagacactt

SEQ ID NO: 7488134 - DNA, 22 bp, Homo sapiens
agaaagtacagatgagacactt

SEQ ID NO: 7488135 - DNA, 23 bp, Homo sapiens
agaaagtcatggccaggtttgat

SEQ ID NO: 7488136 - DNA, 22 bp, Homo sapiens
agaaagggttctctgaggtgct

SEQ ID NO: 7488137 - DNA, 22 bp, Homo sapiens
agaaaggtcaaaatcgtgacat

SEQ ID NO: 7488138 - DNA, 22 bp, Homo sapiens
agaaaggtcacttagcctcagc

SEQ ID NO: 7488139 - DNA, 22 bp, Homo sapiens
agaaagggtcactgaaagagga

SEQ ID NO: 7488140 - DNA, 22 bp, Homo sapiens
agaaagggttctctgaggtgct

SEQ ID NO: 7488141 - DNA, 22 bp, Homo sapiens
agaaagggttctctgaggtgct

SEQ ID NO: 7488142 - DNA, 22 bp, Homo sapiens
agaaagggttctctgaggtgct

SEQ ID NO: 7488143 - DNA, 22 bp, Homo sapiens
agaaagggtcactgaaagagga

SEQ ID NO: 7488144 - DNA, 22 bp, Homo sapiens
agaaagggttctctgaggtgct

SEQ ID NO: 7488145 - DNA, 22 bp, Homo sapiens
agaaagggttctctgaggtgct

SEQ ID NO: 7488146 - DNA, 22 bp, Homo sapiens
agaaagggtcactgaaagagga

SEQ ID NO: 7488147 - DNA, 22 bp, Homo sapiens
agaaagggtcactgaaagagga

SEQ ID NO: 7488148 - DNA, 22 bp, Homo sapiens
agaaagggtcactgaaagagga

SEQ ID NO: 7488149 - DNA, 22 bp, Homo sapiens
agaaagggtcactgaaagagga

SEQ ID NO: 7488150 - DNA, 22 bp, Homo sapiens
agaaagggctattttgaggtag

SEQ ID NO: 7488151 - DNA, 22 bp, Homo sapiens
agaaagggtcactgaaagagga

SEQ ID NO: 7488152 - DNA, 22 bp, Homo sapiens
agaaagggctattttgaggtag

SEQ ID NO: 7488153 - DNA, 22 bp, Homo sapiens
agaaagctggaagagctgggat

SEQ ID NO: 7488154 - DNA, 22 bp, Homo sapiens
agaaagctccccatgagatgat

SEQ ID NO: 7488155 - DNA, 22 bp, Homo sapiens
agaaagggctattttgaggtag

SEQ ID NO: 7488156 - DNA, 22 bp, Homo sapiens
agaaagttatcacaaaattgag

SEQ ID NO: 7488157 - DNA, 22 bp, Homo sapiens
agaaagttatcacaaaattgag

SEQ ID NO: 7488158 - DNA, 22 bp, Homo sapiens
agaaagttcactggtatatttt

SEQ ID NO: 7488159 - DNA, 22 bp, Homo sapiens
agaaagttagcagactcttggc

SEQ ID NO: 7488160 - DNA, 22 bp, Homo sapiens
agaaagttagcagactcttggc

SEQ ID NO: 7488161 - DNA, 22 bp, Homo sapiens
agaaagttagcagactcttggc

SEQ ID NO: 7488162 - DNA, 22 bp, Homo sapiens
agaaagttagcagactcttggc

SEQ ID NO: 7488163 - DNA, 22 bp, Homo sapiens
agaaagttcactggtatatttt

SEQ ID NO: 7488164 - DNA, 22 bp, Homo sapiens
agaaagttctgtgagttgttca

SEQ ID NO: 7488165 - DNA, 22 bp, Homo sapiens
agaaagttctgtgagttgttca

SEQ ID NO: 7488166 - DNA, 22 bp, Homo sapiens
agaaagttctgtgagttgttca

SEQ ID NO: 7488167 - DNA, 22 bp, Homo sapiens
agaaagttgttggaggaaatga

SEQ ID NO: 7488168 - DNA, 22 bp, Homo sapiens
agaaagttgttggaggaaatga

SEQ ID NO: 7488169 - DNA, 22 bp, Homo sapiens
agaaagttctgtgagttgttca

SEQ ID NO: 7488170 - DNA, 22 bp, Homo sapiens
agaaagttgttttagccaaacc

SEQ ID NO: 7488171 - DNA, 22 bp, Homo sapiens
agaaagtctgctttctggatgg

SEQ ID NO: 7488172 - DNA, 22 bp, Homo sapiens
agaaagtgaacgtgttcagttt

SEQ ID NO: 7488173 - DNA, 22 bp, Homo sapiens
agaaagtgaacgtgttcagttt

SEQ ID NO: 7488174 - DNA, 22 bp, Homo sapiens
agaaagtctgctttctggatgg

SEQ ID NO: 7488175 - DNA, 22 bp, Homo sapiens
agaaagtgaccttgaaaactgg

SEQ ID NO: 7488176 - DNA, 22 bp, Homo sapiens
agaaagtgaccttgaaaactgg

SEQ ID NO: 7488177 - DNA, 22 bp, Homo sapiens
agaaagtgcctcccttgggagc

SEQ ID NO: 7488178 - DNA, 22 bp, Homo sapiens
agaaagtgcctcccttgggagc

SEQ ID NO: 7488179 - DNA, 22 bp, Homo sapiens
agaaagtgaccttgaaaactgg

SEQ ID NO: 7488180 - DNA, 22 bp, Homo sapiens
agaaagtgcctcccttgggagc

SEQ ID NO: 7488181 - DNA, 22 bp, Homo sapiens
agaaagtgtgtcatactaagtg

SEQ ID NO: 7488182 - DNA, 22 bp, Homo sapiens
agaaagttaaacagtgataaga

SEQ ID NO: 7488183 - DNA, 22 bp, Homo sapiens
agaaagttaaacagtgataaga

SEQ ID NO: 7488184 - DNA, 22 bp, Homo sapiens
agaaagtgcttccctttggact

SEQ ID NO: 7488185 - DNA, 22 bp, Homo sapiens
agaaagtgcttccctttggact

SEQ ID NO: 7488186 - DNA, 22 bp, Homo sapiens
agaaagtgcttccctttggact

SEQ ID NO: 7488187 - DNA, 22 bp, Homo sapiens
agaaagtgcttccctttggact

SEQ ID NO: 7488188 - DNA, 22 bp, Homo sapiens
agaaagtgcttccctttggtga

SEQ ID NO: 7488189 - DNA, 22 bp, Homo sapiens
agaaagtgcttccctttggtga

SEQ ID NO: 7488190 - DNA, 22 bp, Homo sapiens
agaaagtgtgtcatactaagtg

SEQ ID NO: 7488191 - DNA, 22 bp, Homo sapiens
agaaagtgtgtcatactaagtg

SEQ ID NO: 7488192 - DNA, 22 bp, Homo sapiens
agaaagtgtgtcatactaagtg

SEQ ID NO: 7488193 - DNA, 22 bp, Homo sapiens
agaacactgtaaagtcattgaa

SEQ ID NO: 7488194 - DNA, 22 bp, Homo sapiens
agaacactgtaaagtcattgaa

SEQ ID NO: 7488195 - DNA, 22 bp, Homo sapiens
agaacactgtaaagtcattgaa

SEQ ID NO: 7488196 - DNA, 22 bp, Homo sapiens
agaacactgtaaagtcattgaa

SEQ ID NO: 7488197 - DNA, 22 bp, Homo sapiens
agaacacttgctcctgattctc

SEQ ID NO: 7488198 - DNA, 22 bp, Homo sapiens
agaacacttgctcctgattctc

SEQ ID NO: 7488199 - DNA, 18 bp, Homo sapiens
agaacacttggttagatc

SEQ ID NO: 7488200 - DNA, 18 bp, Homo sapiens
agaacacttggttagatc

SEQ ID NO: 7488201 - DNA, 22 bp, Homo sapiens
agaacacttttaaatggcttgt

SEQ ID NO: 7488202 - DNA, 22 bp, Homo sapiens
agaacacttttaaatggcttgt

SEQ ID NO: 7488203 - DNA, 18 bp, Homo sapiens
agaacacttggttagatc

SEQ ID NO: 7488204 - DNA, 22 bp, Homo sapiens
agaacacttttaaatggcttgt

SEQ ID NO: 7488205 - DNA, 22 bp, Homo sapiens
agaacacttttaaatggcttgt

SEQ ID NO: 7488206 - DNA, 22 bp, Homo sapiens
agaacagaagggaggaaggcct

SEQ ID NO: 7488207 - DNA, 22 bp, Homo sapiens
agaacagaagggaggaaggcct

SEQ ID NO: 7488208 - DNA, 22 bp, Homo sapiens
agaacagaagggaggaaggcct

SEQ ID NO: 7488209 - DNA, 22 bp, Homo sapiens
agaacagatgtgggcagacctg

SEQ ID NO: 7488210 - DNA, 22 bp, Homo sapiens
agaacagcaacatcagacaaag

SEQ ID NO: 7488211 - DNA, 22 bp, Homo sapiens
agaacagatgtgggcagacctg

SEQ ID NO: 7488212 - DNA, 22 bp, Homo sapiens
agaacagatgtgggcagacctg

SEQ ID NO: 7488213 - DNA, 22 bp, Homo sapiens
agaacagatgtgggcagacctg

SEQ ID NO: 7488214 - DNA, 22 bp, Homo sapiens
agaacagaggccttatgtttca

SEQ ID NO: 7488215 - DNA, 22 bp, Homo sapiens
agaacagaggccttatgtttca

SEQ ID NO: 7488216 - DNA, 22 bp, Homo sapiens
agaacagaggccttatgtttca

SEQ ID NO: 7488217 - DNA, 22 bp, Homo sapiens
agaacagaggccttatgtttca

SEQ ID NO: 7488218 - DNA, 22 bp, Homo sapiens
agaacagaagggaggaaggcct

SEQ ID NO: 7488219 - DNA, 22 bp, Homo sapiens
agaacagaggccttatgtttca

SEQ ID NO: 7488220 - DNA, 22 bp, Homo sapiens
agaacagaggccttatgtttca

SEQ ID NO: 7488221 - DNA, 22 bp, Homo sapiens
agaacagcaggaaggccaggta

SEQ ID NO: 7488222 - DNA, 22 bp, Homo sapiens
agaacagcaggaaggccaggta

SEQ ID NO: 7488223 - DNA, 22 bp, Homo sapiens
agaacagcaggaaggccaggta

SEQ ID NO: 7488224 - DNA, 22 bp, Homo sapiens
agaacagcaggaaggccaggta

SEQ ID NO: 7488225 - DNA, 22 bp, Homo sapiens
agaacagcaggaaggccaggta

SEQ ID NO: 7488226 - DNA, 22 bp, Homo sapiens
agaacagcagtagtatacagta

SEQ ID NO: 7488227 - DNA, 22 bp, Homo sapiens
agaacagcagtagtatacagta

SEQ ID NO: 7488228 - DNA, 22 bp, Homo sapiens
agaacagcagcacgtcaagctg

SEQ ID NO: 7488229 - DNA, 22 bp, Homo sapiens
agaacagcacaggaagtgtatc

SEQ ID NO: 7488230 - DNA, 22 bp, Homo sapiens
agaacagcaacatcagacaaag

SEQ ID NO: 7488231 - DNA, 22 bp, Homo sapiens
agaacagcacaggaagtgtatc

SEQ ID NO: 7488232 - DNA, 22 bp, Homo sapiens
agaacagcagcacgtcaagctg

SEQ ID NO: 7488233 - DNA, 22 bp, Homo sapiens
agaacagcagcacgtcaagctg

SEQ ID NO: 7488234 - DNA, 22 bp, Homo sapiens
agaacagcctatagtggccttt

SEQ ID NO: 7488235 - DNA, 22 bp, Homo sapiens
agaacagccaataaaagagggg

SEQ ID NO: 7488236 - DNA, 22 bp, Homo sapiens
agaacagccaataaaagagggg

SEQ ID NO: 7488237 - DNA, 22 bp, Homo sapiens
agaacagctgatttacggggct

SEQ ID NO: 7488238 - DNA, 22 bp, Homo sapiens
agaacagcctatagtggccttt

SEQ ID NO: 7488239 - DNA, 22 bp, Homo sapiens
agaacagctgattccatgtcaa

SEQ ID NO: 7488240 - DNA, 22 bp, Homo sapiens
agaacagcagttatggttcatt

SEQ ID NO: 7488241 - DNA, 22 bp, Homo sapiens
agaacagccaactgtgtaggag

SEQ ID NO: 7488242 - DNA, 22 bp, Homo sapiens
agaacagccaactgtgtaggag

SEQ ID NO: 7488243 - DNA, 22 bp, Homo sapiens
agaacagcagtagtatacagta

SEQ ID NO: 7488244 - DNA, 22 bp, Homo sapiens
agaacagcagttatggttcatt

SEQ ID NO: 7488245 - DNA, 22 bp, Homo sapiens
agaaattaggaaagtaacactt

SEQ ID NO: 7488246 - DNA, 22 bp, Homo sapiens
agaaattaggaaagtaacactt

SEQ ID NO: 7488247 - DNA, 23 bp, Homo sapiens
agaaagtttgtgccttgtgacac

SEQ ID NO: 7488248 - DNA, 23 bp, Homo sapiens
agaaagtttgtgccttgtgacac

SEQ ID NO: 7488249 - DNA, 22 bp, Homo sapiens
agaaagtttggggctgggcacg

SEQ ID NO: 7488250 - DNA, 22 bp, Homo sapiens
agaaagtttggggctgggcacg

SEQ ID NO: 7488251 - DNA, 23 bp, Homo sapiens
agaaagtttgtgccttgtgacac

SEQ ID NO: 7488252 - DNA, 22 bp, Homo sapiens
agaaagtttgagaactgtagat

SEQ ID NO: 7488253 - DNA, 22 bp, Homo sapiens
agaaagtttattcctatctagc

SEQ ID NO: 7488254 - DNA, 22 bp, Homo sapiens
agaaagttgttttagccaaacc

SEQ ID NO: 7488255 - DNA, 22 bp, Homo sapiens
agaaagtttatttcttgatgga

SEQ ID NO: 7488256 - DNA, 22 bp, Homo sapiens
agaaagtttatttcttgatgga

SEQ ID NO: 7488257 - DNA, 22 bp, Homo sapiens
agaaagtttgagaactgtagat

SEQ ID NO: 7488258 - DNA, 22 bp, Homo sapiens
agaaagtttgagaactgtagat

SEQ ID NO: 7488259 - DNA, 22 bp, Homo sapiens
agaacactctcctgaaaattaa

SEQ ID NO: 7488260 - DNA, 22 bp, Homo sapiens
agaacactgctagtataatcac

SEQ ID NO: 7488261 - DNA, 22 bp, Homo sapiens
agaacactgatagctgagggga

SEQ ID NO: 7488262 - DNA, 22 bp, Homo sapiens
agaacactgctagtataatcac

SEQ ID NO: 7488263 - DNA, 22 bp, Homo sapiens
agaacactgggaagttactaac

SEQ ID NO: 7488264 - DNA, 22 bp, Homo sapiens
agaacactgctagtataatcac

SEQ ID NO: 7488265 - DNA, 22 bp, Homo sapiens
agaacactgctagtataatcac

SEQ ID NO: 7488266 - DNA, 20 bp, Homo sapiens
agaacactggtgtattgtga

SEQ ID NO: 7488267 - DNA, 22 bp, Homo sapiens
agaacactgggaagttactaac

SEQ ID NO: 7488268 - DNA, 22 bp, Homo sapiens
agaacactgggaagttactaac

SEQ ID NO: 7488269 - DNA, 20 bp, Homo sapiens
agaacactggtgtattgtga

SEQ ID NO: 7488270 - DNA, 22 bp, Homo sapiens
agaaattatgcagtagttttat

SEQ ID NO: 7488271 - DNA, 22 bp, Homo sapiens
agaacacatagagaagttttat

SEQ ID NO: 7488272 - DNA, 22 bp, Homo sapiens
agaacacatagagaagttttat

SEQ ID NO: 7488273 - DNA, 22 bp, Homo sapiens
agaacacatagagaagttttat

SEQ ID NO: 7488274 - DNA, 22 bp, Homo sapiens
agaacacatagagaagttttat

SEQ ID NO: 7488275 - DNA, 22 bp, Homo sapiens
agaaattatgcagtagttttat

SEQ ID NO: 7488276 - DNA, 22 bp, Homo sapiens
agaaattaggaaagtaacactt

SEQ ID NO: 7488277 - DNA, 22 bp, Homo sapiens
agaaattatgcagtagttttat

SEQ ID NO: 7488278 - DNA, 22 bp, Homo sapiens
agaaattatgcagtagttttat

SEQ ID NO: 7488279 - DNA, 22 bp, Homo sapiens
agaaattatgcagtagttttat

SEQ ID NO: 7488280 - DNA, 22 bp, Homo sapiens
agaaattatgcagtagttttat

SEQ ID NO: 7488281 - DNA, 22 bp, Homo sapiens
atctcacagaggcccaccagga

SEQ ID NO: 7488282 - DNA, 22 bp, Homo sapiens
atctcacagaggcccaccagga

SEQ ID NO: 7488283 - DNA, 22 bp, Homo sapiens
atctcacactgggtttgagggt

SEQ ID NO: 7488284 - DNA, 22 bp, Homo sapiens
atctcacactgggtttgagggt

SEQ ID NO: 7488285 - DNA, 22 bp, Homo sapiens
atctcaaatgattacaccaagc

SEQ ID NO: 7488286 - DNA, 22 bp, Homo sapiens
atctcaaagcatggagcagaat

SEQ ID NO: 7488287 - DNA, 22 bp, Homo sapiens
atctcaaagcatggagcagaat

SEQ ID NO: 7488288 - DNA, 22 bp, Homo sapiens
atctcaaagcatggagcagaat

SEQ ID NO: 7488289 - DNA, 22 bp, Homo sapiens
atctcaaagcatggagcagaat

SEQ ID NO: 7488290 - DNA, 22 bp, Homo sapiens
atctcaccaagttattacgaga

SEQ ID NO: 7488291 - DNA, 22 bp, Homo sapiens
atctcacatcctcagtagtgca

SEQ ID NO: 7488292 - DNA, 22 bp, Homo sapiens
atctcacaggactgaaacgtaa

SEQ ID NO: 7488293 - DNA, 22 bp, Homo sapiens
atctcacaggactgaaacgtaa

SEQ ID NO: 7488294 - DNA, 22 bp, Homo sapiens
atctcacagaggcccaccagga

SEQ ID NO: 7488295 - DNA, 21 bp, Homo sapiens
atctcacagcccagagaagcc

SEQ ID NO: 7488296 - DNA, 21 bp, Homo sapiens
atctcacagcccagagaagcc

SEQ ID NO: 7488297 - DNA, 21 bp, Homo sapiens
atctcacagcccagagaagcc

SEQ ID NO: 7488298 - DNA, 22 bp, Homo sapiens
atctaataccctctttatttct

SEQ ID NO: 7488299 - DNA, 22 bp, Homo sapiens
atctaagagttaacatcaagaa

SEQ ID NO: 7488300 - DNA, 22 bp, Homo sapiens
atctaagatgtattgagcactt

SEQ ID NO: 7488301 - DNA, 23 bp, Homo sapiens
atctaatttctccaaatctctac

SEQ ID NO: 7488302 - DNA, 23 bp, Homo sapiens
atctaatttctccaaatctctac

SEQ ID NO: 7488303 - DNA, 23 bp, Homo sapiens
atctaatttctccaaatctctac

SEQ ID NO: 7488304 - DNA, 22 bp, Homo sapiens
atctaattttcactcatttgct

SEQ ID NO: 7488305 - DNA, 22 bp, Homo sapiens
atctaattttcactcatttgct

SEQ ID NO: 7488306 - DNA, 22 bp, Homo sapiens
atctatttctgctaataacaat

SEQ ID NO: 7488307 - DNA, 22 bp, Homo sapiens
atctatttctgctaataacaat

SEQ ID NO: 7488308 - DNA, 22 bp, Homo sapiens
atctaattttcactcatttgct

SEQ ID NO: 7488309 - DNA, 22 bp, Homo sapiens
atctaattttcactcatttgct

SEQ ID NO: 7488310 - DNA, 22 bp, Homo sapiens
atctcaaacatctttgaccata

SEQ ID NO: 7488311 - DNA, 22 bp, Homo sapiens
atctcaaacatctttgaccata

SEQ ID NO: 7488312 - DNA, 22 bp, Homo sapiens
atctcaaaaatgacctagagaa

SEQ ID NO: 7488313 - DNA, 22 bp, Homo sapiens
atctatttctgctaataacaat

SEQ ID NO: 7488314 - DNA, 22 bp, Homo sapiens
atctattttaaatggcagtaaa

SEQ ID NO: 7488315 - DNA, 22 bp, Homo sapiens
atctcaaagcatggagcagaat

SEQ ID NO: 7488316 - DNA, 22 bp, Homo sapiens
atctcaaacatctttgaccata

SEQ ID NO: 7488317 - DNA, 22 bp, Homo sapiens
atcgtttaccctgagtgattgc

SEQ ID NO: 7488318 - DNA, 22 bp, Homo sapiens
atctaaaaggagctctttatct

SEQ ID NO: 7488319 - DNA, 22 bp, Homo sapiens
atctaaaaggagctctttatct

SEQ ID NO: 7488320 - DNA, 22 bp, Homo sapiens
atctaaaaggagctctttatct

SEQ ID NO: 7488321 - DNA, 22 bp, Homo sapiens
atctaaaaggagctctttatct

SEQ ID NO: 7488322 - DNA, 22 bp, Homo sapiens
atctaaaaggagctctttatct

SEQ ID NO: 7488323 - DNA, 22 bp, Homo sapiens
atcgtttaccctgagtgattgc

SEQ ID NO: 7488324 - DNA, 22 bp, Homo sapiens
atcggggaaaagggaggctgtg

SEQ ID NO: 7488325 - DNA, 22 bp, Homo sapiens
atctaaaatgtggttagttggt

SEQ ID NO: 7488326 - DNA, 22 bp, Homo sapiens
atctaaaatgtggttagttggt

SEQ ID NO: 7488327 - DNA, 22 bp, Homo sapiens
atctaaaaggagctctttatct

SEQ ID NO: 7488328 - DNA, 22 bp, Homo sapiens
atctaaaaggagctctttatct

SEQ ID NO: 7488329 - DNA, 22 bp, Homo sapiens
atctaaaatgtggttagttggt

SEQ ID NO: 7488330 - DNA, 22 bp, Homo sapiens
atctaaaatgtggttagttggt

SEQ ID NO: 7488331 - DNA, 22 bp, Homo sapiens
atctaaagtgtcataagtagct

SEQ ID NO: 7488332 - DNA, 23 bp, Homo sapiens
atctaaagtgttaaatagctggg

SEQ ID NO: 7488333 - DNA, 22 bp, Homo sapiens
atctaaactgtttactctctgc

SEQ ID NO: 7488334 - DNA, 22 bp, Homo sapiens
atctaaagtgtcataagtagct

SEQ ID NO: 7488335 - DNA, 23 bp, Homo sapiens
atctaaagtgttaaatagctggg

SEQ ID NO: 7488336 - DNA, 22 bp, Homo sapiens
atctaaagtgtttcatgaaaga

SEQ ID NO: 7488337 - DNA, 22 bp, Homo sapiens
atctaaagtgtcataagtagct

SEQ ID NO: 7488338 - DNA, 22 bp, Homo sapiens
atctaaagtgtttcatgaaaga

SEQ ID NO: 7488339 - DNA, 22 bp, Homo sapiens
atctaagagttaacatcaagaa

SEQ ID NO: 7488340 - DNA, 22 bp, Homo sapiens
atctaacactgtaaactgtctt

SEQ ID NO: 7488341 - DNA, 22 bp, Homo sapiens
atctaacactgtaaactgtctt

SEQ ID NO: 7488342 - DNA, 22 bp, Homo sapiens
atctaacagcaacaccagaata

SEQ ID NO: 7488343 - DNA, 22 bp, Homo sapiens
atcatccatggctgatcataaa

SEQ ID NO: 7488344 - DNA, 22 bp, Homo sapiens
atcatccatggctgatcataaa

SEQ ID NO: 7488345 - DNA, 22 bp, Homo sapiens
atcatcctagaaggaagctagg

SEQ ID NO: 7488346 - DNA, 22 bp, Homo sapiens
atcatcctagaaggaagctagg

SEQ ID NO: 7488347 - DNA, 22 bp, Homo sapiens
atcatcctattgtgccccaggt

SEQ ID NO: 7488348 - DNA, 19 bp, Homo sapiens
atcatcctgggtcatgcac

SEQ ID NO: 7488349 - DNA, 19 bp, Homo sapiens
atcatcctgggtcatgcac

SEQ ID NO: 7488350 - DNA, 22 bp, Homo sapiens
atcatcctattgtgccccaggt

SEQ ID NO: 7488351 - DNA, 22 bp, Homo sapiens
atcatctgtcccaaataagaga

SEQ ID NO: 7488352 - DNA, 22 bp, Homo sapiens
atcatctgggttaatgtgctca

SEQ ID NO: 7488353 - DNA, 22 bp, Homo sapiens
atcatctgcctcatcactgcat

SEQ ID NO: 7488354 - DNA, 22 bp, Homo sapiens
atcatctgcacagatcctattt

SEQ ID NO: 7488355 - DNA, 20 bp, Homo sapiens
atcatctcaaagctgaggtt

SEQ ID NO: 7488356 - DNA, 22 bp, Homo sapiens
atcatctagtttaactttcttt

SEQ ID NO: 7488357 - DNA, 22 bp, Homo sapiens
atcatctagtttaactttcttt

SEQ ID NO: 7488358 - DNA, 22 bp, Homo sapiens
agaacagctgcaaaacttaatc

SEQ ID NO: 7488359 - DNA, 22 bp, Homo sapiens
agaacagcttgcctttaataga

SEQ ID NO: 7488360 - DNA, 22 bp, Homo sapiens
agaacagcttgcctttaataga

SEQ ID NO: 7488361 - DNA, 22 bp, Homo sapiens
agaacaggaggaagccagctcc

SEQ ID NO: 7488362 - DNA, 22 bp, Homo sapiens
agaacaggaggaagccagctcc

SEQ ID NO: 7488363 - DNA, 22 bp, Homo sapiens
agaacaggcagttggttggatt

SEQ ID NO: 7488364 - DNA, 22 bp, Homo sapiens
agaacaggcagttggttggatt

SEQ ID NO: 7488365 - DNA, 22 bp, Homo sapiens
agaacaggcagttggttggatt

SEQ ID NO: 7488366 - DNA, 22 bp, Homo sapiens
agaacaggaggaagccagctcc

SEQ ID NO: 7488367 - DNA, 22 bp, Homo sapiens
agaacaggaggaagccagctcc

SEQ ID NO: 7488368 - DNA, 22 bp, Homo sapiens
agaacaggaggaagccagctcc

SEQ ID NO: 7488369 - DNA, 22 bp, Homo sapiens
atcatccaagcgtagttcttct

SEQ ID NO: 7488370 - DNA, 22 bp, Homo sapiens
agaacagggactggaggcttca

SEQ ID NO: 7488371 - DNA, 22 bp, Homo sapiens
agaacagggactggaggcttca

SEQ ID NO: 7488372 - DNA, 22 bp, Homo sapiens
agaacagggactggaggcttca

SEQ ID NO: 7488373 - DNA, 22 bp, Homo sapiens
atcatccaagcgtagttcttct

SEQ ID NO: 7488374 - DNA, 22 bp, Homo sapiens
atcatccactggagccggcagg

SEQ ID NO: 7488375 - DNA, 22 bp, Homo sapiens
atcatccagccccagaagggag

SEQ ID NO: 7488376 - DNA, 22 bp, Homo sapiens
atcatccatctagcgcgggggg

SEQ ID NO: 7488377 - DNA, 22 bp, Homo sapiens
atcgccgaggtcctgctccaag

SEQ ID NO: 7488378 - DNA, 22 bp, Homo sapiens
atcggcaagccccacaccgtcc

SEQ ID NO: 7488379 - DNA, 22 bp, Homo sapiens
atcggcttaaggcgcaccctct

SEQ ID NO: 7488380 - DNA, 22 bp, Homo sapiens
atcggcttcctgaaggcaagga

SEQ ID NO: 7488381 - DNA, 22 bp, Homo sapiens
atcgctttacagcctgcttcct

SEQ ID NO: 7488382 - DNA, 22 bp, Homo sapiens
atcggcaagccccacaccgtcc

SEQ ID NO: 7488383 - DNA, 22 bp, Homo sapiens
atcgcaagtttaaaaatctttg

SEQ ID NO: 7488384 - DNA, 22 bp, Homo sapiens
atcgcaagtttaaaaatctttg

SEQ ID NO: 7488385 - DNA, 22 bp, Homo sapiens
atcgcaagtttaaaaatctttg

SEQ ID NO: 7488386 - DNA, 22 bp, Homo sapiens
atcgagttctgatgtcccttct

SEQ ID NO: 7488387 - DNA, 22 bp, Homo sapiens
atcgatcccgcgtaaggccccg

SEQ ID NO: 7488388 - DNA, 22 bp, Homo sapiens
atcgactaagaatattgccacc

SEQ ID NO: 7488389 - DNA, 22 bp, Homo sapiens
atccttttcctttgggtgccct

SEQ ID NO: 7488390 - DNA, 22 bp, Homo sapiens
atccttttcctttgggtgccct

SEQ ID NO: 7488391 - DNA, 22 bp, Homo sapiens
atcctgggcaaagtatgctgtc

SEQ ID NO: 7488392 - DNA, 22 bp, Homo sapiens
atcctgggcaaagtatgctgtc

SEQ ID NO: 7488393 - DNA, 18 bp, Homo sapiens
atcctgggagcagacagc

SEQ ID NO: 7488394 - DNA, 18 bp, Homo sapiens
atcctgggagcagacagc

SEQ ID NO: 7488395 - DNA, 18 bp, Homo sapiens
atcctgggagcagacagc

SEQ ID NO: 7488396 - DNA, 22 bp, Homo sapiens
atcatcttgctttctgtttact

SEQ ID NO: 7488397 - DNA, 18 bp, Homo sapiens
atcctgggagcagacagc

SEQ ID NO: 7488398 - DNA, 22 bp, Homo sapiens
atcatcttgaaagtctatgttt

SEQ ID NO: 7488399 - DNA, 22 bp, Homo sapiens
atcatcttgaaagtctatgttt

SEQ ID NO: 7488400 - DNA, 22 bp, Homo sapiens
atcatcttgaaagtctatgttt

SEQ ID NO: 7488401 - DNA, 22 bp, Homo sapiens
atcatcttcgaaaaaagtcaga

SEQ ID NO: 7488402 - DNA, 22 bp, Homo sapiens
atcatcttgaaagtctatgttt

SEQ ID NO: 7488403 - DNA, 22 bp, Homo sapiens
atcatcttcgaaaaaagtcaga

SEQ ID NO: 7488404 - DNA, 22 bp, Homo sapiens
atcatcttcatattcctcagct

SEQ ID NO: 7488405 - DNA, 22 bp, Homo sapiens
atcatcttcgaaaaaagtcaga

SEQ ID NO: 7488406 - DNA, 22 bp, Homo sapiens
atcatcttcgaaaaaagtcaga

SEQ ID NO: 7488407 - DNA, 22 bp, Homo sapiens
atcatcttcgaaaaaagtcaga

SEQ ID NO: 7488408 - DNA, 22 bp, Homo sapiens
atcatcttatctgactcatttt

SEQ ID NO: 7488409 - DNA, 22 bp, Homo sapiens
atcatcttcatattcctcagct

SEQ ID NO: 7488410 - DNA, 22 bp, Homo sapiens
atcatcttcatattcctcagct

SEQ ID NO: 7488411 - DNA, 22 bp, Homo sapiens
atcatcttaaggtatctcaagc

SEQ ID NO: 7488412 - DNA, 22 bp, Homo sapiens
atcatcttatctgactcatttt

SEQ ID NO: 7488413 - DNA, 22 bp, Homo sapiens
atcatcttaaatctagaatgtg

SEQ ID NO: 7488414 - DNA, 22 bp, Homo sapiens
atcatcttaaatctagaatgtg

SEQ ID NO: 7488415 - DNA, 22 bp, Homo sapiens
atcatcttaaatctagaatgtg

SEQ ID NO: 7488416 - DNA, 22 bp, Homo sapiens
atcatcttaaggtatctcaagc

SEQ ID NO: 7488417 - DNA, 22 bp, Homo sapiens
agaaaagtgctctagtgagagc

SEQ ID NO: 7488418 - DNA, 23 bp, Homo sapiens
agaaaagttcatacctttttaac

SEQ ID NO: 7488419 - DNA, 23 bp, Homo sapiens
agaaaagttcatacctttttaac

SEQ ID NO: 7488420 - DNA, 23 bp, Homo sapiens
agaaaagttcatacctttttaac

SEQ ID NO: 7488421 - DNA, 23 bp, Homo sapiens
agaaaagttcatacctttttaac

SEQ ID NO: 7488422 - DNA, 22 bp, Homo sapiens
agaaaagtgctctagtgagagc

SEQ ID NO: 7488423 - DNA, 22 bp, Homo sapiens
agaaaagtgctctagtgagagc

SEQ ID NO: 7488424 - DNA, 22 bp, Homo sapiens
agaaaagtgctctagtgagagc

SEQ ID NO: 7488425 - DNA, 23 bp, Homo sapiens
agaaaagttcatacctttttaac

SEQ ID NO: 7488426 - DNA, 22 bp, Homo sapiens
agaaaagtttaaatcttggcac

SEQ ID NO: 7488427 - DNA, 22 bp, Homo sapiens
agaaaagtttaaatcttggcac

SEQ ID NO: 7488428 - DNA, 22 bp, Homo sapiens
agaaaagtttaaatcttggcac

SEQ ID NO: 7488429 - DNA, 22 bp, Homo sapiens
agaaaagtttaaatcttggcac

SEQ ID NO: 7488430 - DNA, 22 bp, Homo sapiens
agaaaataaattgatggtggaa

SEQ ID NO: 7488431 - DNA, 22 bp, Homo sapiens
agaaaataaattgatggtggaa

SEQ ID NO: 7488432 - DNA, 22 bp, Homo sapiens
agaaaagttttctgagactgac

SEQ ID NO: 7488433 - DNA, 22 bp, Homo sapiens
agaaaagtttaaatcttggcac

SEQ ID NO: 7488434 - DNA, 22 bp, Homo sapiens
agaaaagttttctgagactgac

SEQ ID NO: 7488435 - DNA, 22 bp, Homo sapiens
agaaaagttttctgagactgac

SEQ ID NO: 7488436 - DNA, 22 bp, Homo sapiens
agaaaagttttctgagactgac

SEQ ID NO: 7488437 - DNA, 22 bp, Homo sapiens
agaaaagttttctgagactgac

SEQ ID NO: 7488438 - DNA, 22 bp, Homo sapiens
agaaaagttttctgagactgac

SEQ ID NO: 7488439 - DNA, 22 bp, Homo sapiens
agaaaagttttctgagactgac

SEQ ID NO: 7488440 - DNA, 22 bp, Homo sapiens
agaaaagttttctgagactgac

SEQ ID NO: 7488441 - DNA, 22 bp, Homo sapiens
agaaaaggttgaaagtaggatt

SEQ ID NO: 7488442 - DNA, 22 bp, Homo sapiens
agaaaaggttgaaagtaggatt

SEQ ID NO: 7488443 - DNA, 21 bp, Homo sapiens
agaaaagtagagttttcagag

SEQ ID NO: 7488444 - DNA, 21 bp, Homo sapiens
agaaaagtagagttttcagag

SEQ ID NO: 7488445 - DNA, 21 bp, Homo sapiens
agaaaagtatttgaatcaaga

SEQ ID NO: 7488446 - DNA, 21 bp, Homo sapiens
agaaaagtagagttttcagag

SEQ ID NO: 7488447 - DNA, 21 bp, Homo sapiens
agaaaagtagagttttcagag

SEQ ID NO: 7488448 - DNA, 21 bp, Homo sapiens
agaaaagtatttgaatcaaga

SEQ ID NO: 7488449 - DNA, 21 bp, Homo sapiens
agaaaagtatttgaatcaaga

SEQ ID NO: 7488450 - DNA, 21 bp, Homo sapiens
agaaaagtatttgaatcaaga

SEQ ID NO: 7488451 - DNA, 21 bp, Homo sapiens
agaaaagtatttgaatcaaga

SEQ ID NO: 7488452 - DNA, 22 bp, Homo sapiens
agaaaagtgctctagtgagagc

SEQ ID NO: 7488453 - DNA, 21 bp, Homo sapiens
agaaaagtatttgaatcaaga

SEQ ID NO: 7488454 - DNA, 21 bp, Homo sapiens
agaaaagtatttgaatcaaga

SEQ ID NO: 7488455 - DNA, 22 bp, Homo sapiens
agaaaagtgctctagtgagagc

SEQ ID NO: 7488456 - DNA, 22 bp, Homo sapiens
agaaaagtgctctagtgagagc

SEQ ID NO: 7488457 - DNA, 22 bp, Homo sapiens
agaaaagtgctctagtgagagc

SEQ ID NO: 7488458 - DNA, 22 bp, Homo sapiens
agaaaagtgctctagtgagagc

SEQ ID NO: 7488459 - DNA, 22 bp, Homo sapiens
agaaaagtgctctagtgagagc

SEQ ID NO: 7488460 - DNA, 22 bp, Homo sapiens
atattctagccaaagtgtgagc

SEQ ID NO: 7488461 - DNA, 22 bp, Homo sapiens
atattctataagcagttggaag

SEQ ID NO: 7488462 - DNA, 22 bp, Homo sapiens
atattctataagcagttggaag

SEQ ID NO: 7488463 - DNA, 22 bp, Homo sapiens
atattctctgctgcttttgtgt

SEQ ID NO: 7488464 - DNA, 22 bp, Homo sapiens
atattctgcctcactacagttg

SEQ ID NO: 7488465 - DNA, 22 bp, Homo sapiens
atattctctgctgcttttgtgt

SEQ ID NO: 7488466 - DNA, 22 bp, Homo sapiens
atattctctgctgcttttgtgt

SEQ ID NO: 7488467 - DNA, 22 bp, Homo sapiens
atattctgcctcactacagttg

SEQ ID NO: 7488468 - DNA, 22 bp, Homo sapiens
atattctgcctcactacagttg

SEQ ID NO: 7488469 - DNA, 22 bp, Homo sapiens
atattccagttatatcaaatca

SEQ ID NO: 7488470 - DNA, 22 bp, Homo sapiens
atattccagttatatcaaatca

SEQ ID NO: 7488471 - DNA, 22 bp, Homo sapiens
atattccagttatatcaaatca

SEQ ID NO: 7488472 - DNA, 22 bp, Homo sapiens
atattccagttatatcaaatca

SEQ ID NO: 7488473 - DNA, 22 bp, Homo sapiens
atattccagttatatcaaatca

SEQ ID NO: 7488474 - DNA, 22 bp, Homo sapiens
atattccattggtttcccttct

SEQ ID NO: 7488475 - DNA, 22 bp, Homo sapiens
atattccattggtttcccttct

SEQ ID NO: 7488476 - DNA, 22 bp, Homo sapiens
atattcctgtttttaacacttt

SEQ ID NO: 7488477 - DNA, 22 bp, Homo sapiens
atattcctgtttttaacacttt

SEQ ID NO: 7488478 - DNA, 22 bp, Homo sapiens
atattccttttaaagagttaca

SEQ ID NO: 7488479 - DNA, 22 bp, Homo sapiens
atattccattggtttcccttct

SEQ ID NO: 7488480 - DNA, 22 bp, Homo sapiens
atattccattggtttcccttct

SEQ ID NO: 7488481 - DNA, 22 bp, Homo sapiens
atattccattggtttcccttct

SEQ ID NO: 7488482 - DNA, 22 bp, Homo sapiens
atattccattggtttcccttct

SEQ ID NO: 7488483 - DNA, 22 bp, Homo sapiens
atattcatcgtgtagaaatact

SEQ ID NO: 7488484 - DNA, 22 bp, Homo sapiens
atattacataaacatgagtgaa

SEQ ID NO: 7488485 - DNA, 22 bp, Homo sapiens
atattcatcgtgtagaaatact

SEQ ID NO: 7488486 - DNA, 22 bp, Homo sapiens
atattcatcgtgtagaaatact

SEQ ID NO: 7488487 - DNA, 17 bp, Homo sapiens
atattccaagggcttgg

SEQ ID NO: 7488488 - DNA, 17 bp, Homo sapiens
atattccaagggcttgg

SEQ ID NO: 7488489 - DNA, 22 bp, Homo sapiens
atattcattgaacacctactac

SEQ ID NO: 7488490 - DNA, 22 bp, Homo sapiens
atattcattgaacacctactac

SEQ ID NO: 7488491 - DNA, 22 bp, Homo sapiens
atattcattgaacacctactac

SEQ ID NO: 7488492 - DNA, 22 bp, Homo sapiens
atattcatcgtgtagaaatact

SEQ ID NO: 7488493 - DNA, 22 bp, Homo sapiens
atattcatcgtgtagaaatact

SEQ ID NO: 7488494 - DNA, 22 bp, Homo sapiens
atattcatcgtgtagaaatact

SEQ ID NO: 7488495 - DNA, 22 bp, Homo sapiens
atattacataaacatgagtgaa

SEQ ID NO: 7488496 - DNA, 22 bp, Homo sapiens
atattacacacggtatcacggg

SEQ ID NO: 7488497 - DNA, 22 bp, Homo sapiens
atattacacacggtatcacggg

SEQ ID NO: 7488498 - DNA, 22 bp, Homo sapiens
agaaaataaattgatggtggaa

SEQ ID NO: 7488499 - DNA, 22 bp, Homo sapiens
agaaaataaattgatggtggaa

SEQ ID NO: 7488500 - DNA, 22 bp, Homo sapiens
atattacacacggtatcacggg

SEQ ID NO: 7488501 - DNA, 22 bp, Homo sapiens
atattacacacggtatcacggg

SEQ ID NO: 7488502 - DNA, 22 bp, Homo sapiens
atattcttccaaaacatcattt

SEQ ID NO: 7488503 - DNA, 22 bp, Homo sapiens
atattcttccaaaacatcattt

SEQ ID NO: 7488504 - DNA, 22 bp, Homo sapiens
atattcttccaaaacatcattt

SEQ ID NO: 7488505 - DNA, 22 bp, Homo sapiens
atattcttccaaaacatcattt

SEQ ID NO: 7488506 - DNA, 22 bp, Homo sapiens
atattcttccaaaacatcattt

SEQ ID NO: 7488507 - DNA, 22 bp, Homo sapiens
atattcttccaaaacatcattt

SEQ ID NO: 7488508 - DNA, 22 bp, Homo sapiens
atattcttccaaaacatcattt

SEQ ID NO: 7488509 - DNA, 22 bp, Homo sapiens
atattcttccaaaacatcattt

SEQ ID NO: 7488510 - DNA, 22 bp, Homo sapiens
atattcttccaaaacatcattt

SEQ ID NO: 7488511 - DNA, 22 bp, Homo sapiens
atattctgggttagatatgttt

SEQ ID NO: 7488512 - DNA, 22 bp, Homo sapiens
atattctgggttagatatgttt

SEQ ID NO: 7488513 - DNA, 22 bp, Homo sapiens
atattctgcttttgatgcattc

SEQ ID NO: 7488514 - DNA, 22 bp, Homo sapiens
atattcttatccttttctctgt

SEQ ID NO: 7488515 - DNA, 22 bp, Homo sapiens
atattcttatccttttctctgt

SEQ ID NO: 7488516 - DNA, 22 bp, Homo sapiens
atattcttatccttttctctgt

SEQ ID NO: 7488517 - DNA, 22 bp, Homo sapiens
atattcttccaaaacatcattt

SEQ ID NO: 7488518 - DNA, 22 bp, Homo sapiens
atattcttatccttttctctgt

SEQ ID NO: 7488519 - DNA, 22 bp, Homo sapiens
atattcttccaaaacatcattt

SEQ ID NO: 7488520 - DNA, 22 bp, Homo sapiens
atattcttccaaaacatcattt

SEQ ID NO: 7488521 - DNA, 22 bp, Homo sapiens
atatttataagcaagcaggact

SEQ ID NO: 7488522 - DNA, 22 bp, Homo sapiens
atatttataagcaagcaggact

SEQ ID NO: 7488523 - DNA, 22 bp, Homo sapiens
atatttataagcaagcaggact

SEQ ID NO: 7488524 - DNA, 22 bp, Homo sapiens
atatttataagcaagcaggact

SEQ ID NO: 7488525 - DNA, 22 bp, Homo sapiens
atatttataagcaagcaggact

SEQ ID NO: 7488526 - DNA, 22 bp, Homo sapiens
atatttataagcaagcaggact

SEQ ID NO: 7488527 - DNA, 22 bp, Homo sapiens
atatttataaggcaggcaagta

SEQ ID NO: 7488528 - DNA, 22 bp, Homo sapiens
atatttataaggcaggcaagta

SEQ ID NO: 7488529 - DNA, 22 bp, Homo sapiens
atatttataagcaagcaggact

SEQ ID NO: 7488530 - DNA, 22 bp, Homo sapiens
atatttataaggcaggcaagta

SEQ ID NO: 7488531 - DNA, 22 bp, Homo sapiens
atatttataaggcaggcaagta

SEQ ID NO: 7488532 - DNA, 22 bp, Homo sapiens
atatttcatggggttccatact

SEQ ID NO: 7488533 - DNA, 22 bp, Homo sapiens
atatttcatggggttccatact

SEQ ID NO: 7488534 - DNA, 22 bp, Homo sapiens
atatttcatggggttccatact

SEQ ID NO: 7488535 - DNA, 22 bp, Homo sapiens
atatttcatggggttccatact

SEQ ID NO: 7488536 - DNA, 22 bp, Homo sapiens
atatttcatggggttccatact

SEQ ID NO: 7488537 - DNA, 23 bp, Homo sapiens
atatttccaggttagtgaggtaa

SEQ ID NO: 7488538 - DNA, 22 bp, Homo sapiens
atatttcatggggttccatact

SEQ ID NO: 7488539 - DNA, 21 bp, Homo sapiens
atatttctcataaggttatgg

SEQ ID NO: 7488540 - DNA, 21 bp, Homo sapiens
atatttctcataaggttatgg

SEQ ID NO: 7488541 - DNA, 21 bp, Homo sapiens
atatttctcataaggttatgg

SEQ ID NO: 7488542 - DNA, 21 bp, Homo sapiens
atatttctcataaggttatgg

SEQ ID NO: 7488543 - DNA, 23 bp, Homo sapiens
atatttccaggttagtgaggtaa

SEQ ID NO: 7488544 - DNA, 23 bp, Homo sapiens
atatttccaggttagtgaggtaa

SEQ ID NO: 7488545 - DNA, 20 bp, Homo sapiens
atatttcaggtagtgtgccc

SEQ ID NO: 7488546 - DNA, 20 bp, Homo sapiens
atatttcaggtagtgtgccc

SEQ ID NO: 7488547 - DNA, 20 bp, Homo sapiens
atatttcaggtagtgtgccc

SEQ ID NO: 7488548 - DNA, 22 bp, Homo sapiens
atatttcaggttttgcaggccg

SEQ ID NO: 7488549 - DNA, 22 bp, Homo sapiens
atatttcaggttttgcaggccg

SEQ ID NO: 7488550 - DNA, 22 bp, Homo sapiens
atatttcagctttacttaggaa

SEQ ID NO: 7488551 - DNA, 22 bp, Homo sapiens
atatttcagctttacttaggaa

SEQ ID NO: 7488552 - DNA, 22 bp, Homo sapiens
atatttcagctttacttaggaa

SEQ ID NO: 7488553 - DNA, 22 bp, Homo sapiens
atatttataaggcaggcaagta

SEQ ID NO: 7488554 - DNA, 22 bp, Homo sapiens
atatttataaggcaggcaagta

SEQ ID NO: 7488555 - DNA, 22 bp, Homo sapiens
atatttataaggcaggcaagta

SEQ ID NO: 7488556 - DNA, 22 bp, Homo sapiens
atatttcacgtaggttgttttc

SEQ ID NO: 7488557 - DNA, 22 bp, Homo sapiens
atatttcacgtaggttgttttc

SEQ ID NO: 7488558 - DNA, 22 bp, Homo sapiens
atatttcacgtaggttgttttc

SEQ ID NO: 7488559 - DNA, 22 bp, Homo sapiens
atatttcacgtaggttgttttc

SEQ ID NO: 7488560 - DNA, 21 bp, Homo sapiens
atatttcagatttccgtaatc

SEQ ID NO: 7488561 - DNA, 21 bp, Homo sapiens
atatttcagatttccgtaatc

SEQ ID NO: 7488562 - DNA, 22 bp, Homo sapiens
atatttcacgtaggttgttttc

SEQ ID NO: 7488563 - DNA, 22 bp, Homo sapiens
atatggatgagataatgagcca

SEQ ID NO: 7488564 - DNA, 22 bp, Homo sapiens
atatggcaaaggggaattaagg

SEQ ID NO: 7488565 - DNA, 22 bp, Homo sapiens
agaaaagggcaggagggataca

SEQ ID NO: 7488566 - DNA, 22 bp, Homo sapiens
atatggagaactcaaaaagtga

SEQ ID NO: 7488567 - DNA, 22 bp, Homo sapiens
atatggagtccttgctgtgtgc

SEQ ID NO: 7488568 - DNA, 22 bp, Homo sapiens
atatggaatggtaatctacaat

SEQ ID NO: 7488569 - DNA, 22 bp, Homo sapiens
atatggaatggtaatctacaat

SEQ ID NO: 7488570 - DNA, 22 bp, Homo sapiens
atatgcttgactctttcacatc

SEQ ID NO: 7488571 - DNA, 22 bp, Homo sapiens
atatggaatggtaatctacaat

SEQ ID NO: 7488572 - DNA, 22 bp, Homo sapiens
agaaaaggttgaaagtaggatt

SEQ ID NO: 7488573 - DNA, 22 bp, Homo sapiens
agaaaaggttgaaagtaggatt

SEQ ID NO: 7488574 - DNA, 22 bp, Homo sapiens
agaaaagggcaggagggataca

SEQ ID NO: 7488575 - DNA, 22 bp, Homo sapiens
agaaaaggttgaaagtaggatt

SEQ ID NO: 7488576 - DNA, 22 bp, Homo sapiens
agaaaaggttgaaagtaggatt

SEQ ID NO: 7488577 - DNA, 22 bp, Homo sapiens
agaaaaggttgaaagtaggatt

SEQ ID NO: 7488578 - DNA, 22 bp, Homo sapiens
agaaaaggttgaaagtaggatt

SEQ ID NO: 7488579 - DNA, 22 bp, Homo sapiens
agaaaaggttgaaagtaggatt

SEQ ID NO: 7488580 - DNA, 22 bp, Homo sapiens
agaaaaggttgaaagtaggatt

SEQ ID NO: 7488581 - DNA, 22 bp, Homo sapiens
agaaaaggttgaaagtaggatt

SEQ ID NO: 7488582 - DNA, 22 bp, Homo sapiens
agaaaaggttgaaagtaggatt

SEQ ID NO: 7488583 - DNA, 22 bp, Homo sapiens
agaaaaggttgaaagtaggatt

SEQ ID NO: 7488584 - DNA, 22 bp, Homo sapiens
atatgcttgtcacacacatcca

SEQ ID NO: 7488585 - DNA, 22 bp, Homo sapiens
atatgcttgtcacacacatcca

SEQ ID NO: 7488586 - DNA, 22 bp, Homo sapiens
atatgctttgggattagatcat

SEQ ID NO: 7488587 - DNA, 22 bp, Homo sapiens
atatgctttgggattagatcat

SEQ ID NO: 7488588 - DNA, 22 bp, Homo sapiens
atatggaactattctgtgtaga

SEQ ID NO: 7488589 - DNA, 22 bp, Homo sapiens
atatggaaatagcaatatggtt

SEQ ID NO: 7488590 - DNA, 17 bp, Homo sapiens
atatgctttgtatttat

SEQ ID NO: 7488591 - DNA, 22 bp, Homo sapiens
atatggaaatagcaatatggtt

SEQ ID NO: 7488592 - DNA, 22 bp, Homo sapiens
atatggaatggtaatctacaat

SEQ ID NO: 7488593 - DNA, 18 bp, Homo sapiens
atatggaatgcctggcta

SEQ ID NO: 7488594 - DNA, 18 bp, Homo sapiens
atatggaatgcctggcta

SEQ ID NO: 7488595 - DNA, 22 bp, Homo sapiens
atatggaagttacctgacttca

SEQ ID NO: 7488596 - DNA, 22 bp, Homo sapiens
atatggaagttacctgacttca

SEQ ID NO: 7488597 - DNA, 22 bp, Homo sapiens
atatggaagagcctgggaattt

SEQ ID NO: 7488598 - DNA, 22 bp, Homo sapiens
atatggaagagcctgggaattt

SEQ ID NO: 7488599 - DNA, 22 bp, Homo sapiens
atatggaactattctgtgtaga

SEQ ID NO: 7488600 - DNA, 22 bp, Homo sapiens
atatggaactattctgtgtaga

SEQ ID NO: 7488601 - DNA, 22 bp, Homo sapiens
atatggaagagcctgggaattt

SEQ ID NO: 7488602 - DNA, 22 bp, Homo sapiens
atatggaagttacctgacttca

SEQ ID NO: 7488603 - DNA, 20 bp, Homo sapiens
actttctcggtttctcacct

SEQ ID NO: 7488604 - DNA, 22 bp, Homo sapiens
atatgcttatgatgtctcaagt

SEQ ID NO: 7488605 - DNA, 22 bp, Homo sapiens
atatgcttccaagttattccac

SEQ ID NO: 7488606 - DNA, 22 bp, Homo sapiens
atatgcttccaagttattccac

SEQ ID NO: 7488607 - DNA, 22 bp, Homo sapiens
atatgcttccaagttattccac

SEQ ID NO: 7488608 - DNA, 22 bp, Homo sapiens
atatgcttgactctttcacatc

SEQ ID NO: 7488609 - DNA, 22 bp, Homo sapiens
atatgcttgggactgatacagt

SEQ ID NO: 7488610 - DNA, 22 bp, Homo sapiens
atatgcttgggactgatacagt

SEQ ID NO: 7488611 - DNA, 22 bp, Homo sapiens
atatgcttgggactgatacagt

SEQ ID NO: 7488612 - DNA, 22 bp, Homo sapiens
atatgcttacagcttaaaatcc

SEQ ID NO: 7488613 - DNA, 22 bp, Homo sapiens
atatgcttatgatggttaattt

SEQ ID NO: 7488614 - DNA, 22 bp, Homo sapiens
atatgcttatgatggttaattt

SEQ ID NO: 7488615 - DNA, 22 bp, Homo sapiens
atatgaaagtaagcatgtgtgt

SEQ ID NO: 7488616 - DNA, 20 bp, Homo sapiens
actttctcggtttctcacct

SEQ ID NO: 7488617 - DNA, 22 bp, Homo sapiens
atatgaaagtaagcatgtgtgt

SEQ ID NO: 7488618 - DNA, 22 bp, Homo sapiens
atatgaaagtaagcatgtgtgt

SEQ ID NO: 7488619 - DNA, 22 bp, Homo sapiens
atatgaaagtaagcatgtgtgt

SEQ ID NO: 7488620 - DNA, 22 bp, Homo sapiens
actttctcccacccacccgtct

SEQ ID NO: 7488621 - DNA, 20 bp, Homo sapiens
actttctcggtttctcacct

SEQ ID NO: 7488622 - DNA, 22 bp, Homo sapiens
actttctcccacccacccgtct

SEQ ID NO: 7488623 - DNA, 22 bp, Homo sapiens
actttctcaggaattcacagac

SEQ ID NO: 7488624 - DNA, 22 bp, Homo sapiens
actttctcaggaattcacagac

SEQ ID NO: 7488625 - DNA, 22 bp, Homo sapiens
actttctccagaaaaccaagga

SEQ ID NO: 7488626 - DNA, 19 bp, Homo sapiens
actttctccaggacctgtt

SEQ ID NO: 7488627 - DNA, 22 bp, Homo sapiens
actttctccagaaaaccaagga

SEQ ID NO: 7488628 - DNA, 22 bp, Homo sapiens
actttcatgttggtgaagggtt

SEQ ID NO: 7488629 - DNA, 22 bp, Homo sapiens
actttcatggtagttgtattct

SEQ ID NO: 7488630 - DNA, 22 bp, Homo sapiens
actttcatggatctctgttcag

SEQ ID NO: 7488631 - DNA, 22 bp, Homo sapiens
actttcatttgtgaagactgta

SEQ ID NO: 7488632 - DNA, 22 bp, Homo sapiens
actttcatttgtaataaacttc

SEQ ID NO: 7488633 - DNA, 22 bp, Homo sapiens
actttcatttgtaataaacttc

SEQ ID NO: 7488634 - DNA, 22 bp, Homo sapiens
actttcatttgtaataaacttc

SEQ ID NO: 7488635 - DNA, 22 bp, Homo sapiens
actttcatttgtaataaacttc

SEQ ID NO: 7488636 - DNA, 22 bp, Homo sapiens
actttcatttgtaataaacttc

SEQ ID NO: 7488637 - DNA, 22 bp, Homo sapiens
actttcatttgtaataaacttc

SEQ ID NO: 7488638 - DNA, 22 bp, Homo sapiens
actttcatttgtaataaacttc

SEQ ID NO: 7488639 - DNA, 22 bp, Homo sapiens
actttcatgttggtgaagggtt

SEQ ID NO: 7488640 - DNA, 22 bp, Homo sapiens
actttcatgttggtgaagggtt

SEQ ID NO: 7488641 - DNA, 22 bp, Homo sapiens
actttcagaattgtacagagtc

SEQ ID NO: 7488642 - DNA, 22 bp, Homo sapiens
actttcatgctctgagcactgg

SEQ ID NO: 7488643 - DNA, 22 bp, Homo sapiens
actttcaatttgcactaaccta

SEQ ID NO: 7488644 - DNA, 22 bp, Homo sapiens
actttcaattcccttagcaact

SEQ ID NO: 7488645 - DNA, 22 bp, Homo sapiens
actttcaattcccttagcaact

SEQ ID NO: 7488646 - DNA, 22 bp, Homo sapiens
actttcaattcactgagatata

SEQ ID NO: 7488647 - DNA, 22 bp, Homo sapiens
actttcaattcactgagatata

SEQ ID NO: 7488648 - DNA, 22 bp, Homo sapiens
actttcaagaacttctttaatg

SEQ ID NO: 7488649 - DNA, 22 bp, Homo sapiens
actttcaagcaagaacactttg

SEQ ID NO: 7488650 - DNA, 22 bp, Homo sapiens
actttcaagccctctagagaca

SEQ ID NO: 7488651 - DNA, 22 bp, Homo sapiens
actttcaagccctctagagaca

SEQ ID NO: 7488652 - DNA, 22 bp, Homo sapiens
actttcaagccctctagagaca

SEQ ID NO: 7488653 - DNA, 22 bp, Homo sapiens
actttcaagcaagaacactttg

SEQ ID NO: 7488654 - DNA, 22 bp, Homo sapiens
actttcaacctgtcccccagag

SEQ ID NO: 7488655 - DNA, 22 bp, Homo sapiens
actttcaagaacttctttaatg

SEQ ID NO: 7488656 - DNA, 22 bp, Homo sapiens
actttcaagaacttctttaatg

SEQ ID NO: 7488657 - DNA, 22 bp, Homo sapiens
actttcaagaacttctttaatg

SEQ ID NO: 7488658 - DNA, 22 bp, Homo sapiens
actttcaagcaagaacactttg

SEQ ID NO: 7488659 - DNA, 22 bp, Homo sapiens
actttctattgtttagattctg

SEQ ID NO: 7488660 - DNA, 22 bp, Homo sapiens
actttctattgtttagattctg

SEQ ID NO: 7488661 - DNA, 22 bp, Homo sapiens
actttctattcccacagagata

SEQ ID NO: 7488662 - DNA, 22 bp, Homo sapiens
actttctattcccacagagata

SEQ ID NO: 7488663 - DNA, 22 bp, Homo sapiens
actttctcaggaattcacagac

SEQ ID NO: 7488664 - DNA, 22 bp, Homo sapiens
actttctcaggaattcacagac

SEQ ID NO: 7488665 - DNA, 22 bp, Homo sapiens
actttctcaaatcagactttaa

SEQ ID NO: 7488666 - DNA, 22 bp, Homo sapiens
actttctcaaatcagactttaa

SEQ ID NO: 7488667 - DNA, 22 bp, Homo sapiens
actttctaggtctcagtccttt

SEQ ID NO: 7488668 - DNA, 22 bp, Homo sapiens
actttctaggtctcagtccttt

SEQ ID NO: 7488669 - DNA, 22 bp, Homo sapiens
actttctaggtctcagtccttt

SEQ ID NO: 7488670 - DNA, 22 bp, Homo sapiens
actttctaggtctcagtccttt

SEQ ID NO: 7488671 - DNA, 22 bp, Homo sapiens
actttctaggtctcagtccttt

SEQ ID NO: 7488672 - DNA, 22 bp, Homo sapiens
actttctaggtgctattgtgat

SEQ ID NO: 7488673 - DNA, 22 bp, Homo sapiens
actttctaggtgctattgtgat

SEQ ID NO: 7488674 - DNA, 22 bp, Homo sapiens
actttctaggtgctattgtgat

SEQ ID NO: 7488675 - DNA, 22 bp, Homo sapiens
actttctattcccacagagata

SEQ ID NO: 7488676 - DNA, 22 bp, Homo sapiens
actttctattcccacagagata

SEQ ID NO: 7488677 - DNA, 22 bp, Homo sapiens
actttctattcccacagagata

SEQ ID NO: 7488678 - DNA, 22 bp, Homo sapiens
actttctattcccacagagata

SEQ ID NO: 7488679 - DNA, 22 bp, Homo sapiens
actttctatggcttattatgag

SEQ ID NO: 7488680 - DNA, 22 bp, Homo sapiens
actttctatggcttattatgag

SEQ ID NO: 7488681 - DNA, 22 bp, Homo sapiens
actttctatggcttattatgag

SEQ ID NO: 7488682 - DNA, 22 bp, Homo sapiens
actttctatggcttattatgag

SEQ ID NO: 7488683 - DNA, 23 bp, Homo sapiens
actttcccatagcatggcttcct

SEQ ID NO: 7488684 - DNA, 23 bp, Homo sapiens
actttcccatagcatggcttcct

SEQ ID NO: 7488685 - DNA, 22 bp, Homo sapiens
actttcccacttaatgtattta

SEQ ID NO: 7488686 - DNA, 22 bp, Homo sapiens
actttcccacttaatgtattta

SEQ ID NO: 7488687 - DNA, 22 bp, Homo sapiens
actttcctagacttcagtgaca

SEQ ID NO: 7488688 - DNA, 22 bp, Homo sapiens
actttccctctcagaactctta

SEQ ID NO: 7488689 - DNA, 22 bp, Homo sapiens
actttcctagacttcagtgaca

SEQ ID NO: 7488690 - DNA, 22 bp, Homo sapiens
actttcctagacttcagtgaca

SEQ ID NO: 7488691 - DNA, 22 bp, Homo sapiens
actttcctagacttcagtgaca

SEQ ID NO: 7488692 - DNA, 22 bp, Homo sapiens
actttccttatggatggggaaa

SEQ ID NO: 7488693 - DNA, 22 bp, Homo sapiens
actttctaaaattgctagcact

SEQ ID NO: 7488694 - DNA, 22 bp, Homo sapiens
actttctaaaattgctagcact

SEQ ID NO: 7488695 - DNA, 22 bp, Homo sapiens
actttctaattgtctccagtgt

SEQ ID NO: 7488696 - DNA, 22 bp, Homo sapiens
actttcctggccctgtcctctg

SEQ ID NO: 7488697 - DNA, 22 bp, Homo sapiens
actttcctgccaaggccagagt

SEQ ID NO: 7488698 - DNA, 22 bp, Homo sapiens
actttcctggccctgtcctctg

SEQ ID NO: 7488699 - DNA, 22 bp, Homo sapiens
actttcctgccaaggccagagt

SEQ ID NO: 7488700 - DNA, 22 bp, Homo sapiens
actttcctggccctgtcctctg

SEQ ID NO: 7488701 - DNA, 22 bp, Homo sapiens
actttatgacaccctttagtga

SEQ ID NO: 7488702 - DNA, 22 bp, Homo sapiens
actttatttcctattgcatcca

SEQ ID NO: 7488703 - DNA, 22 bp, Homo sapiens
actttatttcctattgcatcca

SEQ ID NO: 7488704 - DNA, 22 bp, Homo sapiens
actttatttcctattgcatcca

SEQ ID NO: 7488705 - DNA, 22 bp, Homo sapiens
actttatcaggaatcacacagc

SEQ ID NO: 7488706 - DNA, 22 bp, Homo sapiens
actttcaaaagagaagtcatga

SEQ ID NO: 7488707 - DNA, 22 bp, Homo sapiens
actttcaaaagagaagtcatga

SEQ ID NO: 7488708 - DNA, 22 bp, Homo sapiens
actttcaaatatcatgattcta

SEQ ID NO: 7488709 - DNA, 22 bp, Homo sapiens
actttcaaatatcatgattcta

SEQ ID NO: 7488710 - DNA, 22 bp, Homo sapiens
actttcaaatatcatgattcta

SEQ ID NO: 7488711 - DNA, 22 bp, Homo sapiens
actttatttcctattgcatcca

SEQ ID NO: 7488712 - DNA, 22 bp, Homo sapiens
actttcaaaagagaagtcatga

SEQ ID NO: 7488713 - DNA, 22 bp, Homo sapiens
actttatttcctattgcatcca

SEQ ID NO: 7488714 - DNA, 22 bp, Homo sapiens
actttatttcctattgcatcca

SEQ ID NO: 7488715 - DNA, 22 bp, Homo sapiens
atactgtatatctgagagccca

SEQ ID NO: 7488716 - DNA, 22 bp, Homo sapiens
atactgtatatttcacatcttg

SEQ ID NO: 7488717 - DNA, 22 bp, Homo sapiens
atactgtagaggcatagctagt

SEQ ID NO: 7488718 - DNA, 22 bp, Homo sapiens
atactgtagaggcatagctagt

SEQ ID NO: 7488719 - DNA, 22 bp, Homo sapiens
atactgtagaggcatagctagt

SEQ ID NO: 7488720 - DNA, 22 bp, Homo sapiens
atactgtagaggcatagctagt

SEQ ID NO: 7488721 - DNA, 22 bp, Homo sapiens
atactgtatcacttgtgagtga

SEQ ID NO: 7488722 - DNA, 22 bp, Homo sapiens
atactgtatcacttgtgagtga

SEQ ID NO: 7488723 - DNA, 22 bp, Homo sapiens
atactgtgtaaaatttgaacct

SEQ ID NO: 7488724 - DNA, 22 bp, Homo sapiens
actttagtctgtttcattatct

SEQ ID NO: 7488725 - DNA, 22 bp, Homo sapiens
actttagtaaacttatgttact

SEQ ID NO: 7488726 - DNA, 22 bp, Homo sapiens
atactgtgtgcagagtcctaat

SEQ ID NO: 7488727 - DNA, 22 bp, Homo sapiens
atactgtgtgcagagtcctaat

SEQ ID NO: 7488728 - DNA, 22 bp, Homo sapiens
atactgtgtgcagagtcctaat

SEQ ID NO: 7488729 - DNA, 22 bp, Homo sapiens
atactgaattaggtaaagcata

SEQ ID NO: 7488730 - DNA, 22 bp, Homo sapiens
atactgaattaggtaaagcata

SEQ ID NO: 7488731 - DNA, 22 bp, Homo sapiens
atactgaattaggtaaagcata

SEQ ID NO: 7488732 - DNA, 22 bp, Homo sapiens
atactgaattaggtaaagcata

SEQ ID NO: 7488733 - DNA, 22 bp, Homo sapiens
atactgaattaggtaaagcata

SEQ ID NO: 7488734 - DNA, 21 bp, Homo sapiens
atactgaacctcataagccca

SEQ ID NO: 7488735 - DNA, 22 bp, Homo sapiens
atactgaaggcattcagataac

SEQ ID NO: 7488736 - DNA, 22 bp, Homo sapiens
atactgaaggcattcagataac

SEQ ID NO: 7488737 - DNA, 22 bp, Homo sapiens
atactgaaggcattcagataac

SEQ ID NO: 7488738 - DNA, 22 bp, Homo sapiens
atactgaaggcattcagataac

SEQ ID NO: 7488739 - DNA, 22 bp, Homo sapiens
atactgaattaggtaaagcata

SEQ ID NO: 7488740 - DNA, 22 bp, Homo sapiens
atactgaattaggtaaagcata

SEQ ID NO: 7488741 - DNA, 22 bp, Homo sapiens
atactgaaagggtgttacctaa

SEQ ID NO: 7488742 - DNA, 22 bp, Homo sapiens
atactgaacatgtttgcagtca

SEQ ID NO: 7488743 - DNA, 22 bp, Homo sapiens
atactgaacatgtttgcagtca

SEQ ID NO: 7488744 - DNA, 22 bp, Homo sapiens
atactgaacatgtttgcagtca

SEQ ID NO: 7488745 - DNA, 22 bp, Homo sapiens
atactgaacatgtttgcagtca

SEQ ID NO: 7488746 - DNA, 23 bp, Homo sapiens
atactgaaactgttgtttatctg

SEQ ID NO: 7488747 - DNA, 22 bp, Homo sapiens
atactgaaagggtgttacctaa

SEQ ID NO: 7488748 - DNA, 23 bp, Homo sapiens
atactgaaactgttgtttatctg

SEQ ID NO: 7488749 - DNA, 22 bp, Homo sapiens
atactgaaaataagtgagttga

SEQ ID NO: 7488750 - DNA, 22 bp, Homo sapiens
atactgaaaataagtgagttga

SEQ ID NO: 7488751 - DNA, 22 bp, Homo sapiens
atactgaaaaatgatttgctgt

SEQ ID NO: 7488752 - DNA, 22 bp, Homo sapiens
atacattcaaaggaaggataga

SEQ ID NO: 7488753 - DNA, 22 bp, Homo sapiens
atactggagaagccaagaagcc

SEQ ID NO: 7488754 - DNA, 22 bp, Homo sapiens
atactggatttgaaacatttca

SEQ ID NO: 7488755 - DNA, 22 bp, Homo sapiens
atactgatacggaagaaaaaag

SEQ ID NO: 7488756 - DNA, 22 bp, Homo sapiens
atactgatgatgtgaagaaaca

SEQ ID NO: 7488757 - DNA, 22 bp, Homo sapiens
atactgatgatgtgaagaaaca

SEQ ID NO: 7488758 - DNA, 22 bp, Homo sapiens
atactgatgatgtgaagaaaca

SEQ ID NO: 7488759 - DNA, 22 bp, Homo sapiens
atactgattgatattcccatga

SEQ ID NO: 7488760 - DNA, 22 bp, Homo sapiens
atactgattagttgagaaagca

SEQ ID NO: 7488761 - DNA, 22 bp, Homo sapiens
atactgattagttgagaaagca

SEQ ID NO: 7488762 - DNA, 22 bp, Homo sapiens
atactgtaatacctaaatgaac

SEQ ID NO: 7488763 - DNA, 22 bp, Homo sapiens
atactgtaatacctaaatgaac

SEQ ID NO: 7488764 - DNA, 22 bp, Homo sapiens
atactgtaatacctaaatgaac

SEQ ID NO: 7488765 - DNA, 22 bp, Homo sapiens
atactgtacgtcccagatagga

SEQ ID NO: 7488766 - DNA, 22 bp, Homo sapiens
atactgtacgctcctggcattt

SEQ ID NO: 7488767 - DNA, 22 bp, Homo sapiens
atacatgttgagaaaatatctg

SEQ ID NO: 7488768 - DNA, 22 bp, Homo sapiens
atacatgttgagaaaatatctg

SEQ ID NO: 7488769 - DNA, 22 bp, Homo sapiens
atacatgttgtaccatatgttt

SEQ ID NO: 7488770 - DNA, 22 bp, Homo sapiens
atacatgttgtaccatatgttt

SEQ ID NO: 7488771 - DNA, 22 bp, Homo sapiens
atacatgttgtaccatatgttt

SEQ ID NO: 7488772 - DNA, 22 bp, Homo sapiens
atacatgttgtaccatatgttt

SEQ ID NO: 7488773 - DNA, 22 bp, Homo sapiens
atacattagctcatatgattaa

SEQ ID NO: 7488774 - DNA, 22 bp, Homo sapiens
atacattagctcatatgattaa

SEQ ID NO: 7488775 - DNA, 22 bp, Homo sapiens
atacattagaatctggtactca

SEQ ID NO: 7488776 - DNA, 22 bp, Homo sapiens
atacattagaatctggtactca

SEQ ID NO: 7488777 - DNA, 22 bp, Homo sapiens
atacattagaatctggtactca

SEQ ID NO: 7488778 - DNA, 22 bp, Homo sapiens
atacattagaatctggtactca

SEQ ID NO: 7488779 - DNA, 22 bp, Homo sapiens
atacatgttgtaccatatgttt

SEQ ID NO: 7488780 - DNA, 22 bp, Homo sapiens
atacatgttgtaccatatgttt

SEQ ID NO: 7488781 - DNA, 22 bp, Homo sapiens
atacatgttgtaccatatgttt

SEQ ID NO: 7488782 - DNA, 22 bp, Homo sapiens
atacatgttgtaccatatgttt

SEQ ID NO: 7488783 - DNA, 22 bp, Homo sapiens
atacattagctcatatgattaa

SEQ ID NO: 7488784 - DNA, 22 bp, Homo sapiens
atacattagctcatatgattaa

SEQ ID NO: 7488785 - DNA, 22 bp, Homo sapiens
atacattagctcatatgattaa

SEQ ID NO: 7488786 - DNA, 22 bp, Homo sapiens
atacattagctcatatgattaa

SEQ ID NO: 7488787 - DNA, 22 bp, Homo sapiens
atacattagctcatatgattaa

SEQ ID NO: 7488788 - DNA, 22 bp, Homo sapiens
atacattagctcatatgattaa

SEQ ID NO: 7488789 - DNA, 22 bp, Homo sapiens
atacattagctcatatgattaa

SEQ ID NO: 7488790 - DNA, 22 bp, Homo sapiens
atacattagtgaacaaaagaga

SEQ ID NO: 7488791 - DNA, 22 bp, Homo sapiens
atacattagtgaacaaaagaga

SEQ ID NO: 7488792 - DNA, 22 bp, Homo sapiens
atacattagtgaacaaaagaga

SEQ ID NO: 7488793 - DNA, 22 bp, Homo sapiens
atacattagtgaacaaaagaga

SEQ ID NO: 7488794 - DNA, 22 bp, Homo sapiens
atacattagtgaacaaaagaga

SEQ ID NO: 7488795 - DNA, 22 bp, Homo sapiens
atacattagtgaacaaaagaga

SEQ ID NO: 7488796 - DNA, 22 bp, Homo sapiens
atacattattgttaaagaacat

SEQ ID NO: 7488797 - DNA, 22 bp, Homo sapiens
atacattattgttaaagaacat

SEQ ID NO: 7488798 - DNA, 22 bp, Homo sapiens
acttctgtcctccaagccacgt

SEQ ID NO: 7488799 - DNA, 22 bp, Homo sapiens
acttctgtatgtcctgcattca

SEQ ID NO: 7488800 - DNA, 22 bp, Homo sapiens
acttctgtcctccaagccacgt

SEQ ID NO: 7488801 - DNA, 22 bp, Homo sapiens
acttctgtcctccaagccacgt

SEQ ID NO: 7488802 - DNA, 22 bp, Homo sapiens
acttctgtcctccaagccacgt

SEQ ID NO: 7488803 - DNA, 22 bp, Homo sapiens
acttcttcttcagctgggggat

SEQ ID NO: 7488804 - DNA, 22 bp, Homo sapiens
acttcttcttcagctgggggat

SEQ ID NO: 7488805 - DNA, 22 bp, Homo sapiens
acttctgggtcccacccccaga

SEQ ID NO: 7488806 - DNA, 22 bp, Homo sapiens
acttctgtaaagggaagacagt

SEQ ID NO: 7488807 - DNA, 22 bp, Homo sapiens
acttctgtaaagggaagacagt

SEQ ID NO: 7488808 - DNA, 22 bp, Homo sapiens
acttctgtatgtcctgcattca

SEQ ID NO: 7488809 - DNA, 22 bp, Homo sapiens
acttctgtatgtcctgcattca

SEQ ID NO: 7488810 - DNA, 22 bp, Homo sapiens
acttctggtgtcatactgcatt

SEQ ID NO: 7488811 - DNA, 22 bp, Homo sapiens
acttctggaggcctagggaaga

SEQ ID NO: 7488812 - DNA, 22 bp, Homo sapiens
acttctggatagagtcagcttt

SEQ ID NO: 7488813 - DNA, 22 bp, Homo sapiens
acttctggatagagtcagcttt

SEQ ID NO: 7488814 - DNA, 22 bp, Homo sapiens
atacatgttcgtgtacatgttc

SEQ ID NO: 7488815 - DNA, 22 bp, Homo sapiens
atacatgttcgtgtacatgttc

SEQ ID NO: 7488816 - DNA, 22 bp, Homo sapiens
atacatgttcgtgtacatgttc

SEQ ID NO: 7488817 - DNA, 22 bp, Homo sapiens
atacatgttgagaaaatatctg

SEQ ID NO: 7488818 - DNA, 22 bp, Homo sapiens
atacatgttcgtgtacatgttc

SEQ ID NO: 7488819 - DNA, 22 bp, Homo sapiens
atacatgttcgtgtacatgttc

SEQ ID NO: 7488820 - DNA, 22 bp, Homo sapiens
atacatgttgagaaaatatctg

SEQ ID NO: 7488821 - DNA, 22 bp, Homo sapiens
atacatgttgagaaaatatctg

SEQ ID NO: 7488822 - DNA, 22 bp, Homo sapiens
atacatgttgagaaaatatctg

SEQ ID NO: 7488823 - DNA, 22 bp, Homo sapiens
atacatgttgagaaaatatctg

SEQ ID NO: 7488824 - DNA, 22 bp, Homo sapiens
atacatgttgagaaaatatctg

SEQ ID NO: 7488825 - DNA, 22 bp, Homo sapiens
atacatgttgagaaaatatctg

SEQ ID NO: 7488826 - DNA, 22 bp, Homo sapiens
atacatctatgcctttctgaca

SEQ ID NO: 7488827 - DNA, 22 bp, Homo sapiens
atacatctagagtcataaaaac

SEQ ID NO: 7488828 - DNA, 22 bp, Homo sapiens
atacatctatgcctttctgaca

SEQ ID NO: 7488829 - DNA, 22 bp, Homo sapiens
atacatctatgcctttctgaca

SEQ ID NO: 7488830 - DNA, 22 bp, Homo sapiens
acttcttgatgaaaatggtact

SEQ ID NO: 7488831 - DNA, 22 bp, Homo sapiens
acttcttgggaccctggcaccg

SEQ ID NO: 7488832 - DNA, 22 bp, Homo sapiens
acttagaagatgcagtaaagca

SEQ ID NO: 7488833 - DNA, 22 bp, Homo sapiens
acttagaagatgcagtaaagca

SEQ ID NO: 7488834 - DNA, 22 bp, Homo sapiens
acttagaagatgcagtaaagca

SEQ ID NO: 7488835 - DNA, 22 bp, Homo sapiens
acttagaagatgcagtaaagca

SEQ ID NO: 7488836 - DNA, 22 bp, Homo sapiens
acttagaagatgcagtaaagca

SEQ ID NO: 7488837 - DNA, 22 bp, Homo sapiens
acttagaacaggcagaattcca

SEQ ID NO: 7488838 - DNA, 22 bp, Homo sapiens
acttagaatatgttcaagattt

SEQ ID NO: 7488839 - DNA, 22 bp, Homo sapiens
acttagaatatgttcaagattt

SEQ ID NO: 7488840 - DNA, 22 bp, Homo sapiens
atacacttgtacattttttaat

SEQ ID NO: 7488841 - DNA, 20 bp, Homo sapiens
atacacttgcccagcttgtg

SEQ ID NO: 7488842 - DNA, 20 bp, Homo sapiens
atacacttgcccagcttgtg

SEQ ID NO: 7488843 - DNA, 22 bp, Homo sapiens
atacacttgtacattttttaat

SEQ ID NO: 7488844 - DNA, 22 bp, Homo sapiens
atacacttgtacattttttaat

SEQ ID NO: 7488845 - DNA, 22 bp, Homo sapiens
atacacttgtacattttttaat

SEQ ID NO: 7488846 - DNA, 22 bp, Homo sapiens
atacagatgttgaatgttatat

SEQ ID NO: 7488847 - DNA, 22 bp, Homo sapiens
atacagatgttgaatgttatat

SEQ ID NO: 7488848 - DNA, 22 bp, Homo sapiens
atacagatgttaaagcaatttc

SEQ ID NO: 7488849 - DNA, 22 bp, Homo sapiens
atacagatgttgaatgttatat

SEQ ID NO: 7488850 - DNA, 22 bp, Homo sapiens
acttagaatatgttcaagattt

SEQ ID NO: 7488851 - DNA, 22 bp, Homo sapiens
atacagatgttaaagcaatttc

SEQ ID NO: 7488852 - DNA, 22 bp, Homo sapiens
acttacaatcaaccaccttgga

SEQ ID NO: 7488853 - DNA, 22 bp, Homo sapiens
acttacaatcaaccaccttgga

SEQ ID NO: 7488854 - DNA, 22 bp, Homo sapiens
acttacaatcaaccaccttgga

SEQ ID NO: 7488855 - DNA, 22 bp, Homo sapiens
acttaccagagaggatccgccc

SEQ ID NO: 7488856 - DNA, 22 bp, Homo sapiens
acttagaaagggattctagatt

SEQ ID NO: 7488857 - DNA, 22 bp, Homo sapiens
acttagaaagggattctagatt

SEQ ID NO: 7488858 - DNA, 22 bp, Homo sapiens
acttacctaatagtccatagca

SEQ ID NO: 7488859 - DNA, 22 bp, Homo sapiens
acttagaacaggcagaattcca

SEQ ID NO: 7488860 - DNA, 22 bp, Homo sapiens
acttagaacaggcagaattcca

SEQ ID NO: 7488861 - DNA, 22 bp, Homo sapiens
acttacaagttccctttctcag

SEQ ID NO: 7488862 - DNA, 22 bp, Homo sapiens
acttacaatcaaccaccttgga

SEQ ID NO: 7488863 - DNA, 22 bp, Homo sapiens
acttacaagctagggaagcttg

SEQ ID NO: 7488864 - DNA, 22 bp, Homo sapiens
acttacaagttccctttctcag

SEQ ID NO: 7488865 - DNA, 19 bp, Homo sapiens
acttaatccctatctcttg

SEQ ID NO: 7488866 - DNA, 18 bp, Homo sapiens
acttaagatccatgctag

SEQ ID NO: 7488867 - DNA, 22 bp, Homo sapiens
acttacaagctagggaagcttg

SEQ ID NO: 7488868 - DNA, 22 bp, Homo sapiens
acttaagatagagcaagtctga

SEQ ID NO: 7488869 - DNA, 22 bp, Homo sapiens
acttaagatagagcaagtctga

SEQ ID NO: 7488870 - DNA, 22 bp, Homo sapiens
acttaagatagagcaagtctga

SEQ ID NO: 7488871 - DNA, 22 bp, Homo sapiens
acttaagatagagcaagtctga

SEQ ID NO: 7488872 - DNA, 21 bp, Homo sapiens
acttaaattccttgatattta

SEQ ID NO: 7488873 - DNA, 23 bp, Homo sapiens
acttaaatggttctttatctcag

SEQ ID NO: 7488874 - DNA, 23 bp, Homo sapiens
acttaaatggttctttatctcag

SEQ ID NO: 7488875 - DNA, 22 bp, Homo sapiens
acttaaatagaactcctcaata

SEQ ID NO: 7488876 - DNA, 21 bp, Homo sapiens
acttaaattccttgatattta

SEQ ID NO: 7488877 - DNA, 21 bp, Homo sapiens
acttaaattccttgatattta

SEQ ID NO: 7488878 - DNA, 20 bp, Homo sapiens
acttaacaccgactaatgat

SEQ ID NO: 7488879 - DNA, 20 bp, Homo sapiens
acttaacaccgactaatgat

SEQ ID NO: 7488880 - DNA, 20 bp, Homo sapiens
acttaacaccgactaatgat

SEQ ID NO: 7488881 - DNA, 21 bp, Homo sapiens
acttaaattccttgatattta

SEQ ID NO: 7488882 - DNA, 22 bp, Homo sapiens
acttaacagacattatttacct

SEQ ID NO: 7488883 - DNA, 22 bp, Homo sapiens
acttaacagacattatttacct

SEQ ID NO: 7488884 - DNA, 22 bp, Homo sapiens
acttaacagacattatttacct

SEQ ID NO: 7488885 - DNA, 22 bp, Homo sapiens
acttaacagacattatttacct

SEQ ID NO: 7488886 - DNA, 22 bp, Homo sapiens
ataatgcatttagaataattca

SEQ ID NO: 7488887 - DNA, 22 bp, Homo sapiens
ataatgcatttagaataattca

SEQ ID NO: 7488888 - DNA, 22 bp, Homo sapiens
ataatgcatttagaataattca

SEQ ID NO: 7488889 - DNA, 22 bp, Homo sapiens
ataatgcatttagaataattca

SEQ ID NO: 7488890 - DNA, 22 bp, Homo sapiens
ataatgcatttagaataattca

SEQ ID NO: 7488891 - DNA, 22 bp, Homo sapiens
ataatgcatttagaataattca

SEQ ID NO: 7488892 - DNA, 22 bp, Homo sapiens
ataatgctgggagaaattgtta

SEQ ID NO: 7488893 - DNA, 22 bp, Homo sapiens
ataatgcatttagaataattca

SEQ ID NO: 7488894 - DNA, 22 bp, Homo sapiens
ataatgcatttagaataattca

SEQ ID NO: 7488895 - DNA, 22 bp, Homo sapiens
ataatgcatttagaataattca

SEQ ID NO: 7488896 - DNA, 22 bp, Homo sapiens
ataatgccattgtctcatccag

SEQ ID NO: 7488897 - DNA, 22 bp, Homo sapiens
ataatggcatgacagttatata

SEQ ID NO: 7488898 - DNA, 22 bp, Homo sapiens
ataatggactcagtaatagtga

SEQ ID NO: 7488899 - DNA, 22 bp, Homo sapiens
ataatggaggaagctatgtgga

SEQ ID NO: 7488900 - DNA, 22 bp, Homo sapiens
ataatggattcagaaccgtcaa

SEQ ID NO: 7488901 - DNA, 22 bp, Homo sapiens
acttaaagttataatttgctaa

SEQ ID NO: 7488902 - DNA, 22 bp, Homo sapiens
acttaaagttataatttgctaa

SEQ ID NO: 7488903 - DNA, 22 bp, Homo sapiens
ataatggccgggggctgaatgc

SEQ ID NO: 7488904 - DNA, 22 bp, Homo sapiens
atacagcagtgaataagataaa

SEQ ID NO: 7488905 - DNA, 22 bp, Homo sapiens
atacagcagtgaataagataaa

SEQ ID NO: 7488906 - DNA, 22 bp, Homo sapiens
atacagattgctatacttacaa

SEQ ID NO: 7488907 - DNA, 22 bp, Homo sapiens
atacagcagcccttgctttgca

SEQ ID NO: 7488908 - DNA, 22 bp, Homo sapiens
atacagcagcccttgctttgca

SEQ ID NO: 7488909 - DNA, 22 bp, Homo sapiens
atacagcagcccttgctttgca

SEQ ID NO: 7488910 - DNA, 22 bp, Homo sapiens
atacagattgctatacttacaa

SEQ ID NO: 7488911 - DNA, 22 bp, Homo sapiens
atacagattgctatacttacaa

SEQ ID NO: 7488912 - DNA, 22 bp, Homo sapiens
atacagattgctatacttacaa

SEQ ID NO: 7488913 - DNA, 22 bp, Homo sapiens
atacagcttacagttctaatgc

SEQ ID NO: 7488914 - DNA, 22 bp, Homo sapiens
atacagctgccttctaactatg

SEQ ID NO: 7488915 - DNA, 22 bp, Homo sapiens
atacagccagcttcctgacctt

SEQ ID NO: 7488916 - DNA, 22 bp, Homo sapiens
atacagcagtgaataagataaa

SEQ ID NO: 7488917 - DNA, 22 bp, Homo sapiens
atacagcagtgaataagataaa

SEQ ID NO: 7488918 - DNA, 22 bp, Homo sapiens
atacagcagtgaataagataaa

SEQ ID NO: 7488919 - DNA, 22 bp, Homo sapiens
atacagcagtgaataagataaa

SEQ ID NO: 7488920 - DNA, 22 bp, Homo sapiens
atacagcagtttgtgatcctag

SEQ ID NO: 7488921 - DNA, 22 bp, Homo sapiens
atacagggacatccagtttttc

SEQ ID NO: 7488922 - DNA, 22 bp, Homo sapiens
atacagggacatccagtttttc

SEQ ID NO: 7488923 - DNA, 22 bp, Homo sapiens
atacagggacatccagtttttc

SEQ ID NO: 7488924 - DNA, 22 bp, Homo sapiens
atacaggtaatttgaataatag

SEQ ID NO: 7488925 - DNA, 22 bp, Homo sapiens
atacaggtaggggacatacatc

SEQ ID NO: 7488926 - DNA, 22 bp, Homo sapiens
atacaggtaatttgaataatag

SEQ ID NO: 7488927 - DNA, 22 bp, Homo sapiens
atacagggacatccagtttttc

SEQ ID NO: 7488928 - DNA, 22 bp, Homo sapiens
atacagggacatccagtttttc

SEQ ID NO: 7488929 - DNA, 22 bp, Homo sapiens
atacaggatgctgaacatctct

SEQ ID NO: 7488930 - DNA, 22 bp, Homo sapiens
atacaggatgctgaacatctct

SEQ ID NO: 7488931 - DNA, 22 bp, Homo sapiens
atacagcttacagttctaatgc

SEQ ID NO: 7488932 - DNA, 22 bp, Homo sapiens
atacagcttatgcatatatctc

SEQ ID NO: 7488933 - DNA, 22 bp, Homo sapiens
atacagcttatgcatatatctc

SEQ ID NO: 7488934 - DNA, 22 bp, Homo sapiens
atacagctttctttcacatgag

SEQ ID NO: 7488935 - DNA, 22 bp, Homo sapiens
atacagctttctttcacatgag

SEQ ID NO: 7488936 - DNA, 22 bp, Homo sapiens
atacagcttatgcatatatctc

SEQ ID NO: 7488937 - DNA, 22 bp, Homo sapiens
atacagctttctttcacatgag

SEQ ID NO: 7488938 - DNA, 22 bp, Homo sapiens
atacaggtgtacacacatgcaa

SEQ ID NO: 7488939 - DNA, 22 bp, Homo sapiens
atacaggtgtacacacatgcaa

SEQ ID NO: 7488940 - DNA, 22 bp, Homo sapiens
atacaggtgtacacacatgcaa

SEQ ID NO: 7488941 - DNA, 22 bp, Homo sapiens
atacaggtaggggacatacatc

SEQ ID NO: 7488942 - DNA, 22 bp, Homo sapiens
atacaggtaggggacatacatc

SEQ ID NO: 7488943 - DNA, 22 bp, Homo sapiens
atacaggtggaactaaataaat

SEQ ID NO: 7488944 - DNA, 22 bp, Homo sapiens
atacaggtggacttcagttagt

SEQ ID NO: 7488945 - DNA, 22 bp, Homo sapiens
atacaggttctctagggaacag

SEQ ID NO: 7488946 - DNA, 22 bp, Homo sapiens
atacagtaaccacattctatag

SEQ ID NO: 7488947 - DNA, 22 bp, Homo sapiens
atacagtaaccacattctatag

SEQ ID NO: 7488948 - DNA, 22 bp, Homo sapiens
atacagtaaccacattctatag

SEQ ID NO: 7488949 - DNA, 22 bp, Homo sapiens
atacagtaaccacattctatag

SEQ ID NO: 7488950 - DNA, 22 bp, Homo sapiens
atacagtaaccacattctatag

SEQ ID NO: 7488951 - DNA, 22 bp, Homo sapiens
atacagtaaccacattctatag

SEQ ID NO: 7488952 - DNA, 22 bp, Homo sapiens
atacagtaaccacattctatag

SEQ ID NO: 7488953 - DNA, 22 bp, Homo sapiens
acttctcttcataggtggcaat

SEQ ID NO: 7488954 - DNA, 22 bp, Homo sapiens
acttctcttcataggtggcaat

SEQ ID NO: 7488955 - DNA, 22 bp, Homo sapiens
acttctcttccccggaactcta

SEQ ID NO: 7488956 - DNA, 19 bp, Homo sapiens
acttctgaggaactgcaca

SEQ ID NO: 7488957 - DNA, 19 bp, Homo sapiens
acttctgaggaactgcaca

SEQ ID NO: 7488958 - DNA, 19 bp, Homo sapiens
acttctgaggaactgcaca

SEQ ID NO: 7488959 - DNA, 22 bp, Homo sapiens
acttctgagaaatttaaggaca

SEQ ID NO: 7488960 - DNA, 22 bp, Homo sapiens
acttctgagaaatttaaggaca

SEQ ID NO: 7488961 - DNA, 22 bp, Homo sapiens
acttctgaagcagagatttggg

SEQ ID NO: 7488962 - DNA, 22 bp, Homo sapiens
acttctctttagtactaaatgt

SEQ ID NO: 7488963 - DNA, 22 bp, Homo sapiens
acttctgaagcagagatttggg

SEQ ID NO: 7488964 - DNA, 22 bp, Homo sapiens
acttctgataaagagcatgtgc

SEQ ID NO: 7488965 - DNA, 22 bp, Homo sapiens
acttctgataaagagcatgtgc

SEQ ID NO: 7488966 - DNA, 22 bp, Homo sapiens
acttctgattaaggatgaatgc

SEQ ID NO: 7488967 - DNA, 22 bp, Homo sapiens
acttctgattaaggatgaatgc

SEQ ID NO: 7488968 - DNA, 22 bp, Homo sapiens
acttctgattaaggatgaatgc

SEQ ID NO: 7488969 - DNA, 22 bp, Homo sapiens
acttctgattacacatgggcct

SEQ ID NO: 7488970 - DNA, 22 bp, Homo sapiens
actgtcaaaagagattatatta

SEQ ID NO: 7488971 - DNA, 22 bp, Homo sapiens
actgtcaaaagagattatatta

SEQ ID NO: 7488972 - DNA, 22 bp, Homo sapiens
actgtcaaaagagattatatta

SEQ ID NO: 7488973 - DNA, 22 bp, Homo sapiens
actgtcaaatgcaatgaactca

SEQ ID NO: 7488974 - DNA, 22 bp, Homo sapiens
actgtatttttgaatcattgtg

SEQ ID NO: 7488975 - DNA, 22 bp, Homo sapiens
actgtatttttgaatcattgtg

SEQ ID NO: 7488976 - DNA, 22 bp, Homo sapiens
actgtatttttgaatcattgtg

SEQ ID NO: 7488977 - DNA, 22 bp, Homo sapiens
actgtattttgggtgtattttc

SEQ ID NO: 7488978 - DNA, 22 bp, Homo sapiens
actgtattttgggtgtattttc

SEQ ID NO: 7488979 - DNA, 22 bp, Homo sapiens
actgtatttggatataagatct

SEQ ID NO: 7488980 - DNA, 22 bp, Homo sapiens
actgtatttggatataagatct

SEQ ID NO: 7488981 - DNA, 22 bp, Homo sapiens
actgtatttggatataagatct

SEQ ID NO: 7488982 - DNA, 22 bp, Homo sapiens
actgtatttggatataagatct

SEQ ID NO: 7488983 - DNA, 22 bp, Homo sapiens
actgtatttccaacagacaaat

SEQ ID NO: 7488984 - DNA, 22 bp, Homo sapiens
actgtatttccaacagacaaat

SEQ ID NO: 7488985 - DNA, 22 bp, Homo sapiens
actgtattggttttctattgct

SEQ ID NO: 7488986 - DNA, 21 bp, Homo sapiens
actgtattgttttcaaggatc

SEQ ID NO: 7488987 - DNA, 22 bp, Homo sapiens
actgtagtgatgataattaagt

SEQ ID NO: 7488988 - DNA, 22 bp, Homo sapiens
actgtataaggcataggtaagc

SEQ ID NO: 7488989 - DNA, 22 bp, Homo sapiens
actgtataaggcataggtaagc

SEQ ID NO: 7488990 - DNA, 22 bp, Homo sapiens
actgtatacttctgtatacaat

SEQ ID NO: 7488991 - DNA, 22 bp, Homo sapiens
actgtatacttctgtatacaat

SEQ ID NO: 7488992 - DNA, 22 bp, Homo sapiens
actgtatagatggagttgattt

SEQ ID NO: 7488993 - DNA, 22 bp, Homo sapiens
actgtatagtatttattcttag

SEQ ID NO: 7488994 - DNA, 22 bp, Homo sapiens
actgtatagtatttattcttag

SEQ ID NO: 7488995 - DNA, 22 bp, Homo sapiens
actgtatagtatttattcttag

SEQ ID NO: 7488996 - DNA, 22 bp, Homo sapiens
actgtattcctactagaatcta

SEQ ID NO: 7488997 - DNA, 22 bp, Homo sapiens
actgtattcctactagaatcta

SEQ ID NO: 7488998 - DNA, 22 bp, Homo sapiens
actgtattcctactagaatcta

SEQ ID NO: 7488999 - DNA, 22 bp, Homo sapiens
actgtatagtatttattcttag

SEQ ID NO: 7489000 - DNA, 22 bp, Homo sapiens
actgtatattggacaaggaaaa

SEQ ID NO: 7489001 - DNA, 22 bp, Homo sapiens
actgtattctagtcatgtttgt

SEQ ID NO: 7489002 - DNA, 22 bp, Homo sapiens
actgtatacttctgtatacaat

SEQ ID NO: 7489003 - DNA, 22 bp, Homo sapiens
actgtattggaaatatagcaaa

SEQ ID NO: 7489004 - DNA, 22 bp, Homo sapiens
actgtattggaaatatagcaaa

SEQ ID NO: 7489005 - DNA, 22 bp, Homo sapiens
actgtattggaaatatagcaaa

SEQ ID NO: 7489006 - DNA, 22 bp, Homo sapiens
actgtattggaaatatagcaaa

SEQ ID NO: 7489007 - DNA, 22 bp, Homo sapiens
actgtcatcagaagatgaaaat

SEQ ID NO: 7489008 - DNA, 22 bp, Homo sapiens
actgtcagggatcatgaaagct

SEQ ID NO: 7489009 - DNA, 22 bp, Homo sapiens
actgtcatcagaagatgaaaat

SEQ ID NO: 7489010 - DNA, 22 bp, Homo sapiens
actgtcatctggtagatgatgg

SEQ ID NO: 7489011 - DNA, 22 bp, Homo sapiens
ataaaaactgacccatcctttg

SEQ ID NO: 7489012 - DNA, 22 bp, Homo sapiens
actgtcatcttgtaagcaatgt

SEQ ID NO: 7489013 - DNA, 22 bp, Homo sapiens
actgtcactgtgatgttagaga

SEQ ID NO: 7489014 - DNA, 22 bp, Homo sapiens
actgtcactgtgatgttagaga

SEQ ID NO: 7489015 - DNA, 22 bp, Homo sapiens
actgtcactgtgatgttagaga

SEQ ID NO: 7489016 - DNA, 22 bp, Homo sapiens
actgtcacttgcaactgtgagg

SEQ ID NO: 7489017 - DNA, 22 bp, Homo sapiens
actgtcactgacagaatcaaca

SEQ ID NO: 7489018 - DNA, 22 bp, Homo sapiens
actgtcactgacagaatcaaca

SEQ ID NO: 7489019 - DNA, 22 bp, Homo sapiens
actgtcactgacagaatcaaca

SEQ ID NO: 7489020 - DNA, 22 bp, Homo sapiens
actgtcacttgcaactgtgagg

SEQ ID NO: 7489021 - DNA, 22 bp, Homo sapiens
actgtcacttgcaactgtgagg

SEQ ID NO: 7489022 - DNA, 22 bp, Homo sapiens
actgtcacttgcaactgtgagg

SEQ ID NO: 7489023 - DNA, 22 bp, Homo sapiens
actgtcaggatggcagcttgtt

SEQ ID NO: 7489024 - DNA, 22 bp, Homo sapiens
actgtcacttgcaactgtgagg

SEQ ID NO: 7489025 - DNA, 22 bp, Homo sapiens
actgtcacttgcaactgtgagg

SEQ ID NO: 7489026 - DNA, 19 bp, Homo sapiens
actgtcacataaaggaagg

SEQ ID NO: 7489027 - DNA, 19 bp, Homo sapiens
actgtcacataaaggaagg

SEQ ID NO: 7489028 - DNA, 19 bp, Homo sapiens
actgtcacataaaggaagg

SEQ ID NO: 7489029 - DNA, 22 bp, Homo sapiens
actgtcaatgggttcattgagt

SEQ ID NO: 7489030 - DNA, 22 bp, Homo sapiens
actgtcaaggaaacaaaattac

SEQ ID NO: 7489031 - DNA, 22 bp, Homo sapiens
actgtcaagagattcaaattca

SEQ ID NO: 7489032 - DNA, 22 bp, Homo sapiens
actgtcaagagattcaaattca

SEQ ID NO: 7489033 - DNA, 22 bp, Homo sapiens
actgtcaaatgcaatgaactca

SEQ ID NO: 7489034 - DNA, 22 bp, Homo sapiens
actgtcaagagattcaaattca

SEQ ID NO: 7489035 - DNA, 22 bp, Homo sapiens
actgtcactccaactgagtcgt

SEQ ID NO: 7489036 - DNA, 22 bp, Homo sapiens
actgtcactccaactgagtcgt

SEQ ID NO: 7489037 - DNA, 22 bp, Homo sapiens
actgtcactactatgtgtttgt

SEQ ID NO: 7489038 - DNA, 22 bp, Homo sapiens
actgtcaccatcagagcgggaa

SEQ ID NO: 7489039 - DNA, 22 bp, Homo sapiens
actgtcactaactaagtctagt

SEQ ID NO: 7489040 - DNA, 22 bp, Homo sapiens
actgtcactaactaagtctagt

SEQ ID NO: 7489041 - DNA, 22 bp, Homo sapiens
actgtcacctaaattttcattg

SEQ ID NO: 7489042 - DNA, 20 bp, Homo sapiens
actgggagctaacggagatt

SEQ ID NO: 7489043 - DNA, 20 bp, Homo sapiens
actgggagctaacggagatt

SEQ ID NO: 7489044 - DNA, 20 bp, Homo sapiens
actgggagctaacggagatt

SEQ ID NO: 7489045 - DNA, 22 bp, Homo sapiens
actgggactgtatgtgctggac

SEQ ID NO: 7489046 - DNA, 22 bp, Homo sapiens
actgggactgtatgtgctggac

SEQ ID NO: 7489047 - DNA, 22 bp, Homo sapiens
actgggagaaactgacacctta

SEQ ID NO: 7489048 - DNA, 22 bp, Homo sapiens
actgggagaaactgacacctta

SEQ ID NO: 7489049 - DNA, 22 bp, Homo sapiens
actgggacagtcagaaacatga

SEQ ID NO: 7489050 - DNA, 22 bp, Homo sapiens
actgggaatggagcctgggcct

SEQ ID NO: 7489051 - DNA, 22 bp, Homo sapiens
actgggaatctcaggaacatgg

SEQ ID NO: 7489052 - DNA, 23 bp, Homo sapiens
actgggaagtttggagagacgca

SEQ ID NO: 7489053 - DNA, 22 bp, Homo sapiens
actgggaagtcagagagaggct

SEQ ID NO: 7489054 - DNA, 23 bp, Homo sapiens
actgggaagtttggagagacgca

SEQ ID NO: 7489055 - DNA, 22 bp, Homo sapiens
actgggaagtcagagagaggct

SEQ ID NO: 7489056 - DNA, 22 bp, Homo sapiens
actgggaagtcagagagaggct

SEQ ID NO: 7489057 - DNA, 22 bp, Homo sapiens
actgggaaggagcaggatctgt

SEQ ID NO: 7489058 - DNA, 22 bp, Homo sapiens
actgggaaggaaaggaatgtaa

SEQ ID NO: 7489059 - DNA, 22 bp, Homo sapiens
actgggaagactggaattgctc

SEQ ID NO: 7489060 - DNA, 22 bp, Homo sapiens
actgggaagagagaattctgtc

SEQ ID NO: 7489061 - DNA, 22 bp, Homo sapiens
actgggaagacaagaaagatag

SEQ ID NO: 7489062 - DNA, 22 bp, Homo sapiens
actgggaagatggaggcaagca

SEQ ID NO: 7489063 - DNA, 22 bp, Homo sapiens
actgggaagatggaggcaagca

SEQ ID NO: 7489064 - DNA, 22 bp, Homo sapiens
actgggaagctgttttgctttt

SEQ ID NO: 7489065 - DNA, 22 bp, Homo sapiens
actgggaaggaaaggaatgtaa

SEQ ID NO: 7489066 - DNA, 22 bp, Homo sapiens
actgggaagatggaggcaagca

SEQ ID NO: 7489067 - DNA, 22 bp, Homo sapiens
actgggaacaaggtgctcagcg

SEQ ID NO: 7489068 - DNA, 22 bp, Homo sapiens
actgggaacctgtgctaggagg

SEQ ID NO: 7489069 - DNA, 22 bp, Homo sapiens
actgggaacctgtgctaggagg

SEQ ID NO: 7489070 - DNA, 22 bp, Homo sapiens
actgggaacaaggtgctcagcg

SEQ ID NO: 7489071 - DNA, 22 bp, Homo sapiens
actgggaaatgaagtctggtgg

SEQ ID NO: 7489072 - DNA, 22 bp, Homo sapiens
actgggaaattgccctagttct

SEQ ID NO: 7489073 - DNA, 22 bp, Homo sapiens
actgggaaagtgctgcctgcag

SEQ ID NO: 7489074 - DNA, 22 bp, Homo sapiens
actgggaaagtgctgcctgcag

SEQ ID NO: 7489075 - DNA, 22 bp, Homo sapiens
actgggaaaagctatggcaaat

SEQ ID NO: 7489076 - DNA, 19 bp, Homo sapiens
actgggaaaaaggcactgg

SEQ ID NO: 7489077 - DNA, 22 bp, Homo sapiens
actgggaaaagctatggcaaat

SEQ ID NO: 7489078 - DNA, 19 bp, Homo sapiens
actgggaaaaaggcactgg

SEQ ID NO: 7489079 - DNA, 19 bp, Homo sapiens
actgggaaaaaggcactgg

SEQ ID NO: 7489080 - DNA, 22 bp, Homo sapiens
actgtacatgtaaacattgtca

SEQ ID NO: 7489081 - DNA, 22 bp, Homo sapiens
actgtacatgtaaacattgtca

SEQ ID NO: 7489082 - DNA, 22 bp, Homo sapiens
actgtaacactcatactgaagt

SEQ ID NO: 7489083 - DNA, 22 bp, Homo sapiens
actgtaaccagtgtggtgagag

SEQ ID NO: 7489084 - DNA, 22 bp, Homo sapiens
actgtaacactcatactgaagt

SEQ ID NO: 7489085 - DNA, 22 bp, Homo sapiens
actgtaaattttggttgcaggt

SEQ ID NO: 7489086 - DNA, 20 bp, Homo sapiens
actgggagctaacggagatt

SEQ ID NO: 7489087 - DNA, 20 bp, Homo sapiens
actgggagctaacggagatt

SEQ ID NO: 7489088 - DNA, 22 bp, Homo sapiens
actgtaacacaatggtatctgt

SEQ ID NO: 7489089 - DNA, 22 bp, Homo sapiens
actgtacatgtaaacattgtca

SEQ ID NO: 7489090 - DNA, 22 bp, Homo sapiens
actgtacatgtaaacattgtca

SEQ ID NO: 7489091 - DNA, 22 bp, Homo sapiens
actgtacatgtaaacattgtca

SEQ ID NO: 7489092 - DNA, 22 bp, Homo sapiens
actgtactccaacctgggcaac

SEQ ID NO: 7489093 - DNA, 22 bp, Homo sapiens
actgtactcaagcctgggcaat

SEQ ID NO: 7489094 - DNA, 22 bp, Homo sapiens
actgtacctcaaactctggaac

SEQ ID NO: 7489095 - DNA, 22 bp, Homo sapiens
actgtaccaccttgctcttgtc

SEQ ID NO: 7489096 - DNA, 22 bp, Homo sapiens
actgtagagaatctgagaaaaa

SEQ ID NO: 7489097 - DNA, 22 bp, Homo sapiens
actgtacttttcttggctagat

SEQ ID NO: 7489098 - DNA, 22 bp, Homo sapiens
actgtagtctaaatatagtctt

SEQ ID NO: 7489099 - DNA, 22 bp, Homo sapiens
actgtagaggcctggattgagg

SEQ ID NO: 7489100 - DNA, 22 bp, Homo sapiens
actgtactccagcctgggaaac

SEQ ID NO: 7489101 - DNA, 22 bp, Homo sapiens
actgtactcggggaaatggggt

SEQ ID NO: 7489102 - DNA, 22 bp, Homo sapiens
actgtactgtgtattgtagaat

SEQ ID NO: 7489103 - DNA, 22 bp, Homo sapiens
actgtactgaaaagtaagcaag

SEQ ID NO: 7489104 - DNA, 22 bp, Homo sapiens
actgtacttacgcatatacagg

SEQ ID NO: 7489105 - DNA, 22 bp, Homo sapiens
actgtactgtgtattgtagaat

SEQ ID NO: 7489106 - DNA, 22 bp, Homo sapiens
actgtactttagaaagtgtagt

SEQ ID NO: 7489107 - DNA, 22 bp, Homo sapiens
actgtacttacgcatatacagg

SEQ ID NO: 7489108 - DNA, 22 bp, Homo sapiens
ataatgaatgcagagttatttt

SEQ ID NO: 7489109 - DNA, 22 bp, Homo sapiens
ataatgaatgcagagttatttt

SEQ ID NO: 7489110 - DNA, 22 bp, Homo sapiens
ataatgaatgcagagttatttt

SEQ ID NO: 7489111 - DNA, 22 bp, Homo sapiens
ataatgaatgcagagttatttt

SEQ ID NO: 7489112 - DNA, 22 bp, Homo sapiens
ataatgaatcagcatagggtga

SEQ ID NO: 7489113 - DNA, 22 bp, Homo sapiens
ataatgaatcagcatagggtga

SEQ ID NO: 7489114 - DNA, 22 bp, Homo sapiens
ataatgaaatatgaggaaggtc

SEQ ID NO: 7489115 - DNA, 22 bp, Homo sapiens
ataatgaatgcagagttatttt

SEQ ID NO: 7489116 - DNA, 22 bp, Homo sapiens
ataatgaatgcagagttatttt

SEQ ID NO: 7489117 - DNA, 22 bp, Homo sapiens
ataatgaatgcagagttatttt

SEQ ID NO: 7489118 - DNA, 22 bp, Homo sapiens
ataatgacattcttagactgga

SEQ ID NO: 7489119 - DNA, 22 bp, Homo sapiens
ataatgagcttttgaatactga

SEQ ID NO: 7489120 - DNA, 22 bp, Homo sapiens
ataatgcacctttgagtatggc

SEQ ID NO: 7489121 - DNA, 22 bp, Homo sapiens
ataatgcagcttttcaatggcc

SEQ ID NO: 7489122 - DNA, 22 bp, Homo sapiens
ataatgcagcttttcaatggcc

SEQ ID NO: 7489123 - DNA, 22 bp, Homo sapiens
ataatgcacctttgagtatggc

SEQ ID NO: 7489124 - DNA, 23 bp, Homo sapiens
ataatgcaagtggtggtaatctg

SEQ ID NO: 7489125 - DNA, 22 bp, Homo sapiens
ataatgcacctttgagtatggc

SEQ ID NO: 7489126 - DNA, 23 bp, Homo sapiens
ataatgcaagtggtggtaatctg

SEQ ID NO: 7489127 - DNA, 22 bp, Homo sapiens
ataatctgagctatttcatgag

SEQ ID NO: 7489128 - DNA, 22 bp, Homo sapiens
ataatctggcttgtttgcttaa

SEQ ID NO: 7489129 - DNA, 22 bp, Homo sapiens
ataatctggtctttgtatgagt

SEQ ID NO: 7489130 - DNA, 22 bp, Homo sapiens
ataatctggtctttgtatgagt

SEQ ID NO: 7489131 - DNA, 22 bp, Homo sapiens
ataatctggtctttgtatgagt

SEQ ID NO: 7489132 - DNA, 22 bp, Homo sapiens
ataatctgacaaagacttaagc

SEQ ID NO: 7489133 - DNA, 22 bp, Homo sapiens
ataatccattaattaatgacca

SEQ ID NO: 7489134 - DNA, 22 bp, Homo sapiens
ataatccatgtctagagtaaag

SEQ ID NO: 7489135 - DNA, 22 bp, Homo sapiens
ataatccatgtctagagtaaag

SEQ ID NO: 7489136 - DNA, 22 bp, Homo sapiens
ataatctggtctttgtatgagt

SEQ ID NO: 7489137 - DNA, 22 bp, Homo sapiens
ataatctgtggatggttttgag

SEQ ID NO: 7489138 - DNA, 22 bp, Homo sapiens
ataatcttgtatttcctaaagt

SEQ ID NO: 7489139 - DNA, 22 bp, Homo sapiens
ataatcttgtatttcctaaagt

SEQ ID NO: 7489140 - DNA, 22 bp, Homo sapiens
ataatcttgtatttcctaaagt

SEQ ID NO: 7489141 - DNA, 22 bp, Homo sapiens
ataatcttgtatttcctaaagt

SEQ ID NO: 7489142 - DNA, 22 bp, Homo sapiens
ataatctttcttttccagatag

SEQ ID NO: 7489143 - DNA, 22 bp, Homo sapiens
actgtgcagtgttgtaacccga

SEQ ID NO: 7489144 - DNA, 22 bp, Homo sapiens
actgtgcatctattgccattta

SEQ ID NO: 7489145 - DNA, 22 bp, Homo sapiens
actgtgcatgaaccgaaacaaa

SEQ ID NO: 7489146 - DNA, 22 bp, Homo sapiens
actgtgcatgaaccgaaacaaa

SEQ ID NO: 7489147 - DNA, 22 bp, Homo sapiens
actgtgcagtgttgtaacccga

SEQ ID NO: 7489148 - DNA, 22 bp, Homo sapiens
actgtgcaggtagatgcctggg

SEQ ID NO: 7489149 - DNA, 22 bp, Homo sapiens
actgtgcaggtgaactgtttgc

SEQ ID NO: 7489150 - DNA, 22 bp, Homo sapiens
actgtgcaggtagatgcctggg

SEQ ID NO: 7489151 - DNA, 22 bp, Homo sapiens
actgtgcaggtagatgcctggg

SEQ ID NO: 7489152 - DNA, 22 bp, Homo sapiens
actgtgcaggggaagagagaaa

SEQ ID NO: 7489153 - DNA, 22 bp, Homo sapiens
actgtgcaggggaagagagaaa

SEQ ID NO: 7489154 - DNA, 22 bp, Homo sapiens
actgtgcagctgagtgctaatt

SEQ ID NO: 7489155 - DNA, 22 bp, Homo sapiens
actgtgcaggggaagagagaaa

SEQ ID NO: 7489156 - DNA, 22 bp, Homo sapiens
actgtgcagctgagtgctaatt

SEQ ID NO: 7489157 - DNA, 21 bp, Homo sapiens
actgtgcagcctgaggatgtg

SEQ ID NO: 7489158 - DNA, 22 bp, Homo sapiens
actgtgcaccctggacagtgtc

SEQ ID NO: 7489159 - DNA, 22 bp, Homo sapiens
actgtgcaccctggacagtgtc

SEQ ID NO: 7489160 - DNA, 22 bp, Homo sapiens
actgtgcacacaaaaatagatt

SEQ ID NO: 7489161 - DNA, 22 bp, Homo sapiens
actgtgcacacaaaaatagatt

SEQ ID NO: 7489162 - DNA, 22 bp, Homo sapiens
actgtgcacacaaaaatagatt

SEQ ID NO: 7489163 - DNA, 22 bp, Homo sapiens
actgtgcacacaaaaatagatt

SEQ ID NO: 7489164 - DNA, 22 bp, Homo sapiens
ataaggttttcttttgttccct

SEQ ID NO: 7489165 - DNA, 22 bp, Homo sapiens
ataagtaggaaaatttgaatat

SEQ ID NO: 7489166 - DNA, 22 bp, Homo sapiens
ataatccatgtctagagtaaag

SEQ ID NO: 7489167 - DNA, 22 bp, Homo sapiens
ataaggttggtcttaactacct

SEQ ID NO: 7489168 - DNA, 22 bp, Homo sapiens
ataaggttaggattatagtgtt

SEQ ID NO: 7489169 - DNA, 22 bp, Homo sapiens
ataaggttttcttttgttccct

SEQ ID NO: 7489170 - DNA, 22 bp, Homo sapiens
actgtgccacaattcaccaggg

SEQ ID NO: 7489171 - DNA, 22 bp, Homo sapiens
actgtgcatttgtcatggggtt

SEQ ID NO: 7489172 - DNA, 22 bp, Homo sapiens
actgtgccacaattcaccaggg

SEQ ID NO: 7489173 - DNA, 22 bp, Homo sapiens
actgtgcatttgaagggatcat

SEQ ID NO: 7489174 - DNA, 22 bp, Homo sapiens
actgtgcatttgaagggatcat

SEQ ID NO: 7489175 - DNA, 22 bp, Homo sapiens
actgtgcatttcatgtcttttc

SEQ ID NO: 7489176 - DNA, 22 bp, Homo sapiens
actgtgcatttcatgtcttttc

SEQ ID NO: 7489177 - DNA, 22 bp, Homo sapiens
actgtgcattccccaacctgtg

SEQ ID NO: 7489178 - DNA, 22 bp, Homo sapiens
actgtgcattccccaacctgtg

SEQ ID NO: 7489179 - DNA, 22 bp, Homo sapiens
actgtgcatggtatccttgatg

SEQ ID NO: 7489180 - DNA, 22 bp, Homo sapiens
actgtgcatggtatccttgatg

SEQ ID NO: 7489181 - DNA, 22 bp, Homo sapiens
actgtgcatgaaccgaaacaaa

SEQ ID NO: 7489182 - DNA, 22 bp, Homo sapiens
actgtgcatgaaccgaaacaaa

SEQ ID NO: 7489183 - DNA, 22 bp, Homo sapiens
ataaaatttgctactgttaaat

SEQ ID NO: 7489184 - DNA, 22 bp, Homo sapiens
ataaaatttgctactgttaaat

SEQ ID NO: 7489185 - DNA, 22 bp, Homo sapiens
ataaaatttgctactgttaaat

SEQ ID NO: 7489186 - DNA, 22 bp, Homo sapiens
ataaaatttgctactgttaaat

SEQ ID NO: 7489187 - DNA, 22 bp, Homo sapiens
ataaaatttgctactgttaaat

SEQ ID NO: 7489188 - DNA, 22 bp, Homo sapiens
ataaaatttgctactgttaaat

SEQ ID NO: 7489189 - DNA, 22 bp, Homo sapiens
ataaaatttgctactgttaaat

SEQ ID NO: 7489190 - DNA, 22 bp, Homo sapiens
ataaaatttgctactgttaaat

SEQ ID NO: 7489191 - DNA, 22 bp, Homo sapiens
ataaaatttgctactgttaaat

SEQ ID NO: 7489192 - DNA, 22 bp, Homo sapiens
ataaaatttgctactgttaaat

SEQ ID NO: 7489193 - DNA, 22 bp, Homo sapiens
ataaaatgtctccactgggctc

SEQ ID NO: 7489194 - DNA, 22 bp, Homo sapiens
ataaaatgtctccactgggctc

SEQ ID NO: 7489195 - DNA, 22 bp, Homo sapiens
ataaaatggtaaacgaagctga

SEQ ID NO: 7489196 - DNA, 22 bp, Homo sapiens
ataaaatttgctactgttaaat

SEQ ID NO: 7489197 - DNA, 22 bp, Homo sapiens
ataaaatttgctactgttaaat

SEQ ID NO: 7489198 - DNA, 22 bp, Homo sapiens
ataaaatgtctccactgggctc

SEQ ID NO: 7489199 - DNA, 22 bp, Homo sapiens
ataaaatttgctactgttaaat

SEQ ID NO: 7489200 - DNA, 22 bp, Homo sapiens
ataaaatgtctccactgggctc

SEQ ID NO: 7489201 - DNA, 22 bp, Homo sapiens
ataaaatgtctccactgggctc

SEQ ID NO: 7489202 - DNA, 22 bp, Homo sapiens
ataaaatggtaaacgaagctga

SEQ ID NO: 7489203 - DNA, 22 bp, Homo sapiens
ataaaaactgacccatcctttg

SEQ ID NO: 7489204 - DNA, 22 bp, Homo sapiens
ataaaaactgacccatcctttg

SEQ ID NO: 7489205 - DNA, 22 bp, Homo sapiens
ataaaaactgacccatcctttg

SEQ ID NO: 7489206 - DNA, 22 bp, Homo sapiens
ataaacaagactggccaacttt

SEQ ID NO: 7489207 - DNA, 22 bp, Homo sapiens
ataaacaagactggccaacttt

SEQ ID NO: 7489208 - DNA, 22 bp, Homo sapiens
ataaacaagactggccaacttt

SEQ ID NO: 7489209 - DNA, 22 bp, Homo sapiens
ataaacaagactggccaacttt

SEQ ID NO: 7489210 - DNA, 22 bp, Homo sapiens
ataaacaagactggccaacttt

SEQ ID NO: 7489211 - DNA, 22 bp, Homo sapiens
ataaacaagactggccaacttt

SEQ ID NO: 7489212 - DNA, 22 bp, Homo sapiens
ataaacaagactggccaacttt

SEQ ID NO: 7489213 - DNA, 22 bp, Homo sapiens
ataaacaagactggccaacttt

SEQ ID NO: 7489214 - DNA, 22 bp, Homo sapiens
ataaacaagactggccaacttt

SEQ ID NO: 7489215 - DNA, 22 bp, Homo sapiens
ataaacaagactggccaacttt

SEQ ID NO: 7489216 - DNA, 22 bp, Homo sapiens
ataaaatttgctactgttaaat

SEQ ID NO: 7489217 - DNA, 22 bp, Homo sapiens
ataaaatttgctactgttaaat

SEQ ID NO: 7489218 - DNA, 22 bp, Homo sapiens
ataaaatttgctactgttaaat

SEQ ID NO: 7489219 - DNA, 22 bp, Homo sapiens
ataaacagctccatttagtgcc

SEQ ID NO: 7489220 - DNA, 22 bp, Homo sapiens
ataaacagctccatttagtgcc

SEQ ID NO: 7489221 - DNA, 22 bp, Homo sapiens
ataaacagctccatttagtgcc

SEQ ID NO: 7489222 - DNA, 22 bp, Homo sapiens
ataaacagtaaatgtgagcagt

SEQ ID NO: 7489223 - DNA, 22 bp, Homo sapiens
ataaacagtagagaaaggtggt

SEQ ID NO: 7489224 - DNA, 22 bp, Homo sapiens
ataaacagtaaatgtgagcagt

SEQ ID NO: 7489225 - DNA, 22 bp, Homo sapiens
ataaacagtaaatgtgagcagt

SEQ ID NO: 7489226 - DNA, 22 bp, Homo sapiens
ataaacagtagagaaaggtggt

SEQ ID NO: 7489227 - DNA, 22 bp, Homo sapiens
ataaacagtagagaaaggtggt

SEQ ID NO: 7489228 - DNA, 22 bp, Homo sapiens
actgtgagcagcgacctgagga

SEQ ID NO: 7489229 - DNA, 21 bp, Homo sapiens
ataaacagcatgtgatccatg

SEQ ID NO: 7489230 - DNA, 22 bp, Homo sapiens
ataaacagcataaaatacgctt

SEQ ID NO: 7489231 - DNA, 22 bp, Homo sapiens
ataaacagcataaaatacgctt

SEQ ID NO: 7489232 - DNA, 21 bp, Homo sapiens
ataaacagcatgtgatccatg

SEQ ID NO: 7489233 - DNA, 22 bp, Homo sapiens
ataaacagcctgcccaaattgg

SEQ ID NO: 7489234 - DNA, 22 bp, Homo sapiens
ataaacagcctgcccaaattgg

SEQ ID NO: 7489235 - DNA, 22 bp, Homo sapiens
ataaacagcataaaatacgctt

SEQ ID NO: 7489236 - DNA, 22 bp, Homo sapiens
ataaacagagtagttgctactg

SEQ ID NO: 7489237 - DNA, 22 bp, Homo sapiens
ataaacacttctagggcacaca

SEQ ID NO: 7489238 - DNA, 22 bp, Homo sapiens
actgtgagggtactggaacaga

SEQ ID NO: 7489239 - DNA, 22 bp, Homo sapiens
actgtgagtgatttccttctgg

SEQ ID NO: 7489240 - DNA, 21 bp, Homo sapiens
actgtgataatgctttttctg

SEQ ID NO: 7489241 - DNA, 22 bp, Homo sapiens
actgtgatgatgaagcatggtt

SEQ ID NO: 7489242 - DNA, 22 bp, Homo sapiens
actgtgatgcagttgccatcca

SEQ ID NO: 7489243 - DNA, 22 bp, Homo sapiens
actgtgatgcagttgccatcca

SEQ ID NO: 7489244 - DNA, 22 bp, Homo sapiens
actgtgatgttctctatcttgg

SEQ ID NO: 7489245 - DNA, 22 bp, Homo sapiens
actgtgatgttctctatcttgg

SEQ ID NO: 7489246 - DNA, 22 bp, Homo sapiens
actgtgatgtttgtgatcatct

SEQ ID NO: 7489247 - DNA, 22 bp, Homo sapiens
actgtgcacaattctaagtcct

SEQ ID NO: 7489248 - DNA, 22 bp, Homo sapiens
actgtgcaatgagtaataaact

SEQ ID NO: 7489249 - DNA, 22 bp, Homo sapiens
actgtgcacaattctaagtcct

SEQ ID NO: 7489250 - DNA, 22 bp, Homo sapiens
actgtgcacaattctaagtcct

SEQ ID NO: 7489251 - DNA, 22 bp, Homo sapiens
actgtgcaatgagtaataaact

SEQ ID NO: 7489252 - DNA, 22 bp, Homo sapiens
actgtgcaatgagtaataaact

SEQ ID NO: 7489253 - DNA, 22 bp, Homo sapiens
actgtgcaatgagtaataaact

SEQ ID NO: 7489254 - DNA, 22 bp, Homo sapiens
actgtgcaaatgacaggcacac

SEQ ID NO: 7489255 - DNA, 22 bp, Homo sapiens
actgtgcaaatgacaggcacac

SEQ ID NO: 7489256 - DNA, 22 bp, Homo sapiens
actgtgcaagtcaaagatgggc

SEQ ID NO: 7489257 - DNA, 22 bp, Homo sapiens
actgtgcaaatgacaggcacac

SEQ ID NO: 7489258 - DNA, 22 bp, Homo sapiens
actcttcagtacaataatatct

SEQ ID NO: 7489259 - DNA, 22 bp, Homo sapiens
agtgcaatgaataacagccacc

SEQ ID NO: 7489260 - DNA, 22 bp, Homo sapiens
actcttcacttcccctgccagc

SEQ ID NO: 7489261 - DNA, 22 bp, Homo sapiens
agtgcaatgtgtacagaaaaat

SEQ ID NO: 7489262 - DNA, 22 bp, Homo sapiens
actcttcaccgctactgaaata

SEQ ID NO: 7489263 - DNA, 22 bp, Homo sapiens
actcttcacacttgtctccagg

SEQ ID NO: 7489264 - DNA, 22 bp, Homo sapiens
actcttcaagggcctagaggtg

SEQ ID NO: 7489265 - DNA, 22 bp, Homo sapiens
actcttcacacttgtctccagg

SEQ ID NO: 7489266 - DNA, 22 bp, Homo sapiens
actcttcacacatgctgccctc

SEQ ID NO: 7489267 - DNA, 22 bp, Homo sapiens
actcttcaagggcctagaggtg

SEQ ID NO: 7489268 - DNA, 22 bp, Homo sapiens
actcttattttgaagtaataat

SEQ ID NO: 7489269 - DNA, 22 bp, Homo sapiens
actcttattttgaagtaataat

SEQ ID NO: 7489270 - DNA, 22 bp, Homo sapiens
actcttattttgaagtaataat

SEQ ID NO: 7489271 - DNA, 22 bp, Homo sapiens
actcttattccctcagaaatat

SEQ ID NO: 7489272 - DNA, 22 bp, Homo sapiens
actcttattccctcagaaatat

SEQ ID NO: 7489273 - DNA, 22 bp, Homo sapiens
agtgcaattttgctttcccaat

SEQ ID NO: 7489274 - DNA, 22 bp, Homo sapiens
agtgcacaccttagtacaaagt

SEQ ID NO: 7489275 - DNA, 22 bp, Homo sapiens
agtgcagggggaaagggtgtct

SEQ ID NO: 7489276 - DNA, 22 bp, Homo sapiens
agtgcagggggaaagggtgtct

SEQ ID NO: 7489277 - DNA, 22 bp, Homo sapiens
agtgcagggggaaagggtgtct

SEQ ID NO: 7489278 - DNA, 22 bp, Homo sapiens
agtgcagggggaaagggtgtct

SEQ ID NO: 7489279 - DNA, 22 bp, Homo sapiens
agtgcagtgatgaataatggtt

SEQ ID NO: 7489280 - DNA, 22 bp, Homo sapiens
agtgcagtggttaggagccagg

SEQ ID NO: 7489281 - DNA, 22 bp, Homo sapiens
agtgcagtaaatgggcattatg

SEQ ID NO: 7489282 - DNA, 22 bp, Homo sapiens
agtgcaggttaaggaactggcc

SEQ ID NO: 7489283 - DNA, 22 bp, Homo sapiens
agtgcagtaaatgggcattatg

SEQ ID NO: 7489284 - DNA, 22 bp, Homo sapiens
agtgcaggttaaggaactggcc

SEQ ID NO: 7489285 - DNA, 22 bp, Homo sapiens
agtgcaggttaaggaactggcc

SEQ ID NO: 7489286 - DNA, 22 bp, Homo sapiens
agtgcaggttaaggaactggcc

SEQ ID NO: 7489287 - DNA, 22 bp, Homo sapiens
agtgcaggttaaggaactggcc

SEQ ID NO: 7489288 - DNA, 22 bp, Homo sapiens
actctgtgaactctatcagata

SEQ ID NO: 7489289 - DNA, 22 bp, Homo sapiens
actctgtgaagtcttattatgc

SEQ ID NO: 7489290 - DNA, 21 bp, Homo sapiens
actctgtcttgagccatctgt

SEQ ID NO: 7489291 - DNA, 21 bp, Homo sapiens
actctgtcttgagccatctgt

SEQ ID NO: 7489292 - DNA, 22 bp, Homo sapiens
actctgtgaactctatcagata

SEQ ID NO: 7489293 - DNA, 21 bp, Homo sapiens
actctgtcttgagccatctgt

SEQ ID NO: 7489294 - DNA, 22 bp, Homo sapiens
actctgtcacctactcactgta

SEQ ID NO: 7489295 - DNA, 22 bp, Homo sapiens
actctgtcacctactcactgta

SEQ ID NO: 7489296 - DNA, 22 bp, Homo sapiens
actctgtatccctctcaaattg

SEQ ID NO: 7489297 - DNA, 20 bp, Homo sapiens
actctgtaggtaatgagact

SEQ ID NO: 7489298 - DNA, 22 bp, Homo sapiens
actctgtatccctctcaaattg

SEQ ID NO: 7489299 - DNA, 22 bp, Homo sapiens
actctgtagagtataccaatgt

SEQ ID NO: 7489300 - DNA, 22 bp, Homo sapiens
actctgtagcctgtaagagagc

SEQ ID NO: 7489301 - DNA, 23 bp, Homo sapiens
actctgtaggctgtccatgtgca

SEQ ID NO: 7489302 - DNA, 22 bp, Homo sapiens
actctgtgttttggtggcagca

SEQ ID NO: 7489303 - DNA, 22 bp, Homo sapiens
actctgtgttttggtggcagca

SEQ ID NO: 7489304 - DNA, 22 bp, Homo sapiens
actcttatgggaacaaggatta

SEQ ID NO: 7489305 - DNA, 22 bp, Homo sapiens
actcttattccctcagaaatat

SEQ ID NO: 7489306 - DNA, 22 bp, Homo sapiens
actcttatagtattggttatta

SEQ ID NO: 7489307 - DNA, 22 bp, Homo sapiens
actctgtgtgagtagagcctgt

SEQ ID NO: 7489308 - DNA, 22 bp, Homo sapiens
actctgtgctggggacctcatc

SEQ ID NO: 7489309 - DNA, 22 bp, Homo sapiens
actctgtgctggggacctcatc

SEQ ID NO: 7489310 - DNA, 22 bp, Homo sapiens
actctgtgccaggcactttggg

SEQ ID NO: 7489311 - DNA, 22 bp, Homo sapiens
actgagggatttaataaatttt

SEQ ID NO: 7489312 - DNA, 22 bp, Homo sapiens
actgagggagagtcttaggttg

SEQ ID NO: 7489313 - DNA, 22 bp, Homo sapiens
actgagggagagtcttaggttg

SEQ ID NO: 7489314 - DNA, 22 bp, Homo sapiens
actgagggactcccacctggca

SEQ ID NO: 7489315 - DNA, 22 bp, Homo sapiens
actgagggactcccacctggca

SEQ ID NO: 7489316 - DNA, 22 bp, Homo sapiens
actgaggcttacaaaggtaaag

SEQ ID NO: 7489317 - DNA, 21 bp, Homo sapiens
actgagggccagagaggacct

SEQ ID NO: 7489318 - DNA, 23 bp, Homo sapiens
actgagggccacttccatcgtga

SEQ ID NO: 7489319 - DNA, 23 bp, Homo sapiens
actgagggccacttccatcgtga

SEQ ID NO: 7489320 - DNA, 22 bp, Homo sapiens
actgagggcataaaagtactgt

SEQ ID NO: 7489321 - DNA, 22 bp, Homo sapiens
actgagggccaaaggcactgag

SEQ ID NO: 7489322 - DNA, 22 bp, Homo sapiens
actgagggccaaaggcactgag

SEQ ID NO: 7489323 - DNA, 22 bp, Homo sapiens
actgaggcccgaggatctcctg

SEQ ID NO: 7489324 - DNA, 22 bp, Homo sapiens
actgaggcgcagtccggctgtc

SEQ ID NO: 7489325 - DNA, 22 bp, Homo sapiens
actgaggcttaaagagattagg

SEQ ID NO: 7489326 - DNA, 22 bp, Homo sapiens
actgaggctagattgctgttct

SEQ ID NO: 7489327 - DNA, 22 bp, Homo sapiens
actgaggagaaatttgagtgaa

SEQ ID NO: 7489328 - DNA, 22 bp, Homo sapiens
actgaggacagtgaggagggct

SEQ ID NO: 7489329 - DNA, 22 bp, Homo sapiens
actgaggacagtgaggagggct

SEQ ID NO: 7489330 - DNA, 22 bp, Homo sapiens
actgaggacagtgaggagggct

SEQ ID NO: 7489331 - DNA, 22 bp, Homo sapiens
actgaggacagtgaggagggct

SEQ ID NO: 7489332 - DNA, 22 bp, Homo sapiens
actgagctgtgacaatgcttaa

SEQ ID NO: 7489333 - DNA, 20 bp, Homo sapiens
actgagctgcatggagagga

SEQ ID NO: 7489334 - DNA, 22 bp, Homo sapiens
actgagctgcttgaagtgaact

SEQ ID NO: 7489335 - DNA, 22 bp, Homo sapiens
actgaggattagcccaggctag

SEQ ID NO: 7489336 - DNA, 22 bp, Homo sapiens
actgaggattagcccaggctag

SEQ ID NO: 7489337 - DNA, 22 bp, Homo sapiens
actgaggattagcccaggctag

SEQ ID NO: 7489338 - DNA, 22 bp, Homo sapiens
actgaggattagcccaggctag

SEQ ID NO: 7489339 - DNA, 22 bp, Homo sapiens
actgaggatggataggtcatat

SEQ ID NO: 7489340 - DNA, 22 bp, Homo sapiens
actgaggcagtgaggtcggtct

SEQ ID NO: 7489341 - DNA, 22 bp, Homo sapiens
actgaggcagaagggtaagtgg

SEQ ID NO: 7489342 - DNA, 22 bp, Homo sapiens
agtgcatgtatctacagtcaca

SEQ ID NO: 7489343 - DNA, 22 bp, Homo sapiens
agtgcatggtcaagctaaacca

SEQ ID NO: 7489344 - DNA, 23 bp, Homo sapiens
agtgcatgcttgacttagcaagc

SEQ ID NO: 7489345 - DNA, 23 bp, Homo sapiens
agtgcatgcttgacttagcaagc

SEQ ID NO: 7489346 - DNA, 22 bp, Homo sapiens
agtgcatgtccagtagtttatg

SEQ ID NO: 7489347 - DNA, 22 bp, Homo sapiens
actgagctcttgactgggagtt

SEQ ID NO: 7489348 - DNA, 22 bp, Homo sapiens
actgagctcttgactgggagtt

SEQ ID NO: 7489349 - DNA, 20 bp, Homo sapiens
actgagctgcatggagagga

SEQ ID NO: 7489350 - DNA, 20 bp, Homo sapiens
actgagctgcatggagagga

SEQ ID NO: 7489351 - DNA, 20 bp, Homo sapiens
actgagctgcatggagagga

SEQ ID NO: 7489352 - DNA, 22 bp, Homo sapiens
actgagctgcaagtcagggagg

SEQ ID NO: 7489353 - DNA, 22 bp, Homo sapiens
agtgcatatatgaagagtatga

SEQ ID NO: 7489354 - DNA, 22 bp, Homo sapiens
agtgcatagctgcgaagcattt

SEQ ID NO: 7489355 - DNA, 22 bp, Homo sapiens
agtgcatagggggatgcacagc

SEQ ID NO: 7489356 - DNA, 22 bp, Homo sapiens
agtgcataatgaaggagcttga

SEQ ID NO: 7489357 - DNA, 22 bp, Homo sapiens
agtgcataagtggggttgaagg

SEQ ID NO: 7489358 - DNA, 22 bp, Homo sapiens
agtgcataaaggaaaaactgaa

SEQ ID NO: 7489359 - DNA, 22 bp, Homo sapiens
agtgcagttaggatggggaatt

SEQ ID NO: 7489360 - DNA, 22 bp, Homo sapiens
agtgcataaaggaaaaactgaa

SEQ ID NO: 7489361 - DNA, 22 bp, Homo sapiens
agtgcagttaggatggggaatt

SEQ ID NO: 7489362 - DNA, 22 bp, Homo sapiens
agtgcagttaggatggggaatt

SEQ ID NO: 7489363 - DNA, 22 bp, Homo sapiens
agtgcagtggttaggagccagg

SEQ ID NO: 7489364 - DNA, 22 bp, Homo sapiens
agtgcatgcgcttgggaggggt

SEQ ID NO: 7489365 - DNA, 22 bp, Homo sapiens
agtgcatgccttcctgtggatg

SEQ ID NO: 7489366 - DNA, 22 bp, Homo sapiens
agtgcatatatgaagagtatga

SEQ ID NO: 7489367 - DNA, 22 bp, Homo sapiens
agtgcatgaaagcatacaaggc

SEQ ID NO: 7489368 - DNA, 22 bp, Homo sapiens
agtgcatatatgaagagtatga

SEQ ID NO: 7489369 - DNA, 22 bp, Homo sapiens
agtgcatagggggatgcacagc

SEQ ID NO: 7489370 - DNA, 22 bp, Homo sapiens
agtgcatatatgaagagtatga

SEQ ID NO: 7489371 - DNA, 23 bp, Homo sapiens
actcgtggaattctctgcgatcg

SEQ ID NO: 7489372 - DNA, 23 bp, Homo sapiens
actcgtggaattctctgcgatcg

SEQ ID NO: 7489373 - DNA, 22 bp, Homo sapiens
actcggggtggagagagcggtg

SEQ ID NO: 7489374 - DNA, 22 bp, Homo sapiens
actcggcagcctgagagttcac

SEQ ID NO: 7489375 - DNA, 22 bp, Homo sapiens
actccttactaaaaggaacata

SEQ ID NO: 7489376 - DNA, 23 bp, Homo sapiens
actcgtggaattctctgcgatcg

SEQ ID NO: 7489377 - DNA, 23 bp, Homo sapiens
actcgtggaattctctgcgatcg

SEQ ID NO: 7489378 - DNA, 22 bp, Homo sapiens
actcgtgtcaagatcctaagtc

SEQ ID NO: 7489379 - DNA, 23 bp, Homo sapiens
actcgtggaattctctgcgatcg

SEQ ID NO: 7489380 - DNA, 22 bp, Homo sapiens
agtctgtcagtcattctaacaa

SEQ ID NO: 7489381 - DNA, 22 bp, Homo sapiens
agtctgtctaatattattcagg

SEQ ID NO: 7489382 - DNA, 22 bp, Homo sapiens
agtctgtctaatattattcagg

SEQ ID NO: 7489383 - DNA, 22 bp, Homo sapiens
agtctgtctaatattattcagg

SEQ ID NO: 7489384 - DNA, 22 bp, Homo sapiens
agtctgtcattaaacttcccaa

SEQ ID NO: 7489385 - DNA, 22 bp, Homo sapiens
agtcttctgggtgtttccagag

SEQ ID NO: 7489386 - DNA, 20 bp, Homo sapiens
agtctgtcaatttacagtgg

SEQ ID NO: 7489387 - DNA, 22 bp, Homo sapiens
agtctgtcagtcattctaacaa

SEQ ID NO: 7489388 - DNA, 22 bp, Homo sapiens
actctaaaagtgaagtgtggtc

SEQ ID NO: 7489389 - DNA, 22 bp, Homo sapiens
agtctggttgattcctttgcac

SEQ ID NO: 7489390 - DNA, 22 bp, Homo sapiens
agtcttcttgatcttttcagtg

SEQ ID NO: 7489391 - DNA, 22 bp, Homo sapiens
agtcttctgtttttcagcagct

SEQ ID NO: 7489392 - DNA, 22 bp, Homo sapiens
agtcttcttgatcttttcagtg

SEQ ID NO: 7489393 - DNA, 22 bp, Homo sapiens
agtcttctgggtgtttccagag

SEQ ID NO: 7489394 - DNA, 22 bp, Homo sapiens
agtctgtctacttaaagtctgt

SEQ ID NO: 7489395 - DNA, 22 bp, Homo sapiens
agtcttctgtttttcagcagct

SEQ ID NO: 7489396 - DNA, 22 bp, Homo sapiens
agtcttctgtttttcagcagct

SEQ ID NO: 7489397 - DNA, 22 bp, Homo sapiens
agtcttctttcatttactcagt

SEQ ID NO: 7489398 - DNA, 22 bp, Homo sapiens
agtcttctttcatttactcagt

SEQ ID NO: 7489399 - DNA, 22 bp, Homo sapiens
agtcttcttgatcttttcagtg

SEQ ID NO: 7489400 - DNA, 22 bp, Homo sapiens
agtcttcttgatcttttcagtg

SEQ ID NO: 7489401 - DNA, 22 bp, Homo sapiens
agtcttcttgatcttttcagtg

SEQ ID NO: 7489402 - DNA, 22 bp, Homo sapiens
agtcttcttttattacttgggg

SEQ ID NO: 7489403 - DNA, 22 bp, Homo sapiens
agtcttctttgtgttctctcat

SEQ ID NO: 7489404 - DNA, 22 bp, Homo sapiens
agtcttctttgtgttctctcat

SEQ ID NO: 7489405 - DNA, 22 bp, Homo sapiens
agtcttctttcatttactcagt

SEQ ID NO: 7489406 - DNA, 22 bp, Homo sapiens
agtcttctttcatttactcagt

SEQ ID NO: 7489407 - DNA, 22 bp, Homo sapiens
agtcttctttgtgttctctcat

SEQ ID NO: 7489408 - DNA, 22 bp, Homo sapiens
agtcttcttttattacttgggg

SEQ ID NO: 7489409 - DNA, 22 bp, Homo sapiens
agtcttgaaagcacattagagt

SEQ ID NO: 7489410 - DNA, 22 bp, Homo sapiens
agtcttgaaagcacattagagt

SEQ ID NO: 7489411 - DNA, 22 bp, Homo sapiens
agtctttaacatttggagattg

SEQ ID NO: 7489412 - DNA, 22 bp, Homo sapiens
agtctttaagtaatgataggca

SEQ ID NO: 7489413 - DNA, 22 bp, Homo sapiens
agtctttaagtaatgataggca

SEQ ID NO: 7489414 - DNA, 22 bp, Homo sapiens
agtctttaagtaatgataggca

SEQ ID NO: 7489415 - DNA, 22 bp, Homo sapiens
agtctttaatgatcatgtattt

SEQ ID NO: 7489416 - DNA, 22 bp, Homo sapiens
agtctttaatgatcatgtattt

SEQ ID NO: 7489417 - DNA, 22 bp, Homo sapiens
agtctttaatgatcatgtattt

SEQ ID NO: 7489418 - DNA, 22 bp, Homo sapiens
agtctttaatgatcatgtattt

SEQ ID NO: 7489419 - DNA, 22 bp, Homo sapiens
agtctttaatgatcatgtattt

SEQ ID NO: 7489420 - DNA, 22 bp, Homo sapiens
agtctttacatgtgttatatat

SEQ ID NO: 7489421 - DNA, 22 bp, Homo sapiens
agtctttaatgatcatgtattt

SEQ ID NO: 7489422 - DNA, 22 bp, Homo sapiens
agtctttacagaaaggcaggaa

SEQ ID NO: 7489423 - DNA, 22 bp, Homo sapiens
agtctttacagaaaggcaggaa

SEQ ID NO: 7489424 - DNA, 22 bp, Homo sapiens
agtctttacagaaaggcaggaa

SEQ ID NO: 7489425 - DNA, 22 bp, Homo sapiens
agtctttacatgtgttatatat

SEQ ID NO: 7489426 - DNA, 22 bp, Homo sapiens
agtctttacatgtgttatatat

SEQ ID NO: 7489427 - DNA, 22 bp, Homo sapiens
agtctttacatgtgttatatat

SEQ ID NO: 7489428 - DNA, 20 bp, Homo sapiens
actctgtactgtcaatgttg

SEQ ID NO: 7489429 - DNA, 22 bp, Homo sapiens
agtctttagggaggtcagagtt

SEQ ID NO: 7489430 - DNA, 22 bp, Homo sapiens
agtctttagggaggtcagagtt

SEQ ID NO: 7489431 - DNA, 22 bp, Homo sapiens
agtctttagagtcttagtgttt

SEQ ID NO: 7489432 - DNA, 22 bp, Homo sapiens
agtctttagggaggtcagagtt

SEQ ID NO: 7489433 - DNA, 22 bp, Homo sapiens
actctgtaattctgaagcacct

SEQ ID NO: 7489434 - DNA, 22 bp, Homo sapiens
agtctttagagtcttagtgttt

SEQ ID NO: 7489435 - DNA, 22 bp, Homo sapiens
agtctttagagtcttagtgttt

SEQ ID NO: 7489436 - DNA, 22 bp, Homo sapiens
agtctttagagtcttagtgttt

SEQ ID NO: 7489437 - DNA, 22 bp, Homo sapiens
agtctttagaaggtagttgagg

SEQ ID NO: 7489438 - DNA, 22 bp, Homo sapiens
agtctttagaaggtagttgagg

SEQ ID NO: 7489439 - DNA, 22 bp, Homo sapiens
agtctttagaaggtagttgagg

SEQ ID NO: 7489440 - DNA, 22 bp, Homo sapiens
agtctttagaaggtagttgagg

SEQ ID NO: 7489441 - DNA, 22 bp, Homo sapiens
agtctttacatgtgttatatat

SEQ ID NO: 7489442 - DNA, 22 bp, Homo sapiens
agtctttacatgtgttatatat

SEQ ID NO: 7489443 - DNA, 22 bp, Homo sapiens
agtctttactaaacagaccacc

SEQ ID NO: 7489444 - DNA, 22 bp, Homo sapiens
agtctttactaaacagaccacc

SEQ ID NO: 7489445 - DNA, 22 bp, Homo sapiens
agtctttactaaacagaccacc

SEQ ID NO: 7489446 - DNA, 19 bp, Homo sapiens
agtcttgtatttttcaagc

SEQ ID NO: 7489447 - DNA, 19 bp, Homo sapiens
agtcttgtatttttcaagc

SEQ ID NO: 7489448 - DNA, 19 bp, Homo sapiens
agtcttgtatttttcaagc

SEQ ID NO: 7489449 - DNA, 22 bp, Homo sapiens
agtcttggttttcttaggtctg

SEQ ID NO: 7489450 - DNA, 22 bp, Homo sapiens
agtcttggtctccctggcagct

SEQ ID NO: 7489451 - DNA, 22 bp, Homo sapiens
agtcttggtgtcagtggtctga

SEQ ID NO: 7489452 - DNA, 22 bp, Homo sapiens
agtcttggctatgcatagagct

SEQ ID NO: 7489453 - DNA, 22 bp, Homo sapiens
agtcttggctatgcatagagct

SEQ ID NO: 7489454 - DNA, 22 bp, Homo sapiens
agtcttggctatgcatagagct

SEQ ID NO: 7489455 - DNA, 22 bp, Homo sapiens
agtcttgggttgcctgatattg

SEQ ID NO: 7489456 - DNA, 22 bp, Homo sapiens
agtcttgggagaggctggcagt

SEQ ID NO: 7489457 - DNA, 22 bp, Homo sapiens
agtcttgggagaggctggcagt

SEQ ID NO: 7489458 - DNA, 22 bp, Homo sapiens
agtctttaacatttggagattg

SEQ ID NO: 7489459 - DNA, 22 bp, Homo sapiens
agtctttaacatttggagattg

SEQ ID NO: 7489460 - DNA, 22 bp, Homo sapiens
agtctttaacatttggagattg

SEQ ID NO: 7489461 - DNA, 22 bp, Homo sapiens
agtctttaacatttggagattg

SEQ ID NO: 7489462 - DNA, 18 bp, Homo sapiens
agtctttaaagatgttac

SEQ ID NO: 7489463 - DNA, 18 bp, Homo sapiens
agtctttaaagatgttac

SEQ ID NO: 7489464 - DNA, 18 bp, Homo sapiens
agtctttaaagatgttac

SEQ ID NO: 7489465 - DNA, 18 bp, Homo sapiens
agtctttaaagatgttac

SEQ ID NO: 7489466 - DNA, 18 bp, Homo sapiens
agtctttaaagatgttac

SEQ ID NO: 7489467 - DNA, 18 bp, Homo sapiens
agtctttaaagatgttac

SEQ ID NO: 7489468 - DNA, 18 bp, Homo sapiens
agtcttgttctgttgccc

SEQ ID NO: 7489469 - DNA, 22 bp, Homo sapiens
agtcttgtcttattttaataga

SEQ ID NO: 7489470 - DNA, 22 bp, Homo sapiens
agtcttgtcttattttaataga

SEQ ID NO: 7489471 - DNA, 22 bp, Homo sapiens
agtcttgtcttattttaataga

SEQ ID NO: 7489472 - DNA, 22 bp, Homo sapiens
agtcttgtcttgcaagggctga

SEQ ID NO: 7489473 - DNA, 22 bp, Homo sapiens
actcctgtgggcatggcacccc

SEQ ID NO: 7489474 - DNA, 22 bp, Homo sapiens
actcctgtgtggctgggaggtt

SEQ ID NO: 7489475 - DNA, 22 bp, Homo sapiens
actcctgtgggcatggcacccc

SEQ ID NO: 7489476 - DNA, 22 bp, Homo sapiens
actcctgtgaggtaggtggcaa

SEQ ID NO: 7489477 - DNA, 22 bp, Homo sapiens
actcctgtgaggtaggtggcaa

SEQ ID NO: 7489478 - DNA, 22 bp, Homo sapiens
actcctggtttgtgtcctggct

SEQ ID NO: 7489479 - DNA, 22 bp, Homo sapiens
actcctggtttgtgtcctggct

SEQ ID NO: 7489480 - DNA, 22 bp, Homo sapiens
actcctggtttgtgtcctggct

SEQ ID NO: 7489481 - DNA, 22 bp, Homo sapiens
actcctggtttgtgtcctggct

SEQ ID NO: 7489482 - DNA, 17 bp, Homo sapiens
actcctggtctgaaggg

SEQ ID NO: 7489483 - DNA, 22 bp, Homo sapiens
actcctggtgctgatgaagaga

SEQ ID NO: 7489484 - DNA, 22 bp, Homo sapiens
actcctggtgctgatgaagaga

SEQ ID NO: 7489485 - DNA, 22 bp, Homo sapiens
actcctggtgctgatgaagaga

SEQ ID NO: 7489486 - DNA, 22 bp, Homo sapiens
actcctggttcccagttgagat

SEQ ID NO: 7489487 - DNA, 22 bp, Homo sapiens
actcctgggttgcagtcctcaa

SEQ ID NO: 7489488 - DNA, 22 bp, Homo sapiens
actcctgggttgcagtcctcaa

SEQ ID NO: 7489489 - DNA, 22 bp, Homo sapiens
actcctgggttgcagtcctcaa

SEQ ID NO: 7489490 - DNA, 20 bp, Homo sapiens
actcctggtaacttttgtga

SEQ ID NO: 7489491 - DNA, 20 bp, Homo sapiens
actcctggtaacttttgtga

SEQ ID NO: 7489492 - DNA, 17 bp, Homo sapiens
actcctggtctgaaggg

SEQ ID NO: 7489493 - DNA, 22 bp, Homo sapiens
actcctgggttctaaatttgaa

SEQ ID NO: 7489494 - DNA, 22 bp, Homo sapiens
actcctgggttccggagattct

SEQ ID NO: 7489495 - DNA, 18 bp, Homo sapiens
agtcccatcttcagctct

SEQ ID NO: 7489496 - DNA, 22 bp, Homo sapiens
agtcccagtgacttggccagaa

SEQ ID NO: 7489497 - DNA, 22 bp, Homo sapiens
agtcccagtgacttggccagaa

SEQ ID NO: 7489498 - DNA, 21 bp, Homo sapiens
agtcccaggggtgagtgatgt

SEQ ID NO: 7489499 - DNA, 22 bp, Homo sapiens
agtcccagtgacttggccagaa

SEQ ID NO: 7489500 - DNA, 19 bp, Homo sapiens
agtcccaggcccgaaagag

SEQ ID NO: 7489501 - DNA, 19 bp, Homo sapiens
agtcccaggcccgaaagag

SEQ ID NO: 7489502 - DNA, 19 bp, Homo sapiens
agtcccaggcccgaaagag

SEQ ID NO: 7489503 - DNA, 21 bp, Homo sapiens
agtcccaggggtgagtgatgt

SEQ ID NO: 7489504 - DNA, 21 bp, Homo sapiens
agtcccaggggtgagtgatgt

SEQ ID NO: 7489505 - DNA, 21 bp, Homo sapiens
agtcccaggggtgagtgatgt

SEQ ID NO: 7489506 - DNA, 21 bp, Homo sapiens
agtcccaggggtgagtgatgt

SEQ ID NO: 7489507 - DNA, 22 bp, Homo sapiens
agtcccaggcagccgagccggt

SEQ ID NO: 7489508 - DNA, 22 bp, Homo sapiens
agtcccaggcagccgagccggt

SEQ ID NO: 7489509 - DNA, 22 bp, Homo sapiens
agtcccaggcagccgagccggt

SEQ ID NO: 7489510 - DNA, 22 bp, Homo sapiens
agtcccaggcagccgagccggt

SEQ ID NO: 7489511 - DNA, 22 bp, Homo sapiens
agtcccagcttcccccatgcag

SEQ ID NO: 7489512 - DNA, 22 bp, Homo sapiens
agtcccagcttcccccatgcag

SEQ ID NO: 7489513 - DNA, 22 bp, Homo sapiens
agtcccagcttcccccatgcag

SEQ ID NO: 7489514 - DNA, 22 bp, Homo sapiens
agtcccagcttcccccatgcag

SEQ ID NO: 7489515 - DNA, 22 bp, Homo sapiens
agtcccagttcggttcttcctc

SEQ ID NO: 7489516 - DNA, 22 bp, Homo sapiens
agtcccagttcggttcttcctc

SEQ ID NO: 7489517 - DNA, 22 bp, Homo sapiens
agtcccagttcggttcttcctc

SEQ ID NO: 7489518 - DNA, 22 bp, Homo sapiens
agtcccagtgagatgagccacg

SEQ ID NO: 7489519 - DNA, 22 bp, Homo sapiens
agtcccagtgagatgagccacg

SEQ ID NO: 7489520 - DNA, 22 bp, Homo sapiens
agtcccagtgagatgagccacg

SEQ ID NO: 7489521 - DNA, 22 bp, Homo sapiens
agtcccagtgacttggccagaa

SEQ ID NO: 7489522 - DNA, 22 bp, Homo sapiens
agtcccagtgacttggccagaa

SEQ ID NO: 7489523 - DNA, 22 bp, Homo sapiens
agtcccagtgacttggccagaa

SEQ ID NO: 7489524 - DNA, 22 bp, Homo sapiens
agtcccagtgagatgaaccagg

SEQ ID NO: 7489525 - DNA, 22 bp, Homo sapiens
agtcccagtgagatgagccacg

SEQ ID NO: 7489526 - DNA, 22 bp, Homo sapiens
agtcccagtgagatgagccacg

SEQ ID NO: 7489527 - DNA, 22 bp, Homo sapiens
agtcccagtgagatgagccacg

SEQ ID NO: 7489528 - DNA, 22 bp, Homo sapiens
agtcccagtgagatgagccacg

SEQ ID NO: 7489529 - DNA, 22 bp, Homo sapiens
agtcccagtgagatgaaccagg

SEQ ID NO: 7489530 - DNA, 22 bp, Homo sapiens
agtcccagtgagatgaaccagg

SEQ ID NO: 7489531 - DNA, 22 bp, Homo sapiens
agtcccagtgagatgagccacg

SEQ ID NO: 7489532 - DNA, 22 bp, Homo sapiens
agtcccagtgagatgagccacg

SEQ ID NO: 7489533 - DNA, 18 bp, Homo sapiens
actggctttagcatcaga

SEQ ID NO: 7489534 - DNA, 22 bp, Homo sapiens
actggctttgagggaatagcta

SEQ ID NO: 7489535 - DNA, 22 bp, Homo sapiens
actggcttgtgagacaatgcct

SEQ ID NO: 7489536 - DNA, 21 bp, Homo sapiens
actggcttgtatttggtaagc

SEQ ID NO: 7489537 - DNA, 18 bp, Homo sapiens
actggctttagcatcaga

SEQ ID NO: 7489538 - DNA, 21 bp, Homo sapiens
actggcttggctctggctgaa

SEQ ID NO: 7489539 - DNA, 22 bp, Homo sapiens
agtgtttatggaaccctggtgg

SEQ ID NO: 7489540 - DNA, 22 bp, Homo sapiens
agtgtttatattatggaaatat

SEQ ID NO: 7489541 - DNA, 22 bp, Homo sapiens
agtgtttatattatggaaatat

SEQ ID NO: 7489542 - DNA, 22 bp, Homo sapiens
actggctttgagggaatagcta

SEQ ID NO: 7489543 - DNA, 22 bp, Homo sapiens
actggctttgcctctgcctctc

SEQ ID NO: 7489544 - DNA, 22 bp, Homo sapiens
actggctttgcctctgcctctc

SEQ ID NO: 7489545 - DNA, 22 bp, Homo sapiens
actggctttggcttcagatgag

SEQ ID NO: 7489546 - DNA, 22 bp, Homo sapiens
actggctttgggttgccgcaga

SEQ ID NO: 7489547 - DNA, 22 bp, Homo sapiens
actggctttgggttgccgcaga

SEQ ID NO: 7489548 - DNA, 22 bp, Homo sapiens
agtgtttaccccaatcagttta

SEQ ID NO: 7489549 - DNA, 20 bp, Homo sapiens
agtgtttagaatactattat

SEQ ID NO: 7489550 - DNA, 20 bp, Homo sapiens
agtgtttagaatactattat

SEQ ID NO: 7489551 - DNA, 20 bp, Homo sapiens
agtgtttagaatactattat

SEQ ID NO: 7489552 - DNA, 22 bp, Homo sapiens
agtgtttaccccaatcagttta

SEQ ID NO: 7489553 - DNA, 22 bp, Homo sapiens
agtgtttacattgaagcttgta

SEQ ID NO: 7489554 - DNA, 22 bp, Homo sapiens
agtgtttacattgaagcttgta

SEQ ID NO: 7489555 - DNA, 22 bp, Homo sapiens
agtgtttacattgaagcttgta

SEQ ID NO: 7489556 - DNA, 22 bp, Homo sapiens
agtgtttaatgccttttccagc

SEQ ID NO: 7489557 - DNA, 22 bp, Homo sapiens
agtgtttagttaagatttcaaa

SEQ ID NO: 7489558 - DNA, 22 bp, Homo sapiens
agtgtttagttaagatttcaaa

SEQ ID NO: 7489559 - DNA, 22 bp, Homo sapiens
agtgtttagggaatcaaggggt

SEQ ID NO: 7489560 - DNA, 22 bp, Homo sapiens
agtgtttagtcaagtaagacgc

SEQ ID NO: 7489561 - DNA, 22 bp, Homo sapiens
agtgtttagcatgaagttcatt

SEQ ID NO: 7489562 - DNA, 22 bp, Homo sapiens
agtgtttagcatgaagttcatt

SEQ ID NO: 7489563 - DNA, 22 bp, Homo sapiens
agtgtttagcatgaagttcatt

SEQ ID NO: 7489564 - DNA, 22 bp, Homo sapiens
agtgtttagcatgaagttcatt

SEQ ID NO: 7489565 - DNA, 20 bp, Homo sapiens
agtgtttagaatactattat

SEQ ID NO: 7489566 - DNA, 20 bp, Homo sapiens
agtgtttagaatactattat

SEQ ID NO: 7489567 - DNA, 22 bp, Homo sapiens
agtgtttagaggaggaaagatg

SEQ ID NO: 7489568 - DNA, 22 bp, Homo sapiens
agtgttggaccgaggtggagcc

SEQ ID NO: 7489569 - DNA, 22 bp, Homo sapiens
agtgttggaccgaggtggagcc

SEQ ID NO: 7489570 - DNA, 22 bp, Homo sapiens
agtgttgcatgaggcagtacca

SEQ ID NO: 7489571 - DNA, 22 bp, Homo sapiens
agtgttgcatgaggcagtacca

SEQ ID NO: 7489572 - DNA, 22 bp, Homo sapiens
agtgttgaagaggggatgttaa

SEQ ID NO: 7489573 - DNA, 22 bp, Homo sapiens
agtgttctttgcatgaggatag

SEQ ID NO: 7489574 - DNA, 22 bp, Homo sapiens
agtgttctttgcatgaggatag

SEQ ID NO: 7489575 - DNA, 22 bp, Homo sapiens
agtgttcttgtttctaagcaaa

SEQ ID NO: 7489576 - DNA, 21 bp, Homo sapiens
agtgtgtgataggcaggaaga

SEQ ID NO: 7489577 - DNA, 21 bp, Homo sapiens
agtgtgtgataggcaggaaga

SEQ ID NO: 7489578 - DNA, 21 bp, Homo sapiens
agtgtgtgataggcaggaaga

SEQ ID NO: 7489579 - DNA, 21 bp, Homo sapiens
agtgtgtgataggcaggaaga

SEQ ID NO: 7489580 - DNA, 22 bp, Homo sapiens
agtgttcttcctatctgctgtt

SEQ ID NO: 7489581 - DNA, 22 bp, Homo sapiens
agtgttcttcctatctgctgtt

SEQ ID NO: 7489582 - DNA, 22 bp, Homo sapiens
agtgttcttctggggtatgctc

SEQ ID NO: 7489583 - DNA, 22 bp, Homo sapiens
agtgttcttctggggtatgctc

SEQ ID NO: 7489584 - DNA, 22 bp, Homo sapiens
agtgttcttgtttctaagcaaa

SEQ ID NO: 7489585 - DNA, 22 bp, Homo sapiens
agtgtttaaactgaagtgatga

SEQ ID NO: 7489586 - DNA, 22 bp, Homo sapiens
agtgtttaaactgaagtgatga

SEQ ID NO: 7489587 - DNA, 22 bp, Homo sapiens
agtgttgtctaaatgaatgcta

SEQ ID NO: 7489588 - DNA, 22 bp, Homo sapiens
agtgtttaaaaatggaaatgca

SEQ ID NO: 7489589 - DNA, 22 bp, Homo sapiens
agtgtttaaaaatggaaatgca

SEQ ID NO: 7489590 - DNA, 22 bp, Homo sapiens
agtgttgtcaaacggctcagca

SEQ ID NO: 7489591 - DNA, 22 bp, Homo sapiens
agtgttgtaataaatatcatct

SEQ ID NO: 7489592 - DNA, 22 bp, Homo sapiens
agtgttgtatgggatgactgct

SEQ ID NO: 7489593 - DNA, 23 bp, Homo sapiens
agtgttggttgggaagccaagca

SEQ ID NO: 7489594 - DNA, 22 bp, Homo sapiens
agtgtttaatgccttttccagc

SEQ ID NO: 7489595 - DNA, 22 bp, Homo sapiens
agtgtttaatgccttttccagc

SEQ ID NO: 7489596 - DNA, 22 bp, Homo sapiens
agtgtttacagagtagtggaaa

SEQ ID NO: 7489597 - DNA, 22 bp, Homo sapiens
agtgtttacagagtagtggaaa

SEQ ID NO: 7489598 - DNA, 22 bp, Homo sapiens
agtgtttaagttacacacatat

SEQ ID NO: 7489599 - DNA, 22 bp, Homo sapiens
agtgtttaagttacacacatat

SEQ ID NO: 7489600 - DNA, 22 bp, Homo sapiens
agtgtttaagttacacacatat

SEQ ID NO: 7489601 - DNA, 22 bp, Homo sapiens
agtgtttaaactgaagtgatga

SEQ ID NO: 7489602 - DNA, 22 bp, Homo sapiens
agtgtattagcaagctctccag

SEQ ID NO: 7489603 - DNA, 22 bp, Homo sapiens
agtgtattagttgtccagcagt

SEQ ID NO: 7489604 - DNA, 22 bp, Homo sapiens
agtgtattacagaactgacatt

SEQ ID NO: 7489605 - DNA, 22 bp, Homo sapiens
agtgtattacagaactgacatt

SEQ ID NO: 7489606 - DNA, 22 bp, Homo sapiens
agtgtattagcaagctctccag

SEQ ID NO: 7489607 - DNA, 22 bp, Homo sapiens
actgctttatctgagaagtcct

SEQ ID NO: 7489608 - DNA, 22 bp, Homo sapiens
agtgtattatcagaaactgtgg

SEQ ID NO: 7489609 - DNA, 22 bp, Homo sapiens
actgctttatctgagaagtcct

SEQ ID NO: 7489610 - DNA, 22 bp, Homo sapiens
actgctttatctgagaagtcct

SEQ ID NO: 7489611 - DNA, 22 bp, Homo sapiens
actgctttatctgagaagtcct

SEQ ID NO: 7489612 - DNA, 23 bp, Homo sapiens
actgctttattcatgaggctctc

SEQ ID NO: 7489613 - DNA, 22 bp, Homo sapiens
actgcttttagaaatctataga

SEQ ID NO: 7489614 - DNA, 22 bp, Homo sapiens
actgcttttagaaatctataga

SEQ ID NO: 7489615 - DNA, 22 bp, Homo sapiens
agtgtattaaaatgctcctaag

SEQ ID NO: 7489616 - DNA, 22 bp, Homo sapiens
agtgtatgtcctgaggggagaa

SEQ ID NO: 7489617 - DNA, 22 bp, Homo sapiens
agtgtatgtcaagtatatacac

SEQ ID NO: 7489618 - DNA, 22 bp, Homo sapiens
agtgtatgtcaagtatatacac

SEQ ID NO: 7489619 - DNA, 22 bp, Homo sapiens
agtgtatgcaggttttcaatgt

SEQ ID NO: 7489620 - DNA, 22 bp, Homo sapiens
agtgtatgcaggttttcaatgt

SEQ ID NO: 7489621 - DNA, 22 bp, Homo sapiens
agtgtattacagaactgacatt

SEQ ID NO: 7489622 - DNA, 22 bp, Homo sapiens
agtgtattaatgctccaggagt

SEQ ID NO: 7489623 - DNA, 22 bp, Homo sapiens
agtgtattaatgctccaggagt

SEQ ID NO: 7489624 - DNA, 22 bp, Homo sapiens
agtgtattaatgctccaggagt

SEQ ID NO: 7489625 - DNA, 22 bp, Homo sapiens
agtgtattaagttatgaagtta

SEQ ID NO: 7489626 - DNA, 22 bp, Homo sapiens
agtgtattaaaatgctcctaag

SEQ ID NO: 7489627 - DNA, 22 bp, Homo sapiens
agtgtattaagttatgaagtta

SEQ ID NO: 7489628 - DNA, 22 bp, Homo sapiens
agtgtaggtgagggcctgggtt

SEQ ID NO: 7489629 - DNA, 22 bp, Homo sapiens
agtgtatacttttagtagaatt

SEQ ID NO: 7489630 - DNA, 22 bp, Homo sapiens
agtgtaggtgagggcctgggtt

SEQ ID NO: 7489631 - DNA, 22 bp, Homo sapiens
agtgtagggtggtcagagcaga

SEQ ID NO: 7489632 - DNA, 22 bp, Homo sapiens
agtgtagggtggtcagagcaga

SEQ ID NO: 7489633 - DNA, 21 bp, Homo sapiens
agtgtaggtcattagctgttg

SEQ ID NO: 7489634 - DNA, 22 bp, Homo sapiens
agtgtatctaggtatctatagt

SEQ ID NO: 7489635 - DNA, 22 bp, Homo sapiens
agtgtatcatggttggcagaca

SEQ ID NO: 7489636 - DNA, 22 bp, Homo sapiens
agtgtatatgtgctgagaaacg

SEQ ID NO: 7489637 - DNA, 22 bp, Homo sapiens
agtgtatgaacttaagagagag

SEQ ID NO: 7489638 - DNA, 22 bp, Homo sapiens
agtgtatgagtttcagttcttc

SEQ ID NO: 7489639 - DNA, 21 bp, Homo sapiens
actggaagtgggtcaggaagt

SEQ ID NO: 7489640 - DNA, 21 bp, Homo sapiens
actggaagtgggtcaggaagt

SEQ ID NO: 7489641 - DNA, 21 bp, Homo sapiens
actggaagtgggtcaggaagt

SEQ ID NO: 7489642 - DNA, 22 bp, Homo sapiens
actggaagccagttgacaatca

SEQ ID NO: 7489643 - DNA, 22 bp, Homo sapiens
actggaagccagttgacaatca

SEQ ID NO: 7489644 - DNA, 22 bp, Homo sapiens
actggaaattgagaggtcactg

SEQ ID NO: 7489645 - DNA, 22 bp, Homo sapiens
actggaaattgagaggtcactg

SEQ ID NO: 7489646 - DNA, 21 bp, Homo sapiens
agtgtgtgataggcaggaaga

SEQ ID NO: 7489647 - DNA, 22 bp, Homo sapiens
agtgtgtgaccttttaatttaa

SEQ ID NO: 7489648 - DNA, 22 bp, Homo sapiens
actggaattggatggaagtggt

SEQ ID NO: 7489649 - DNA, 20 bp, Homo sapiens
actggacactgaggtgagct

SEQ ID NO: 7489650 - DNA, 22 bp, Homo sapiens
actggaatgaagttaatctgat

SEQ ID NO: 7489651 - DNA, 22 bp, Homo sapiens
actggaatgaagttaatctgat

SEQ ID NO: 7489652 - DNA, 22 bp, Homo sapiens
actggaattaggtttgtataca

SEQ ID NO: 7489653 - DNA, 22 bp, Homo sapiens
actggaattggaatctggagct

SEQ ID NO: 7489654 - DNA, 22 bp, Homo sapiens
actggaaaaccactgaaatgag

SEQ ID NO: 7489655 - DNA, 22 bp, Homo sapiens
actggaaaaccactgaaatgag

SEQ ID NO: 7489656 - DNA, 22 bp, Homo sapiens
actgcttttgatctcttctgta

SEQ ID NO: 7489657 - DNA, 22 bp, Homo sapiens
actggaaaaccactgaaatgag

SEQ ID NO: 7489658 - DNA, 22 bp, Homo sapiens
actggaaaattcaaatggggtc

SEQ ID NO: 7489659 - DNA, 22 bp, Homo sapiens
actggaaaacactactacatgc

SEQ ID NO: 7489660 - DNA, 22 bp, Homo sapiens
actggaaaacactactacatgc

SEQ ID NO: 7489661 - DNA, 22 bp, Homo sapiens
actgcttttctaagattctgtg

SEQ ID NO: 7489662 - DNA, 22 bp, Homo sapiens
actgcttttgatctcttctgta

SEQ ID NO: 7489663 - DNA, 22 bp, Homo sapiens
actggaaagtattctttcactg

SEQ ID NO: 7489664 - DNA, 22 bp, Homo sapiens
actggaaagtattctttcactg

SEQ ID NO: 7489665 - DNA, 22 bp, Homo sapiens
actggaaaggctctgaatggga

SEQ ID NO: 7489666 - DNA, 22 bp, Homo sapiens
actggaaagtattctttcactg

SEQ ID NO: 7489667 - DNA, 22 bp, Homo sapiens
actggaaactacagcctatcct

SEQ ID NO: 7489668 - DNA, 22 bp, Homo sapiens
actggaaactacagcctatcct

SEQ ID NO: 7489669 - DNA, 22 bp, Homo sapiens
actggaaagttgattatgtcca

SEQ ID NO: 7489670 - DNA, 22 bp, Homo sapiens
actggaaataaattttgaatgt

SEQ ID NO: 7489671 - DNA, 22 bp, Homo sapiens
actggaaagttgattatgtcca

SEQ ID NO: 7489672 - DNA, 22 bp, Homo sapiens
actggaaatgagatgatatcag

SEQ ID NO: 7489673 - DNA, 22 bp, Homo sapiens
actggaaataaattttgaatgt

SEQ ID NO: 7489674 - DNA, 22 bp, Homo sapiens
actggaaatgagatgatatcag

SEQ ID NO: 7489675 - DNA, 22 bp, Homo sapiens
actgcacttcagcctgggtgac

SEQ ID NO: 7489676 - DNA, 22 bp, Homo sapiens
actgcacttcagcctgggtgtc

SEQ ID NO: 7489677 - DNA, 22 bp, Homo sapiens
actgcacttcagcctgggtgac

SEQ ID NO: 7489678 - DNA, 22 bp, Homo sapiens
actgcacttcagcctgggtgac

SEQ ID NO: 7489679 - DNA, 22 bp, Homo sapiens
actgcacttcagcctgggtgac

SEQ ID NO: 7489680 - DNA, 22 bp, Homo sapiens
actgcacttcagcctgggtgac

SEQ ID NO: 7489681 - DNA, 22 bp, Homo sapiens
actgcacttcagcctgggtgac

SEQ ID NO: 7489682 - DNA, 22 bp, Homo sapiens
actgcacttcagcctgggtgac

SEQ ID NO: 7489683 - DNA, 22 bp, Homo sapiens
actgcacttcagcctgggtgac

SEQ ID NO: 7489684 - DNA, 22 bp, Homo sapiens
actgcacttcagcctgggtgac

SEQ ID NO: 7489685 - DNA, 22 bp, Homo sapiens
agtggcagtggctgggcagagc

SEQ ID NO: 7489686 - DNA, 22 bp, Homo sapiens
agtggcagtggctgggcagagc

SEQ ID NO: 7489687 - DNA, 22 bp, Homo sapiens
agtggcagtggctgggcagagc

SEQ ID NO: 7489688 - DNA, 22 bp, Homo sapiens
agtggcagtggctgggcagagc

SEQ ID NO: 7489689 - DNA, 22 bp, Homo sapiens
actgcacttcagcctgggtgac

SEQ ID NO: 7489690 - DNA, 22 bp, Homo sapiens
actgcacttcagcctgggtgac

SEQ ID NO: 7489691 - DNA, 22 bp, Homo sapiens
agtggcagtggaaagcacacgg

SEQ ID NO: 7489692 - DNA, 22 bp, Homo sapiens
agtggcagtggaaagcacacgg

SEQ ID NO: 7489693 - DNA, 22 bp, Homo sapiens
agtggcagtggctgggcagagc

SEQ ID NO: 7489694 - DNA, 22 bp, Homo sapiens
agtggcagtggctgggcagagc

SEQ ID NO: 7489695 - DNA, 22 bp, Homo sapiens
agtggcagtggctgggcagagc

SEQ ID NO: 7489696 - DNA, 22 bp, Homo sapiens
agtggcagtggctgggcagagc

SEQ ID NO: 7489697 - DNA, 22 bp, Homo sapiens
agtggcagtggctgggcagagc

SEQ ID NO: 7489698 - DNA, 22 bp, Homo sapiens
agtggcagtggctgggcagagc

SEQ ID NO: 7489699 - DNA, 22 bp, Homo sapiens
agtggcagtggctgggcagagc

SEQ ID NO: 7489700 - DNA, 22 bp, Homo sapiens
agtggcagtggctgggcagagc

SEQ ID NO: 7489701 - DNA, 22 bp, Homo sapiens
agtggcagtggctgggcagagc

SEQ ID NO: 7489702 - DNA, 22 bp, Homo sapiens
agtggcagtggctgggcagagc

SEQ ID NO: 7489703 - DNA, 22 bp, Homo sapiens
agtggcagtggaaagcacacgg

SEQ ID NO: 7489704 - DNA, 22 bp, Homo sapiens
agtggcagtagatgagctggtt

SEQ ID NO: 7489705 - DNA, 22 bp, Homo sapiens
agtggcagtagatgagctggtt

SEQ ID NO: 7489706 - DNA, 22 bp, Homo sapiens
agtggcagtggaaagcacacgg

SEQ ID NO: 7489707 - DNA, 22 bp, Homo sapiens
agtggcagtggaaagcacacgg

SEQ ID NO: 7489708 - DNA, 22 bp, Homo sapiens
agtggcagtggaaagcacacgg

SEQ ID NO: 7489709 - DNA, 22 bp, Homo sapiens
agtggcagtggaaagcacacgg

SEQ ID NO: 7489710 - DNA, 22 bp, Homo sapiens
agtggcagtggaaagcacacgg

SEQ ID NO: 7489711 - DNA, 22 bp, Homo sapiens
agtggcagtagatgagctggtt

SEQ ID NO: 7489712 - DNA, 22 bp, Homo sapiens
agtggcagtagatgagctggtt

SEQ ID NO: 7489713 - DNA, 22 bp, Homo sapiens
agtggcagtagatgagctggtt

SEQ ID NO: 7489714 - DNA, 22 bp, Homo sapiens
agtggcagtagatgagctggtt

SEQ ID NO: 7489715 - DNA, 22 bp, Homo sapiens
agtggcagtagatgagctggtt

SEQ ID NO: 7489716 - DNA, 21 bp, Homo sapiens
actgagggccagagaggacct

SEQ ID NO: 7489717 - DNA, 21 bp, Homo sapiens
actgagggccagagaggacct

SEQ ID NO: 7489718 - DNA, 21 bp, Homo sapiens
actgagggccagagaggacct

SEQ ID NO: 7489719 - DNA, 21 bp, Homo sapiens
actgagggccagagaggacct

SEQ ID NO: 7489720 - DNA, 21 bp, Homo sapiens
actgagggccagagaggacct

SEQ ID NO: 7489721 - DNA, 22 bp, Homo sapiens
actgaggggctttcaggcccag

SEQ ID NO: 7489722 - DNA, 22 bp, Homo sapiens
actgaggggttggagagtgagg

SEQ ID NO: 7489723 - DNA, 22 bp, Homo sapiens
actgaggggttggagagtgagg

SEQ ID NO: 7489724 - DNA, 22 bp, Homo sapiens
actgagggtaatataaaacatt

SEQ ID NO: 7489725 - DNA, 22 bp, Homo sapiens
agtggcagagccagggttggga

SEQ ID NO: 7489726 - DNA, 22 bp, Homo sapiens
agtggcagagccagggttggga

SEQ ID NO: 7489727 - DNA, 22 bp, Homo sapiens
agtggcagggctggctgctgca

SEQ ID NO: 7489728 - DNA, 22 bp, Homo sapiens
agtggcagggctggctgctgca

SEQ ID NO: 7489729 - DNA, 22 bp, Homo sapiens
agtggcagggctggctgctgca

SEQ ID NO: 7489730 - DNA, 22 bp, Homo sapiens
agtggcagggctggctgctgca

SEQ ID NO: 7489731 - DNA, 22 bp, Homo sapiens
agtggcagggctggctgctgca

SEQ ID NO: 7489732 - DNA, 22 bp, Homo sapiens
agtggcagggctggctgctgca

SEQ ID NO: 7489733 - DNA, 22 bp, Homo sapiens
agtggcagggctggctgctgca

SEQ ID NO: 7489734 - DNA, 22 bp, Homo sapiens
agtggcagggctggctgctgca

SEQ ID NO: 7489735 - DNA, 22 bp, Homo sapiens
agtggcagagccagggttggga

SEQ ID NO: 7489736 - DNA, 22 bp, Homo sapiens
agtggcagagccagggttggga

SEQ ID NO: 7489737 - DNA, 22 bp, Homo sapiens
agtggcagagctgggatttggg

SEQ ID NO: 7489738 - DNA, 22 bp, Homo sapiens
agtggcagagctgggatttggg

SEQ ID NO: 7489739 - DNA, 22 bp, Homo sapiens
agtggcagagctgggatttggg

SEQ ID NO: 7489740 - DNA, 22 bp, Homo sapiens
agtggcagtagatgagctggtt

SEQ ID NO: 7489741 - DNA, 22 bp, Homo sapiens
agtggcagtagatgagctggtt

SEQ ID NO: 7489742 - DNA, 22 bp, Homo sapiens
agtggcagtagatgagctggtt

SEQ ID NO: 7489743 - DNA, 22 bp, Homo sapiens
agtggcagtagatgagctggtt

SEQ ID NO: 7489744 - DNA, 22 bp, Homo sapiens
agtggcagtagatgagctggtt

SEQ ID NO: 7489745 - DNA, 22 bp, Homo sapiens
agtggcagtaacattccacaat

SEQ ID NO: 7489746 - DNA, 22 bp, Homo sapiens
agtggcagtagatgagctggtt

SEQ ID NO: 7489747 - DNA, 22 bp, Homo sapiens
agtggcagtagatgagctggtt

SEQ ID NO: 7489748 - DNA, 22 bp, Homo sapiens
agtggcagtagatgagctggtt

SEQ ID NO: 7489749 - DNA, 22 bp, Homo sapiens
agtggcagtagatgagctggtt

SEQ ID NO: 7489750 - DNA, 22 bp, Homo sapiens
agtggcagtagatgagctggtt

SEQ ID NO: 7489751 - DNA, 22 bp, Homo sapiens
agtggcaggtgtgtagtatccc

SEQ ID NO: 7489752 - DNA, 22 bp, Homo sapiens
agtggcagggctggctgctgca

SEQ ID NO: 7489753 - DNA, 22 bp, Homo sapiens
agtggcagggctggctgctgca

SEQ ID NO: 7489754 - DNA, 22 bp, Homo sapiens
agtggcagggctggctgctgca

SEQ ID NO: 7489755 - DNA, 22 bp, Homo sapiens
agtggcaggtgtttcgtggtgc

SEQ ID NO: 7489756 - DNA, 22 bp, Homo sapiens
agtggcaggtgtttcgtggtgc

SEQ ID NO: 7489757 - DNA, 22 bp, Homo sapiens
agtggcaggtgtttcgtggtgc

SEQ ID NO: 7489758 - DNA, 22 bp, Homo sapiens
agtggcaggtgtttcgtggtgc

SEQ ID NO: 7489759 - DNA, 22 bp, Homo sapiens
agtggcaggtgtttcgtggtgc

SEQ ID NO: 7489760 - DNA, 22 bp, Homo sapiens
agtggcaggtgtttcgtggtgc

SEQ ID NO: 7489761 - DNA, 22 bp, Homo sapiens
agtggcaggtgtttcgtggtgc

SEQ ID NO: 7489762 - DNA, 22 bp, Homo sapiens
agtggcaggtgtttcgtggtgc

SEQ ID NO: 7489763 - DNA, 22 bp, Homo sapiens
agtggcagtaacattccacaat

SEQ ID NO: 7489764 - DNA, 21 bp, Homo sapiens
agtggggtctctgtggaggcc

SEQ ID NO: 7489765 - DNA, 21 bp, Homo sapiens
agtggggtctctgtggaggcc

SEQ ID NO: 7489766 - DNA, 21 bp, Homo sapiens
agtggggtctctgtggaggcc

SEQ ID NO: 7489767 - DNA, 21 bp, Homo sapiens
agtggggtctctgtggaggcc

SEQ ID NO: 7489768 - DNA, 21 bp, Homo sapiens
agtggggtctctgtggaggcc

SEQ ID NO: 7489769 - DNA, 21 bp, Homo sapiens
agtggggtctctgtggaggcc

SEQ ID NO: 7489770 - DNA, 22 bp, Homo sapiens
actgcagaggtggggtgcagag

SEQ ID NO: 7489771 - DNA, 22 bp, Homo sapiens
actgcagcaaagcccgtgtctt

SEQ ID NO: 7489772 - DNA, 22 bp, Homo sapiens
actgcagcaaagcccgtgtctt

SEQ ID NO: 7489773 - DNA, 22 bp, Homo sapiens
actgcagcaaagcccgtgtctt

SEQ ID NO: 7489774 - DNA, 22 bp, Homo sapiens
actgcagaggtggggtgcagag

SEQ ID NO: 7489775 - DNA, 22 bp, Homo sapiens
actgcactttaggccaactagg

SEQ ID NO: 7489776 - DNA, 22 bp, Homo sapiens
actgcagagcttttcagttgag

SEQ ID NO: 7489777 - DNA, 22 bp, Homo sapiens
actgcagaggtggggtgcagag

SEQ ID NO: 7489778 - DNA, 22 bp, Homo sapiens
actgcagaggtggggtgcagag

SEQ ID NO: 7489779 - DNA, 22 bp, Homo sapiens
actgcagagcttttcagttgag

SEQ ID NO: 7489780 - DNA, 22 bp, Homo sapiens
actgcagagcttttcagttgag

SEQ ID NO: 7489781 - DNA, 22 bp, Homo sapiens
actgcagagcttttcagttgag

SEQ ID NO: 7489782 - DNA, 22 bp, Homo sapiens
actgcagactctacagttataa

SEQ ID NO: 7489783 - DNA, 22 bp, Homo sapiens
actgcagactctacagttataa

SEQ ID NO: 7489784 - DNA, 22 bp, Homo sapiens
actgcacttcagcctgggtgtc

SEQ ID NO: 7489785 - DNA, 22 bp, Homo sapiens
actgcacttcagcctgggtgtc

SEQ ID NO: 7489786 - DNA, 22 bp, Homo sapiens
actgcactttaggccaactagg

SEQ ID NO: 7489787 - DNA, 22 bp, Homo sapiens
actgcagactctacagttataa

SEQ ID NO: 7489788 - DNA, 22 bp, Homo sapiens
actgcagactctacagttataa

SEQ ID NO: 7489789 - DNA, 22 bp, Homo sapiens
actgcacttcagcctgggtgtc

SEQ ID NO: 7489790 - DNA, 22 bp, Homo sapiens
actgcacttcagcctgggtgtc

SEQ ID NO: 7489791 - DNA, 22 bp, Homo sapiens
actgcacttcagcctgggtgtc

SEQ ID NO: 7489792 - DNA, 22 bp, Homo sapiens
actgcacttcagcctgggtgtc

SEQ ID NO: 7489793 - DNA, 22 bp, Homo sapiens
actgcacttcagcctgggtgtc

SEQ ID NO: 7489794 - DNA, 22 bp, Homo sapiens
actgcacttcagcctgggtgtc

SEQ ID NO: 7489795 - DNA, 22 bp, Homo sapiens
actgcacttcagcctgggtgtc

SEQ ID NO: 7489796 - DNA, 22 bp, Homo sapiens
actgcacttcagcctgggtgtc

SEQ ID NO: 7489797 - DNA, 22 bp, Homo sapiens
actgcacttcagcctgggtgtc

SEQ ID NO: 7489798 - DNA, 22 bp, Homo sapiens
actgcacttcagcctgggtgtc

SEQ ID NO: 7489799 - DNA, 22 bp, Homo sapiens
actgcacttcagcctgggtgtc

SEQ ID NO: 7489800 - DNA, 22 bp, Homo sapiens
actgcacttcagcctgggtgtc

SEQ ID NO: 7489801 - DNA, 22 bp, Homo sapiens
agtgtacagtttgtagtactac

SEQ ID NO: 7489802 - DNA, 22 bp, Homo sapiens
agtgtacatagttaggaacatc

SEQ ID NO: 7489803 - DNA, 22 bp, Homo sapiens
agtgtacatagttaggaacatc

SEQ ID NO: 7489804 - DNA, 22 bp, Homo sapiens
agtgtacatagttaggaacatc

SEQ ID NO: 7489805 - DNA, 22 bp, Homo sapiens
agtgtacagttctatgaatttc

SEQ ID NO: 7489806 - DNA, 22 bp, Homo sapiens
agtgtacagtttgtagtactac

SEQ ID NO: 7489807 - DNA, 22 bp, Homo sapiens
agtgtacagttctatgaatttc

SEQ ID NO: 7489808 - DNA, 22 bp, Homo sapiens
agtgtacagttctatgaatttc

SEQ ID NO: 7489809 - DNA, 22 bp, Homo sapiens
agtgtacagttctatgaatttc

SEQ ID NO: 7489810 - DNA, 22 bp, Homo sapiens
agtgtacagtgtagtggcgtta

SEQ ID NO: 7489811 - DNA, 22 bp, Homo sapiens
agtgtacactaaatgaatacaa

SEQ ID NO: 7489812 - DNA, 22 bp, Homo sapiens
agtgtacactaaatgaatacaa

SEQ ID NO: 7489813 - DNA, 22 bp, Homo sapiens
agtgtacactaaatgaatacaa

SEQ ID NO: 7489814 - DNA, 22 bp, Homo sapiens
agtgtacaagaccttattgttg

SEQ ID NO: 7489815 - DNA, 22 bp, Homo sapiens
agtgtacaagaccttattgttg

SEQ ID NO: 7489816 - DNA, 22 bp, Homo sapiens
agtgtacacttgcagcctcaag

SEQ ID NO: 7489817 - DNA, 20 bp, Homo sapiens
agtgtacagacactagaaat

SEQ ID NO: 7489818 - DNA, 20 bp, Homo sapiens
agtgtacagacactagaaat

SEQ ID NO: 7489819 - DNA, 20 bp, Homo sapiens
agtgtacagacactagaaat

SEQ ID NO: 7489820 - DNA, 22 bp, Homo sapiens
agtgtagatgaaattaaaccca

SEQ ID NO: 7489821 - DNA, 22 bp, Homo sapiens
agtgtagacataggtctggtct

SEQ ID NO: 7489822 - DNA, 22 bp, Homo sapiens
agtgtagggtggtcagagcaga

SEQ ID NO: 7489823 - DNA, 22 bp, Homo sapiens
agtgtagaaggagaaatggatc

SEQ ID NO: 7489824 - DNA, 22 bp, Homo sapiens
agtgtacatgtttacagcatct

SEQ ID NO: 7489825 - DNA, 22 bp, Homo sapiens
agtgtacattctgtttgaggta

SEQ ID NO: 7489826 - DNA, 22 bp, Homo sapiens
agtgtacatgtttacagcatct

SEQ ID NO: 7489827 - DNA, 22 bp, Homo sapiens
agtgtacatcagaacatatcaa

SEQ ID NO: 7489828 - DNA, 22 bp, Homo sapiens
agtgtacatcagaacatatcaa

SEQ ID NO: 7489829 - DNA, 22 bp, Homo sapiens
agtgtacatcagaacatatcaa

SEQ ID NO: 7489830 - DNA, 22 bp, Homo sapiens
agtgtacatcagaacatatcaa

SEQ ID NO: 7489831 - DNA, 22 bp, Homo sapiens
agtgtacatcagaacatatcaa

SEQ ID NO: 7489832 - DNA, 22 bp, Homo sapiens
agtgtacatgtttacagcatct

SEQ ID NO: 7489833 - DNA, 22 bp, Homo sapiens
agtgtacatgtttacagcatct

SEQ ID NO: 7489834 - DNA, 22 bp, Homo sapiens
agtgtacatcagaacatatcaa

SEQ ID NO: 7489835 - DNA, 22 bp, Homo sapiens
agtgtacatgtacacattagta

SEQ ID NO: 7489836 - DNA, 22 bp, Homo sapiens
agtgtacatgtacacattagta

SEQ ID NO: 7489837 - DNA, 22 bp, Homo sapiens
acctgcaggcacaggtgtgcgc

SEQ ID NO: 7489838 - DNA, 22 bp, Homo sapiens
acctgcagctgagaaaatgact

SEQ ID NO: 7489839 - DNA, 22 bp, Homo sapiens
acctgcagctgagaaaatgact

SEQ ID NO: 7489840 - DNA, 22 bp, Homo sapiens
acctgcagctaaagatgtaggg

SEQ ID NO: 7489841 - DNA, 22 bp, Homo sapiens
acctgcagctaaagatgtaggg

SEQ ID NO: 7489842 - DNA, 22 bp, Homo sapiens
acctgcagctaaagatgtaggg

SEQ ID NO: 7489843 - DNA, 22 bp, Homo sapiens
acctgcagccacttctctcctt

SEQ ID NO: 7489844 - DNA, 22 bp, Homo sapiens
acctgcagtggccactcctaat

SEQ ID NO: 7489845 - DNA, 22 bp, Homo sapiens
acctgcaggtgtttccacactt

SEQ ID NO: 7489846 - DNA, 19 bp, Homo sapiens
acctgcagtaataattcct

SEQ ID NO: 7489847 - DNA, 19 bp, Homo sapiens
acctgcagtaataattcct

SEQ ID NO: 7489848 - DNA, 22 bp, Homo sapiens
acctgcaggggtgctctctggg

SEQ ID NO: 7489849 - DNA, 22 bp, Homo sapiens
acctgcaggcacaggtgtgcgc

SEQ ID NO: 7489850 - DNA, 22 bp, Homo sapiens
acctgcaggggtgctctctggg

SEQ ID NO: 7489851 - DNA, 22 bp, Homo sapiens
acctgcagtggccactcctaat

SEQ ID NO: 7489852 - DNA, 22 bp, Homo sapiens
acctgcatgatgtctgaagcaa

SEQ ID NO: 7489853 - DNA, 22 bp, Homo sapiens
acctgccaagcatcagtggcag

SEQ ID NO: 7489854 - DNA, 22 bp, Homo sapiens
acctgcagtggccactcctaat

SEQ ID NO: 7489855 - DNA, 22 bp, Homo sapiens
acctgcagtggccactcctaat

SEQ ID NO: 7489856 - DNA, 22 bp, Homo sapiens
acctgcagtggccactcctaat

SEQ ID NO: 7489857 - DNA, 20 bp, Homo sapiens
acctgccacagagaaaggta

SEQ ID NO: 7489858 - DNA, 22 bp, Homo sapiens
acctgccaagcatcagtggcag

SEQ ID NO: 7489859 - DNA, 22 bp, Homo sapiens
acctgccagaatccaagccaca

SEQ ID NO: 7489860 - DNA, 21 bp, Homo sapiens
acctgccacattgcagacttg

SEQ ID NO: 7489861 - DNA, 22 bp, Homo sapiens
acctgccagaatgctagtcctg

SEQ ID NO: 7489862 - DNA, 22 bp, Homo sapiens
acctgccagaatgctagtcctg

SEQ ID NO: 7489863 - DNA, 22 bp, Homo sapiens
acctgccagctgagaagggtgt

SEQ ID NO: 7489864 - DNA, 22 bp, Homo sapiens
aggtccagttgccagaatggcc

SEQ ID NO: 7489865 - DNA, 22 bp, Homo sapiens
aggtccagttgccagaatggcc

SEQ ID NO: 7489866 - DNA, 22 bp, Homo sapiens
aggtccagttgccagaatggcc

SEQ ID NO: 7489867 - DNA, 22 bp, Homo sapiens
acctgcccacacttccttccca

SEQ ID NO: 7489868 - DNA, 22 bp, Homo sapiens
acctgccagtgaatactatctt

SEQ ID NO: 7489869 - DNA, 22 bp, Homo sapiens
acctgcccacacttccttccca

SEQ ID NO: 7489870 - DNA, 22 bp, Homo sapiens
acctgcccacacttccttccca

SEQ ID NO: 7489871 - DNA, 22 bp, Homo sapiens
acctgagacttgggatgggaat

SEQ ID NO: 7489872 - DNA, 22 bp, Homo sapiens
acctgagacttgggatgggaat

SEQ ID NO: 7489873 - DNA, 22 bp, Homo sapiens
acctgagacctaatctgactgt

SEQ ID NO: 7489874 - DNA, 22 bp, Homo sapiens
acctgagacctaatctgactgt

SEQ ID NO: 7489875 - DNA, 22 bp, Homo sapiens
acctgagcctagggaggttgag

SEQ ID NO: 7489876 - DNA, 21 bp, Homo sapiens
acctgagctccacctcctgcc

SEQ ID NO: 7489877 - DNA, 21 bp, Homo sapiens
acctgagctccacctcctgcc

SEQ ID NO: 7489878 - DNA, 22 bp, Homo sapiens
acctgaggaagggcgagaagct

SEQ ID NO: 7489879 - DNA, 22 bp, Homo sapiens
acctgaggaagggcgagaagct

SEQ ID NO: 7489880 - DNA, 22 bp, Homo sapiens
acctgaggactggatggtagaa

SEQ ID NO: 7489881 - DNA, 22 bp, Homo sapiens
acctgaggactggatggtagaa

SEQ ID NO: 7489882 - DNA, 22 bp, Homo sapiens
acctgaggactggatggtagaa

SEQ ID NO: 7489883 - DNA, 22 bp, Homo sapiens
acctgaggcctccccagcagac

SEQ ID NO: 7489884 - DNA, 22 bp, Homo sapiens
acctgaggcctccccagcagac

SEQ ID NO: 7489885 - DNA, 18 bp, Homo sapiens
acctgattggcgcagccc

SEQ ID NO: 7489886 - DNA, 18 bp, Homo sapiens
acctgattggcgcagccc

SEQ ID NO: 7489887 - DNA, 18 bp, Homo sapiens
acctgattggcgcagccc

SEQ ID NO: 7489888 - DNA, 23 bp, Homo sapiens
acctgcaaatttggtcctcttct

SEQ ID NO: 7489889 - DNA, 20 bp, Homo sapiens
acctgaggtccctatggtct

SEQ ID NO: 7489890 - DNA, 22 bp, Homo sapiens
acctgagggcccaaacttggta

SEQ ID NO: 7489891 - DNA, 20 bp, Homo sapiens
acctgaggtccctatggtct

SEQ ID NO: 7489892 - DNA, 20 bp, Homo sapiens
acctgaggtccctatggtct

SEQ ID NO: 7489893 - DNA, 22 bp, Homo sapiens
acctgagggcccaaacttggta

SEQ ID NO: 7489894 - DNA, 22 bp, Homo sapiens
acctgagggcccaaacttggta

SEQ ID NO: 7489895 - DNA, 22 bp, Homo sapiens
acctgaggctgttagtctaggt

SEQ ID NO: 7489896 - DNA, 22 bp, Homo sapiens
acctgagggagattaggcctga

SEQ ID NO: 7489897 - DNA, 22 bp, Homo sapiens
acctgaggctgttagtctaggt

SEQ ID NO: 7489898 - DNA, 22 bp, Homo sapiens
acctgaggctgttagtctaggt

SEQ ID NO: 7489899 - DNA, 22 bp, Homo sapiens
acctgagggagattaggcctga

SEQ ID NO: 7489900 - DNA, 22 bp, Homo sapiens
acctgaggcctccccagcagac

SEQ ID NO: 7489901 - DNA, 22 bp, Homo sapiens
acctgaggcctccccagcagac

SEQ ID NO: 7489902 - DNA, 22 bp, Homo sapiens
acctgaggctgttagtctaggt

SEQ ID NO: 7489903 - DNA, 22 bp, Homo sapiens
acctgaggcctccccagcagac

SEQ ID NO: 7489904 - DNA, 22 bp, Homo sapiens
acctgaggcctccccagcagac

SEQ ID NO: 7489905 - DNA, 22 bp, Homo sapiens
acctctgtatagttgcctgtgg

SEQ ID NO: 7489906 - DNA, 22 bp, Homo sapiens
acctctttgaacctcagtgtga

SEQ ID NO: 7489907 - DNA, 22 bp, Homo sapiens
acctcttaatattgcaccttct

SEQ ID NO: 7489908 - DNA, 22 bp, Homo sapiens
acctcttaatattgcaccttct

SEQ ID NO: 7489909 - DNA, 22 bp, Homo sapiens
acctctgggaaaagtatggaaa

SEQ ID NO: 7489910 - DNA, 22 bp, Homo sapiens
acctctgggcagcacctttgta

SEQ ID NO: 7489911 - DNA, 22 bp, Homo sapiens
acctctgggcagcacctttgta

SEQ ID NO: 7489912 - DNA, 22 bp, Homo sapiens
acctctgtacctcctctgacag

SEQ ID NO: 7489913 - DNA, 22 bp, Homo sapiens
acctctgtacctcctctgacag

SEQ ID NO: 7489914 - DNA, 22 bp, Homo sapiens
acctctgggaaaagtatggaaa

SEQ ID NO: 7489915 - DNA, 22 bp, Homo sapiens
acctctgggaaaagtatggaaa

SEQ ID NO: 7489916 - DNA, 22 bp, Homo sapiens
acctctggccttcaggcatcat

SEQ ID NO: 7489917 - DNA, 22 bp, Homo sapiens
acctctggccttcaggcatcat

SEQ ID NO: 7489918 - DNA, 22 bp, Homo sapiens
acctctggccttcaggcatcat

SEQ ID NO: 7489919 - DNA, 20 bp, Homo sapiens
acctcctggaagcaggtgcc

SEQ ID NO: 7489920 - DNA, 20 bp, Homo sapiens
acctcctggaagcaggtgcc

SEQ ID NO: 7489921 - DNA, 22 bp, Homo sapiens
acctcctgatgagagtaaagga

SEQ ID NO: 7489922 - DNA, 22 bp, Homo sapiens
acctcctgatgagagtaaagga

SEQ ID NO: 7489923 - DNA, 22 bp, Homo sapiens
acctgaactggtctgctgcccg

SEQ ID NO: 7489924 - DNA, 22 bp, Homo sapiens
acctgaattgatttgacctgta

SEQ ID NO: 7489925 - DNA, 22 bp, Homo sapiens
acctgaattttggatgagctgt

SEQ ID NO: 7489926 - DNA, 22 bp, Homo sapiens
acctgaccaggtggcttcccaa

SEQ ID NO: 7489927 - DNA, 17 bp, Homo sapiens
acctgacagtacagtgt

SEQ ID NO: 7489928 - DNA, 22 bp, Homo sapiens
acctgaaaattattatttccgc

SEQ ID NO: 7489929 - DNA, 22 bp, Homo sapiens
acctgaaaattattatttccgc

SEQ ID NO: 7489930 - DNA, 22 bp, Homo sapiens
acctgaaaattattatttccgc

SEQ ID NO: 7489931 - DNA, 22 bp, Homo sapiens
acctgaaaccaacttgtgtact

SEQ ID NO: 7489932 - DNA, 22 bp, Homo sapiens
acctgaaaattattatttccgc

SEQ ID NO: 7489933 - DNA, 22 bp, Homo sapiens
acctgaaactcaactttatctc

SEQ ID NO: 7489934 - DNA, 22 bp, Homo sapiens
acctgaaactcaactttatctc

SEQ ID NO: 7489935 - DNA, 22 bp, Homo sapiens
acctgaaaccaacttgtgtact

SEQ ID NO: 7489936 - DNA, 22 bp, Homo sapiens
acctgaaactcaactttatctc

SEQ ID NO: 7489937 - DNA, 19 bp, Homo sapiens
accctctcagtgcctgagg

SEQ ID NO: 7489938 - DNA, 19 bp, Homo sapiens
accctctccccactgggtc

SEQ ID NO: 7489939 - DNA, 19 bp, Homo sapiens
accctctccccactgggtc

SEQ ID NO: 7489940 - DNA, 19 bp, Homo sapiens
accctctctgtagaaagat

SEQ ID NO: 7489941 - DNA, 19 bp, Homo sapiens
accctctctgtagaaagat

SEQ ID NO: 7489942 - DNA, 19 bp, Homo sapiens
accctctctgtagaaagat

SEQ ID NO: 7489943 - DNA, 22 bp, Homo sapiens
accctctgagaggcacactttg

SEQ ID NO: 7489944 - DNA, 20 bp, Homo sapiens
accctctgaatagtatctgg

SEQ ID NO: 7489945 - DNA, 20 bp, Homo sapiens
accctctgaatagtatctgg

SEQ ID NO: 7489946 - DNA, 22 bp, Homo sapiens
acctcctccaaggagccatagg

SEQ ID NO: 7489947 - DNA, 22 bp, Homo sapiens
acctcctgatgagagtaaagga

SEQ ID NO: 7489948 - DNA, 22 bp, Homo sapiens
acctcccttgctaaagactgtg

SEQ ID NO: 7489949 - DNA, 22 bp, Homo sapiens
acctcccttgctaaagactgtg

SEQ ID NO: 7489950 - DNA, 22 bp, Homo sapiens
acctcccttgctaaagactgtg

SEQ ID NO: 7489951 - DNA, 22 bp, Homo sapiens
acctcctatgcctggggccagt

SEQ ID NO: 7489952 - DNA, 22 bp, Homo sapiens
accctctgcatcagcttcttta

SEQ ID NO: 7489953 - DNA, 22 bp, Homo sapiens
accctctgccttgagcagtgcc

SEQ ID NO: 7489954 - DNA, 19 bp, Homo sapiens
accctctgccacaagcctc

SEQ ID NO: 7489955 - DNA, 19 bp, Homo sapiens
accctctgccacaagcctc

SEQ ID NO: 7489956 - DNA, 22 bp, Homo sapiens
accctctgcatcagcttcttta

SEQ ID NO: 7489957 - DNA, 22 bp, Homo sapiens
accctctgcatcagcttcttta

SEQ ID NO: 7489958 - DNA, 22 bp, Homo sapiens
accctctgagaggcacactttg

SEQ ID NO: 7489959 - DNA, 22 bp, Homo sapiens
accctccccaagaggtcgtgcc

SEQ ID NO: 7489960 - DNA, 22 bp, Homo sapiens
accctccccaagaggtcgtgcc

SEQ ID NO: 7489961 - DNA, 22 bp, Homo sapiens
accctccactttatctgtcttt

SEQ ID NO: 7489962 - DNA, 22 bp, Homo sapiens
accctccccaagaggtcgtgcc

SEQ ID NO: 7489963 - DNA, 22 bp, Homo sapiens
accctccccaagaggtcgtgcc

SEQ ID NO: 7489964 - DNA, 22 bp, Homo sapiens
accctccccaagaggtcgtgcc

SEQ ID NO: 7489965 - DNA, 22 bp, Homo sapiens
accctcggatttggcctaggac

SEQ ID NO: 7489966 - DNA, 22 bp, Homo sapiens
accctcggatttggcctaggac

SEQ ID NO: 7489967 - DNA, 22 bp, Homo sapiens
accctccccaagaggtcgtgcc

SEQ ID NO: 7489968 - DNA, 22 bp, Homo sapiens
accctccccaagaggtcgtgcc

SEQ ID NO: 7489969 - DNA, 19 bp, Homo sapiens
accctctcagtgcctgagg

SEQ ID NO: 7489970 - DNA, 22 bp, Homo sapiens
accctctagagggaagcacttt

SEQ ID NO: 7489971 - DNA, 22 bp, Homo sapiens
accctcccatttccatgtagca

SEQ ID NO: 7489972 - DNA, 22 bp, Homo sapiens
accctcccatttccatgtagca

SEQ ID NO: 7489973 - DNA, 22 bp, Homo sapiens
accctcccatttccatgtagca

SEQ ID NO: 7489974 - DNA, 22 bp, Homo sapiens
accctcccatttccatgtagca

SEQ ID NO: 7489975 - DNA, 22 bp, Homo sapiens
accctcccatttccatgtagca

SEQ ID NO: 7489976 - DNA, 22 bp, Homo sapiens
accctcccatttccatgtagca

SEQ ID NO: 7489977 - DNA, 22 bp, Homo sapiens
accctccaggctgcagctcctg

SEQ ID NO: 7489978 - DNA, 22 bp, Homo sapiens
accctccaggctgcagctcctg

SEQ ID NO: 7489979 - DNA, 22 bp, Homo sapiens
accctccaggctgcagctcctg

SEQ ID NO: 7489980 - DNA, 20 bp, Homo sapiens
acctggctctcaggagcaac

SEQ ID NO: 7489981 - DNA, 20 bp, Homo sapiens
acctggctctcaggagcaac

SEQ ID NO: 7489982 - DNA, 20 bp, Homo sapiens
acctggctctcaggagcaac

SEQ ID NO: 7489983 - DNA, 19 bp, Homo sapiens
acctggcctcttgagcaag

SEQ ID NO: 7489984 - DNA, 20 bp, Homo sapiens
acctggctctcaggagcaac

SEQ ID NO: 7489985 - DNA, 19 bp, Homo sapiens
acctggcctcttgagcaag

SEQ ID NO: 7489986 - DNA, 19 bp, Homo sapiens
acctggcctcttgagcaag

SEQ ID NO: 7489987 - DNA, 22 bp, Homo sapiens
acctggccccactgtgctgctg

SEQ ID NO: 7489988 - DNA, 22 bp, Homo sapiens
acctggccccactgtgctgctg

SEQ ID NO: 7489989 - DNA, 22 bp, Homo sapiens
acctggccccactgtgctgctg

SEQ ID NO: 7489990 - DNA, 22 bp, Homo sapiens
acctggccccactgtgctgctg

SEQ ID NO: 7489991 - DNA, 22 bp, Homo sapiens
acctggccatccagctggcatc

SEQ ID NO: 7489992 - DNA, 22 bp, Homo sapiens
acctggctgagaacgtgcagct

SEQ ID NO: 7489993 - DNA, 22 bp, Homo sapiens
acctggctgagaacgtgcagct

SEQ ID NO: 7489994 - DNA, 22 bp, Homo sapiens
acctggctgagaacgtgcagct

SEQ ID NO: 7489995 - DNA, 22 bp, Homo sapiens
acctggctgagaacgtgcagct

SEQ ID NO: 7489996 - DNA, 22 bp, Homo sapiens
aggtggagatcagggactaagg

SEQ ID NO: 7489997 - DNA, 22 bp, Homo sapiens
aggtggcatgcctgagacataa

SEQ ID NO: 7489998 - DNA, 22 bp, Homo sapiens
aggtggcatgcctgagacataa

SEQ ID NO: 7489999 - DNA, 22 bp, Homo sapiens
aggtggagatcagggactaagg

SEQ ID NO: 7490000 - DNA, 22 bp, Homo sapiens
aggtggagacccagagaaggcg

SEQ ID NO: 7490001 - DNA, 22 bp, Homo sapiens
aggtggagatcagggactaagg

SEQ ID NO: 7490002 - DNA, 22 bp, Homo sapiens
aggtggagatcagggactaagg

SEQ ID NO: 7490003 - DNA, 19 bp, Homo sapiens
acctggccagagttcaata

SEQ ID NO: 7490004 - DNA, 19 bp, Homo sapiens
acctggccagagttcaata

SEQ ID NO: 7490005 - DNA, 22 bp, Homo sapiens
acctggccaatttttgtatttt

SEQ ID NO: 7490006 - DNA, 22 bp, Homo sapiens
acctggccaatttttgtatttt

SEQ ID NO: 7490007 - DNA, 22 bp, Homo sapiens
acctggcatgaagcatgcctta

SEQ ID NO: 7490008 - DNA, 22 bp, Homo sapiens
acctggccagtggggccgcgct

SEQ ID NO: 7490009 - DNA, 22 bp, Homo sapiens
acctggccaatttttgtatttt

SEQ ID NO: 7490010 - DNA, 19 bp, Homo sapiens
acctggccagagttcaata

SEQ ID NO: 7490011 - DNA, 22 bp, Homo sapiens
acctggccagtggggccgcgct

SEQ ID NO: 7490012 - DNA, 22 bp, Homo sapiens
acctggccatccagctggcatc

SEQ ID NO: 7490013 - DNA, 22 bp, Homo sapiens
acctggccagtggggccgcgct

SEQ ID NO: 7490014 - DNA, 22 bp, Homo sapiens
acctggccatccagctggcatc

SEQ ID NO: 7490015 - DNA, 22 bp, Homo sapiens
acctggccatccagctggcatc

SEQ ID NO: 7490016 - DNA, 22 bp, Homo sapiens
acctggccagtggggccgcgct

SEQ ID NO: 7490017 - DNA, 22 bp, Homo sapiens
acctggccagtggggccgcgct

SEQ ID NO: 7490018 - DNA, 22 bp, Homo sapiens
acctggcactacaggcacctgt

SEQ ID NO: 7490019 - DNA, 22 bp, Homo sapiens
acctggcactacaggcacctgt

SEQ ID NO: 7490020 - DNA, 22 bp, Homo sapiens
acctggcactacaggcacctgt

SEQ ID NO: 7490021 - DNA, 22 bp, Homo sapiens
acctggcactacaggcacctgt

SEQ ID NO: 7490022 - DNA, 22 bp, Homo sapiens
acctggcaggaaggtgggtgat

SEQ ID NO: 7490023 - DNA, 22 bp, Homo sapiens
acctggcataagggcttgagtc

SEQ ID NO: 7490024 - DNA, 22 bp, Homo sapiens
acctggcataagggcttgagtc

SEQ ID NO: 7490025 - DNA, 22 bp, Homo sapiens
aggtggcctaaggtggcactgg

SEQ ID NO: 7490026 - DNA, 22 bp, Homo sapiens
aggtggcccagctgacagatag

SEQ ID NO: 7490027 - DNA, 18 bp, Homo sapiens
aggtggcctgggagcttt

SEQ ID NO: 7490028 - DNA, 22 bp, Homo sapiens
aggtggccggtgccagccgggc

SEQ ID NO: 7490029 - DNA, 22 bp, Homo sapiens
aggtggccggtgccagccgggc

SEQ ID NO: 7490030 - DNA, 23 bp, Homo sapiens
aggtggcctttgcctctttctct

SEQ ID NO: 7490031 - DNA, 18 bp, Homo sapiens
aggtggcctgggagcttt

SEQ ID NO: 7490032 - DNA, 18 bp, Homo sapiens
aggtggcctgggagcttt

SEQ ID NO: 7490033 - DNA, 18 bp, Homo sapiens
aggtggcctgggagcttt

SEQ ID NO: 7490034 - DNA, 22 bp, Homo sapiens
aggtggcctaaggtggcactgg

SEQ ID NO: 7490035 - DNA, 18 bp, Homo sapiens
aggtggcctgggagcttt

SEQ ID NO: 7490036 - DNA, 18 bp, Homo sapiens
aggtggcctgggagcttt

SEQ ID NO: 7490037 - DNA, 22 bp, Homo sapiens
aggtggctatgaggatgcagtc

SEQ ID NO: 7490038 - DNA, 22 bp, Homo sapiens
aggtggctatgaggatgcagtc

SEQ ID NO: 7490039 - DNA, 23 bp, Homo sapiens
aggtggcctttgcctctttctct

SEQ ID NO: 7490040 - DNA, 22 bp, Homo sapiens
aggtggctcctcccatggctgg

SEQ ID NO: 7490041 - DNA, 22 bp, Homo sapiens
aggtggctcctcccatggctgg

SEQ ID NO: 7490042 - DNA, 22 bp, Homo sapiens
aggtggctcctcccatggctgg

SEQ ID NO: 7490043 - DNA, 22 bp, Homo sapiens
aggtggctcccagtgttgttgt

SEQ ID NO: 7490044 - DNA, 22 bp, Homo sapiens
aggtggctatgaggatgcagtc

SEQ ID NO: 7490045 - DNA, 22 bp, Homo sapiens
aggtggctatgaggatgcagtc

SEQ ID NO: 7490046 - DNA, 22 bp, Homo sapiens
aggtggctatgaggatgcagtc

SEQ ID NO: 7490047 - DNA, 22 bp, Homo sapiens
aggtggctcccagtgttgttgt

SEQ ID NO: 7490048 - DNA, 22 bp, Homo sapiens
aggtggcatttacaccatggga

SEQ ID NO: 7490049 - DNA, 22 bp, Homo sapiens
aggtggcatttacaccatggga

SEQ ID NO: 7490050 - DNA, 22 bp, Homo sapiens
aggtggcatttacaccatggga

SEQ ID NO: 7490051 - DNA, 22 bp, Homo sapiens
aggtggcatttacaccatggga

SEQ ID NO: 7490052 - DNA, 22 bp, Homo sapiens
aggtggcatttacaccatggga

SEQ ID NO: 7490053 - DNA, 22 bp, Homo sapiens
aggtggccaataaatgttggag

SEQ ID NO: 7490054 - DNA, 22 bp, Homo sapiens
aggtggccaagactgtttgaca

SEQ ID NO: 7490055 - DNA, 22 bp, Homo sapiens
aggtggccaagactgtttgaca

SEQ ID NO: 7490056 - DNA, 22 bp, Homo sapiens
aggtggcatgcctgagacataa

SEQ ID NO: 7490057 - DNA, 22 bp, Homo sapiens
aggtggcatttacaccatggga

SEQ ID NO: 7490058 - DNA, 22 bp, Homo sapiens
aggtggcatgcctgagacataa

SEQ ID NO: 7490059 - DNA, 22 bp, Homo sapiens
aggtggcatgcctgagacataa

SEQ ID NO: 7490060 - DNA, 19 bp, Homo sapiens
aggtggccatgtccagcct

SEQ ID NO: 7490061 - DNA, 19 bp, Homo sapiens
aggtggccatgtccagcct

SEQ ID NO: 7490062 - DNA, 21 bp, Homo sapiens
aggtggccacaaatctgtttc

SEQ ID NO: 7490063 - DNA, 22 bp, Homo sapiens
aggtggccaataaatgttggag

SEQ ID NO: 7490064 - DNA, 23 bp, Homo sapiens
aggtggccaccagaatgttaagg

SEQ ID NO: 7490065 - DNA, 21 bp, Homo sapiens
aggtggccacaaatctgtttc

SEQ ID NO: 7490066 - DNA, 20 bp, Homo sapiens
aggtggcccattatagtgga

SEQ ID NO: 7490067 - DNA, 22 bp, Homo sapiens
aggtggccccaggcctctgcca

SEQ ID NO: 7490068 - DNA, 22 bp, Homo sapiens
aggtggccccaggcctctgcca

SEQ ID NO: 7490069 - DNA, 22 bp, Homo sapiens
aggtggcccagctgacagatag

SEQ ID NO: 7490070 - DNA, 22 bp, Homo sapiens
aggtggcccagctgacagatag

SEQ ID NO: 7490071 - DNA, 22 bp, Homo sapiens
aggtggccggtgccagccgggc

SEQ ID NO: 7490072 - DNA, 22 bp, Homo sapiens
aggtggccggtgccagccgggc

SEQ ID NO: 7490073 - DNA, 22 bp, Homo sapiens
aggtggccccaggcctctgcca

SEQ ID NO: 7490074 - DNA, 22 bp, Homo sapiens
aggtctctggggaactccaggg

SEQ ID NO: 7490075 - DNA, 22 bp, Homo sapiens
aggtctctggggaactccaggg

SEQ ID NO: 7490076 - DNA, 22 bp, Homo sapiens
aggtctctgcccacacaggctt

SEQ ID NO: 7490077 - DNA, 22 bp, Homo sapiens
aggtctctgcccacacaggctt

SEQ ID NO: 7490078 - DNA, 22 bp, Homo sapiens
aggtctctcagccctgacattc

SEQ ID NO: 7490079 - DNA, 22 bp, Homo sapiens
aggtctctgagtactgctggac

SEQ ID NO: 7490080 - DNA, 22 bp, Homo sapiens
aggtctctcacactcacagggc

SEQ ID NO: 7490081 - DNA, 22 bp, Homo sapiens
aggtctcctcatattctgcctc

SEQ ID NO: 7490082 - DNA, 22 bp, Homo sapiens
aggtctccttgtgggtcttgcc

SEQ ID NO: 7490083 - DNA, 22 bp, Homo sapiens
aggtctctaaaatagtcaaact

SEQ ID NO: 7490084 - DNA, 22 bp, Homo sapiens
aggtctctagaaattcagccag

SEQ ID NO: 7490085 - DNA, 22 bp, Homo sapiens
aggtctctcacactcacagggc

SEQ ID NO: 7490086 - DNA, 22 bp, Homo sapiens
aggtctcactttgtggaagtga

SEQ ID NO: 7490087 - DNA, 22 bp, Homo sapiens
aggtctcaatctcaggtggtca

SEQ ID NO: 7490088 - DNA, 22 bp, Homo sapiens
aggtctcactttgtggaagtga

SEQ ID NO: 7490089 - DNA, 20 bp, Homo sapiens
aggtctcagagcaagagccc

SEQ ID NO: 7490090 - DNA, 20 bp, Homo sapiens
aggtctcagagcaagagccc

SEQ ID NO: 7490091 - DNA, 22 bp, Homo sapiens
aggtctcccaagggccagggag

SEQ ID NO: 7490092 - DNA, 20 bp, Homo sapiens
aggtctcagagcaagagccc

SEQ ID NO: 7490093 - DNA, 22 bp, Homo sapiens
aggtctcccaagggccagggag

SEQ ID NO: 7490094 - DNA, 22 bp, Homo sapiens
acctggagtcatttgaggagta

SEQ ID NO: 7490095 - DNA, 22 bp, Homo sapiens
acctggagtcatttgaggagta

SEQ ID NO: 7490096 - DNA, 22 bp, Homo sapiens
acctggagggaagttctgactt

SEQ ID NO: 7490097 - DNA, 22 bp, Homo sapiens
acctggagggaagttctgactt

SEQ ID NO: 7490098 - DNA, 22 bp, Homo sapiens
acctggaggcagaggttgcagt

SEQ ID NO: 7490099 - DNA, 22 bp, Homo sapiens
aggtctcttgctgtctctgggc

SEQ ID NO: 7490100 - DNA, 22 bp, Homo sapiens
aggtctcttgctgtctctgggc

SEQ ID NO: 7490101 - DNA, 22 bp, Homo sapiens
acctggatgctggccttgcctt

SEQ ID NO: 7490102 - DNA, 22 bp, Homo sapiens
acctggcacacactggggagtg

SEQ ID NO: 7490103 - DNA, 22 bp, Homo sapiens
acctggcacagagtatgctctc

SEQ ID NO: 7490104 - DNA, 22 bp, Homo sapiens
acctggagtcatttgaggagta

SEQ ID NO: 7490105 - DNA, 22 bp, Homo sapiens
acctggatgctggccttgcctt

SEQ ID NO: 7490106 - DNA, 22 bp, Homo sapiens
acctggagtcatttgaggagta

SEQ ID NO: 7490107 - DNA, 22 bp, Homo sapiens
aggtctagatttatagacagca

SEQ ID NO: 7490108 - DNA, 22 bp, Homo sapiens
aggtctcaaactggcaccctgt

SEQ ID NO: 7490109 - DNA, 22 bp, Homo sapiens
aggtctcaaactggcaccctgt

SEQ ID NO: 7490110 - DNA, 22 bp, Homo sapiens
aggtctcaattcctgctcctgt

SEQ ID NO: 7490111 - DNA, 22 bp, Homo sapiens
aggtctcaatctcaggtggtca

SEQ ID NO: 7490112 - DNA, 22 bp, Homo sapiens
aggtctcaattcctgctcctgt

SEQ ID NO: 7490113 - DNA, 22 bp, Homo sapiens
aggtctcaattcctgctcctgt

SEQ ID NO: 7490114 - DNA, 22 bp, Homo sapiens
aggtctcaagagaaaagtggtg

SEQ ID NO: 7490115 - DNA, 22 bp, Homo sapiens
aggtctcaagagaaaagtggtg

SEQ ID NO: 7490116 - DNA, 22 bp, Homo sapiens
aggtctcaagttgagaaggcag

SEQ ID NO: 7490117 - DNA, 22 bp, Homo sapiens
aggtctcaagttgagaaggcag

SEQ ID NO: 7490118 - DNA, 22 bp, Homo sapiens
aggtcgagtttcggggctactt

SEQ ID NO: 7490119 - DNA, 22 bp, Homo sapiens
aggtctaactgatagaattcat

SEQ ID NO: 7490120 - DNA, 22 bp, Homo sapiens
aggtctaactgatagaattcat

SEQ ID NO: 7490121 - DNA, 22 bp, Homo sapiens
aggtcgagtttcggggctactt

SEQ ID NO: 7490122 - DNA, 19 bp, Homo sapiens
aggtctaatcataagacaa

SEQ ID NO: 7490123 - DNA, 22 bp, Homo sapiens
aggtcctgtttcttccctgggg

SEQ ID NO: 7490124 - DNA, 22 bp, Homo sapiens
aggtcctgtttcttccctgggg

SEQ ID NO: 7490125 - DNA, 22 bp, Homo sapiens
aggtcctgtttcttccctgggg

SEQ ID NO: 7490126 - DNA, 22 bp, Homo sapiens
aggtcctgtgtccaggggcctg

SEQ ID NO: 7490127 - DNA, 20 bp, Homo sapiens
aggtcctgttccttgtctcc

SEQ ID NO: 7490128 - DNA, 22 bp, Homo sapiens
aggtcctgtgtccaggggcctg

SEQ ID NO: 7490129 - DNA, 22 bp, Homo sapiens
aggtcctgtgtccaggggcctg

SEQ ID NO: 7490130 - DNA, 22 bp, Homo sapiens
aggtcctgtgtccaggggcctg

SEQ ID NO: 7490131 - DNA, 22 bp, Homo sapiens
aggtcctgtgtccaggggcctg

SEQ ID NO: 7490132 - DNA, 19 bp, Homo sapiens
acctgccatgacagcctga

SEQ ID NO: 7490133 - DNA, 22 bp, Homo sapiens
aggtcctgtgtccaggggcctg

SEQ ID NO: 7490134 - DNA, 22 bp, Homo sapiens
aggtcctgtcttatctctgtaa

SEQ ID NO: 7490135 - DNA, 22 bp, Homo sapiens
aggtcctgtggtttgggtaaaa

SEQ ID NO: 7490136 - DNA, 22 bp, Homo sapiens
aggtccagttttcagttctcat

SEQ ID NO: 7490137 - DNA, 22 bp, Homo sapiens
aggtccagttttcagttctcat

SEQ ID NO: 7490138 - DNA, 22 bp, Homo sapiens
aggtccagttgccagaatggcc

SEQ ID NO: 7490139 - DNA, 22 bp, Homo sapiens
aggtcctgtctatcaccctcgc

SEQ ID NO: 7490140 - DNA, 22 bp, Homo sapiens
aggtcctgtcttatctctgtaa

SEQ ID NO: 7490141 - DNA, 22 bp, Homo sapiens
aggtcctgtcttatctctgtaa

SEQ ID NO: 7490142 - DNA, 22 bp, Homo sapiens
aggtcctgtcttatctctgtaa

SEQ ID NO: 7490143 - DNA, 22 bp, Homo sapiens
agtaaaaattgaggtgcaaaat

SEQ ID NO: 7490144 - DNA, 22 bp, Homo sapiens
agtaaaaattgaggtgcaaaat

SEQ ID NO: 7490145 - DNA, 22 bp, Homo sapiens
agtaaaaattgaggtgcaaaat

SEQ ID NO: 7490146 - DNA, 22 bp, Homo sapiens
aggttggccaagctgctggccc

SEQ ID NO: 7490147 - DNA, 22 bp, Homo sapiens
aggttgaagagactttaaatta

SEQ ID NO: 7490148 - DNA, 22 bp, Homo sapiens
agtaaaaattgaggtgcaaaat

SEQ ID NO: 7490149 - DNA, 22 bp, Homo sapiens
aggttgaaataggttatctaag

SEQ ID NO: 7490150 - DNA, 22 bp, Homo sapiens
aggttcttttggccaacctcat

SEQ ID NO: 7490151 - DNA, 22 bp, Homo sapiens
aggttgaaataggttatctaag

SEQ ID NO: 7490152 - DNA, 22 bp, Homo sapiens
aggttctttgtagtgtcattgg

SEQ ID NO: 7490153 - DNA, 22 bp, Homo sapiens
aggttctttgtagtgtcattgg

SEQ ID NO: 7490154 - DNA, 22 bp, Homo sapiens
acgggaatagggaataggcaga

SEQ ID NO: 7490155 - DNA, 22 bp, Homo sapiens
acggcttcttgactgtgggttg

SEQ ID NO: 7490156 - DNA, 22 bp, Homo sapiens
acggcttcttgactgtgggttg

SEQ ID NO: 7490157 - DNA, 22 bp, Homo sapiens
acggcttcttgactgtgggttg

SEQ ID NO: 7490158 - DNA, 22 bp, Homo sapiens
acggcaggctcagagctggaat

SEQ ID NO: 7490159 - DNA, 22 bp, Homo sapiens
acggcctggtgcagcaggtcgc

SEQ ID NO: 7490160 - DNA, 22 bp, Homo sapiens
acggattttacttccatggtta

SEQ ID NO: 7490161 - DNA, 21 bp, Homo sapiens
acgctggggatggggtctaga

SEQ ID NO: 7490162 - DNA, 22 bp, Homo sapiens
acggatttcagagttctgattc

SEQ ID NO: 7490163 - DNA, 22 bp, Homo sapiens
acggaaaaccctgagcaaactt

SEQ ID NO: 7490164 - DNA, 22 bp, Homo sapiens
acggaaaaccctgagcaaactt

SEQ ID NO: 7490165 - DNA, 17 bp, Homo sapiens
acggaacagagggtgcc

SEQ ID NO: 7490166 - DNA, 22 bp, Homo sapiens
acggaaggctggagaagtacca

SEQ ID NO: 7490167 - DNA, 22 bp, Homo sapiens
acgcctgtaatcccagcacttt

SEQ ID NO: 7490168 - DNA, 22 bp, Homo sapiens
acgcctgtaatcccagcacttt

SEQ ID NO: 7490169 - DNA, 22 bp, Homo sapiens
acgcctgtaatcccagcacttt

SEQ ID NO: 7490170 - DNA, 22 bp, Homo sapiens
acgcctgtaatcccagcacttt

SEQ ID NO: 7490171 - DNA, 22 bp, Homo sapiens
acgcctgtaatcccagcacttt

SEQ ID NO: 7490172 - DNA, 22 bp, Homo sapiens
acgcccagactcccatactttg

SEQ ID NO: 7490173 - DNA, 22 bp, Homo sapiens
acgcccggtctccatagttttt

SEQ ID NO: 7490174 - DNA, 22 bp, Homo sapiens
acgcccggtctccatagttttt

SEQ ID NO: 7490175 - DNA, 22 bp, Homo sapiens
acgcctctgcagctgccgggcc

SEQ ID NO: 7490176 - DNA, 22 bp, Homo sapiens
acgccctttttctctagagtag

SEQ ID NO: 7490177 - DNA, 22 bp, Homo sapiens
acgcctgtaatcccagcacttt

SEQ ID NO: 7490178 - DNA, 22 bp, Homo sapiens
acgcctgtaatcccagcacttt

SEQ ID NO: 7490179 - DNA, 22 bp, Homo sapiens
acgcctgtaatcccagcacttt

SEQ ID NO: 7490180 - DNA, 22 bp, Homo sapiens
acgcctgtaatcccagcacttt

SEQ ID NO: 7490181 - DNA, 22 bp, Homo sapiens
acgcatggtaaatccactgact

SEQ ID NO: 7490182 - DNA, 22 bp, Homo sapiens
acgcccagactcccatactttg

SEQ ID NO: 7490183 - DNA, 22 bp, Homo sapiens
acgcccagactcccatactttg

SEQ ID NO: 7490184 - DNA, 22 bp, Homo sapiens
acgcccagactcccatactttg

SEQ ID NO: 7490185 - DNA, 22 bp, Homo sapiens
acgcccagactcccatactttg

SEQ ID NO: 7490186 - DNA, 22 bp, Homo sapiens
acgcagtttgtggacatttttt

SEQ ID NO: 7490187 - DNA, 22 bp, Homo sapiens
acgcagtttgtggacatttttt

SEQ ID NO: 7490188 - DNA, 22 bp, Homo sapiens
acgcccagactcccatactttg

SEQ ID NO: 7490189 - DNA, 22 bp, Homo sapiens
acgcccagactcccatactttg

SEQ ID NO: 7490190 - DNA, 22 bp, Homo sapiens
acgcccagactcccatactttg

SEQ ID NO: 7490191 - DNA, 22 bp, Homo sapiens
acgcccagactcccatactttg

SEQ ID NO: 7490192 - DNA, 22 bp, Homo sapiens
aggtggctcctcccatggctgg

SEQ ID NO: 7490193 - DNA, 22 bp, Homo sapiens
acgcaggagtgggtggagtgga

SEQ ID NO: 7490194 - DNA, 22 bp, Homo sapiens
acgcagtctttgctctctgtca

SEQ ID NO: 7490195 - DNA, 22 bp, Homo sapiens
acgcagtttgtggacatttttt

SEQ ID NO: 7490196 - DNA, 22 bp, Homo sapiens
acgattgtggacctgggacagt

SEQ ID NO: 7490197 - DNA, 22 bp, Homo sapiens
acgatggttcatcttttgggga

SEQ ID NO: 7490198 - DNA, 20 bp, Homo sapiens
acgatggtgatggtacatcc

SEQ ID NO: 7490199 - DNA, 22 bp, Homo sapiens
acgatgatgaaagagaacattc

SEQ ID NO: 7490200 - DNA, 20 bp, Homo sapiens
aggtggctcctgctgggggt

SEQ ID NO: 7490201 - DNA, 22 bp, Homo sapiens
aggtggctcctcccatggctgg

SEQ ID NO: 7490202 - DNA, 22 bp, Homo sapiens
aggtggctcctcccatggctgg

SEQ ID NO: 7490203 - DNA, 22 bp, Homo sapiens
aggtggctcctcccatggctgg

SEQ ID NO: 7490204 - DNA, 22 bp, Homo sapiens
aggtggctcctcccatggctgg

SEQ ID NO: 7490205 - DNA, 22 bp, Homo sapiens
aggtggctcctcccatggctgg

SEQ ID NO: 7490206 - DNA, 20 bp, Homo sapiens
aggtggctcctgctgggggt

SEQ ID NO: 7490207 - DNA, 20 bp, Homo sapiens
aggtggctcctgctgggggt

SEQ ID NO: 7490208 - DNA, 20 bp, Homo sapiens
aggtggctcctgctgggggt

SEQ ID NO: 7490209 - DNA, 20 bp, Homo sapiens
aggtggctcctgctgggggt

SEQ ID NO: 7490210 - DNA, 20 bp, Homo sapiens
aggtggctcctgctgggggt

SEQ ID NO: 7490211 - DNA, 22 bp, Homo sapiens
agtaaacagaaagcaagatgat

SEQ ID NO: 7490212 - DNA, 22 bp, Homo sapiens
agtaaacagaaagcaagatgat

SEQ ID NO: 7490213 - DNA, 22 bp, Homo sapiens
agtaaacagaaagcaagatgat

SEQ ID NO: 7490214 - DNA, 22 bp, Homo sapiens
agtaaacagaaagcaagatgat

SEQ ID NO: 7490215 - DNA, 22 bp, Homo sapiens
agtaaacagaaagcaagatgat

SEQ ID NO: 7490216 - DNA, 22 bp, Homo sapiens
agtaaacagaaagcaagatgat

SEQ ID NO: 7490217 - DNA, 22 bp, Homo sapiens
agtaaacagaaagcaagatgat

SEQ ID NO: 7490218 - DNA, 22 bp, Homo sapiens
agtaaacagaaagcaagatgat

SEQ ID NO: 7490219 - DNA, 22 bp, Homo sapiens
agtaaacagaaagcaagatgat

SEQ ID NO: 7490220 - DNA, 22 bp, Homo sapiens
agtaaacagaaagcaagatgat

SEQ ID NO: 7490221 - DNA, 22 bp, Homo sapiens
agtaaacactgtctttatatat

SEQ ID NO: 7490222 - DNA, 22 bp, Homo sapiens
agtaaacaggcatgatagtgtt

SEQ ID NO: 7490223 - DNA, 22 bp, Homo sapiens
agtaaacaggcatgatagtgtt

SEQ ID NO: 7490224 - DNA, 22 bp, Homo sapiens
agtaaacagaaagcaagatgat

SEQ ID NO: 7490225 - DNA, 22 bp, Homo sapiens
agtaaacagtaggaactgagaa

SEQ ID NO: 7490226 - DNA, 22 bp, Homo sapiens
agtaaacagtaggaactgagaa

SEQ ID NO: 7490227 - DNA, 22 bp, Homo sapiens
agtaaacagtaggaactgagaa

SEQ ID NO: 7490228 - DNA, 22 bp, Homo sapiens
actagaaattactcagaataaa

SEQ ID NO: 7490229 - DNA, 22 bp, Homo sapiens
actagaacttctaactaaggtc

SEQ ID NO: 7490230 - DNA, 22 bp, Homo sapiens
actagaaccagaggaggcaggt

SEQ ID NO: 7490231 - DNA, 22 bp, Homo sapiens
actagaaattactcagaataaa

SEQ ID NO: 7490232 - DNA, 22 bp, Homo sapiens
actagattttggccattataca

SEQ ID NO: 7490233 - DNA, 22 bp, Homo sapiens
actagattttggccattataca

SEQ ID NO: 7490234 - DNA, 22 bp, Homo sapiens
actagcagaaactgatcatggc

SEQ ID NO: 7490235 - DNA, 22 bp, Homo sapiens
actagcaagttttgtgtctgga

SEQ ID NO: 7490236 - DNA, 22 bp, Homo sapiens
actagcagaaactgatcatggc

SEQ ID NO: 7490237 - DNA, 22 bp, Homo sapiens
actagcagggatattatataag

SEQ ID NO: 7490238 - DNA, 22 bp, Homo sapiens
actagcagggatgttattactt

SEQ ID NO: 7490239 - DNA, 22 bp, Homo sapiens
actagcagtcagcggttggcaa

SEQ ID NO: 7490240 - DNA, 22 bp, Homo sapiens
actagccaagttttacgactaa

SEQ ID NO: 7490241 - DNA, 22 bp, Homo sapiens
actagctgtgacagctgcgtgt

SEQ ID NO: 7490242 - DNA, 22 bp, Homo sapiens
actagattttggccattataca

SEQ ID NO: 7490243 - DNA, 22 bp, Homo sapiens
actagattttggccattataca

SEQ ID NO: 7490244 - DNA, 22 bp, Homo sapiens
actagataattataaaaggtag

SEQ ID NO: 7490245 - DNA, 19 bp, Homo sapiens
actagatacaacatgcaga

SEQ ID NO: 7490246 - DNA, 22 bp, Homo sapiens
actagagtttcacagcaaagtt

SEQ ID NO: 7490247 - DNA, 22 bp, Homo sapiens
actagaatgcaagctccacaag

SEQ ID NO: 7490248 - DNA, 22 bp, Homo sapiens
actagacaggttgtactattgg

SEQ ID NO: 7490249 - DNA, 22 bp, Homo sapiens
actagacatcgagctacagagt

SEQ ID NO: 7490250 - DNA, 22 bp, Homo sapiens
actagacatcgagctacagagt

SEQ ID NO: 7490251 - DNA, 22 bp, Homo sapiens
agtaaacactgtctttatatat

SEQ ID NO: 7490252 - DNA, 22 bp, Homo sapiens
agtaaacactgtctttatatat

SEQ ID NO: 7490253 - DNA, 22 bp, Homo sapiens
agtaaacactaaaatgactgcg

SEQ ID NO: 7490254 - DNA, 22 bp, Homo sapiens
agtaaacactgtctttatatat

SEQ ID NO: 7490255 - DNA, 22 bp, Homo sapiens
agtaaacactgtctttatatat

SEQ ID NO: 7490256 - DNA, 22 bp, Homo sapiens
agtaaacactaaaatgactgcg

SEQ ID NO: 7490257 - DNA, 22 bp, Homo sapiens
agtaaacactaaaatgactgcg

SEQ ID NO: 7490258 - DNA, 22 bp, Homo sapiens
agtaaacactaaaatgactgcg

SEQ ID NO: 7490259 - DNA, 22 bp, Homo sapiens
agtaaacacgtggggtttcttt

SEQ ID NO: 7490260 - DNA, 22 bp, Homo sapiens
agtaaacacgtggggtttcttt

SEQ ID NO: 7490261 - DNA, 22 bp, Homo sapiens
agtaaacacgtggggtttcttt

SEQ ID NO: 7490262 - DNA, 22 bp, Homo sapiens
agtaaaattgtattggaaaaca

SEQ ID NO: 7490263 - DNA, 22 bp, Homo sapiens
agtaaaattgtattggaaaaca

SEQ ID NO: 7490264 - DNA, 22 bp, Homo sapiens
agtaaaattgtattggaaaaca

SEQ ID NO: 7490265 - DNA, 22 bp, Homo sapiens
agtaaaattgtattggaaaaca

SEQ ID NO: 7490266 - DNA, 22 bp, Homo sapiens
agtaaaatttctgctgaggaga

SEQ ID NO: 7490267 - DNA, 22 bp, Homo sapiens
agtaaaatttctgctgaggaga

SEQ ID NO: 7490268 - DNA, 22 bp, Homo sapiens
agtaaacaatgtatgaggacag

SEQ ID NO: 7490269 - DNA, 22 bp, Homo sapiens
agtaaacaatgtatgaggacag

SEQ ID NO: 7490270 - DNA, 22 bp, Homo sapiens
agtaaacaatgtatgaggacag

SEQ ID NO: 7490271 - DNA, 22 bp, Homo sapiens
agtaaaacagagaaatcactca

SEQ ID NO: 7490272 - DNA, 22 bp, Homo sapiens
agtaaaacagagaaatcactca

SEQ ID NO: 7490273 - DNA, 22 bp, Homo sapiens
agtaaaacagagaaatcactca

SEQ ID NO: 7490274 - DNA, 22 bp, Homo sapiens
agtaaaacagagaaatcactca

SEQ ID NO: 7490275 - DNA, 22 bp, Homo sapiens
agtaaaacagagaaatcactca

SEQ ID NO: 7490276 - DNA, 22 bp, Homo sapiens
agtaaaatcaccatctctttgt

SEQ ID NO: 7490277 - DNA, 22 bp, Homo sapiens
agtaaaatcaccatctctttgt

SEQ ID NO: 7490278 - DNA, 22 bp, Homo sapiens
agtaaaatcaccatctctttgt

SEQ ID NO: 7490279 - DNA, 22 bp, Homo sapiens
agtaaaatcaccatctctttgt

SEQ ID NO: 7490280 - DNA, 22 bp, Homo sapiens
agtaaaattaatggatcagaag

SEQ ID NO: 7490281 - DNA, 22 bp, Homo sapiens
agtaaaatcttaagcacagtgg

SEQ ID NO: 7490282 - DNA, 22 bp, Homo sapiens
agtaaaatcttaagcacagtgg

SEQ ID NO: 7490283 - DNA, 22 bp, Homo sapiens
agtaaaatcttaagcacagtgg

SEQ ID NO: 7490284 - DNA, 22 bp, Homo sapiens
agtaaaatcaccatctctttgt

SEQ ID NO: 7490285 - DNA, 22 bp, Homo sapiens
agtaaaatcaccatctctttgt

SEQ ID NO: 7490286 - DNA, 22 bp, Homo sapiens
agtcaaagatgaccgagttcct

SEQ ID NO: 7490287 - DNA, 22 bp, Homo sapiens
agtcaaagggtatttggattga

SEQ ID NO: 7490288 - DNA, 22 bp, Homo sapiens
agtcaaataagactgtcataag

SEQ ID NO: 7490289 - DNA, 22 bp, Homo sapiens
agtcaaagttgtccccagcacc

SEQ ID NO: 7490290 - DNA, 22 bp, Homo sapiens
agtcaaagatgaccgagttcct

SEQ ID NO: 7490291 - DNA, 22 bp, Homo sapiens
agtcaaagatgaccgagttcct

SEQ ID NO: 7490292 - DNA, 22 bp, Homo sapiens
agtcaaactgcctaggaagcag

SEQ ID NO: 7490293 - DNA, 22 bp, Homo sapiens
agtcaaactgcctaggaagcag

SEQ ID NO: 7490294 - DNA, 22 bp, Homo sapiens
agtcaaagaagatggttccaaa

SEQ ID NO: 7490295 - DNA, 22 bp, Homo sapiens
agtcaaagatgaccgagttcct

SEQ ID NO: 7490296 - DNA, 22 bp, Homo sapiens
agtattttcgccatcacaagaa

SEQ ID NO: 7490297 - DNA, 22 bp, Homo sapiens
agtattttcaaccatagcctgg

SEQ ID NO: 7490298 - DNA, 22 bp, Homo sapiens
agtattttcaaccatagcctgg

SEQ ID NO: 7490299 - DNA, 22 bp, Homo sapiens
agtattttcgccatcacaagaa

SEQ ID NO: 7490300 - DNA, 22 bp, Homo sapiens
agtattttcgccatcacaagaa

SEQ ID NO: 7490301 - DNA, 22 bp, Homo sapiens
agtattttcgccatcacaagaa

SEQ ID NO: 7490302 - DNA, 22 bp, Homo sapiens
agtattttcgccatcacaagaa

SEQ ID NO: 7490303 - DNA, 22 bp, Homo sapiens
agtattttcgccatcacaagaa

SEQ ID NO: 7490304 - DNA, 22 bp, Homo sapiens
agtattttcgccatcacaagaa

SEQ ID NO: 7490305 - DNA, 22 bp, Homo sapiens
agtatttgaagatgttgagtac

SEQ ID NO: 7490306 - DNA, 22 bp, Homo sapiens
agtatttgttgaatgagtgaat

SEQ ID NO: 7490307 - DNA, 22 bp, Homo sapiens
agtattttcaaccatagcctgg

SEQ ID NO: 7490308 - DNA, 22 bp, Homo sapiens
agtattttcaaccatagcctgg

SEQ ID NO: 7490309 - DNA, 22 bp, Homo sapiens
agtattttcaaccatagcctgg

SEQ ID NO: 7490310 - DNA, 22 bp, Homo sapiens
agtatttgttgaatgagtgaat

SEQ ID NO: 7490311 - DNA, 22 bp, Homo sapiens
agtatttgttgaatgagtgaat

SEQ ID NO: 7490312 - DNA, 22 bp, Homo sapiens
agtatttgtggatttgtattgg

SEQ ID NO: 7490313 - DNA, 22 bp, Homo sapiens
agtatttgcatgttagggacct

SEQ ID NO: 7490314 - DNA, 22 bp, Homo sapiens
agtatttgtggatttgtattgg

SEQ ID NO: 7490315 - DNA, 21 bp, Homo sapiens
actagctttctggagaagtgt

SEQ ID NO: 7490316 - DNA, 22 bp, Homo sapiens
actaggaaggcatatgggcaga

SEQ ID NO: 7490317 - DNA, 22 bp, Homo sapiens
actagcttgggcctgggtcaga

SEQ ID NO: 7490318 - DNA, 22 bp, Homo sapiens
actagctttacagcatgagtgg

SEQ ID NO: 7490319 - DNA, 21 bp, Homo sapiens
actagctttctggagaagtgt

SEQ ID NO: 7490320 - DNA, 22 bp, Homo sapiens
actaggaattcaagtagacaga

SEQ ID NO: 7490321 - DNA, 22 bp, Homo sapiens
actaggaagtggcaaaactgga

SEQ ID NO: 7490322 - DNA, 22 bp, Homo sapiens
actaggaattcaagtagacaga

SEQ ID NO: 7490323 - DNA, 22 bp, Homo sapiens
actaggaagtggcaaaactgga

SEQ ID NO: 7490324 - DNA, 22 bp, Homo sapiens
actagggaaagttatgttcaca

SEQ ID NO: 7490325 - DNA, 22 bp, Homo sapiens
actagggagatcaattgtgcag

SEQ ID NO: 7490326 - DNA, 22 bp, Homo sapiens
actagggaaagttatgttcaca

SEQ ID NO: 7490327 - DNA, 22 bp, Homo sapiens
actaggggctcaggcccaggga

SEQ ID NO: 7490328 - DNA, 22 bp, Homo sapiens
actaggggctcaggcccaggga

SEQ ID NO: 7490329 - DNA, 22 bp, Homo sapiens
actaggggctcaggcccaggga

SEQ ID NO: 7490330 - DNA, 22 bp, Homo sapiens
actagtctgccagggagaggca

SEQ ID NO: 7490331 - DNA, 22 bp, Homo sapiens
actagtctgcattacaaaatag

SEQ ID NO: 7490332 - DNA, 22 bp, Homo sapiens
actagtcatttaggtgatatta

SEQ ID NO: 7490333 - DNA, 22 bp, Homo sapiens
actagtattgcctactgtacat

SEQ ID NO: 7490334 - DNA, 22 bp, Homo sapiens
actagtattgcctactgtacat

SEQ ID NO: 7490335 - DNA, 22 bp, Homo sapiens
actaggggctcaggcccaggga

SEQ ID NO: 7490336 - DNA, 22 bp, Homo sapiens
actaggggctcaggcccaggga

SEQ ID NO: 7490337 - DNA, 22 bp, Homo sapiens
actaggggctcaggcccaggga

SEQ ID NO: 7490338 - DNA, 22 bp, Homo sapiens
actaggggctcaggcccaggga

SEQ ID NO: 7490339 - DNA, 22 bp, Homo sapiens
agtatacatatattagccttcg

SEQ ID NO: 7490340 - DNA, 22 bp, Homo sapiens
agtatactgaaagtaaatatga

SEQ ID NO: 7490341 - DNA, 22 bp, Homo sapiens
actagtgaagaagatttgactg

SEQ ID NO: 7490342 - DNA, 22 bp, Homo sapiens
agtatacatatattagccttcg

SEQ ID NO: 7490343 - DNA, 22 bp, Homo sapiens
agtatacatatattagccttcg

SEQ ID NO: 7490344 - DNA, 22 bp, Homo sapiens
agtataggtaggaggatggtat

SEQ ID NO: 7490345 - DNA, 22 bp, Homo sapiens
agtatttcttcatatgattact

SEQ ID NO: 7490346 - DNA, 22 bp, Homo sapiens
agtatactagtgcagcatgtat

SEQ ID NO: 7490347 - DNA, 22 bp, Homo sapiens
agtatactgaaagtaaatatga

SEQ ID NO: 7490348 - DNA, 22 bp, Homo sapiens
agtcaaataagactgtcataag

SEQ ID NO: 7490349 - DNA, 22 bp, Homo sapiens
agtcaaataagactgtcataag

SEQ ID NO: 7490350 - DNA, 22 bp, Homo sapiens
agtcaaataagagagagatgtt

SEQ ID NO: 7490351 - DNA, 22 bp, Homo sapiens
agtcaaatatcttaaaaggcta

SEQ ID NO: 7490352 - DNA, 22 bp, Homo sapiens
agtcaacaaaaatgtggagcct

SEQ ID NO: 7490353 - DNA, 22 bp, Homo sapiens
agtcaaatgagtaaatatataa

SEQ ID NO: 7490354 - DNA, 22 bp, Homo sapiens
agtcaaatgagtaaatatataa

SEQ ID NO: 7490355 - DNA, 22 bp, Homo sapiens
agtcaaatatcttaaaaggcta

SEQ ID NO: 7490356 - DNA, 22 bp, Homo sapiens
agtcaaatgagtaaatatataa

SEQ ID NO: 7490357 - DNA, 22 bp, Homo sapiens
agtcaacatttgagatgcaatg

SEQ ID NO: 7490358 - DNA, 22 bp, Homo sapiens
agtcaaccatttagaagagtgt

SEQ ID NO: 7490359 - DNA, 22 bp, Homo sapiens
agtcaaccatttagaagagtgt

SEQ ID NO: 7490360 - DNA, 22 bp, Homo sapiens
agtcaaccggtattagtctgtt

SEQ ID NO: 7490361 - DNA, 22 bp, Homo sapiens
agtcaacatttgagatgcaatg

SEQ ID NO: 7490362 - DNA, 22 bp, Homo sapiens
agtcaacagtttttgatgtaaa

SEQ ID NO: 7490363 - DNA, 22 bp, Homo sapiens
agtcaacacctggttctattac

SEQ ID NO: 7490364 - DNA, 22 bp, Homo sapiens
agtcaacacctggttctattac

SEQ ID NO: 7490365 - DNA, 22 bp, Homo sapiens
agtcaacacctggttctattac

SEQ ID NO: 7490366 - DNA, 22 bp, Homo sapiens
agtcaacacattaaacctaggg

SEQ ID NO: 7490367 - DNA, 23 bp, Homo sapiens
actcagctttgggagatgactca

SEQ ID NO: 7490368 - DNA, 23 bp, Homo sapiens
actcagctttgggagatgactca

SEQ ID NO: 7490369 - DNA, 22 bp, Homo sapiens
actcaggaaatgaagactggtt

SEQ ID NO: 7490370 - DNA, 22 bp, Homo sapiens
actcaggaaatgaagactggtt

SEQ ID NO: 7490371 - DNA, 22 bp, Homo sapiens
actcaggaaatgaagactggtt

SEQ ID NO: 7490372 - DNA, 22 bp, Homo sapiens
agtcaactgttttgctaatgat

SEQ ID NO: 7490373 - DNA, 22 bp, Homo sapiens
actcagcttcctacagctagaa

SEQ ID NO: 7490374 - DNA, 22 bp, Homo sapiens
actcagcttgcacacatcaatg

SEQ ID NO: 7490375 - DNA, 22 bp, Homo sapiens
actcagcttgcacacatcaatg

SEQ ID NO: 7490376 - DNA, 23 bp, Homo sapiens
actcagctttgggagatgactca

SEQ ID NO: 7490377 - DNA, 23 bp, Homo sapiens
actcagctttgggagatgactca

SEQ ID NO: 7490378 - DNA, 22 bp, Homo sapiens
actcaggaatggggctgggact

SEQ ID NO: 7490379 - DNA, 22 bp, Homo sapiens
actcaggaatggggctgggact

SEQ ID NO: 7490380 - DNA, 22 bp, Homo sapiens
actcaggaagaaagcagctggt

SEQ ID NO: 7490381 - DNA, 22 bp, Homo sapiens
actcaggaagaaagcagctggt

SEQ ID NO: 7490382 - DNA, 22 bp, Homo sapiens
actcaggaagaaagcagctggt

SEQ ID NO: 7490383 - DNA, 22 bp, Homo sapiens
actcaggaatggggctgggact

SEQ ID NO: 7490384 - DNA, 22 bp, Homo sapiens
actcaggaatggggctgggact

SEQ ID NO: 7490385 - DNA, 22 bp, Homo sapiens
actcaggaaattgagataatgg

SEQ ID NO: 7490386 - DNA, 22 bp, Homo sapiens
actcaggaaatgagaggctctc

SEQ ID NO: 7490387 - DNA, 22 bp, Homo sapiens
actcaggcctccttctgtcctt

SEQ ID NO: 7490388 - DNA, 22 bp, Homo sapiens
actcaggctacaacgcgtggct

SEQ ID NO: 7490389 - DNA, 22 bp, Homo sapiens
actcaggcctccttctgtcctt

SEQ ID NO: 7490390 - DNA, 22 bp, Homo sapiens
actcaggccccatcgcccatct

SEQ ID NO: 7490391 - DNA, 22 bp, Homo sapiens
actcaggctacaggggcagaag

SEQ ID NO: 7490392 - DNA, 22 bp, Homo sapiens
actcaggctacaacgcgtggct

SEQ ID NO: 7490393 - DNA, 22 bp, Homo sapiens
actcaggctagggaaaaagtgg

SEQ ID NO: 7490394 - DNA, 22 bp, Homo sapiens
actcaggctacaggggcagaag

SEQ ID NO: 7490395 - DNA, 22 bp, Homo sapiens
actcaggcactcagccctcgcc

SEQ ID NO: 7490396 - DNA, 21 bp, Homo sapiens
actcaggcaccaggggatggc

SEQ ID NO: 7490397 - DNA, 21 bp, Homo sapiens
actcaggcaccaggggatggc

SEQ ID NO: 7490398 - DNA, 19 bp, Homo sapiens
actcaggcaatgagaaaca

SEQ ID NO: 7490399 - DNA, 22 bp, Homo sapiens
actcaggagggatcagctatca

SEQ ID NO: 7490400 - DNA, 22 bp, Homo sapiens
actcaggagggatcagctatca

SEQ ID NO: 7490401 - DNA, 17 bp, Homo sapiens
actcaggatctgggagt

SEQ ID NO: 7490402 - DNA, 17 bp, Homo sapiens
actcaggatctgggagt

SEQ ID NO: 7490403 - DNA, 22 bp, Homo sapiens
actcaggcttcaggcacagctg

SEQ ID NO: 7490404 - DNA, 19 bp, Homo sapiens
actcaggcttcctctgagg

SEQ ID NO: 7490405 - DNA, 22 bp, Homo sapiens
actcaggcttcaggcacagctg

SEQ ID NO: 7490406 - DNA, 22 bp, Homo sapiens
actcaggctgttttttccttgt

SEQ ID NO: 7490407 - DNA, 22 bp, Homo sapiens
agtccaggcgggtatagaggct

SEQ ID NO: 7490408 - DNA, 22 bp, Homo sapiens
agtccaggcgggtatagaggct

SEQ ID NO: 7490409 - DNA, 22 bp, Homo sapiens
agtccaggcgggtatagaggct

SEQ ID NO: 7490410 - DNA, 22 bp, Homo sapiens
agtccaggcgggtatagaggct

SEQ ID NO: 7490411 - DNA, 22 bp, Homo sapiens
agtccaggcgggtatagaggct

SEQ ID NO: 7490412 - DNA, 22 bp, Homo sapiens
agtcccagctactcaagaggct

SEQ ID NO: 7490413 - DNA, 22 bp, Homo sapiens
agtcccagctcagaaccactag

SEQ ID NO: 7490414 - DNA, 22 bp, Homo sapiens
agtcccagctcagaaccactag

SEQ ID NO: 7490415 - DNA, 22 bp, Homo sapiens
agtccaggcgggtatagaggct

SEQ ID NO: 7490416 - DNA, 22 bp, Homo sapiens
agtcccagctcagaaccactag

SEQ ID NO: 7490417 - DNA, 22 bp, Homo sapiens
agtcccagctcagaaccactag

SEQ ID NO: 7490418 - DNA, 22 bp, Homo sapiens
agtcccagctctgccacttact

SEQ ID NO: 7490419 - DNA, 22 bp, Homo sapiens
agtcccagctctgccacttact

SEQ ID NO: 7490420 - DNA, 22 bp, Homo sapiens
agtcccagctctgccacttact

SEQ ID NO: 7490421 - DNA, 22 bp, Homo sapiens
agtcccagcttcccccatgcag

SEQ ID NO: 7490422 - DNA, 22 bp, Homo sapiens
agaggtcagaacaggaaagtgt

SEQ ID NO: 7490423 - DNA, 22 bp, Homo sapiens
agaggtcagaacaggaaagtgt

SEQ ID NO: 7490424 - DNA, 22 bp, Homo sapiens
agaggtcaatgggacttggatc

SEQ ID NO: 7490425 - DNA, 22 bp, Homo sapiens
agaggtcaatgggacttggatc

SEQ ID NO: 7490426 - DNA, 22 bp, Homo sapiens
agaggtcactccaccttcttct

SEQ ID NO: 7490427 - DNA, 22 bp, Homo sapiens
agaggtattgcacgtgctctct

SEQ ID NO: 7490428 - DNA, 22 bp, Homo sapiens
agaggtattagatttgcatagg

SEQ ID NO: 7490429 - DNA, 22 bp, Homo sapiens
agaggtattaggtaattcagta

SEQ ID NO: 7490430 - DNA, 22 bp, Homo sapiens
agaggtatgttcacttcccttt

SEQ ID NO: 7490431 - DNA, 22 bp, Homo sapiens
agaggtattagatttgcatagg

SEQ ID NO: 7490432 - DNA, 22 bp, Homo sapiens
attgctgactcaataattgaag

SEQ ID NO: 7490433 - DNA, 22 bp, Homo sapiens
attgctgacaccaagtagtagc

SEQ ID NO: 7490434 - DNA, 22 bp, Homo sapiens
attgctgactcaataattgaag

SEQ ID NO: 7490435 - DNA, 22 bp, Homo sapiens
attgctgaacttataaatgaat

SEQ ID NO: 7490436 - DNA, 22 bp, Homo sapiens
attgctgaacttataaatgaat

SEQ ID NO: 7490437 - DNA, 22 bp, Homo sapiens
attgctgaacttataaatgaat

SEQ ID NO: 7490438 - DNA, 22 bp, Homo sapiens
attgctgaataatattccactg

SEQ ID NO: 7490439 - DNA, 21 bp, Homo sapiens
agaggtcattgggctggttct

SEQ ID NO: 7490440 - DNA, 22 bp, Homo sapiens
agaggtctatgctaggggaact

SEQ ID NO: 7490441 - DNA, 21 bp, Homo sapiens
agaggtctaagattctagctt

SEQ ID NO: 7490442 - DNA, 22 bp, Homo sapiens
agaggtctcagttatgtttaaa

SEQ ID NO: 7490443 - DNA, 22 bp, Homo sapiens
agaggtctgagcaatctcaagc

SEQ ID NO: 7490444 - DNA, 22 bp, Homo sapiens
agaggtcagaggtcgccaggtc

SEQ ID NO: 7490445 - DNA, 22 bp, Homo sapiens
agaggtcagaggtcgccaggtc

SEQ ID NO: 7490446 - DNA, 22 bp, Homo sapiens
agaggtcagaggtcgccaggtc

SEQ ID NO: 7490447 - DNA, 22 bp, Homo sapiens
agaggtcagagcaggaaaggca

SEQ ID NO: 7490448 - DNA, 22 bp, Homo sapiens
agaggtcagagcaggaaaggca

SEQ ID NO: 7490449 - DNA, 22 bp, Homo sapiens
agaggtcagatttctcctggtg

SEQ ID NO: 7490450 - DNA, 22 bp, Homo sapiens
agaggtcatatctcagaagaga

SEQ ID NO: 7490451 - DNA, 22 bp, Homo sapiens
agaggtcatatctcagaagaga

SEQ ID NO: 7490452 - DNA, 22 bp, Homo sapiens
agaggtcatatctcagaagaga

SEQ ID NO: 7490453 - DNA, 22 bp, Homo sapiens
attgctcctgatgcatagagct

SEQ ID NO: 7490454 - DNA, 22 bp, Homo sapiens
attgctcctgatgcatagagct

SEQ ID NO: 7490455 - DNA, 22 bp, Homo sapiens
attgctctaatgtgggcagttt

SEQ ID NO: 7490456 - DNA, 22 bp, Homo sapiens
attgctctgcaatcctccccaa

SEQ ID NO: 7490457 - DNA, 17 bp, Homo sapiens
attgctctggggatttt

SEQ ID NO: 7490458 - DNA, 21 bp, Homo sapiens
attgctctgttgtgtctagaa

SEQ ID NO: 7490459 - DNA, 21 bp, Homo sapiens
attgctctgttgtgtctagaa

SEQ ID NO: 7490460 - DNA, 22 bp, Homo sapiens
attgctcttgcttagggaggca

SEQ ID NO: 7490461 - DNA, 22 bp, Homo sapiens
attgctgaaagtattttatgac

SEQ ID NO: 7490462 - DNA, 22 bp, Homo sapiens
attgctgaaatgaaaggatatg

SEQ ID NO: 7490463 - DNA, 22 bp, Homo sapiens
attgctgaaagtattttatgac

SEQ ID NO: 7490464 - DNA, 22 bp, Homo sapiens
attgctgaaatgaaaggatatg

SEQ ID NO: 7490465 - DNA, 22 bp, Homo sapiens
attgctcagcacaagcagcaga

SEQ ID NO: 7490466 - DNA, 22 bp, Homo sapiens
attgctcagcacaagcagcaga

SEQ ID NO: 7490467 - DNA, 22 bp, Homo sapiens
attgctcagcacaagcagcaga

SEQ ID NO: 7490468 - DNA, 22 bp, Homo sapiens
attgctcagcacaagcagcaga

SEQ ID NO: 7490469 - DNA, 22 bp, Homo sapiens
attgctaggaacaggttgcacc

SEQ ID NO: 7490470 - DNA, 19 bp, Homo sapiens
attgctcaccatggggctt

SEQ ID NO: 7490471 - DNA, 22 bp, Homo sapiens
attgctaggaacaggttgcacc

SEQ ID NO: 7490472 - DNA, 22 bp, Homo sapiens
attgctaggaacaggttgcacc

SEQ ID NO: 7490473 - DNA, 22 bp, Homo sapiens
attgctaggaacaggttgcacc

SEQ ID NO: 7490474 - DNA, 22 bp, Homo sapiens
attgctaggaacaggttgcacc

SEQ ID NO: 7490475 - DNA, 22 bp, Homo sapiens
attgctaggaacaggttgcacc

SEQ ID NO: 7490476 - DNA, 22 bp, Homo sapiens
attgctaatgtgcgaatgtgta

SEQ ID NO: 7490477 - DNA, 22 bp, Homo sapiens
attgcatttgtcattgttgagg

SEQ ID NO: 7490478 - DNA, 23 bp, Homo sapiens
attgccagacggcccctgctcgc

SEQ ID NO: 7490479 - DNA, 22 bp, Homo sapiens
attgccaggagggttgagaata

SEQ ID NO: 7490480 - DNA, 22 bp, Homo sapiens
attgccaggagggttgagaata

SEQ ID NO: 7490481 - DNA, 22 bp, Homo sapiens
attgcattgtattgtaaatgtt

SEQ ID NO: 7490482 - DNA, 22 bp, Homo sapiens
attgcattcattgacatatgag

SEQ ID NO: 7490483 - DNA, 22 bp, Homo sapiens
attgcctttggaggaagaaagc

SEQ ID NO: 7490484 - DNA, 22 bp, Homo sapiens
attgcctttggaggaagaaagc

SEQ ID NO: 7490485 - DNA, 22 bp, Homo sapiens
attgcctttggaggaagaaagc

SEQ ID NO: 7490486 - DNA, 22 bp, Homo sapiens
attgccttgtcagatttctttt

SEQ ID NO: 7490487 - DNA, 22 bp, Homo sapiens
attgcccttgcccattgagagt

SEQ ID NO: 7490488 - DNA, 22 bp, Homo sapiens
attgcccttgcccattgagagt

SEQ ID NO: 7490489 - DNA, 22 bp, Homo sapiens
attgcccttgtcaggcacgggt

SEQ ID NO: 7490490 - DNA, 22 bp, Homo sapiens
attgcctgccactctgtgagga

SEQ ID NO: 7490491 - DNA, 22 bp, Homo sapiens
attgcctgccactctgtgagga

SEQ ID NO: 7490492 - DNA, 22 bp, Homo sapiens
attgcctgccactctgtgagga

SEQ ID NO: 7490493 - DNA, 23 bp, Homo sapiens
attgccaggatgctgaagcttac

SEQ ID NO: 7490494 - DNA, 22 bp, Homo sapiens
attgccaggatgtggtttgtag

SEQ ID NO: 7490495 - DNA, 22 bp, Homo sapiens
attgccatgctcatagggtcga

SEQ ID NO: 7490496 - DNA, 22 bp, Homo sapiens
attgcccaataataaaatggta

SEQ ID NO: 7490497 - DNA, 22 bp, Homo sapiens
attgccctagggctaagcagga

SEQ ID NO: 7490498 - DNA, 22 bp, Homo sapiens
attgccctagggctaagcagga

SEQ ID NO: 7490499 - DNA, 22 bp, Homo sapiens
attgccctctggctgacaggct

SEQ ID NO: 7490500 - DNA, 22 bp, Homo sapiens
attgccctctggctgacaggct

SEQ ID NO: 7490501 - DNA, 22 bp, Homo sapiens
agagttgctatagaaggatgga

SEQ ID NO: 7490502 - DNA, 22 bp, Homo sapiens
agagttgcttatgtcaggtgag

SEQ ID NO: 7490503 - DNA, 22 bp, Homo sapiens
agagttggcccacgtgtaggcg

SEQ ID NO: 7490504 - DNA, 19 bp, Homo sapiens
agagttgggcactgtttca

SEQ ID NO: 7490505 - DNA, 22 bp, Homo sapiens
agagttgttgtacaaactaaat

SEQ ID NO: 7490506 - DNA, 22 bp, Homo sapiens
agagttggccaaaaggggcatt

SEQ ID NO: 7490507 - DNA, 22 bp, Homo sapiens
agagttggagaaattaaaattt

SEQ ID NO: 7490508 - DNA, 22 bp, Homo sapiens
agagttgctccattagaactta

SEQ ID NO: 7490509 - DNA, 22 bp, Homo sapiens
agagttggagaaattaaaattt

SEQ ID NO: 7490510 - DNA, 19 bp, Homo sapiens
agagtttaggtctatcagg

SEQ ID NO: 7490511 - DNA, 22 bp, Homo sapiens
agagtttcttgtgagcactgac

SEQ ID NO: 7490512 - DNA, 19 bp, Homo sapiens
agagtttaggtctatcagg

SEQ ID NO: 7490513 - DNA, 22 bp, Homo sapiens
agagtttagggctgagagcttg

SEQ ID NO: 7490514 - DNA, 19 bp, Homo sapiens
agagtttaggtctatcagg

SEQ ID NO: 7490515 - DNA, 22 bp, Homo sapiens
agagtttaggggacacagaata

SEQ ID NO: 7490516 - DNA, 22 bp, Homo sapiens
agagttgttgtacaaactaaat

SEQ ID NO: 7490517 - DNA, 22 bp, Homo sapiens
agagtttaaacactgtcacaga

SEQ ID NO: 7490518 - DNA, 22 bp, Homo sapiens
agagtttacagaaataagctgt

SEQ ID NO: 7490519 - DNA, 22 bp, Homo sapiens
agagtttaccactatttttggt

SEQ ID NO: 7490520 - DNA, 22 bp, Homo sapiens
agagtttagggctgagagcttg

SEQ ID NO: 7490521 - DNA, 22 bp, Homo sapiens
agagtttaccactatttttggt

SEQ ID NO: 7490522 - DNA, 22 bp, Homo sapiens
agaggtgacataggagaggctc

SEQ ID NO: 7490523 - DNA, 22 bp, Homo sapiens
agaggtgacataggagaggctc

SEQ ID NO: 7490524 - DNA, 22 bp, Homo sapiens
agaggtgacataggagaggctc

SEQ ID NO: 7490525 - DNA, 22 bp, Homo sapiens
agaggtgacataggagaggctc

SEQ ID NO: 7490526 - DNA, 22 bp, Homo sapiens
agaggtgaaagaatttggctct

SEQ ID NO: 7490527 - DNA, 22 bp, Homo sapiens
agaggtgaaagaatttggctct

SEQ ID NO: 7490528 - DNA, 22 bp, Homo sapiens
agagtgggtgatctctgttgtc

SEQ ID NO: 7490529 - DNA, 22 bp, Homo sapiens
agagtgggtgatctctgttgtc

SEQ ID NO: 7490530 - DNA, 22 bp, Homo sapiens
agagtggggacagggcctgtcc

SEQ ID NO: 7490531 - DNA, 22 bp, Homo sapiens
agagtgggtgatctctgttgtc

SEQ ID NO: 7490532 - DNA, 22 bp, Homo sapiens
agaggtgaaagaatttggctct

SEQ ID NO: 7490533 - DNA, 22 bp, Homo sapiens
agaggtcttttggtctgcagaa

SEQ ID NO: 7490534 - DNA, 22 bp, Homo sapiens
agaggtcttttggtctgcagaa

SEQ ID NO: 7490535 - DNA, 22 bp, Homo sapiens
agaggtcttttggtctgcagaa

SEQ ID NO: 7490536 - DNA, 22 bp, Homo sapiens
agaggtctgactcagcagatta

SEQ ID NO: 7490537 - DNA, 22 bp, Homo sapiens
agaggtcttaagatctagactg

SEQ ID NO: 7490538 - DNA, 22 bp, Homo sapiens
agaggtcttaagatctagactg

SEQ ID NO: 7490539 - DNA, 20 bp, Homo sapiens
agagtgggtgtcacaggctg

SEQ ID NO: 7490540 - DNA, 22 bp, Homo sapiens
agagttctgaaattatctttac

SEQ ID NO: 7490541 - DNA, 22 bp, Homo sapiens
agagttctgaaattatctttac

SEQ ID NO: 7490542 - DNA, 22 bp, Homo sapiens
agagttctgaaattatctttac

SEQ ID NO: 7490543 - DNA, 20 bp, Homo sapiens
agagtgggtgtcacaggctg

SEQ ID NO: 7490544 - DNA, 22 bp, Homo sapiens
agagttctgaattttattctct

SEQ ID NO: 7490545 - DNA, 22 bp, Homo sapiens
agagttctgaattttattctct

SEQ ID NO: 7490546 - DNA, 22 bp, Homo sapiens
agagttctgctcttctcagtga

SEQ ID NO: 7490547 - DNA, 21 bp, Homo sapiens
agagttcttgctgagcaagcc

SEQ ID NO: 7490548 - DNA, 21 bp, Homo sapiens
agagttcttgctgagcaagcc

SEQ ID NO: 7490549 - DNA, 21 bp, Homo sapiens
agagttcttgctgagcaagcc

SEQ ID NO: 7490550 - DNA, 21 bp, Homo sapiens
agagttcttgctgagcaagcc

SEQ ID NO: 7490551 - DNA, 22 bp, Homo sapiens
agagttctgctcttctcagtga

SEQ ID NO: 7490552 - DNA, 22 bp, Homo sapiens
agagttcttgccctagaaaatg

SEQ ID NO: 7490553 - DNA, 22 bp, Homo sapiens
agagttctgtctgccacacgaa

SEQ ID NO: 7490554 - DNA, 22 bp, Homo sapiens
agagttctgctcttctcagtga

SEQ ID NO: 7490555 - DNA, 22 bp, Homo sapiens
agagttctgtctgccacacgaa

SEQ ID NO: 7490556 - DNA, 22 bp, Homo sapiens
agagtttttcatttacccgttg

SEQ ID NO: 7490557 - DNA, 23 bp, Homo sapiens
agagttttctgttttctgtaggg

SEQ ID NO: 7490558 - DNA, 22 bp, Homo sapiens
agagtttttcatttacccgttg

SEQ ID NO: 7490559 - DNA, 22 bp, Homo sapiens
agataaaatgattttctggatc

SEQ ID NO: 7490560 - DNA, 22 bp, Homo sapiens
agataaaatgattttctggatc

SEQ ID NO: 7490561 - DNA, 22 bp, Homo sapiens
agagttttatggctttaattct

SEQ ID NO: 7490562 - DNA, 22 bp, Homo sapiens
agataaaatgattttctggatc

SEQ ID NO: 7490563 - DNA, 22 bp, Homo sapiens
agataaaatggttcaaaggcta

SEQ ID NO: 7490564 - DNA, 22 bp, Homo sapiens
agataaaatggttcaaaggcta

SEQ ID NO: 7490565 - DNA, 22 bp, Homo sapiens
agataaaatgattttctggatc

SEQ ID NO: 7490566 - DNA, 17 bp, Homo sapiens
agagttttaagaaattt

SEQ ID NO: 7490567 - DNA, 17 bp, Homo sapiens
agagttttaagaaattt

SEQ ID NO: 7490568 - DNA, 17 bp, Homo sapiens
agagttttaagaaattt

SEQ ID NO: 7490569 - DNA, 17 bp, Homo sapiens
agagttttaagaaattt

SEQ ID NO: 7490570 - DNA, 17 bp, Homo sapiens
agagttttaagaaattt

SEQ ID NO: 7490571 - DNA, 22 bp, Homo sapiens
agagtttgtgtcctttatcagg

SEQ ID NO: 7490572 - DNA, 22 bp, Homo sapiens
agagtttgtgggcttttcctcc

SEQ ID NO: 7490573 - DNA, 22 bp, Homo sapiens
agagtttgttgaatttacttgg

SEQ ID NO: 7490574 - DNA, 22 bp, Homo sapiens
agagtttgtactttaccctgag

SEQ ID NO: 7490575 - DNA, 22 bp, Homo sapiens
agagtttggtgaagcaatttga

SEQ ID NO: 7490576 - DNA, 22 bp, Homo sapiens
agagtttgtatttttcagtgaa

SEQ ID NO: 7490577 - DNA, 22 bp, Homo sapiens
agagtttgtagtggtgaatgta

SEQ ID NO: 7490578 - DNA, 22 bp, Homo sapiens
agagtttgtatttttcagtgaa

SEQ ID NO: 7490579 - DNA, 22 bp, Homo sapiens
agagtttgaagttatctttgac

SEQ ID NO: 7490580 - DNA, 20 bp, Homo sapiens
agagtttggggtcattttgg

SEQ ID NO: 7490581 - DNA, 22 bp, Homo sapiens
atttattgaagcttattacgtt

SEQ ID NO: 7490582 - DNA, 22 bp, Homo sapiens
atttattgaagcttattacgtt

SEQ ID NO: 7490583 - DNA, 22 bp, Homo sapiens
atttattgaagcttattacgtt

SEQ ID NO: 7490584 - DNA, 22 bp, Homo sapiens
agataaattcctaagatttcag

SEQ ID NO: 7490585 - DNA, 22 bp, Homo sapiens
agataaattcctaagatttcag

SEQ ID NO: 7490586 - DNA, 22 bp, Homo sapiens
agataaattcctaagatttcag

SEQ ID NO: 7490587 - DNA, 22 bp, Homo sapiens
agataaattcctaagatttcag

SEQ ID NO: 7490588 - DNA, 22 bp, Homo sapiens
atttattgaagcttattacgtt

SEQ ID NO: 7490589 - DNA, 22 bp, Homo sapiens
agataaaatggttcaaaggcta

SEQ ID NO: 7490590 - DNA, 22 bp, Homo sapiens
agataaaatggttcaaaggcta

SEQ ID NO: 7490591 - DNA, 22 bp, Homo sapiens
agataaaatggttcaaaggcta

SEQ ID NO: 7490592 - DNA, 22 bp, Homo sapiens
agataaacccaacttaatgaag

SEQ ID NO: 7490593 - DNA, 22 bp, Homo sapiens
agataaacccaacttaatgaag

SEQ ID NO: 7490594 - DNA, 22 bp, Homo sapiens
agataaattcctaagatttcag

SEQ ID NO: 7490595 - DNA, 22 bp, Homo sapiens
agataaattcctaagatttcag

SEQ ID NO: 7490596 - DNA, 22 bp, Homo sapiens
agataaacccaacttaatgaag

SEQ ID NO: 7490597 - DNA, 22 bp, Homo sapiens
agagttttatggctttaattct

SEQ ID NO: 7490598 - DNA, 22 bp, Homo sapiens
agataaagtccaaactgtgtag

SEQ ID NO: 7490599 - DNA, 22 bp, Homo sapiens
agataaagtccaaactgtgtag

SEQ ID NO: 7490600 - DNA, 22 bp, Homo sapiens
atttcacaaagaacagatgcag

SEQ ID NO: 7490601 - DNA, 21 bp, Homo sapiens
atttcacaccctcctttttct

SEQ ID NO: 7490602 - DNA, 21 bp, Homo sapiens
atttcacaccctcctttttct

SEQ ID NO: 7490603 - DNA, 21 bp, Homo sapiens
atttcacaccctcctttttct

SEQ ID NO: 7490604 - DNA, 22 bp, Homo sapiens
atttcacaaagaacagatgcag

SEQ ID NO: 7490605 - DNA, 22 bp, Homo sapiens
atttcacaaagaacagatgcag

SEQ ID NO: 7490606 - DNA, 22 bp, Homo sapiens
atttcacaaagaacagatgcag

SEQ ID NO: 7490607 - DNA, 22 bp, Homo sapiens
atttcacaaaccatcctgattt

SEQ ID NO: 7490608 - DNA, 22 bp, Homo sapiens
atttcacagcgtggttgactgc

SEQ ID NO: 7490609 - DNA, 22 bp, Homo sapiens
atttcacagcgtggttgactgc

SEQ ID NO: 7490610 - DNA, 22 bp, Homo sapiens
atttcacagcgtggttgactgc

SEQ ID NO: 7490611 - DNA, 22 bp, Homo sapiens
atttcacagcgtggttgactgc

SEQ ID NO: 7490612 - DNA, 22 bp, Homo sapiens
atttcacagctgctgttcaggt

SEQ ID NO: 7490613 - DNA, 22 bp, Homo sapiens
atttcacagctgctgttcaggt

SEQ ID NO: 7490614 - DNA, 22 bp, Homo sapiens
atttcacagctgctgttcaggt

SEQ ID NO: 7490615 - DNA, 22 bp, Homo sapiens
atttcacagctgctgttcaggt

SEQ ID NO: 7490616 - DNA, 22 bp, Homo sapiens
atttcacagctgtcagtgttac

SEQ ID NO: 7490617 - DNA, 22 bp, Homo sapiens
atttcacagctgtcagtgttac

SEQ ID NO: 7490618 - DNA, 22 bp, Homo sapiens
atttcacagctgtcagtgttac

SEQ ID NO: 7490619 - DNA, 22 bp, Homo sapiens
atttcacagctgtcagtgttac

SEQ ID NO: 7490620 - DNA, 22 bp, Homo sapiens
atttcacaggccagtggtgggg

SEQ ID NO: 7490621 - DNA, 22 bp, Homo sapiens
atttcacagctgtcagtgttac

SEQ ID NO: 7490622 - DNA, 22 bp, Homo sapiens
atttcacagctgtcagtgttac

SEQ ID NO: 7490623 - DNA, 22 bp, Homo sapiens
atttcacatctatctcagattt

SEQ ID NO: 7490624 - DNA, 22 bp, Homo sapiens
atttcacatctatctcagattt

SEQ ID NO: 7490625 - DNA, 22 bp, Homo sapiens
atttcacatctatctcagattt

SEQ ID NO: 7490626 - DNA, 22 bp, Homo sapiens
atttcacatctatctcagattt

SEQ ID NO: 7490627 - DNA, 22 bp, Homo sapiens
atttcacattaatttgatgctc

SEQ ID NO: 7490628 - DNA, 22 bp, Homo sapiens
atttcacattaatttgatgctc

SEQ ID NO: 7490629 - DNA, 22 bp, Homo sapiens
atttcacattaatttgatgctc

SEQ ID NO: 7490630 - DNA, 22 bp, Homo sapiens
atttcacattaatttgatgctc

SEQ ID NO: 7490631 - DNA, 22 bp, Homo sapiens
atttcacatctatctcagattt

SEQ ID NO: 7490632 - DNA, 22 bp, Homo sapiens
atttcactgcttgagctgcagc

SEQ ID NO: 7490633 - DNA, 22 bp, Homo sapiens
atttcactcttaattgcttcct

SEQ ID NO: 7490634 - DNA, 22 bp, Homo sapiens
atttcactctccctgccactta

SEQ ID NO: 7490635 - DNA, 17 bp, Homo sapiens
atttcacttagcatgag

SEQ ID NO: 7490636 - DNA, 22 bp, Homo sapiens
atttcactgcttgagctgcagc

SEQ ID NO: 7490637 - DNA, 22 bp, Homo sapiens
atttcactctccctgccactta

SEQ ID NO: 7490638 - DNA, 22 bp, Homo sapiens
atttcactctccctgccactta

SEQ ID NO: 7490639 - DNA, 22 bp, Homo sapiens
atttcactcattcatgttactt

SEQ ID NO: 7490640 - DNA, 22 bp, Homo sapiens
atttcactcattcatgttactt

SEQ ID NO: 7490641 - DNA, 17 bp, Homo sapiens
atttcacttagcatgag

SEQ ID NO: 7490642 - DNA, 17 bp, Homo sapiens
atttcacttagcatgag

SEQ ID NO: 7490643 - DNA, 22 bp, Homo sapiens
atttcacttagtgtaatgtctt

SEQ ID NO: 7490644 - DNA, 22 bp, Homo sapiens
atttcacttagtgtaatgtctt

SEQ ID NO: 7490645 - DNA, 22 bp, Homo sapiens
atttcacttagtgtaatgtctt

SEQ ID NO: 7490646 - DNA, 22 bp, Homo sapiens
atttcacttagtgtaatgtctt

SEQ ID NO: 7490647 - DNA, 21 bp, Homo sapiens
atttcagaaatattggtggga

SEQ ID NO: 7490648 - DNA, 20 bp, Homo sapiens
agatacagtggtttctttag

SEQ ID NO: 7490649 - DNA, 20 bp, Homo sapiens
agatacagtggtttctttag

SEQ ID NO: 7490650 - DNA, 22 bp, Homo sapiens
agatacagtgttacatttttat

SEQ ID NO: 7490651 - DNA, 20 bp, Homo sapiens
agatacagtttaattactct

SEQ ID NO: 7490652 - DNA, 22 bp, Homo sapiens
agatacatagctgtgagcacac

SEQ ID NO: 7490653 - DNA, 22 bp, Homo sapiens
agatacatagctgtgagcacac

SEQ ID NO: 7490654 - DNA, 22 bp, Homo sapiens
agatacatagctgtgagcacac

SEQ ID NO: 7490655 - DNA, 22 bp, Homo sapiens
agatacatagctgtgagcacac

SEQ ID NO: 7490656 - DNA, 22 bp, Homo sapiens
agatacatatagaaaacatcaa

SEQ ID NO: 7490657 - DNA, 22 bp, Homo sapiens
agatacatatagaaaacatcaa

SEQ ID NO: 7490658 - DNA, 22 bp, Homo sapiens
agatacatatagaaaacatcaa

SEQ ID NO: 7490659 - DNA, 22 bp, Homo sapiens
agatacatagctgtgagcacac

SEQ ID NO: 7490660 - DNA, 22 bp, Homo sapiens
agatacatcatttataccttca

SEQ ID NO: 7490661 - DNA, 22 bp, Homo sapiens
agatacatatagaaaacatcaa

SEQ ID NO: 7490662 - DNA, 22 bp, Homo sapiens
agatacatatagaaaacatcaa

SEQ ID NO: 7490663 - DNA, 22 bp, Homo sapiens
agatacatggaacgtcaaacct

SEQ ID NO: 7490664 - DNA, 22 bp, Homo sapiens
agatacatcttgaacttctaga

SEQ ID NO: 7490665 - DNA, 22 bp, Homo sapiens
agatacatcttgaacttctaga

SEQ ID NO: 7490666 - DNA, 22 bp, Homo sapiens
agatacatcttgaacttctaga

SEQ ID NO: 7490667 - DNA, 22 bp, Homo sapiens
agatacatcatttataccttca

SEQ ID NO: 7490668 - DNA, 22 bp, Homo sapiens
agatacatcttgaacttctaga

SEQ ID NO: 7490669 - DNA, 22 bp, Homo sapiens
agatacatcatttataccttca

SEQ ID NO: 7490670 - DNA, 22 bp, Homo sapiens
agatacattgttctaagcattg

SEQ ID NO: 7490671 - DNA, 22 bp, Homo sapiens
agatacattgttctaagcattg

SEQ ID NO: 7490672 - DNA, 22 bp, Homo sapiens
agatacattgttctaagcattg

SEQ ID NO: 7490673 - DNA, 22 bp, Homo sapiens
agatacattgcacgatgcagat

SEQ ID NO: 7490674 - DNA, 22 bp, Homo sapiens
agatacattgagtttcctcctg

SEQ ID NO: 7490675 - DNA, 22 bp, Homo sapiens
agatacattgagtttcctcctg

SEQ ID NO: 7490676 - DNA, 22 bp, Homo sapiens
agatacatgtcaagagacttat

SEQ ID NO: 7490677 - DNA, 22 bp, Homo sapiens
agatacatgtcaagagacttat

SEQ ID NO: 7490678 - DNA, 22 bp, Homo sapiens
agatacatggaacgtcaaacct

SEQ ID NO: 7490679 - DNA, 22 bp, Homo sapiens
agatacatggaacgtcaaacct

SEQ ID NO: 7490680 - DNA, 22 bp, Homo sapiens
agatacatgtcaagagacttat

SEQ ID NO: 7490681 - DNA, 22 bp, Homo sapiens
agatacattagtagttacttgt

SEQ ID NO: 7490682 - DNA, 22 bp, Homo sapiens
agatacattagtagttacttgt

SEQ ID NO: 7490683 - DNA, 22 bp, Homo sapiens
atttgtgataatttgttacagc

SEQ ID NO: 7490684 - DNA, 22 bp, Homo sapiens
atttgtgataatttgttacagc

SEQ ID NO: 7490685 - DNA, 22 bp, Homo sapiens
atttgtgatcgtgcgtgatgaa

SEQ ID NO: 7490686 - DNA, 22 bp, Homo sapiens
atttgtgcatatcccatccacc

SEQ ID NO: 7490687 - DNA, 22 bp, Homo sapiens
atttgtggctcagagtagggta

SEQ ID NO: 7490688 - DNA, 22 bp, Homo sapiens
atttgtgggactataatgcagg

SEQ ID NO: 7490689 - DNA, 22 bp, Homo sapiens
atttgtgggactataatgcagg

SEQ ID NO: 7490690 - DNA, 22 bp, Homo sapiens
atttgtgggactataatgcagg

SEQ ID NO: 7490691 - DNA, 22 bp, Homo sapiens
atttgtgggactataatgcagg

SEQ ID NO: 7490692 - DNA, 22 bp, Homo sapiens
atttgtgggactataatgcagg

SEQ ID NO: 7490693 - DNA, 22 bp, Homo sapiens
atttggctgtagtaactggatc

SEQ ID NO: 7490694 - DNA, 22 bp, Homo sapiens
atttggctgggtgttagaaaga

SEQ ID NO: 7490695 - DNA, 22 bp, Homo sapiens
atttgtgaattaagcatgtcaa

SEQ ID NO: 7490696 - DNA, 22 bp, Homo sapiens
atttgtgataatttgttacagc

SEQ ID NO: 7490697 - DNA, 22 bp, Homo sapiens
atttgtgataatttgttacagc

SEQ ID NO: 7490698 - DNA, 15 bp, Homo sapiens
atttggcatggcctc

SEQ ID NO: 7490699 - DNA, 22 bp, Homo sapiens
atttggctagcttatggttata

SEQ ID NO: 7490700 - DNA, 22 bp, Homo sapiens
atttggctattgaattattcct

SEQ ID NO: 7490701 - DNA, 22 bp, Homo sapiens
atttggctagcttatggttata

SEQ ID NO: 7490702 - DNA, 22 bp, Homo sapiens
atttggctgggtgttagaaaga

SEQ ID NO: 7490703 - DNA, 22 bp, Homo sapiens
atttgttccacacatatttact

SEQ ID NO: 7490704 - DNA, 22 bp, Homo sapiens
atttgttcatgggttgttatgc

SEQ ID NO: 7490705 - DNA, 22 bp, Homo sapiens
atttgttcatgggttgttatgc

SEQ ID NO: 7490706 - DNA, 22 bp, Homo sapiens
atttgttcatgggttgttatgc

SEQ ID NO: 7490707 - DNA, 22 bp, Homo sapiens
atttgttccacacatatttact

SEQ ID NO: 7490708 - DNA, 22 bp, Homo sapiens
atttgttccatgagtaaggcta

SEQ ID NO: 7490709 - DNA, 22 bp, Homo sapiens
atttgttctcataaagaatgaa

SEQ ID NO: 7490710 - DNA, 22 bp, Homo sapiens
atttgttctcataaagaatgaa

SEQ ID NO: 7490711 - DNA, 22 bp, Homo sapiens
atttgttctcataaagaatgaa

SEQ ID NO: 7490712 - DNA, 22 bp, Homo sapiens
atttgttccatgagtaaggcta

SEQ ID NO: 7490713 - DNA, 22 bp, Homo sapiens
atttgttcttcatgatcctgtc

SEQ ID NO: 7490714 - DNA, 22 bp, Homo sapiens
atttgttaattatgaggcatac

SEQ ID NO: 7490715 - DNA, 22 bp, Homo sapiens
atttgttaattatgaggcatac

SEQ ID NO: 7490716 - DNA, 22 bp, Homo sapiens
atttgttaattatgaggcatac

SEQ ID NO: 7490717 - DNA, 22 bp, Homo sapiens
atttgttcacaatcagggcagg

SEQ ID NO: 7490718 - DNA, 22 bp, Homo sapiens
atttgttcacaatcagggcagg

SEQ ID NO: 7490719 - DNA, 22 bp, Homo sapiens
atttgttcatgggttgttatgc

SEQ ID NO: 7490720 - DNA, 22 bp, Homo sapiens
atttgttcagcattgaatttgg

SEQ ID NO: 7490721 - DNA, 22 bp, Homo sapiens
atttgttcagcattgaatttgg

SEQ ID NO: 7490722 - DNA, 22 bp, Homo sapiens
atttgttcagcattgaatttgg

SEQ ID NO: 7490723 - DNA, 22 bp, Homo sapiens
atttgttcagcattgaatttgg

SEQ ID NO: 7490724 - DNA, 22 bp, Homo sapiens
atttggcatagagtatcattct

SEQ ID NO: 7490725 - DNA, 22 bp, Homo sapiens
atttggcagtgaagggatcaca

SEQ ID NO: 7490726 - DNA, 22 bp, Homo sapiens
atttggcagtataaattctggc

SEQ ID NO: 7490727 - DNA, 22 bp, Homo sapiens
atttggcagtgaagggatcaca

SEQ ID NO: 7490728 - DNA, 18 bp, Homo sapiens
atttggcagatgatgaac

SEQ ID NO: 7490729 - DNA, 18 bp, Homo sapiens
atttggcagatgatgaac

SEQ ID NO: 7490730 - DNA, 22 bp, Homo sapiens
atttggcagccacagcaatctt

SEQ ID NO: 7490731 - DNA, 22 bp, Homo sapiens
atttggcagccacagcaatctt

SEQ ID NO: 7490732 - DNA, 20 bp, Homo sapiens
atttggcatagtttaagcaa

SEQ ID NO: 7490733 - DNA, 20 bp, Homo sapiens
atttggcatgaagtattgat

SEQ ID NO: 7490734 - DNA, 20 bp, Homo sapiens
atttggcatgaagtattgat

SEQ ID NO: 7490735 - DNA, 22 bp, Homo sapiens
atttggcataggcagaggccca

SEQ ID NO: 7490736 - DNA, 20 bp, Homo sapiens
atttggcatagtttaagcaa

SEQ ID NO: 7490737 - DNA, 20 bp, Homo sapiens
atttggcatagtttaagcaa

SEQ ID NO: 7490738 - DNA, 22 bp, Homo sapiens
atttggcatagagtatcattct

SEQ ID NO: 7490739 - DNA, 22 bp, Homo sapiens
atttggcatagagtatcattct

SEQ ID NO: 7490740 - DNA, 22 bp, Homo sapiens
atttggcaacattaattgaatc

SEQ ID NO: 7490741 - DNA, 22 bp, Homo sapiens
atttggcaacattaattgaatc

SEQ ID NO: 7490742 - DNA, 22 bp, Homo sapiens
atttggcaacattaattgaatc

SEQ ID NO: 7490743 - DNA, 22 bp, Homo sapiens
atttggcaatgctagagaagtt

SEQ ID NO: 7490744 - DNA, 22 bp, Homo sapiens
atttggcaatgctagagaagtt

SEQ ID NO: 7490745 - DNA, 22 bp, Homo sapiens
atttggcacagcttttcctacc

SEQ ID NO: 7490746 - DNA, 22 bp, Homo sapiens
atttggcacactgggttctcgt

SEQ ID NO: 7490747 - DNA, 22 bp, Homo sapiens
atttggcaaataatttgagggt

SEQ ID NO: 7490748 - DNA, 21 bp, Homo sapiens
atttggcaaaggcgatgcaca

SEQ ID NO: 7490749 - DNA, 22 bp, Homo sapiens
atttggcaaaaattagcagtag

SEQ ID NO: 7490750 - DNA, 22 bp, Homo sapiens
atttggcaaaagttagaagaaa

SEQ ID NO: 7490751 - DNA, 22 bp, Homo sapiens
atttggcaaaaattagcagtag

SEQ ID NO: 7490752 - DNA, 21 bp, Homo sapiens
caaaaggataggaaattaggg

SEQ ID NO: 7490753 - DNA, 22 bp, Homo sapiens
caaaaggcaggggaaagagtgc

SEQ ID NO: 7490754 - DNA, 22 bp, Homo sapiens
caaaaggcaggggaaagagtgc

SEQ ID NO: 7490755 - DNA, 22 bp, Homo sapiens
caaaaggccagtactttgtttg

SEQ ID NO: 7490756 - DNA, 22 bp, Homo sapiens
caaaaggccagtactttgtttg

SEQ ID NO: 7490757 - DNA, 22 bp, Homo sapiens
caaaagggagttctctggaagg

SEQ ID NO: 7490758 - DNA, 22 bp, Homo sapiens
caaaagggagttctctggaagg

SEQ ID NO: 7490759 - DNA, 22 bp, Homo sapiens
caaaagtaatcgtggcttttgc

SEQ ID NO: 7490760 - DNA, 22 bp, Homo sapiens
caaaagtaatcgtggcttttgc

SEQ ID NO: 7490761 - DNA, 22 bp, Homo sapiens
caaaagggagttctctggaagg

SEQ ID NO: 7490762 - DNA, 22 bp, Homo sapiens
caaaagtaatgtatgctcatcg

SEQ ID NO: 7490763 - DNA, 22 bp, Homo sapiens
caaaagtaatgtatgctcatcg

SEQ ID NO: 7490764 - DNA, 22 bp, Homo sapiens
caaaagtaatggcggtttttac

SEQ ID NO: 7490765 - DNA, 22 bp, Homo sapiens
caaaagtaatggcggtttttac

SEQ ID NO: 7490766 - DNA, 22 bp, Homo sapiens
caaaagtaatggcggtttttac

SEQ ID NO: 7490767 - DNA, 22 bp, Homo sapiens
caaaagtaattgcagtttttgc

SEQ ID NO: 7490768 - DNA, 22 bp, Homo sapiens
caaaagtaattgcagtttttgc

SEQ ID NO: 7490769 - DNA, 22 bp, Homo sapiens
caaaagtaattatggtttttgc

SEQ ID NO: 7490770 - DNA, 22 bp, Homo sapiens
caaaagtaattatggtttttgc

SEQ ID NO: 7490771 - DNA, 22 bp, Homo sapiens
caaaagtaattatggtttttgc

SEQ ID NO: 7490772 - DNA, 22 bp, Homo sapiens
caaaagtagtgaagttgtacat

SEQ ID NO: 7490773 - DNA, 22 bp, Homo sapiens
caaaagtagtgaagttgtacat

SEQ ID NO: 7490774 - DNA, 22 bp, Homo sapiens
caaaagtagtgaagttgtacat

SEQ ID NO: 7490775 - DNA, 22 bp, Homo sapiens
caaaagtaccttgtgtgctttg

SEQ ID NO: 7490776 - DNA, 22 bp, Homo sapiens
caaaagtaccttgtgtgctttg

SEQ ID NO: 7490777 - DNA, 22 bp, Homo sapiens
caaaagtaccttgtgtgctttg

SEQ ID NO: 7490778 - DNA, 22 bp, Homo sapiens
caaaagtaccttgtgtgctttg

SEQ ID NO: 7490779 - DNA, 22 bp, Homo sapiens
caaaagtaccttgtgtgctttg

SEQ ID NO: 7490780 - DNA, 22 bp, Homo sapiens
caaaagtaattgtggtttttgc

SEQ ID NO: 7490781 - DNA, 22 bp, Homo sapiens
caaaagtaccttgtgtgctttg

SEQ ID NO: 7490782 - DNA, 22 bp, Homo sapiens
caaaagtaccttgtgtgctttg

SEQ ID NO: 7490783 - DNA, 22 bp, Homo sapiens
caaaagtaattgcagtttttgc

SEQ ID NO: 7490784 - DNA, 22 bp, Homo sapiens
caaaagtaattgcagtttttgc

SEQ ID NO: 7490785 - DNA, 22 bp, Homo sapiens
caaaagtaattgcagtttttgc

SEQ ID NO: 7490786 - DNA, 22 bp, Homo sapiens
caaaagtaattgcagtttttgc

SEQ ID NO: 7490787 - DNA, 22 bp, Homo sapiens
caaaagtaattgcggtttttgc

SEQ ID NO: 7490788 - DNA, 22 bp, Homo sapiens
caaaagtaattgcggtttttgc

SEQ ID NO: 7490789 - DNA, 22 bp, Homo sapiens
caaaagtaattgcggtttttgc

SEQ ID NO: 7490790 - DNA, 22 bp, Homo sapiens
caaaagtaattgtggttttcac

SEQ ID NO: 7490791 - DNA, 22 bp, Homo sapiens
caaaagtaattgtggtttttgc

SEQ ID NO: 7490792 - DNA, 22 bp, Homo sapiens
caaaagtaattgtggtttttgc

SEQ ID NO: 7490793 - DNA, 22 bp, Homo sapiens
caaaagtaattgtggttttcac

SEQ ID NO: 7490794 - DNA, 22 bp, Homo sapiens
caaaagcagttctatctgagtt

SEQ ID NO: 7490795 - DNA, 21 bp, Homo sapiens
caaaaggataggaaattaggg

SEQ ID NO: 7490796 - DNA, 21 bp, Homo sapiens
caaaaggataggaaattaggg

SEQ ID NO: 7490797 - DNA, 21 bp, Homo sapiens
caaaaggataggaaattaggg

SEQ ID NO: 7490798 - DNA, 22 bp, Homo sapiens
caaaaaacacagatgtctgtgt

SEQ ID NO: 7490799 - DNA, 22 bp, Homo sapiens
caaaagcagttctatctgagtt

SEQ ID NO: 7490800 - DNA, 21 bp, Homo sapiens
caaaaggataggaaattaggg

SEQ ID NO: 7490801 - DNA, 21 bp, Homo sapiens
caaaaggataggaaattaggg

SEQ ID NO: 7490802 - DNA, 21 bp, Homo sapiens
caaaaggataggaaattaggg

SEQ ID NO: 7490803 - DNA, 21 bp, Homo sapiens
caaaaggataggaaattaggg

SEQ ID NO: 7490804 - DNA, 21 bp, Homo sapiens
caaaaggataggaaattaggg

SEQ ID NO: 7490805 - DNA, 22 bp, Homo sapiens
caaaaaacacagatgtctgtgt

SEQ ID NO: 7490806 - DNA, 22 bp, Homo sapiens
caaaaaacacagatgtctgtgt

SEQ ID NO: 7490807 - DNA, 22 bp, Homo sapiens
caaaaaacacagatgtctgtgt

SEQ ID NO: 7490808 - DNA, 22 bp, Homo sapiens
caaaaaacacagatgtctgtgt

SEQ ID NO: 7490809 - DNA, 22 bp, Homo sapiens
caaaaaacacagatgtctgtgt

SEQ ID NO: 7490810 - DNA, 22 bp, Homo sapiens
attttaaccctcttatatatac

SEQ ID NO: 7490811 - DNA, 22 bp, Homo sapiens
caaaaaacacagatgtctgtgt

SEQ ID NO: 7490812 - DNA, 22 bp, Homo sapiens
attttaaccctcttatatatac

SEQ ID NO: 7490813 - DNA, 22 bp, Homo sapiens
attttaaccctcttatatatac

SEQ ID NO: 7490814 - DNA, 22 bp, Homo sapiens
atttgtttcagggccttggtat

SEQ ID NO: 7490815 - DNA, 22 bp, Homo sapiens
atttgtttcagggccttggtat

SEQ ID NO: 7490816 - DNA, 22 bp, Homo sapiens
atttgtttcagggccttggtat

SEQ ID NO: 7490817 - DNA, 22 bp, Homo sapiens
atttgtttcagggccttggtat

SEQ ID NO: 7490818 - DNA, 22 bp, Homo sapiens
atttgtttcagggccttggtat

SEQ ID NO: 7490819 - DNA, 22 bp, Homo sapiens
atttgtttcagggccttggtat

SEQ ID NO: 7490820 - DNA, 20 bp, Homo sapiens
atttgtttctactctctgac

SEQ ID NO: 7490821 - DNA, 20 bp, Homo sapiens
atttgtttctactctctgac

SEQ ID NO: 7490822 - DNA, 20 bp, Homo sapiens
atttgtttctactctctgac

SEQ ID NO: 7490823 - DNA, 20 bp, Homo sapiens
atttgtttctactctctgac

SEQ ID NO: 7490824 - DNA, 20 bp, Homo sapiens
atttgtttctactctctgac

SEQ ID NO: 7490825 - DNA, 22 bp, Homo sapiens
atttgtttatcgtcgattgtag

SEQ ID NO: 7490826 - DNA, 22 bp, Homo sapiens
atttgtttatcgtcgattgtag

SEQ ID NO: 7490827 - DNA, 22 bp, Homo sapiens
atttgtttatcgtcgattgtag

SEQ ID NO: 7490828 - DNA, 22 bp, Homo sapiens
atttgtttatcgtcgattgtag

SEQ ID NO: 7490829 - DNA, 22 bp, Homo sapiens
atttgctttgggacagcttaaa

SEQ ID NO: 7490830 - DNA, 22 bp, Homo sapiens
atttgctttgggacagcttaaa

SEQ ID NO: 7490831 - DNA, 22 bp, Homo sapiens
atttctcttagcaagacattac

SEQ ID NO: 7490832 - DNA, 22 bp, Homo sapiens
atttgcttttactatgttaaaa

SEQ ID NO: 7490833 - DNA, 22 bp, Homo sapiens
atttgcttttactatgttaaaa

SEQ ID NO: 7490834 - DNA, 22 bp, Homo sapiens
atttgcttttactatgttaaaa

SEQ ID NO: 7490835 - DNA, 22 bp, Homo sapiens
atttgctttgggacagcttaaa

SEQ ID NO: 7490836 - DNA, 22 bp, Homo sapiens
atttctcttagcaagacattac

SEQ ID NO: 7490837 - DNA, 22 bp, Homo sapiens
atttctcttagcaagacattac

SEQ ID NO: 7490838 - DNA, 18 bp, Homo sapiens
atttctctggggtgattc

SEQ ID NO: 7490839 - DNA, 22 bp, Homo sapiens
atttctctgcctcagcttctgc

SEQ ID NO: 7490840 - DNA, 22 bp, Homo sapiens
atttctctgcctcagcttctgc

SEQ ID NO: 7490841 - DNA, 22 bp, Homo sapiens
atttctctgcctcagcttctgc

SEQ ID NO: 7490842 - DNA, 18 bp, Homo sapiens
atttctctggggtgattc

SEQ ID NO: 7490843 - DNA, 22 bp, Homo sapiens
atttctctgcctcagcttctgc

SEQ ID NO: 7490844 - DNA, 22 bp, Homo sapiens
atttctctgcctcagcttctgc

SEQ ID NO: 7490845 - DNA, 22 bp, Homo sapiens
atttctctgcagtgttcggaat

SEQ ID NO: 7490846 - DNA, 22 bp, Homo sapiens
atttctctgcagtgttcggaat

SEQ ID NO: 7490847 - DNA, 22 bp, Homo sapiens
atttggatatcactgaatacat

SEQ ID NO: 7490848 - DNA, 22 bp, Homo sapiens
atttggatatcactgaatacat

SEQ ID NO: 7490849 - DNA, 22 bp, Homo sapiens
atttggatatcactgaatacat

SEQ ID NO: 7490850 - DNA, 22 bp, Homo sapiens
atttggagtagggcctgggtat

SEQ ID NO: 7490851 - DNA, 22 bp, Homo sapiens
atttggatatcactgaatacat

SEQ ID NO: 7490852 - DNA, 22 bp, Homo sapiens
atttggatatcactgaatacat

SEQ ID NO: 7490853 - DNA, 22 bp, Homo sapiens
atttggatatcactgaatacat

SEQ ID NO: 7490854 - DNA, 22 bp, Homo sapiens
atttggattcttatttagcact

SEQ ID NO: 7490855 - DNA, 22 bp, Homo sapiens
atttggatgaacaatggaaaaa

SEQ ID NO: 7490856 - DNA, 22 bp, Homo sapiens
atttggatgcactaaataaaat

SEQ ID NO: 7490857 - DNA, 22 bp, Homo sapiens
atttggatgcactaaataaaat

SEQ ID NO: 7490858 - DNA, 22 bp, Homo sapiens
atttggatgcactaaataaaat

SEQ ID NO: 7490859 - DNA, 22 bp, Homo sapiens
atttggatgcactaaataaaat

SEQ ID NO: 7490860 - DNA, 17 bp, Homo sapiens
atttggaatttctcttc

SEQ ID NO: 7490861 - DNA, 17 bp, Homo sapiens
atttggaatttctcttc

SEQ ID NO: 7490862 - DNA, 17 bp, Homo sapiens
atttggaatttctcttc

SEQ ID NO: 7490863 - DNA, 17 bp, Homo sapiens
atttggaatttctcttc

SEQ ID NO: 7490864 - DNA, 17 bp, Homo sapiens
atttggaatttctcttc

SEQ ID NO: 7490865 - DNA, 22 bp, Homo sapiens
atttggaggcccatcccttaca

SEQ ID NO: 7490866 - DNA, 22 bp, Homo sapiens
atttggaggcctctcctgcttg

SEQ ID NO: 7490867 - DNA, 22 bp, Homo sapiens
atttggagacaggatttttcag

SEQ ID NO: 7490868 - DNA, 22 bp, Homo sapiens
atttggaattctatttcagtag

SEQ ID NO: 7490869 - DNA, 22 bp, Homo sapiens
atttgcttttactatgttaaaa

SEQ ID NO: 7490870 - DNA, 22 bp, Homo sapiens
atttgcttttactatgttaaaa

SEQ ID NO: 7490871 - DNA, 22 bp, Homo sapiens
atttctctcattgttagctagg

SEQ ID NO: 7490872 - DNA, 22 bp, Homo sapiens
atttctctcattgttagctagg

SEQ ID NO: 7490873 - DNA, 22 bp, Homo sapiens
atttctctcattgttagctagg

SEQ ID NO: 7490874 - DNA, 22 bp, Homo sapiens
atttctctcattgttagctagg

SEQ ID NO: 7490875 - DNA, 22 bp, Homo sapiens
atttctctcattgttagctagg

SEQ ID NO: 7490876 - DNA, 22 bp, Homo sapiens
atttctcattttgcttcaaagg

SEQ ID NO: 7490877 - DNA, 22 bp, Homo sapiens
atttctcctccagatggtggtt

SEQ ID NO: 7490878 - DNA, 22 bp, Homo sapiens
atttctcctccagatggtggtt

SEQ ID NO: 7490879 - DNA, 22 bp, Homo sapiens
atttctccttgttgcaatgcag

SEQ ID NO: 7490880 - DNA, 22 bp, Homo sapiens
atttctctaagcatccgtttgc

SEQ ID NO: 7490881 - DNA, 22 bp, Homo sapiens
atttctctaagcatccgtttgc

SEQ ID NO: 7490882 - DNA, 22 bp, Homo sapiens
atttctccttgttgcaatgcag

SEQ ID NO: 7490883 - DNA, 22 bp, Homo sapiens
atttccttcatcagcctatcct

SEQ ID NO: 7490884 - DNA, 22 bp, Homo sapiens
atttccttcagtgtttaatact

SEQ ID NO: 7490885 - DNA, 22 bp, Homo sapiens
atttccttcatcagcctatcct

SEQ ID NO: 7490886 - DNA, 22 bp, Homo sapiens
atttccttcagtgtttaatact

SEQ ID NO: 7490887 - DNA, 22 bp, Homo sapiens
atttccttcatcagcctatcct

SEQ ID NO: 7490888 - DNA, 22 bp, Homo sapiens
atttccttcatcagcctatcct

SEQ ID NO: 7490889 - DNA, 22 bp, Homo sapiens
atttctcatcaagtgccaactc

SEQ ID NO: 7490890 - DNA, 22 bp, Homo sapiens
atttctcatctttgtgaatggt

SEQ ID NO: 7490891 - DNA, 22 bp, Homo sapiens
atttctcatctttgtgaatggt

SEQ ID NO: 7490892 - DNA, 22 bp, Homo sapiens
atttctcattaagatcttccaa

SEQ ID NO: 7490893 - DNA, 22 bp, Homo sapiens
atttctcattaagatcttccaa

SEQ ID NO: 7490894 - DNA, 22 bp, Homo sapiens
atttctcatgtacaaaaacact

SEQ ID NO: 7490895 - DNA, 22 bp, Homo sapiens
atttctcatgtacaaaaacact

SEQ ID NO: 7490896 - DNA, 22 bp, Homo sapiens
atttctcatgtacaaaaacact

SEQ ID NO: 7490897 - DNA, 22 bp, Homo sapiens
atttctcattttgcttcaaagg

SEQ ID NO: 7490898 - DNA, 22 bp, Homo sapiens
atttctcattttgcttcaaagg

SEQ ID NO: 7490899 - DNA, 22 bp, Homo sapiens
atttctcattaagatcttccaa

SEQ ID NO: 7490900 - DNA, 22 bp, Homo sapiens
atttctcattaagatcttccaa

SEQ ID NO: 7490901 - DNA, 22 bp, Homo sapiens
atttctcattttgcttcaaagg

SEQ ID NO: 7490902 - DNA, 22 bp, Homo sapiens
atttctcattttgcttcaaagg

SEQ ID NO: 7490903 - DNA, 22 bp, Homo sapiens
agatagacatacaatgtatgaa

SEQ ID NO: 7490904 - DNA, 21 bp, Homo sapiens
agatacttgctaacttaggca

SEQ ID NO: 7490905 - DNA, 22 bp, Homo sapiens
agatagatagtgaggtaatagc

SEQ ID NO: 7490906 - DNA, 21 bp, Homo sapiens
agatagttgggcatgcagctg

SEQ ID NO: 7490907 - DNA, 22 bp, Homo sapiens
atttccagactttttccaggaa

SEQ ID NO: 7490908 - DNA, 22 bp, Homo sapiens
agatactggaggttcctacaac

SEQ ID NO: 7490909 - DNA, 19 bp, Homo sapiens
agatactggtctgtggtac

SEQ ID NO: 7490910 - DNA, 22 bp, Homo sapiens
agatactatggaattttatgag

SEQ ID NO: 7490911 - DNA, 22 bp, Homo sapiens
agatacatttgtgtgcatgtat

SEQ ID NO: 7490912 - DNA, 22 bp, Homo sapiens
agatactaagcatttccagcac

SEQ ID NO: 7490913 - DNA, 22 bp, Homo sapiens
agatacatttgtgtgcatgtat

SEQ ID NO: 7490914 - DNA, 22 bp, Homo sapiens
agatacatttgtgtgcatgtat

SEQ ID NO: 7490915 - DNA, 22 bp, Homo sapiens
agatacatttgtgtgcatgtat

SEQ ID NO: 7490916 - DNA, 22 bp, Homo sapiens
agatacattgttctaagcattg

SEQ ID NO: 7490917 - DNA, 22 bp, Homo sapiens
agatacattgttctaagcattg

SEQ ID NO: 7490918 - DNA, 16 bp, Homo sapiens
atttccagattatgca

SEQ ID NO: 7490919 - DNA, 22 bp, Homo sapiens
atttccagcagcatatttgtct

SEQ ID NO: 7490920 - DNA, 17 bp, Homo sapiens
atttccagagtggccct

SEQ ID NO: 7490921 - DNA, 22 bp, Homo sapiens
atttcctaggtgctcgagtgct

SEQ ID NO: 7490922 - DNA, 22 bp, Homo sapiens
atttccagcagcatatttgtct

SEQ ID NO: 7490923 - DNA, 22 bp, Homo sapiens
atttcctatacagttgtccata

SEQ ID NO: 7490924 - DNA, 22 bp, Homo sapiens
atttccagcataggcttattga

SEQ ID NO: 7490925 - DNA, 22 bp, Homo sapiens
atttccagcataggcttattga

SEQ ID NO: 7490926 - DNA, 22 bp, Homo sapiens
atttcctatagatatggtgagt

SEQ ID NO: 7490927 - DNA, 22 bp, Homo sapiens
atttcctatacagttgtccata

SEQ ID NO: 7490928 - DNA, 22 bp, Homo sapiens
atttcctatagatatggtgagt

SEQ ID NO: 7490929 - DNA, 22 bp, Homo sapiens
atttcctatcctggtcttaaaa

SEQ ID NO: 7490930 - DNA, 22 bp, Homo sapiens
atttcctatggatacaggcaga

SEQ ID NO: 7490931 - DNA, 22 bp, Homo sapiens
atttcctatttcttgtccccta

SEQ ID NO: 7490932 - DNA, 22 bp, Homo sapiens
atttcctatggatacaggcaga

SEQ ID NO: 7490933 - DNA, 22 bp, Homo sapiens
atttcctatggatacaggcaga

SEQ ID NO: 7490934 - DNA, 22 bp, Homo sapiens
atttccttcagtgtttaatact

SEQ ID NO: 7490935 - DNA, 22 bp, Homo sapiens
atttcctgttgcttttgccact

SEQ ID NO: 7490936 - DNA, 22 bp, Homo sapiens
atttcctgttgcttttgccact

SEQ ID NO: 7490937 - DNA, 22 bp, Homo sapiens
atttccttcagtgtttaatact

SEQ ID NO: 7490938 - DNA, 22 bp, Homo sapiens
atttcctgttgcttttgccact

SEQ ID NO: 7490939 - DNA, 22 bp, Homo sapiens
atttccttcagtgtttaatact

SEQ ID NO: 7490940 - DNA, 22 bp, Homo sapiens
atttccttcagtgtttaatact

SEQ ID NO: 7490941 - DNA, 22 bp, Homo sapiens
atttcctgtacctatcaaggca

SEQ ID NO: 7490942 - DNA, 22 bp, Homo sapiens
atttcctgtacctatcaaggca

SEQ ID NO: 7490943 - DNA, 22 bp, Homo sapiens
atttcctgtaggggcttgcgaa

SEQ ID NO: 7490944 - DNA, 22 bp, Homo sapiens
atttcctgtaggggcttgcgaa

SEQ ID NO: 7490945 - DNA, 22 bp, Homo sapiens
atttcctgtgtctctatttatg

SEQ ID NO: 7490946 - DNA, 22 bp, Homo sapiens
atttcctgtgtctctatttatg

SEQ ID NO: 7490947 - DNA, 22 bp, Homo sapiens
atttcctgtgtctctatttatg

SEQ ID NO: 7490948 - DNA, 22 bp, Homo sapiens
atttcctggaggaatggaagca

SEQ ID NO: 7490949 - DNA, 22 bp, Homo sapiens
atttcctggagccagtttacct

SEQ ID NO: 7490950 - DNA, 22 bp, Homo sapiens
atttcctggagccagtttacct

SEQ ID NO: 7490951 - DNA, 22 bp, Homo sapiens
atttcctggtaccaggctttct

SEQ ID NO: 7490952 - DNA, 22 bp, Homo sapiens
atttcctgggtctcactccaga

SEQ ID NO: 7490953 - DNA, 22 bp, Homo sapiens
atttcctgggtctcactccaga

SEQ ID NO: 7490954 - DNA, 22 bp, Homo sapiens
atttcctgggtctcactccaga

SEQ ID NO: 7490955 - DNA, 22 bp, Homo sapiens
atttcctgtaaaatggtactgc

SEQ ID NO: 7490956 - DNA, 22 bp, Homo sapiens
atttcctgtaaaatggtactgc

SEQ ID NO: 7490957 - DNA, 22 bp, Homo sapiens
atttcctggttgcattggcttt

SEQ ID NO: 7490958 - DNA, 22 bp, Homo sapiens
atttcctggtgtggaagtattt

SEQ ID NO: 7490959 - DNA, 22 bp, Homo sapiens
atttcctggtaccaggctttct

SEQ ID NO: 7490960 - DNA, 22 bp, Homo sapiens
atttcctgacagggcagtggta

SEQ ID NO: 7490961 - DNA, 22 bp, Homo sapiens
atttcctcatgatcataatgca

SEQ ID NO: 7490962 - DNA, 22 bp, Homo sapiens
atttcctcatgatcataatgca

SEQ ID NO: 7490963 - DNA, 17 bp, Homo sapiens
atttcctcagggctgag

SEQ ID NO: 7490964 - DNA, 17 bp, Homo sapiens
atttcctcagggctgag

SEQ ID NO: 7490965 - DNA, 22 bp, Homo sapiens
atttcctatggatacaggcaga

SEQ ID NO: 7490966 - DNA, 17 bp, Homo sapiens
atttcctcagggctgag

SEQ ID NO: 7490967 - DNA, 22 bp, Homo sapiens
atttcctgatatatcctgtagt

SEQ ID NO: 7490968 - DNA, 22 bp, Homo sapiens
atttcctgatctgtaaaatagc

SEQ ID NO: 7490969 - DNA, 22 bp, Homo sapiens
atttcctgacttccattgaggc

SEQ ID NO: 7490970 - DNA, 22 bp, Homo sapiens
atttcctgatatatcctgtagt

SEQ ID NO: 7490971 - DNA, 22 bp, Homo sapiens
atttcctgcaaggagtgggttt

SEQ ID NO: 7490972 - DNA, 17 bp, Homo sapiens
atttcctgcaagcccct

SEQ ID NO: 7490973 - DNA, 17 bp, Homo sapiens
atttcctgcaagcccct

SEQ ID NO: 7490974 - DNA, 22 bp, Homo sapiens
atttcctgatttgtaaaattcc

SEQ ID NO: 7490975 - DNA, 22 bp, Homo sapiens
atttcctgatctgtaaaatagc

SEQ ID NO: 7490976 - DNA, 22 bp, Homo sapiens
atttcctgatctgtaaaatagc

SEQ ID NO: 7490977 - DNA, 22 bp, Homo sapiens
atttcctggaatgactagtggg

SEQ ID NO: 7490978 - DNA, 22 bp, Homo sapiens
atttcctggaatgactagtggg

SEQ ID NO: 7490979 - DNA, 22 bp, Homo sapiens
atttcctgcaggggctggtggg

SEQ ID NO: 7490980 - DNA, 22 bp, Homo sapiens
atttcctgcaggggctggtggg

SEQ ID NO: 7490981 - DNA, 22 bp, Homo sapiens
atttcctgcaaggagtgggttt

SEQ ID NO: 7490982 - DNA, 22 bp, Homo sapiens
atttcctgcagagcccctccga

SEQ ID NO: 7490983 - DNA, 22 bp, Homo sapiens
attataggcttgagccaccgtg

SEQ ID NO: 7490984 - DNA, 22 bp, Homo sapiens
attataggcttgagccaccgtg

SEQ ID NO: 7490985 - DNA, 22 bp, Homo sapiens
attataggcttgagccaccgtg

SEQ ID NO: 7490986 - DNA, 22 bp, Homo sapiens
attataggcttgagccaccgtg

SEQ ID NO: 7490987 - DNA, 22 bp, Homo sapiens
attataggcttgagccaccgtg

SEQ ID NO: 7490988 - DNA, 22 bp, Homo sapiens
attattaaagcttaggtcttat

SEQ ID NO: 7490989 - DNA, 22 bp, Homo sapiens
attattaaagcttaggtcttat

SEQ ID NO: 7490990 - DNA, 22 bp, Homo sapiens
attataggcttgagccaccgtg

SEQ ID NO: 7490991 - DNA, 22 bp, Homo sapiens
attattaaagcttaggtcttat

SEQ ID NO: 7490992 - DNA, 22 bp, Homo sapiens
attattaaagcttaggtcttat

SEQ ID NO: 7490993 - DNA, 22 bp, Homo sapiens
attattaaagcttaggtcttat

SEQ ID NO: 7490994 - DNA, 22 bp, Homo sapiens
attattaaagcttaggtcttat

SEQ ID NO: 7490995 - DNA, 22 bp, Homo sapiens
attattaaagcttaggtcttat

SEQ ID NO: 7490996 - DNA, 22 bp, Homo sapiens
attattaaagcttaggtcttat

SEQ ID NO: 7490997 - DNA, 23 bp, Homo sapiens
attattaaggacatggactttgt

SEQ ID NO: 7490998 - DNA, 23 bp, Homo sapiens
attattaaggacatggactttgt

SEQ ID NO: 7490999 - DNA, 23 bp, Homo sapiens
attattaaggacatggactttgt

SEQ ID NO: 7491000 - DNA, 23 bp, Homo sapiens
attattaaggacatggactttgt

SEQ ID NO: 7491001 - DNA, 22 bp, Homo sapiens
attattataaagtgcatgacct

SEQ ID NO: 7491002 - DNA, 22 bp, Homo sapiens
attattataaagtgcatgacct

SEQ ID NO: 7491003 - DNA, 22 bp, Homo sapiens
attattatatagggaaagtccc

SEQ ID NO: 7491004 - DNA, 21 bp, Homo sapiens
attattataaagaccacaggg

SEQ ID NO: 7491005 - DNA, 22 bp, Homo sapiens
attattagtgatgttgttactg

SEQ ID NO: 7491006 - DNA, 21 bp, Homo sapiens
attattataaagaccacaggg

SEQ ID NO: 7491007 - DNA, 22 bp, Homo sapiens
attattataaagtgcatgacct

SEQ ID NO: 7491008 - DNA, 21 bp, Homo sapiens
attattataaagaccacaggg

SEQ ID NO: 7491009 - DNA, 22 bp, Homo sapiens
attattagattcttaattgtaa

SEQ ID NO: 7491010 - DNA, 22 bp, Homo sapiens
attattagacttatatggtagt

SEQ ID NO: 7491011 - DNA, 22 bp, Homo sapiens
attattagattcttaattgtaa

SEQ ID NO: 7491012 - DNA, 22 bp, Homo sapiens
attattaggtgctctctgacaa

SEQ ID NO: 7491013 - DNA, 22 bp, Homo sapiens
attattaggactactggggttg

SEQ ID NO: 7491014 - DNA, 22 bp, Homo sapiens
attattaggtgctctctgacaa

SEQ ID NO: 7491015 - DNA, 21 bp, Homo sapiens
attattatttctgtgtccagc

SEQ ID NO: 7491016 - DNA, 22 bp, Homo sapiens
attattattgttgatgttaggg

SEQ ID NO: 7491017 - DNA, 22 bp, Homo sapiens
attattattttagagagaggcc

SEQ ID NO: 7491018 - DNA, 22 bp, Homo sapiens
attattattttagagagaggcc

SEQ ID NO: 7491019 - DNA, 22 bp, Homo sapiens
attattattttagagagaggcc

SEQ ID NO: 7491020 - DNA, 22 bp, Homo sapiens
attattcaaattcccactatac

SEQ ID NO: 7491021 - DNA, 21 bp, Homo sapiens
attattatttctgtgtccagc

SEQ ID NO: 7491022 - DNA, 22 bp, Homo sapiens
attattattgttgatgttaggg

SEQ ID NO: 7491023 - DNA, 22 bp, Homo sapiens
attattattgttgatgttaggg

SEQ ID NO: 7491024 - DNA, 22 bp, Homo sapiens
attattattgttgatgttaggg

SEQ ID NO: 7491025 - DNA, 22 bp, Homo sapiens
attattattgttgatgttaggg

SEQ ID NO: 7491026 - DNA, 22 bp, Homo sapiens
attattattgttgatgttaggg

SEQ ID NO: 7491027 - DNA, 22 bp, Homo sapiens
attattattgttgatgttaggg

SEQ ID NO: 7491028 - DNA, 22 bp, Homo sapiens
attattattgttgatgttaggg

SEQ ID NO: 7491029 - DNA, 22 bp, Homo sapiens
attattatatagggaaagtccc

SEQ ID NO: 7491030 - DNA, 22 bp, Homo sapiens
attattatggttgctcttttcc

SEQ ID NO: 7491031 - DNA, 22 bp, Homo sapiens
attattatggttgctcttttcc

SEQ ID NO: 7491032 - DNA, 22 bp, Homo sapiens
attattatggttgctcttttcc

SEQ ID NO: 7491033 - DNA, 22 bp, Homo sapiens
attattatggttgctcttttcc

SEQ ID NO: 7491034 - DNA, 22 bp, Homo sapiens
attattatggttgctcttttcc

SEQ ID NO: 7491035 - DNA, 22 bp, Homo sapiens
attattcaacacttgagaaatt

SEQ ID NO: 7491036 - DNA, 22 bp, Homo sapiens
attattcaacacttgagaaatt

SEQ ID NO: 7491037 - DNA, 22 bp, Homo sapiens
attattcaaattcccactatac

SEQ ID NO: 7491038 - DNA, 22 bp, Homo sapiens
attattcaaattcccactatac

SEQ ID NO: 7491039 - DNA, 22 bp, Homo sapiens
attattcaacacttgagaaatt

SEQ ID NO: 7491040 - DNA, 22 bp, Homo sapiens
attattcaacacttgagaaatt

SEQ ID NO: 7491041 - DNA, 22 bp, Homo sapiens
attattcaacacttgagaaatt

SEQ ID NO: 7491042 - DNA, 22 bp, Homo sapiens
agaggcactcgggagtctgtgg

SEQ ID NO: 7491043 - DNA, 22 bp, Homo sapiens
agaggcactcgggagtctgtgg

SEQ ID NO: 7491044 - DNA, 22 bp, Homo sapiens
agaggcactgttcttagcgact

SEQ ID NO: 7491045 - DNA, 22 bp, Homo sapiens
agaggcactgttcttagcgact

SEQ ID NO: 7491046 - DNA, 22 bp, Homo sapiens
agaggcagaagtgttcaaaccc

SEQ ID NO: 7491047 - DNA, 22 bp, Homo sapiens
agaggcagaagtgttcaaaccc

SEQ ID NO: 7491048 - DNA, 22 bp, Homo sapiens
agaggcagaagtgttcaaaccc

SEQ ID NO: 7491049 - DNA, 22 bp, Homo sapiens
agaggcagaagtgttcaaaccc

SEQ ID NO: 7491050 - DNA, 22 bp, Homo sapiens
agaggcagaagtgttcaaaccc

SEQ ID NO: 7491051 - DNA, 22 bp, Homo sapiens
agaggcagaagtgttcaaaccc

SEQ ID NO: 7491052 - DNA, 22 bp, Homo sapiens
agaggcagaagtgttcaaaccc

SEQ ID NO: 7491053 - DNA, 22 bp, Homo sapiens
agaggcagaagtgttcaaaccc

SEQ ID NO: 7491054 - DNA, 22 bp, Homo sapiens
attataggcttgagccaccgtg

SEQ ID NO: 7491055 - DNA, 22 bp, Homo sapiens
agaggaggctgggtccagataa

SEQ ID NO: 7491056 - DNA, 22 bp, Homo sapiens
attataggcttgagccaccgtg

SEQ ID NO: 7491057 - DNA, 22 bp, Homo sapiens
agaggaggctgggtccagataa

SEQ ID NO: 7491058 - DNA, 22 bp, Homo sapiens
agaggaggctgggtccagataa

SEQ ID NO: 7491059 - DNA, 22 bp, Homo sapiens
agaggaggctgggtccagataa

SEQ ID NO: 7491060 - DNA, 22 bp, Homo sapiens
agaggaggctgggtccagataa

SEQ ID NO: 7491061 - DNA, 22 bp, Homo sapiens
agaggaggctgggtccagataa

SEQ ID NO: 7491062 - DNA, 22 bp, Homo sapiens
agaggaggctctgggatcgtcc

SEQ ID NO: 7491063 - DNA, 22 bp, Homo sapiens
agaggaggctctgggatcgtcc

SEQ ID NO: 7491064 - DNA, 22 bp, Homo sapiens
agaggaggctctgggatcgtcc

SEQ ID NO: 7491065 - DNA, 22 bp, Homo sapiens
agaggaggctctgggatcgtcc

SEQ ID NO: 7491066 - DNA, 22 bp, Homo sapiens
agaggaggctctgggatcgtcc

SEQ ID NO: 7491067 - DNA, 22 bp, Homo sapiens
agaggaggctgggtccagataa

SEQ ID NO: 7491068 - DNA, 22 bp, Homo sapiens
agaggaggctctgggatcgtcc

SEQ ID NO: 7491069 - DNA, 22 bp, Homo sapiens
agaggaggctctgggatcgtcc

SEQ ID NO: 7491070 - DNA, 22 bp, Homo sapiens
agaggaggccaggcccacacct

SEQ ID NO: 7491071 - DNA, 22 bp, Homo sapiens
agaggaggccaggcccacacct

SEQ ID NO: 7491072 - DNA, 22 bp, Homo sapiens
agaggaggccaggcccacacct

SEQ ID NO: 7491073 - DNA, 22 bp, Homo sapiens
agaggaggccaggcccacacct

SEQ ID NO: 7491074 - DNA, 22 bp, Homo sapiens
agaggaggccaggcccacacct

SEQ ID NO: 7491075 - DNA, 22 bp, Homo sapiens
agaggaggccaggcccacacct

SEQ ID NO: 7491076 - DNA, 22 bp, Homo sapiens
agaggaggccaggcccacacct

SEQ ID NO: 7491077 - DNA, 22 bp, Homo sapiens
agaggaggatttgtaaaggtct

SEQ ID NO: 7491078 - DNA, 22 bp, Homo sapiens
agaggaggatttgtaaaggtct

SEQ ID NO: 7491079 - DNA, 22 bp, Homo sapiens
agaggaggcagcttaactcagt

SEQ ID NO: 7491080 - DNA, 22 bp, Homo sapiens
agaggaggcagcttaactcagt

SEQ ID NO: 7491081 - DNA, 22 bp, Homo sapiens
agaggaggcagcttaactcagt

SEQ ID NO: 7491082 - DNA, 20 bp, Homo sapiens
agaggaggattattttattc

SEQ ID NO: 7491083 - DNA, 22 bp, Homo sapiens
agaggagcttttggaaaaggcc

SEQ ID NO: 7491084 - DNA, 22 bp, Homo sapiens
agaggagcttttggaaaaggcc

SEQ ID NO: 7491085 - DNA, 22 bp, Homo sapiens
agaggaggaagagctttaaaat

SEQ ID NO: 7491086 - DNA, 22 bp, Homo sapiens
agaggaggaagagctttaaaat

SEQ ID NO: 7491087 - DNA, 22 bp, Homo sapiens
agaggaggaagagctttaaaat

SEQ ID NO: 7491088 - DNA, 22 bp, Homo sapiens
agaggaggatttgtaaaggtct

SEQ ID NO: 7491089 - DNA, 20 bp, Homo sapiens
agaggaggattattttattc

SEQ ID NO: 7491090 - DNA, 22 bp, Homo sapiens
agaggaggatttgtaaaggtct

SEQ ID NO: 7491091 - DNA, 22 bp, Homo sapiens
agaggaggatttgtaaaggtct

SEQ ID NO: 7491092 - DNA, 22 bp, Homo sapiens
agaggaggatttgtaaaggtct

SEQ ID NO: 7491093 - DNA, 22 bp, Homo sapiens
agaggaggatttgtaaaggtct

SEQ ID NO: 7491094 - DNA, 22 bp, Homo sapiens
agaggacaggttttccatgggc

SEQ ID NO: 7491095 - DNA, 22 bp, Homo sapiens
agaggacaggttttccatgggc

SEQ ID NO: 7491096 - DNA, 22 bp, Homo sapiens
agaggacaggttttccatgggc

SEQ ID NO: 7491097 - DNA, 22 bp, Homo sapiens
agaggacaggttttccatgggc

SEQ ID NO: 7491098 - DNA, 22 bp, Homo sapiens
agaggagaatccgtttccttgc

SEQ ID NO: 7491099 - DNA, 22 bp, Homo sapiens
agaggacaggttttccatgggc

SEQ ID NO: 7491100 - DNA, 22 bp, Homo sapiens
agaggacaggttttccatgggc

SEQ ID NO: 7491101 - DNA, 22 bp, Homo sapiens
agaggagctgggaggccctcgt

SEQ ID NO: 7491102 - DNA, 22 bp, Homo sapiens
agaggagctgggaggccctcgt

SEQ ID NO: 7491103 - DNA, 22 bp, Homo sapiens
agaggagctgggaggccctcgt

SEQ ID NO: 7491104 - DNA, 22 bp, Homo sapiens
agaggagaatccgtttccttgc

SEQ ID NO: 7491105 - DNA, 22 bp, Homo sapiens
agaggagaatccgtttccttgc

SEQ ID NO: 7491106 - DNA, 22 bp, Homo sapiens
agaggagaatccgtttccttgc

SEQ ID NO: 7491107 - DNA, 22 bp, Homo sapiens
agaggagcttttggaaaaggcc

SEQ ID NO: 7491108 - DNA, 22 bp, Homo sapiens
agaggagcttttggaaaaggcc

SEQ ID NO: 7491109 - DNA, 22 bp, Homo sapiens
agaggagctgggaggccctcgt

SEQ ID NO: 7491110 - DNA, 22 bp, Homo sapiens
agaggagcttttggaaaaggcc

SEQ ID NO: 7491111 - DNA, 22 bp, Homo sapiens
agaggagcttttggaaaaggcc

SEQ ID NO: 7491112 - DNA, 22 bp, Homo sapiens
agaggagcctcagtttgcagcc

SEQ ID NO: 7491113 - DNA, 22 bp, Homo sapiens
agaggagctgggaggccctcgt

SEQ ID NO: 7491114 - DNA, 22 bp, Homo sapiens
atgtttatgacctccataagga

SEQ ID NO: 7491115 - DNA, 22 bp, Homo sapiens
atgtttagtcattcagctcctt

SEQ ID NO: 7491116 - DNA, 22 bp, Homo sapiens
atgtttactggtttatagaata

SEQ ID NO: 7491117 - DNA, 22 bp, Homo sapiens
atgtttactggtttatagaata

SEQ ID NO: 7491118 - DNA, 22 bp, Homo sapiens
atgtttactggtttatagaata

SEQ ID NO: 7491119 - DNA, 22 bp, Homo sapiens
atgtttactgaaaagatttcaa

SEQ ID NO: 7491120 - DNA, 22 bp, Homo sapiens
atgtttactgaaaagatttcaa

SEQ ID NO: 7491121 - DNA, 22 bp, Homo sapiens
atgtttactggtttatagaata

SEQ ID NO: 7491122 - DNA, 22 bp, Homo sapiens
atgtttactggtttatagaata

SEQ ID NO: 7491123 - DNA, 22 bp, Homo sapiens
atgtttatgcaaacatgtgagt

SEQ ID NO: 7491124 - DNA, 22 bp, Homo sapiens
atgtttatgcaaacatgtgagt

SEQ ID NO: 7491125 - DNA, 22 bp, Homo sapiens
atgtttatgcaaacatgtgagt

SEQ ID NO: 7491126 - DNA, 22 bp, Homo sapiens
atgtttatgcaaacatgtgagt

SEQ ID NO: 7491127 - DNA, 22 bp, Homo sapiens
atgtttatgacctccataagga

SEQ ID NO: 7491128 - DNA, 22 bp, Homo sapiens
atgtttatgcaaacatgtgagt

SEQ ID NO: 7491129 - DNA, 22 bp, Homo sapiens
atgtttatgcaaacatgtgagt

SEQ ID NO: 7491130 - DNA, 22 bp, Homo sapiens
atgtttatgcaaacatgtgagt

SEQ ID NO: 7491131 - DNA, 21 bp, Homo sapiens
atgtttacactgactactgtg

SEQ ID NO: 7491132 - DNA, 22 bp, Homo sapiens
atgtttacagaggaagtgcctc

SEQ ID NO: 7491133 - DNA, 22 bp, Homo sapiens
atgtttacagaggaagtgcctc

SEQ ID NO: 7491134 - DNA, 22 bp, Homo sapiens
atgtttacagaggaagtgcctc

SEQ ID NO: 7491135 - DNA, 22 bp, Homo sapiens
atgtttactgaaaagatttcaa

SEQ ID NO: 7491136 - DNA, 21 bp, Homo sapiens
atgtttacactgactactgtg

SEQ ID NO: 7491137 - DNA, 19 bp, Homo sapiens
atgtttacactcaggggct

SEQ ID NO: 7491138 - DNA, 21 bp, Homo sapiens
atgtttacactgactactgtg

SEQ ID NO: 7491139 - DNA, 22 bp, Homo sapiens
atgtttacaattcagtattaca

SEQ ID NO: 7491140 - DNA, 22 bp, Homo sapiens
atgtttacaattcagtattaca

SEQ ID NO: 7491141 - DNA, 19 bp, Homo sapiens
atgtttacactcaggggct

SEQ ID NO: 7491142 - DNA, 22 bp, Homo sapiens
atgtttacaattcagtattaca

SEQ ID NO: 7491143 - DNA, 22 bp, Homo sapiens
atgtttacaattcagtattaca

SEQ ID NO: 7491144 - DNA, 22 bp, Homo sapiens
atgtttacaattcagtattaca

SEQ ID NO: 7491145 - DNA, 22 bp, Homo sapiens
atgtttacaattcagtattaca

SEQ ID NO: 7491146 - DNA, 22 bp, Homo sapiens
atgtttacaattcagtattaca

SEQ ID NO: 7491147 - DNA, 22 bp, Homo sapiens
atgtttacaattcagtattaca

SEQ ID NO: 7491148 - DNA, 22 bp, Homo sapiens
atgtttacaattcagtattaca

SEQ ID NO: 7491149 - DNA, 22 bp, Homo sapiens
agagctgtttgtctagagagtg

SEQ ID NO: 7491150 - DNA, 22 bp, Homo sapiens
agagctgtttggacatctgagt

SEQ ID NO: 7491151 - DNA, 22 bp, Homo sapiens
agagctgtttggacatctgagt

SEQ ID NO: 7491152 - DNA, 22 bp, Homo sapiens
agaggaagctgagatgcctctt

SEQ ID NO: 7491153 - DNA, 22 bp, Homo sapiens
agaggaagctgagatgcctctt

SEQ ID NO: 7491154 - DNA, 22 bp, Homo sapiens
agaggaagctgagatgcctctt

SEQ ID NO: 7491155 - DNA, 22 bp, Homo sapiens
agaggacaaaatgagaagtgct

SEQ ID NO: 7491156 - DNA, 22 bp, Homo sapiens
agaggacaaaatgagaagtgct

SEQ ID NO: 7491157 - DNA, 22 bp, Homo sapiens
agaggaagctgagatgcctctt

SEQ ID NO: 7491158 - DNA, 22 bp, Homo sapiens
agaggaagctgagatgcctctt

SEQ ID NO: 7491159 - DNA, 22 bp, Homo sapiens
agaggaagctgagatgcctctt

SEQ ID NO: 7491160 - DNA, 22 bp, Homo sapiens
agaggaagctgagatgcctctt

SEQ ID NO: 7491161 - DNA, 22 bp, Homo sapiens
agaggaagctgagatgcctctt

SEQ ID NO: 7491162 - DNA, 22 bp, Homo sapiens
agaggaagccattgcttactga

SEQ ID NO: 7491163 - DNA, 22 bp, Homo sapiens
agaggaagctgagatgcctctt

SEQ ID NO: 7491164 - DNA, 22 bp, Homo sapiens
agaggaagctgagatgcctctt

SEQ ID NO: 7491165 - DNA, 22 bp, Homo sapiens
agaggaagctgagatgcctctt

SEQ ID NO: 7491166 - DNA, 22 bp, Homo sapiens
agaggaagctgagatgcctctt

SEQ ID NO: 7491167 - DNA, 22 bp, Homo sapiens
atgtttatgttgggctatattt

SEQ ID NO: 7491168 - DNA, 22 bp, Homo sapiens
atgtttatgttgggctatattt

SEQ ID NO: 7491169 - DNA, 22 bp, Homo sapiens
atgtttatgttgggctatattt

SEQ ID NO: 7491170 - DNA, 22 bp, Homo sapiens
atgtttatggagcaggtattag

SEQ ID NO: 7491171 - DNA, 22 bp, Homo sapiens
atgtttatggagcaggtattag

SEQ ID NO: 7491172 - DNA, 22 bp, Homo sapiens
atgtttatggagcaggtattag

SEQ ID NO: 7491173 - DNA, 22 bp, Homo sapiens
atgtttatggagcaggtattag

SEQ ID NO: 7491174 - DNA, 22 bp, Homo sapiens
agaggacagagtgctggattta

SEQ ID NO: 7491175 - DNA, 22 bp, Homo sapiens
agaggacagacggaaagtgcca

SEQ ID NO: 7491176 - DNA, 22 bp, Homo sapiens
agaggacagagtgctggattta

SEQ ID NO: 7491177 - DNA, 22 bp, Homo sapiens
agaggacagagtgctggattta

SEQ ID NO: 7491178 - DNA, 22 bp, Homo sapiens
agaggacagcccccttgtctgg

SEQ ID NO: 7491179 - DNA, 22 bp, Homo sapiens
agaggacagagtgctggattta

SEQ ID NO: 7491180 - DNA, 22 bp, Homo sapiens
agaggacagcccccttgtctgg

SEQ ID NO: 7491181 - DNA, 22 bp, Homo sapiens
agaggacagcccccttgtctgg

SEQ ID NO: 7491182 - DNA, 22 bp, Homo sapiens
agaggacagcccccttgtctgg

SEQ ID NO: 7491183 - DNA, 22 bp, Homo sapiens
agaggacaggttttccatgggc

SEQ ID NO: 7491184 - DNA, 22 bp, Homo sapiens
agaggacaggttttccatgggc

SEQ ID NO: 7491185 - DNA, 22 bp, Homo sapiens
agaggacacatctttcctcaaa

SEQ ID NO: 7491186 - DNA, 22 bp, Homo sapiens
agaggacacatctttcctcaaa

SEQ ID NO: 7491187 - DNA, 22 bp, Homo sapiens
agaggacaaaatgagaagtgct

SEQ ID NO: 7491188 - DNA, 22 bp, Homo sapiens
agaggacaaaatgagaagtgct

SEQ ID NO: 7491189 - DNA, 22 bp, Homo sapiens
agaggacaaaatgagaagtgct

SEQ ID NO: 7491190 - DNA, 22 bp, Homo sapiens
agaggacagacggaaagtgcca

SEQ ID NO: 7491191 - DNA, 22 bp, Homo sapiens
agaggacagacggaaagtgcca

SEQ ID NO: 7491192 - DNA, 22 bp, Homo sapiens
agaggacagacggaaagtgcca

SEQ ID NO: 7491193 - DNA, 22 bp, Homo sapiens
agaggacagacggaaagtgcca

SEQ ID NO: 7491194 - DNA, 22 bp, Homo sapiens
agaggacagacggaaagtgcca

SEQ ID NO: 7491195 - DNA, 22 bp, Homo sapiens
atgtgtagggaagtgaaatgta

SEQ ID NO: 7491196 - DNA, 22 bp, Homo sapiens
atgtgtagaactgtaatgccca

SEQ ID NO: 7491197 - DNA, 22 bp, Homo sapiens
atgtgtacactggacttctgat

SEQ ID NO: 7491198 - DNA, 22 bp, Homo sapiens
atgtgtaggtgaatcgaggctg

SEQ ID NO: 7491199 - DNA, 22 bp, Homo sapiens
atgtgtatacttgtgcttactc

SEQ ID NO: 7491200 - DNA, 22 bp, Homo sapiens
atgtgtatacttgtgcttactc

SEQ ID NO: 7491201 - DNA, 22 bp, Homo sapiens
atgtgtatacttgtgcttactc

SEQ ID NO: 7491202 - DNA, 22 bp, Homo sapiens
atgtgtatatttattgtagttt

SEQ ID NO: 7491203 - DNA, 22 bp, Homo sapiens
atgtgtatatttattgtagttt

SEQ ID NO: 7491204 - DNA, 21 bp, Homo sapiens
agagctgggacttgcctgaga

SEQ ID NO: 7491205 - DNA, 22 bp, Homo sapiens
agagctgggacttggactcaat

SEQ ID NO: 7491206 - DNA, 21 bp, Homo sapiens
agagctgggacttgcctgaga

SEQ ID NO: 7491207 - DNA, 22 bp, Homo sapiens
agagctggtgcatattcagaaa

SEQ ID NO: 7491208 - DNA, 22 bp, Homo sapiens
agagctggtgcatattcagaaa

SEQ ID NO: 7491209 - DNA, 22 bp, Homo sapiens
agagctggtgcatattcagaaa

SEQ ID NO: 7491210 - DNA, 22 bp, Homo sapiens
agagctggtgcatattcagaaa

SEQ ID NO: 7491211 - DNA, 21 bp, Homo sapiens
agagctggtaggtaggtaggt

SEQ ID NO: 7491212 - DNA, 21 bp, Homo sapiens
agagctggtaggtaggtaggt

SEQ ID NO: 7491213 - DNA, 22 bp, Homo sapiens
agagctgggacttggactcaat

SEQ ID NO: 7491214 - DNA, 22 bp, Homo sapiens
agagctgggacttggactcaat

SEQ ID NO: 7491215 - DNA, 22 bp, Homo sapiens
agagctgggacttggactcaat

SEQ ID NO: 7491216 - DNA, 21 bp, Homo sapiens
agagctggtaggtaggtaggt

SEQ ID NO: 7491217 - DNA, 22 bp, Homo sapiens
agagctggtttactcaggaatt

SEQ ID NO: 7491218 - DNA, 22 bp, Homo sapiens
agagctggtttactcaggaatt

SEQ ID NO: 7491219 - DNA, 22 bp, Homo sapiens
agagctggtttactcaggaatt

SEQ ID NO: 7491220 - DNA, 22 bp, Homo sapiens
agagctggtgcatattcagaaa

SEQ ID NO: 7491221 - DNA, 22 bp, Homo sapiens
agagctggtgcatattcagaaa

SEQ ID NO: 7491222 - DNA, 22 bp, Homo sapiens
agagctggtttactcaggaatt

SEQ ID NO: 7491223 - DNA, 22 bp, Homo sapiens
agagctggtttactcaggaatt

SEQ ID NO: 7491224 - DNA, 22 bp, Homo sapiens
agagctggtttactcaggaatt

SEQ ID NO: 7491225 - DNA, 22 bp, Homo sapiens
agagctggtttactcaggaatt

SEQ ID NO: 7491226 - DNA, 22 bp, Homo sapiens
agagctggtttactcaggaatt

SEQ ID NO: 7491227 - DNA, 22 bp, Homo sapiens
agagctgtgctttgcaccacgt

SEQ ID NO: 7491228 - DNA, 22 bp, Homo sapiens
agagctgtgaaaatgaggtttg

SEQ ID NO: 7491229 - DNA, 22 bp, Homo sapiens
agagctgtggatagtcctggat

SEQ ID NO: 7491230 - DNA, 22 bp, Homo sapiens
agagctgtgctttgcaccacgt

SEQ ID NO: 7491231 - DNA, 22 bp, Homo sapiens
agagctgtggatagtcctggat

SEQ ID NO: 7491232 - DNA, 22 bp, Homo sapiens
agagctgtagcttcctagagcc

SEQ ID NO: 7491233 - DNA, 22 bp, Homo sapiens
agagctgtagcttcctagagcc

SEQ ID NO: 7491234 - DNA, 22 bp, Homo sapiens
agagctggtttactcaggaatt

SEQ ID NO: 7491235 - DNA, 22 bp, Homo sapiens
agagctgtcacatagagccaga

SEQ ID NO: 7491236 - DNA, 22 bp, Homo sapiens
agagctgtgtcctgtgcactag

SEQ ID NO: 7491237 - DNA, 22 bp, Homo sapiens
agagctgtgttaagaacaggcc

SEQ ID NO: 7491238 - DNA, 22 bp, Homo sapiens
agagctgtgttaagaacaggcc

SEQ ID NO: 7491239 - DNA, 22 bp, Homo sapiens
agagctgttaattttgcactgg

SEQ ID NO: 7491240 - DNA, 22 bp, Homo sapiens
agagctgttcaacgtagcaatg

SEQ ID NO: 7491241 - DNA, 22 bp, Homo sapiens
agagctgtttattgatgtcaca

SEQ ID NO: 7491242 - DNA, 22 bp, Homo sapiens
agagctgtttattgatgtcaca

SEQ ID NO: 7491243 - DNA, 22 bp, Homo sapiens
agagctgtttattgatgtcaca

SEQ ID NO: 7491244 - DNA, 22 bp, Homo sapiens
agagctgtttggacatctgagt

SEQ ID NO: 7491245 - DNA, 22 bp, Homo sapiens
agagctgttcagcagccaggtt

SEQ ID NO: 7491246 - DNA, 17 bp, Homo sapiens
agaggcagatacttgga

SEQ ID NO: 7491247 - DNA, 17 bp, Homo sapiens
agaggcagatacttgga

SEQ ID NO: 7491248 - DNA, 17 bp, Homo sapiens
agaggcagatacttgga

SEQ ID NO: 7491249 - DNA, 17 bp, Homo sapiens
agaggcagatacttgga

SEQ ID NO: 7491250 - DNA, 17 bp, Homo sapiens
agaggcagatacttgga

SEQ ID NO: 7491251 - DNA, 22 bp, Homo sapiens
agaggcagaagtgttcaaaccc

SEQ ID NO: 7491252 - DNA, 22 bp, Homo sapiens
agaggcagaagtgttcaaaccc

SEQ ID NO: 7491253 - DNA, 17 bp, Homo sapiens
agaggcagatacttgga

SEQ ID NO: 7491254 - DNA, 17 bp, Homo sapiens
agaggcagatacttgga

SEQ ID NO: 7491255 - DNA, 17 bp, Homo sapiens
agaggcagatacttgga

SEQ ID NO: 7491256 - DNA, 22 bp, Homo sapiens
agaggcagcagtcatactacag

SEQ ID NO: 7491257 - DNA, 22 bp, Homo sapiens
agaggcagcagtcatactacag

SEQ ID NO: 7491258 - DNA, 22 bp, Homo sapiens
agaggcagcagtcatactacag

SEQ ID NO: 7491259 - DNA, 22 bp, Homo sapiens
agaggcagccgtatttcaaagg

SEQ ID NO: 7491260 - DNA, 22 bp, Homo sapiens
agaggcagccgtatttcaaagg

SEQ ID NO: 7491261 - DNA, 22 bp, Homo sapiens
agaggcagcagtcatactacag

SEQ ID NO: 7491262 - DNA, 22 bp, Homo sapiens
agaggcagcagtcatactacag

SEQ ID NO: 7491263 - DNA, 22 bp, Homo sapiens
agaggcagcagtcatactacag

SEQ ID NO: 7491264 - DNA, 22 bp, Homo sapiens
agaggcagcagtcatactacag

SEQ ID NO: 7491265 - DNA, 22 bp, Homo sapiens
agaggcagcagtcatactacag

SEQ ID NO: 7491266 - DNA, 22 bp, Homo sapiens
agaggcagcagtcatactacag

SEQ ID NO: 7491267 - DNA, 22 bp, Homo sapiens
agaggcagccgtatttcaaagg

SEQ ID NO: 7491268 - DNA, 22 bp, Homo sapiens
agaggcaggaagagctgatttt

SEQ ID NO: 7491269 - DNA, 22 bp, Homo sapiens
agaggcaggaagagctgatttt

SEQ ID NO: 7491270 - DNA, 22 bp, Homo sapiens
agaggcaggaagagctgatttt

SEQ ID NO: 7491271 - DNA, 22 bp, Homo sapiens
agaggcagccgtatttcaaagg

SEQ ID NO: 7491272 - DNA, 22 bp, Homo sapiens
agaggcagccgtatttcaaagg

SEQ ID NO: 7491273 - DNA, 22 bp, Homo sapiens
agaggcagccgtatttcaaagg

SEQ ID NO: 7491274 - DNA, 22 bp, Homo sapiens
agaggcagccgtatttcaaagg

SEQ ID NO: 7491275 - DNA, 22 bp, Homo sapiens
agaggcaggaagagctgatttt

SEQ ID NO: 7491276 - DNA, 22 bp, Homo sapiens
agaggcaggaagagctgatttt

SEQ ID NO: 7491277 - DNA, 22 bp, Homo sapiens
agaggcaggaagagctgatttt

SEQ ID NO: 7491278 - DNA, 22 bp, Homo sapiens
agaggcaggaagagctgatttt

SEQ ID NO: 7491279 - DNA, 22 bp, Homo sapiens
agaggcaggaagagctgatttt

SEQ ID NO: 7491280 - DNA, 22 bp, Homo sapiens
agaggcaggaggttgacttgag

SEQ ID NO: 7491281 - DNA, 22 bp, Homo sapiens
agaggcaggaggttgacttgag

SEQ ID NO: 7491282 - DNA, 22 bp, Homo sapiens
agaggcaggaggttgacttgag

SEQ ID NO: 7491283 - DNA, 22 bp, Homo sapiens
agaggcaggaggttgacttgag

SEQ ID NO: 7491284 - DNA, 22 bp, Homo sapiens
agaggcaggaggttgacttgag

SEQ ID NO: 7491285 - DNA, 22 bp, Homo sapiens
agaggcaggaggttgacttgag

SEQ ID NO: 7491286 - DNA, 22 bp, Homo sapiens
agaggcaggaagagctgatttt

SEQ ID NO: 7491287 - DNA, 22 bp, Homo sapiens
agaggcaggaagagctgatttt

SEQ ID NO: 7491288 - DNA, 22 bp, Homo sapiens
agaggcaggaagagctgatttt

SEQ ID NO: 7491289 - DNA, 22 bp, Homo sapiens
agaggcaggaagagctgatttt

SEQ ID NO: 7491290 - DNA, 20 bp, Homo sapiens
attcatgtctttataaaagc

SEQ ID NO: 7491291 - DNA, 22 bp, Homo sapiens
attcatgttagcccacatgtag

SEQ ID NO: 7491292 - DNA, 22 bp, Homo sapiens
attcatgtggggagccttctgt

SEQ ID NO: 7491293 - DNA, 22 bp, Homo sapiens
attcatgttcggggccacgttg

SEQ ID NO: 7491294 - DNA, 22 bp, Homo sapiens
attcatgttttcttgcttcaag

SEQ ID NO: 7491295 - DNA, 22 bp, Homo sapiens
attcatgttttcttgcttcaag

SEQ ID NO: 7491296 - DNA, 22 bp, Homo sapiens
attcatgttagcccacatgtag

SEQ ID NO: 7491297 - DNA, 22 bp, Homo sapiens
attcattccaggtcagtcagac

SEQ ID NO: 7491298 - DNA, 22 bp, Homo sapiens
attcattctgacctcaagagaa

SEQ ID NO: 7491299 - DNA, 22 bp, Homo sapiens
attcattcttggtatgaacagc

SEQ ID NO: 7491300 - DNA, 22 bp, Homo sapiens
attcattcttggtatgaacagc

SEQ ID NO: 7491301 - DNA, 22 bp, Homo sapiens
attcattcttggtatgaacagc

SEQ ID NO: 7491302 - DNA, 19 bp, Homo sapiens
attcattggccagggtggt

SEQ ID NO: 7491303 - DNA, 22 bp, Homo sapiens
attcattccaggtcagtcagac

SEQ ID NO: 7491304 - DNA, 22 bp, Homo sapiens
attcatgttttcttgcttcaag

SEQ ID NO: 7491305 - DNA, 22 bp, Homo sapiens
attcattagccactaactagca

SEQ ID NO: 7491306 - DNA, 22 bp, Homo sapiens
attcattagccactaactagca

SEQ ID NO: 7491307 - DNA, 22 bp, Homo sapiens
agaggcaggaggttgacttgag

SEQ ID NO: 7491308 - DNA, 22 bp, Homo sapiens
agaggcaggaggttgacttgag

SEQ ID NO: 7491309 - DNA, 18 bp, Homo sapiens
attcaggggctgaatgtg

SEQ ID NO: 7491310 - DNA, 22 bp, Homo sapiens
attcagtagaagttagctatta

SEQ ID NO: 7491311 - DNA, 22 bp, Homo sapiens
attcagtaggtgtgaacttatt

SEQ ID NO: 7491312 - DNA, 22 bp, Homo sapiens
attcagtaggtctagaataaga

SEQ ID NO: 7491313 - DNA, 22 bp, Homo sapiens
attcagtaggtctagaataaga

SEQ ID NO: 7491314 - DNA, 22 bp, Homo sapiens
attcagtaggtctagaataaga

SEQ ID NO: 7491315 - DNA, 20 bp, Homo sapiens
attcatgtctttataaaagc

SEQ ID NO: 7491316 - DNA, 20 bp, Homo sapiens
attcatgtctttataaaagc

SEQ ID NO: 7491317 - DNA, 22 bp, Homo sapiens
attcatgtaacattagagaaat

SEQ ID NO: 7491318 - DNA, 22 bp, Homo sapiens
attcatgtcatagcaggatttc

SEQ ID NO: 7491319 - DNA, 22 bp, Homo sapiens
attcatgtcatagcaggatttc

SEQ ID NO: 7491320 - DNA, 22 bp, Homo sapiens
attcatgcaggattgtctccaa

SEQ ID NO: 7491321 - DNA, 22 bp, Homo sapiens
attcatgtaacattagagaaat

SEQ ID NO: 7491322 - DNA, 22 bp, Homo sapiens
attcatgtaacattagagaaat

SEQ ID NO: 7491323 - DNA, 22 bp, Homo sapiens
attcatgtaaaattggatagac

SEQ ID NO: 7491324 - DNA, 22 bp, Homo sapiens
attcatttagagggattaagca

SEQ ID NO: 7491325 - DNA, 22 bp, Homo sapiens
attcatttagagggattaagca

SEQ ID NO: 7491326 - DNA, 22 bp, Homo sapiens
attcatttagagggattaagca

SEQ ID NO: 7491327 - DNA, 22 bp, Homo sapiens
attcatttagagggattaagca

SEQ ID NO: 7491328 - DNA, 22 bp, Homo sapiens
attcatttagagggattaagca

SEQ ID NO: 7491329 - DNA, 22 bp, Homo sapiens
attcatttagagggattaagca

SEQ ID NO: 7491330 - DNA, 22 bp, Homo sapiens
attcatttagagggattaagca

SEQ ID NO: 7491331 - DNA, 22 bp, Homo sapiens
attcattggcttgaactccacc

SEQ ID NO: 7491332 - DNA, 22 bp, Homo sapiens
attcatttaggtattcacttac

SEQ ID NO: 7491333 - DNA, 22 bp, Homo sapiens
attcatttaggtattcacttac

SEQ ID NO: 7491334 - DNA, 22 bp, Homo sapiens
attcatttaggtattcacttac

SEQ ID NO: 7491335 - DNA, 22 bp, Homo sapiens
attcatttaggtattcacttac

SEQ ID NO: 7491336 - DNA, 22 bp, Homo sapiens
attcatttaggtattcacttac

SEQ ID NO: 7491337 - DNA, 22 bp, Homo sapiens
attcatttaggtattcacttac

SEQ ID NO: 7491338 - DNA, 22 bp, Homo sapiens
attcatttaggtattcacttac

SEQ ID NO: 7491339 - DNA, 22 bp, Homo sapiens
agaggcctgtgtgctccagtgg

SEQ ID NO: 7491340 - DNA, 21 bp, Homo sapiens
agaggccttacaggatagacc

SEQ ID NO: 7491341 - DNA, 21 bp, Homo sapiens
agaggccttacaggatagacc

SEQ ID NO: 7491342 - DNA, 22 bp, Homo sapiens
agaggcctgtgtgctccagtgg

SEQ ID NO: 7491343 - DNA, 22 bp, Homo sapiens
attcatttgctattgtgtatgg

SEQ ID NO: 7491344 - DNA, 22 bp, Homo sapiens
attcatttgctattgtgtatgg

SEQ ID NO: 7491345 - DNA, 22 bp, Homo sapiens
attcatttgctattgtgtatgg

SEQ ID NO: 7491346 - DNA, 22 bp, Homo sapiens
attcatttgctattgtgtatgg

SEQ ID NO: 7491347 - DNA, 22 bp, Homo sapiens
attcatttgctattgtgtatgg

SEQ ID NO: 7491348 - DNA, 22 bp, Homo sapiens
attcatttgctattgtgtatgg

SEQ ID NO: 7491349 - DNA, 22 bp, Homo sapiens
attcatttgctattgtgtatgg

SEQ ID NO: 7491350 - DNA, 22 bp, Homo sapiens
attcatttgctattgtgtatgg

SEQ ID NO: 7491351 - DNA, 22 bp, Homo sapiens
agaggctagagatctgtcctac

SEQ ID NO: 7491352 - DNA, 22 bp, Homo sapiens
agaggctaggaccatgtatcat

SEQ ID NO: 7491353 - DNA, 22 bp, Homo sapiens
agaggctaggaccatgtatcat

SEQ ID NO: 7491354 - DNA, 22 bp, Homo sapiens
agaggctcactcttggaaccca

SEQ ID NO: 7491355 - DNA, 22 bp, Homo sapiens
agaggctcagaggcctggtcct

SEQ ID NO: 7491356 - DNA, 22 bp, Homo sapiens
agaggctcagaggcctggtcct

SEQ ID NO: 7491357 - DNA, 22 bp, Homo sapiens
agaggctcagaggcctggtcct

SEQ ID NO: 7491358 - DNA, 23 bp, Homo sapiens
agaggctcagcgtccacctctac

SEQ ID NO: 7491359 - DNA, 22 bp, Homo sapiens
agaggctcctcggtgcctcgtg

SEQ ID NO: 7491360 - DNA, 22 bp, Homo sapiens
agaggctccaccttctctgtcc

SEQ ID NO: 7491361 - DNA, 16 bp, Homo sapiens
agaggctcctccttgc

SEQ ID NO: 7491362 - DNA, 22 bp, Homo sapiens
agaggctcctagccactggctt

SEQ ID NO: 7491363 - DNA, 22 bp, Homo sapiens
agaggctccaccttctctgtcc

SEQ ID NO: 7491364 - DNA, 22 bp, Homo sapiens
agaggctccaccttctctgtcc

SEQ ID NO: 7491365 - DNA, 22 bp, Homo sapiens
agaggctccgtcatccctcttt

SEQ ID NO: 7491366 - DNA, 21 bp, Homo sapiens
agaggcggggttttggaggcc

SEQ ID NO: 7491367 - DNA, 22 bp, Homo sapiens
agaggcggaggttgcagtgagc

SEQ ID NO: 7491368 - DNA, 21 bp, Homo sapiens
agaggcggggttttggaggcc

SEQ ID NO: 7491369 - DNA, 21 bp, Homo sapiens
agaggcggggttttggaggcc

SEQ ID NO: 7491370 - DNA, 22 bp, Homo sapiens
agaggcggaggttgcagtgagc

SEQ ID NO: 7491371 - DNA, 22 bp, Homo sapiens
agaggcggaggttgcagtgagc

SEQ ID NO: 7491372 - DNA, 22 bp, Homo sapiens
agaggcggaggttgcagtgagc

SEQ ID NO: 7491373 - DNA, 22 bp, Homo sapiens
agaggcggaggttgcagtgagc

SEQ ID NO: 7491374 - DNA, 22 bp, Homo sapiens
agaggcggagcttgcagtgagc

SEQ ID NO: 7491375 - DNA, 22 bp, Homo sapiens
agaggcggagcttgcagtgagc

SEQ ID NO: 7491376 - DNA, 22 bp, Homo sapiens
agaggcgcagactcttgagtgt

SEQ ID NO: 7491377 - DNA, 22 bp, Homo sapiens
agaggcgcagactcttgagtgt

SEQ ID NO: 7491378 - DNA, 22 bp, Homo sapiens
agaggcggagcttgcagtgagc

SEQ ID NO: 7491379 - DNA, 22 bp, Homo sapiens
agaggcggagcttgcagtgagc

SEQ ID NO: 7491380 - DNA, 22 bp, Homo sapiens
agaggcctttctgttgagtgaa

SEQ ID NO: 7491381 - DNA, 22 bp, Homo sapiens
agaggcggagcttgcagtgagc

SEQ ID NO: 7491382 - DNA, 16 bp, Homo sapiens
agaggccttgaggaag

SEQ ID NO: 7491383 - DNA, 22 bp, Homo sapiens
agaggcctttgggcaacatccc

SEQ ID NO: 7491384 - DNA, 22 bp, Homo sapiens
attgataaattgcaatggggct

SEQ ID NO: 7491385 - DNA, 22 bp, Homo sapiens
attgataaattgcaatggggct

SEQ ID NO: 7491386 - DNA, 22 bp, Homo sapiens
attgataaattgcaatggggct

SEQ ID NO: 7491387 - DNA, 22 bp, Homo sapiens
attgcaggcaaagtgctgtgtc

SEQ ID NO: 7491388 - DNA, 22 bp, Homo sapiens
attgcagctggtcagggtaatt

SEQ ID NO: 7491389 - DNA, 22 bp, Homo sapiens
attgaggtcccagaaaggactg

SEQ ID NO: 7491390 - DNA, 22 bp, Homo sapiens
attcccacatgtcgtgggaggg

SEQ ID NO: 7491391 - DNA, 22 bp, Homo sapiens
attcccacacttgaagccctct

SEQ ID NO: 7491392 - DNA, 22 bp, Homo sapiens
attcccacagctggtataaata

SEQ ID NO: 7491393 - DNA, 22 bp, Homo sapiens
attcccaccaacaatgtacagg

SEQ ID NO: 7491394 - DNA, 22 bp, Homo sapiens
attcccaccaagcaggccatgc

SEQ ID NO: 7491395 - DNA, 22 bp, Homo sapiens
attccattgtatgtgtagacta

SEQ ID NO: 7491396 - DNA, 22 bp, Homo sapiens
attccattgtgtaaggatatcg

SEQ ID NO: 7491397 - DNA, 22 bp, Homo sapiens
attccatttacaaggactagat

SEQ ID NO: 7491398 - DNA, 22 bp, Homo sapiens
attccatttgtgtggaatggct

SEQ ID NO: 7491399 - DNA, 22 bp, Homo sapiens
attcccacaatgtgtgcttcat

SEQ ID NO: 7491400 - DNA, 22 bp, Homo sapiens
attgcaggatacccaggtagag

SEQ ID NO: 7491401 - DNA, 22 bp, Homo sapiens
attgcagggactcaataagaat

SEQ ID NO: 7491402 - DNA, 22 bp, Homo sapiens
attgcaggctctgacaccaggc

SEQ ID NO: 7491403 - DNA, 22 bp, Homo sapiens
attgcagggaggcaggtagatg

SEQ ID NO: 7491404 - DNA, 22 bp, Homo sapiens
attgcagtgatggttgcataat

SEQ ID NO: 7491405 - DNA, 22 bp, Homo sapiens
attgcagtgtgtgttccatgag

SEQ ID NO: 7491406 - DNA, 22 bp, Homo sapiens
attgcagtgtgtgttccatgag

SEQ ID NO: 7491407 - DNA, 22 bp, Homo sapiens
attgcagtgatggttgcataat

SEQ ID NO: 7491408 - DNA, 22 bp, Homo sapiens
attgcagggtccctgccatcgg

SEQ ID NO: 7491409 - DNA, 22 bp, Homo sapiens
attgcaggttgcatttgtttat

SEQ ID NO: 7491410 - DNA, 22 bp, Homo sapiens
attgcatatgcagcacatcagg

SEQ ID NO: 7491411 - DNA, 22 bp, Homo sapiens
attgcatgacatatccacttgt

SEQ ID NO: 7491412 - DNA, 22 bp, Homo sapiens
attgcatatgcagcacatcagg

SEQ ID NO: 7491413 - DNA, 22 bp, Homo sapiens
attgcagtgttgcctggggcct

SEQ ID NO: 7491414 - DNA, 20 bp, Homo sapiens
attgcagttggacctgtctc

SEQ ID NO: 7491415 - DNA, 22 bp, Homo sapiens
attgcagtgtgtgttccatgag

SEQ ID NO: 7491416 - DNA, 22 bp, Homo sapiens
attgcagtgttgcctggggcct

SEQ ID NO: 7491417 - DNA, 22 bp, Homo sapiens
attgcattgcagctagattttg

SEQ ID NO: 7491418 - DNA, 22 bp, Homo sapiens
attgcattcattgacatatgag

SEQ ID NO: 7491419 - DNA, 22 bp, Homo sapiens
attgcattacatgatgaaggag

SEQ ID NO: 7491420 - DNA, 22 bp, Homo sapiens
attccagtgtgcttccttgcta

SEQ ID NO: 7491421 - DNA, 22 bp, Homo sapiens
attccagttagtggcagcttat

SEQ ID NO: 7491422 - DNA, 22 bp, Homo sapiens
attccagtgtgcatggtacaca

SEQ ID NO: 7491423 - DNA, 22 bp, Homo sapiens
attccagtgtgcttccttgcta

SEQ ID NO: 7491424 - DNA, 21 bp, Homo sapiens
attccagtataagcctctttg

SEQ ID NO: 7491425 - DNA, 21 bp, Homo sapiens
attccagtataagcctctttg

SEQ ID NO: 7491426 - DNA, 22 bp, Homo sapiens
attccaggttgtagaaaagttt

SEQ ID NO: 7491427 - DNA, 22 bp, Homo sapiens
attccagtccaaatgttttcct

SEQ ID NO: 7491428 - DNA, 22 bp, Homo sapiens
attccaggttgtagaaaagttt

SEQ ID NO: 7491429 - DNA, 22 bp, Homo sapiens
attccaggcatgcaggaacaag

SEQ ID NO: 7491430 - DNA, 22 bp, Homo sapiens
attccaggcatgcaggaacaag

SEQ ID NO: 7491431 - DNA, 22 bp, Homo sapiens
attccaggttgtagaaaagttt

SEQ ID NO: 7491432 - DNA, 22 bp, Homo sapiens
attccagttctcctctctaaag

SEQ ID NO: 7491433 - DNA, 22 bp, Homo sapiens
attccagttctcctctctaaag

SEQ ID NO: 7491434 - DNA, 22 bp, Homo sapiens
attccagttgggttctaataca

SEQ ID NO: 7491435 - DNA, 22 bp, Homo sapiens
attccagttgggttctaataca

SEQ ID NO: 7491436 - DNA, 22 bp, Homo sapiens
attccattacagatcttttcct

SEQ ID NO: 7491437 - DNA, 22 bp, Homo sapiens
attccattgtatgtgtagacta

SEQ ID NO: 7491438 - DNA, 22 bp, Homo sapiens
attccattgtatgtgtagacta

SEQ ID NO: 7491439 - DNA, 22 bp, Homo sapiens
attccattcttgcttttgatct

SEQ ID NO: 7491440 - DNA, 22 bp, Homo sapiens
attccattgtatgtgtagacta

SEQ ID NO: 7491441 - DNA, 22 bp, Homo sapiens
attccattgtgtaaggatatcg

SEQ ID NO: 7491442 - DNA, 22 bp, Homo sapiens
attccagatgttactgaaaggc

SEQ ID NO: 7491443 - DNA, 22 bp, Homo sapiens
attccagatgttactgaaaggc

SEQ ID NO: 7491444 - DNA, 22 bp, Homo sapiens
attccagatggcttcaagtaag

SEQ ID NO: 7491445 - DNA, 22 bp, Homo sapiens
attccagatgttactgaaaggc

SEQ ID NO: 7491446 - DNA, 22 bp, Homo sapiens
attccagatgttactgaaaggc

SEQ ID NO: 7491447 - DNA, 22 bp, Homo sapiens
attccagatgttactgaaaggc

SEQ ID NO: 7491448 - DNA, 22 bp, Homo sapiens
attccagatgttactgaaaggc

SEQ ID NO: 7491449 - DNA, 22 bp, Homo sapiens
attccaggaagtgtgggaccaa

SEQ ID NO: 7491450 - DNA, 22 bp, Homo sapiens
attccaggactaaaggaacagc

SEQ ID NO: 7491451 - DNA, 22 bp, Homo sapiens
attccaggactaaaggaacagc

SEQ ID NO: 7491452 - DNA, 22 bp, Homo sapiens
attccaggaagtgtgggaccaa

SEQ ID NO: 7491453 - DNA, 22 bp, Homo sapiens
attccaggcagaccagagagat

SEQ ID NO: 7491454 - DNA, 22 bp, Homo sapiens
attccaggcaaagcagagaaga

SEQ ID NO: 7491455 - DNA, 22 bp, Homo sapiens
attccaggcaaagcagagaaga

SEQ ID NO: 7491456 - DNA, 22 bp, Homo sapiens
attccaggcagaccagagagat

SEQ ID NO: 7491457 - DNA, 22 bp, Homo sapiens
attccaggattccaggacaaat

SEQ ID NO: 7491458 - DNA, 22 bp, Homo sapiens
attccaggagctaactgtggtc

SEQ ID NO: 7491459 - DNA, 22 bp, Homo sapiens
attccaggagctaactgtggtc

SEQ ID NO: 7491460 - DNA, 22 bp, Homo sapiens
attccaggattccaggacaaat

SEQ ID NO: 7491461 - DNA, 22 bp, Homo sapiens
attccaggattccaggacaaat

SEQ ID NO: 7491462 - DNA, 22 bp, Homo sapiens
attccaggattccaggacaaat

SEQ ID NO: 7491463 - DNA, 22 bp, Homo sapiens
attccaggattccaggacaaat

SEQ ID NO: 7491464 - DNA, 22 bp, Homo sapiens
attccaggcaaagcagagaaga

SEQ ID NO: 7491465 - DNA, 22 bp, Homo sapiens
attccaggcaaagcagagaaga

SEQ ID NO: 7491466 - DNA, 21 bp, Homo sapiens
agagggagagtggcccttcca

SEQ ID NO: 7491467 - DNA, 22 bp, Homo sapiens
agagggagaagctaaaataact

SEQ ID NO: 7491468 - DNA, 21 bp, Homo sapiens
agagggagagtggcccttcca

SEQ ID NO: 7491469 - DNA, 21 bp, Homo sapiens
agagggagagtggcccttcca

SEQ ID NO: 7491470 - DNA, 21 bp, Homo sapiens
agagggagagtggcccttcca

SEQ ID NO: 7491471 - DNA, 21 bp, Homo sapiens
agagggagagtggcccttcca

SEQ ID NO: 7491472 - DNA, 21 bp, Homo sapiens
agagggagagtggcccttcca

SEQ ID NO: 7491473 - DNA, 22 bp, Homo sapiens
attccagaataccggcaagatg

SEQ ID NO: 7491474 - DNA, 22 bp, Homo sapiens
attccagaataccggcaagatg

SEQ ID NO: 7491475 - DNA, 22 bp, Homo sapiens
attccagacaggtaaattaggt

SEQ ID NO: 7491476 - DNA, 22 bp, Homo sapiens
attccagaataccggcaagatg

SEQ ID NO: 7491477 - DNA, 22 bp, Homo sapiens
attccagaataccggcaagatg

SEQ ID NO: 7491478 - DNA, 22 bp, Homo sapiens
attccagacaggtaaattaggt

SEQ ID NO: 7491479 - DNA, 22 bp, Homo sapiens
attccagacaggtaaattaggt

SEQ ID NO: 7491480 - DNA, 22 bp, Homo sapiens
attccagacaggtaaattaggt

SEQ ID NO: 7491481 - DNA, 22 bp, Homo sapiens
attccagagaaaggcctggctg

SEQ ID NO: 7491482 - DNA, 22 bp, Homo sapiens
attccagagaaaggcctggctg

SEQ ID NO: 7491483 - DNA, 22 bp, Homo sapiens
attccagagaggttctggaggt

SEQ ID NO: 7491484 - DNA, 22 bp, Homo sapiens
attccagagaggttctggaggt

SEQ ID NO: 7491485 - DNA, 22 bp, Homo sapiens
attccagacaggtaaattaggt

SEQ ID NO: 7491486 - DNA, 22 bp, Homo sapiens
attccagagaggttctggaggt

SEQ ID NO: 7491487 - DNA, 22 bp, Homo sapiens
attccagagaggttctggaggt

SEQ ID NO: 7491488 - DNA, 23 bp, Homo sapiens
attccagagctagagtcaagtgg

SEQ ID NO: 7491489 - DNA, 22 bp, Homo sapiens
attccagagaggttctggaggt

SEQ ID NO: 7491490 - DNA, 23 bp, Homo sapiens
attccagagctagagtcaagtgg

SEQ ID NO: 7491491 - DNA, 23 bp, Homo sapiens
attccagagctagagtcaagtgg

SEQ ID NO: 7491492 - DNA, 22 bp, Homo sapiens
attccagatgcttgtatttaaa

SEQ ID NO: 7491493 - DNA, 22 bp, Homo sapiens
attccagatggcttcaagtaag

SEQ ID NO: 7491494 - DNA, 22 bp, Homo sapiens
attccagatggcttcaagtaag

SEQ ID NO: 7491495 - DNA, 22 bp, Homo sapiens
attccagatggcttcaagtaag

SEQ ID NO: 7491496 - DNA, 22 bp, Homo sapiens
attccagatgaattgcatagtt

SEQ ID NO: 7491497 - DNA, 22 bp, Homo sapiens
attccagatggcttcaagtaag

SEQ ID NO: 7491498 - DNA, 22 bp, Homo sapiens
attccagatgaattgcatagtt

SEQ ID NO: 7491499 - DNA, 22 bp, Homo sapiens
attccagatgaattgcatagtt

SEQ ID NO: 7491500 - DNA, 22 bp, Homo sapiens
attccagaggggattcccggcc

SEQ ID NO: 7491501 - DNA, 22 bp, Homo sapiens
attccagatgaattgcatagtt

SEQ ID NO: 7491502 - DNA, 22 bp, Homo sapiens
attccagatgaattgcatagtt

SEQ ID NO: 7491503 - DNA, 22 bp, Homo sapiens
attccagatgaattgcatagtt

SEQ ID NO: 7491504 - DNA, 22 bp, Homo sapiens
agagggagaaaagaatcagttg

SEQ ID NO: 7491505 - DNA, 22 bp, Homo sapiens
agagggagaaaagaatcagttg

SEQ ID NO: 7491506 - DNA, 22 bp, Homo sapiens
agagggagaaaagaatcagttg

SEQ ID NO: 7491507 - DNA, 22 bp, Homo sapiens
agagggagaaaagaatcagttg

SEQ ID NO: 7491508 - DNA, 22 bp, Homo sapiens
agagggagaaaagaatcagttg

SEQ ID NO: 7491509 - DNA, 22 bp, Homo sapiens
agagggagaaaagaatcagttg

SEQ ID NO: 7491510 - DNA, 22 bp, Homo sapiens
agagggagaaaagaatcagttg

SEQ ID NO: 7491511 - DNA, 22 bp, Homo sapiens
agagggagaaaagaatcagttg

SEQ ID NO: 7491512 - DNA, 22 bp, Homo sapiens
agagggaatgtgattgcaccat

SEQ ID NO: 7491513 - DNA, 22 bp, Homo sapiens
agagggacaataagataaaatg

SEQ ID NO: 7491514 - DNA, 22 bp, Homo sapiens
agagggaatgtgattgcaccat

SEQ ID NO: 7491515 - DNA, 22 bp, Homo sapiens
agagggaatgtgattgcaccat

SEQ ID NO: 7491516 - DNA, 18 bp, Homo sapiens
agagggaatcagttggat

SEQ ID NO: 7491517 - DNA, 22 bp, Homo sapiens
agagggaatgtgattgcaccat

SEQ ID NO: 7491518 - DNA, 22 bp, Homo sapiens
agagggagaagctaaaataact

SEQ ID NO: 7491519 - DNA, 22 bp, Homo sapiens
agagggagaaaagaatcagttg

SEQ ID NO: 7491520 - DNA, 22 bp, Homo sapiens
agagggagaagctaaaataact

SEQ ID NO: 7491521 - DNA, 22 bp, Homo sapiens
agagggagaagctaaaataact

SEQ ID NO: 7491522 - DNA, 22 bp, Homo sapiens
agagggagaaaagaatcagttg

SEQ ID NO: 7491523 - DNA, 21 bp, Homo sapiens
agagggagagtggcccttcca

SEQ ID NO: 7491524 - DNA, 21 bp, Homo sapiens
agagggagagtggcccttcca

SEQ ID NO: 7491525 - DNA, 22 bp, Homo sapiens
agagggagaagctaaaataact

SEQ ID NO: 7491526 - DNA, 22 bp, Homo sapiens
agagggagaagctaaaataact

SEQ ID NO: 7491527 - DNA, 22 bp, Homo sapiens
agaggctgtctcatattttgta

SEQ ID NO: 7491528 - DNA, 22 bp, Homo sapiens
agaggctgtctcatattttgta

SEQ ID NO: 7491529 - DNA, 22 bp, Homo sapiens
agaggctgtgcagagggagtgc

SEQ ID NO: 7491530 - DNA, 22 bp, Homo sapiens
agaggctgtgcagagggagtgc

SEQ ID NO: 7491531 - DNA, 22 bp, Homo sapiens
agaggctgtgcagagggagtgc

SEQ ID NO: 7491532 - DNA, 22 bp, Homo sapiens
agaggctgtgcagagggagtgc

SEQ ID NO: 7491533 - DNA, 22 bp, Homo sapiens
agaggctgtgcagagggagtgc

SEQ ID NO: 7491534 - DNA, 22 bp, Homo sapiens
agagggaaaaactcatgtcatt

SEQ ID NO: 7491535 - DNA, 22 bp, Homo sapiens
agagggaaaaactcatgtcatt

SEQ ID NO: 7491536 - DNA, 18 bp, Homo sapiens
agagggaaagcaggctga

SEQ ID NO: 7491537 - DNA, 18 bp, Homo sapiens
agagggaaagcaggctga

SEQ ID NO: 7491538 - DNA, 18 bp, Homo sapiens
agagggaaagcaggctga

SEQ ID NO: 7491539 - DNA, 18 bp, Homo sapiens
agagggaaagcaggctga

SEQ ID NO: 7491540 - DNA, 18 bp, Homo sapiens
agagggaaagcaggctga

SEQ ID NO: 7491541 - DNA, 18 bp, Homo sapiens
agagggaaagcaggctga

SEQ ID NO: 7491542 - DNA, 17 bp, Homo sapiens
agagggaaaatgcggtt

SEQ ID NO: 7491543 - DNA, 17 bp, Homo sapiens
agagggaaaatgcggtt

SEQ ID NO: 7491544 - DNA, 17 bp, Homo sapiens
agagggaaaatgcggtt

SEQ ID NO: 7491545 - DNA, 17 bp, Homo sapiens
agagggaaaatgcggtt

SEQ ID NO: 7491546 - DNA, 17 bp, Homo sapiens
agagggaaaatgcggtt

SEQ ID NO: 7491547 - DNA, 22 bp, Homo sapiens
agagggaaaaactcatgtcatt

SEQ ID NO: 7491548 - DNA, 22 bp, Homo sapiens
agagggaaaaactcatgtcatt

SEQ ID NO: 7491549 - DNA, 22 bp, Homo sapiens
agagggaaatccaggagtgctt

SEQ ID NO: 7491550 - DNA, 22 bp, Homo sapiens
agagggaaatccaggagtgctt

SEQ ID NO: 7491551 - DNA, 22 bp, Homo sapiens
agagggaaatccaggagtgctt

SEQ ID NO: 7491552 - DNA, 22 bp, Homo sapiens
agagggaaatccaggagtgctt

SEQ ID NO: 7491553 - DNA, 22 bp, Homo sapiens
agagggaaatccaggagtgctt

SEQ ID NO: 7491554 - DNA, 22 bp, Homo sapiens
agagggaaatccaggagtgctt

SEQ ID NO: 7491555 - DNA, 18 bp, Homo sapiens
agagggaaagcaggctga

SEQ ID NO: 7491556 - DNA, 18 bp, Homo sapiens
agagggaaagcaggctga

SEQ ID NO: 7491557 - DNA, 22 bp, Homo sapiens
agagggaaatccaggagtgctt

SEQ ID NO: 7491558 - DNA, 18 bp, Homo sapiens
agagggaaagcaggctga

SEQ ID NO: 7491559 - DNA, 18 bp, Homo sapiens
agagggaatcagttggat

SEQ ID NO: 7491560 - DNA, 18 bp, Homo sapiens
agagggaatcagttggat

SEQ ID NO: 7491561 - DNA, 18 bp, Homo sapiens
agagggaatcagttggat

SEQ ID NO: 7491562 - DNA, 22 bp, Homo sapiens
agagggaaggacagatgtttca

SEQ ID NO: 7491563 - DNA, 22 bp, Homo sapiens
agagggaaggacagatgtttca

SEQ ID NO: 7491564 - DNA, 22 bp, Homo sapiens
agagggaaatccaggagtgctt

SEQ ID NO: 7491565 - DNA, 22 bp, Homo sapiens
agagggaaatccaggagtgctt

SEQ ID NO: 7491566 - DNA, 22 bp, Homo sapiens
agagggaacggatcccagcgcg

SEQ ID NO: 7491567 - DNA, 22 bp, Homo sapiens
agagggaacggatcccagcgcg

SEQ ID NO: 7491568 - DNA, 22 bp, Homo sapiens
agagggaacggatcccagcgcg

SEQ ID NO: 7491569 - DNA, 22 bp, Homo sapiens
atgaaagtggcttgattaaatg

SEQ ID NO: 7491570 - DNA, 22 bp, Homo sapiens
atgaaagtgaaggtttactaag

SEQ ID NO: 7491571 - DNA, 22 bp, Homo sapiens
atgaaagtgaaggtttactaag

SEQ ID NO: 7491572 - DNA, 23 bp, Homo sapiens
atgaaagttcttaaaatgtcatg

SEQ ID NO: 7491573 - DNA, 22 bp, Homo sapiens
atgaaagtgtttaagtttatgt

SEQ ID NO: 7491574 - DNA, 22 bp, Homo sapiens
atgaaagtgtttaagtttatgt

SEQ ID NO: 7491575 - DNA, 22 bp, Homo sapiens
atgaaagtgtttaagtttatgt

SEQ ID NO: 7491576 - DNA, 22 bp, Homo sapiens
atgaaagtgtttaagtttatgt

SEQ ID NO: 7491577 - DNA, 22 bp, Homo sapiens
atgaaagtagggtaaaatcaca

SEQ ID NO: 7491578 - DNA, 22 bp, Homo sapiens
atgaaagtagggtaaaatcaca

SEQ ID NO: 7491579 - DNA, 22 bp, Homo sapiens
atgaaagtacctgtaatatgtt

SEQ ID NO: 7491580 - DNA, 22 bp, Homo sapiens
atgaaagtacctgtaatatgtt

SEQ ID NO: 7491581 - DNA, 22 bp, Homo sapiens
atgaaagtagggtaaaatcaca

SEQ ID NO: 7491582 - DNA, 22 bp, Homo sapiens
atgaaagtgaaggtttactaag

SEQ ID NO: 7491583 - DNA, 22 bp, Homo sapiens
atgaaagtagggtaaaatcaca

SEQ ID NO: 7491584 - DNA, 22 bp, Homo sapiens
atgaaagctcagtgcactgaca

SEQ ID NO: 7491585 - DNA, 22 bp, Homo sapiens
atgaaagtacctgtaatatgtt

SEQ ID NO: 7491586 - DNA, 22 bp, Homo sapiens
atgaaagcaggaattgttctgt

SEQ ID NO: 7491587 - DNA, 22 bp, Homo sapiens
atgaaagctcagtgcactgaca

SEQ ID NO: 7491588 - DNA, 22 bp, Homo sapiens
atgaaagtacctgtaatatgtt

SEQ ID NO: 7491589 - DNA, 22 bp, Homo sapiens
atgaaagtacctgtaatatgtt

SEQ ID NO: 7491590 - DNA, 22 bp, Homo sapiens
atgaaagatgatttaaagtact

SEQ ID NO: 7491591 - DNA, 22 bp, Homo sapiens
atgaaagatgatttaaagtact

SEQ ID NO: 7491592 - DNA, 22 bp, Homo sapiens
atgaaagatgatttaaagtact

SEQ ID NO: 7491593 - DNA, 22 bp, Homo sapiens
atgaaactgggataactatagc

SEQ ID NO: 7491594 - DNA, 22 bp, Homo sapiens
atgaaagatgatttaaagtact

SEQ ID NO: 7491595 - DNA, 22 bp, Homo sapiens
atgaaactgaaggacaaccaga

SEQ ID NO: 7491596 - DNA, 22 bp, Homo sapiens
atgaaactgggataactatagc

SEQ ID NO: 7491597 - DNA, 22 bp, Homo sapiens
atgaaactgggataactatagc

SEQ ID NO: 7491598 - DNA, 22 bp, Homo sapiens
atgaaagcacgtgggaagataa

SEQ ID NO: 7491599 - DNA, 22 bp, Homo sapiens
atgaaagcacgtgggaagataa

SEQ ID NO: 7491600 - DNA, 22 bp, Homo sapiens
atgaaagcaagaagtgagttga

SEQ ID NO: 7491601 - DNA, 22 bp, Homo sapiens
atgaaagcacgtgggaagataa

SEQ ID NO: 7491602 - DNA, 22 bp, Homo sapiens
atgaaagcaacttatttgagat

SEQ ID NO: 7491603 - DNA, 22 bp, Homo sapiens
atgaaagcacgtgggaagataa

SEQ ID NO: 7491604 - DNA, 22 bp, Homo sapiens
atgaaagcaacttatttgagat

SEQ ID NO: 7491605 - DNA, 22 bp, Homo sapiens
atgaaagcaagaagtgagttga

SEQ ID NO: 7491606 - DNA, 22 bp, Homo sapiens
atgaaagcaaattataggccat

SEQ ID NO: 7491607 - DNA, 22 bp, Homo sapiens
atgaaagcaacttatttgagat

SEQ ID NO: 7491608 - DNA, 22 bp, Homo sapiens
atgaaagatgatttaaagtact

SEQ ID NO: 7491609 - DNA, 22 bp, Homo sapiens
atgaaagatgatttaaagtact

SEQ ID NO: 7491610 - DNA, 22 bp, Homo sapiens
atgaaagatgatttaaagtact

SEQ ID NO: 7491611 - DNA, 22 bp, Homo sapiens
atgaaatttgctgctaagttcc

SEQ ID NO: 7491612 - DNA, 22 bp, Homo sapiens
atgaaatttgaccaattattta

SEQ ID NO: 7491613 - DNA, 22 bp, Homo sapiens
atgaaattttaattatacctct

SEQ ID NO: 7491614 - DNA, 22 bp, Homo sapiens
atgaaattttaattatacctct

SEQ ID NO: 7491615 - DNA, 22 bp, Homo sapiens
atgaaatttgctgctaagttcc

SEQ ID NO: 7491616 - DNA, 22 bp, Homo sapiens
atgaaatttgctgctaagttcc

SEQ ID NO: 7491617 - DNA, 22 bp, Homo sapiens
atgaaattttaattatacctct

SEQ ID NO: 7491618 - DNA, 22 bp, Homo sapiens
atgaaattttaattatacctct

SEQ ID NO: 7491619 - DNA, 22 bp, Homo sapiens
atgaacaataaaatagatcaca

SEQ ID NO: 7491620 - DNA, 22 bp, Homo sapiens
atgaacaataaaatagatcaca

SEQ ID NO: 7491621 - DNA, 22 bp, Homo sapiens
atgaacaataaaatagatcaca

SEQ ID NO: 7491622 - DNA, 22 bp, Homo sapiens
atgaacaataaaatagatcaca

SEQ ID NO: 7491623 - DNA, 22 bp, Homo sapiens
atgaaattgatcttgaactttt

SEQ ID NO: 7491624 - DNA, 22 bp, Homo sapiens
atgaaattgatcttgaactttt

SEQ ID NO: 7491625 - DNA, 22 bp, Homo sapiens
atgaaattgatcttgaactttt

SEQ ID NO: 7491626 - DNA, 22 bp, Homo sapiens
atgaaattgatcttgaactttt

SEQ ID NO: 7491627 - DNA, 22 bp, Homo sapiens
atgaaagtttgcattcctcagt

SEQ ID NO: 7491628 - DNA, 22 bp, Homo sapiens
atgaaagtttgcattcctcagt

SEQ ID NO: 7491629 - DNA, 23 bp, Homo sapiens
atgaaagttcttaaaatgtcatg

SEQ ID NO: 7491630 - DNA, 23 bp, Homo sapiens
atgaaagttcttaaaatgtcatg

SEQ ID NO: 7491631 - DNA, 23 bp, Homo sapiens
atgaaagttcttaaaatgtcatg

SEQ ID NO: 7491632 - DNA, 22 bp, Homo sapiens
atgaaatttgaccaattattta

SEQ ID NO: 7491633 - DNA, 22 bp, Homo sapiens
atgaaatttgaccaattattta

SEQ ID NO: 7491634 - DNA, 22 bp, Homo sapiens
atgaaattgatcttgaactttt

SEQ ID NO: 7491635 - DNA, 22 bp, Homo sapiens
atgaaattgatcttgaactttt

SEQ ID NO: 7491636 - DNA, 22 bp, Homo sapiens
atgaaatttgaccaattattta

SEQ ID NO: 7491637 - DNA, 22 bp, Homo sapiens
atgaaatttgaccaattattta

SEQ ID NO: 7491638 - DNA, 22 bp, Homo sapiens
agacaaattgggacattgtgtt

SEQ ID NO: 7491639 - DNA, 22 bp, Homo sapiens
agacaaattgggacattgtgtt

SEQ ID NO: 7491640 - DNA, 22 bp, Homo sapiens
agacaaattgggacattgtgtt

SEQ ID NO: 7491641 - DNA, 22 bp, Homo sapiens
agacaaattgggacattgtgtt

SEQ ID NO: 7491642 - DNA, 22 bp, Homo sapiens
agacaaattgggacattgtgtt

SEQ ID NO: 7491643 - DNA, 22 bp, Homo sapiens
agacaaattgggacattgtgtt

SEQ ID NO: 7491644 - DNA, 22 bp, Homo sapiens
agacaaatggtaattatgtcta

SEQ ID NO: 7491645 - DNA, 22 bp, Homo sapiens
agacaaatggtaattatgtcta

SEQ ID NO: 7491646 - DNA, 22 bp, Homo sapiens
agacaaatgaacaaatatgtga

SEQ ID NO: 7491647 - DNA, 22 bp, Homo sapiens
agacaaatggagtatgagcaac

SEQ ID NO: 7491648 - DNA, 22 bp, Homo sapiens
agacaaatggagtatgagcaac

SEQ ID NO: 7491649 - DNA, 22 bp, Homo sapiens
agacaaatggagtatgagcaac

SEQ ID NO: 7491650 - DNA, 22 bp, Homo sapiens
agacaaatggtaattatgtcta

SEQ ID NO: 7491651 - DNA, 22 bp, Homo sapiens
agacaaatggtaattatgtcta

SEQ ID NO: 7491652 - DNA, 22 bp, Homo sapiens
agacaaatggagtatgagcaac

SEQ ID NO: 7491653 - DNA, 22 bp, Homo sapiens
agacaaatggagtatgagcaac

SEQ ID NO: 7491654 - DNA, 22 bp, Homo sapiens
agacaaatggagtatgagcaac

SEQ ID NO: 7491655 - DNA, 22 bp, Homo sapiens
agacaaataactttttatgtcc

SEQ ID NO: 7491656 - DNA, 22 bp, Homo sapiens
agacaaataactttttatgtcc

SEQ ID NO: 7491657 - DNA, 22 bp, Homo sapiens
agacaaaggattaatgatgatg

SEQ ID NO: 7491658 - DNA, 22 bp, Homo sapiens
agacaaataactttttatgtcc

SEQ ID NO: 7491659 - DNA, 22 bp, Homo sapiens
agacaaatgaacaaatatgtga

SEQ ID NO: 7491660 - DNA, 22 bp, Homo sapiens
agacaaatgaacaaatatgtga

SEQ ID NO: 7491661 - DNA, 22 bp, Homo sapiens
agacaaataagtgctgggattt

SEQ ID NO: 7491662 - DNA, 22 bp, Homo sapiens
agacaaataagtgctgggattt

SEQ ID NO: 7491663 - DNA, 22 bp, Homo sapiens
agacaaataagtgctgggattt

SEQ ID NO: 7491664 - DNA, 22 bp, Homo sapiens
agacaaataactttttatgtcc

SEQ ID NO: 7491665 - DNA, 22 bp, Homo sapiens
agacaaatgaacaaatatgtga

SEQ ID NO: 7491666 - DNA, 22 bp, Homo sapiens
agacaaatgaacaaatatgtga

SEQ ID NO: 7491667 - DNA, 22 bp, Homo sapiens
agacaaatgaacaaatatgtga

SEQ ID NO: 7491668 - DNA, 22 bp, Homo sapiens
agacaaatgaacaaatatgtga

SEQ ID NO: 7491669 - DNA, 22 bp, Homo sapiens
agacaaaggattaatgatgatg

SEQ ID NO: 7491670 - DNA, 22 bp, Homo sapiens
agacaaaggattaatgatgatg

SEQ ID NO: 7491671 - DNA, 22 bp, Homo sapiens
agacaaaggattaatgatgatg

SEQ ID NO: 7491672 - DNA, 22 bp, Homo sapiens
agacaaaggattaatgatgatg

SEQ ID NO: 7491673 - DNA, 22 bp, Homo sapiens
agacaaagacagcatctcaggt

SEQ ID NO: 7491674 - DNA, 22 bp, Homo sapiens
agacaaagacagcatctcaggt

SEQ ID NO: 7491675 - DNA, 22 bp, Homo sapiens
agacaaaggattaatgatgatg

SEQ ID NO: 7491676 - DNA, 22 bp, Homo sapiens
agacaaaggattaatgatgatg

SEQ ID NO: 7491677 - DNA, 22 bp, Homo sapiens
agacaaaggattaatgatgatg

SEQ ID NO: 7491678 - DNA, 22 bp, Homo sapiens
agacaaaggattaatgatgatg

SEQ ID NO: 7491679 - DNA, 22 bp, Homo sapiens
atgaacaataatcatgtctatg

SEQ ID NO: 7491680 - DNA, 22 bp, Homo sapiens
atgaacaataatcatgtctatg

SEQ ID NO: 7491681 - DNA, 22 bp, Homo sapiens
atgaacaataatcatgtctatg

SEQ ID NO: 7491682 - DNA, 22 bp, Homo sapiens
atgaacaataatcatgtctatg

SEQ ID NO: 7491683 - DNA, 22 bp, Homo sapiens
atgaacaatctggcaagaactt

SEQ ID NO: 7491684 - DNA, 22 bp, Homo sapiens
atgaacaatctggcaagaactt

SEQ ID NO: 7491685 - DNA, 22 bp, Homo sapiens
atgaacaatctggcaagaactt

SEQ ID NO: 7491686 - DNA, 22 bp, Homo sapiens
atgaacaatctggcaagaactt

SEQ ID NO: 7491687 - DNA, 22 bp, Homo sapiens
atgaacaatctgttgacttctg

SEQ ID NO: 7491688 - DNA, 22 bp, Homo sapiens
atgaacaatctgttgacttctg

SEQ ID NO: 7491689 - DNA, 22 bp, Homo sapiens
atgaacaatgactacatattga

SEQ ID NO: 7491690 - DNA, 22 bp, Homo sapiens
atgaacaatgactacatattga

SEQ ID NO: 7491691 - DNA, 22 bp, Homo sapiens
atgaacaatgactacatattga

SEQ ID NO: 7491692 - DNA, 22 bp, Homo sapiens
atgaacaatgactacatattga

SEQ ID NO: 7491693 - DNA, 22 bp, Homo sapiens
atgaacaatgactacatattga

SEQ ID NO: 7491694 - DNA, 22 bp, Homo sapiens
atgaacaatgactacatattga

SEQ ID NO: 7491695 - DNA, 22 bp, Homo sapiens
atgaacaatgactacatattga

SEQ ID NO: 7491696 - DNA, 22 bp, Homo sapiens
agaattgctggaatttgcttta

SEQ ID NO: 7491697 - DNA, 20 bp, Homo sapiens
agaattcttaccctttgatg

SEQ ID NO: 7491698 - DNA, 22 bp, Homo sapiens
agaattcttggtggttagaata

SEQ ID NO: 7491699 - DNA, 22 bp, Homo sapiens
agaattcttggtggttagaata

SEQ ID NO: 7491700 - DNA, 22 bp, Homo sapiens
agacaaagaaaccgtagaagca

SEQ ID NO: 7491701 - DNA, 22 bp, Homo sapiens
agacaaagaaaccgtagaagca

SEQ ID NO: 7491702 - DNA, 22 bp, Homo sapiens
agacaaagaaaccgtagaagca

SEQ ID NO: 7491703 - DNA, 22 bp, Homo sapiens
agacaaagaaaccgtagaagca

SEQ ID NO: 7491704 - DNA, 22 bp, Homo sapiens
agacaaagaaaccgtagaagca

SEQ ID NO: 7491705 - DNA, 22 bp, Homo sapiens
agacaaagacagcatctcaggt

SEQ ID NO: 7491706 - DNA, 22 bp, Homo sapiens
agacaaagacagcatctcaggt

SEQ ID NO: 7491707 - DNA, 22 bp, Homo sapiens
agacaaagacagcatctcaggt

SEQ ID NO: 7491708 - DNA, 22 bp, Homo sapiens
agacaaaccttgttttatgatg

SEQ ID NO: 7491709 - DNA, 22 bp, Homo sapiens
agacaaaccttgttttatgatg

SEQ ID NO: 7491710 - DNA, 23 bp, Homo sapiens
agacaaacttccttcactgcacc

SEQ ID NO: 7491711 - DNA, 22 bp, Homo sapiens
agacaaaccttgttttatgatg

SEQ ID NO: 7491712 - DNA, 18 bp, Homo sapiens
agacaaacttcttctgcc

SEQ ID NO: 7491713 - DNA, 18 bp, Homo sapiens
agacaaacttcttctgcc

SEQ ID NO: 7491714 - DNA, 18 bp, Homo sapiens
agacaaacttcttctgcc

SEQ ID NO: 7491715 - DNA, 21 bp, Homo sapiens
agaagtccccactctgtcgca

SEQ ID NO: 7491716 - DNA, 22 bp, Homo sapiens
agaagtctattgatggcagtcc

SEQ ID NO: 7491717 - DNA, 22 bp, Homo sapiens
agaagtgaaactgcaaaagtgt

SEQ ID NO: 7491718 - DNA, 22 bp, Homo sapiens
agaagtctggaattcctgcagg

SEQ ID NO: 7491719 - DNA, 22 bp, Homo sapiens
agaagtcaccctgttgctgtga

SEQ ID NO: 7491720 - DNA, 22 bp, Homo sapiens
agaagtcaatgatgagagtgct

SEQ ID NO: 7491721 - DNA, 21 bp, Homo sapiens
agaagtcaattgaactgaaat

SEQ ID NO: 7491722 - DNA, 22 bp, Homo sapiens
agaagtcagccacagtgggaga

SEQ ID NO: 7491723 - DNA, 22 bp, Homo sapiens
agaagtcagccacagtgggaga

SEQ ID NO: 7491724 - DNA, 22 bp, Homo sapiens
agaagtcagccacagtgggaga

SEQ ID NO: 7491725 - DNA, 22 bp, Homo sapiens
agaagtcagccacagtgggaga

SEQ ID NO: 7491726 - DNA, 20 bp, Homo sapiens
agaagtcagctcagaagtga

SEQ ID NO: 7491727 - DNA, 20 bp, Homo sapiens
agaagtcagctcagaagtga

SEQ ID NO: 7491728 - DNA, 23 bp, Homo sapiens
agaagtggaatggccgtggggtc

SEQ ID NO: 7491729 - DNA, 23 bp, Homo sapiens
agaagtggaatggccgtggggtc

SEQ ID NO: 7491730 - DNA, 23 bp, Homo sapiens
agaagtggaatggccgtggggtc

SEQ ID NO: 7491731 - DNA, 22 bp, Homo sapiens
agaagtgctccagtgagttggg

SEQ ID NO: 7491732 - DNA, 22 bp, Homo sapiens
agaagtgccgaaaggaagacag

SEQ ID NO: 7491733 - DNA, 22 bp, Homo sapiens
agaagtgccgaaaggaagacag

SEQ ID NO: 7491734 - DNA, 22 bp, Homo sapiens
agaagtgccgaaaggaagacag

SEQ ID NO: 7491735 - DNA, 23 bp, Homo sapiens
agaagtggaatggccgtggggtc

SEQ ID NO: 7491736 - DNA, 22 bp, Homo sapiens
agaagtgctccagtgagttggg

SEQ ID NO: 7491737 - DNA, 22 bp, Homo sapiens
agaagtgctccagtgagttggg

SEQ ID NO: 7491738 - DNA, 22 bp, Homo sapiens
agaagtgctccagtgagttggg

SEQ ID NO: 7491739 - DNA, 22 bp, Homo sapiens
agaagtgccgaaaggaagacag

SEQ ID NO: 7491740 - DNA, 22 bp, Homo sapiens
agaagtgagttgtgactatggg

SEQ ID NO: 7491741 - DNA, 19 bp, Homo sapiens
agaagtgcatggtctagag

SEQ ID NO: 7491742 - DNA, 22 bp, Homo sapiens
agaagtgccatactgtggtcca

SEQ ID NO: 7491743 - DNA, 22 bp, Homo sapiens
agaagtgagtgtgactcagcag

SEQ ID NO: 7491744 - DNA, 22 bp, Homo sapiens
agaagtgagttgtgactatggg

SEQ ID NO: 7491745 - DNA, 22 bp, Homo sapiens
agaagtgagttgtgactatggg

SEQ ID NO: 7491746 - DNA, 22 bp, Homo sapiens
agaagtgagactcagttgatga

SEQ ID NO: 7491747 - DNA, 22 bp, Homo sapiens
agaagtgagactcagttgatga

SEQ ID NO: 7491748 - DNA, 22 bp, Homo sapiens
agaagtgagactcagttgatga

SEQ ID NO: 7491749 - DNA, 22 bp, Homo sapiens
agaagtgagactcagttgatga

SEQ ID NO: 7491750 - DNA, 22 bp, Homo sapiens
agaagtgagtgtgactcagcag

SEQ ID NO: 7491751 - DNA, 22 bp, Homo sapiens
agaagtgaggaaatcctcttta

SEQ ID NO: 7491752 - DNA, 22 bp, Homo sapiens
agaagtgaggaaatcctcttta

SEQ ID NO: 7491753 - DNA, 22 bp, Homo sapiens
agaagggaactcagagatgatt

SEQ ID NO: 7491754 - DNA, 22 bp, Homo sapiens
agaagtattctgcatgtactga

SEQ ID NO: 7491755 - DNA, 22 bp, Homo sapiens
agaagtattctgcatgtactga

SEQ ID NO: 7491756 - DNA, 22 bp, Homo sapiens
agaaggctttaagtactggcat

SEQ ID NO: 7491757 - DNA, 22 bp, Homo sapiens
agaaggctttaagtactggcat

SEQ ID NO: 7491758 - DNA, 22 bp, Homo sapiens
agaaggctttaagtactggcat

SEQ ID NO: 7491759 - DNA, 22 bp, Homo sapiens
agaaggctggccctgggtggcc

SEQ ID NO: 7491760 - DNA, 22 bp, Homo sapiens
atctcaggaggaccctgatgct

SEQ ID NO: 7491761 - DNA, 22 bp, Homo sapiens
agaaggctggccctgggtggcc

SEQ ID NO: 7491762 - DNA, 22 bp, Homo sapiens
agaaggctggccctgggtggcc

SEQ ID NO: 7491763 - DNA, 22 bp, Homo sapiens
agaaggcttaaaacatggaata

SEQ ID NO: 7491764 - DNA, 22 bp, Homo sapiens
agaaggcttaaaacatggaata

SEQ ID NO: 7491765 - DNA, 22 bp, Homo sapiens
agaagtcaatgatgagagtgct

SEQ ID NO: 7491766 - DNA, 22 bp, Homo sapiens
agaagtcaatgatgagagtgct

SEQ ID NO: 7491767 - DNA, 22 bp, Homo sapiens
agaagtcaagtggtctatgaaa

SEQ ID NO: 7491768 - DNA, 22 bp, Homo sapiens
agaagtcaagtggtctatgaaa

SEQ ID NO: 7491769 - DNA, 22 bp, Homo sapiens
agaagtatttggctaaaagaca

SEQ ID NO: 7491770 - DNA, 22 bp, Homo sapiens
agaagtatttggctaaaagaca

SEQ ID NO: 7491771 - DNA, 22 bp, Homo sapiens
agaagtcaagtggtctatgaaa

SEQ ID NO: 7491772 - DNA, 22 bp, Homo sapiens
agaagtatttggctaaaagaca

SEQ ID NO: 7491773 - DNA, 22 bp, Homo sapiens
agaagtattctgcatgtactga

SEQ ID NO: 7491774 - DNA, 22 bp, Homo sapiens
agaagtatttggctaaaagaca

SEQ ID NO: 7491775 - DNA, 16 bp, Homo sapiens
atctcaggagagtctt

SEQ ID NO: 7491776 - DNA, 22 bp, Homo sapiens
atctcagatctacagatctaca

SEQ ID NO: 7491777 - DNA, 22 bp, Homo sapiens
atctcaggaggaccctgatgct

SEQ ID NO: 7491778 - DNA, 22 bp, Homo sapiens
atctcaggaggaccctgatgct

SEQ ID NO: 7491779 - DNA, 22 bp, Homo sapiens
atctcaggaggaccctgatgct

SEQ ID NO: 7491780 - DNA, 22 bp, Homo sapiens
atctcagagaaatttgaatgca

SEQ ID NO: 7491781 - DNA, 22 bp, Homo sapiens
atctcagacatgttgtccatga

SEQ ID NO: 7491782 - DNA, 22 bp, Homo sapiens
atctcagagaaatttgaatgca

SEQ ID NO: 7491783 - DNA, 22 bp, Homo sapiens
atctcagatctacagatctaca

SEQ ID NO: 7491784 - DNA, 22 bp, Homo sapiens
atctcagatctacagatctaca

SEQ ID NO: 7491785 - DNA, 22 bp, Homo sapiens
atctcagaaagtttaatttttc

SEQ ID NO: 7491786 - DNA, 22 bp, Homo sapiens
atctcagacatgttgtccatga

SEQ ID NO: 7491787 - DNA, 22 bp, Homo sapiens
atctcagaaggcatttccaaga

SEQ ID NO: 7491788 - DNA, 22 bp, Homo sapiens
atctcagaaacatatctaatcc

SEQ ID NO: 7491789 - DNA, 22 bp, Homo sapiens
atctcagaaacatatctaatcc

SEQ ID NO: 7491790 - DNA, 22 bp, Homo sapiens
atctcagaaacatatctaatcc

SEQ ID NO: 7491791 - DNA, 22 bp, Homo sapiens
atctcagaaacatatctaatcc

SEQ ID NO: 7491792 - DNA, 22 bp, Homo sapiens
atctcaccaagttattacgaga

SEQ ID NO: 7491793 - DNA, 22 bp, Homo sapiens
agaagtttatttatgccccaat

SEQ ID NO: 7491794 - DNA, 22 bp, Homo sapiens
agaagtttcacaatgggtttta

SEQ ID NO: 7491795 - DNA, 22 bp, Homo sapiens
agaagtttcacaatgggtttta

SEQ ID NO: 7491796 - DNA, 22 bp, Homo sapiens
agaagtttctctgaacgtgtag

SEQ ID NO: 7491797 - DNA, 22 bp, Homo sapiens
agaagtttccagtctagtaagg

SEQ ID NO: 7491798 - DNA, 22 bp, Homo sapiens
agaagtttccagtctagtaagg

SEQ ID NO: 7491799 - DNA, 22 bp, Homo sapiens
agaagtttccagtctagtaagg

SEQ ID NO: 7491800 - DNA, 22 bp, Homo sapiens
agaagtttatttatgccccaat

SEQ ID NO: 7491801 - DNA, 22 bp, Homo sapiens
agaagttgttcaaggtggtgag

SEQ ID NO: 7491802 - DNA, 22 bp, Homo sapiens
agaagtttaaccaggtgctact

SEQ ID NO: 7491803 - DNA, 23 bp, Homo sapiens
agaagttcaagaccagcctgccc

SEQ ID NO: 7491804 - DNA, 22 bp, Homo sapiens
agaagttgtaggtttgcatatt

SEQ ID NO: 7491805 - DNA, 22 bp, Homo sapiens
agaagttgtaggtttgcatatt

SEQ ID NO: 7491806 - DNA, 22 bp, Homo sapiens
agaagttgttcaaggtggtgag

SEQ ID NO: 7491807 - DNA, 22 bp, Homo sapiens
agaagttatccaccttagatgc

SEQ ID NO: 7491808 - DNA, 22 bp, Homo sapiens
agaagttctctccaccttgggt

SEQ ID NO: 7491809 - DNA, 22 bp, Homo sapiens
agaagttatccaccttagatgc

SEQ ID NO: 7491810 - DNA, 19 bp, Homo sapiens
agaagttagacattgcaat

SEQ ID NO: 7491811 - DNA, 22 bp, Homo sapiens
agaagttaccacatacttctct

SEQ ID NO: 7491812 - DNA, 19 bp, Homo sapiens
agaagttagacattgcaat

SEQ ID NO: 7491813 - DNA, 22 bp, Homo sapiens
agaagtgtcagtgcaggcagct

SEQ ID NO: 7491814 - DNA, 22 bp, Homo sapiens
agaagtggtgtgtggccgagct

SEQ ID NO: 7491815 - DNA, 22 bp, Homo sapiens
agaagtggtgtgtggccgagct

SEQ ID NO: 7491816 - DNA, 22 bp, Homo sapiens
agaagtggtgtgtggccgagct

SEQ ID NO: 7491817 - DNA, 22 bp, Homo sapiens
agaagtggtctgtcttccagat

SEQ ID NO: 7491818 - DNA, 20 bp, Homo sapiens
agaagtggctgcagacacta

SEQ ID NO: 7491819 - DNA, 22 bp, Homo sapiens
agaagtggtgtgtggccgagct

SEQ ID NO: 7491820 - DNA, 22 bp, Homo sapiens
agaagtggtgtgtggccgagct

SEQ ID NO: 7491821 - DNA, 20 bp, Homo sapiens
agaagtggctgcagacacta

SEQ ID NO: 7491822 - DNA, 20 bp, Homo sapiens
agaagtggctgcagacacta

SEQ ID NO: 7491823 - DNA, 22 bp, Homo sapiens
agaagtggtctgtcttccagat

SEQ ID NO: 7491824 - DNA, 22 bp, Homo sapiens
agaagtggtctgtcttccagat

SEQ ID NO: 7491825 - DNA, 22 bp, Homo sapiens
agaagttaattcctgaaattct

SEQ ID NO: 7491826 - DNA, 22 bp, Homo sapiens
agaagttaattcctgaaattct

SEQ ID NO: 7491827 - DNA, 22 bp, Homo sapiens
agaagttaccacatacttctct

SEQ ID NO: 7491828 - DNA, 22 bp, Homo sapiens
agaagttaccacatacttctct

SEQ ID NO: 7491829 - DNA, 22 bp, Homo sapiens
agaagtgtttatttcagcaaca

SEQ ID NO: 7491830 - DNA, 22 bp, Homo sapiens
agaagtgtttatttcagcaaca

SEQ ID NO: 7491831 - DNA, 22 bp, Homo sapiens
agaagttaattcctgaaattct

SEQ ID NO: 7491832 - DNA, 22 bp, Homo sapiens
agaagtgtcagtgcaggcagct

SEQ ID NO: 7491833 - DNA, 22 bp, Homo sapiens
agaagtgtctcatcaggcaata

SEQ ID NO: 7491834 - DNA, 22 bp, Homo sapiens
agaagtgtctcatcaggcaata

SEQ ID NO: 7491835 - DNA, 22 bp, Homo sapiens
agaagtgtggtctagcagtggc

SEQ ID NO: 7491836 - DNA, 22 bp, Homo sapiens
agaagtttggtcctataaactc

SEQ ID NO: 7491837 - DNA, 22 bp, Homo sapiens
agaagtttggtcctataaactc

SEQ ID NO: 7491838 - DNA, 22 bp, Homo sapiens
agaagtttggtcctataaactc

SEQ ID NO: 7491839 - DNA, 22 bp, Homo sapiens
agaagtttggtcctataaactc

SEQ ID NO: 7491840 - DNA, 22 bp, Homo sapiens
agaagtttggtcctataaactc

SEQ ID NO: 7491841 - DNA, 22 bp, Homo sapiens
agaagtttggtcctataaactc

SEQ ID NO: 7491842 - DNA, 22 bp, Homo sapiens
agaagtttggtccttttcaagg

SEQ ID NO: 7491843 - DNA, 22 bp, Homo sapiens
agaagtttggtccttttcaagg

SEQ ID NO: 7491844 - DNA, 22 bp, Homo sapiens
agaagtttggtcctataaactc

SEQ ID NO: 7491845 - DNA, 22 bp, Homo sapiens
agaagtttggtccttttcaagg

SEQ ID NO: 7491846 - DNA, 22 bp, Homo sapiens
agaagtttggtccttttcaagg

SEQ ID NO: 7491847 - DNA, 22 bp, Homo sapiens
agaagtttggtcctataaactc

SEQ ID NO: 7491848 - DNA, 22 bp, Homo sapiens
agaagtttggtcctataaactc

SEQ ID NO: 7491849 - DNA, 22 bp, Homo sapiens
agaagtttctttgaacgtgtag

SEQ ID NO: 7491850 - DNA, 22 bp, Homo sapiens
agaagtttgaaattaggagaaa

SEQ ID NO: 7491851 - DNA, 22 bp, Homo sapiens
agaagtttgaaattaggagaaa

SEQ ID NO: 7491852 - DNA, 22 bp, Homo sapiens
agaagtttgaaattaggagaaa

SEQ ID NO: 7491853 - DNA, 22 bp, Homo sapiens
agaagtttgaaattaggagaaa

SEQ ID NO: 7491854 - DNA, 22 bp, Homo sapiens
agaagtttgctcacttgggaca

SEQ ID NO: 7491855 - DNA, 22 bp, Homo sapiens
agaagtttggatgccatcatag

SEQ ID NO: 7491856 - DNA, 20 bp, Homo sapiens
agaagtttgggggtgtggag

SEQ ID NO: 7491857 - DNA, 22 bp, Homo sapiens
agaagtttgggggcgaaggcag

SEQ ID NO: 7491858 - DNA, 22 bp, Homo sapiens
agaagtttggatgccatcatag

SEQ ID NO: 7491859 - DNA, 22 bp, Homo sapiens
atgaaactctaacttaacaagt

SEQ ID NO: 7491860 - DNA, 22 bp, Homo sapiens
atgaaactctaacttaacaagt

SEQ ID NO: 7491861 - DNA, 23 bp, Homo sapiens
atgaaactcaagccagatccaag

SEQ ID NO: 7491862 - DNA, 22 bp, Homo sapiens
atgaaactctaacttaacaagt

SEQ ID NO: 7491863 - DNA, 22 bp, Homo sapiens
atgaaactctaacttaacaagt

SEQ ID NO: 7491864 - DNA, 22 bp, Homo sapiens
atgaaactctaacttaacaagt

SEQ ID NO: 7491865 - DNA, 22 bp, Homo sapiens
atgaaactgaaggacaaccaga

SEQ ID NO: 7491866 - DNA, 22 bp, Homo sapiens
atgaaactgaaggacaaccaga

SEQ ID NO: 7491867 - DNA, 22 bp, Homo sapiens
atgaaactgaaggacaaccaga

SEQ ID NO: 7491868 - DNA, 22 bp, Homo sapiens
atgaaactgaaggacaaccaga

SEQ ID NO: 7491869 - DNA, 22 bp, Homo sapiens
atctttgttgctctcatttctg

SEQ ID NO: 7491870 - DNA, 22 bp, Homo sapiens
atgaaacatgctttgtggatga

SEQ ID NO: 7491871 - DNA, 22 bp, Homo sapiens
atgaaacatgctttgtggatga

SEQ ID NO: 7491872 - DNA, 23 bp, Homo sapiens
atgaaactcaagccagatccaag

SEQ ID NO: 7491873 - DNA, 23 bp, Homo sapiens
atgaaactcaagccagatccaag

SEQ ID NO: 7491874 - DNA, 22 bp, Homo sapiens
atgcacctgaactccatcagct

SEQ ID NO: 7491875 - DNA, 22 bp, Homo sapiens
atgcacctgaactccatcagct

SEQ ID NO: 7491876 - DNA, 22 bp, Homo sapiens
atgcacctgaactccatcagct

SEQ ID NO: 7491877 - DNA, 22 bp, Homo sapiens
atgcacctgaactccatcagct

SEQ ID NO: 7491878 - DNA, 22 bp, Homo sapiens
atgcacctgaactccatcagct

SEQ ID NO: 7491879 - DNA, 22 bp, Homo sapiens
atgcacctgaactccatcagct

SEQ ID NO: 7491880 - DNA, 22 bp, Homo sapiens
atgcacctgaactccatcagct

SEQ ID NO: 7491881 - DNA, 22 bp, Homo sapiens
atgcacctgaactccatcagct

SEQ ID NO: 7491882 - DNA, 22 bp, Homo sapiens
atgcacctgaactccatcagct

SEQ ID NO: 7491883 - DNA, 22 bp, Homo sapiens
atgcacctgaactccatcagct

SEQ ID NO: 7491884 - DNA, 22 bp, Homo sapiens
atgcacgccccacactggtgtg

SEQ ID NO: 7491885 - DNA, 22 bp, Homo sapiens
atgcactaaatcttttgtgcac

SEQ ID NO: 7491886 - DNA, 22 bp, Homo sapiens
atgcactgcccctctgcacctc

SEQ ID NO: 7491887 - DNA, 22 bp, Homo sapiens
atgcactgcccctctgcacctc

SEQ ID NO: 7491888 - DNA, 22 bp, Homo sapiens
atgcactgcccctctgcacctc

SEQ ID NO: 7491889 - DNA, 22 bp, Homo sapiens
atgcactacttggctttactga

SEQ ID NO: 7491890 - DNA, 22 bp, Homo sapiens
atgcactatgatgagctagtct

SEQ ID NO: 7491891 - DNA, 22 bp, Homo sapiens
atgcactacttggctttactga

SEQ ID NO: 7491892 - DNA, 22 bp, Homo sapiens
atgcactgggtgaggaaggaga

SEQ ID NO: 7491893 - DNA, 22 bp, Homo sapiens
atgcactgggccacagtatgac

SEQ ID NO: 7491894 - DNA, 22 bp, Homo sapiens
atgcactgggtgaggaaggaga

SEQ ID NO: 7491895 - DNA, 22 bp, Homo sapiens
atgcactgggtgaggaaggaga

SEQ ID NO: 7491896 - DNA, 22 bp, Homo sapiens
atgcactgtaagactagccatg

SEQ ID NO: 7491897 - DNA, 22 bp, Homo sapiens
atgcactgtaggtgccatctgc

SEQ ID NO: 7491898 - DNA, 22 bp, Homo sapiens
atgcactgtaagactagccatg

SEQ ID NO: 7491899 - DNA, 22 bp, Homo sapiens
atgcaccccagaagctgcagtg

SEQ ID NO: 7491900 - DNA, 22 bp, Homo sapiens
atgcaccccagaagctgcagtg

SEQ ID NO: 7491901 - DNA, 20 bp, Homo sapiens
atgcaccctcagggtccctg

SEQ ID NO: 7491902 - DNA, 22 bp, Homo sapiens
atgcaccccagaagctgcagtg

SEQ ID NO: 7491903 - DNA, 22 bp, Homo sapiens
atgcaccccagaagctgcagtg

SEQ ID NO: 7491904 - DNA, 22 bp, Homo sapiens
atgcacccatgtacatacacat

SEQ ID NO: 7491905 - DNA, 22 bp, Homo sapiens
atgcacccagtgtctggactat

SEQ ID NO: 7491906 - DNA, 22 bp, Homo sapiens
atgcacccagtgtctggactat

SEQ ID NO: 7491907 - DNA, 22 bp, Homo sapiens
atgcacatgtatgtcaatattt

SEQ ID NO: 7491908 - DNA, 22 bp, Homo sapiens
atgcacatgtatgtcaatattt

SEQ ID NO: 7491909 - DNA, 22 bp, Homo sapiens
atgcacattgtagccacacaat

SEQ ID NO: 7491910 - DNA, 22 bp, Homo sapiens
atgcacatgtggctttatgtat

SEQ ID NO: 7491911 - DNA, 22 bp, Homo sapiens
atgcacattgtagccacacaat

SEQ ID NO: 7491912 - DNA, 22 bp, Homo sapiens
atgcacatgtggctttatgtat

SEQ ID NO: 7491913 - DNA, 22 bp, Homo sapiens
atgcacatgaggcaagcaaaat

SEQ ID NO: 7491914 - DNA, 22 bp, Homo sapiens
atgcacatgaggcaagcaaaat

SEQ ID NO: 7491915 - DNA, 22 bp, Homo sapiens
atgcacatgaggcaagcaaaat

SEQ ID NO: 7491916 - DNA, 22 bp, Homo sapiens
atgcacatgaggcaagcaaaat

SEQ ID NO: 7491917 - DNA, 22 bp, Homo sapiens
atgcacatgaggcaagcaaaat

SEQ ID NO: 7491918 - DNA, 22 bp, Homo sapiens
atgcacatgtatctatatacaa

SEQ ID NO: 7491919 - DNA, 22 bp, Homo sapiens
atgcacatgtatgtcaatattt

SEQ ID NO: 7491920 - DNA, 22 bp, Homo sapiens
atgcacatgtatgtcaatattt

SEQ ID NO: 7491921 - DNA, 22 bp, Homo sapiens
atgcacatgtatctatatacaa

SEQ ID NO: 7491922 - DNA, 22 bp, Homo sapiens
atgcacatgtatctatatacaa

SEQ ID NO: 7491923 - DNA, 17 bp, Homo sapiens
atgcacatgtaagagga

SEQ ID NO: 7491924 - DNA, 22 bp, Homo sapiens
atgcacatgtatctatatacaa

SEQ ID NO: 7491925 - DNA, 22 bp, Homo sapiens
atgcacatgtatctatatacaa

SEQ ID NO: 7491926 - DNA, 17 bp, Homo sapiens
agacagacctctgcatc

SEQ ID NO: 7491927 - DNA, 17 bp, Homo sapiens
agacagacctctgcatc

SEQ ID NO: 7491928 - DNA, 17 bp, Homo sapiens
agacagacctctgcatc

SEQ ID NO: 7491929 - DNA, 17 bp, Homo sapiens
agacagacctctgcatc

SEQ ID NO: 7491930 - DNA, 17 bp, Homo sapiens
agacagacctctgcatc

SEQ ID NO: 7491931 - DNA, 17 bp, Homo sapiens
agacagacctctgcatc

SEQ ID NO: 7491932 - DNA, 17 bp, Homo sapiens
agacagacctctgcatc

SEQ ID NO: 7491933 - DNA, 17 bp, Homo sapiens
agacagacctctgcatc

SEQ ID NO: 7491934 - DNA, 22 bp, Homo sapiens
agacagacggctttatacacag

SEQ ID NO: 7491935 - DNA, 22 bp, Homo sapiens
agacagacggctttatacacag

SEQ ID NO: 7491936 - DNA, 22 bp, Homo sapiens
agacagacggctttatacacag

SEQ ID NO: 7491937 - DNA, 21 bp, Homo sapiens
agacagactgcctgacccacg

SEQ ID NO: 7491938 - DNA, 21 bp, Homo sapiens
agacagactgcctgacccacg

SEQ ID NO: 7491939 - DNA, 21 bp, Homo sapiens
agacagactgcctgacccacg

SEQ ID NO: 7491940 - DNA, 22 bp, Homo sapiens
agacagacggctttatacacag

SEQ ID NO: 7491941 - DNA, 22 bp, Homo sapiens
agacagacgtagtgtgagagta

SEQ ID NO: 7491942 - DNA, 22 bp, Homo sapiens
agacagacgtagtgtgagagta

SEQ ID NO: 7491943 - DNA, 22 bp, Homo sapiens
agacagacgtagtgtgagagta

SEQ ID NO: 7491944 - DNA, 22 bp, Homo sapiens
agacagacgtagtgtgagagta

SEQ ID NO: 7491945 - DNA, 22 bp, Homo sapiens
agacagacgtagtgtgagagta

SEQ ID NO: 7491946 - DNA, 22 bp, Homo sapiens
atgcacttaaataacataactt

SEQ ID NO: 7491947 - DNA, 22 bp, Homo sapiens
atgcactgtgagagtgaggggt

SEQ ID NO: 7491948 - DNA, 22 bp, Homo sapiens
atgcactgttggatatatttgt

SEQ ID NO: 7491949 - DNA, 22 bp, Homo sapiens
atgcacttaaataacataactt

SEQ ID NO: 7491950 - DNA, 22 bp, Homo sapiens
atgcactgttggatatatttgt

SEQ ID NO: 7491951 - DNA, 22 bp, Homo sapiens
atgcactgtgagagtgaggggt

SEQ ID NO: 7491952 - DNA, 22 bp, Homo sapiens
atgcactgtgagagtgaggggt

SEQ ID NO: 7491953 - DNA, 22 bp, Homo sapiens
atgcacttaaataacataactt

SEQ ID NO: 7491954 - DNA, 22 bp, Homo sapiens
agacagacatgctagttttctt

SEQ ID NO: 7491955 - DNA, 22 bp, Homo sapiens
agacagacatgctagttttctt

SEQ ID NO: 7491956 - DNA, 22 bp, Homo sapiens
agacagacatgctagttttctt

SEQ ID NO: 7491957 - DNA, 22 bp, Homo sapiens
agacagacattctagagccacc

SEQ ID NO: 7491958 - DNA, 22 bp, Homo sapiens
agacagaccatggctattcaga

SEQ ID NO: 7491959 - DNA, 22 bp, Homo sapiens
agacagaccatggctattcaga

SEQ ID NO: 7491960 - DNA, 22 bp, Homo sapiens
agacagacatgctagttttctt

SEQ ID NO: 7491961 - DNA, 22 bp, Homo sapiens
agacagacattctagagccacc

SEQ ID NO: 7491962 - DNA, 22 bp, Homo sapiens
agacagacattctagagccacc

SEQ ID NO: 7491963 - DNA, 22 bp, Homo sapiens
agacagacattctagagccacc

SEQ ID NO: 7491964 - DNA, 22 bp, Homo sapiens
agacagacattctagagccacc

SEQ ID NO: 7491965 - DNA, 22 bp, Homo sapiens
agacagacattctagagccacc

SEQ ID NO: 7491966 - DNA, 22 bp, Homo sapiens
agacagacattctagagccacc

SEQ ID NO: 7491967 - DNA, 22 bp, Homo sapiens
agacagacattctagagccacc

SEQ ID NO: 7491968 - DNA, 22 bp, Homo sapiens
atgacaaaatgaatgcagctag

SEQ ID NO: 7491969 - DNA, 22 bp, Homo sapiens
atgacaaaattcacaggtgtga

SEQ ID NO: 7491970 - DNA, 22 bp, Homo sapiens
atgacaaaattcacaggtgtga

SEQ ID NO: 7491971 - DNA, 22 bp, Homo sapiens
atgacaaaatgaatgcagctag

SEQ ID NO: 7491972 - DNA, 22 bp, Homo sapiens
atgacaaaatgaatgcagctag

SEQ ID NO: 7491973 - DNA, 22 bp, Homo sapiens
atgacaaaatgaatgcagctag

SEQ ID NO: 7491974 - DNA, 22 bp, Homo sapiens
atgacaaaataaatggtctctg

SEQ ID NO: 7491975 - DNA, 22 bp, Homo sapiens
atgacaaaataaatggtctctg

SEQ ID NO: 7491976 - DNA, 22 bp, Homo sapiens
atgacaaaataaatggtctctg

SEQ ID NO: 7491977 - DNA, 22 bp, Homo sapiens
agacaaatttcctgcaatgaag

SEQ ID NO: 7491978 - DNA, 22 bp, Homo sapiens
atgacaaaagaagacatgaggt

SEQ ID NO: 7491979 - DNA, 22 bp, Homo sapiens
atgacaaaagaagacatgaggt

SEQ ID NO: 7491980 - DNA, 22 bp, Homo sapiens
atgacaaaagaagacatgaggt

SEQ ID NO: 7491981 - DNA, 22 bp, Homo sapiens
atgacaaaagaagacatgaggt

SEQ ID NO: 7491982 - DNA, 22 bp, Homo sapiens
atgacaaaagaagacatgaggt

SEQ ID NO: 7491983 - DNA, 22 bp, Homo sapiens
atgacaaaagaagacatgaggt

SEQ ID NO: 7491984 - DNA, 22 bp, Homo sapiens
atgacaaaagaagacatgaggt

SEQ ID NO: 7491985 - DNA, 22 bp, Homo sapiens
atgacaaaagaagacatgaggt

SEQ ID NO: 7491986 - DNA, 23 bp, Homo sapiens
atgacaaacaggacatcttgtgc

SEQ ID NO: 7491987 - DNA, 22 bp, Homo sapiens
atgacaaacccaggatgtaaca

SEQ ID NO: 7491988 - DNA, 22 bp, Homo sapiens
atgacaaacccaggatgtaaca

SEQ ID NO: 7491989 - DNA, 22 bp, Homo sapiens
atgacaaacccaggatgtaaca

SEQ ID NO: 7491990 - DNA, 23 bp, Homo sapiens
atgacaaacaggacatcttgtgc

SEQ ID NO: 7491991 - DNA, 23 bp, Homo sapiens
atgacaaacaggacatcttgtgc

SEQ ID NO: 7491992 - DNA, 23 bp, Homo sapiens
atgacaaacaggacatcttgtgc

SEQ ID NO: 7491993 - DNA, 23 bp, Homo sapiens
atgacaaacaggacatcttgtgc

SEQ ID NO: 7491994 - DNA, 22 bp, Homo sapiens
atgacaaaattcacaggtgtga

SEQ ID NO: 7491995 - DNA, 22 bp, Homo sapiens
atgacaaaggctgaaagggaaa

SEQ ID NO: 7491996 - DNA, 22 bp, Homo sapiens
atgacaaacccaggatgtaaca

SEQ ID NO: 7491997 - DNA, 22 bp, Homo sapiens
atgacaaacccaggatgtaaca

SEQ ID NO: 7491998 - DNA, 22 bp, Homo sapiens
atgacaaacccaggatgtaaca

SEQ ID NO: 7491999 - DNA, 22 bp, Homo sapiens
atgacaaaggctgaaagggaaa

SEQ ID NO: 7492000 - DNA, 22 bp, Homo sapiens
atgacaaattcagaccatagca

SEQ ID NO: 7492001 - DNA, 22 bp, Homo sapiens
atgacaaattcagaccatagca

SEQ ID NO: 7492002 - DNA, 22 bp, Homo sapiens
atgacaaattcagaccatagca

SEQ ID NO: 7492003 - DNA, 22 bp, Homo sapiens
atgacaaattcagaccatagca

SEQ ID NO: 7492004 - DNA, 22 bp, Homo sapiens
atgacaaattcagaccatagca

SEQ ID NO: 7492005 - DNA, 22 bp, Homo sapiens
atgacaaattcagaccatagca

SEQ ID NO: 7492006 - DNA, 22 bp, Homo sapiens
atgacaaattcagaccatagca

SEQ ID NO: 7492007 - DNA, 22 bp, Homo sapiens
atgacaacctgtgagctggtat

SEQ ID NO: 7492008 - DNA, 22 bp, Homo sapiens
atgacaacacatggtgctgaat

SEQ ID NO: 7492009 - DNA, 22 bp, Homo sapiens
atgacaacacatggtgctgaat

SEQ ID NO: 7492010 - DNA, 22 bp, Homo sapiens
atgacaacctgtgagctggtat

SEQ ID NO: 7492011 - DNA, 22 bp, Homo sapiens
atgacaacacatggtgctgaat

SEQ ID NO: 7492012 - DNA, 22 bp, Homo sapiens
atgacaaattcagaccatagca

SEQ ID NO: 7492013 - DNA, 22 bp, Homo sapiens
atgacaagggagggtcctgcta

SEQ ID NO: 7492014 - DNA, 22 bp, Homo sapiens
atgacaacctgtgagctggtat

SEQ ID NO: 7492015 - DNA, 22 bp, Homo sapiens
atgacaagagtgttcagggaga

SEQ ID NO: 7492016 - DNA, 22 bp, Homo sapiens
atgacaagagtgttcagggaga

SEQ ID NO: 7492017 - DNA, 22 bp, Homo sapiens
atgacaagggagggtcctgcta

SEQ ID NO: 7492018 - DNA, 22 bp, Homo sapiens
atgacaagggttgacacatgtc

SEQ ID NO: 7492019 - DNA, 22 bp, Homo sapiens
atgacaagggttgacacatgtc

SEQ ID NO: 7492020 - DNA, 22 bp, Homo sapiens
atgacaagggttgacacatgtc

SEQ ID NO: 7492021 - DNA, 22 bp, Homo sapiens
atgacaagggttgacacatgtc

SEQ ID NO: 7492022 - DNA, 22 bp, Homo sapiens
atgcaacatacattctgaagct

SEQ ID NO: 7492023 - DNA, 22 bp, Homo sapiens
atgcaacatacattctgaagct

SEQ ID NO: 7492024 - DNA, 22 bp, Homo sapiens
atgcaacatacattctgaagct

SEQ ID NO: 7492025 - DNA, 22 bp, Homo sapiens
atgcaacatccaattccttttg

SEQ ID NO: 7492026 - DNA, 22 bp, Homo sapiens
atgcaacatccaattccttttg

SEQ ID NO: 7492027 - DNA, 22 bp, Homo sapiens
atgcaacatccaattccttttg

SEQ ID NO: 7492028 - DNA, 22 bp, Homo sapiens
atgcacataggccaaatcattt

SEQ ID NO: 7492029 - DNA, 22 bp, Homo sapiens
atgcacataggccaaatcattt

SEQ ID NO: 7492030 - DNA, 22 bp, Homo sapiens
atgcacataggccaaatcattt

SEQ ID NO: 7492031 - DNA, 22 bp, Homo sapiens
atgcacataggccaaatcattt

SEQ ID NO: 7492032 - DNA, 22 bp, Homo sapiens
atgcacataggccaaatcattt

SEQ ID NO: 7492033 - DNA, 20 bp, Homo sapiens
atgcacatacgcatgcacat

SEQ ID NO: 7492034 - DNA, 20 bp, Homo sapiens
atgcacatacgcatgcacat

SEQ ID NO: 7492035 - DNA, 20 bp, Homo sapiens
atgcacatacgcatgcacat

SEQ ID NO: 7492036 - DNA, 22 bp, Homo sapiens
atgcacatcttacagatgcaga

SEQ ID NO: 7492037 - DNA, 22 bp, Homo sapiens
atgcacatcttacagatgcaga

SEQ ID NO: 7492038 - DNA, 22 bp, Homo sapiens
atgcacatcactctgaagaaaa

SEQ ID NO: 7492039 - DNA, 22 bp, Homo sapiens
atgcacatcactctgaagaaaa

SEQ ID NO: 7492040 - DNA, 22 bp, Homo sapiens
atgcacatcactctgaagaaaa

SEQ ID NO: 7492041 - DNA, 22 bp, Homo sapiens
atgcacatcactctgaagaaaa

SEQ ID NO: 7492042 - DNA, 22 bp, Homo sapiens
atgcacatcttacagatgcaga

SEQ ID NO: 7492043 - DNA, 22 bp, Homo sapiens
atgcacatcttacagatgcaga

SEQ ID NO: 7492044 - DNA, 22 bp, Homo sapiens
atgcacatacatatgctctata

SEQ ID NO: 7492045 - DNA, 22 bp, Homo sapiens
atgcacatacatatgctctata

SEQ ID NO: 7492046 - DNA, 22 bp, Homo sapiens
atgcaagaaacagagacgctga

SEQ ID NO: 7492047 - DNA, 19 bp, Homo sapiens
atgcacagtcatttgtaag

SEQ ID NO: 7492048 - DNA, 22 bp, Homo sapiens
atgcacatacatatgctctata

SEQ ID NO: 7492049 - DNA, 22 bp, Homo sapiens
atgcacatacatatgctctata

SEQ ID NO: 7492050 - DNA, 22 bp, Homo sapiens
atgcaagacataaataatcttt

SEQ ID NO: 7492051 - DNA, 22 bp, Homo sapiens
atgcaactgagatggcctctgg

SEQ ID NO: 7492052 - DNA, 22 bp, Homo sapiens
atgcaactgagatggcctctgg

SEQ ID NO: 7492053 - DNA, 22 bp, Homo sapiens
atgcaactacttctgcaccaat

SEQ ID NO: 7492054 - DNA, 22 bp, Homo sapiens
atgcaactacttctgcaccaat

SEQ ID NO: 7492055 - DNA, 22 bp, Homo sapiens
atgcaactacttctgcaccaat

SEQ ID NO: 7492056 - DNA, 23 bp, Homo sapiens
atgcaacattgccagtatgggca

SEQ ID NO: 7492057 - DNA, 23 bp, Homo sapiens
atgcaacattgccagtatgggca

SEQ ID NO: 7492058 - DNA, 22 bp, Homo sapiens
atgcaactacccccaggatttt

SEQ ID NO: 7492059 - DNA, 22 bp, Homo sapiens
agacatttcctagacatcaatg

SEQ ID NO: 7492060 - DNA, 22 bp, Homo sapiens
agacatatggtgaaacatttta

SEQ ID NO: 7492061 - DNA, 22 bp, Homo sapiens
agacatttcctagacatcaatg

SEQ ID NO: 7492062 - DNA, 22 bp, Homo sapiens
agacatttcctagacatcaatg

SEQ ID NO: 7492063 - DNA, 22 bp, Homo sapiens
agacatttcctagacatcaatg

SEQ ID NO: 7492064 - DNA, 22 bp, Homo sapiens
agacatttcctagacatcaatg

SEQ ID NO: 7492065 - DNA, 22 bp, Homo sapiens
agacatttcctagacatcaatg

SEQ ID NO: 7492066 - DNA, 22 bp, Homo sapiens
agacatttattcacacatttat

SEQ ID NO: 7492067 - DNA, 22 bp, Homo sapiens
agacatttattgaacacctagc

SEQ ID NO: 7492068 - DNA, 22 bp, Homo sapiens
agacatttattgaacacctagc

SEQ ID NO: 7492069 - DNA, 22 bp, Homo sapiens
agacatatggtgaaacatttta

SEQ ID NO: 7492070 - DNA, 22 bp, Homo sapiens
agacatatggtgaaacatttta

SEQ ID NO: 7492071 - DNA, 22 bp, Homo sapiens
agacatatggtgaaacatttta

SEQ ID NO: 7492072 - DNA, 22 bp, Homo sapiens
agacatatggtgaaacatttta

SEQ ID NO: 7492073 - DNA, 22 bp, Homo sapiens
agacatatattgcaattcactg

SEQ ID NO: 7492074 - DNA, 23 bp, Homo sapiens
agacatatgttctttccagatat

SEQ ID NO: 7492075 - DNA, 22 bp, Homo sapiens
agacatattggcttgctttaat

SEQ ID NO: 7492076 - DNA, 22 bp, Homo sapiens
agacatatggtgaaacatttta

SEQ ID NO: 7492077 - DNA, 23 bp, Homo sapiens
agacatatgttctttccagatat

SEQ ID NO: 7492078 - DNA, 22 bp, Homo sapiens
agacatcaatgatcagaggtag

SEQ ID NO: 7492079 - DNA, 22 bp, Homo sapiens
agacatcaatgatcagaggtag

SEQ ID NO: 7492080 - DNA, 23 bp, Homo sapiens
agacattttaataaggacttttt

SEQ ID NO: 7492081 - DNA, 22 bp, Homo sapiens
agacattttaacatctgggttt

SEQ ID NO: 7492082 - DNA, 22 bp, Homo sapiens
agacatttggagccaactttcc

SEQ ID NO: 7492083 - DNA, 22 bp, Homo sapiens
agacatttggagccaactttcc

SEQ ID NO: 7492084 - DNA, 22 bp, Homo sapiens
agacatttggagccaactttcc

SEQ ID NO: 7492085 - DNA, 22 bp, Homo sapiens
agacatttggaagatacacata

SEQ ID NO: 7492086 - DNA, 22 bp, Homo sapiens
agacatttggaagatacacata

SEQ ID NO: 7492087 - DNA, 22 bp, Homo sapiens
agacatttggaagatacacata

SEQ ID NO: 7492088 - DNA, 22 bp, Homo sapiens
agacatttggaagatacacata

SEQ ID NO: 7492089 - DNA, 22 bp, Homo sapiens
agacatttggaagatacacata

SEQ ID NO: 7492090 - DNA, 22 bp, Homo sapiens
agacatttggaagatacacata

SEQ ID NO: 7492091 - DNA, 22 bp, Homo sapiens
agacatttcctagacatcaatg

SEQ ID NO: 7492092 - DNA, 22 bp, Homo sapiens
agacagctgttccttcatgttt

SEQ ID NO: 7492093 - DNA, 22 bp, Homo sapiens
agacagctgttccttcatgttt

SEQ ID NO: 7492094 - DNA, 23 bp, Homo sapiens
agacagcttagagtttgcctctc

SEQ ID NO: 7492095 - DNA, 21 bp, Homo sapiens
agacagctttaaagacacagg

SEQ ID NO: 7492096 - DNA, 21 bp, Homo sapiens
agacagctttaaagacacagg

SEQ ID NO: 7492097 - DNA, 21 bp, Homo sapiens
agacagctttaaagacacagg

SEQ ID NO: 7492098 - DNA, 22 bp, Homo sapiens
agacaggacacaagctgcataa

SEQ ID NO: 7492099 - DNA, 22 bp, Homo sapiens
agacaggacacaagctgcataa

SEQ ID NO: 7492100 - DNA, 22 bp, Homo sapiens
agacaggacacaagctgcataa

SEQ ID NO: 7492101 - DNA, 22 bp, Homo sapiens
agacagctgctcgcagagctat

SEQ ID NO: 7492102 - DNA, 22 bp, Homo sapiens
agacagctgctcgcagagctat

SEQ ID NO: 7492103 - DNA, 22 bp, Homo sapiens
agacagctgctcgcagagctat

SEQ ID NO: 7492104 - DNA, 22 bp, Homo sapiens
agacagctgggagtgtccttct

SEQ ID NO: 7492105 - DNA, 22 bp, Homo sapiens
agacagctggtagcacttcctg

SEQ ID NO: 7492106 - DNA, 22 bp, Homo sapiens
agacagctgggaaatggagtgt

SEQ ID NO: 7492107 - DNA, 22 bp, Homo sapiens
agacagctgggagtgtccttct

SEQ ID NO: 7492108 - DNA, 22 bp, Homo sapiens
agacagctgggagtgtccttct

SEQ ID NO: 7492109 - DNA, 22 bp, Homo sapiens
agacaggcagaggctgcagagg

SEQ ID NO: 7492110 - DNA, 22 bp, Homo sapiens
agacaggcagaggctgcagagg

SEQ ID NO: 7492111 - DNA, 22 bp, Homo sapiens
agacaggcagaggctgcagagg

SEQ ID NO: 7492112 - DNA, 22 bp, Homo sapiens
agacaggcagaggctgcagagg

SEQ ID NO: 7492113 - DNA, 22 bp, Homo sapiens
agacaggcagaggctgcagagg

SEQ ID NO: 7492114 - DNA, 22 bp, Homo sapiens
agacaggatgcatactcttggt

SEQ ID NO: 7492115 - DNA, 20 bp, Homo sapiens
agacaggagcccccattcag

SEQ ID NO: 7492116 - DNA, 22 bp, Homo sapiens
agacaggatgcatactcttggt

SEQ ID NO: 7492117 - DNA, 22 bp, Homo sapiens
agacaggatgcatactcttggt

SEQ ID NO: 7492118 - DNA, 20 bp, Homo sapiens
agacaggagcccccattcag

SEQ ID NO: 7492119 - DNA, 22 bp, Homo sapiens
agacaggagagggaactgccgg

SEQ ID NO: 7492120 - DNA, 22 bp, Homo sapiens
agacaggagagggaactgccgg

SEQ ID NO: 7492121 - DNA, 22 bp, Homo sapiens
agacaggacacaagctgcataa

SEQ ID NO: 7492122 - DNA, 22 bp, Homo sapiens
agacaggacacaagctgcataa

SEQ ID NO: 7492123 - DNA, 22 bp, Homo sapiens
agacaggacacaagctgcataa

SEQ ID NO: 7492124 - DNA, 22 bp, Homo sapiens
agacaggagagggaactgccgg

SEQ ID NO: 7492125 - DNA, 22 bp, Homo sapiens
agacaggacacaagctgcataa

SEQ ID NO: 7492126 - DNA, 22 bp, Homo sapiens
agacaggagagggaactgccgg

SEQ ID NO: 7492127 - DNA, 22 bp, Homo sapiens
agacaggagagggaactgccgg

SEQ ID NO: 7492128 - DNA, 22 bp, Homo sapiens
agacagcaggggagtctggttt

SEQ ID NO: 7492129 - DNA, 22 bp, Homo sapiens
agacagcagggagcaggattca

SEQ ID NO: 7492130 - DNA, 22 bp, Homo sapiens
agacagcagggagcaggattca

SEQ ID NO: 7492131 - DNA, 22 bp, Homo sapiens
agacagcagggagcaggattca

SEQ ID NO: 7492132 - DNA, 22 bp, Homo sapiens
agacagcagggagcaggattca

SEQ ID NO: 7492133 - DNA, 22 bp, Homo sapiens
agacagcagggagcaggattca

SEQ ID NO: 7492134 - DNA, 22 bp, Homo sapiens
agacagcaggggagtctggttt

SEQ ID NO: 7492135 - DNA, 22 bp, Homo sapiens
agacagcaggggagtctggttt

SEQ ID NO: 7492136 - DNA, 22 bp, Homo sapiens
agacagcaggggagtctggttt

SEQ ID NO: 7492137 - DNA, 21 bp, Homo sapiens
agacagcagtctccaaacccc

SEQ ID NO: 7492138 - DNA, 21 bp, Homo sapiens
agacagcagtctccaaacccc

SEQ ID NO: 7492139 - DNA, 22 bp, Homo sapiens
agacagcaggggagtctggttt

SEQ ID NO: 7492140 - DNA, 21 bp, Homo sapiens
agacagcagtctccaaacccc

SEQ ID NO: 7492141 - DNA, 22 bp, Homo sapiens
agacagcatgagcctgctgatg

SEQ ID NO: 7492142 - DNA, 22 bp, Homo sapiens
agacagcatgagcctgctgatg

SEQ ID NO: 7492143 - DNA, 22 bp, Homo sapiens
agacagcatgagcctgctgatg

SEQ ID NO: 7492144 - DNA, 22 bp, Homo sapiens
agacagcatgagcctgctgatg

SEQ ID NO: 7492145 - DNA, 22 bp, Homo sapiens
agacagcatgagcctgctgatg

SEQ ID NO: 7492146 - DNA, 22 bp, Homo sapiens
agacagcatgatacatgatgct

SEQ ID NO: 7492147 - DNA, 22 bp, Homo sapiens
agacagcatgatacatgatgct

SEQ ID NO: 7492148 - DNA, 22 bp, Homo sapiens
agacagcatgagcctgctgatg

SEQ ID NO: 7492149 - DNA, 22 bp, Homo sapiens
agacagcatgagcctgctgatg

SEQ ID NO: 7492150 - DNA, 22 bp, Homo sapiens
agacagcagaaactagagcact

SEQ ID NO: 7492151 - DNA, 22 bp, Homo sapiens
agacagcagaaactagagcact

SEQ ID NO: 7492152 - DNA, 22 bp, Homo sapiens
agacagcagaaactagagcact

SEQ ID NO: 7492153 - DNA, 21 bp, Homo sapiens
agacagcagatagtcgaaagg

SEQ ID NO: 7492154 - DNA, 21 bp, Homo sapiens
agacagcagatagtcgaaagg

SEQ ID NO: 7492155 - DNA, 22 bp, Homo sapiens
agacagcagcagaggggctccc

SEQ ID NO: 7492156 - DNA, 22 bp, Homo sapiens
agacagcagcagaggggctccc

SEQ ID NO: 7492157 - DNA, 22 bp, Homo sapiens
agacagcagcagaggggctccc

SEQ ID NO: 7492158 - DNA, 21 bp, Homo sapiens
agacagcagatagtcgaaagg

SEQ ID NO: 7492159 - DNA, 21 bp, Homo sapiens
agacagcagatagtcgaaagg

SEQ ID NO: 7492160 - DNA, 22 bp, Homo sapiens
agacagactgtgtttgaatcct

SEQ ID NO: 7492161 - DNA, 22 bp, Homo sapiens
agacagactgtgtttgaatcct

SEQ ID NO: 7492162 - DNA, 22 bp, Homo sapiens
agacagactgtgtttgaatcct

SEQ ID NO: 7492163 - DNA, 22 bp, Homo sapiens
agacagactggtttgaattggt

SEQ ID NO: 7492164 - DNA, 22 bp, Homo sapiens
agacagactggtttgaattggt

SEQ ID NO: 7492165 - DNA, 22 bp, Homo sapiens
agacagactggtttgaattggt

SEQ ID NO: 7492166 - DNA, 21 bp, Homo sapiens
agacagactgcctgacccacg

SEQ ID NO: 7492167 - DNA, 22 bp, Homo sapiens
agacagacttgaaaatgttctt

SEQ ID NO: 7492168 - DNA, 22 bp, Homo sapiens
agacagacttgaaaatgttctt

SEQ ID NO: 7492169 - DNA, 22 bp, Homo sapiens
agacagcagaaactagagcact

SEQ ID NO: 7492170 - DNA, 22 bp, Homo sapiens
agacagacttgaaaatgttctt

SEQ ID NO: 7492171 - DNA, 22 bp, Homo sapiens
agacagccaatgctggaagatg

SEQ ID NO: 7492172 - DNA, 22 bp, Homo sapiens
agacagcatttctagcaccagg

SEQ ID NO: 7492173 - DNA, 22 bp, Homo sapiens
agacagccaatgctggaagatg

SEQ ID NO: 7492174 - DNA, 22 bp, Homo sapiens
agacagccaatgctggaagatg

SEQ ID NO: 7492175 - DNA, 22 bp, Homo sapiens
agacagcatttctagcaccagg

SEQ ID NO: 7492176 - DNA, 22 bp, Homo sapiens
agacagcatttctagcaccagg

SEQ ID NO: 7492177 - DNA, 22 bp, Homo sapiens
agacagcatttctagcaccagg

SEQ ID NO: 7492178 - DNA, 22 bp, Homo sapiens
agacagcatttctagcaccagg

SEQ ID NO: 7492179 - DNA, 22 bp, Homo sapiens
agacagcatttctagcaccagg

SEQ ID NO: 7492180 - DNA, 22 bp, Homo sapiens
agacagcatttcccggaaccgc

SEQ ID NO: 7492181 - DNA, 22 bp, Homo sapiens
agacagcatttcccggaaccgc

SEQ ID NO: 7492182 - DNA, 22 bp, Homo sapiens
agacagcatggagctgataaca

SEQ ID NO: 7492183 - DNA, 22 bp, Homo sapiens
agacagcatggagctgataaca

SEQ ID NO: 7492184 - DNA, 22 bp, Homo sapiens
agacagcatggagctgataaca

SEQ ID NO: 7492185 - DNA, 22 bp, Homo sapiens
agacagcatgatacatgatgct

SEQ ID NO: 7492186 - DNA, 22 bp, Homo sapiens
agacagcatggagctgataaca

SEQ ID NO: 7492187 - DNA, 22 bp, Homo sapiens
agacagcatgatacatgatgct

SEQ ID NO: 7492188 - DNA, 22 bp, Homo sapiens
agacagcatgatacatgatgct

SEQ ID NO: 7492189 - DNA, 22 bp, Homo sapiens
agacagcatgatacatgatgct

SEQ ID NO: 7492190 - DNA, 22 bp, Homo sapiens
agacagcatgatacatgatgct

SEQ ID NO: 7492191 - DNA, 22 bp, Homo sapiens
agacagcatgatacatgatgct

SEQ ID NO: 7492192 - DNA, 22 bp, Homo sapiens
agacagcatgatacatgatgct

SEQ ID NO: 7492193 - DNA, 22 bp, Homo sapiens
agacagcatgatacatgatgct

SEQ ID NO: 7492194 - DNA, 22 bp, Homo sapiens
agacagctatcaacaactttct

SEQ ID NO: 7492195 - DNA, 22 bp, Homo sapiens
agacagctagggctgcagggac

SEQ ID NO: 7492196 - DNA, 22 bp, Homo sapiens
agacagctaataaatgagtgtg

SEQ ID NO: 7492197 - DNA, 22 bp, Homo sapiens
agacagctagggctgcagggac

SEQ ID NO: 7492198 - DNA, 22 bp, Homo sapiens
agacagccaatgctggaagatg

SEQ ID NO: 7492199 - DNA, 22 bp, Homo sapiens
agacagctaataaatgagtgtg

SEQ ID NO: 7492200 - DNA, 22 bp, Homo sapiens
agacagcgaggacagaggggtg

SEQ ID NO: 7492201 - DNA, 19 bp, Homo sapiens
agacagctctattattttg

SEQ ID NO: 7492202 - DNA, 22 bp, Homo sapiens
agacagctctgggttccacact

SEQ ID NO: 7492203 - DNA, 19 bp, Homo sapiens
agacagctctattattttg

SEQ ID NO: 7492204 - DNA, 22 bp, Homo sapiens
agacagctccaagtgtctctgt

SEQ ID NO: 7492205 - DNA, 22 bp, Homo sapiens
agacagctccaagtgtctctgt

SEQ ID NO: 7492206 - DNA, 18 bp, Homo sapiens
agacagctgaaaggaaaa

SEQ ID NO: 7492207 - DNA, 22 bp, Homo sapiens
agacagctgcctccaccacagc

SEQ ID NO: 7492208 - DNA, 22 bp, Homo sapiens
agacagctgcctccaccacagc

SEQ ID NO: 7492209 - DNA, 22 bp, Homo sapiens
agagaccaagggaatagtctca

SEQ ID NO: 7492210 - DNA, 22 bp, Homo sapiens
agagaccaagggaatagtctca

SEQ ID NO: 7492211 - DNA, 19 bp, Homo sapiens
agagaccacagagctgcct

SEQ ID NO: 7492212 - DNA, 19 bp, Homo sapiens
agagaccacagagctgcct

SEQ ID NO: 7492213 - DNA, 19 bp, Homo sapiens
agagaccacagagctgcct

SEQ ID NO: 7492214 - DNA, 22 bp, Homo sapiens
agagaccagaatccagctgcct

SEQ ID NO: 7492215 - DNA, 22 bp, Homo sapiens
agagacatagcacagtttttcg

SEQ ID NO: 7492216 - DNA, 22 bp, Homo sapiens
agagaccagaatccagctgcct

SEQ ID NO: 7492217 - DNA, 19 bp, Homo sapiens
agagaccacagagctgcct

SEQ ID NO: 7492218 - DNA, 22 bp, Homo sapiens
agagacccattgccggaatcac

SEQ ID NO: 7492219 - DNA, 22 bp, Homo sapiens
agagacccagactgatcattgc

SEQ ID NO: 7492220 - DNA, 21 bp, Homo sapiens
agagaccagctgttactccca

SEQ ID NO: 7492221 - DNA, 21 bp, Homo sapiens
agagaccagctgttactccca

SEQ ID NO: 7492222 - DNA, 22 bp, Homo sapiens
agagacccgcagcctcggagct

SEQ ID NO: 7492223 - DNA, 22 bp, Homo sapiens
agagaccctggagttcttcact

SEQ ID NO: 7492224 - DNA, 20 bp, Homo sapiens
agagaccctgtagcttgcag

SEQ ID NO: 7492225 - DNA, 22 bp, Homo sapiens
agagacagggttttgtcgtgtt

SEQ ID NO: 7492226 - DNA, 22 bp, Homo sapiens
agagacagggttttgtcgtgtt

SEQ ID NO: 7492227 - DNA, 22 bp, Homo sapiens
agagacatgcagttgttgtgaa

SEQ ID NO: 7492228 - DNA, 22 bp, Homo sapiens
agagacagggttttgtcgtgtt

SEQ ID NO: 7492229 - DNA, 22 bp, Homo sapiens
agagaccaagggaatagtctca

SEQ ID NO: 7492230 - DNA, 22 bp, Homo sapiens
agagacagggttttgtcgtgtt

SEQ ID NO: 7492231 - DNA, 22 bp, Homo sapiens
agagacagggttttgtcgtgtt

SEQ ID NO: 7492232 - DNA, 22 bp, Homo sapiens
agagacagggttttgtcgtgtt

SEQ ID NO: 7492233 - DNA, 22 bp, Homo sapiens
agagacagggttttgtcgtgtt

SEQ ID NO: 7492234 - DNA, 22 bp, Homo sapiens
agagacagggttttgtcgtgtt

SEQ ID NO: 7492235 - DNA, 22 bp, Homo sapiens
agagacagggttttgtcgtgtt

SEQ ID NO: 7492236 - DNA, 22 bp, Homo sapiens
agagacagggttttgtcgtgtt

SEQ ID NO: 7492237 - DNA, 21 bp, Homo sapiens
agagacagagaaagtaacatt

SEQ ID NO: 7492238 - DNA, 21 bp, Homo sapiens
agagacagagaaagtaacatt

SEQ ID NO: 7492239 - DNA, 22 bp, Homo sapiens
agagacagaggcaatatagctt

SEQ ID NO: 7492240 - DNA, 22 bp, Homo sapiens
agagacagggttttgtcgtgtt

SEQ ID NO: 7492241 - DNA, 22 bp, Homo sapiens
agagacagggttttgtcgtgtt

SEQ ID NO: 7492242 - DNA, 22 bp, Homo sapiens
agagacagggttttgtcgtgtt

SEQ ID NO: 7492243 - DNA, 22 bp, Homo sapiens
agagacagaggcaatatagctt

SEQ ID NO: 7492244 - DNA, 22 bp, Homo sapiens
agagacagggttttgccatgtt

SEQ ID NO: 7492245 - DNA, 22 bp, Homo sapiens
agagacagggttttgtcgtgtt

SEQ ID NO: 7492246 - DNA, 22 bp, Homo sapiens
agagaaggaaagctgacatggg

SEQ ID NO: 7492247 - DNA, 22 bp, Homo sapiens
agagaaggaaagctgacatggg

SEQ ID NO: 7492248 - DNA, 22 bp, Homo sapiens
agagaaggaaagctgacatggg

SEQ ID NO: 7492249 - DNA, 22 bp, Homo sapiens
agagaaggaaagctgacatggg

SEQ ID NO: 7492250 - DNA, 22 bp, Homo sapiens
agagaaggaaagctgacatggg

SEQ ID NO: 7492251 - DNA, 22 bp, Homo sapiens
agagaaggaaagctgacatggg

SEQ ID NO: 7492252 - DNA, 22 bp, Homo sapiens
agagaaggaaagctgacatggg

SEQ ID NO: 7492253 - DNA, 22 bp, Homo sapiens
agagaagcagggagtcatctgt

SEQ ID NO: 7492254 - DNA, 22 bp, Homo sapiens
agagaagattcttatatgtctt

SEQ ID NO: 7492255 - DNA, 22 bp, Homo sapiens
agagaagattcttatatgtctt

SEQ ID NO: 7492256 - DNA, 22 bp, Homo sapiens
agagaagcattcttctcagggc

SEQ ID NO: 7492257 - DNA, 22 bp, Homo sapiens
agagaagcattcttctcagggc

SEQ ID NO: 7492258 - DNA, 22 bp, Homo sapiens
agagaagctgacaggggcgtgc

SEQ ID NO: 7492259 - DNA, 22 bp, Homo sapiens
agagaagattcttatatgtctt

SEQ ID NO: 7492260 - DNA, 22 bp, Homo sapiens
agagaagattcttatatgtctt

SEQ ID NO: 7492261 - DNA, 22 bp, Homo sapiens
agagaagattcttatatgtctt

SEQ ID NO: 7492262 - DNA, 22 bp, Homo sapiens
agagaagattcttatatgtctt

SEQ ID NO: 7492263 - DNA, 22 bp, Homo sapiens
agagaagattcttatatgtctt

SEQ ID NO: 7492264 - DNA, 22 bp, Homo sapiens
agagaagagtcttgtcaaatta

SEQ ID NO: 7492265 - DNA, 22 bp, Homo sapiens
agagaagattcttatatgtctt

SEQ ID NO: 7492266 - DNA, 22 bp, Homo sapiens
agagaagagtcttgtcaaatta

SEQ ID NO: 7492267 - DNA, 22 bp, Homo sapiens
agagaagagtcttgtcaaatta

SEQ ID NO: 7492268 - DNA, 22 bp, Homo sapiens
agagaagagtcttgtcaaatta

SEQ ID NO: 7492269 - DNA, 22 bp, Homo sapiens
agagaagagtcttgtcaaatta

SEQ ID NO: 7492270 - DNA, 22 bp, Homo sapiens
atggctcagcccatggaagaaa

SEQ ID NO: 7492271 - DNA, 22 bp, Homo sapiens
atggctcagcccatggaagaaa

SEQ ID NO: 7492272 - DNA, 22 bp, Homo sapiens
atggctcagcgcctttctgtgg

SEQ ID NO: 7492273 - DNA, 22 bp, Homo sapiens
atggctcagcccatggaagaaa

SEQ ID NO: 7492274 - DNA, 22 bp, Homo sapiens
atggctcagcccatggaagaaa

SEQ ID NO: 7492275 - DNA, 22 bp, Homo sapiens
atggctcagcccatggaagaaa

SEQ ID NO: 7492276 - DNA, 22 bp, Homo sapiens
agagagttgaggaagcaacact

SEQ ID NO: 7492277 - DNA, 22 bp, Homo sapiens
agagagttgtaccacactcata

SEQ ID NO: 7492278 - DNA, 22 bp, Homo sapiens
agagatgaaaagtggagactgg

SEQ ID NO: 7492279 - DNA, 22 bp, Homo sapiens
agagatgaaaagtggagactgg

SEQ ID NO: 7492280 - DNA, 22 bp, Homo sapiens
agagatgaaaagtggagactgg

SEQ ID NO: 7492281 - DNA, 22 bp, Homo sapiens
agagagttgtatgtttctaaaa

SEQ ID NO: 7492282 - DNA, 22 bp, Homo sapiens
agagagttgtatgtttctaaaa

SEQ ID NO: 7492283 - DNA, 22 bp, Homo sapiens
agagagttgtatgtttctaaaa

SEQ ID NO: 7492284 - DNA, 22 bp, Homo sapiens
agagatgaaaagtggagactgg

SEQ ID NO: 7492285 - DNA, 17 bp, Homo sapiens
atggctcacctgtgggc

SEQ ID NO: 7492286 - DNA, 17 bp, Homo sapiens
atggctcacctgtgggc

SEQ ID NO: 7492287 - DNA, 17 bp, Homo sapiens
atggctcacctgtgggc

SEQ ID NO: 7492288 - DNA, 17 bp, Homo sapiens
atggctcacctgtgggc

SEQ ID NO: 7492289 - DNA, 17 bp, Homo sapiens
atggctcacctgtgggc

SEQ ID NO: 7492290 - DNA, 17 bp, Homo sapiens
atggctcacctgtgggc

SEQ ID NO: 7492291 - DNA, 17 bp, Homo sapiens
atggctcacctgtgggc

SEQ ID NO: 7492292 - DNA, 17 bp, Homo sapiens
atggctcacctgtgggc

SEQ ID NO: 7492293 - DNA, 22 bp, Homo sapiens
atggctagttgatatggtgttt

SEQ ID NO: 7492294 - DNA, 22 bp, Homo sapiens
atggctattttagagatcaagg

SEQ ID NO: 7492295 - DNA, 22 bp, Homo sapiens
atggctagcaccgcgttgctgg

SEQ ID NO: 7492296 - DNA, 22 bp, Homo sapiens
atggctagcaccgcgttgctgg

SEQ ID NO: 7492297 - DNA, 22 bp, Homo sapiens
atggctagcaccgcgttgctgg

SEQ ID NO: 7492298 - DNA, 22 bp, Homo sapiens
atggcctggggattcctgagca

SEQ ID NO: 7492299 - DNA, 22 bp, Homo sapiens
atggccttagtgatgattaata

SEQ ID NO: 7492300 - DNA, 22 bp, Homo sapiens
atggccttagtgatgattaata

SEQ ID NO: 7492301 - DNA, 22 bp, Homo sapiens
atggccttattatggcacccga

SEQ ID NO: 7492302 - DNA, 22 bp, Homo sapiens
atggccttattcaaggaagact

SEQ ID NO: 7492303 - DNA, 22 bp, Homo sapiens
atggccttcatgatagaaggta

SEQ ID NO: 7492304 - DNA, 22 bp, Homo sapiens
atggccttcatgatagaaggta

SEQ ID NO: 7492305 - DNA, 20 bp, Homo sapiens
atggccttcctctctgtcca

SEQ ID NO: 7492306 - DNA, 20 bp, Homo sapiens
atggccttcctctctgtcca

SEQ ID NO: 7492307 - DNA, 22 bp, Homo sapiens
atggccttgatagcctaaaaca

SEQ ID NO: 7492308 - DNA, 22 bp, Homo sapiens
atggcctttctcagtggtgctt

SEQ ID NO: 7492309 - DNA, 22 bp, Homo sapiens
atggccttggctgcagagacat

SEQ ID NO: 7492310 - DNA, 22 bp, Homo sapiens
atggctaaacctgaactggtct

SEQ ID NO: 7492311 - DNA, 22 bp, Homo sapiens
atggctagcaccgcgttgctgg

SEQ ID NO: 7492312 - DNA, 22 bp, Homo sapiens
agagactgatggagctcactct

SEQ ID NO: 7492313 - DNA, 22 bp, Homo sapiens
agagactgatggagctcactct

SEQ ID NO: 7492314 - DNA, 23 bp, Homo sapiens
agagactataagttatgttctgt

SEQ ID NO: 7492315 - DNA, 22 bp, Homo sapiens
agagactaatgggagcggaagt

SEQ ID NO: 7492316 - DNA, 22 bp, Homo sapiens
atggcctgatgcacctgtccca

SEQ ID NO: 7492317 - DNA, 22 bp, Homo sapiens
atggcctctagctgagaccaat

SEQ ID NO: 7492318 - DNA, 22 bp, Homo sapiens
atggcctcagcatggagcttcg

SEQ ID NO: 7492319 - DNA, 22 bp, Homo sapiens
atggcctccgacccatgacgtg

SEQ ID NO: 7492320 - DNA, 22 bp, Homo sapiens
agagacctgagatcctcgacat

SEQ ID NO: 7492321 - DNA, 22 bp, Homo sapiens
agagaccttcctgactccagag

SEQ ID NO: 7492322 - DNA, 22 bp, Homo sapiens
agagacctttctcctgcctttc

SEQ ID NO: 7492323 - DNA, 22 bp, Homo sapiens
agagactaagccagcatagtgc

SEQ ID NO: 7492324 - DNA, 22 bp, Homo sapiens
agagacgcattcagaggcaggc

SEQ ID NO: 7492325 - DNA, 22 bp, Homo sapiens
agagactaagccagcatagtgc

SEQ ID NO: 7492326 - DNA, 22 bp, Homo sapiens
agagacgcattcagaggcaggc

SEQ ID NO: 7492327 - DNA, 22 bp, Homo sapiens
atggcctgatgcacctgtccca

SEQ ID NO: 7492328 - DNA, 20 bp, Homo sapiens
atggcctgctagaagtctgt

SEQ ID NO: 7492329 - DNA, 22 bp, Homo sapiens
atggcctggccagagctctgct

SEQ ID NO: 7492330 - DNA, 22 bp, Homo sapiens
atggcctgcagtgctgccacag

SEQ ID NO: 7492331 - DNA, 22 bp, Homo sapiens
atggcctgcagtgctgccacag

SEQ ID NO: 7492332 - DNA, 22 bp, Homo sapiens
atggcctgggcccgcttcagat

SEQ ID NO: 7492333 - DNA, 22 bp, Homo sapiens
atggcctgggcccgcttcagat

SEQ ID NO: 7492334 - DNA, 22 bp, Homo sapiens
atggcctggccagagctctgct

SEQ ID NO: 7492335 - DNA, 22 bp, Homo sapiens
atggcctgggcccgcttcagat

SEQ ID NO: 7492336 - DNA, 22 bp, Homo sapiens
atggcctggggattcctgagca

SEQ ID NO: 7492337 - DNA, 22 bp, Homo sapiens
atggccttagtgatgattaata

SEQ ID NO: 7492338 - DNA, 22 bp, Homo sapiens
atggcctggggagcatgggaag

SEQ ID NO: 7492339 - DNA, 22 bp, Homo sapiens
atggcctggggagcatgggaag

SEQ ID NO: 7492340 - DNA, 22 bp, Homo sapiens
atggcctgggcccgcttcagat

SEQ ID NO: 7492341 - DNA, 22 bp, Homo sapiens
agacattttggaaagtattact

SEQ ID NO: 7492342 - DNA, 22 bp, Homo sapiens
agacattttggaaagtattact

SEQ ID NO: 7492343 - DNA, 22 bp, Homo sapiens
agaccaaagaaaacacatctgg

SEQ ID NO: 7492344 - DNA, 22 bp, Homo sapiens
agaccaagactataatgagagg

SEQ ID NO: 7492345 - DNA, 22 bp, Homo sapiens
agacattttggaaagtattact

SEQ ID NO: 7492346 - DNA, 22 bp, Homo sapiens
agacattttggaaagtattact

SEQ ID NO: 7492347 - DNA, 22 bp, Homo sapiens
agacattttggaaagtattact

SEQ ID NO: 7492348 - DNA, 22 bp, Homo sapiens
agaccactaaaactttctctat

SEQ ID NO: 7492349 - DNA, 22 bp, Homo sapiens
agaccactaaaactttctctat

SEQ ID NO: 7492350 - DNA, 22 bp, Homo sapiens
agaccactaaaactttctctat

SEQ ID NO: 7492351 - DNA, 22 bp, Homo sapiens
agaccactaaaactttctctat

SEQ ID NO: 7492352 - DNA, 22 bp, Homo sapiens
agaccaccaaaactttctccat

SEQ ID NO: 7492353 - DNA, 22 bp, Homo sapiens
agaccacaggcatgcacagagc

SEQ ID NO: 7492354 - DNA, 22 bp, Homo sapiens
agaccacaggcatgcacagagc

SEQ ID NO: 7492355 - DNA, 22 bp, Homo sapiens
agacattttgcattccctgaag

SEQ ID NO: 7492356 - DNA, 22 bp, Homo sapiens
agacattttgcaatgggtagct

SEQ ID NO: 7492357 - DNA, 22 bp, Homo sapiens
agacattttggaaagtattact

SEQ ID NO: 7492358 - DNA, 22 bp, Homo sapiens
agacattttggaaagtattact

SEQ ID NO: 7492359 - DNA, 22 bp, Homo sapiens
agacattttgcaatgggtagct

SEQ ID NO: 7492360 - DNA, 22 bp, Homo sapiens
agacattttgatacccctaccg

SEQ ID NO: 7492361 - DNA, 22 bp, Homo sapiens
agacattttacattcttccatt

SEQ ID NO: 7492362 - DNA, 22 bp, Homo sapiens
agacattttacattcttccatt

SEQ ID NO: 7492363 - DNA, 23 bp, Homo sapiens
agacattttaataaggacttttt

SEQ ID NO: 7492364 - DNA, 22 bp, Homo sapiens
agacattttagacataaaagat

SEQ ID NO: 7492365 - DNA, 22 bp, Homo sapiens
agacattttagacataaaagat

SEQ ID NO: 7492366 - DNA, 22 bp, Homo sapiens
agacattttagacataaaagat

SEQ ID NO: 7492367 - DNA, 22 bp, Homo sapiens
agaccacttggataagaaacag

SEQ ID NO: 7492368 - DNA, 22 bp, Homo sapiens
agaccactcaaaattagtgtct

SEQ ID NO: 7492369 - DNA, 22 bp, Homo sapiens
agaccactggcctcctgcagac

SEQ ID NO: 7492370 - DNA, 22 bp, Homo sapiens
agaccactggcctcctgcagac

SEQ ID NO: 7492371 - DNA, 22 bp, Homo sapiens
agaccacttggataagaaacag

SEQ ID NO: 7492372 - DNA, 22 bp, Homo sapiens
agaccaggaaggcctacagata

SEQ ID NO: 7492373 - DNA, 22 bp, Homo sapiens
agaccaggaaggcctacagata

SEQ ID NO: 7492374 - DNA, 22 bp, Homo sapiens
agaccaggaaggcctacagata

SEQ ID NO: 7492375 - DNA, 22 bp, Homo sapiens
agaccagggtcccacagagtct

SEQ ID NO: 7492376 - DNA, 22 bp, Homo sapiens
agaccagggtcccacagagtct

SEQ ID NO: 7492377 - DNA, 22 bp, Homo sapiens
agaccagggtcccacagagtct

SEQ ID NO: 7492378 - DNA, 22 bp, Homo sapiens
agaccagggtcccacagagtct

SEQ ID NO: 7492379 - DNA, 22 bp, Homo sapiens
agaccaggtctttatggctcca

SEQ ID NO: 7492380 - DNA, 22 bp, Homo sapiens
agaccaggtctttatggctcca

SEQ ID NO: 7492381 - DNA, 22 bp, Homo sapiens
agaccaggtctttatggctcca

SEQ ID NO: 7492382 - DNA, 22 bp, Homo sapiens
agaccaggtctttatggctcca

SEQ ID NO: 7492383 - DNA, 22 bp, Homo sapiens
agacccagaaagcagctgcatt

SEQ ID NO: 7492384 - DNA, 22 bp, Homo sapiens
agacccagaaagcagctgcatt

SEQ ID NO: 7492385 - DNA, 22 bp, Homo sapiens
agacccagaaagcagctgcatt

SEQ ID NO: 7492386 - DNA, 22 bp, Homo sapiens
agacccacactttgagtagcaa

SEQ ID NO: 7492387 - DNA, 22 bp, Homo sapiens
agacccagaaagcagctgcatt

SEQ ID NO: 7492388 - DNA, 22 bp, Homo sapiens
agaccatgggctcctgggacat

SEQ ID NO: 7492389 - DNA, 22 bp, Homo sapiens
agaccatgggctctgaagagca

SEQ ID NO: 7492390 - DNA, 22 bp, Homo sapiens
agaccattccctggaagaatat

SEQ ID NO: 7492391 - DNA, 22 bp, Homo sapiens
agacccacactttgagtagcaa

SEQ ID NO: 7492392 - DNA, 22 bp, Homo sapiens
agaccagttttattatttgagt

SEQ ID NO: 7492393 - DNA, 22 bp, Homo sapiens
agaccagttcccttcttggctg

SEQ ID NO: 7492394 - DNA, 22 bp, Homo sapiens
agaccagtgttttagttagaag

SEQ ID NO: 7492395 - DNA, 22 bp, Homo sapiens
agaccagttacattagaacttc

SEQ ID NO: 7492396 - DNA, 21 bp, Homo sapiens
agaccagtgggataaataggt

SEQ ID NO: 7492397 - DNA, 21 bp, Homo sapiens
agaccagtgggataaataggt

SEQ ID NO: 7492398 - DNA, 22 bp, Homo sapiens
agaccagtgcatggcgtttgct

SEQ ID NO: 7492399 - DNA, 22 bp, Homo sapiens
agaccagtgagtaggccttaga

SEQ ID NO: 7492400 - DNA, 22 bp, Homo sapiens
agaccagtagtatggattatga

SEQ ID NO: 7492401 - DNA, 22 bp, Homo sapiens
agaccagtaaaattagtgggag

SEQ ID NO: 7492402 - DNA, 22 bp, Homo sapiens
atggccagcccttcccgcagct

SEQ ID NO: 7492403 - DNA, 22 bp, Homo sapiens
atggccagcccttcccgcagct

SEQ ID NO: 7492404 - DNA, 22 bp, Homo sapiens
atggccagcccttcccgcagct

SEQ ID NO: 7492405 - DNA, 22 bp, Homo sapiens
atggccagcccttcccgcagct

SEQ ID NO: 7492406 - DNA, 22 bp, Homo sapiens
atggccagccactcctgatggc

SEQ ID NO: 7492407 - DNA, 22 bp, Homo sapiens
atggccagccactcctgatggc

SEQ ID NO: 7492408 - DNA, 22 bp, Homo sapiens
atggccagcccttcccgcagct

SEQ ID NO: 7492409 - DNA, 22 bp, Homo sapiens
atggccagcaagttcagaattt

SEQ ID NO: 7492410 - DNA, 22 bp, Homo sapiens
atggccagccactcctgatggc

SEQ ID NO: 7492411 - DNA, 22 bp, Homo sapiens
atggccagccactcctgatggc

SEQ ID NO: 7492412 - DNA, 22 bp, Homo sapiens
atggccagctcagagcactcag

SEQ ID NO: 7492413 - DNA, 22 bp, Homo sapiens
atggccagctcagagcactcag

SEQ ID NO: 7492414 - DNA, 22 bp, Homo sapiens
atggccagctcagagcactcag

SEQ ID NO: 7492415 - DNA, 22 bp, Homo sapiens
atggccagctcagagcactcag

SEQ ID NO: 7492416 - DNA, 22 bp, Homo sapiens
atggccagcctggtacttggca

SEQ ID NO: 7492417 - DNA, 22 bp, Homo sapiens
atggccagctagcacttgcatt

SEQ ID NO: 7492418 - DNA, 22 bp, Homo sapiens
atggccagctcagagcactcag

SEQ ID NO: 7492419 - DNA, 23 bp, Homo sapiens
agacccagagactggctctgctc

SEQ ID NO: 7492420 - DNA, 22 bp, Homo sapiens
agacccagagggctgctgggag

SEQ ID NO: 7492421 - DNA, 22 bp, Homo sapiens
agacccagagggctgctgggag

SEQ ID NO: 7492422 - DNA, 22 bp, Homo sapiens
atggcagcctgagcagaggaat

SEQ ID NO: 7492423 - DNA, 22 bp, Homo sapiens
atggcagcctgagcagaggaat

SEQ ID NO: 7492424 - DNA, 22 bp, Homo sapiens
atggcagcctgagcagaggaat

SEQ ID NO: 7492425 - DNA, 23 bp, Homo sapiens
agacccagagactggctctgctc

SEQ ID NO: 7492426 - DNA, 23 bp, Homo sapiens
agacccagagactggctctgctc

SEQ ID NO: 7492427 - DNA, 23 bp, Homo sapiens
agacccagagactggctctgctc

SEQ ID NO: 7492428 - DNA, 22 bp, Homo sapiens
atggccagcaaggtagggcaat

SEQ ID NO: 7492429 - DNA, 22 bp, Homo sapiens
atggccagcaagttcagaattt

SEQ ID NO: 7492430 - DNA, 22 bp, Homo sapiens
atggccagcaagttcagaattt

SEQ ID NO: 7492431 - DNA, 22 bp, Homo sapiens
atggcagcggagctggaaatga

SEQ ID NO: 7492432 - DNA, 22 bp, Homo sapiens
atggcagcggagctggaaatga

SEQ ID NO: 7492433 - DNA, 22 bp, Homo sapiens
atggcagcctgtggacagtcaa

SEQ ID NO: 7492434 - DNA, 22 bp, Homo sapiens
atggcagcctgtggacagtcaa

SEQ ID NO: 7492435 - DNA, 22 bp, Homo sapiens
atggccaggcacctctggctga

SEQ ID NO: 7492436 - DNA, 22 bp, Homo sapiens
atggccagggccaaaagagatg

SEQ ID NO: 7492437 - DNA, 22 bp, Homo sapiens
atggccaggcacctctggctga

SEQ ID NO: 7492438 - DNA, 22 bp, Homo sapiens
atggccaggcacctctggctga

SEQ ID NO: 7492439 - DNA, 22 bp, Homo sapiens
atggccaggcacctctggctga

SEQ ID NO: 7492440 - DNA, 22 bp, Homo sapiens
atggccagcttataggggctca

SEQ ID NO: 7492441 - DNA, 22 bp, Homo sapiens
atggccagcttataggggctca

SEQ ID NO: 7492442 - DNA, 22 bp, Homo sapiens
atggccaggcacctctggctga

SEQ ID NO: 7492443 - DNA, 22 bp, Homo sapiens
atggccagcttataggggctca

SEQ ID NO: 7492444 - DNA, 22 bp, Homo sapiens
atggccagcttataggggctca

SEQ ID NO: 7492445 - DNA, 22 bp, Homo sapiens
atggccagtcaagcctctggct

SEQ ID NO: 7492446 - DNA, 22 bp, Homo sapiens
atggccagtcaagcctctggct

SEQ ID NO: 7492447 - DNA, 22 bp, Homo sapiens
atggccagtcaagcctctggct

SEQ ID NO: 7492448 - DNA, 22 bp, Homo sapiens
atggccagggtggcactgtggt

SEQ ID NO: 7492449 - DNA, 22 bp, Homo sapiens
atggccagggtggcactgtggt

SEQ ID NO: 7492450 - DNA, 22 bp, Homo sapiens
atggccagggtggcactgtggt

SEQ ID NO: 7492451 - DNA, 22 bp, Homo sapiens
atggccagggccaaaagagatg

SEQ ID NO: 7492452 - DNA, 22 bp, Homo sapiens
atggccagggtggcactgtggt

SEQ ID NO: 7492453 - DNA, 22 bp, Homo sapiens
atggccagggtggcactgtggt

SEQ ID NO: 7492454 - DNA, 22 bp, Homo sapiens
atggccagggtggcactgtggt

SEQ ID NO: 7492455 - DNA, 22 bp, Homo sapiens
agagaagacttacagccacagt

SEQ ID NO: 7492456 - DNA, 22 bp, Homo sapiens
agagaagagcaatgataaattt

SEQ ID NO: 7492457 - DNA, 22 bp, Homo sapiens
atggccagtcaagcctctggct

SEQ ID NO: 7492458 - DNA, 22 bp, Homo sapiens
agagaagacttacagccacagt

SEQ ID NO: 7492459 - DNA, 22 bp, Homo sapiens
agagaagagcaatgataaattt

SEQ ID NO: 7492460 - DNA, 22 bp, Homo sapiens
agagaagagcaatgataaattt

SEQ ID NO: 7492461 - DNA, 22 bp, Homo sapiens
agagaagagcaatgataaattt

SEQ ID NO: 7492462 - DNA, 22 bp, Homo sapiens
agagaagagcaatgataaattt

SEQ ID NO: 7492463 - DNA, 18 bp, Homo sapiens
agagaagaggtgttagtc

SEQ ID NO: 7492464 - DNA, 22 bp, Homo sapiens
agagaagagcaatgataaattt

SEQ ID NO: 7492465 - DNA, 21 bp, Homo sapiens
agagaagaggactttctcaca

SEQ ID NO: 7492466 - DNA, 22 bp, Homo sapiens
agagaagagcaatgataaattt

SEQ ID NO: 7492467 - DNA, 22 bp, Homo sapiens
agagaagagcaatgataaattt

SEQ ID NO: 7492468 - DNA, 21 bp, Homo sapiens
agagaagaggactttctcaca

SEQ ID NO: 7492469 - DNA, 22 bp, Homo sapiens
agagaagagcaatgataaattt

SEQ ID NO: 7492470 - DNA, 22 bp, Homo sapiens
agagaagagcaatgataaattt

SEQ ID NO: 7492471 - DNA, 22 bp, Homo sapiens
agagaagagcaatgataaattt

SEQ ID NO: 7492472 - DNA, 22 bp, Homo sapiens
atgggggcctgaacaggcaaaa

SEQ ID NO: 7492473 - DNA, 22 bp, Homo sapiens
atgggggcctgaacaggcaaaa

SEQ ID NO: 7492474 - DNA, 22 bp, Homo sapiens
atgggggcctgaacaggcaaaa

SEQ ID NO: 7492475 - DNA, 22 bp, Homo sapiens
agagatggcgtctcagagcctg

SEQ ID NO: 7492476 - DNA, 22 bp, Homo sapiens
agagatggcgtctcagagcctg

SEQ ID NO: 7492477 - DNA, 22 bp, Homo sapiens
agagatggcgtctcagagcctg

SEQ ID NO: 7492478 - DNA, 22 bp, Homo sapiens
agagatggcgtctcagagcctg

SEQ ID NO: 7492479 - DNA, 22 bp, Homo sapiens
atgggggaaagtacgagcatgg

SEQ ID NO: 7492480 - DNA, 22 bp, Homo sapiens
atgggggaaagtacgagcatgg

SEQ ID NO: 7492481 - DNA, 22 bp, Homo sapiens
agagatggccttaggtgggaat

SEQ ID NO: 7492482 - DNA, 22 bp, Homo sapiens
agagatggccttaggtgggaat

SEQ ID NO: 7492483 - DNA, 22 bp, Homo sapiens
agagatggccttaggtgggaat

SEQ ID NO: 7492484 - DNA, 22 bp, Homo sapiens
agagatggccttaggtgggaat

SEQ ID NO: 7492485 - DNA, 22 bp, Homo sapiens
agagatggccttaggtgggaat

SEQ ID NO: 7492486 - DNA, 22 bp, Homo sapiens
agagatggccttaggtgggaat

SEQ ID NO: 7492487 - DNA, 22 bp, Homo sapiens
atgggggcggctgaagcccagg

SEQ ID NO: 7492488 - DNA, 22 bp, Homo sapiens
atggggggatgaaggagtccaa

SEQ ID NO: 7492489 - DNA, 22 bp, Homo sapiens
atggggtgaccatgagcattta

SEQ ID NO: 7492490 - DNA, 22 bp, Homo sapiens
atggggtgaccatgagcattta

SEQ ID NO: 7492491 - DNA, 16 bp, Homo sapiens
atggggtacaaccagt

SEQ ID NO: 7492492 - DNA, 22 bp, Homo sapiens
atggggtgaccatgagcattta

SEQ ID NO: 7492493 - DNA, 22 bp, Homo sapiens
atggggtgagactaggattaaa

SEQ ID NO: 7492494 - DNA, 22 bp, Homo sapiens
atggggtgagactaggattaaa

SEQ ID NO: 7492495 - DNA, 20 bp, Homo sapiens
atggggtgagtgacgccctc

SEQ ID NO: 7492496 - DNA, 22 bp, Homo sapiens
atggggtgcatgcagattggga

SEQ ID NO: 7492497 - DNA, 22 bp, Homo sapiens
atggggtggagtccgggcagcg

SEQ ID NO: 7492498 - DNA, 22 bp, Homo sapiens
atggggtgcatgcagattggga

SEQ ID NO: 7492499 - DNA, 22 bp, Homo sapiens
atggggtgcatgcagattggga

SEQ ID NO: 7492500 - DNA, 20 bp, Homo sapiens
atggggtgagtgacgccctc

SEQ ID NO: 7492501 - DNA, 22 bp, Homo sapiens
agagatgcagggtacatggaat

SEQ ID NO: 7492502 - DNA, 22 bp, Homo sapiens
agagatgacatgagggacttaa

SEQ ID NO: 7492503 - DNA, 22 bp, Homo sapiens
agagatgcagggtacatggaat

SEQ ID NO: 7492504 - DNA, 22 bp, Homo sapiens
agagatgagaacatgcttggat

SEQ ID NO: 7492505 - DNA, 22 bp, Homo sapiens
agagatgagaacatgcttggat

SEQ ID NO: 7492506 - DNA, 22 bp, Homo sapiens
agagatgactgatggctgatta

SEQ ID NO: 7492507 - DNA, 22 bp, Homo sapiens
agagatgactgatggctgatta

SEQ ID NO: 7492508 - DNA, 22 bp, Homo sapiens
agagatgactgatggctgatta

SEQ ID NO: 7492509 - DNA, 22 bp, Homo sapiens
agagatgactgatggctgatta

SEQ ID NO: 7492510 - DNA, 22 bp, Homo sapiens
agagatgacatgagggacttaa

SEQ ID NO: 7492511 - DNA, 22 bp, Homo sapiens
agagatgacatgagggacttaa

SEQ ID NO: 7492512 - DNA, 22 bp, Homo sapiens
agagatgaatcttgagactctg

SEQ ID NO: 7492513 - DNA, 22 bp, Homo sapiens
agagatgaatcttgagactctg

SEQ ID NO: 7492514 - DNA, 22 bp, Homo sapiens
agagatgaatcttgagactctg

SEQ ID NO: 7492515 - DNA, 22 bp, Homo sapiens
agagatgaatcttgagactctg

SEQ ID NO: 7492516 - DNA, 22 bp, Homo sapiens
agagatgaagggcattccccag

SEQ ID NO: 7492517 - DNA, 22 bp, Homo sapiens
agagatgaatcttgagactctg

SEQ ID NO: 7492518 - DNA, 22 bp, Homo sapiens
agagatgaatcttgagactctg

SEQ ID NO: 7492519 - DNA, 22 bp, Homo sapiens
agagatggagagcactggggct

SEQ ID NO: 7492520 - DNA, 22 bp, Homo sapiens
agagatggatgttattatgggt

SEQ ID NO: 7492521 - DNA, 22 bp, Homo sapiens
agagatggatgttattatgggt

SEQ ID NO: 7492522 - DNA, 22 bp, Homo sapiens
agagatggatgttattatgggt

SEQ ID NO: 7492523 - DNA, 19 bp, Homo sapiens
agagatgctaagagtcttt

SEQ ID NO: 7492524 - DNA, 19 bp, Homo sapiens
agagatgctaagagtcttt

SEQ ID NO: 7492525 - DNA, 22 bp, Homo sapiens
agagatgctgcccgcagacgtg

SEQ ID NO: 7492526 - DNA, 22 bp, Homo sapiens
agagatgcattcagcatggatg

SEQ ID NO: 7492527 - DNA, 22 bp, Homo sapiens
agagatgcattcagcatggatg

SEQ ID NO: 7492528 - DNA, 22 bp, Homo sapiens
agagatgcattcagcatggatg

SEQ ID NO: 7492529 - DNA, 22 bp, Homo sapiens
agagatgcatctcttaaaattg

SEQ ID NO: 7492530 - DNA, 22 bp, Homo sapiens
agagatgcccttgaaaggatta

SEQ ID NO: 7492531 - DNA, 22 bp, Homo sapiens
agagccaatcttcagagcagag

SEQ ID NO: 7492532 - DNA, 22 bp, Homo sapiens
agagccaatcttcagagcagag

SEQ ID NO: 7492533 - DNA, 22 bp, Homo sapiens
agagccacagtggataggagcc

SEQ ID NO: 7492534 - DNA, 22 bp, Homo sapiens
agagccacggcaggcctaggaa

SEQ ID NO: 7492535 - DNA, 22 bp, Homo sapiens
agagccaaggctgagagctatt

SEQ ID NO: 7492536 - DNA, 22 bp, Homo sapiens
agagccaagttgtcaaggcact

SEQ ID NO: 7492537 - DNA, 22 bp, Homo sapiens
agagccaatcttcagagcagag

SEQ ID NO: 7492538 - DNA, 22 bp, Homo sapiens
agagccactgggagacagagca

SEQ ID NO: 7492539 - DNA, 22 bp, Homo sapiens
agagccactgggagacagagca

SEQ ID NO: 7492540 - DNA, 22 bp, Homo sapiens
agagccactgggagacagagca

SEQ ID NO: 7492541 - DNA, 22 bp, Homo sapiens
agagccacggcaggcctaggaa

SEQ ID NO: 7492542 - DNA, 22 bp, Homo sapiens
agagccacagtggataggagcc

SEQ ID NO: 7492543 - DNA, 22 bp, Homo sapiens
agagccacggcaggcctaggaa

SEQ ID NO: 7492544 - DNA, 19 bp, Homo sapiens
agagccagacagcatagga

SEQ ID NO: 7492545 - DNA, 19 bp, Homo sapiens
agagccagacagcatagga

SEQ ID NO: 7492546 - DNA, 19 bp, Homo sapiens
agagccagacagcatagga

SEQ ID NO: 7492547 - DNA, 19 bp, Homo sapiens
agagccagacagcatagga

SEQ ID NO: 7492548 - DNA, 22 bp, Homo sapiens
agagccagaccattgccgtgca

SEQ ID NO: 7492549 - DNA, 22 bp, Homo sapiens
agagccagaccattgccgtgca

SEQ ID NO: 7492550 - DNA, 22 bp, Homo sapiens
agagccagaccattgccgtgca

SEQ ID NO: 7492551 - DNA, 22 bp, Homo sapiens
agagccagaccattgccgtgca

SEQ ID NO: 7492552 - DNA, 22 bp, Homo sapiens
agagccagagacctgggttcac

SEQ ID NO: 7492553 - DNA, 22 bp, Homo sapiens
agagccagagacctgggttcac

SEQ ID NO: 7492554 - DNA, 22 bp, Homo sapiens
agagccagagacctgggttcac

SEQ ID NO: 7492555 - DNA, 22 bp, Homo sapiens
agagccagagacctgggttcac

SEQ ID NO: 7492556 - DNA, 22 bp, Homo sapiens
agagccagagacctgggttcac

SEQ ID NO: 7492557 - DNA, 22 bp, Homo sapiens
agagccagatggagccgtgtgt

SEQ ID NO: 7492558 - DNA, 19 bp, Homo sapiens
agagccagacagcatagga

SEQ ID NO: 7492559 - DNA, 22 bp, Homo sapiens
agagccagaccattgccgtgca

SEQ ID NO: 7492560 - DNA, 19 bp, Homo sapiens
agagccagacagcatagga

SEQ ID NO: 7492561 - DNA, 22 bp, Homo sapiens
agagccagaccattgccgtgca

SEQ ID NO: 7492562 - DNA, 22 bp, Homo sapiens
agagccagaccattgccgtgca

SEQ ID NO: 7492563 - DNA, 22 bp, Homo sapiens
agagccagaccattgccgtgca

SEQ ID NO: 7492564 - DNA, 22 bp, Homo sapiens
agagccagaccattgccgtgca

SEQ ID NO: 7492565 - DNA, 22 bp, Homo sapiens
agagccaaggcctcagtctcaa

SEQ ID NO: 7492566 - DNA, 17 bp, Homo sapiens
agagcatgtgtaggagc

SEQ ID NO: 7492567 - DNA, 17 bp, Homo sapiens
agagcatgtgtaggagc

SEQ ID NO: 7492568 - DNA, 23 bp, Homo sapiens
agagccaagcttctttctcacat

SEQ ID NO: 7492569 - DNA, 22 bp, Homo sapiens
agagcatcaccgttacccactt

SEQ ID NO: 7492570 - DNA, 22 bp, Homo sapiens
agagcatccatttttgtcacat

SEQ ID NO: 7492571 - DNA, 22 bp, Homo sapiens
agagcatctaacacataagcct

SEQ ID NO: 7492572 - DNA, 22 bp, Homo sapiens
agagcatccatttttgtcacat

SEQ ID NO: 7492573 - DNA, 22 bp, Homo sapiens
agagcagtcattaatacatgta

SEQ ID NO: 7492574 - DNA, 22 bp, Homo sapiens
agagcagtcattaatacatgta

SEQ ID NO: 7492575 - DNA, 22 bp, Homo sapiens
agagcagcctgtgatgatgcac

SEQ ID NO: 7492576 - DNA, 22 bp, Homo sapiens
agagcagcctgtgatgatgcac

SEQ ID NO: 7492577 - DNA, 22 bp, Homo sapiens
agagcagcctgtgatgatgcac

SEQ ID NO: 7492578 - DNA, 18 bp, Homo sapiens
agagcagcggcatcacac

SEQ ID NO: 7492579 - DNA, 22 bp, Homo sapiens
agagcagcctgtgatgatgcac

SEQ ID NO: 7492580 - DNA, 22 bp, Homo sapiens
agagcagcctgtgatgatgcac

SEQ ID NO: 7492581 - DNA, 22 bp, Homo sapiens
agagcagcctcagctccctgtg

SEQ ID NO: 7492582 - DNA, 22 bp, Homo sapiens
agagcagcctcagctccctgtg

SEQ ID NO: 7492583 - DNA, 22 bp, Homo sapiens
atggggttcacctgacagagaa

SEQ ID NO: 7492584 - DNA, 22 bp, Homo sapiens
atggggtggagtccgggcagcg

SEQ ID NO: 7492585 - DNA, 22 bp, Homo sapiens
atggggtggagtccgggcagcg

SEQ ID NO: 7492586 - DNA, 22 bp, Homo sapiens
atggggtggagtccgggcagcg

SEQ ID NO: 7492587 - DNA, 22 bp, Homo sapiens
atggggtggagtccgggcagcg

SEQ ID NO: 7492588 - DNA, 22 bp, Homo sapiens
atggggtggagtccgggcagcg

SEQ ID NO: 7492589 - DNA, 22 bp, Homo sapiens
atgggtaggatttactcagatg

SEQ ID NO: 7492590 - DNA, 22 bp, Homo sapiens
atgggtaggatttactcagatg

SEQ ID NO: 7492591 - DNA, 22 bp, Homo sapiens
atgggtagaatcatttctggac

SEQ ID NO: 7492592 - DNA, 22 bp, Homo sapiens
atgggtagactgacaaagtcaa

SEQ ID NO: 7492593 - DNA, 22 bp, Homo sapiens
atgggtaggagaacaaatataa

SEQ ID NO: 7492594 - DNA, 22 bp, Homo sapiens
atggggttcacctgacagagaa

SEQ ID NO: 7492595 - DNA, 22 bp, Homo sapiens
atggggttcacctgacagagaa

SEQ ID NO: 7492596 - DNA, 22 bp, Homo sapiens
atgggtaaagcaggaagagagt

SEQ ID NO: 7492597 - DNA, 22 bp, Homo sapiens
atgggtaaagcaggaagagagt

SEQ ID NO: 7492598 - DNA, 22 bp, Homo sapiens
atgggtaaggctgaaggaaagt

SEQ ID NO: 7492599 - DNA, 22 bp, Homo sapiens
atgggtggaggagaaaggcatc

SEQ ID NO: 7492600 - DNA, 22 bp, Homo sapiens
atgggtggaggagaaaggcatc

SEQ ID NO: 7492601 - DNA, 22 bp, Homo sapiens
atgggtggagggtgacacggat

SEQ ID NO: 7492602 - DNA, 22 bp, Homo sapiens
atgggtggaggagaaaggcatc

SEQ ID NO: 7492603 - DNA, 22 bp, Homo sapiens
atgggtggaggagaaaggcatc

SEQ ID NO: 7492604 - DNA, 22 bp, Homo sapiens
atgggtggagggtgacacggat

SEQ ID NO: 7492605 - DNA, 22 bp, Homo sapiens
atgggtggagggtgacacggat

SEQ ID NO: 7492606 - DNA, 22 bp, Homo sapiens
atgggtggagggtgacacggat

SEQ ID NO: 7492607 - DNA, 22 bp, Homo sapiens
atgggtggagggtgacacggat

SEQ ID NO: 7492608 - DNA, 22 bp, Homo sapiens
atgtatttgcttgttatggatt

SEQ ID NO: 7492609 - DNA, 22 bp, Homo sapiens
atgtattttaagatttgcctca

SEQ ID NO: 7492610 - DNA, 22 bp, Homo sapiens
atgtattttaagatttgcctca

SEQ ID NO: 7492611 - DNA, 22 bp, Homo sapiens
atgtatttgcttgttatggatt

SEQ ID NO: 7492612 - DNA, 22 bp, Homo sapiens
atgtatttgcttgttatggatt

SEQ ID NO: 7492613 - DNA, 22 bp, Homo sapiens
atgtatttgcttgttatggatt

SEQ ID NO: 7492614 - DNA, 22 bp, Homo sapiens
atgtatttgcttgttatggatt

SEQ ID NO: 7492615 - DNA, 22 bp, Homo sapiens
atgtatttgcttgttatggatt

SEQ ID NO: 7492616 - DNA, 22 bp, Homo sapiens
atgtatttgcttgttatggatt

SEQ ID NO: 7492617 - DNA, 22 bp, Homo sapiens
atgtatttgcgtatggacatac

SEQ ID NO: 7492618 - DNA, 22 bp, Homo sapiens
atgtatttgcgtatggacatac

SEQ ID NO: 7492619 - DNA, 22 bp, Homo sapiens
atgtatttgcgtatggacatac

SEQ ID NO: 7492620 - DNA, 22 bp, Homo sapiens
atgtatttgcgtatggacatac

SEQ ID NO: 7492621 - DNA, 22 bp, Homo sapiens
atgtatttgcgtatggacatac

SEQ ID NO: 7492622 - DNA, 22 bp, Homo sapiens
atgtatttgcgtatggacatac

SEQ ID NO: 7492623 - DNA, 22 bp, Homo sapiens
atgtatttgcgtatggacatac

SEQ ID NO: 7492624 - DNA, 22 bp, Homo sapiens
atgtatttgcgtatggacatac

SEQ ID NO: 7492625 - DNA, 22 bp, Homo sapiens
agagccagcaactctagccctg

SEQ ID NO: 7492626 - DNA, 22 bp, Homo sapiens
agagccagcaagtgaatagtga

SEQ ID NO: 7492627 - DNA, 22 bp, Homo sapiens
atgtatttgaaatttgagacat

SEQ ID NO: 7492628 - DNA, 22 bp, Homo sapiens
atgtatttgcgaggttaggaaa

SEQ ID NO: 7492629 - DNA, 22 bp, Homo sapiens
atgtatttgcgaggttaggaaa

SEQ ID NO: 7492630 - DNA, 22 bp, Homo sapiens
atgtatttgcgaggttaggaaa

SEQ ID NO: 7492631 - DNA, 22 bp, Homo sapiens
atgtatttgaaatttgagacat

SEQ ID NO: 7492632 - DNA, 22 bp, Homo sapiens
atgtatttgaaatttgagacat

SEQ ID NO: 7492633 - DNA, 22 bp, Homo sapiens
agagccagatggagccgtgtgt

SEQ ID NO: 7492634 - DNA, 22 bp, Homo sapiens
agagccagatggagccgtgtgt

SEQ ID NO: 7492635 - DNA, 22 bp, Homo sapiens
agagccagatggagccgtgtgt

SEQ ID NO: 7492636 - DNA, 22 bp, Homo sapiens
agagccagatggagccgtgtgt

SEQ ID NO: 7492637 - DNA, 22 bp, Homo sapiens
agagccagatggagccgtgtgt

SEQ ID NO: 7492638 - DNA, 22 bp, Homo sapiens
agagccagcaactctagccctg

SEQ ID NO: 7492639 - DNA, 22 bp, Homo sapiens
agagccagcaactctagccctg

SEQ ID NO: 7492640 - DNA, 22 bp, Homo sapiens
agagccagcaactctagccctg

SEQ ID NO: 7492641 - DNA, 22 bp, Homo sapiens
agagccagcaactctagccctg

SEQ ID NO: 7492642 - DNA, 22 bp, Homo sapiens
agagccagcaactctagccctg

SEQ ID NO: 7492643 - DNA, 22 bp, Homo sapiens
agagcctgcagtggagaccttg

SEQ ID NO: 7492644 - DNA, 22 bp, Homo sapiens
agagcctgcagtggagaccttg

SEQ ID NO: 7492645 - DNA, 22 bp, Homo sapiens
agagcctgcagtggagaccttg

SEQ ID NO: 7492646 - DNA, 22 bp, Homo sapiens
agagcctgggaatttgcatgtt

SEQ ID NO: 7492647 - DNA, 22 bp, Homo sapiens
agagcctggctcccagctaccg

SEQ ID NO: 7492648 - DNA, 22 bp, Homo sapiens
agagcctgcatcaggcttgggg

SEQ ID NO: 7492649 - DNA, 22 bp, Homo sapiens
agagcctgggaatttgcatgtt

SEQ ID NO: 7492650 - DNA, 22 bp, Homo sapiens
agagcctgggcagctcctctgg

SEQ ID NO: 7492651 - DNA, 22 bp, Homo sapiens
agagcctgggcagctcctctgg

SEQ ID NO: 7492652 - DNA, 22 bp, Homo sapiens
agagcctgggcagctcctctgg

SEQ ID NO: 7492653 - DNA, 22 bp, Homo sapiens
agagcctggggattggcaaggg

SEQ ID NO: 7492654 - DNA, 22 bp, Homo sapiens
agagcctggggattggcaaggg

SEQ ID NO: 7492655 - DNA, 22 bp, Homo sapiens
agagcctgggcagctcctctgg

SEQ ID NO: 7492656 - DNA, 22 bp, Homo sapiens
agagcctggggattggcaaggg

SEQ ID NO: 7492657 - DNA, 22 bp, Homo sapiens
atgtcaaatcagttttatcaga

SEQ ID NO: 7492658 - DNA, 22 bp, Homo sapiens
atgtcaaatcagttttatcaga

SEQ ID NO: 7492659 - DNA, 22 bp, Homo sapiens
atgtcaaatcagttttatcaga

SEQ ID NO: 7492660 - DNA, 22 bp, Homo sapiens
atgtcaaatcagttttatcaga

SEQ ID NO: 7492661 - DNA, 22 bp, Homo sapiens
agagcctgcagctgtgaagaaa

SEQ ID NO: 7492662 - DNA, 22 bp, Homo sapiens
atgtcaaagcagactgagagcg

SEQ ID NO: 7492663 - DNA, 22 bp, Homo sapiens
atgtcaaacacaacaccagtgg

SEQ ID NO: 7492664 - DNA, 22 bp, Homo sapiens
atgtcaaagcagactgagagcg

SEQ ID NO: 7492665 - DNA, 22 bp, Homo sapiens
atgtcaaacacaacaccagtgg

SEQ ID NO: 7492666 - DNA, 22 bp, Homo sapiens
atgtcaaacacaacaccagtgg

SEQ ID NO: 7492667 - DNA, 22 bp, Homo sapiens
atgtcaaacacaacaccagtgg

SEQ ID NO: 7492668 - DNA, 22 bp, Homo sapiens
atgtattttaagatttgcctca

SEQ ID NO: 7492669 - DNA, 22 bp, Homo sapiens
atgtattttaagatttgcctca

SEQ ID NO: 7492670 - DNA, 22 bp, Homo sapiens
atgtattttaagatttgcctca

SEQ ID NO: 7492671 - DNA, 22 bp, Homo sapiens
atgtattttaagatttgcctca

SEQ ID NO: 7492672 - DNA, 22 bp, Homo sapiens
atgtcaaacacaacaccagtgg

SEQ ID NO: 7492673 - DNA, 22 bp, Homo sapiens
atgtattttgccagactgtctc

SEQ ID NO: 7492674 - DNA, 22 bp, Homo sapiens
atgtattttgccagactgtctc

SEQ ID NO: 7492675 - DNA, 22 bp, Homo sapiens
atgtattttgccagactgtctc

SEQ ID NO: 7492676 - DNA, 22 bp, Homo sapiens
agagcctgtacttttctgtgaa

SEQ ID NO: 7492677 - DNA, 22 bp, Homo sapiens
agagcctgtacttttctgtgaa

SEQ ID NO: 7492678 - DNA, 22 bp, Homo sapiens
agagcctgtcaattgtaaagag

SEQ ID NO: 7492679 - DNA, 22 bp, Homo sapiens
agagcctgtcaattgtaaagag

SEQ ID NO: 7492680 - DNA, 22 bp, Homo sapiens
agagcctgtcaattgtaaagag

SEQ ID NO: 7492681 - DNA, 22 bp, Homo sapiens
agagcctgtcaattgtaaagag

SEQ ID NO: 7492682 - DNA, 22 bp, Homo sapiens
agagcctgtctgcctttctacc

SEQ ID NO: 7492683 - DNA, 22 bp, Homo sapiens
agagcctgtacttttctgtgaa

SEQ ID NO: 7492684 - DNA, 22 bp, Homo sapiens
agagcctggttcaaattttacc

SEQ ID NO: 7492685 - DNA, 22 bp, Homo sapiens
agagcctgtaacatctttctta

SEQ ID NO: 7492686 - DNA, 22 bp, Homo sapiens
agagcctggtctgagataggac

SEQ ID NO: 7492687 - DNA, 22 bp, Homo sapiens
agagcctgttcggaggcgcccc

SEQ ID NO: 7492688 - DNA, 22 bp, Homo sapiens
agagcctgttcggaggcgcccc

SEQ ID NO: 7492689 - DNA, 22 bp, Homo sapiens
agagcctgttttgtgggagatg

SEQ ID NO: 7492690 - DNA, 22 bp, Homo sapiens
agagcctgttcggaggcgcccc

SEQ ID NO: 7492691 - DNA, 22 bp, Homo sapiens
agagcctgttttgtgggagatg

SEQ ID NO: 7492692 - DNA, 22 bp, Homo sapiens
agagcctgtgggagatgcagct

SEQ ID NO: 7492693 - DNA, 22 bp, Homo sapiens
agagcctgtgggagatgcagct

SEQ ID NO: 7492694 - DNA, 22 bp, Homo sapiens
agagcctgtgggagatgcagct

SEQ ID NO: 7492695 - DNA, 22 bp, Homo sapiens
agagcctgtgggagatgcagct

SEQ ID NO: 7492696 - DNA, 22 bp, Homo sapiens
agagcctgtgggagatgcagct

SEQ ID NO: 7492697 - DNA, 22 bp, Homo sapiens
agagcctgtgggagatgcagct

SEQ ID NO: 7492698 - DNA, 22 bp, Homo sapiens
agagcctgtgattgtcatcacc

SEQ ID NO: 7492699 - DNA, 22 bp, Homo sapiens
agagcctgtgattgtcatcacc

SEQ ID NO: 7492700 - DNA, 22 bp, Homo sapiens
agagcctgtgattgtcatcacc

SEQ ID NO: 7492701 - DNA, 22 bp, Homo sapiens
agagcctgtgattgtcatcacc

SEQ ID NO: 7492702 - DNA, 22 bp, Homo sapiens
atgtgtacaaccaagcactaaa

SEQ ID NO: 7492703 - DNA, 22 bp, Homo sapiens
atgtgtaatgtggtattttaat

SEQ ID NO: 7492704 - DNA, 22 bp, Homo sapiens
atgtgtaaattgttaggtttaa

SEQ ID NO: 7492705 - DNA, 22 bp, Homo sapiens
atgtgtaatgtggtattttaat

SEQ ID NO: 7492706 - DNA, 22 bp, Homo sapiens
atgtgtaaagttagatgtctga

SEQ ID NO: 7492707 - DNA, 22 bp, Homo sapiens
atgtgtaaaaggcatgttttat

SEQ ID NO: 7492708 - DNA, 22 bp, Homo sapiens
atgtgtaaagcttttctttgtt

SEQ ID NO: 7492709 - DNA, 22 bp, Homo sapiens
atgtggggactctgagagaatt

SEQ ID NO: 7492710 - DNA, 22 bp, Homo sapiens
atgtgtaaaaggcatgttttat

SEQ ID NO: 7492711 - DNA, 22 bp, Homo sapiens
atgtggttttggattattcatg

SEQ ID NO: 7492712 - DNA, 22 bp, Homo sapiens
atgtgtaaaaagtgcttaatat

SEQ ID NO: 7492713 - DNA, 22 bp, Homo sapiens
atgtggttgaagaattacatct

SEQ ID NO: 7492714 - DNA, 22 bp, Homo sapiens
atgtggttgcctttctgtcctt

SEQ ID NO: 7492715 - DNA, 22 bp, Homo sapiens
atgtggttgcctttctgtcctt

SEQ ID NO: 7492716 - DNA, 22 bp, Homo sapiens
atgtggggacaaaatgatggcc

SEQ ID NO: 7492717 - DNA, 22 bp, Homo sapiens
atgtggggacaaaatgatggcc

SEQ ID NO: 7492718 - DNA, 22 bp, Homo sapiens
atgtggggactctgagagaatt

SEQ ID NO: 7492719 - DNA, 22 bp, Homo sapiens
atgtggggacaaaatgatggcc

SEQ ID NO: 7492720 - DNA, 22 bp, Homo sapiens
atgtgggccgtgcgggtgtcct

SEQ ID NO: 7492721 - DNA, 22 bp, Homo sapiens
atgtgggccgtgcgggtgtcct

SEQ ID NO: 7492722 - DNA, 22 bp, Homo sapiens
atgtgggccgtgcgggtgtcct

SEQ ID NO: 7492723 - DNA, 22 bp, Homo sapiens
atgtgggccgtgcgggtgtcct

SEQ ID NO: 7492724 - DNA, 22 bp, Homo sapiens
atgtgggagatttcaggaggtg

SEQ ID NO: 7492725 - DNA, 22 bp, Homo sapiens
agagcctgttttgtgggagatg

SEQ ID NO: 7492726 - DNA, 22 bp, Homo sapiens
atgtgggagatttcaggaggtg

SEQ ID NO: 7492727 - DNA, 22 bp, Homo sapiens
atgtgggagatttcaggaggtg

SEQ ID NO: 7492728 - DNA, 22 bp, Homo sapiens
atgtgggagatttcaggaggtg

SEQ ID NO: 7492729 - DNA, 21 bp, Homo sapiens
cagaggcaggctctgtgtgtg

SEQ ID NO: 7492730 - DNA, 21 bp, Homo sapiens
cagaggcaggctctgtgtgtg

SEQ ID NO: 7492731 - DNA, 21 bp, Homo sapiens
cagaggcaggtcctgggacgg

SEQ ID NO: 7492732 - DNA, 21 bp, Homo sapiens
cagaggcaggtcctgggacgg

SEQ ID NO: 7492733 - DNA, 21 bp, Homo sapiens
cagaggcaggtcctgggacgg

SEQ ID NO: 7492734 - DNA, 21 bp, Homo sapiens
cagaggcaggtcctgggacgg

SEQ ID NO: 7492735 - DNA, 22 bp, Homo sapiens
cagaggagttcagtacacagcc

SEQ ID NO: 7492736 - DNA, 21 bp, Homo sapiens
cagaggcaggctctgtgtgtg

SEQ ID NO: 7492737 - DNA, 21 bp, Homo sapiens
cagaggcaggctctgtgtgtg

SEQ ID NO: 7492738 - DNA, 21 bp, Homo sapiens
cagaggcaggctctgtgtgtg

SEQ ID NO: 7492739 - DNA, 22 bp, Homo sapiens
agcccagccggattcccagttc

SEQ ID NO: 7492740 - DNA, 22 bp, Homo sapiens
agcccagccggattcccagttc

SEQ ID NO: 7492741 - DNA, 22 bp, Homo sapiens
agcccagccggattcccagttc

SEQ ID NO: 7492742 - DNA, 22 bp, Homo sapiens
agcccagccggattcccagttc

SEQ ID NO: 7492743 - DNA, 22 bp, Homo sapiens
agcccagccggattcccagttc

SEQ ID NO: 7492744 - DNA, 22 bp, Homo sapiens
agcccagccggattcccagttc

SEQ ID NO: 7492745 - DNA, 22 bp, Homo sapiens
cagaggagttcagtacacagcc

SEQ ID NO: 7492746 - DNA, 22 bp, Homo sapiens
cagaggagttcagtacacagcc

SEQ ID NO: 7492747 - DNA, 22 bp, Homo sapiens
cagaggagttcagtacacagcc

SEQ ID NO: 7492748 - DNA, 21 bp, Homo sapiens
cagaggcaggtcctgggacgg

SEQ ID NO: 7492749 - DNA, 21 bp, Homo sapiens
cagaggcaggtcctgggacgg

SEQ ID NO: 7492750 - DNA, 21 bp, Homo sapiens
cagaggcaggtcctgggacgg

SEQ ID NO: 7492751 - DNA, 21 bp, Homo sapiens
cagaggcaggtcctgggacgg

SEQ ID NO: 7492752 - DNA, 21 bp, Homo sapiens
cagaggcaggtcctgggacgg

SEQ ID NO: 7492753 - DNA, 21 bp, Homo sapiens
cagaggcaggtcctgggacgg

SEQ ID NO: 7492754 - DNA, 22 bp, Homo sapiens
cagaggcagtggggttgctcct

SEQ ID NO: 7492755 - DNA, 22 bp, Homo sapiens
cagaggcagtggggttgctcct

SEQ ID NO: 7492756 - DNA, 22 bp, Homo sapiens
cagaggcatactcccagtcttg

SEQ ID NO: 7492757 - DNA, 22 bp, Homo sapiens
cagaggcagtggggttgctcct

SEQ ID NO: 7492758 - DNA, 22 bp, Homo sapiens
cagaggcagtggggttgctcct

SEQ ID NO: 7492759 - DNA, 22 bp, Homo sapiens
cagaggcagtggggttgctcct

SEQ ID NO: 7492760 - DNA, 22 bp, Homo sapiens
cagaggcagtggggttgctcct

SEQ ID NO: 7492761 - DNA, 22 bp, Homo sapiens
cagaggcagtggggttgctcct

SEQ ID NO: 7492762 - DNA, 22 bp, Homo sapiens
cagaggcattactgaaaaggtg

SEQ ID NO: 7492763 - DNA, 22 bp, Homo sapiens
cagaggcattactgaaaaggtg

SEQ ID NO: 7492764 - DNA, 23 bp, Homo sapiens
cagaggcatcggattcaacatca

SEQ ID NO: 7492765 - DNA, 22 bp, Homo sapiens
cagaggcattactgaaaaggtg

SEQ ID NO: 7492766 - DNA, 22 bp, Homo sapiens
cagaggcattactgaaaaggtg

SEQ ID NO: 7492767 - DNA, 22 bp, Homo sapiens
cagaggcattactgaaaaggtg

SEQ ID NO: 7492768 - DNA, 22 bp, Homo sapiens
cagaggcattactgaaaaggtg

SEQ ID NO: 7492769 - DNA, 22 bp, Homo sapiens
agcccaggcagagggatgcttg

SEQ ID NO: 7492770 - DNA, 20 bp, Homo sapiens
cagaggcattttcagactct

SEQ ID NO: 7492771 - DNA, 20 bp, Homo sapiens
cagaggcattttcagactct

SEQ ID NO: 7492772 - DNA, 20 bp, Homo sapiens
cagaggcattttcagactct

SEQ ID NO: 7492773 - DNA, 22 bp, Homo sapiens
agcccaggcagagggatgcttg

SEQ ID NO: 7492774 - DNA, 22 bp, Homo sapiens
agcccaggcagagggatgcttg

SEQ ID NO: 7492775 - DNA, 22 bp, Homo sapiens
agcccaggcagagggatgcttg

SEQ ID NO: 7492776 - DNA, 22 bp, Homo sapiens
agcccaggcagagggatgcttg

SEQ ID NO: 7492777 - DNA, 22 bp, Homo sapiens
agcccaggcagagggatgcttg

SEQ ID NO: 7492778 - DNA, 22 bp, Homo sapiens
agcccaggcagagggatgcttg

SEQ ID NO: 7492779 - DNA, 22 bp, Homo sapiens
agcccaggcagagggatgcttg

SEQ ID NO: 7492780 - DNA, 22 bp, Homo sapiens
agcccaggcagagggatgcttg

SEQ ID NO: 7492781 - DNA, 22 bp, Homo sapiens
agcccaggcagagggatgcttg

SEQ ID NO: 7492782 - DNA, 22 bp, Homo sapiens
agcccaggcagagggatgcttg

SEQ ID NO: 7492783 - DNA, 22 bp, Homo sapiens
agcccaggcagagggatgcttg

SEQ ID NO: 7492784 - DNA, 22 bp, Homo sapiens
cagaggcatactcccagtcttg

SEQ ID NO: 7492785 - DNA, 22 bp, Homo sapiens
cagaggcatactcccagtcttg

SEQ ID NO: 7492786 - DNA, 22 bp, Homo sapiens
cagaggcatactcccagtcttg

SEQ ID NO: 7492787 - DNA, 22 bp, Homo sapiens
cagaggcatactcccagtcttg

SEQ ID NO: 7492788 - DNA, 22 bp, Homo sapiens
cagaggcatactcccagtcttg

SEQ ID NO: 7492789 - DNA, 22 bp, Homo sapiens
cagaggcatactcccagtcttg

SEQ ID NO: 7492790 - DNA, 22 bp, Homo sapiens
cagaggcatactcccagtcttg

SEQ ID NO: 7492791 - DNA, 22 bp, Homo sapiens
cagaggcatactcccagtcttg

SEQ ID NO: 7492792 - DNA, 22 bp, Homo sapiens
cagaggcatactcccagtcttg

SEQ ID NO: 7492793 - DNA, 22 bp, Homo sapiens
cagaggcatataattgctgggg

SEQ ID NO: 7492794 - DNA, 22 bp, Homo sapiens
cagaggcatataattgctgggg

SEQ ID NO: 7492795 - DNA, 23 bp, Homo sapiens
cagaggcatcggattcaacatca

SEQ ID NO: 7492796 - DNA, 23 bp, Homo sapiens
cagaggcatcggattcaacatca

SEQ ID NO: 7492797 - DNA, 23 bp, Homo sapiens
cagaggcatcggattcaacatca

SEQ ID NO: 7492798 - DNA, 23 bp, Homo sapiens
cagaggcatcggattcaacatca

SEQ ID NO: 7492799 - DNA, 23 bp, Homo sapiens
cagaggcatcggattcaacatca

SEQ ID NO: 7492800 - DNA, 23 bp, Homo sapiens
cagaggcatcggattcaacatca

SEQ ID NO: 7492801 - DNA, 22 bp, Homo sapiens
cagaggctgacaaaatattgct

SEQ ID NO: 7492802 - DNA, 22 bp, Homo sapiens
cagaggctgacaaaatattgct

SEQ ID NO: 7492803 - DNA, 22 bp, Homo sapiens
cagaggctgacaaaatattgct

SEQ ID NO: 7492804 - DNA, 22 bp, Homo sapiens
cagaggctgacaaaatattgct

SEQ ID NO: 7492805 - DNA, 22 bp, Homo sapiens
cagagggacagtatgatgaaag

SEQ ID NO: 7492806 - DNA, 22 bp, Homo sapiens
cagagggacagtatgatgaaag

SEQ ID NO: 7492807 - DNA, 22 bp, Homo sapiens
cagagggacagtatgatgaaag

SEQ ID NO: 7492808 - DNA, 22 bp, Homo sapiens
agcccagggaaccaggaagtgg

SEQ ID NO: 7492809 - DNA, 22 bp, Homo sapiens
agcccagggaaccaggaagtgg

SEQ ID NO: 7492810 - DNA, 22 bp, Homo sapiens
agcccagggaaccaggaagtgg

SEQ ID NO: 7492811 - DNA, 22 bp, Homo sapiens
agcccagggaaccaggaagtgg

SEQ ID NO: 7492812 - DNA, 22 bp, Homo sapiens
cagaggctcttcctcactgccc

SEQ ID NO: 7492813 - DNA, 22 bp, Homo sapiens
cagaggctcttcctcactgccc

SEQ ID NO: 7492814 - DNA, 22 bp, Homo sapiens
cagaggctcttcctcactgccc

SEQ ID NO: 7492815 - DNA, 22 bp, Homo sapiens
cagaggctcttcctcactgccc

SEQ ID NO: 7492816 - DNA, 22 bp, Homo sapiens
cagaggctcttcctcactgccc

SEQ ID NO: 7492817 - DNA, 22 bp, Homo sapiens
cagagggaccagaacatactgt

SEQ ID NO: 7492818 - DNA, 22 bp, Homo sapiens
cagagggaccagaacatactgt

SEQ ID NO: 7492819 - DNA, 22 bp, Homo sapiens
cagagggaccagaacatactgt

SEQ ID NO: 7492820 - DNA, 22 bp, Homo sapiens
cagagggagccctccaggagca

SEQ ID NO: 7492821 - DNA, 22 bp, Homo sapiens
cagagggaccagaacatactgt

SEQ ID NO: 7492822 - DNA, 22 bp, Homo sapiens
cagagggacagtgtaatgcata

SEQ ID NO: 7492823 - DNA, 22 bp, Homo sapiens
cagagggacagtgtaatgcata

SEQ ID NO: 7492824 - DNA, 22 bp, Homo sapiens
cagagggacagtgtaatgcata

SEQ ID NO: 7492825 - DNA, 22 bp, Homo sapiens
cagagggaccagaacatactgt

SEQ ID NO: 7492826 - DNA, 22 bp, Homo sapiens
cagagggacagtgtaatgcata

SEQ ID NO: 7492827 - DNA, 22 bp, Homo sapiens
cagagggaccagaacatactgt

SEQ ID NO: 7492828 - DNA, 22 bp, Homo sapiens
cagagggacagtgtaatgcata

SEQ ID NO: 7492829 - DNA, 22 bp, Homo sapiens
cagagggagtttctgaggttgc

SEQ ID NO: 7492830 - DNA, 22 bp, Homo sapiens
cagagggagccctccaggagca

SEQ ID NO: 7492831 - DNA, 22 bp, Homo sapiens
cagagggagtttctgaggttgc

SEQ ID NO: 7492832 - DNA, 22 bp, Homo sapiens
cagagggagccctccaggagca

SEQ ID NO: 7492833 - DNA, 22 bp, Homo sapiens
cagagggagccctccaggagca

SEQ ID NO: 7492834 - DNA, 22 bp, Homo sapiens
cagagggagccctccaggagca

SEQ ID NO: 7492835 - DNA, 22 bp, Homo sapiens
cagagggagccctccaggagca

SEQ ID NO: 7492836 - DNA, 22 bp, Homo sapiens
cagagggagccctccaggagca

SEQ ID NO: 7492837 - DNA, 22 bp, Homo sapiens
cagagggagccctccaggagca

SEQ ID NO: 7492838 - DNA, 22 bp, Homo sapiens
agcccagggaaccaggaagtgg

SEQ ID NO: 7492839 - DNA, 22 bp, Homo sapiens
agcccagggaaccaggaagtgg

SEQ ID NO: 7492840 - DNA, 22 bp, Homo sapiens
agcccagggaaccaggaagtgg

SEQ ID NO: 7492841 - DNA, 22 bp, Homo sapiens
agcccagggaaccaggaagtgg

SEQ ID NO: 7492842 - DNA, 22 bp, Homo sapiens
agcccagggaaccaggaagtgg

SEQ ID NO: 7492843 - DNA, 22 bp, Homo sapiens
agcccagggaaccaggaagtgg

SEQ ID NO: 7492844 - DNA, 22 bp, Homo sapiens
agcccagggaaccaggaagtgg

SEQ ID NO: 7492845 - DNA, 22 bp, Homo sapiens
agcccagggaaccaggaagtgg

SEQ ID NO: 7492846 - DNA, 22 bp, Homo sapiens
agcccagggaaccaggaagtgg

SEQ ID NO: 7492847 - DNA, 22 bp, Homo sapiens
agcccaggctggagtgcagtgg

SEQ ID NO: 7492848 - DNA, 22 bp, Homo sapiens
agcccaggctggagtgcagtgg

SEQ ID NO: 7492849 - DNA, 22 bp, Homo sapiens
agcccaggctggagtgcagtgg

SEQ ID NO: 7492850 - DNA, 20 bp, Homo sapiens
agcccaggcctgtgtgagtc

SEQ ID NO: 7492851 - DNA, 22 bp, Homo sapiens
agcccaggctggagtgcagtgg

SEQ ID NO: 7492852 - DNA, 22 bp, Homo sapiens
agcccaggctggagtgcagtgg

SEQ ID NO: 7492853 - DNA, 22 bp, Homo sapiens
agcccaggctggagtgcagtgg

SEQ ID NO: 7492854 - DNA, 22 bp, Homo sapiens
agcccaggctggagtgcagtgg

SEQ ID NO: 7492855 - DNA, 22 bp, Homo sapiens
agcccaggctggagtgcagtgg

SEQ ID NO: 7492856 - DNA, 22 bp, Homo sapiens
agcccaggctggagtgcagtgg

SEQ ID NO: 7492857 - DNA, 22 bp, Homo sapiens
agcccaggctggagtgcagtgg

SEQ ID NO: 7492858 - DNA, 22 bp, Homo sapiens
agcccaggctggagtgcagtgg

SEQ ID NO: 7492859 - DNA, 18 bp, Homo sapiens
agcccaggcatcgtctgc

SEQ ID NO: 7492860 - DNA, 18 bp, Homo sapiens
agcccaggcatcgtctgc

SEQ ID NO: 7492861 - DNA, 20 bp, Homo sapiens
agcccaggcctgtgtgagtc

SEQ ID NO: 7492862 - DNA, 18 bp, Homo sapiens
agcccaggcatcgtctgc

SEQ ID NO: 7492863 - DNA, 20 bp, Homo sapiens
agcccaggcctgtgtgagtc

SEQ ID NO: 7492864 - DNA, 20 bp, Homo sapiens
agcccaggcctgtgtgagtc

SEQ ID NO: 7492865 - DNA, 20 bp, Homo sapiens
agcccaggcctgtgtgagtc

SEQ ID NO: 7492866 - DNA, 20 bp, Homo sapiens
agcccaggcctgtgtgagtc

SEQ ID NO: 7492867 - DNA, 18 bp, Homo sapiens
agcccaggcatcgtctgc

SEQ ID NO: 7492868 - DNA, 20 bp, Homo sapiens
agcccaggcctgtgtgagtc

SEQ ID NO: 7492869 - DNA, 20 bp, Homo sapiens
agcccaggcctgtgtgagtc

SEQ ID NO: 7492870 - DNA, 20 bp, Homo sapiens
agcccaggcctgtgtgagtc

SEQ ID NO: 7492871 - DNA, 20 bp, Homo sapiens
agcccaggcctgtgtgagtc

SEQ ID NO: 7492872 - DNA, 22 bp, Homo sapiens
agcccaggctggagtgcagtgg

SEQ ID NO: 7492873 - DNA, 20 bp, Homo sapiens
agcccaggcctgtgtgagtc

SEQ ID NO: 7492874 - DNA, 22 bp, Homo sapiens
agcccagagggtagcagaagaa

SEQ ID NO: 7492875 - DNA, 22 bp, Homo sapiens
agcccagagggtagcagaagaa

SEQ ID NO: 7492876 - DNA, 22 bp, Homo sapiens
agcccagataaagtacaaccat

SEQ ID NO: 7492877 - DNA, 22 bp, Homo sapiens
agcccagataaagtacaaccat

SEQ ID NO: 7492878 - DNA, 22 bp, Homo sapiens
agcccagcaaagggaggttcag

SEQ ID NO: 7492879 - DNA, 22 bp, Homo sapiens
agcccagcaaagggaggttcag

SEQ ID NO: 7492880 - DNA, 22 bp, Homo sapiens
agcccagatggtagccctagaa

SEQ ID NO: 7492881 - DNA, 22 bp, Homo sapiens
agcccagatggtagccctagaa

SEQ ID NO: 7492882 - DNA, 22 bp, Homo sapiens
agcccagatggtagccctagaa

SEQ ID NO: 7492883 - DNA, 22 bp, Homo sapiens
agcccagatggtagccctagaa

SEQ ID NO: 7492884 - DNA, 22 bp, Homo sapiens
agcccagataaagtacaaccat

SEQ ID NO: 7492885 - DNA, 22 bp, Homo sapiens
agcccagaggctgggcgtgcat

SEQ ID NO: 7492886 - DNA, 22 bp, Homo sapiens
agcccagaggggtttgaggact

SEQ ID NO: 7492887 - DNA, 22 bp, Homo sapiens
agcccagaggggtttgaggact

SEQ ID NO: 7492888 - DNA, 22 bp, Homo sapiens
agcccagagggtagcagaagaa

SEQ ID NO: 7492889 - DNA, 22 bp, Homo sapiens
agcccagagggtagcagaagaa

SEQ ID NO: 7492890 - DNA, 22 bp, Homo sapiens
agcccagagggtagcagaagaa

SEQ ID NO: 7492891 - DNA, 22 bp, Homo sapiens
agcccagagggtagcagaagaa

SEQ ID NO: 7492892 - DNA, 22 bp, Homo sapiens
agcccagaggctgggcgtgcat

SEQ ID NO: 7492893 - DNA, 22 bp, Homo sapiens
agcccagagccccggccatgtt

SEQ ID NO: 7492894 - DNA, 22 bp, Homo sapiens
agcccagagcctctcctaaagg

SEQ ID NO: 7492895 - DNA, 22 bp, Homo sapiens
agcccagagcctctcctaaagg

SEQ ID NO: 7492896 - DNA, 22 bp, Homo sapiens
agcccagaggctgggcgtgcat

SEQ ID NO: 7492897 - DNA, 22 bp, Homo sapiens
agcccagaaatgaaaggatgat

SEQ ID NO: 7492898 - DNA, 22 bp, Homo sapiens
agcccagaaatgaaaggatgat

SEQ ID NO: 7492899 - DNA, 22 bp, Homo sapiens
agcccagaaatgaaaggatgat

SEQ ID NO: 7492900 - DNA, 22 bp, Homo sapiens
agcccactccaagggtttttct

SEQ ID NO: 7492901 - DNA, 22 bp, Homo sapiens
agcccagagacaatgctcagta

SEQ ID NO: 7492902 - DNA, 22 bp, Homo sapiens
agcccagagacaatgctcagta

SEQ ID NO: 7492903 - DNA, 22 bp, Homo sapiens
agcccagagacaatgctcagta

SEQ ID NO: 7492904 - DNA, 22 bp, Homo sapiens
agcccagagccccggccatgtt

SEQ ID NO: 7492905 - DNA, 22 bp, Homo sapiens
agcccagagccccggccatgtt

SEQ ID NO: 7492906 - DNA, 22 bp, Homo sapiens
agcccagagccccggccatgtt

SEQ ID NO: 7492907 - DNA, 22 bp, Homo sapiens
agcccagagccccggccatgtt

SEQ ID NO: 7492908 - DNA, 22 bp, Homo sapiens
agcccactccaagggtttttct

SEQ ID NO: 7492909 - DNA, 23 bp, Homo sapiens
agcccaccttgttagtcctgtgg

SEQ ID NO: 7492910 - DNA, 23 bp, Homo sapiens
agcccaccttgttagtcctgtgg

SEQ ID NO: 7492911 - DNA, 23 bp, Homo sapiens
agcccaccttgttagtcctgtgg

SEQ ID NO: 7492912 - DNA, 22 bp, Homo sapiens
agcccactgttttcatttctct

SEQ ID NO: 7492913 - DNA, 22 bp, Homo sapiens
agcccaaggcttccctgctggc

SEQ ID NO: 7492914 - DNA, 22 bp, Homo sapiens
agcccaaggcttccctgctggc

SEQ ID NO: 7492915 - DNA, 22 bp, Homo sapiens
agcccaaggcttccctgctggc

SEQ ID NO: 7492916 - DNA, 22 bp, Homo sapiens
agcccagcagtaagattagaga

SEQ ID NO: 7492917 - DNA, 22 bp, Homo sapiens
agcccagcagtaagattagaga

SEQ ID NO: 7492918 - DNA, 22 bp, Homo sapiens
agcccagcagtaagattagaga

SEQ ID NO: 7492919 - DNA, 23 bp, Homo sapiens
agcccagcagagaacctaggtcc

SEQ ID NO: 7492920 - DNA, 23 bp, Homo sapiens
agcccagcagagaacctaggtcc

SEQ ID NO: 7492921 - DNA, 23 bp, Homo sapiens
agcccagcagagaacctaggtcc

SEQ ID NO: 7492922 - DNA, 23 bp, Homo sapiens
agcccagcagagaacctaggtcc

SEQ ID NO: 7492923 - DNA, 23 bp, Homo sapiens
agcccagcagagaacctaggtcc

SEQ ID NO: 7492924 - DNA, 22 bp, Homo sapiens
agcccagccactattaaatgtt

SEQ ID NO: 7492925 - DNA, 22 bp, Homo sapiens
agcccagcccgggctgcgcttt

SEQ ID NO: 7492926 - DNA, 22 bp, Homo sapiens
agcccagcccgggctgcgcttt

SEQ ID NO: 7492927 - DNA, 22 bp, Homo sapiens
agcccagcccgggctgcgcttt

SEQ ID NO: 7492928 - DNA, 22 bp, Homo sapiens
agcccagccactattaaatgtt

SEQ ID NO: 7492929 - DNA, 22 bp, Homo sapiens
agcccagccactattaaatgtt

SEQ ID NO: 7492930 - DNA, 22 bp, Homo sapiens
agcccagcccgggctgcgcttt

SEQ ID NO: 7492931 - DNA, 22 bp, Homo sapiens
agcccagcccgggctgcgcttt

SEQ ID NO: 7492932 - DNA, 22 bp, Homo sapiens
agcccagcaaagggaggttcag

SEQ ID NO: 7492933 - DNA, 22 bp, Homo sapiens
agcccagcaaagggaggttcag

SEQ ID NO: 7492934 - DNA, 22 bp, Homo sapiens
agcccagcaaagggaggttcag

SEQ ID NO: 7492935 - DNA, 22 bp, Homo sapiens
agcccagcaaagggaggttcag

SEQ ID NO: 7492936 - DNA, 22 bp, Homo sapiens
agcccagcaaagggaggttcag

SEQ ID NO: 7492937 - DNA, 22 bp, Homo sapiens
agcccagcaaaggggtttgaga

SEQ ID NO: 7492938 - DNA, 22 bp, Homo sapiens
agcccagcaaaggggtttgaga

SEQ ID NO: 7492939 - DNA, 22 bp, Homo sapiens
agcccagcaaaggggtttgaga

SEQ ID NO: 7492940 - DNA, 22 bp, Homo sapiens
agcccagcactgggggcccagc

SEQ ID NO: 7492941 - DNA, 22 bp, Homo sapiens
agcccagcactgggggcccagc

SEQ ID NO: 7492942 - DNA, 22 bp, Homo sapiens
agcccagcactgggggcccagc

SEQ ID NO: 7492943 - DNA, 22 bp, Homo sapiens
agcccagcactgggggcccagc

SEQ ID NO: 7492944 - DNA, 22 bp, Homo sapiens
agcccagcagaaagtccagcct

SEQ ID NO: 7492945 - DNA, 22 bp, Homo sapiens
agcccagcagaaagtccagcct

SEQ ID NO: 7492946 - DNA, 22 bp, Homo sapiens
agcccagcagaaagtccagcct

SEQ ID NO: 7492947 - DNA, 22 bp, Homo sapiens
agcccagcactgggggcccagc

SEQ ID NO: 7492948 - DNA, 22 bp, Homo sapiens
agcccagcagaaagtccagcct

SEQ ID NO: 7492949 - DNA, 22 bp, Homo sapiens
agcccagcagaaagtccagcct

SEQ ID NO: 7492950 - DNA, 22 bp, Homo sapiens
agcccagcagaaagtccagcct

SEQ ID NO: 7492951 - DNA, 22 bp, Homo sapiens
cagacatggaaatttagtgtta

SEQ ID NO: 7492952 - DNA, 22 bp, Homo sapiens
cagacatggcgccaagtgctag

SEQ ID NO: 7492953 - DNA, 22 bp, Homo sapiens
cagactttctggaagctaaaaa

SEQ ID NO: 7492954 - DNA, 22 bp, Homo sapiens
cagactttctggaagctaaaaa

SEQ ID NO: 7492955 - DNA, 22 bp, Homo sapiens
cagactttctgactcccttgcc

SEQ ID NO: 7492956 - DNA, 22 bp, Homo sapiens
cagagaaaaaatcctgctctca

SEQ ID NO: 7492957 - DNA, 22 bp, Homo sapiens
cagagaaaaaatcctgctctca

SEQ ID NO: 7492958 - DNA, 22 bp, Homo sapiens
cagacttttgggaggtctgtgg

SEQ ID NO: 7492959 - DNA, 22 bp, Homo sapiens
cagacttttgacattaatacag

SEQ ID NO: 7492960 - DNA, 22 bp, Homo sapiens
cagacttttgacattaatacag

SEQ ID NO: 7492961 - DNA, 22 bp, Homo sapiens
cagagaaaaaatcctgctctca

SEQ ID NO: 7492962 - DNA, 22 bp, Homo sapiens
cagagaaaaaatcctgctctca

SEQ ID NO: 7492963 - DNA, 22 bp, Homo sapiens
cagagaaactcagatagctgat

SEQ ID NO: 7492964 - DNA, 22 bp, Homo sapiens
cagagaaactcagatagctgat

SEQ ID NO: 7492965 - DNA, 22 bp, Homo sapiens
cagagaaaaaatcctgctctca

SEQ ID NO: 7492966 - DNA, 22 bp, Homo sapiens
cagagaaaaaatcctgctctca

SEQ ID NO: 7492967 - DNA, 22 bp, Homo sapiens
cagagaaaaaatcctgctctca

SEQ ID NO: 7492968 - DNA, 22 bp, Homo sapiens
cagagaaaaaatcctgctctca

SEQ ID NO: 7492969 - DNA, 22 bp, Homo sapiens
cagagaaaaaatcctgctctca

SEQ ID NO: 7492970 - DNA, 22 bp, Homo sapiens
cagagaaactcagatagctgat

SEQ ID NO: 7492971 - DNA, 22 bp, Homo sapiens
cagagaaactcagatagctgat

SEQ ID NO: 7492972 - DNA, 22 bp, Homo sapiens
cagagaaagaagcccattcatt

SEQ ID NO: 7492973 - DNA, 22 bp, Homo sapiens
cagagaaagaagcccattcatt

SEQ ID NO: 7492974 - DNA, 22 bp, Homo sapiens
cagagaaagaagcccattcatt

SEQ ID NO: 7492975 - DNA, 22 bp, Homo sapiens
cagagaaagaagcccattcatt

SEQ ID NO: 7492976 - DNA, 22 bp, Homo sapiens
cagagaaactcagatagctgat

SEQ ID NO: 7492977 - DNA, 22 bp, Homo sapiens
cagagaaactcagatagctgat

SEQ ID NO: 7492978 - DNA, 22 bp, Homo sapiens
cagagaaactcagatagctgat

SEQ ID NO: 7492979 - DNA, 22 bp, Homo sapiens
cagagaaactcagatagctgat

SEQ ID NO: 7492980 - DNA, 22 bp, Homo sapiens
cagagaaactcagatagctgat

SEQ ID NO: 7492981 - DNA, 22 bp, Homo sapiens
cagagaaagaagcccattcatt

SEQ ID NO: 7492982 - DNA, 22 bp, Homo sapiens
cagagaaagaagcccattcatt

SEQ ID NO: 7492983 - DNA, 22 bp, Homo sapiens
cagagaaagaagcccattcatt

SEQ ID NO: 7492984 - DNA, 22 bp, Homo sapiens
cagagaaagaagcccattcatt

SEQ ID NO: 7492985 - DNA, 22 bp, Homo sapiens
cagagaaagaagcccattcatt

SEQ ID NO: 7492986 - DNA, 22 bp, Homo sapiens
agcccaaagtcctgcttccctg

SEQ ID NO: 7492987 - DNA, 22 bp, Homo sapiens
agccatcctactacctcagcat

SEQ ID NO: 7492988 - DNA, 22 bp, Homo sapiens
agccatcctactacctcagcat

SEQ ID NO: 7492989 - DNA, 22 bp, Homo sapiens
agcccaagcataggagggaggc

SEQ ID NO: 7492990 - DNA, 22 bp, Homo sapiens
agcccaagaagagctttcttgc

SEQ ID NO: 7492991 - DNA, 22 bp, Homo sapiens
agcccaaagtcctgcttccctg

SEQ ID NO: 7492992 - DNA, 22 bp, Homo sapiens
agcccaagaagagctttcttgc

SEQ ID NO: 7492993 - DNA, 23 bp, Homo sapiens
agccatcatcctgctgctggggc

SEQ ID NO: 7492994 - DNA, 22 bp, Homo sapiens
agccatcacttgagaatctatt

SEQ ID NO: 7492995 - DNA, 18 bp, Homo sapiens
agccatatggagactctg

SEQ ID NO: 7492996 - DNA, 22 bp, Homo sapiens
agcccaagcctggctggcgatg

SEQ ID NO: 7492997 - DNA, 22 bp, Homo sapiens
agcccaagcctggctggcgatg

SEQ ID NO: 7492998 - DNA, 22 bp, Homo sapiens
agcccaagcctggctggcgatg

SEQ ID NO: 7492999 - DNA, 22 bp, Homo sapiens
agcccaagcctggctggcgatg

SEQ ID NO: 7493000 - DNA, 22 bp, Homo sapiens
agcccaagccagtgcttctaga

SEQ ID NO: 7493001 - DNA, 22 bp, Homo sapiens
agcccaagcataggagggaggc

SEQ ID NO: 7493002 - DNA, 22 bp, Homo sapiens
agcccaagcataggagggaggc

SEQ ID NO: 7493003 - DNA, 22 bp, Homo sapiens
agcccaagcataggagggaggc

SEQ ID NO: 7493004 - DNA, 22 bp, Homo sapiens
agcccaagctatgaggtgacct

SEQ ID NO: 7493005 - DNA, 22 bp, Homo sapiens
agcccaagctatgaggtgacct

SEQ ID NO: 7493006 - DNA, 22 bp, Homo sapiens
agcccaagctatgaggtgacct

SEQ ID NO: 7493007 - DNA, 22 bp, Homo sapiens
cagagaaagggtgaattccttc

SEQ ID NO: 7493008 - DNA, 22 bp, Homo sapiens
cagagaaagggtgaattccttc

SEQ ID NO: 7493009 - DNA, 22 bp, Homo sapiens
cagagaaagacttgcccttagt

SEQ ID NO: 7493010 - DNA, 22 bp, Homo sapiens
cagagaaagggtgaattccttc

SEQ ID NO: 7493011 - DNA, 22 bp, Homo sapiens
cagagaaagggtgaattccttc

SEQ ID NO: 7493012 - DNA, 22 bp, Homo sapiens
cagagaaagggtgaattccttc

SEQ ID NO: 7493013 - DNA, 22 bp, Homo sapiens
cagagaaagggtgaattccttc

SEQ ID NO: 7493014 - DNA, 22 bp, Homo sapiens
cagagaaagggtgaattccttc

SEQ ID NO: 7493015 - DNA, 22 bp, Homo sapiens
cagagaaagggtgaattccttc

SEQ ID NO: 7493016 - DNA, 22 bp, Homo sapiens
agccatatcaagcattcttcac

SEQ ID NO: 7493017 - DNA, 22 bp, Homo sapiens
cagagaaagggtgaattccttc

SEQ ID NO: 7493018 - DNA, 22 bp, Homo sapiens
cagagaaagggtgaattccttc

SEQ ID NO: 7493019 - DNA, 22 bp, Homo sapiens
cagagaaagaagcccattcatt

SEQ ID NO: 7493020 - DNA, 22 bp, Homo sapiens
cagagaaagaagcccattcatt

SEQ ID NO: 7493021 - DNA, 22 bp, Homo sapiens
cagagaaagaagcccattcatt

SEQ ID NO: 7493022 - DNA, 22 bp, Homo sapiens
cagagaaagaagcccattcatt

SEQ ID NO: 7493023 - DNA, 22 bp, Homo sapiens
cagagaaagacttgcccttagt

SEQ ID NO: 7493024 - DNA, 22 bp, Homo sapiens
cagagaaagacttgcccttagt

SEQ ID NO: 7493025 - DNA, 22 bp, Homo sapiens
cagagaaagacttgcccttagt

SEQ ID NO: 7493026 - DNA, 22 bp, Homo sapiens
cagagaaagaagcccattcatt

SEQ ID NO: 7493027 - DNA, 22 bp, Homo sapiens
cagagaaagaagcccattcatt

SEQ ID NO: 7493028 - DNA, 22 bp, Homo sapiens
cagagaaagaagcccattcatt

SEQ ID NO: 7493029 - DNA, 22 bp, Homo sapiens
cagagaaagacttgcccttagt

SEQ ID NO: 7493030 - DNA, 22 bp, Homo sapiens
cagacatgatgtaagcagaggc

SEQ ID NO: 7493031 - DNA, 22 bp, Homo sapiens
cagacatgatgtaagcagaggc

SEQ ID NO: 7493032 - DNA, 22 bp, Homo sapiens
cagacatgagatacagctgcta

SEQ ID NO: 7493033 - DNA, 22 bp, Homo sapiens
cagacatgatgtaagcagaggc

SEQ ID NO: 7493034 - DNA, 21 bp, Homo sapiens
cagacatgagtctcagctttg

SEQ ID NO: 7493035 - DNA, 21 bp, Homo sapiens
cagacatgagtctcagctttg

SEQ ID NO: 7493036 - DNA, 22 bp, Homo sapiens
cagacatcacactcagattgca

SEQ ID NO: 7493037 - DNA, 22 bp, Homo sapiens
cagacatatgttttaacagatt

SEQ ID NO: 7493038 - DNA, 22 bp, Homo sapiens
cagacatctgtacccagcctgt

SEQ ID NO: 7493039 - DNA, 22 bp, Homo sapiens
cagacatctgtacccagcctgt

SEQ ID NO: 7493040 - DNA, 22 bp, Homo sapiens
cagacatctgtacccagcctgt

SEQ ID NO: 7493041 - DNA, 22 bp, Homo sapiens
cagacatccaggtacgagcttt

SEQ ID NO: 7493042 - DNA, 22 bp, Homo sapiens
cagacatccaggtacgagcttt

SEQ ID NO: 7493043 - DNA, 22 bp, Homo sapiens
cagacagtggacttgataaagg

SEQ ID NO: 7493044 - DNA, 22 bp, Homo sapiens
cagacagtggacttgataaagg

SEQ ID NO: 7493045 - DNA, 22 bp, Homo sapiens
cagacagtggacttgataaagg

SEQ ID NO: 7493046 - DNA, 22 bp, Homo sapiens
cagacagtggacttgataaagg

SEQ ID NO: 7493047 - DNA, 22 bp, Homo sapiens
cagacagtggacttgataaagg

SEQ ID NO: 7493048 - DNA, 22 bp, Homo sapiens
cagacagtggacttgataaagg

SEQ ID NO: 7493049 - DNA, 22 bp, Homo sapiens
cagacatatccctgctccctta

SEQ ID NO: 7493050 - DNA, 22 bp, Homo sapiens
cagacatatccctgctccctta

SEQ ID NO: 7493051 - DNA, 22 bp, Homo sapiens
cagacagtttatcctaaataac

SEQ ID NO: 7493052 - DNA, 22 bp, Homo sapiens
cagacagtgttagagtcaagct

SEQ ID NO: 7493053 - DNA, 22 bp, Homo sapiens
cagacagtggacttgataaagg

SEQ ID NO: 7493054 - DNA, 22 bp, Homo sapiens
cagacaggtagggacagaacat

SEQ ID NO: 7493055 - DNA, 22 bp, Homo sapiens
cagacaggttgcaaaacttcaa

SEQ ID NO: 7493056 - DNA, 22 bp, Homo sapiens
cagacaggttgcaaaacttcaa

SEQ ID NO: 7493057 - DNA, 22 bp, Homo sapiens
cagacaggtagggacagaacat

SEQ ID NO: 7493058 - DNA, 22 bp, Homo sapiens
cagacaggtagggacagaacat

SEQ ID NO: 7493059 - DNA, 22 bp, Homo sapiens
cagacaggtagggacagaacat

SEQ ID NO: 7493060 - DNA, 22 bp, Homo sapiens
cagacaggtagggacagaacat

SEQ ID NO: 7493061 - DNA, 22 bp, Homo sapiens
cagacaggtagggacagaacat

SEQ ID NO: 7493062 - DNA, 22 bp, Homo sapiens
agccagagagccccaggttcta

SEQ ID NO: 7493063 - DNA, 22 bp, Homo sapiens
agccagagagccccaggttcta

SEQ ID NO: 7493064 - DNA, 22 bp, Homo sapiens
agccagagagccccaggttcta

SEQ ID NO: 7493065 - DNA, 22 bp, Homo sapiens
agccagagagtgttggagatgt

SEQ ID NO: 7493066 - DNA, 22 bp, Homo sapiens
agccagagagtgttggagatgt

SEQ ID NO: 7493067 - DNA, 22 bp, Homo sapiens
cagacaggaagttcagaagaaa

SEQ ID NO: 7493068 - DNA, 22 bp, Homo sapiens
agccagagagtgttggagatgt

SEQ ID NO: 7493069 - DNA, 22 bp, Homo sapiens
cagacagggttttggtctttgg

SEQ ID NO: 7493070 - DNA, 22 bp, Homo sapiens
cagacagggttttggtctttgg

SEQ ID NO: 7493071 - DNA, 22 bp, Homo sapiens
cagacagggttttggtctttgg

SEQ ID NO: 7493072 - DNA, 22 bp, Homo sapiens
cagacagggttttggtctttgg

SEQ ID NO: 7493073 - DNA, 22 bp, Homo sapiens
cagacagggtgggtttctgggc

SEQ ID NO: 7493074 - DNA, 22 bp, Homo sapiens
cagacagggtgggtttctgggc

SEQ ID NO: 7493075 - DNA, 22 bp, Homo sapiens
cagacagggtgggtttctgggc

SEQ ID NO: 7493076 - DNA, 22 bp, Homo sapiens
cagacaggaagttcagaagaaa

SEQ ID NO: 7493077 - DNA, 22 bp, Homo sapiens
cagacaggaagttcagaagaaa

SEQ ID NO: 7493078 - DNA, 22 bp, Homo sapiens
agccagagactgtgtctgtaat

SEQ ID NO: 7493079 - DNA, 22 bp, Homo sapiens
agccagagactgtgtctgtaat

SEQ ID NO: 7493080 - DNA, 22 bp, Homo sapiens
agccagagactgtgtctgtaat

SEQ ID NO: 7493081 - DNA, 22 bp, Homo sapiens
agccagagactttacctgtgca

SEQ ID NO: 7493082 - DNA, 22 bp, Homo sapiens
agccagagactttacctgtgca

SEQ ID NO: 7493083 - DNA, 22 bp, Homo sapiens
agccagagactgtgtctgtaat

SEQ ID NO: 7493084 - DNA, 22 bp, Homo sapiens
agccagagactgtgtctgtaat

SEQ ID NO: 7493085 - DNA, 22 bp, Homo sapiens
agccagagaacagcaggaaatg

SEQ ID NO: 7493086 - DNA, 22 bp, Homo sapiens
agccagacatggctcctgctcc

SEQ ID NO: 7493087 - DNA, 23 bp, Homo sapiens
agccacttctatcttgctcctgg

SEQ ID NO: 7493088 - DNA, 22 bp, Homo sapiens
agccagagaacagcaggaaatg

SEQ ID NO: 7493089 - DNA, 22 bp, Homo sapiens
agccagagaacagcaggaaatg

SEQ ID NO: 7493090 - DNA, 22 bp, Homo sapiens
agccagacatggctcctgctcc

SEQ ID NO: 7493091 - DNA, 22 bp, Homo sapiens
agccagacatggctcctgctcc

SEQ ID NO: 7493092 - DNA, 22 bp, Homo sapiens
agccagacatggctcctgctcc

SEQ ID NO: 7493093 - DNA, 22 bp, Homo sapiens
cagaatggcttttatggctcag

SEQ ID NO: 7493094 - DNA, 20 bp, Homo sapiens
cagaatgctgtaatcaagaa

SEQ ID NO: 7493095 - DNA, 22 bp, Homo sapiens
cagaatgggaaggactgcagtt

SEQ ID NO: 7493096 - DNA, 22 bp, Homo sapiens
cagaatgtatatgatctaaggt

SEQ ID NO: 7493097 - DNA, 22 bp, Homo sapiens
cagaatgtagatcatcatcaag

SEQ ID NO: 7493098 - DNA, 22 bp, Homo sapiens
cagaatgtatatgatctaaggt

SEQ ID NO: 7493099 - DNA, 22 bp, Homo sapiens
cagaatgtatatgatctaaggt

SEQ ID NO: 7493100 - DNA, 22 bp, Homo sapiens
agccactgtctgaacttctgtg

SEQ ID NO: 7493101 - DNA, 22 bp, Homo sapiens
agccactgtgagaggaccaggg

SEQ ID NO: 7493102 - DNA, 22 bp, Homo sapiens
agccactgtctgaacttctgtg

SEQ ID NO: 7493103 - DNA, 22 bp, Homo sapiens
agccactgtgagaggaccaggg

SEQ ID NO: 7493104 - DNA, 22 bp, Homo sapiens
agccactgtgagaggaccaggg

SEQ ID NO: 7493105 - DNA, 22 bp, Homo sapiens
agccactgtgagaggaccaggg

SEQ ID NO: 7493106 - DNA, 22 bp, Homo sapiens
agccactgtgagaggaccaggg

SEQ ID NO: 7493107 - DNA, 22 bp, Homo sapiens
agccactgtgagaggaccaggg

SEQ ID NO: 7493108 - DNA, 22 bp, Homo sapiens
cagaatgtatatgatctaaggt

SEQ ID NO: 7493109 - DNA, 22 bp, Homo sapiens
cagaatgtattctcataaagcc

SEQ ID NO: 7493110 - DNA, 22 bp, Homo sapiens
cagaatgtattctcataaagcc

SEQ ID NO: 7493111 - DNA, 19 bp, Homo sapiens
agccagaactagtgtttct

SEQ ID NO: 7493112 - DNA, 22 bp, Homo sapiens
agccagaaccactggaacggtg

SEQ ID NO: 7493113 - DNA, 22 bp, Homo sapiens
agccagaacgcatcgccaaggc

SEQ ID NO: 7493114 - DNA, 23 bp, Homo sapiens
agccacttctatcttgctcctgg

SEQ ID NO: 7493115 - DNA, 22 bp, Homo sapiens
agccagaaaaacaccaagagga

SEQ ID NO: 7493116 - DNA, 22 bp, Homo sapiens
agccagaaaaacaccaagagga

SEQ ID NO: 7493117 - DNA, 22 bp, Homo sapiens
agccactttagataccatctta

SEQ ID NO: 7493118 - DNA, 22 bp, Homo sapiens
agccagaaaaacaccaagagga

SEQ ID NO: 7493119 - DNA, 22 bp, Homo sapiens
agccagaaaggggcattatctg

SEQ ID NO: 7493120 - DNA, 22 bp, Homo sapiens
agccagaaaggggcattatctg

SEQ ID NO: 7493121 - DNA, 22 bp, Homo sapiens
agccactgtgtgaccagctgtc

SEQ ID NO: 7493122 - DNA, 22 bp, Homo sapiens
agccactgtgtgaccagctgtc

SEQ ID NO: 7493123 - DNA, 22 bp, Homo sapiens
agccactgtgtgaccagctgtc

SEQ ID NO: 7493124 - DNA, 22 bp, Homo sapiens
agccactgtgtgaccagctgtc

SEQ ID NO: 7493125 - DNA, 22 bp, Homo sapiens
agccactgtgtgaccagctgtc

SEQ ID NO: 7493126 - DNA, 23 bp, Homo sapiens
agccacttctatcttgctcctgg

SEQ ID NO: 7493127 - DNA, 22 bp, Homo sapiens
agccactgtgtgaccagctgtc

SEQ ID NO: 7493128 - DNA, 22 bp, Homo sapiens
agccactgtgcaggagcagtgt

SEQ ID NO: 7493129 - DNA, 22 bp, Homo sapiens
agccactgtgcaggagcagtgt

SEQ ID NO: 7493130 - DNA, 22 bp, Homo sapiens
agccactgtgtgaccagctgtc

SEQ ID NO: 7493131 - DNA, 22 bp, Homo sapiens
agccactgtgcaggagcagtgt

SEQ ID NO: 7493132 - DNA, 22 bp, Homo sapiens
cagaatgtatatgatctaaggt

SEQ ID NO: 7493133 - DNA, 22 bp, Homo sapiens
agccactgtgcaggagcagtgt

SEQ ID NO: 7493134 - DNA, 22 bp, Homo sapiens
agccactgtgcaggagcagtgt

SEQ ID NO: 7493135 - DNA, 22 bp, Homo sapiens
cagaatatgacaagattttcct

SEQ ID NO: 7493136 - DNA, 22 bp, Homo sapiens
cagaataccctatagacagaat

SEQ ID NO: 7493137 - DNA, 22 bp, Homo sapiens
cagaatatgacaagattttcct

SEQ ID NO: 7493138 - DNA, 22 bp, Homo sapiens
cagaatatgaccctaggccttt

SEQ ID NO: 7493139 - DNA, 22 bp, Homo sapiens
cagaatatgaccctaggccttt

SEQ ID NO: 7493140 - DNA, 22 bp, Homo sapiens
cagaatatgacaagattttcct

SEQ ID NO: 7493141 - DNA, 22 bp, Homo sapiens
cagaatatgacaagattttcct

SEQ ID NO: 7493142 - DNA, 22 bp, Homo sapiens
cagaatatgaccctaggccttt

SEQ ID NO: 7493143 - DNA, 22 bp, Homo sapiens
cagaatcagcccttgctattaa

SEQ ID NO: 7493144 - DNA, 22 bp, Homo sapiens
cagaatcagcccttgctattaa

SEQ ID NO: 7493145 - DNA, 22 bp, Homo sapiens
cagaatatgactcgggcactac

SEQ ID NO: 7493146 - DNA, 22 bp, Homo sapiens
cagaatcaagtccaattagcac

SEQ ID NO: 7493147 - DNA, 22 bp, Homo sapiens
cagaatcagtgacacatgtata

SEQ ID NO: 7493148 - DNA, 22 bp, Homo sapiens
cagaatcagtgacacatgtata

SEQ ID NO: 7493149 - DNA, 22 bp, Homo sapiens
cagaatcagtgacacatgtata

SEQ ID NO: 7493150 - DNA, 22 bp, Homo sapiens
cagaatcagtgacacatgtata

SEQ ID NO: 7493151 - DNA, 21 bp, Homo sapiens
cagaatccagtctcttattac

SEQ ID NO: 7493152 - DNA, 22 bp, Homo sapiens
cagaatccagaattgctgaggt

SEQ ID NO: 7493153 - DNA, 22 bp, Homo sapiens
cagaatccacaacagaagttga

SEQ ID NO: 7493154 - DNA, 22 bp, Homo sapiens
cagaatccacaacagaagttga

SEQ ID NO: 7493155 - DNA, 22 bp, Homo sapiens
cagaatctcgacttctggcccc

SEQ ID NO: 7493156 - DNA, 22 bp, Homo sapiens
cagaatccatgacagacgttga

SEQ ID NO: 7493157 - DNA, 22 bp, Homo sapiens
cagaatccatgacagacgttga

SEQ ID NO: 7493158 - DNA, 22 bp, Homo sapiens
cagaatgagataacccagattg

SEQ ID NO: 7493159 - DNA, 22 bp, Homo sapiens
cagaatgaaatgtaagaacacc

SEQ ID NO: 7493160 - DNA, 22 bp, Homo sapiens
cagaatcttcttaattggcaca

SEQ ID NO: 7493161 - DNA, 22 bp, Homo sapiens
cagaatctgttggggttgcaga

SEQ ID NO: 7493162 - DNA, 22 bp, Homo sapiens
cagaatctgagtcgtgattgta

SEQ ID NO: 7493163 - DNA, 22 bp, Homo sapiens
cagaatctgttggggttgcaga

SEQ ID NO: 7493164 - DNA, 22 bp, Homo sapiens
cagaatctgagtcgtgattgta

SEQ ID NO: 7493165 - DNA, 22 bp, Homo sapiens
cagaatctacaccctcagaaat

SEQ ID NO: 7493166 - DNA, 22 bp, Homo sapiens
cagaatctctgggagtggatca

SEQ ID NO: 7493167 - DNA, 22 bp, Homo sapiens
cagaatgagtagcatcttcacc

SEQ ID NO: 7493168 - DNA, 22 bp, Homo sapiens
cagaatgagtagcatcttcacc

SEQ ID NO: 7493169 - DNA, 22 bp, Homo sapiens
cagaatgagtagcatcttcacc

SEQ ID NO: 7493170 - DNA, 22 bp, Homo sapiens
cagaatgcaaattttataatat

SEQ ID NO: 7493171 - DNA, 22 bp, Homo sapiens
cagaatgcaaattttataatat

SEQ ID NO: 7493172 - DNA, 22 bp, Homo sapiens
cagaatgcaaattttataatat

SEQ ID NO: 7493173 - DNA, 22 bp, Homo sapiens
cagaatgcagaatgttcatttt

SEQ ID NO: 7493174 - DNA, 22 bp, Homo sapiens
cagaatgcagaatgttcatttt

SEQ ID NO: 7493175 - DNA, 22 bp, Homo sapiens
cagaatgcattgcttctgatgg

SEQ ID NO: 7493176 - DNA, 22 bp, Homo sapiens
cagaatgcattgcttctgatgg

SEQ ID NO: 7493177 - DNA, 20 bp, Homo sapiens
cagaatgctgtaatcaagaa

SEQ ID NO: 7493178 - DNA, 22 bp, Homo sapiens
agccacatttttctgctcctga

SEQ ID NO: 7493179 - DNA, 22 bp, Homo sapiens
agccacatttttctgctcctga

SEQ ID NO: 7493180 - DNA, 22 bp, Homo sapiens
agccaccaccactgaaaggtta

SEQ ID NO: 7493181 - DNA, 22 bp, Homo sapiens
agccaccaccactgaaaggtta

SEQ ID NO: 7493182 - DNA, 22 bp, Homo sapiens
agccaccaccactgaaaggtta

SEQ ID NO: 7493183 - DNA, 22 bp, Homo sapiens
agccacccattcccgagcccta

SEQ ID NO: 7493184 - DNA, 22 bp, Homo sapiens
agccacagtgggctaccagctc

SEQ ID NO: 7493185 - DNA, 22 bp, Homo sapiens
agccacagtgggctaccagctc

SEQ ID NO: 7493186 - DNA, 22 bp, Homo sapiens
agccacatgagtgagccatctt

SEQ ID NO: 7493187 - DNA, 22 bp, Homo sapiens
agccacatttttctgctcctga

SEQ ID NO: 7493188 - DNA, 22 bp, Homo sapiens
agccacatggacctgatgctag

SEQ ID NO: 7493189 - DNA, 22 bp, Homo sapiens
agccacatgagtgagccatctt

SEQ ID NO: 7493190 - DNA, 22 bp, Homo sapiens
agccacatgagtgagccatctt

SEQ ID NO: 7493191 - DNA, 22 bp, Homo sapiens
agccacagtgggctaccagctc

SEQ ID NO: 7493192 - DNA, 22 bp, Homo sapiens
agccacagtgggctaccagctc

SEQ ID NO: 7493193 - DNA, 22 bp, Homo sapiens
agccacagtgggctaccagctc

SEQ ID NO: 7493194 - DNA, 22 bp, Homo sapiens
agccacagtgggctaccagctc

SEQ ID NO: 7493195 - DNA, 22 bp, Homo sapiens
agccacagtgggctaccagctc

SEQ ID NO: 7493196 - DNA, 22 bp, Homo sapiens
agccacagtgcaagagagaaaa

SEQ ID NO: 7493197 - DNA, 22 bp, Homo sapiens
agccacagtgcaagagagaaaa

SEQ ID NO: 7493198 - DNA, 22 bp, Homo sapiens
agccacagtgcaagagagaaaa

SEQ ID NO: 7493199 - DNA, 22 bp, Homo sapiens
agccacagtgcaagagagaaaa

SEQ ID NO: 7493200 - DNA, 22 bp, Homo sapiens
agccacagtgcaagagagaaaa

SEQ ID NO: 7493201 - DNA, 22 bp, Homo sapiens
agccaccctaccagccctgaaa

SEQ ID NO: 7493202 - DNA, 22 bp, Homo sapiens
agccaccctaccagccctgaaa

SEQ ID NO: 7493203 - DNA, 22 bp, Homo sapiens
agccacctcacctgctgccgtt

SEQ ID NO: 7493204 - DNA, 16 bp, Homo sapiens
agccacctcagaggac

SEQ ID NO: 7493205 - DNA, 22 bp, Homo sapiens
agccacctcctgctctgctcac

SEQ ID NO: 7493206 - DNA, 22 bp, Homo sapiens
agccacctcctgctctgctcac

SEQ ID NO: 7493207 - DNA, 22 bp, Homo sapiens
agccacctcctgctctgctcac

SEQ ID NO: 7493208 - DNA, 22 bp, Homo sapiens
agccacctctatcttgggctcc

SEQ ID NO: 7493209 - DNA, 22 bp, Homo sapiens
agccactcagtgctgtattgac

SEQ ID NO: 7493210 - DNA, 22 bp, Homo sapiens
agccactccttcagcgtctgct

SEQ ID NO: 7493211 - DNA, 22 bp, Homo sapiens
agccaccttcacatggtctatc

SEQ ID NO: 7493212 - DNA, 22 bp, Homo sapiens
agccaccttcacatggtctatc

SEQ ID NO: 7493213 - DNA, 22 bp, Homo sapiens
agccacctctatcttgggctcc

SEQ ID NO: 7493214 - DNA, 22 bp, Homo sapiens
agccacctctgtgcaggcctcg

SEQ ID NO: 7493215 - DNA, 22 bp, Homo sapiens
agccacctctgtgcaggcctcg

SEQ ID NO: 7493216 - DNA, 22 bp, Homo sapiens
agcatatacaaactcatataca

SEQ ID NO: 7493217 - DNA, 22 bp, Homo sapiens
agcatatacaaactcatataca

SEQ ID NO: 7493218 - DNA, 22 bp, Homo sapiens
agcatatacaaactcatataca

SEQ ID NO: 7493219 - DNA, 22 bp, Homo sapiens
agcatatacaaactcatataca

SEQ ID NO: 7493220 - DNA, 22 bp, Homo sapiens
agcatatacaaactcatataca

SEQ ID NO: 7493221 - DNA, 22 bp, Homo sapiens
agcataggcggtggtaggaccc

SEQ ID NO: 7493222 - DNA, 22 bp, Homo sapiens
agcataggcggtggtaggaccc

SEQ ID NO: 7493223 - DNA, 22 bp, Homo sapiens
agcatagatacattgagccaca

SEQ ID NO: 7493224 - DNA, 22 bp, Homo sapiens
agcatagagtcctgagggcagg

SEQ ID NO: 7493225 - DNA, 22 bp, Homo sapiens
agcatagatacattgagccaca

SEQ ID NO: 7493226 - DNA, 22 bp, Homo sapiens
agcataggtggagattagtgtt

SEQ ID NO: 7493227 - DNA, 22 bp, Homo sapiens
agcatagggtcctagtacacag

SEQ ID NO: 7493228 - DNA, 22 bp, Homo sapiens
agcataggtggagattagtgtt

SEQ ID NO: 7493229 - DNA, 22 bp, Homo sapiens
agcataggttttccggtgtgcc

SEQ ID NO: 7493230 - DNA, 22 bp, Homo sapiens
agcatagtatgataagtgacaa

SEQ ID NO: 7493231 - DNA, 22 bp, Homo sapiens
agcatagttaatacttttggta

SEQ ID NO: 7493232 - DNA, 22 bp, Homo sapiens
agcatataaatggacatatttg

SEQ ID NO: 7493233 - DNA, 22 bp, Homo sapiens
agcatatagctatctttgattg

SEQ ID NO: 7493234 - DNA, 22 bp, Homo sapiens
agccacaggaaacagagacagc

SEQ ID NO: 7493235 - DNA, 22 bp, Homo sapiens
agccacaggaaacagagacagc

SEQ ID NO: 7493236 - DNA, 22 bp, Homo sapiens
agccacaggaaacagagacagc

SEQ ID NO: 7493237 - DNA, 22 bp, Homo sapiens
agccacaggaaacagagacagc

SEQ ID NO: 7493238 - DNA, 22 bp, Homo sapiens
agccacaggaaacagagacagc

SEQ ID NO: 7493239 - DNA, 22 bp, Homo sapiens
agccacaggaaacagagacagc

SEQ ID NO: 7493240 - DNA, 22 bp, Homo sapiens
agccacaggaaacagagacagc

SEQ ID NO: 7493241 - DNA, 22 bp, Homo sapiens
agccacaggaaacagagacagc

SEQ ID NO: 7493242 - DNA, 22 bp, Homo sapiens
agccacaggaaacagagacagc

SEQ ID NO: 7493243 - DNA, 22 bp, Homo sapiens
agccacagtctgtagccagctt

SEQ ID NO: 7493244 - DNA, 22 bp, Homo sapiens
agccacagtctgtagccagctt

SEQ ID NO: 7493245 - DNA, 22 bp, Homo sapiens
agccacagtctgtagccagctt

SEQ ID NO: 7493246 - DNA, 22 bp, Homo sapiens
agccacagtctgtagccagctt

SEQ ID NO: 7493247 - DNA, 22 bp, Homo sapiens
agccacagtctgtagccagctt

SEQ ID NO: 7493248 - DNA, 22 bp, Homo sapiens
agccacagtgcaagagagaaaa

SEQ ID NO: 7493249 - DNA, 22 bp, Homo sapiens
agccacagtgcaagagagaaaa

SEQ ID NO: 7493250 - DNA, 22 bp, Homo sapiens
agccacagtgcaagagagaaaa

SEQ ID NO: 7493251 - DNA, 22 bp, Homo sapiens
agccacagtctgtagccagctt

SEQ ID NO: 7493252 - DNA, 22 bp, Homo sapiens
agccacagtctgtagccagctt

SEQ ID NO: 7493253 - DNA, 22 bp, Homo sapiens
agccacagtctgtagccagctt

SEQ ID NO: 7493254 - DNA, 22 bp, Homo sapiens
cagaaatatcagttgaaagtgc

SEQ ID NO: 7493255 - DNA, 22 bp, Homo sapiens
cagaaatatcagttgaaagtgc

SEQ ID NO: 7493256 - DNA, 22 bp, Homo sapiens
cagaaatatcagttgaaagtgc

SEQ ID NO: 7493257 - DNA, 22 bp, Homo sapiens
cagaaatatcagttgaaagtgc

SEQ ID NO: 7493258 - DNA, 22 bp, Homo sapiens
cagaaatatcagttgaaagtgc

SEQ ID NO: 7493259 - DNA, 22 bp, Homo sapiens
cagaaatatcagttgaaagtgc

SEQ ID NO: 7493260 - DNA, 22 bp, Homo sapiens
cagaaatatcagttgaaagtgc

SEQ ID NO: 7493261 - DNA, 22 bp, Homo sapiens
cagaaatatcagttgaaagtgc

SEQ ID NO: 7493262 - DNA, 22 bp, Homo sapiens
cagaaatatcacctggactcta

SEQ ID NO: 7493263 - DNA, 22 bp, Homo sapiens
cagaaatatcacctggactcta

SEQ ID NO: 7493264 - DNA, 22 bp, Homo sapiens
cagaaatatcacctggactcta

SEQ ID NO: 7493265 - DNA, 22 bp, Homo sapiens
cagaaatatcacctggactcta

SEQ ID NO: 7493266 - DNA, 22 bp, Homo sapiens
cagaaatatcacctggactcta

SEQ ID NO: 7493267 - DNA, 22 bp, Homo sapiens
cagaaatatatatgggtcagag

SEQ ID NO: 7493268 - DNA, 21 bp, Homo sapiens
cagaaatatgaatgatggtga

SEQ ID NO: 7493269 - DNA, 21 bp, Homo sapiens
cagaaatatgaatgatggtga

SEQ ID NO: 7493270 - DNA, 21 bp, Homo sapiens
cagaaatatgaatgatggtga

SEQ ID NO: 7493271 - DNA, 21 bp, Homo sapiens
cagaaatatgaatgatggtga

SEQ ID NO: 7493272 - DNA, 21 bp, Homo sapiens
cagaaatatgaatgatggtga

SEQ ID NO: 7493273 - DNA, 21 bp, Homo sapiens
cagaaatatgaatgatggtga

SEQ ID NO: 7493274 - DNA, 22 bp, Homo sapiens
cagaaatatcagttgaaagtgc

SEQ ID NO: 7493275 - DNA, 22 bp, Homo sapiens
cagaaatatcagttgaaagtgc

SEQ ID NO: 7493276 - DNA, 22 bp, Homo sapiens
cagaaatatcagttgaaagtgc

SEQ ID NO: 7493277 - DNA, 22 bp, Homo sapiens
cagaaatatcagttgaaagtgc

SEQ ID NO: 7493278 - DNA, 22 bp, Homo sapiens
cagaaatatcagttgaaagtgc

SEQ ID NO: 7493279 - DNA, 22 bp, Homo sapiens
cagaaatatcagttgaaagtgc

SEQ ID NO: 7493280 - DNA, 22 bp, Homo sapiens
agccactgcccttagccatttg

SEQ ID NO: 7493281 - DNA, 22 bp, Homo sapiens
agccactggcctgggcagctct

SEQ ID NO: 7493282 - DNA, 22 bp, Homo sapiens
agccactgcccttagccatttg

SEQ ID NO: 7493283 - DNA, 22 bp, Homo sapiens
agccactccttcagcgtctgct

SEQ ID NO: 7493284 - DNA, 22 bp, Homo sapiens
agccactggtaaactggtagga

SEQ ID NO: 7493285 - DNA, 22 bp, Homo sapiens
agccactggcctgggcagctct

SEQ ID NO: 7493286 - DNA, 22 bp, Homo sapiens
agccactggtaaactggtagga

SEQ ID NO: 7493287 - DNA, 22 bp, Homo sapiens
agccactggcctgggcagctct

SEQ ID NO: 7493288 - DNA, 22 bp, Homo sapiens
agccactgtctgaacttctgtg

SEQ ID NO: 7493289 - DNA, 22 bp, Homo sapiens
agccactgtctgaacttctgtg

SEQ ID NO: 7493290 - DNA, 22 bp, Homo sapiens
agccactgtctgaacttctgtg

SEQ ID NO: 7493291 - DNA, 22 bp, Homo sapiens
agccactgtaaggggaattgcc

SEQ ID NO: 7493292 - DNA, 22 bp, Homo sapiens
agccactgtaaggggaattgcc

SEQ ID NO: 7493293 - DNA, 22 bp, Homo sapiens
agccactggtaaactggtagga

SEQ ID NO: 7493294 - DNA, 19 bp, Homo sapiens
cagaaatagcgaagtgtaa

SEQ ID NO: 7493295 - DNA, 22 bp, Homo sapiens
cagaaatatatatgggtcagag

SEQ ID NO: 7493296 - DNA, 22 bp, Homo sapiens
cagaaatatatatgggtcagag

SEQ ID NO: 7493297 - DNA, 19 bp, Homo sapiens
cagaaatagcgaagtgtaa

SEQ ID NO: 7493298 - DNA, 22 bp, Homo sapiens
cagaaatattccaagtactgca

SEQ ID NO: 7493299 - DNA, 22 bp, Homo sapiens
cagaaatattccaagtactgca

SEQ ID NO: 7493300 - DNA, 22 bp, Homo sapiens
cagaaatattccaagtactgca

SEQ ID NO: 7493301 - DNA, 22 bp, Homo sapiens
cagaaatattccaagtactgca

SEQ ID NO: 7493302 - DNA, 22 bp, Homo sapiens
cagaaatattccaagtactgca

SEQ ID NO: 7493303 - DNA, 22 bp, Homo sapiens
cagaaatatttattgagtgaca

SEQ ID NO: 7493304 - DNA, 22 bp, Homo sapiens
cagaaatatttattgagtgaca

SEQ ID NO: 7493305 - DNA, 22 bp, Homo sapiens
cagaaatatttattgagtgaca

SEQ ID NO: 7493306 - DNA, 22 bp, Homo sapiens
cagaaatatttattgagtgaca

SEQ ID NO: 7493307 - DNA, 22 bp, Homo sapiens
cagaaatatttattgagtgaca

SEQ ID NO: 7493308 - DNA, 22 bp, Homo sapiens
cagaaatattccaagtactgca

SEQ ID NO: 7493309 - DNA, 22 bp, Homo sapiens
cagaaatattccaagtactgca

SEQ ID NO: 7493310 - DNA, 22 bp, Homo sapiens
cagaaatattccaagtactgca

SEQ ID NO: 7493311 - DNA, 22 bp, Homo sapiens
cagaaatattccaagtactgca

SEQ ID NO: 7493312 - DNA, 22 bp, Homo sapiens
cagaaatattccaagtactgca

SEQ ID NO: 7493313 - DNA, 22 bp, Homo sapiens
cagaaatattccaagtactgca

SEQ ID NO: 7493314 - DNA, 22 bp, Homo sapiens
cagaaatatgtgccatgcctta

SEQ ID NO: 7493315 - DNA, 22 bp, Homo sapiens
cagaaatatgtgccatgcctta

SEQ ID NO: 7493316 - DNA, 22 bp, Homo sapiens
cagaaatatgtgccatgcctta

SEQ ID NO: 7493317 - DNA, 22 bp, Homo sapiens
cagaaatatgtgccatgcctta

SEQ ID NO: 7493318 - DNA, 22 bp, Homo sapiens
cagaaatatgtgccatgcctta

SEQ ID NO: 7493319 - DNA, 22 bp, Homo sapiens
cagaaatatgtgccatgcctta

SEQ ID NO: 7493320 - DNA, 21 bp, Homo sapiens
cagaaatatgaatgatggtga

SEQ ID NO: 7493321 - DNA, 22 bp, Homo sapiens
cagaaatatgtgccatgcctta

SEQ ID NO: 7493322 - DNA, 22 bp, Homo sapiens
cagaaatatgtgccatgcctta

SEQ ID NO: 7493323 - DNA, 18 bp, Homo sapiens
cagaaatcacaccagcac

SEQ ID NO: 7493324 - DNA, 18 bp, Homo sapiens
cagaaatcacaccagcac

SEQ ID NO: 7493325 - DNA, 18 bp, Homo sapiens
cagaaatcacaccagcac

SEQ ID NO: 7493326 - DNA, 22 bp, Homo sapiens
cagaaatatttattgagtgaca

SEQ ID NO: 7493327 - DNA, 22 bp, Homo sapiens
cagaaatatttattgagtgaca

SEQ ID NO: 7493328 - DNA, 22 bp, Homo sapiens
cagaaatatttattgagtgaca

SEQ ID NO: 7493329 - DNA, 22 bp, Homo sapiens
cagaaggagcgctaaggtccca

SEQ ID NO: 7493330 - DNA, 22 bp, Homo sapiens
cagaaggagggggcaagccctg

SEQ ID NO: 7493331 - DNA, 22 bp, Homo sapiens
cagaaatcattgtgatgacagg

SEQ ID NO: 7493332 - DNA, 22 bp, Homo sapiens
cagaaatctccatgtcagacat

SEQ ID NO: 7493333 - DNA, 22 bp, Homo sapiens
cagaataatattggtctcatag

SEQ ID NO: 7493334 - DNA, 22 bp, Homo sapiens
cagaataccctatagacagaat

SEQ ID NO: 7493335 - DNA, 22 bp, Homo sapiens
cagaataccctatagacagaat

SEQ ID NO: 7493336 - DNA, 22 bp, Homo sapiens
cagaataccctatagacagaat

SEQ ID NO: 7493337 - DNA, 22 bp, Homo sapiens
cagaataatattggtctcatag

SEQ ID NO: 7493338 - DNA, 22 bp, Homo sapiens
cagaataatattggtctcatag

SEQ ID NO: 7493339 - DNA, 22 bp, Homo sapiens
cagaataatattggtctcatag

SEQ ID NO: 7493340 - DNA, 22 bp, Homo sapiens
cagaataagctgtgttgtcaag

SEQ ID NO: 7493341 - DNA, 22 bp, Homo sapiens
cagaataagctgtgttgtcaag

SEQ ID NO: 7493342 - DNA, 22 bp, Homo sapiens
cagaaggagggggcaagccctg

SEQ ID NO: 7493343 - DNA, 22 bp, Homo sapiens
cagaaggcaaacaaaaggattt

SEQ ID NO: 7493344 - DNA, 22 bp, Homo sapiens
cagaaggagggggcaagccctg

SEQ ID NO: 7493345 - DNA, 22 bp, Homo sapiens
cagagggatcatcttcctgaag

SEQ ID NO: 7493346 - DNA, 22 bp, Homo sapiens
cagagggagtttctgaggttgc

SEQ ID NO: 7493347 - DNA, 22 bp, Homo sapiens
cagagggatcatcttcctgaag

SEQ ID NO: 7493348 - DNA, 22 bp, Homo sapiens
cagagggatcatcttcctgaag

SEQ ID NO: 7493349 - DNA, 22 bp, Homo sapiens
cagagggatcatcttcctgaag

SEQ ID NO: 7493350 - DNA, 22 bp, Homo sapiens
cagagggcacatggtttcctca

SEQ ID NO: 7493351 - DNA, 22 bp, Homo sapiens
cagagggagtttctgaggttgc

SEQ ID NO: 7493352 - DNA, 22 bp, Homo sapiens
cagagggagtttctgaggttgc

SEQ ID NO: 7493353 - DNA, 22 bp, Homo sapiens
cagagggagtttctgaggttgc

SEQ ID NO: 7493354 - DNA, 22 bp, Homo sapiens
cagagggagtttctgaggttgc

SEQ ID NO: 7493355 - DNA, 22 bp, Homo sapiens
cagagggagtttctgaggttgc

SEQ ID NO: 7493356 - DNA, 22 bp, Homo sapiens
cagagggagtttctgaggttgc

SEQ ID NO: 7493357 - DNA, 22 bp, Homo sapiens
cagagggcacatggtttcctca

SEQ ID NO: 7493358 - DNA, 22 bp, Homo sapiens
cagagggcactcggagtgacat

SEQ ID NO: 7493359 - DNA, 22 bp, Homo sapiens
cagagggcacatggtttcctca

SEQ ID NO: 7493360 - DNA, 22 bp, Homo sapiens
cagagggatcatcttcctgaag

SEQ ID NO: 7493361 - DNA, 22 bp, Homo sapiens
cagagggcactcggagtgacat

SEQ ID NO: 7493362 - DNA, 22 bp, Homo sapiens
cagagggcactcggagtgacat

SEQ ID NO: 7493363 - DNA, 22 bp, Homo sapiens
cagagggccatctctatcttca

SEQ ID NO: 7493364 - DNA, 22 bp, Homo sapiens
cagagggcactcggagtgacat

SEQ ID NO: 7493365 - DNA, 22 bp, Homo sapiens
cagagggcactcggagtgacat

SEQ ID NO: 7493366 - DNA, 22 bp, Homo sapiens
cagagggcactcggagtgacat

SEQ ID NO: 7493367 - DNA, 22 bp, Homo sapiens
cagagggcactcggagtgacat

SEQ ID NO: 7493368 - DNA, 22 bp, Homo sapiens
cagagggccatctctatcttca

SEQ ID NO: 7493369 - DNA, 22 bp, Homo sapiens
cagagggccccctggccacagt

SEQ ID NO: 7493370 - DNA, 22 bp, Homo sapiens
cagagggccccctggccacagt

SEQ ID NO: 7493371 - DNA, 22 bp, Homo sapiens
cagagggccccctggccacagt

SEQ ID NO: 7493372 - DNA, 22 bp, Homo sapiens
cagagggccccctggccacagt

SEQ ID NO: 7493373 - DNA, 22 bp, Homo sapiens
cagagggccccctggccacagt

SEQ ID NO: 7493374 - DNA, 22 bp, Homo sapiens
cagagggccccctggccacagt

SEQ ID NO: 7493375 - DNA, 21 bp, Homo sapiens
cagagggccggcatgtggtct

SEQ ID NO: 7493376 - DNA, 22 bp, Homo sapiens
cagagggccccctggccacagt

SEQ ID NO: 7493377 - DNA, 21 bp, Homo sapiens
cagagggccggcatgtggtct

SEQ ID NO: 7493378 - DNA, 21 bp, Homo sapiens
cagagggccggcatgtggtct

SEQ ID NO: 7493379 - DNA, 22 bp, Homo sapiens
cagagggccccctggccacagt

SEQ ID NO: 7493380 - DNA, 22 bp, Homo sapiens
cagaggtagggagctatgttat

SEQ ID NO: 7493381 - DNA, 22 bp, Homo sapiens
cagaggtattgcaaaagcctag

SEQ ID NO: 7493382 - DNA, 22 bp, Homo sapiens
cagaggtcaggacttcattata

SEQ ID NO: 7493383 - DNA, 22 bp, Homo sapiens
cagaggtcaggttggacattat

SEQ ID NO: 7493384 - DNA, 22 bp, Homo sapiens
cagaggtcaagatctgaagtga

SEQ ID NO: 7493385 - DNA, 22 bp, Homo sapiens
cagaggtattttgataaacgcc

SEQ ID NO: 7493386 - DNA, 22 bp, Homo sapiens
cagaggtcaagatctgaagtga

SEQ ID NO: 7493387 - DNA, 22 bp, Homo sapiens
cagaggtattttgataaacgcc

SEQ ID NO: 7493388 - DNA, 22 bp, Homo sapiens
cagaggtagggttggcccagga

SEQ ID NO: 7493389 - DNA, 22 bp, Homo sapiens
cagaggtattgcaaaagcctag

SEQ ID NO: 7493390 - DNA, 22 bp, Homo sapiens
cagaggtccctatttctttgtt

SEQ ID NO: 7493391 - DNA, 22 bp, Homo sapiens
cagaggtccctatttctttgtt

SEQ ID NO: 7493392 - DNA, 22 bp, Homo sapiens
cagaggtccctatttctttgtt

SEQ ID NO: 7493393 - DNA, 22 bp, Homo sapiens
cagaggtccctgttcttaagga

SEQ ID NO: 7493394 - DNA, 22 bp, Homo sapiens
cagaggtccagcatacatttcc

SEQ ID NO: 7493395 - DNA, 21 bp, Homo sapiens
cagaggtcatcctgaggacaa

SEQ ID NO: 7493396 - DNA, 22 bp, Homo sapiens
cagaggtctgatgcgtccctgc

SEQ ID NO: 7493397 - DNA, 22 bp, Homo sapiens
cagaggtctgacactgaatggt

SEQ ID NO: 7493398 - DNA, 19 bp, Homo sapiens
cagaggtgatatatgccca

SEQ ID NO: 7493399 - DNA, 22 bp, Homo sapiens
cagaggtgacccatagtacctc

SEQ ID NO: 7493400 - DNA, 22 bp, Homo sapiens
cagaggtctgacactgaatggt

SEQ ID NO: 7493401 - DNA, 22 bp, Homo sapiens
cagaggtctgacactgaatggt

SEQ ID NO: 7493402 - DNA, 22 bp, Homo sapiens
cagaggtctccatcaccctcct

SEQ ID NO: 7493403 - DNA, 22 bp, Homo sapiens
cagaggtctccatcaccctcct

SEQ ID NO: 7493404 - DNA, 22 bp, Homo sapiens
cagaggtctgacactgaatggt

SEQ ID NO: 7493405 - DNA, 22 bp, Homo sapiens
agcctccctatgcaccttcagg

SEQ ID NO: 7493406 - DNA, 22 bp, Homo sapiens
cagaggtgcatacaggtcatta

SEQ ID NO: 7493407 - DNA, 22 bp, Homo sapiens
cagaggtgcatacaggtcatta

SEQ ID NO: 7493408 - DNA, 22 bp, Homo sapiens
cagaggtgctggagtgagtcct

SEQ ID NO: 7493409 - DNA, 22 bp, Homo sapiens
cagaggtgctggagtgagtcct

SEQ ID NO: 7493410 - DNA, 22 bp, Homo sapiens
agcctcctggagtttctgggat

SEQ ID NO: 7493411 - DNA, 22 bp, Homo sapiens
agcctcctggagtttctgggat

SEQ ID NO: 7493412 - DNA, 22 bp, Homo sapiens
agcctccctatgcaccttcagg

SEQ ID NO: 7493413 - DNA, 22 bp, Homo sapiens
agcctccctatgcaccttcagg

SEQ ID NO: 7493414 - DNA, 22 bp, Homo sapiens
agcctccctatgcaccttcagg

SEQ ID NO: 7493415 - DNA, 22 bp, Homo sapiens
cagaggtctgatgcgtccctgc

SEQ ID NO: 7493416 - DNA, 22 bp, Homo sapiens
cagaggtgctggagtgagtcct

SEQ ID NO: 7493417 - DNA, 22 bp, Homo sapiens
cagaggtgcatacaggtcatta

SEQ ID NO: 7493418 - DNA, 22 bp, Homo sapiens
cagaggtgcatacaggtcatta

SEQ ID NO: 7493419 - DNA, 22 bp, Homo sapiens
cagaggtgcatacaggtcatta

SEQ ID NO: 7493420 - DNA, 19 bp, Homo sapiens
cagaggtgatatatgccca

SEQ ID NO: 7493421 - DNA, 22 bp, Homo sapiens
cagaggtgcatacaggtcatta

SEQ ID NO: 7493422 - DNA, 22 bp, Homo sapiens
cagaggtgcatacaggtcatta

SEQ ID NO: 7493423 - DNA, 22 bp, Homo sapiens
cagaggtgcatacaggtcatta

SEQ ID NO: 7493424 - DNA, 22 bp, Homo sapiens
agcctctgctggccctggcact

SEQ ID NO: 7493425 - DNA, 22 bp, Homo sapiens
agcctctgctggccctggcact

SEQ ID NO: 7493426 - DNA, 22 bp, Homo sapiens
agcctctgctggccctggcact

SEQ ID NO: 7493427 - DNA, 22 bp, Homo sapiens
agcctctgctggccctggcact

SEQ ID NO: 7493428 - DNA, 22 bp, Homo sapiens
agcctctgctggccctggcact

SEQ ID NO: 7493429 - DNA, 22 bp, Homo sapiens
agcctctgcttatgcaaaggta

SEQ ID NO: 7493430 - DNA, 22 bp, Homo sapiens
agcctctgctggccctggcact

SEQ ID NO: 7493431 - DNA, 22 bp, Homo sapiens
agcctctgctggccctggcact

SEQ ID NO: 7493432 - DNA, 22 bp, Homo sapiens
agcctctggccctagactgctt

SEQ ID NO: 7493433 - DNA, 22 bp, Homo sapiens
agcctctggccctagactgctt

SEQ ID NO: 7493434 - DNA, 22 bp, Homo sapiens
agcctctggccctagactgctt

SEQ ID NO: 7493435 - DNA, 18 bp, Homo sapiens
agcctctggcagagagaa

SEQ ID NO: 7493436 - DNA, 18 bp, Homo sapiens
agcctctggcagagagaa

SEQ ID NO: 7493437 - DNA, 18 bp, Homo sapiens
agcctctggcagagagaa

SEQ ID NO: 7493438 - DNA, 18 bp, Homo sapiens
agcctctggcagagagaa

SEQ ID NO: 7493439 - DNA, 18 bp, Homo sapiens
agcctctggcagagagaa

SEQ ID NO: 7493440 - DNA, 20 bp, Homo sapiens
agcctctgcccttcccactg

SEQ ID NO: 7493441 - DNA, 22 bp, Homo sapiens
agcctctgcacttcttacaggt

SEQ ID NO: 7493442 - DNA, 22 bp, Homo sapiens
agcctctgcacttcttacaggt

SEQ ID NO: 7493443 - DNA, 22 bp, Homo sapiens
agcctctgcacttcttacaggt

SEQ ID NO: 7493444 - DNA, 22 bp, Homo sapiens
agcctctgctggccctggcact

SEQ ID NO: 7493445 - DNA, 22 bp, Homo sapiens
agcctctgctggccctggcact

SEQ ID NO: 7493446 - DNA, 20 bp, Homo sapiens
agcctctgcccttcccactg

SEQ ID NO: 7493447 - DNA, 20 bp, Homo sapiens
agcctctgcccttcccactg

SEQ ID NO: 7493448 - DNA, 20 bp, Homo sapiens
agcctctgcccttcccactg

SEQ ID NO: 7493449 - DNA, 20 bp, Homo sapiens
agcctctgcccttcccactg

SEQ ID NO: 7493450 - DNA, 22 bp, Homo sapiens
agcctctgcacgggcacgggtg

SEQ ID NO: 7493451 - DNA, 22 bp, Homo sapiens
agcctctgatggctcccaagga

SEQ ID NO: 7493452 - DNA, 22 bp, Homo sapiens
agcctcctggagtttctgggat

SEQ ID NO: 7493453 - DNA, 22 bp, Homo sapiens
agcctctgcacttcttacaggt

SEQ ID NO: 7493454 - DNA, 22 bp, Homo sapiens
agcctctgcacttcttacaggt

SEQ ID NO: 7493455 - DNA, 22 bp, Homo sapiens
agcctctgcacgggcacgggtg

SEQ ID NO: 7493456 - DNA, 22 bp, Homo sapiens
agcctctggtcctccctcagct

SEQ ID NO: 7493457 - DNA, 22 bp, Homo sapiens
agcctctggtcctccctcagct

SEQ ID NO: 7493458 - DNA, 22 bp, Homo sapiens
agcctctggtcctccctcagct

SEQ ID NO: 7493459 - DNA, 22 bp, Homo sapiens
agcctctggtcctccctcagct

SEQ ID NO: 7493460 - DNA, 22 bp, Homo sapiens
agcctctggtcctccctcagct

SEQ ID NO: 7493461 - DNA, 22 bp, Homo sapiens
agcctctggtcctccctcagct

SEQ ID NO: 7493462 - DNA, 22 bp, Homo sapiens
agcctctggtcctccctcagct

SEQ ID NO: 7493463 - DNA, 22 bp, Homo sapiens
agcctctgggggagctgggagc

SEQ ID NO: 7493464 - DNA, 22 bp, Homo sapiens
agcctctgggggagctgggagc

SEQ ID NO: 7493465 - DNA, 22 bp, Homo sapiens
agcctctgggggagctgggagc

SEQ ID NO: 7493466 - DNA, 22 bp, Homo sapiens
agcctctggccctagactgctt

SEQ ID NO: 7493467 - DNA, 22 bp, Homo sapiens
agcctctggccctagactgctt

SEQ ID NO: 7493468 - DNA, 22 bp, Homo sapiens
agcctctggccctagactgctt

SEQ ID NO: 7493469 - DNA, 22 bp, Homo sapiens
agcctctgtcaagcttttcaaa

SEQ ID NO: 7493470 - DNA, 22 bp, Homo sapiens
agcctctgtcaagcttttcaaa

SEQ ID NO: 7493471 - DNA, 22 bp, Homo sapiens
agcctctgtcaagcttttcaaa

SEQ ID NO: 7493472 - DNA, 22 bp, Homo sapiens
agcctctgtgactcacaggtca

SEQ ID NO: 7493473 - DNA, 22 bp, Homo sapiens
agcctctgtgactcacaggtca

SEQ ID NO: 7493474 - DNA, 22 bp, Homo sapiens
agcctctgtgactcacaggtca

SEQ ID NO: 7493475 - DNA, 22 bp, Homo sapiens
agcctctgtagaaagcagtgtg

SEQ ID NO: 7493476 - DNA, 22 bp, Homo sapiens
agcctctgtagaaagcagtgtg

SEQ ID NO: 7493477 - DNA, 22 bp, Homo sapiens
agcctctgtagaaagcagtgtg

SEQ ID NO: 7493478 - DNA, 22 bp, Homo sapiens
agcctctgtagaaagcagtgtg

SEQ ID NO: 7493479 - DNA, 22 bp, Homo sapiens
agcctctgtagaaagcagtgtg

SEQ ID NO: 7493480 - DNA, 22 bp, Homo sapiens
agcctctgtagaaagcagtgtg

SEQ ID NO: 7493481 - DNA, 22 bp, Homo sapiens
agcctctgtagaaagcagtgtg

SEQ ID NO: 7493482 - DNA, 22 bp, Homo sapiens
agcctctgtagaaagcagtgtg

SEQ ID NO: 7493483 - DNA, 22 bp, Homo sapiens
agcctggcactgccccatccat

SEQ ID NO: 7493484 - DNA, 22 bp, Homo sapiens
agcctggcactgccccatccat

SEQ ID NO: 7493485 - DNA, 22 bp, Homo sapiens
agcctggcactgccccatccat

SEQ ID NO: 7493486 - DNA, 22 bp, Homo sapiens
agcctggcactgccccatccat

SEQ ID NO: 7493487 - DNA, 22 bp, Homo sapiens
agcctggcactgccccatccat

SEQ ID NO: 7493488 - DNA, 22 bp, Homo sapiens
agcctggcactgccccatccat

SEQ ID NO: 7493489 - DNA, 22 bp, Homo sapiens
agcctggcactgaggcagggcg

SEQ ID NO: 7493490 - DNA, 22 bp, Homo sapiens
agcctggcactgaggcagggcg

SEQ ID NO: 7493491 - DNA, 22 bp, Homo sapiens
agcctggcactgaggcagggcg

SEQ ID NO: 7493492 - DNA, 22 bp, Homo sapiens
agcctggcactgaggcagggcg

SEQ ID NO: 7493493 - DNA, 22 bp, Homo sapiens
agcctggcactgccccatccat

SEQ ID NO: 7493494 - DNA, 22 bp, Homo sapiens
cagcaggatatggtggagagag

SEQ ID NO: 7493495 - DNA, 22 bp, Homo sapiens
cagcaggatatggtggagagag

SEQ ID NO: 7493496 - DNA, 22 bp, Homo sapiens
cagcaggatatggtggagagag

SEQ ID NO: 7493497 - DNA, 22 bp, Homo sapiens
cagcaggatatggtggagagag

SEQ ID NO: 7493498 - DNA, 22 bp, Homo sapiens
cagcaggatatggtggagagag

SEQ ID NO: 7493499 - DNA, 22 bp, Homo sapiens
cagcaggatatggtggagagag

SEQ ID NO: 7493500 - DNA, 22 bp, Homo sapiens
cagcagggaagctgtgctgttt

SEQ ID NO: 7493501 - DNA, 22 bp, Homo sapiens
cagcaggggaactgtgggccag

SEQ ID NO: 7493502 - DNA, 22 bp, Homo sapiens
cagcaggggaactgtgggccag

SEQ ID NO: 7493503 - DNA, 22 bp, Homo sapiens
cagcaggggaactgtgggccag

SEQ ID NO: 7493504 - DNA, 22 bp, Homo sapiens
cagcaggggaactgtgggccag

SEQ ID NO: 7493505 - DNA, 22 bp, Homo sapiens
cagcaggggaactgtgggccag

SEQ ID NO: 7493506 - DNA, 22 bp, Homo sapiens
cagcagggctgtgctaccccat

SEQ ID NO: 7493507 - DNA, 22 bp, Homo sapiens
cagcaggggaactgtgggccag

SEQ ID NO: 7493508 - DNA, 22 bp, Homo sapiens
cagcagggcccccgggtgcgcc

SEQ ID NO: 7493509 - DNA, 22 bp, Homo sapiens
cagcagggctgtgctaccccat

SEQ ID NO: 7493510 - DNA, 22 bp, Homo sapiens
cagcagggctgtgctaccccat

SEQ ID NO: 7493511 - DNA, 22 bp, Homo sapiens
cagcagggcccccgggtgcgcc

SEQ ID NO: 7493512 - DNA, 22 bp, Homo sapiens
cagcagggcccccgggtgcgcc

SEQ ID NO: 7493513 - DNA, 22 bp, Homo sapiens
cagcagggcccccgggtgcgcc

SEQ ID NO: 7493514 - DNA, 22 bp, Homo sapiens
cagcagggcccccgggtgcgcc

SEQ ID NO: 7493515 - DNA, 22 bp, Homo sapiens
cagcagggcccccgggtgcgcc

SEQ ID NO: 7493516 - DNA, 22 bp, Homo sapiens
cagcagggcccccgggtgcgcc

SEQ ID NO: 7493517 - DNA, 22 bp, Homo sapiens
cagcagggcccccgggtgcgcc

SEQ ID NO: 7493518 - DNA, 22 bp, Homo sapiens
cagcagggcccccgggtgcgcc

SEQ ID NO: 7493519 - DNA, 20 bp, Homo sapiens
agcctggcaaacacccccag

SEQ ID NO: 7493520 - DNA, 20 bp, Homo sapiens
agcctggcaaacacccccag

SEQ ID NO: 7493521 - DNA, 22 bp, Homo sapiens
agcctggattcgtgcatccaca

SEQ ID NO: 7493522 - DNA, 23 bp, Homo sapiens
agcctggcacctgcagatcggag

SEQ ID NO: 7493523 - DNA, 23 bp, Homo sapiens
agcctggcacctgcagatcggag

SEQ ID NO: 7493524 - DNA, 22 bp, Homo sapiens
agcctggcactgaggcagggcg

SEQ ID NO: 7493525 - DNA, 22 bp, Homo sapiens
agcctggcactgaggcagggcg

SEQ ID NO: 7493526 - DNA, 20 bp, Homo sapiens
agcctggcaaacacccccag

SEQ ID NO: 7493527 - DNA, 20 bp, Homo sapiens
agcctggcaaacacccccag

SEQ ID NO: 7493528 - DNA, 23 bp, Homo sapiens
agcctggcacctgcagatcggag

SEQ ID NO: 7493529 - DNA, 22 bp, Homo sapiens
agcctggatcctaggctcagct

SEQ ID NO: 7493530 - DNA, 22 bp, Homo sapiens
agcctggatcctaggctcagct

SEQ ID NO: 7493531 - DNA, 22 bp, Homo sapiens
agcctggatccatgtggctacc

SEQ ID NO: 7493532 - DNA, 22 bp, Homo sapiens
agcctggattcgtgcatccaca

SEQ ID NO: 7493533 - DNA, 22 bp, Homo sapiens
agcctggatcctaggctcagct

SEQ ID NO: 7493534 - DNA, 22 bp, Homo sapiens
agcctggatcctaggctcagct

SEQ ID NO: 7493535 - DNA, 22 bp, Homo sapiens
agcctggagttcccaggagaag

SEQ ID NO: 7493536 - DNA, 22 bp, Homo sapiens
agcctggagttcccaggagaag

SEQ ID NO: 7493537 - DNA, 22 bp, Homo sapiens
agcctggagttcccaggagaag

SEQ ID NO: 7493538 - DNA, 22 bp, Homo sapiens
agcctggatccatgtggctacc

SEQ ID NO: 7493539 - DNA, 22 bp, Homo sapiens
cagcagctgaggcgctggcgtg

SEQ ID NO: 7493540 - DNA, 22 bp, Homo sapiens
cagcagctgactccaagagagc

SEQ ID NO: 7493541 - DNA, 22 bp, Homo sapiens
cagcagctgaggcgctggcgtg

SEQ ID NO: 7493542 - DNA, 22 bp, Homo sapiens
cagcagctgaggcgctggcgtg

SEQ ID NO: 7493543 - DNA, 22 bp, Homo sapiens
cagcagctgaggcgctggcgtg

SEQ ID NO: 7493544 - DNA, 22 bp, Homo sapiens
agcctggagttcccaggagaag

SEQ ID NO: 7493545 - DNA, 22 bp, Homo sapiens
cagcagctgatggggaagtgat

SEQ ID NO: 7493546 - DNA, 22 bp, Homo sapiens
cagcagctgatggggaagtgat

SEQ ID NO: 7493547 - DNA, 22 bp, Homo sapiens
cagcagctgaggcgctggcgtg

SEQ ID NO: 7493548 - DNA, 22 bp, Homo sapiens
cagcagctcactcaggtggctc

SEQ ID NO: 7493549 - DNA, 22 bp, Homo sapiens
cagcagctcactcaggtggctc

SEQ ID NO: 7493550 - DNA, 22 bp, Homo sapiens
cagcagctcactgaataatgac

SEQ ID NO: 7493551 - DNA, 22 bp, Homo sapiens
cagcagctcactgaataatgac

SEQ ID NO: 7493552 - DNA, 22 bp, Homo sapiens
cagcagctcactgaataatgac

SEQ ID NO: 7493553 - DNA, 22 bp, Homo sapiens
cagcagctcactgaataatgac

SEQ ID NO: 7493554 - DNA, 22 bp, Homo sapiens
cagcagctcactcaggtggctc

SEQ ID NO: 7493555 - DNA, 22 bp, Homo sapiens
cagcagctcactcaggtggctc

SEQ ID NO: 7493556 - DNA, 22 bp, Homo sapiens
cagcagctcactcaggtggctc

SEQ ID NO: 7493557 - DNA, 22 bp, Homo sapiens
agcctgagctgcctgccgcctc

SEQ ID NO: 7493558 - DNA, 22 bp, Homo sapiens
agcctgagctgcctgccgcctc

SEQ ID NO: 7493559 - DNA, 22 bp, Homo sapiens
agcctgagccccatccagctga

SEQ ID NO: 7493560 - DNA, 22 bp, Homo sapiens
cagcagcattgctctggattcc

SEQ ID NO: 7493561 - DNA, 22 bp, Homo sapiens
agcctgagctgcctgccgcctc

SEQ ID NO: 7493562 - DNA, 22 bp, Homo sapiens
cagcagcattgctctggattcc

SEQ ID NO: 7493563 - DNA, 22 bp, Homo sapiens
cagcagcattgctctggattcc

SEQ ID NO: 7493564 - DNA, 22 bp, Homo sapiens
cagcagcattgctctggattcc

SEQ ID NO: 7493565 - DNA, 22 bp, Homo sapiens
agcctgagccccatccagctga

SEQ ID NO: 7493566 - DNA, 22 bp, Homo sapiens
agcctgagccccatccagctga

SEQ ID NO: 7493567 - DNA, 22 bp, Homo sapiens
agcctgagccccatccagctga

SEQ ID NO: 7493568 - DNA, 22 bp, Homo sapiens
agcctgagagccaagctgtgca

SEQ ID NO: 7493569 - DNA, 22 bp, Homo sapiens
agcctgagagccaagctgtgca

SEQ ID NO: 7493570 - DNA, 22 bp, Homo sapiens
agcctgagagccaagctgtgca

SEQ ID NO: 7493571 - DNA, 22 bp, Homo sapiens
agcctgagagccaagctgtgca

SEQ ID NO: 7493572 - DNA, 23 bp, Homo sapiens
agcctcttttctcctgccctgca

SEQ ID NO: 7493573 - DNA, 22 bp, Homo sapiens
agcctgagagccaagctgtgca

SEQ ID NO: 7493574 - DNA, 22 bp, Homo sapiens
agcctgagagccaagctgtgca

SEQ ID NO: 7493575 - DNA, 21 bp, Homo sapiens
agcctgaatcccaccagttca

SEQ ID NO: 7493576 - DNA, 22 bp, Homo sapiens
agcctcttattctccaggactt

SEQ ID NO: 7493577 - DNA, 22 bp, Homo sapiens
agcctcttattctccaggactt

SEQ ID NO: 7493578 - DNA, 22 bp, Homo sapiens
cagcagctcagtctctcagtag

SEQ ID NO: 7493579 - DNA, 22 bp, Homo sapiens
cagcagctcagtctctcagtag

SEQ ID NO: 7493580 - DNA, 22 bp, Homo sapiens
cagcagctcagtctctcagtag

SEQ ID NO: 7493581 - DNA, 22 bp, Homo sapiens
cagcagctcagtctctcagtag

SEQ ID NO: 7493582 - DNA, 22 bp, Homo sapiens
cagcagctcagtctctcagtag

SEQ ID NO: 7493583 - DNA, 22 bp, Homo sapiens
cagcagctcaggctgcttccca

SEQ ID NO: 7493584 - DNA, 22 bp, Homo sapiens
cagcagctcaggctgcttccca

SEQ ID NO: 7493585 - DNA, 22 bp, Homo sapiens
cagcagctcagtctctcagtag

SEQ ID NO: 7493586 - DNA, 22 bp, Homo sapiens
cagcagctcaggctgcttccca

SEQ ID NO: 7493587 - DNA, 22 bp, Homo sapiens
cagcagctcaggctgcttccca

SEQ ID NO: 7493588 - DNA, 22 bp, Homo sapiens
cagcagctcaggctgcttccca

SEQ ID NO: 7493589 - DNA, 22 bp, Homo sapiens
cagcagctcaggctgcttccca

SEQ ID NO: 7493590 - DNA, 22 bp, Homo sapiens
cagcagctcaggctgcttccca

SEQ ID NO: 7493591 - DNA, 22 bp, Homo sapiens
cagcagctcaggctgcttccca

SEQ ID NO: 7493592 - DNA, 22 bp, Homo sapiens
cagcagctcaggctgcttccca

SEQ ID NO: 7493593 - DNA, 22 bp, Homo sapiens
cagcagctcaggctgcttccca

SEQ ID NO: 7493594 - DNA, 22 bp, Homo sapiens
cagcagctcaggctgcttccca

SEQ ID NO: 7493595 - DNA, 22 bp, Homo sapiens
cagcagctcaggctccttccca

SEQ ID NO: 7493596 - DNA, 22 bp, Homo sapiens
cagcagctcaggctccttccca

SEQ ID NO: 7493597 - DNA, 22 bp, Homo sapiens
cagcagctcaggctccttccca

SEQ ID NO: 7493598 - DNA, 22 bp, Homo sapiens
cagcagctcaggctccttccca

SEQ ID NO: 7493599 - DNA, 22 bp, Homo sapiens
cagcagctcaggctccttccca

SEQ ID NO: 7493600 - DNA, 22 bp, Homo sapiens
cagcagctcactgaataatgac

SEQ ID NO: 7493601 - DNA, 22 bp, Homo sapiens
cagcagctcaggctccttccca

SEQ ID NO: 7493602 - DNA, 22 bp, Homo sapiens
cagcagctcccatccgctgagc

SEQ ID NO: 7493603 - DNA, 22 bp, Homo sapiens
cagcagctccaaagaatagcca

SEQ ID NO: 7493604 - DNA, 22 bp, Homo sapiens
cagcagctcccatccgctgagc

SEQ ID NO: 7493605 - DNA, 22 bp, Homo sapiens
cagcagctccaaagaatagcca

SEQ ID NO: 7493606 - DNA, 22 bp, Homo sapiens
cagcagctccaaagaatagcca

SEQ ID NO: 7493607 - DNA, 22 bp, Homo sapiens
cagcagctccaaagaatagcca

SEQ ID NO: 7493608 - DNA, 22 bp, Homo sapiens
cagcagctccaaagaatagcca

SEQ ID NO: 7493609 - DNA, 22 bp, Homo sapiens
cagcagctccaaagaatagcca

SEQ ID NO: 7493610 - DNA, 22 bp, Homo sapiens
cagcagctccaaagaatagcca

SEQ ID NO: 7493611 - DNA, 22 bp, Homo sapiens
cagcagctcagtctctcagtag

SEQ ID NO: 7493612 - DNA, 22 bp, Homo sapiens
cagcagctcagtctctcagtag

SEQ ID NO: 7493613 - DNA, 22 bp, Homo sapiens
cagcagctgactccaagagagc

SEQ ID NO: 7493614 - DNA, 22 bp, Homo sapiens
cagcagctgactccaagagagc

SEQ ID NO: 7493615 - DNA, 22 bp, Homo sapiens
cagcagctcctctgcggctatg

SEQ ID NO: 7493616 - DNA, 22 bp, Homo sapiens
cagcagctcctctgcggctatg

SEQ ID NO: 7493617 - DNA, 22 bp, Homo sapiens
cagcagctgactccaagagagc

SEQ ID NO: 7493618 - DNA, 22 bp, Homo sapiens
cagcagctcctctgcggctatg

SEQ ID NO: 7493619 - DNA, 22 bp, Homo sapiens
cagcagctcctctgcggctatg

SEQ ID NO: 7493620 - DNA, 22 bp, Homo sapiens
cagcagctcctctgcggctatg

SEQ ID NO: 7493621 - DNA, 22 bp, Homo sapiens
cagcagctcccatccgctgagc

SEQ ID NO: 7493622 - DNA, 22 bp, Homo sapiens
cagcagctcccatccgctgagc

SEQ ID NO: 7493623 - DNA, 22 bp, Homo sapiens
agctcagagggaggtgaagtgg

SEQ ID NO: 7493624 - DNA, 22 bp, Homo sapiens
agctcagagggaggtgaagtgg

SEQ ID NO: 7493625 - DNA, 22 bp, Homo sapiens
agctcagagctcgggaggatgg

SEQ ID NO: 7493626 - DNA, 22 bp, Homo sapiens
agctcagagctcgggaggatgg

SEQ ID NO: 7493627 - DNA, 22 bp, Homo sapiens
agctcagagataatcaagagac

SEQ ID NO: 7493628 - DNA, 22 bp, Homo sapiens
agctcagagctcgggaggatgg

SEQ ID NO: 7493629 - DNA, 22 bp, Homo sapiens
agctcagagataatcaagagac

SEQ ID NO: 7493630 - DNA, 22 bp, Homo sapiens
agctcagagataatcaagagac

SEQ ID NO: 7493631 - DNA, 22 bp, Homo sapiens
agctcagagataatcaagagac

SEQ ID NO: 7493632 - DNA, 22 bp, Homo sapiens
agctcagagataatcaagagac

SEQ ID NO: 7493633 - DNA, 22 bp, Homo sapiens
agctcagagataatcaagagac

SEQ ID NO: 7493634 - DNA, 21 bp, Homo sapiens
agctcagcaagatggaggctc

SEQ ID NO: 7493635 - DNA, 22 bp, Homo sapiens
agctcagagggaggtgaagtgg

SEQ ID NO: 7493636 - DNA, 22 bp, Homo sapiens
agctcagagggaggtgaagtgg

SEQ ID NO: 7493637 - DNA, 21 bp, Homo sapiens
agctcagcaagatggaggctc

SEQ ID NO: 7493638 - DNA, 21 bp, Homo sapiens
agctcagcaagatggaggctc

SEQ ID NO: 7493639 - DNA, 22 bp, Homo sapiens
agctcagcactgtcagcactcc

SEQ ID NO: 7493640 - DNA, 22 bp, Homo sapiens
agctcagcactgtcagcactcc

SEQ ID NO: 7493641 - DNA, 22 bp, Homo sapiens
agctcagcgggcttctggtaag

SEQ ID NO: 7493642 - DNA, 21 bp, Homo sapiens
agctcagccgggcacagtggc

SEQ ID NO: 7493643 - DNA, 21 bp, Homo sapiens
agctcagccgggcacagtggc

SEQ ID NO: 7493644 - DNA, 21 bp, Homo sapiens
agctcagccgggcacagtggc

SEQ ID NO: 7493645 - DNA, 22 bp, Homo sapiens
agctcagcactgtcagcactcc

SEQ ID NO: 7493646 - DNA, 22 bp, Homo sapiens
agctcagccctcctgtgcagct

SEQ ID NO: 7493647 - DNA, 22 bp, Homo sapiens
agctcagccctcctgtgcagct

SEQ ID NO: 7493648 - DNA, 22 bp, Homo sapiens
agctcagccctcctgtgcagct

SEQ ID NO: 7493649 - DNA, 22 bp, Homo sapiens
agctcagcttcctctccatgct

SEQ ID NO: 7493650 - DNA, 22 bp, Homo sapiens
agctcagcttcctctccatgct

SEQ ID NO: 7493651 - DNA, 22 bp, Homo sapiens
agctcaggcaactctgggcccc

SEQ ID NO: 7493652 - DNA, 22 bp, Homo sapiens
agctcaggcaactctgggcccc

SEQ ID NO: 7493653 - DNA, 22 bp, Homo sapiens
agctcaggcaactctgggcccc

SEQ ID NO: 7493654 - DNA, 22 bp, Homo sapiens
agctcagcgggcttctggtaag

SEQ ID NO: 7493655 - DNA, 21 bp, Homo sapiens
agctcagccgggcacagtggc

SEQ ID NO: 7493656 - DNA, 22 bp, Homo sapiens
agctcagcttcctctccatgct

SEQ ID NO: 7493657 - DNA, 22 bp, Homo sapiens
agctcagcttcctctccatgct

SEQ ID NO: 7493658 - DNA, 22 bp, Homo sapiens
agctcagcttcctctccatgct

SEQ ID NO: 7493659 - DNA, 19 bp, Homo sapiens
cagctcaggactcagcccc

SEQ ID NO: 7493660 - DNA, 19 bp, Homo sapiens
cagctcaggactcagcccc

SEQ ID NO: 7493661 - DNA, 19 bp, Homo sapiens
cagctcaggactcagcccc

SEQ ID NO: 7493662 - DNA, 19 bp, Homo sapiens
cagctcaggactcagcccc

SEQ ID NO: 7493663 - DNA, 19 bp, Homo sapiens
cagctcaggactcagcccc

SEQ ID NO: 7493664 - DNA, 19 bp, Homo sapiens
cagctcaggactcagcccc

SEQ ID NO: 7493665 - DNA, 22 bp, Homo sapiens
cagctaaggctccttctaggta

SEQ ID NO: 7493666 - DNA, 22 bp, Homo sapiens
cagctaagccacactcagatgg

SEQ ID NO: 7493667 - DNA, 22 bp, Homo sapiens
cagctcaggaaggaaggccggc

SEQ ID NO: 7493668 - DNA, 22 bp, Homo sapiens
cagctaagccacactcagatgg

SEQ ID NO: 7493669 - DNA, 22 bp, Homo sapiens
cagcgtctcgttgtgggcctcg

SEQ ID NO: 7493670 - DNA, 22 bp, Homo sapiens
agctcaggcaactctgggcccc

SEQ ID NO: 7493671 - DNA, 22 bp, Homo sapiens
agctcaggcaactctgggcccc

SEQ ID NO: 7493672 - DNA, 22 bp, Homo sapiens
agctcaggcaactctgggcccc

SEQ ID NO: 7493673 - DNA, 22 bp, Homo sapiens
cagctaagaatgtctgagatca

SEQ ID NO: 7493674 - DNA, 22 bp, Homo sapiens
cagcgtctcgttgtgggcctcg

SEQ ID NO: 7493675 - DNA, 22 bp, Homo sapiens
agctcaggcaactctgggcccc

SEQ ID NO: 7493676 - DNA, 22 bp, Homo sapiens
agctcaggcaactctgggcccc

SEQ ID NO: 7493677 - DNA, 22 bp, Homo sapiens
cagctcaggctctccatgctcc

SEQ ID NO: 7493678 - DNA, 22 bp, Homo sapiens
cagctcaggctctccatgctcc

SEQ ID NO: 7493679 - DNA, 22 bp, Homo sapiens
cagctcaggctctccatgctcc

SEQ ID NO: 7493680 - DNA, 22 bp, Homo sapiens
cagctcaggctctccatgctcc

SEQ ID NO: 7493681 - DNA, 22 bp, Homo sapiens
cagctcaggcactggcgcggga

SEQ ID NO: 7493682 - DNA, 22 bp, Homo sapiens
cagctcaggcactggcgcggga

SEQ ID NO: 7493683 - DNA, 22 bp, Homo sapiens
cagctcaggcactggcgcggga

SEQ ID NO: 7493684 - DNA, 22 bp, Homo sapiens
cagctcaggcactggcgcggga

SEQ ID NO: 7493685 - DNA, 22 bp, Homo sapiens
cagctcaggcactggcgcggga

SEQ ID NO: 7493686 - DNA, 22 bp, Homo sapiens
cagctcaggcactggcgcggga

SEQ ID NO: 7493687 - DNA, 19 bp, Homo sapiens
cagctcaggactcagcccc

SEQ ID NO: 7493688 - DNA, 19 bp, Homo sapiens
cagctcaggactcagcccc

SEQ ID NO: 7493689 - DNA, 22 bp, Homo sapiens
cagctcagtctggagagatgca

SEQ ID NO: 7493690 - DNA, 22 bp, Homo sapiens
cagctcagtctggagagatgca

SEQ ID NO: 7493691 - DNA, 22 bp, Homo sapiens
cagctcaggctctccatgctcc

SEQ ID NO: 7493692 - DNA, 22 bp, Homo sapiens
cagctcagtctggagagatgca

SEQ ID NO: 7493693 - DNA, 22 bp, Homo sapiens
cagctcaggctctccatgctcc

SEQ ID NO: 7493694 - DNA, 22 bp, Homo sapiens
cagctcaggctctccatgctcc

SEQ ID NO: 7493695 - DNA, 22 bp, Homo sapiens
cagctcaggctctccatgctcc

SEQ ID NO: 7493696 - DNA, 22 bp, Homo sapiens
cagctcattcctcaatctagga

SEQ ID NO: 7493697 - DNA, 22 bp, Homo sapiens
cagctccaaagccccactgtcc

SEQ ID NO: 7493698 - DNA, 22 bp, Homo sapiens
cagctccaaagccccactgtcc

SEQ ID NO: 7493699 - DNA, 22 bp, Homo sapiens
agctcctgaaaatccagactgg

SEQ ID NO: 7493700 - DNA, 22 bp, Homo sapiens
agctcctgaaaatccagactgg

SEQ ID NO: 7493701 - DNA, 22 bp, Homo sapiens
agctcctgaaaatccagactgg

SEQ ID NO: 7493702 - DNA, 22 bp, Homo sapiens
agctcctgaaaagcgcttgctt

SEQ ID NO: 7493703 - DNA, 22 bp, Homo sapiens
agctcctgaaaagcgcttgctt

SEQ ID NO: 7493704 - DNA, 22 bp, Homo sapiens
agctcctgaaaatccagactgg

SEQ ID NO: 7493705 - DNA, 22 bp, Homo sapiens
agctcctgaaaatccagactgg

SEQ ID NO: 7493706 - DNA, 22 bp, Homo sapiens
agctcctgaaaatccagactgg

SEQ ID NO: 7493707 - DNA, 22 bp, Homo sapiens
agctcctgaaaatccagactgg

SEQ ID NO: 7493708 - DNA, 22 bp, Homo sapiens
agctcctgaaaatccagactgg

SEQ ID NO: 7493709 - DNA, 18 bp, Homo sapiens
agctcctgaactctgtgg

SEQ ID NO: 7493710 - DNA, 18 bp, Homo sapiens
agctcctgaactctgtgg

SEQ ID NO: 7493711 - DNA, 18 bp, Homo sapiens
agctcctgaactctgtgg

SEQ ID NO: 7493712 - DNA, 22 bp, Homo sapiens
cagctcattcctcaatctagga

SEQ ID NO: 7493713 - DNA, 22 bp, Homo sapiens
cagctcagtttcaataccaggt

SEQ ID NO: 7493714 - DNA, 19 bp, Homo sapiens
cagctcagtttgattctct

SEQ ID NO: 7493715 - DNA, 22 bp, Homo sapiens
cagctcagtttcaataccaggt

SEQ ID NO: 7493716 - DNA, 22 bp, Homo sapiens
cagctcagtttcaataccaggt

SEQ ID NO: 7493717 - DNA, 22 bp, Homo sapiens
cagctcagtttcaataccaggt

SEQ ID NO: 7493718 - DNA, 22 bp, Homo sapiens
cagctcagtttcaataccaggt

SEQ ID NO: 7493719 - DNA, 22 bp, Homo sapiens
cagctcagtgatgccttcacag

SEQ ID NO: 7493720 - DNA, 22 bp, Homo sapiens
cagctcagtgatgccttcacag

SEQ ID NO: 7493721 - DNA, 22 bp, Homo sapiens
cagctcagtgatgccttcacag

SEQ ID NO: 7493722 - DNA, 22 bp, Homo sapiens
cagctcagtcttgaagcactgg

SEQ ID NO: 7493723 - DNA, 22 bp, Homo sapiens
cagctcagtcttgaagcactgg

SEQ ID NO: 7493724 - DNA, 22 bp, Homo sapiens
cagctcagtcttgaagcactgg

SEQ ID NO: 7493725 - DNA, 22 bp, Homo sapiens
cagctcagtcttgaagcactgg

SEQ ID NO: 7493726 - DNA, 22 bp, Homo sapiens
cagctcagtcttgaagcactgg

SEQ ID NO: 7493727 - DNA, 22 bp, Homo sapiens
cagctcagtcttgaagcactgg

SEQ ID NO: 7493728 - DNA, 22 bp, Homo sapiens
cagctcagtctggagagatgca

SEQ ID NO: 7493729 - DNA, 22 bp, Homo sapiens
cagctcagtctggagagatgca

SEQ ID NO: 7493730 - DNA, 22 bp, Homo sapiens
agctcctgagtagctttactca

SEQ ID NO: 7493731 - DNA, 22 bp, Homo sapiens
agctcctgatacatgcaggaat

SEQ ID NO: 7493732 - DNA, 22 bp, Homo sapiens
agctcctgatacatgcaggaat

SEQ ID NO: 7493733 - DNA, 22 bp, Homo sapiens
agctcctgatacatgcaggaat

SEQ ID NO: 7493734 - DNA, 22 bp, Homo sapiens
agctcctgatacatgcaggaat

SEQ ID NO: 7493735 - DNA, 22 bp, Homo sapiens
agctcctgagtagctttactca

SEQ ID NO: 7493736 - DNA, 20 bp, Homo sapiens
agctcctgagggttactttc

SEQ ID NO: 7493737 - DNA, 20 bp, Homo sapiens
agctcctgagggttactttc

SEQ ID NO: 7493738 - DNA, 20 bp, Homo sapiens
agctcctgagggttactttc

SEQ ID NO: 7493739 - DNA, 20 bp, Homo sapiens
agctcctgagggttactttc

SEQ ID NO: 7493740 - DNA, 23 bp, Homo sapiens
agctcctgaggccagcctctcct

SEQ ID NO: 7493741 - DNA, 23 bp, Homo sapiens
agctcctgaggccagcctctcct

SEQ ID NO: 7493742 - DNA, 23 bp, Homo sapiens
agctcctgaggccagcctctcct

SEQ ID NO: 7493743 - DNA, 18 bp, Homo sapiens
agctcctgaactctgtgg

SEQ ID NO: 7493744 - DNA, 23 bp, Homo sapiens
agctcctgaggccagcctctcct

SEQ ID NO: 7493745 - DNA, 23 bp, Homo sapiens
agctcctgaggccagcctctcct

SEQ ID NO: 7493746 - DNA, 23 bp, Homo sapiens
agctcctgaggccagcctctcct

SEQ ID NO: 7493747 - DNA, 20 bp, Homo sapiens
agctcctgagggttactttc

SEQ ID NO: 7493748 - DNA, 23 bp, Homo sapiens
agctcctgaggccagcctctcct

SEQ ID NO: 7493749 - DNA, 23 bp, Homo sapiens
agctcctgaggccagcctctcct

SEQ ID NO: 7493750 - DNA, 23 bp, Homo sapiens
agctcctgaggccagcctctcct

SEQ ID NO: 7493751 - DNA, 22 bp, Homo sapiens
agctcctgatacatgcaggaat

SEQ ID NO: 7493752 - DNA, 22 bp, Homo sapiens
agctcctgattctcagagatag

SEQ ID NO: 7493753 - DNA, 22 bp, Homo sapiens
agctcctgattctcagagatag

SEQ ID NO: 7493754 - DNA, 22 bp, Homo sapiens
agctcctgattctcagagatag

SEQ ID NO: 7493755 - DNA, 22 bp, Homo sapiens
agctcctgatacatgcaggaat

SEQ ID NO: 7493756 - DNA, 22 bp, Homo sapiens
agctcctgatacatgcaggaat

SEQ ID NO: 7493757 - DNA, 22 bp, Homo sapiens
agctcctgatacatgcaggaat

SEQ ID NO: 7493758 - DNA, 22 bp, Homo sapiens
agctcctgatacatgcaggaat

SEQ ID NO: 7493759 - DNA, 22 bp, Homo sapiens
agctcctgattctcagagatag

SEQ ID NO: 7493760 - DNA, 22 bp, Homo sapiens
cagctctgagactgaggctatg

SEQ ID NO: 7493761 - DNA, 22 bp, Homo sapiens
agctcctgattctcagagatag

SEQ ID NO: 7493762 - DNA, 22 bp, Homo sapiens
agctcctgattctcagagatag

SEQ ID NO: 7493763 - DNA, 22 bp, Homo sapiens
cagctctgagactgaggctatg

SEQ ID NO: 7493764 - DNA, 22 bp, Homo sapiens
cagctctgagactgaggctatg

SEQ ID NO: 7493765 - DNA, 22 bp, Homo sapiens
cagctctgagactgaggctatg

SEQ ID NO: 7493766 - DNA, 22 bp, Homo sapiens
cagctctgagactgaggctatg

SEQ ID NO: 7493767 - DNA, 22 bp, Homo sapiens
cagctctgagactgaggctatg

SEQ ID NO: 7493768 - DNA, 22 bp, Homo sapiens
cagctctgagactgaggctatg

SEQ ID NO: 7493769 - DNA, 22 bp, Homo sapiens
cagccccatggtgtgctccagc

SEQ ID NO: 7493770 - DNA, 22 bp, Homo sapiens
cagccccatggtgtgctccagc

SEQ ID NO: 7493771 - DNA, 22 bp, Homo sapiens
cagccccatggtgtgctccagc

SEQ ID NO: 7493772 - DNA, 22 bp, Homo sapiens
cagccccatggtgtgctccagc

SEQ ID NO: 7493773 - DNA, 22 bp, Homo sapiens
cagccccatggtgtgctccagc

SEQ ID NO: 7493774 - DNA, 22 bp, Homo sapiens
cagccccagcacttagctgagt

SEQ ID NO: 7493775 - DNA, 22 bp, Homo sapiens
cagccccagcacttagctgagt

SEQ ID NO: 7493776 - DNA, 22 bp, Homo sapiens
cagccccagcacttagctgagt

SEQ ID NO: 7493777 - DNA, 20 bp, Homo sapiens
cagcatcaaaggaaggtttg

SEQ ID NO: 7493778 - DNA, 22 bp, Homo sapiens
cagcatcaacattctcagctct

SEQ ID NO: 7493779 - DNA, 22 bp, Homo sapiens
cagcataggatgtggagccagg

SEQ ID NO: 7493780 - DNA, 22 bp, Homo sapiens
cagcatattactttaaaaaatc

SEQ ID NO: 7493781 - DNA, 22 bp, Homo sapiens
cagcatattactttaaaaaatc

SEQ ID NO: 7493782 - DNA, 22 bp, Homo sapiens
cagcatcacagtgcccgaagtc

SEQ ID NO: 7493783 - DNA, 22 bp, Homo sapiens
cagcatcaacattctcagctct

SEQ ID NO: 7493784 - DNA, 22 bp, Homo sapiens
cagccctgagagaaccatctat

SEQ ID NO: 7493785 - DNA, 22 bp, Homo sapiens
cagccctgagagaaccatctat

SEQ ID NO: 7493786 - DNA, 22 bp, Homo sapiens
cagccctgagagaaccatctat

SEQ ID NO: 7493787 - DNA, 22 bp, Homo sapiens
cagccctgagagaaccatctat

SEQ ID NO: 7493788 - DNA, 22 bp, Homo sapiens
cagccctgagagaaccatctat

SEQ ID NO: 7493789 - DNA, 22 bp, Homo sapiens
cagccctgagcaaggcttttaa

SEQ ID NO: 7493790 - DNA, 22 bp, Homo sapiens
cagccctgagcaaggcttttaa

SEQ ID NO: 7493791 - DNA, 22 bp, Homo sapiens
cagccctgagagaaccatctat

SEQ ID NO: 7493792 - DNA, 22 bp, Homo sapiens
cagccctgagagaaccatctat

SEQ ID NO: 7493793 - DNA, 22 bp, Homo sapiens
cagccctgagagaaccatctat

SEQ ID NO: 7493794 - DNA, 22 bp, Homo sapiens
cagccctgagaaggaggatctc

SEQ ID NO: 7493795 - DNA, 22 bp, Homo sapiens
cagccctgagaaggaggatctc

SEQ ID NO: 7493796 - DNA, 22 bp, Homo sapiens
cagccctgagaaggaggatctc

SEQ ID NO: 7493797 - DNA, 22 bp, Homo sapiens
cagccctgagaaggaggatctc

SEQ ID NO: 7493798 - DNA, 22 bp, Homo sapiens
cagccctgagaaggaggatctc

SEQ ID NO: 7493799 - DNA, 23 bp, Homo sapiens
cagccctgaaatcgaggtgacac

SEQ ID NO: 7493800 - DNA, 23 bp, Homo sapiens
cagccctgaaatcgaggtgacac

SEQ ID NO: 7493801 - DNA, 23 bp, Homo sapiens
cagccctgaaatcgaggtgacac

SEQ ID NO: 7493802 - DNA, 22 bp, Homo sapiens
cagccctgagttagcccacgga

SEQ ID NO: 7493803 - DNA, 22 bp, Homo sapiens
cagccctgagttagcccacgga

SEQ ID NO: 7493804 - DNA, 22 bp, Homo sapiens
cagccctgagttagcccacgga

SEQ ID NO: 7493805 - DNA, 22 bp, Homo sapiens
cagccctgagttagcccacgga

SEQ ID NO: 7493806 - DNA, 22 bp, Homo sapiens
cagccctgagttagcccacgga

SEQ ID NO: 7493807 - DNA, 22 bp, Homo sapiens
cagccctgagttagcccacgga

SEQ ID NO: 7493808 - DNA, 22 bp, Homo sapiens
cagccctgagttagcccacgga

SEQ ID NO: 7493809 - DNA, 22 bp, Homo sapiens
cagccctgagttagcccacgga

SEQ ID NO: 7493810 - DNA, 16 bp, Homo sapiens
cagccctgaggaagaa

SEQ ID NO: 7493811 - DNA, 16 bp, Homo sapiens
cagccctgaggaagaa

SEQ ID NO: 7493812 - DNA, 16 bp, Homo sapiens
cagccctgaggaagaa

SEQ ID NO: 7493813 - DNA, 22 bp, Homo sapiens
cagccctgagcaaggcttttaa

SEQ ID NO: 7493814 - DNA, 22 bp, Homo sapiens
cagccctgcacgctgcctccgc

SEQ ID NO: 7493815 - DNA, 22 bp, Homo sapiens
cagccctgcacgctgcctccgc

SEQ ID NO: 7493816 - DNA, 22 bp, Homo sapiens
cagccctgcacgctgcctccgc

SEQ ID NO: 7493817 - DNA, 22 bp, Homo sapiens
cagccctgcacgctgcctccgc

SEQ ID NO: 7493818 - DNA, 22 bp, Homo sapiens
cagccctgcacgctgcctccgc

SEQ ID NO: 7493819 - DNA, 22 bp, Homo sapiens
cagccctgcacgctgcctccgc

SEQ ID NO: 7493820 - DNA, 22 bp, Homo sapiens
cagccctgcacgctgcctccgc

SEQ ID NO: 7493821 - DNA, 22 bp, Homo sapiens
cagccctgcacgctgcctccgc

SEQ ID NO: 7493822 - DNA, 22 bp, Homo sapiens
cagccctgagttagcccacgga

SEQ ID NO: 7493823 - DNA, 22 bp, Homo sapiens
cagccctgagttagcccacgga

SEQ ID NO: 7493824 - DNA, 22 bp, Homo sapiens
cagccctgagttagcccacgga

SEQ ID NO: 7493825 - DNA, 22 bp, Homo sapiens
cagccctgagttagcccacgga

SEQ ID NO: 7493826 - DNA, 22 bp, Homo sapiens
cagccctgagttagcccacgga

SEQ ID NO: 7493827 - DNA, 22 bp, Homo sapiens
agctcagagaatagggcttgag

SEQ ID NO: 7493828 - DNA, 22 bp, Homo sapiens
agctcagagaatagggcttgag

SEQ ID NO: 7493829 - DNA, 22 bp, Homo sapiens
agctcagagataatcaagagac

SEQ ID NO: 7493830 - DNA, 22 bp, Homo sapiens
cagccctgcagagggcgctcct

SEQ ID NO: 7493831 - DNA, 22 bp, Homo sapiens
cagccctgcagagggcgctcct

SEQ ID NO: 7493832 - DNA, 22 bp, Homo sapiens
cagccctgcagagggcgctcct

SEQ ID NO: 7493833 - DNA, 22 bp, Homo sapiens
cagccctgcagagggcgctcct

SEQ ID NO: 7493834 - DNA, 22 bp, Homo sapiens
cagccctgcagagggcgctcct

SEQ ID NO: 7493835 - DNA, 22 bp, Homo sapiens
cagccctgcagagggcgctcct

SEQ ID NO: 7493836 - DNA, 22 bp, Homo sapiens
cagccctgcagagggcgctcct

SEQ ID NO: 7493837 - DNA, 22 bp, Homo sapiens
cagccctgcagagggcgctcct

SEQ ID NO: 7493838 - DNA, 22 bp, Homo sapiens
cagccctgcacgctgcctccgc

SEQ ID NO: 7493839 - DNA, 22 bp, Homo sapiens
cagccctgcacgctgcctccgc

SEQ ID NO: 7493840 - DNA, 22 bp, Homo sapiens
cagccctgcacgctgcctccgc

SEQ ID NO: 7493841 - DNA, 22 bp, Homo sapiens
cagccctgcacgctgcctccgc

SEQ ID NO: 7493842 - DNA, 22 bp, Homo sapiens
cagccctgcacgctgcctccgc

SEQ ID NO: 7493843 - DNA, 22 bp, Homo sapiens
cagcagggttaagtgactcacc

SEQ ID NO: 7493844 - DNA, 22 bp, Homo sapiens
cagcagggttaagtgactcacc

SEQ ID NO: 7493845 - DNA, 22 bp, Homo sapiens
cagcagtgtgcaggtgtgctgg

SEQ ID NO: 7493846 - DNA, 22 bp, Homo sapiens
cagcagtgtgcaggtgtgctgg

SEQ ID NO: 7493847 - DNA, 22 bp, Homo sapiens
cagcagtgtctccagcatcaca

SEQ ID NO: 7493848 - DNA, 22 bp, Homo sapiens
cagcagtgtctccagcatcaca

SEQ ID NO: 7493849 - DNA, 22 bp, Homo sapiens
cagcagtgtctccagcatcaca

SEQ ID NO: 7493850 - DNA, 22 bp, Homo sapiens
cagcagggtatacagggaattt

SEQ ID NO: 7493851 - DNA, 22 bp, Homo sapiens
cagcagggtatacagggaattt

SEQ ID NO: 7493852 - DNA, 22 bp, Homo sapiens
cagcagggtatacagggaattt

SEQ ID NO: 7493853 - DNA, 22 bp, Homo sapiens
cagcagggtatacagggaattt

SEQ ID NO: 7493854 - DNA, 22 bp, Homo sapiens
cagcagggtatacagggaattt

SEQ ID NO: 7493855 - DNA, 22 bp, Homo sapiens
cagcagggtatacagggaattt

SEQ ID NO: 7493856 - DNA, 22 bp, Homo sapiens
cagcagggtatacagggaattt

SEQ ID NO: 7493857 - DNA, 22 bp, Homo sapiens
cagcagggtatacagggaattt

SEQ ID NO: 7493858 - DNA, 22 bp, Homo sapiens
cagcagggggcagcgcagatca

SEQ ID NO: 7493859 - DNA, 22 bp, Homo sapiens
cagcagggggcagcgcagatca

SEQ ID NO: 7493860 - DNA, 22 bp, Homo sapiens
cagcaggggaactgtgggccag

SEQ ID NO: 7493861 - DNA, 22 bp, Homo sapiens
cagcaggggaactgtgggccag

SEQ ID NO: 7493862 - DNA, 22 bp, Homo sapiens
cagcaggggaactgtgggccag

SEQ ID NO: 7493863 - DNA, 22 bp, Homo sapiens
cagcaggggaactgtgggccag

SEQ ID NO: 7493864 - DNA, 22 bp, Homo sapiens
cagcaggggaactgtgggccag

SEQ ID NO: 7493865 - DNA, 22 bp, Homo sapiens
cagcagggggcagcgcagatca

SEQ ID NO: 7493866 - DNA, 22 bp, Homo sapiens
cagcaggggtgtcattgtagtt

SEQ ID NO: 7493867 - DNA, 22 bp, Homo sapiens
cagcagggggcagcgcagatca

SEQ ID NO: 7493868 - DNA, 22 bp, Homo sapiens
cagcagggggcagcgcagatca

SEQ ID NO: 7493869 - DNA, 22 bp, Homo sapiens
cagcaggggtgtcattgtagtt

SEQ ID NO: 7493870 - DNA, 22 bp, Homo sapiens
cagcaggggtgtcattgtagtt

SEQ ID NO: 7493871 - DNA, 22 bp, Homo sapiens
cagcagggtaggttgtatcagt

SEQ ID NO: 7493872 - DNA, 21 bp, Homo sapiens
cagcagtgtgtctgagctaga

SEQ ID NO: 7493873 - DNA, 22 bp, Homo sapiens
cagcagttcaatccagtgcacg

SEQ ID NO: 7493874 - DNA, 22 bp, Homo sapiens
cagcagttcacacttaacaagt

SEQ ID NO: 7493875 - DNA, 22 bp, Homo sapiens
cagcagttcaatccagtgcacg

SEQ ID NO: 7493876 - DNA, 22 bp, Homo sapiens
cagcagttcaatccagtgcacg

SEQ ID NO: 7493877 - DNA, 22 bp, Homo sapiens
cagcagttatgagtagaatagt

SEQ ID NO: 7493878 - DNA, 22 bp, Homo sapiens
cagcagttatgagtagaatagt

SEQ ID NO: 7493879 - DNA, 22 bp, Homo sapiens
cagcagttatgagtagaatagt

SEQ ID NO: 7493880 - DNA, 22 bp, Homo sapiens
cagcagttatgagtagaatagt

SEQ ID NO: 7493881 - DNA, 22 bp, Homo sapiens
cagcagtgtggaagctgagggg

SEQ ID NO: 7493882 - DNA, 22 bp, Homo sapiens
cagcagtgtggaagctgagggg

SEQ ID NO: 7493883 - DNA, 22 bp, Homo sapiens
cagcagtgtggaagctgagggg

SEQ ID NO: 7493884 - DNA, 22 bp, Homo sapiens
cagcagtgtggaagctgagggg

SEQ ID NO: 7493885 - DNA, 22 bp, Homo sapiens
cagcagtgtggaagctgagggg

SEQ ID NO: 7493886 - DNA, 22 bp, Homo sapiens
cagcagtgtggaagctgagggg

SEQ ID NO: 7493887 - DNA, 22 bp, Homo sapiens
cagcagtgtggaagctgagggg

SEQ ID NO: 7493888 - DNA, 22 bp, Homo sapiens
cagcagtgtggaagctgagggg

SEQ ID NO: 7493889 - DNA, 22 bp, Homo sapiens
cagcagttgtttcggattggga

SEQ ID NO: 7493890 - DNA, 22 bp, Homo sapiens
cagcagttgtttcggattggga

SEQ ID NO: 7493891 - DNA, 22 bp, Homo sapiens
cagcagtttcctatggttcagc

SEQ ID NO: 7493892 - DNA, 22 bp, Homo sapiens
cagcagttttgaagtgtggaga

SEQ ID NO: 7493893 - DNA, 22 bp, Homo sapiens
cagcagtttcctatggttcagc

SEQ ID NO: 7493894 - DNA, 22 bp, Homo sapiens
cagcagttcacacttaacaagt

SEQ ID NO: 7493895 - DNA, 22 bp, Homo sapiens
cagcagttcaggctccttcccg

SEQ ID NO: 7493896 - DNA, 22 bp, Homo sapiens
cagcagttctgtactttagagt

SEQ ID NO: 7493897 - DNA, 22 bp, Homo sapiens
cagcagttctgtactttagagt

SEQ ID NO: 7493898 - DNA, 22 bp, Homo sapiens
cagcagttgaaattgacatgtg

SEQ ID NO: 7493899 - DNA, 20 bp, Homo sapiens
cagcatagcggctcacatcc

SEQ ID NO: 7493900 - DNA, 22 bp, Homo sapiens
cagcataggatgtggagccagg

SEQ ID NO: 7493901 - DNA, 22 bp, Homo sapiens
cagcataggatgtggagccagg

SEQ ID NO: 7493902 - DNA, 22 bp, Homo sapiens
cagcatatctgagttgaaagag

SEQ ID NO: 7493903 - DNA, 22 bp, Homo sapiens
cagcagttttgaagtgtggaga

SEQ ID NO: 7493904 - DNA, 22 bp, Homo sapiens
cagcagttttgaagtgtggaga

SEQ ID NO: 7493905 - DNA, 22 bp, Homo sapiens
cagcataaaataaatctacatg

SEQ ID NO: 7493906 - DNA, 22 bp, Homo sapiens
cagcataaaataaatctacatg

SEQ ID NO: 7493907 - DNA, 22 bp, Homo sapiens
cagcataaaataaatctacatg

SEQ ID NO: 7493908 - DNA, 22 bp, Homo sapiens
cagcatactgcatcaaatgagg

SEQ ID NO: 7493909 - DNA, 22 bp, Homo sapiens
cagcatactgcatcaaatgagg

SEQ ID NO: 7493910 - DNA, 22 bp, Homo sapiens
caagatttggcattctgaggag

SEQ ID NO: 7493911 - DNA, 22 bp, Homo sapiens
caagatttggcattctgaggag

SEQ ID NO: 7493912 - DNA, 22 bp, Homo sapiens
caagatttggcattctgaggag

SEQ ID NO: 7493913 - DNA, 22 bp, Homo sapiens
caagatttggcaactttgtcat

SEQ ID NO: 7493914 - DNA, 22 bp, Homo sapiens
caagatttggcaactttgtcat

SEQ ID NO: 7493915 - DNA, 22 bp, Homo sapiens
caagatttggcaactttgtcat

SEQ ID NO: 7493916 - DNA, 22 bp, Homo sapiens
caagatttgacttcgtggtttg

SEQ ID NO: 7493917 - DNA, 22 bp, Homo sapiens
caagatttgccagtggccaact

SEQ ID NO: 7493918 - DNA, 22 bp, Homo sapiens
caagatttccaaccctgggtaa

SEQ ID NO: 7493919 - DNA, 19 bp, Homo sapiens
caagatttgttcacacatg

SEQ ID NO: 7493920 - DNA, 22 bp, Homo sapiens
caagattttatctccgtttctg

SEQ ID NO: 7493921 - DNA, 22 bp, Homo sapiens
caagattttatctccgtttctg

SEQ ID NO: 7493922 - DNA, 22 bp, Homo sapiens
caagcaacgactttcaagctgt

SEQ ID NO: 7493923 - DNA, 19 bp, Homo sapiens
caagatttgttcacacatg

SEQ ID NO: 7493924 - DNA, 19 bp, Homo sapiens
caagatttgttcacacatg

SEQ ID NO: 7493925 - DNA, 22 bp, Homo sapiens
caagatttgggggcacggaatc

SEQ ID NO: 7493926 - DNA, 22 bp, Homo sapiens
caagcagaagcctcaggggcat

SEQ ID NO: 7493927 - DNA, 22 bp, Homo sapiens
caagcagacagtaggcctagaa

SEQ ID NO: 7493928 - DNA, 22 bp, Homo sapiens
caagcagagaagtctctaggct

SEQ ID NO: 7493929 - DNA, 22 bp, Homo sapiens
caagcagagaagtctctaggct

SEQ ID NO: 7493930 - DNA, 22 bp, Homo sapiens
caagcagagaagtctctaggct

SEQ ID NO: 7493931 - DNA, 22 bp, Homo sapiens
caagcagaagcctcaggggcat

SEQ ID NO: 7493932 - DNA, 22 bp, Homo sapiens
caagcagaaatctagaactcca

SEQ ID NO: 7493933 - DNA, 22 bp, Homo sapiens
caagcagaagcctcaggggcat

SEQ ID NO: 7493934 - DNA, 22 bp, Homo sapiens
caagcagacagtaggcctagaa

SEQ ID NO: 7493935 - DNA, 22 bp, Homo sapiens
caagcagaaatctagaactcca

SEQ ID NO: 7493936 - DNA, 22 bp, Homo sapiens
caagcagaaatctagaactcca

SEQ ID NO: 7493937 - DNA, 22 bp, Homo sapiens
caagcagaaatctagaactcca

SEQ ID NO: 7493938 - DNA, 22 bp, Homo sapiens
caagcagaaatctagaactcca

SEQ ID NO: 7493939 - DNA, 22 bp, Homo sapiens
caagcaccatgtgctccatgtt

SEQ ID NO: 7493940 - DNA, 22 bp, Homo sapiens
caagcaccatgtgctccatgtt

SEQ ID NO: 7493941 - DNA, 22 bp, Homo sapiens
caagcaatgctatactcattat

SEQ ID NO: 7493942 - DNA, 22 bp, Homo sapiens
caagcaatgctatactcattat

SEQ ID NO: 7493943 - DNA, 22 bp, Homo sapiens
caagcaatgctatactcattat

SEQ ID NO: 7493944 - DNA, 22 bp, Homo sapiens
caagcaatgctatactcattat

SEQ ID NO: 7493945 - DNA, 22 bp, Homo sapiens
caagcaatattttagaaaggta

SEQ ID NO: 7493946 - DNA, 22 bp, Homo sapiens
caagcaatattttagaaaggta

SEQ ID NO: 7493947 - DNA, 22 bp, Homo sapiens
caagcaatgccctggtatatta

SEQ ID NO: 7493948 - DNA, 22 bp, Homo sapiens
caagcaatgccctggtatatta

SEQ ID NO: 7493949 - DNA, 22 bp, Homo sapiens
caagagccataattttgagagt

SEQ ID NO: 7493950 - DNA, 22 bp, Homo sapiens
caagagccataattttgagagt

SEQ ID NO: 7493951 - DNA, 22 bp, Homo sapiens
caagagcctttgggcagaagga

SEQ ID NO: 7493952 - DNA, 22 bp, Homo sapiens
caagagctaccctgtgccatat

SEQ ID NO: 7493953 - DNA, 22 bp, Homo sapiens
caagagctaccctgtgccatat

SEQ ID NO: 7493954 - DNA, 22 bp, Homo sapiens
caagagcctttgggcagaagga

SEQ ID NO: 7493955 - DNA, 22 bp, Homo sapiens
caagagcctttgggcagaagga

SEQ ID NO: 7493956 - DNA, 22 bp, Homo sapiens
caagatttatattttcacacaa

SEQ ID NO: 7493957 - DNA, 22 bp, Homo sapiens
caagatttagctcccttatctc

SEQ ID NO: 7493958 - DNA, 22 bp, Homo sapiens
caagatttagctcccttatctc

SEQ ID NO: 7493959 - DNA, 22 bp, Homo sapiens
caagatttagcctgctgcctgt

SEQ ID NO: 7493960 - DNA, 22 bp, Homo sapiens
caagagctagactttgtcagga

SEQ ID NO: 7493961 - DNA, 22 bp, Homo sapiens
caagagagatgcagctcactca

SEQ ID NO: 7493962 - DNA, 22 bp, Homo sapiens
caagagagatgcagctcactca

SEQ ID NO: 7493963 - DNA, 17 bp, Homo sapiens
caagagagatgactgga

SEQ ID NO: 7493964 - DNA, 17 bp, Homo sapiens
caagagagatgactgga

SEQ ID NO: 7493965 - DNA, 17 bp, Homo sapiens
caagagagatgactgga

SEQ ID NO: 7493966 - DNA, 17 bp, Homo sapiens
caagagagatgactgga

SEQ ID NO: 7493967 - DNA, 17 bp, Homo sapiens
caagagagatgactgga

SEQ ID NO: 7493968 - DNA, 22 bp, Homo sapiens
caagagacttatgtggaaacct

SEQ ID NO: 7493969 - DNA, 22 bp, Homo sapiens
caagagacttatgtggaaacct

SEQ ID NO: 7493970 - DNA, 22 bp, Homo sapiens
caagagacttatgtggaaacct

SEQ ID NO: 7493971 - DNA, 22 bp, Homo sapiens
caagagcaggtgctgcttccat

SEQ ID NO: 7493972 - DNA, 22 bp, Homo sapiens
caagagcaggtgctgcttccat

SEQ ID NO: 7493973 - DNA, 22 bp, Homo sapiens
caagagcatccctgcatccagc

SEQ ID NO: 7493974 - DNA, 22 bp, Homo sapiens
caagagcatccctgcatccagc

SEQ ID NO: 7493975 - DNA, 22 bp, Homo sapiens
caagagcatccctgcatccagc

SEQ ID NO: 7493976 - DNA, 22 bp, Homo sapiens
caagagagatgcagctcactca

SEQ ID NO: 7493977 - DNA, 22 bp, Homo sapiens
caagagcacgtgccctccataa

SEQ ID NO: 7493978 - DNA, 22 bp, Homo sapiens
caagagatacatttctagtagg

SEQ ID NO: 7493979 - DNA, 22 bp, Homo sapiens
caagagcacgtgccctccataa

SEQ ID NO: 7493980 - DNA, 22 bp, Homo sapiens
agcagcaggctagggaactgct

SEQ ID NO: 7493981 - DNA, 22 bp, Homo sapiens
agcagcaggctagggaactgct

SEQ ID NO: 7493982 - DNA, 22 bp, Homo sapiens
agcagcaggctagggaactgct

SEQ ID NO: 7493983 - DNA, 22 bp, Homo sapiens
agcagcaggctagggaactgct

SEQ ID NO: 7493984 - DNA, 22 bp, Homo sapiens
agcagcaggctagggaactgct

SEQ ID NO: 7493985 - DNA, 22 bp, Homo sapiens
agcagcaggctagggaactgct

SEQ ID NO: 7493986 - DNA, 23 bp, Homo sapiens
agcagcaggaggtattgataagg

SEQ ID NO: 7493987 - DNA, 22 bp, Homo sapiens
agcagcaggattttcgttggga

SEQ ID NO: 7493988 - DNA, 22 bp, Homo sapiens
agcagcaggattttcgttggga

SEQ ID NO: 7493989 - DNA, 22 bp, Homo sapiens
agcagcaggattttcgttggga

SEQ ID NO: 7493990 - DNA, 22 bp, Homo sapiens
agcagcaggctagggaactgct

SEQ ID NO: 7493991 - DNA, 22 bp, Homo sapiens
agcagcaggctgtgtggactga

SEQ ID NO: 7493992 - DNA, 22 bp, Homo sapiens
agcagcaggcttaaggaaaagt

SEQ ID NO: 7493993 - DNA, 22 bp, Homo sapiens
agcagcaggctgtgtggactga

SEQ ID NO: 7493994 - DNA, 22 bp, Homo sapiens
agcagcaggctgtgtggactga

SEQ ID NO: 7493995 - DNA, 22 bp, Homo sapiens
agcagcaggctgtgtggactga

SEQ ID NO: 7493996 - DNA, 22 bp, Homo sapiens
agcagcaggctgtgtggactga

SEQ ID NO: 7493997 - DNA, 22 bp, Homo sapiens
agcagcaggctgtgtggactga

SEQ ID NO: 7493998 - DNA, 22 bp, Homo sapiens
agcagcaggctgggatgagtct

SEQ ID NO: 7493999 - DNA, 22 bp, Homo sapiens
agcagcaggctgggatgagtct

SEQ ID NO: 7494000 - DNA, 22 bp, Homo sapiens
agcagcaggctgggatgagtct

SEQ ID NO: 7494001 - DNA, 22 bp, Homo sapiens
agcagcaggctgggatgagtct

SEQ ID NO: 7494002 - DNA, 22 bp, Homo sapiens
agcagcaggctgggatgagtct

SEQ ID NO: 7494003 - DNA, 22 bp, Homo sapiens
agcagcagctctgttgccctac

SEQ ID NO: 7494004 - DNA, 22 bp, Homo sapiens
agcagcagattatggtctacat

SEQ ID NO: 7494005 - DNA, 22 bp, Homo sapiens
agcagcagctctgttgccctac

SEQ ID NO: 7494006 - DNA, 22 bp, Homo sapiens
agcagcagctctgttgccctac

SEQ ID NO: 7494007 - DNA, 22 bp, Homo sapiens
agcagcagattatggtctacat

SEQ ID NO: 7494008 - DNA, 22 bp, Homo sapiens
agcagcagattatggtctacat

SEQ ID NO: 7494009 - DNA, 20 bp, Homo sapiens
agcagcagatgttggaggtg

SEQ ID NO: 7494010 - DNA, 22 bp, Homo sapiens
caagcagagactagatagctgt

SEQ ID NO: 7494011 - DNA, 22 bp, Homo sapiens
caagcagagaagtctctaggct

SEQ ID NO: 7494012 - DNA, 22 bp, Homo sapiens
caagcagagaagtctctaggct

SEQ ID NO: 7494013 - DNA, 22 bp, Homo sapiens
caagcagagactagatagctgt

SEQ ID NO: 7494014 - DNA, 22 bp, Homo sapiens
caagcagagactagatagctgt

SEQ ID NO: 7494015 - DNA, 22 bp, Homo sapiens
caagcagagactagatagctgt

SEQ ID NO: 7494016 - DNA, 22 bp, Homo sapiens
caagcagagactagatagctgt

SEQ ID NO: 7494017 - DNA, 22 bp, Homo sapiens
caagcagagaggtcaactaata

SEQ ID NO: 7494018 - DNA, 22 bp, Homo sapiens
caagcagagaggtcaactaata

SEQ ID NO: 7494019 - DNA, 22 bp, Homo sapiens
caagcagagaggtcaactaata

SEQ ID NO: 7494020 - DNA, 22 bp, Homo sapiens
caagcagagactagatagctgt

SEQ ID NO: 7494021 - DNA, 22 bp, Homo sapiens
caagcagagaggttagaacaca

SEQ ID NO: 7494022 - DNA, 22 bp, Homo sapiens
caagcagagaggtcaactaata

SEQ ID NO: 7494023 - DNA, 20 bp, Homo sapiens
agcagcagatgttggaggtg

SEQ ID NO: 7494024 - DNA, 22 bp, Homo sapiens
agcagcaggaggccattgtctt

SEQ ID NO: 7494025 - DNA, 22 bp, Homo sapiens
agcagcaggaggccattgtctt

SEQ ID NO: 7494026 - DNA, 22 bp, Homo sapiens
agcagcaggaggccattgtctt

SEQ ID NO: 7494027 - DNA, 22 bp, Homo sapiens
agcagcaggaggccattgtctt

SEQ ID NO: 7494028 - DNA, 22 bp, Homo sapiens
agcagcaggagccgtggggtga

SEQ ID NO: 7494029 - DNA, 22 bp, Homo sapiens
agcagcaggagccgtggggtga

SEQ ID NO: 7494030 - DNA, 22 bp, Homo sapiens
agcagcaggagccgtggggtga

SEQ ID NO: 7494031 - DNA, 22 bp, Homo sapiens
agcagcaggaggctgtccacca

SEQ ID NO: 7494032 - DNA, 22 bp, Homo sapiens
agcagcaggaggctgtccacca

SEQ ID NO: 7494033 - DNA, 22 bp, Homo sapiens
agcagcaggaggctgtccacca

SEQ ID NO: 7494034 - DNA, 22 bp, Homo sapiens
agcagcaggaggctgtccacca

SEQ ID NO: 7494035 - DNA, 22 bp, Homo sapiens
agcagcaggaggccattgtctt

SEQ ID NO: 7494036 - DNA, 22 bp, Homo sapiens
agcagccacagtctgggacagg

SEQ ID NO: 7494037 - DNA, 22 bp, Homo sapiens
agcagccacccagctgctcatt

SEQ ID NO: 7494038 - DNA, 22 bp, Homo sapiens
agcagccacccagctgctcatt

SEQ ID NO: 7494039 - DNA, 22 bp, Homo sapiens
agcagccacccagctgctcatt

SEQ ID NO: 7494040 - DNA, 22 bp, Homo sapiens
agcagccacagtctgggacagg

SEQ ID NO: 7494041 - DNA, 22 bp, Homo sapiens
agcagccacagtctgggacagg

SEQ ID NO: 7494042 - DNA, 22 bp, Homo sapiens
agcagccacccagctgctcatt

SEQ ID NO: 7494043 - DNA, 22 bp, Homo sapiens
agcagccacagtctgggacagg

SEQ ID NO: 7494044 - DNA, 22 bp, Homo sapiens
agcagccaattggaggatgaag

SEQ ID NO: 7494045 - DNA, 22 bp, Homo sapiens
agcagccacacgcctccttctc

SEQ ID NO: 7494046 - DNA, 22 bp, Homo sapiens
agcagccaattggaggatgaag

SEQ ID NO: 7494047 - DNA, 22 bp, Homo sapiens
agcagccacacgcctccttctc

SEQ ID NO: 7494048 - DNA, 22 bp, Homo sapiens
agcagccacagcagatctgagt

SEQ ID NO: 7494049 - DNA, 22 bp, Homo sapiens
agcagccacagcagatctgagt

SEQ ID NO: 7494050 - DNA, 22 bp, Homo sapiens
agcagccacagcagatctgagt

SEQ ID NO: 7494051 - DNA, 22 bp, Homo sapiens
agcagccaaggtaacctgtgct

SEQ ID NO: 7494052 - DNA, 22 bp, Homo sapiens
agcagccaaggtaacctgtgct

SEQ ID NO: 7494053 - DNA, 22 bp, Homo sapiens
agcagccaattggaggatgaag

SEQ ID NO: 7494054 - DNA, 22 bp, Homo sapiens
agcagccacacgcctccttctc

SEQ ID NO: 7494055 - DNA, 22 bp, Homo sapiens
agcagccagaaagggcagtcga

SEQ ID NO: 7494056 - DNA, 22 bp, Homo sapiens
agcagccagaaatccagaggtg

SEQ ID NO: 7494057 - DNA, 22 bp, Homo sapiens
agcagctccctcctcagccacc

SEQ ID NO: 7494058 - DNA, 22 bp, Homo sapiens
agcagctccctcctcagccacc

SEQ ID NO: 7494059 - DNA, 22 bp, Homo sapiens
agcagctcctctaggaacggat

SEQ ID NO: 7494060 - DNA, 22 bp, Homo sapiens
agcagctccctcctcagccacc

SEQ ID NO: 7494061 - DNA, 22 bp, Homo sapiens
agcagctcctctaggaacggat

SEQ ID NO: 7494062 - DNA, 22 bp, Homo sapiens
agcagctccctcctcagccacc

SEQ ID NO: 7494063 - DNA, 22 bp, Homo sapiens
agcagctccctcctcagccacc

SEQ ID NO: 7494064 - DNA, 22 bp, Homo sapiens
agcagctccctcctcagccacc

SEQ ID NO: 7494065 - DNA, 22 bp, Homo sapiens
agcagccagaaagggcagtcga

SEQ ID NO: 7494066 - DNA, 22 bp, Homo sapiens
agcagccagaaagggcagtcga

SEQ ID NO: 7494067 - DNA, 22 bp, Homo sapiens
agcagccagaaatccagaggtg

SEQ ID NO: 7494068 - DNA, 22 bp, Homo sapiens
agcagccagaaatccagaggtg

SEQ ID NO: 7494069 - DNA, 22 bp, Homo sapiens
agcagccacccagctgctcatt

SEQ ID NO: 7494070 - DNA, 22 bp, Homo sapiens
agcagccagaaagggcagtcga

SEQ ID NO: 7494071 - DNA, 22 bp, Homo sapiens
agcagccacccagctgctcatt

SEQ ID NO: 7494072 - DNA, 22 bp, Homo sapiens
cacaagatggtcacataagtgc

SEQ ID NO: 7494073 - DNA, 22 bp, Homo sapiens
cacaagatggtcacataagtgc

SEQ ID NO: 7494074 - DNA, 22 bp, Homo sapiens
cacaagatggtcacataagtgc

SEQ ID NO: 7494075 - DNA, 20 bp, Homo sapiens
cacaagaggagttccctgag

SEQ ID NO: 7494076 - DNA, 20 bp, Homo sapiens
cacaagaggagttccctgag

SEQ ID NO: 7494077 - DNA, 22 bp, Homo sapiens
cacaagatggtcacataagtgc

SEQ ID NO: 7494078 - DNA, 22 bp, Homo sapiens
cacaagatggtttccagatgct

SEQ ID NO: 7494079 - DNA, 22 bp, Homo sapiens
cacaagatggtttccagatgct

SEQ ID NO: 7494080 - DNA, 22 bp, Homo sapiens
cacaagatggtcacataagtgc

SEQ ID NO: 7494081 - DNA, 22 bp, Homo sapiens
cacaagatggtttccagatgct

SEQ ID NO: 7494082 - DNA, 22 bp, Homo sapiens
cacaagctccttatgtggagaa

SEQ ID NO: 7494083 - DNA, 22 bp, Homo sapiens
cacaagctccttatgtggagaa

SEQ ID NO: 7494084 - DNA, 22 bp, Homo sapiens
cacaagctgggcaagtgtatat

SEQ ID NO: 7494085 - DNA, 22 bp, Homo sapiens
cacaaggcacattccttgtcca

SEQ ID NO: 7494086 - DNA, 22 bp, Homo sapiens
cacaaggaggtcctgaggaagc

SEQ ID NO: 7494087 - DNA, 22 bp, Homo sapiens
cacaaggaggtcctgaggaagc

SEQ ID NO: 7494088 - DNA, 22 bp, Homo sapiens
cacaagctgggcaagtgtatat

SEQ ID NO: 7494089 - DNA, 22 bp, Homo sapiens
cacaaggacatgtatatttatg

SEQ ID NO: 7494090 - DNA, 22 bp, Homo sapiens
cacaaggacctcagatggatga

SEQ ID NO: 7494091 - DNA, 22 bp, Homo sapiens
cacaaggacctcagatggatga

SEQ ID NO: 7494092 - DNA, 22 bp, Homo sapiens
cacaaggactggatggagtggg

SEQ ID NO: 7494093 - DNA, 22 bp, Homo sapiens
cacaaggactggatggagtggg

SEQ ID NO: 7494094 - DNA, 22 bp, Homo sapiens
cacaaggactggatggagtggg

SEQ ID NO: 7494095 - DNA, 22 bp, Homo sapiens
cacaaggctttcatctggcata

SEQ ID NO: 7494096 - DNA, 22 bp, Homo sapiens
cacaaggctttcatctggcata

SEQ ID NO: 7494097 - DNA, 22 bp, Homo sapiens
cacaaggctgggacaagtgctg

SEQ ID NO: 7494098 - DNA, 22 bp, Homo sapiens
cacaaggctgggacaagtgctg

SEQ ID NO: 7494099 - DNA, 22 bp, Homo sapiens
cacaaggctttcatctggcata

SEQ ID NO: 7494100 - DNA, 22 bp, Homo sapiens
cacaaggctttcatctggcata

SEQ ID NO: 7494101 - DNA, 22 bp, Homo sapiens
cacaaggctttcatctggcata

SEQ ID NO: 7494102 - DNA, 22 bp, Homo sapiens
cacaaggctttcatctggcata

SEQ ID NO: 7494103 - DNA, 22 bp, Homo sapiens
cacaaggcacattccttgtcca

SEQ ID NO: 7494104 - DNA, 22 bp, Homo sapiens
cacaaggccctgggtcaccaca

SEQ ID NO: 7494105 - DNA, 22 bp, Homo sapiens
cacaaggccctgggtcaccaca

SEQ ID NO: 7494106 - DNA, 22 bp, Homo sapiens
cacaaggccctgggtcaccaca

SEQ ID NO: 7494107 - DNA, 22 bp, Homo sapiens
cacaaggccttgtagaccacgg

SEQ ID NO: 7494108 - DNA, 22 bp, Homo sapiens
agcagccaaccttacattcatc

SEQ ID NO: 7494109 - DNA, 22 bp, Homo sapiens
agcagccaaggtaacctgtgct

SEQ ID NO: 7494110 - DNA, 22 bp, Homo sapiens
agcagccaaggtaacctgtgct

SEQ ID NO: 7494111 - DNA, 22 bp, Homo sapiens
agcagccaaggtaacctgtgct

SEQ ID NO: 7494112 - DNA, 22 bp, Homo sapiens
agcagccaaccttacattcatc

SEQ ID NO: 7494113 - DNA, 22 bp, Homo sapiens
agcagccaaatgaagattttac

SEQ ID NO: 7494114 - DNA, 22 bp, Homo sapiens
agcagccaaatgaagattttac

SEQ ID NO: 7494115 - DNA, 22 bp, Homo sapiens
agcagcatttaagtttcttcta

SEQ ID NO: 7494116 - DNA, 22 bp, Homo sapiens
cacaagggagcttagaaaacat

SEQ ID NO: 7494117 - DNA, 22 bp, Homo sapiens
cacaagggagcttagaaaacat

SEQ ID NO: 7494118 - DNA, 22 bp, Homo sapiens
agcagcatttaagtttcttcta

SEQ ID NO: 7494119 - DNA, 22 bp, Homo sapiens
agcagcagggtcattgctcttt

SEQ ID NO: 7494120 - DNA, 22 bp, Homo sapiens
agcagcagggtcattgctcttt

SEQ ID NO: 7494121 - DNA, 22 bp, Homo sapiens
agcagcagggtcattgctcttt

SEQ ID NO: 7494122 - DNA, 22 bp, Homo sapiens
agcagcagggtcattgctcttt

SEQ ID NO: 7494123 - DNA, 22 bp, Homo sapiens
agcagcagggtgatagtgccca

SEQ ID NO: 7494124 - DNA, 22 bp, Homo sapiens
agcagcagggtgatagtgccca

SEQ ID NO: 7494125 - DNA, 22 bp, Homo sapiens
agcagcagggtgatagtgccca

SEQ ID NO: 7494126 - DNA, 22 bp, Homo sapiens
agcagcagggtgatagtgccca

SEQ ID NO: 7494127 - DNA, 22 bp, Homo sapiens
agcagcagggtgatagtgccca

SEQ ID NO: 7494128 - DNA, 22 bp, Homo sapiens
caattttttccatgctcttaca

SEQ ID NO: 7494129 - DNA, 22 bp, Homo sapiens
caatttttgtacttatagtact

SEQ ID NO: 7494130 - DNA, 22 bp, Homo sapiens
caattttttccatgctcttaca

SEQ ID NO: 7494131 - DNA, 22 bp, Homo sapiens
caattttttccatgctcttaca

SEQ ID NO: 7494132 - DNA, 22 bp, Homo sapiens
caattttttccatgctcttaca

SEQ ID NO: 7494133 - DNA, 22 bp, Homo sapiens
agcagcagggtgtaattgggca

SEQ ID NO: 7494134 - DNA, 22 bp, Homo sapiens
cacaagaaataagctgcctttc

SEQ ID NO: 7494135 - DNA, 22 bp, Homo sapiens
cacaagacttatttgtgtagaa

SEQ ID NO: 7494136 - DNA, 21 bp, Homo sapiens
cacaagacacatagggtgttt

SEQ ID NO: 7494137 - DNA, 21 bp, Homo sapiens
cacaagacacatagggtgttt

SEQ ID NO: 7494138 - DNA, 22 bp, Homo sapiens
cacaagagagtgcgcgttgcaa

SEQ ID NO: 7494139 - DNA, 22 bp, Homo sapiens
cacaagagagtgcgcgttgcaa

SEQ ID NO: 7494140 - DNA, 20 bp, Homo sapiens
cacaagagaatacacactgg

SEQ ID NO: 7494141 - DNA, 20 bp, Homo sapiens
cacaagagaatacacactgg

SEQ ID NO: 7494142 - DNA, 20 bp, Homo sapiens
cacaagagaatacacactgg

SEQ ID NO: 7494143 - DNA, 20 bp, Homo sapiens
cacaagagaatacacactgg

SEQ ID NO: 7494144 - DNA, 20 bp, Homo sapiens
cacaagagaatacacactgg

SEQ ID NO: 7494145 - DNA, 22 bp, Homo sapiens
cacaagacttatttgtgtagaa

SEQ ID NO: 7494146 - DNA, 22 bp, Homo sapiens
agcagcagggctctgcccgtgc

SEQ ID NO: 7494147 - DNA, 22 bp, Homo sapiens
agcagcagggctctgcccgtgc

SEQ ID NO: 7494148 - DNA, 22 bp, Homo sapiens
agcagcagggtcattgctcttt

SEQ ID NO: 7494149 - DNA, 22 bp, Homo sapiens
agcagcagggctctgcccgtgc

SEQ ID NO: 7494150 - DNA, 22 bp, Homo sapiens
agcagcagggctctgcccgtgc

SEQ ID NO: 7494151 - DNA, 22 bp, Homo sapiens
agcagcagggcatgtcttactc

SEQ ID NO: 7494152 - DNA, 22 bp, Homo sapiens
agcagcagggcatgtcttactc

SEQ ID NO: 7494153 - DNA, 22 bp, Homo sapiens
agcagcagggacaaaggaacag

SEQ ID NO: 7494154 - DNA, 22 bp, Homo sapiens
agcagcagggcatgtcttactc

SEQ ID NO: 7494155 - DNA, 22 bp, Homo sapiens
agcagcagggacaaaggaacag

SEQ ID NO: 7494156 - DNA, 22 bp, Homo sapiens
agcagcagggcatgtcttactc

SEQ ID NO: 7494157 - DNA, 22 bp, Homo sapiens
agcagcagggacaaaggaacag

SEQ ID NO: 7494158 - DNA, 22 bp, Homo sapiens
agcagcagggacaaaggaacag

SEQ ID NO: 7494159 - DNA, 22 bp, Homo sapiens
agcagcagggacaaaggaacag

SEQ ID NO: 7494160 - DNA, 21 bp, Homo sapiens
agcagcagggaagcctcatcc

SEQ ID NO: 7494161 - DNA, 21 bp, Homo sapiens
agcagcagggaagcctcatcc

SEQ ID NO: 7494162 - DNA, 21 bp, Homo sapiens
agcagcagggaagcctcatcc

SEQ ID NO: 7494163 - DNA, 22 bp, Homo sapiens
agcagcaggcttaaggaaaagt

SEQ ID NO: 7494164 - DNA, 22 bp, Homo sapiens
agcagcaggcttaaggaaaagt

SEQ ID NO: 7494165 - DNA, 22 bp, Homo sapiens
agcagcaggcttaaggaaaagt

SEQ ID NO: 7494166 - DNA, 22 bp, Homo sapiens
agcagcaggcttaaggaaaagt

SEQ ID NO: 7494167 - DNA, 22 bp, Homo sapiens
agcagcaggcttaaggaaaagt

SEQ ID NO: 7494168 - DNA, 21 bp, Homo sapiens
agcagcagggaagcctcatcc

SEQ ID NO: 7494169 - DNA, 22 bp, Homo sapiens
agcagcagggacaaaggaacag

SEQ ID NO: 7494170 - DNA, 21 bp, Homo sapiens
agcagcagggaagcctcatcc

SEQ ID NO: 7494171 - DNA, 23 bp, Homo sapiens
caacactgccttcaggtgaagaa

SEQ ID NO: 7494172 - DNA, 23 bp, Homo sapiens
caacactgccttcaggtgaagaa

SEQ ID NO: 7494173 - DNA, 23 bp, Homo sapiens
caacactgccttcaggtgaagaa

SEQ ID NO: 7494174 - DNA, 20 bp, Homo sapiens
caacactgcccattgtttgc

SEQ ID NO: 7494175 - DNA, 20 bp, Homo sapiens
caacactgcccattgtttgc

SEQ ID NO: 7494176 - DNA, 22 bp, Homo sapiens
caacacttcttatacttactga

SEQ ID NO: 7494177 - DNA, 22 bp, Homo sapiens
caacagaaatcaattttcccat

SEQ ID NO: 7494178 - DNA, 22 bp, Homo sapiens
caacacttcttatacttactga

SEQ ID NO: 7494179 - DNA, 23 bp, Homo sapiens
caacactgccttcaggtgaagaa

SEQ ID NO: 7494180 - DNA, 22 bp, Homo sapiens
caacagaaggaagcagggtcag

SEQ ID NO: 7494181 - DNA, 22 bp, Homo sapiens
caacagaaatcaattttcccat

SEQ ID NO: 7494182 - DNA, 22 bp, Homo sapiens
caacagaaggaagcagggtcag

SEQ ID NO: 7494183 - DNA, 22 bp, Homo sapiens
caacagaaggtgtactactgaa

SEQ ID NO: 7494184 - DNA, 22 bp, Homo sapiens
caacagaaggtgtactactgaa

SEQ ID NO: 7494185 - DNA, 22 bp, Homo sapiens
caacagaaggaagcagggtcag

SEQ ID NO: 7494186 - DNA, 22 bp, Homo sapiens
caaatagtttttcatgtattat

SEQ ID NO: 7494187 - DNA, 22 bp, Homo sapiens
caaatagtttttcatgtattat

SEQ ID NO: 7494188 - DNA, 22 bp, Homo sapiens
caaatagtttttcatgtattat

SEQ ID NO: 7494189 - DNA, 22 bp, Homo sapiens
caaatagtttttcatgtattat

SEQ ID NO: 7494190 - DNA, 22 bp, Homo sapiens
caaatagtttttcatgtattat

SEQ ID NO: 7494191 - DNA, 22 bp, Homo sapiens
caaatagtttttcatgtattat

SEQ ID NO: 7494192 - DNA, 22 bp, Homo sapiens
caaatagtttttcatgtattat

SEQ ID NO: 7494193 - DNA, 22 bp, Homo sapiens
caaatagtgtcacattgtgagg

SEQ ID NO: 7494194 - DNA, 22 bp, Homo sapiens
caaatagtgtcacattgtgagg

SEQ ID NO: 7494195 - DNA, 22 bp, Homo sapiens
caaatagtgtcacattgtgagg

SEQ ID NO: 7494196 - DNA, 22 bp, Homo sapiens
caaatagtgtcacattgtgagg

SEQ ID NO: 7494197 - DNA, 22 bp, Homo sapiens
caaatagtgtcacattgtgagg

SEQ ID NO: 7494198 - DNA, 22 bp, Homo sapiens
caaatagtgtcacattgtgagg

SEQ ID NO: 7494199 - DNA, 22 bp, Homo sapiens
caaatattccaggtacatccct

SEQ ID NO: 7494200 - DNA, 22 bp, Homo sapiens
caaatattccaggtacatccct

SEQ ID NO: 7494201 - DNA, 22 bp, Homo sapiens
caaatattccaggtacatccct

SEQ ID NO: 7494202 - DNA, 22 bp, Homo sapiens
caaatattccaggtacatccct

SEQ ID NO: 7494203 - DNA, 22 bp, Homo sapiens
caaatatctttggcaaagagaa

SEQ ID NO: 7494204 - DNA, 22 bp, Homo sapiens
caaatatctttggcaaagagaa

SEQ ID NO: 7494205 - DNA, 22 bp, Homo sapiens
caaatatctttggcaaagagaa

SEQ ID NO: 7494206 - DNA, 22 bp, Homo sapiens
caaatatctttggcaaagagaa

SEQ ID NO: 7494207 - DNA, 20 bp, Homo sapiens
caacagaggggtctggagta

SEQ ID NO: 7494208 - DNA, 20 bp, Homo sapiens
caacagaggggtctggagta

SEQ ID NO: 7494209 - DNA, 22 bp, Homo sapiens
caacagagagaccagaaacagg

SEQ ID NO: 7494210 - DNA, 22 bp, Homo sapiens
caacagagcagttgatcaggaa

SEQ ID NO: 7494211 - DNA, 22 bp, Homo sapiens
caacagagcagttgatcaggaa

SEQ ID NO: 7494212 - DNA, 22 bp, Homo sapiens
caacagacctggattcaaaaac

SEQ ID NO: 7494213 - DNA, 22 bp, Homo sapiens
caacagaaggtgtactactgaa

SEQ ID NO: 7494214 - DNA, 22 bp, Homo sapiens
caacagaaggtgtactactgaa

SEQ ID NO: 7494215 - DNA, 22 bp, Homo sapiens
caacagaaggtgtactactgaa

SEQ ID NO: 7494216 - DNA, 22 bp, Homo sapiens
caacagaaggtgtactactgaa

SEQ ID NO: 7494217 - DNA, 22 bp, Homo sapiens
caacagagagaccagaaacagg

SEQ ID NO: 7494218 - DNA, 22 bp, Homo sapiens
caacagagagaccagaaacagg

SEQ ID NO: 7494219 - DNA, 22 bp, Homo sapiens
caacagacctggattcaaaaac

SEQ ID NO: 7494220 - DNA, 22 bp, Homo sapiens
caacagacctggattcaaaaac

SEQ ID NO: 7494221 - DNA, 22 bp, Homo sapiens
caacagacctggattcaaaaac

SEQ ID NO: 7494222 - DNA, 22 bp, Homo sapiens
caacagagagaccagaaacagg

SEQ ID NO: 7494223 - DNA, 22 bp, Homo sapiens
agcacattagtatctaagaaca

SEQ ID NO: 7494224 - DNA, 22 bp, Homo sapiens
agcacattcccacctgtacttc

SEQ ID NO: 7494225 - DNA, 22 bp, Homo sapiens
agcacattagtatctaagaaca

SEQ ID NO: 7494226 - DNA, 20 bp, Homo sapiens
agcacattaaacatactcct

SEQ ID NO: 7494227 - DNA, 22 bp, Homo sapiens
agcacattaagtgagttcatgt

SEQ ID NO: 7494228 - DNA, 22 bp, Homo sapiens
agcacattaagtgagttcatgt

SEQ ID NO: 7494229 - DNA, 22 bp, Homo sapiens
caacagctttagaaacactttc

SEQ ID NO: 7494230 - DNA, 22 bp, Homo sapiens
agcacattaagtgagttcatgt

SEQ ID NO: 7494231 - DNA, 22 bp, Homo sapiens
caacagctggaggcttggcccg

SEQ ID NO: 7494232 - DNA, 23 bp, Homo sapiens
caacagctgttagatatgggctt

SEQ ID NO: 7494233 - DNA, 22 bp, Homo sapiens
caacagctggaggcttggcccg

SEQ ID NO: 7494234 - DNA, 22 bp, Homo sapiens
caacagctcagacacgggacct

SEQ ID NO: 7494235 - DNA, 22 bp, Homo sapiens
caacagctgatctttgatgaag

SEQ ID NO: 7494236 - DNA, 22 bp, Homo sapiens
agcaccaggtcgctggcacgct

SEQ ID NO: 7494237 - DNA, 22 bp, Homo sapiens
caacttggctctctggctatcc

SEQ ID NO: 7494238 - DNA, 22 bp, Homo sapiens
caacttggctctctggctatcc

SEQ ID NO: 7494239 - DNA, 22 bp, Homo sapiens
caactttaaatggctatgtctg

SEQ ID NO: 7494240 - DNA, 22 bp, Homo sapiens
caactttaaatggctatgtctg

SEQ ID NO: 7494241 - DNA, 22 bp, Homo sapiens
caactttaaatggctatgtctg

SEQ ID NO: 7494242 - DNA, 22 bp, Homo sapiens
caagacaatgggtaagtgtaac

SEQ ID NO: 7494243 - DNA, 22 bp, Homo sapiens
caactttagaccccaagtagct

SEQ ID NO: 7494244 - DNA, 22 bp, Homo sapiens
caactttaatttgggtgtcaga

SEQ ID NO: 7494245 - DNA, 22 bp, Homo sapiens
caactttaatttgggtgtcaga

SEQ ID NO: 7494246 - DNA, 22 bp, Homo sapiens
agcaccaggctgttggaagccc

SEQ ID NO: 7494247 - DNA, 22 bp, Homo sapiens
agcaccaggccatggggtccct

SEQ ID NO: 7494248 - DNA, 22 bp, Homo sapiens
agcaccaggccatggggtccct

SEQ ID NO: 7494249 - DNA, 22 bp, Homo sapiens
agcaccaggccatggggtccct

SEQ ID NO: 7494250 - DNA, 22 bp, Homo sapiens
agcaccaggcagtatatcaaag

SEQ ID NO: 7494251 - DNA, 22 bp, Homo sapiens
agcaccaggcaccaaagggcct

SEQ ID NO: 7494252 - DNA, 22 bp, Homo sapiens
agcaccaggtcgctggcacgct

SEQ ID NO: 7494253 - DNA, 22 bp, Homo sapiens
agcaccaggtcgctggcacgct

SEQ ID NO: 7494254 - DNA, 22 bp, Homo sapiens
agcaccaggctgttggaagccc

SEQ ID NO: 7494255 - DNA, 22 bp, Homo sapiens
agcaccaggctgttggaagccc

SEQ ID NO: 7494256 - DNA, 22 bp, Homo sapiens
agcaccaggctgttggaagccc

SEQ ID NO: 7494257 - DNA, 22 bp, Homo sapiens
caagacattgattttgtacaga

SEQ ID NO: 7494258 - DNA, 22 bp, Homo sapiens
caagacattgattttgtacaga

SEQ ID NO: 7494259 - DNA, 22 bp, Homo sapiens
caagacattgattttgtacaga

SEQ ID NO: 7494260 - DNA, 22 bp, Homo sapiens
caagacattgattttgtacaga

SEQ ID NO: 7494261 - DNA, 22 bp, Homo sapiens
caagacattgattttgtacaga

SEQ ID NO: 7494262 - DNA, 22 bp, Homo sapiens
caagacatgcaattgccacttt

SEQ ID NO: 7494263 - DNA, 22 bp, Homo sapiens
caagacatgcaattgccacttt

SEQ ID NO: 7494264 - DNA, 22 bp, Homo sapiens
caagacatgcaattgccacttt

SEQ ID NO: 7494265 - DNA, 21 bp, Homo sapiens
caagacatatgagtactctgg

SEQ ID NO: 7494266 - DNA, 22 bp, Homo sapiens
caagacaatgggtaagtgtaac

SEQ ID NO: 7494267 - DNA, 22 bp, Homo sapiens
caagagacgggcaaggcaagag

SEQ ID NO: 7494268 - DNA, 22 bp, Homo sapiens
caagagacttatgtggaaacct

SEQ ID NO: 7494269 - DNA, 22 bp, Homo sapiens
caagagacttatgtggaaacct

SEQ ID NO: 7494270 - DNA, 22 bp, Homo sapiens
caagagacgggcaaggcaagag

SEQ ID NO: 7494271 - DNA, 22 bp, Homo sapiens
caagactcacacacagaagagg

SEQ ID NO: 7494272 - DNA, 22 bp, Homo sapiens
caagacctcaaaatgagagggg

SEQ ID NO: 7494273 - DNA, 22 bp, Homo sapiens
caagacctcaaaatgagagggg

SEQ ID NO: 7494274 - DNA, 22 bp, Homo sapiens
caagacgtgagtcattgtttag

SEQ ID NO: 7494275 - DNA, 22 bp, Homo sapiens
caagactcacacacagaagagg

SEQ ID NO: 7494276 - DNA, 22 bp, Homo sapiens
caagacttagagcatcttgaaa

SEQ ID NO: 7494277 - DNA, 22 bp, Homo sapiens
caagacttcaccgctctgtgct

SEQ ID NO: 7494278 - DNA, 22 bp, Homo sapiens
agcacatttaagtatgaaatat

SEQ ID NO: 7494279 - DNA, 22 bp, Homo sapiens
agcacatttaagtatgaaatat

SEQ ID NO: 7494280 - DNA, 22 bp, Homo sapiens
agcacattcttgccttaacctc

SEQ ID NO: 7494281 - DNA, 22 bp, Homo sapiens
agcacatttaagtatgaaatat

SEQ ID NO: 7494282 - DNA, 22 bp, Homo sapiens
agcacattgatttattttggag

SEQ ID NO: 7494283 - DNA, 22 bp, Homo sapiens
agcacattcccacctgtacttc

SEQ ID NO: 7494284 - DNA, 22 bp, Homo sapiens
agcacattttatttaagaaaat

SEQ ID NO: 7494285 - DNA, 22 bp, Homo sapiens
agcacattttatttaagaaaat

SEQ ID NO: 7494286 - DNA, 22 bp, Homo sapiens
agcacattttctcaaagctcat

SEQ ID NO: 7494287 - DNA, 22 bp, Homo sapiens
agcacattttctcaaagctcat

SEQ ID NO: 7494288 - DNA, 22 bp, Homo sapiens
agcaccagagctatgggcctgc

SEQ ID NO: 7494289 - DNA, 22 bp, Homo sapiens
agcaccagagctatgggcctgc

SEQ ID NO: 7494290 - DNA, 16 bp, Homo sapiens
agcaccagatcatatc

SEQ ID NO: 7494291 - DNA, 23 bp, Homo sapiens
agcaccaggaacagtgtggtcct

SEQ ID NO: 7494292 - DNA, 22 bp, Homo sapiens
agcaccaggaaagaaggggcca

SEQ ID NO: 7494293 - DNA, 22 bp, Homo sapiens
agcaccaggaaagaaggggcca

SEQ ID NO: 7494294 - DNA, 22 bp, Homo sapiens
agcaccaggaaagaaggggcca

SEQ ID NO: 7494295 - DNA, 22 bp, Homo sapiens
agcaccaggaaagaaggggcca

SEQ ID NO: 7494296 - DNA, 23 bp, Homo sapiens
agcaccaggaacagtgtggtcct

SEQ ID NO: 7494297 - DNA, 23 bp, Homo sapiens
agcaccaggaacagtgtggtcct

SEQ ID NO: 7494298 - DNA, 22 bp, Homo sapiens
agcaccaggatattgttggaga

SEQ ID NO: 7494299 - DNA, 22 bp, Homo sapiens
agcaccaggcaccaaagggcct

SEQ ID NO: 7494300 - DNA, 22 bp, Homo sapiens
agcaccaggcaccaaagggcct

SEQ ID NO: 7494301 - DNA, 22 bp, Homo sapiens
agcaccagcaactatgggctgc

SEQ ID NO: 7494302 - DNA, 22 bp, Homo sapiens
agcaccagcaactatgggctgc

SEQ ID NO: 7494303 - DNA, 22 bp, Homo sapiens
agcaccagcaactatgggctgc

SEQ ID NO: 7494304 - DNA, 22 bp, Homo sapiens
agcaccagcaactatgggctgc

SEQ ID NO: 7494305 - DNA, 22 bp, Homo sapiens
agcaccagcaactatgggctgc

SEQ ID NO: 7494306 - DNA, 22 bp, Homo sapiens
agcaccagagctatgggcctgc

SEQ ID NO: 7494307 - DNA, 22 bp, Homo sapiens
agcaccagctcaaggtgcacct

SEQ ID NO: 7494308 - DNA, 22 bp, Homo sapiens
agcaccagctcaaggtgcacct

SEQ ID NO: 7494309 - DNA, 22 bp, Homo sapiens
agcaccagctcaaggtgcacct

SEQ ID NO: 7494310 - DNA, 22 bp, Homo sapiens
agcaccagctcaaggtgcacct

SEQ ID NO: 7494311 - DNA, 22 bp, Homo sapiens
agcaccagcgtgggggccgttg

SEQ ID NO: 7494312 - DNA, 22 bp, Homo sapiens
agcaccagcgtgggggccgttg

SEQ ID NO: 7494313 - DNA, 22 bp, Homo sapiens
agcaccagcgtgggggccgttg

SEQ ID NO: 7494314 - DNA, 22 bp, Homo sapiens
agcaaagaagacacaggcttca

SEQ ID NO: 7494315 - DNA, 22 bp, Homo sapiens
agcaaagaagacacaggcttca

SEQ ID NO: 7494316 - DNA, 22 bp, Homo sapiens
agcaaagaagacacaggcttca

SEQ ID NO: 7494317 - DNA, 22 bp, Homo sapiens
agcaaagaagacacaggcttca

SEQ ID NO: 7494318 - DNA, 22 bp, Homo sapiens
agcaaagaaatggaggctcaga

SEQ ID NO: 7494319 - DNA, 22 bp, Homo sapiens
agcaaagaaatggaggctcaga

SEQ ID NO: 7494320 - DNA, 22 bp, Homo sapiens
agcaaagaaatggaggctcaga

SEQ ID NO: 7494321 - DNA, 22 bp, Homo sapiens
agcaaagaaatggaggctcaga

SEQ ID NO: 7494322 - DNA, 20 bp, Homo sapiens
agcaaactcttcccatcttc

SEQ ID NO: 7494323 - DNA, 22 bp, Homo sapiens
agcaaagagtaattttgttttg

SEQ ID NO: 7494324 - DNA, 22 bp, Homo sapiens
agcaaagacagggacgaccaag

SEQ ID NO: 7494325 - DNA, 22 bp, Homo sapiens
agcaaagacagggacgaccaag

SEQ ID NO: 7494326 - DNA, 22 bp, Homo sapiens
agcaaagacagggacgaccaag

SEQ ID NO: 7494327 - DNA, 22 bp, Homo sapiens
agcaaagaagggttcttcatta

SEQ ID NO: 7494328 - DNA, 22 bp, Homo sapiens
agcaaagaagggttcttcatta

SEQ ID NO: 7494329 - DNA, 22 bp, Homo sapiens
agcaaagaagggttcttcatta

SEQ ID NO: 7494330 - DNA, 22 bp, Homo sapiens
agcaaagaagggttcttcatta

SEQ ID NO: 7494331 - DNA, 22 bp, Homo sapiens
caaaagtcttcctattctctta

SEQ ID NO: 7494332 - DNA, 22 bp, Homo sapiens
caaaagtcttcctattctctta

SEQ ID NO: 7494333 - DNA, 23 bp, Homo sapiens
caaaagttagcccttcccatctc

SEQ ID NO: 7494334 - DNA, 22 bp, Homo sapiens
caaaagtcttcctattctctta

SEQ ID NO: 7494335 - DNA, 22 bp, Homo sapiens
caaaagttattgcggtttttgc

SEQ ID NO: 7494336 - DNA, 22 bp, Homo sapiens
caaaagttctcacccagacatg

SEQ ID NO: 7494337 - DNA, 22 bp, Homo sapiens
caaaagttctcacccagacatg

SEQ ID NO: 7494338 - DNA, 22 bp, Homo sapiens
caaaagttattgcggtttttgc

SEQ ID NO: 7494339 - DNA, 22 bp, Homo sapiens
caaaagtcttcctattctctta

SEQ ID NO: 7494340 - DNA, 22 bp, Homo sapiens
caaaagtcttcctattctctta

SEQ ID NO: 7494341 - DNA, 22 bp, Homo sapiens
caaaagtctgtcctttaacttc

SEQ ID NO: 7494342 - DNA, 22 bp, Homo sapiens
caaaataccacgacttgtttta

SEQ ID NO: 7494343 - DNA, 22 bp, Homo sapiens
caaaataccacgacttgtttta

SEQ ID NO: 7494344 - DNA, 22 bp, Homo sapiens
caaaataccacgacttgtttta

SEQ ID NO: 7494345 - DNA, 20 bp, Homo sapiens
agcaaactcttcccatcttc

SEQ ID NO: 7494346 - DNA, 22 bp, Homo sapiens
agcaaactaattgcagttctgg

SEQ ID NO: 7494347 - DNA, 22 bp, Homo sapiens
agcaaactaattgcagttctgg

SEQ ID NO: 7494348 - DNA, 22 bp, Homo sapiens
agcaaactaattgcagttctgg

SEQ ID NO: 7494349 - DNA, 22 bp, Homo sapiens
agcaaactaattgcagttctgg

SEQ ID NO: 7494350 - DNA, 22 bp, Homo sapiens
agcaaacctgcagccttctgag

SEQ ID NO: 7494351 - DNA, 22 bp, Homo sapiens
caaaataccacgacttgtttta

SEQ ID NO: 7494352 - DNA, 22 bp, Homo sapiens
agcaaactaattgcagttctgg

SEQ ID NO: 7494353 - DNA, 21 bp, Homo sapiens
agcacagctttaagccatgtg

SEQ ID NO: 7494354 - DNA, 22 bp, Homo sapiens
agcacaggtacggagatgctac

SEQ ID NO: 7494355 - DNA, 22 bp, Homo sapiens
agcacaggtgaaacagtcaggt

SEQ ID NO: 7494356 - DNA, 22 bp, Homo sapiens
agcacaggtgaaacagtcaggt

SEQ ID NO: 7494357 - DNA, 22 bp, Homo sapiens
agcacaggtacggagatgctac

SEQ ID NO: 7494358 - DNA, 21 bp, Homo sapiens
agcacagctttaagccatgtg

SEQ ID NO: 7494359 - DNA, 21 bp, Homo sapiens
agcacagctttaagccatgtg

SEQ ID NO: 7494360 - DNA, 21 bp, Homo sapiens
agcacagctttaagccatgtg

SEQ ID NO: 7494361 - DNA, 22 bp, Homo sapiens
agcacagcttcaccgagcccat

SEQ ID NO: 7494362 - DNA, 22 bp, Homo sapiens
agcacagcttagcacctggcac

SEQ ID NO: 7494363 - DNA, 22 bp, Homo sapiens
agcaaagctaccaattattgag

SEQ ID NO: 7494364 - DNA, 22 bp, Homo sapiens
agcaaagctaccaattattgag

SEQ ID NO: 7494365 - DNA, 22 bp, Homo sapiens
agcaaagccgagacagccagtg

SEQ ID NO: 7494366 - DNA, 22 bp, Homo sapiens
agcaaagccgagacagccagtg

SEQ ID NO: 7494367 - DNA, 20 bp, Homo sapiens
agcaaagcctttagagtttg

SEQ ID NO: 7494368 - DNA, 20 bp, Homo sapiens
agcaaagcctttagagtttg

SEQ ID NO: 7494369 - DNA, 22 bp, Homo sapiens
agcaaagatgtccggggcaagc

SEQ ID NO: 7494370 - DNA, 22 bp, Homo sapiens
agcaaagatgtccggggcaagc

SEQ ID NO: 7494371 - DNA, 18 bp, Homo sapiens
agcaaagcaagagatcac

SEQ ID NO: 7494372 - DNA, 22 bp, Homo sapiens
agcaaagcactttgcatacata

SEQ ID NO: 7494373 - DNA, 22 bp, Homo sapiens
agcaaagcactttgcatacata

SEQ ID NO: 7494374 - DNA, 22 bp, Homo sapiens
agcaaagcaccatatggcagtt

SEQ ID NO: 7494375 - DNA, 22 bp, Homo sapiens
agcaaagcaccatatggcagtt

SEQ ID NO: 7494376 - DNA, 22 bp, Homo sapiens
agcaaagcaccatatggcagtt

SEQ ID NO: 7494377 - DNA, 22 bp, Homo sapiens
agcaaagcaccatatggcagtt

SEQ ID NO: 7494378 - DNA, 18 bp, Homo sapiens
agcaaagcaagagatcac

SEQ ID NO: 7494379 - DNA, 22 bp, Homo sapiens
agcaaagcactttgcatacata

SEQ ID NO: 7494380 - DNA, 22 bp, Homo sapiens
agcaaagcagtggctaagctga

SEQ ID NO: 7494381 - DNA, 22 bp, Homo sapiens
agcaaagcagtggctaagctga

SEQ ID NO: 7494382 - DNA, 22 bp, Homo sapiens
agcaaagcagtggctaagctga

SEQ ID NO: 7494383 - DNA, 22 bp, Homo sapiens
agcaaagccgagacagccagtg

SEQ ID NO: 7494384 - DNA, 22 bp, Homo sapiens
agcaaagccgagacagccagtg

SEQ ID NO: 7494385 - DNA, 22 bp, Homo sapiens
agcaaagcatcactccaatctg

SEQ ID NO: 7494386 - DNA, 22 bp, Homo sapiens
agcaaagcagtggctaagctga

SEQ ID NO: 7494387 - DNA, 22 bp, Homo sapiens
caaatagattgttcaatcctga

SEQ ID NO: 7494388 - DNA, 18 bp, Homo sapiens
caaatagcatgatgtcct

SEQ ID NO: 7494389 - DNA, 18 bp, Homo sapiens
caaatagcatgatgtcct

SEQ ID NO: 7494390 - DNA, 22 bp, Homo sapiens
caaatagattgttcaatcctga

SEQ ID NO: 7494391 - DNA, 22 bp, Homo sapiens
caaatagattgttcaatcctga

SEQ ID NO: 7494392 - DNA, 22 bp, Homo sapiens
caaatagattgttcaatcctga

SEQ ID NO: 7494393 - DNA, 22 bp, Homo sapiens
caaatagattgttcaatcctga

SEQ ID NO: 7494394 - DNA, 22 bp, Homo sapiens
caaatagattgttcaatcctga

SEQ ID NO: 7494395 - DNA, 22 bp, Homo sapiens
caaatagattgttcaatcctga

SEQ ID NO: 7494396 - DNA, 22 bp, Homo sapiens
caaatagattgttcaatcctga

SEQ ID NO: 7494397 - DNA, 22 bp, Homo sapiens
caaatagattgttcaatcctga

SEQ ID NO: 7494398 - DNA, 22 bp, Homo sapiens
caaatagtatgagcaatgattc

SEQ ID NO: 7494399 - DNA, 22 bp, Homo sapiens
caaatagtatgagcaatgattc

SEQ ID NO: 7494400 - DNA, 22 bp, Homo sapiens
caaatagtatgagcaatgattc

SEQ ID NO: 7494401 - DNA, 22 bp, Homo sapiens
caaatagtatgagcaatgattc

SEQ ID NO: 7494402 - DNA, 22 bp, Homo sapiens
caaatagtatgagcaatgattc

SEQ ID NO: 7494403 - DNA, 22 bp, Homo sapiens
caaatagtatgagcaatgattc

SEQ ID NO: 7494404 - DNA, 22 bp, Homo sapiens
caaatagtgaaacagatggggg

SEQ ID NO: 7494405 - DNA, 22 bp, Homo sapiens
caaatagtgaaacagatggggg

SEQ ID NO: 7494406 - DNA, 22 bp, Homo sapiens
caaatagtatgagcaatgattc

SEQ ID NO: 7494407 - DNA, 22 bp, Homo sapiens
agcacatgagctgatggtgggc

SEQ ID NO: 7494408 - DNA, 22 bp, Homo sapiens
agcacatgacttttagtcgagt

SEQ ID NO: 7494409 - DNA, 22 bp, Homo sapiens
agcacatgacttttagtcgagt

SEQ ID NO: 7494410 - DNA, 22 bp, Homo sapiens
agcacatattcagttcatacaa

SEQ ID NO: 7494411 - DNA, 22 bp, Homo sapiens
agcacataccagaaccacaggt

SEQ ID NO: 7494412 - DNA, 22 bp, Homo sapiens
agcacatattcagttcatacaa

SEQ ID NO: 7494413 - DNA, 23 bp, Homo sapiens
agcacatcaaagcagggaggaga

SEQ ID NO: 7494414 - DNA, 23 bp, Homo sapiens
agcacatcaaagcagggaggaga

SEQ ID NO: 7494415 - DNA, 22 bp, Homo sapiens
agcacatgagctgatggtgggc

SEQ ID NO: 7494416 - DNA, 22 bp, Homo sapiens
agcacatgcacagtgctacact

SEQ ID NO: 7494417 - DNA, 22 bp, Homo sapiens
agcacatgcacagtgctacact

SEQ ID NO: 7494418 - DNA, 22 bp, Homo sapiens
agcacatgcacagtgctacact

SEQ ID NO: 7494419 - DNA, 22 bp, Homo sapiens
agcacatgcacagtgctacact

SEQ ID NO: 7494420 - DNA, 22 bp, Homo sapiens
agcacatgcacagtgctacact

SEQ ID NO: 7494421 - DNA, 22 bp, Homo sapiens
agcacatgcacagtgctacact

SEQ ID NO: 7494422 - DNA, 22 bp, Homo sapiens
caaatagacttcaatctcttga

SEQ ID NO: 7494423 - DNA, 22 bp, Homo sapiens
caaatagacttcaatctcttga

SEQ ID NO: 7494424 - DNA, 22 bp, Homo sapiens
caaatagacttcaatctcttga

SEQ ID NO: 7494425 - DNA, 22 bp, Homo sapiens
caaatagacttcaatctcttga

SEQ ID NO: 7494426 - DNA, 22 bp, Homo sapiens
caaatagacttcaatctcttga

SEQ ID NO: 7494427 - DNA, 20 bp, Homo sapiens
agcacattaaacatactcct

SEQ ID NO: 7494428 - DNA, 20 bp, Homo sapiens
agcacattaaacatactcct

SEQ ID NO: 7494429 - DNA, 22 bp, Homo sapiens
agcacatgcacagtgctacact

SEQ ID NO: 7494430 - DNA, 22 bp, Homo sapiens
agcacatgtattctccttgaat

SEQ ID NO: 7494431 - DNA, 22 bp, Homo sapiens
agcacatgtattctccttgaat

SEQ ID NO: 7494432 - DNA, 22 bp, Homo sapiens
agcacagttttcattgcagggt

SEQ ID NO: 7494433 - DNA, 22 bp, Homo sapiens
agcacataccagaaccacaggt

SEQ ID NO: 7494434 - DNA, 22 bp, Homo sapiens
agcacagttttcattgcagggt

SEQ ID NO: 7494435 - DNA, 22 bp, Homo sapiens
agcacagttttcattgcagggt

SEQ ID NO: 7494436 - DNA, 22 bp, Homo sapiens
agcacagttttcattgcagggt

SEQ ID NO: 7494437 - DNA, 22 bp, Homo sapiens
agcacagtttcttttccttgtc

SEQ ID NO: 7494438 - DNA, 22 bp, Homo sapiens
agcacagtttcttttccttgtc

SEQ ID NO: 7494439 - DNA, 19 bp, Homo sapiens
agcacagtttccacatgca

SEQ ID NO: 7494440 - DNA, 19 bp, Homo sapiens
agcacagtttccacatgca

SEQ ID NO: 7494441 - DNA, 19 bp, Homo sapiens
agcacagtttccacatgca

SEQ ID NO: 7494442 - DNA, 22 bp, Homo sapiens
agcacagttctttctctagctg

SEQ ID NO: 7494443 - DNA, 22 bp, Homo sapiens
agcacagttctttctctagctg

SEQ ID NO: 7494444 - DNA, 19 bp, Homo sapiens
agcacagtttccacatgca

SEQ ID NO: 7494445 - DNA, 22 bp, Homo sapiens
agcacagttggtaaaattgtta

SEQ ID NO: 7494446 - DNA, 22 bp, Homo sapiens
agcacagttggtaaaattgtta

SEQ ID NO: 7494447 - DNA, 22 bp, Homo sapiens
agcacagtgctctggacagagt

SEQ ID NO: 7494448 - DNA, 22 bp, Homo sapiens
agcacagtgctctggacagagt

SEQ ID NO: 7494449 - DNA, 22 bp, Homo sapiens
agcacagtgctctggacagagt

SEQ ID NO: 7494450 - DNA, 22 bp, Homo sapiens
agcacagtgcctgacatatatg

SEQ ID NO: 7494451 - DNA, 22 bp, Homo sapiens
agcacagtgctctggacagagt

SEQ ID NO: 7494452 - DNA, 22 bp, Homo sapiens
agcacagtggcttctatgtcta

SEQ ID NO: 7494453 - DNA, 22 bp, Homo sapiens
agcacaggtgaaacagtcaggt

SEQ ID NO: 7494454 - DNA, 22 bp, Homo sapiens
agcacaggtgaaacagtcaggt

SEQ ID NO: 7494455 - DNA, 22 bp, Homo sapiens
agcacaggtgaaacagtcaggt

SEQ ID NO: 7494456 - DNA, 22 bp, Homo sapiens
agcacaggtgaaacagtcaggt

SEQ ID NO: 7494457 - DNA, 22 bp, Homo sapiens
agcacaggtgaaacagtcaggt

SEQ ID NO: 7494458 - DNA, 22 bp, Homo sapiens
agcacaggtgaaacagtcaggt

SEQ ID NO: 7494459 - DNA, 22 bp, Homo sapiens
agcacaggtgaaacagtcaggt

SEQ ID NO: 7494460 - DNA, 22 bp, Homo sapiens
agcacaggtgaaacagtcaggt

SEQ ID NO: 7494461 - DNA, 22 bp, Homo sapiens
agcacaggtgaaacagtcaggt

SEQ ID NO: 7494462 - DNA, 22 bp, Homo sapiens
agcacaggtgaaacagtcaggt

SEQ ID NO: 7494463 - DNA, 22 bp, Homo sapiens
agcacaggtgaaacagtcaggt

SEQ ID NO: 7494464 - DNA, 22 bp, Homo sapiens
agcacaggtgaaacagtcaggt

SEQ ID NO: 7494465 - DNA, 22 bp, Homo sapiens
agcacaggtgaaacagtcaggt

SEQ ID NO: 7494466 - DNA, 22 bp, Homo sapiens
agcacagtaaagcagtgtcaca

SEQ ID NO: 7494467 - DNA, 22 bp, Homo sapiens
agcacaggtgaaacagtcaggt

SEQ ID NO: 7494468 - DNA, 22 bp, Homo sapiens
agcacagtaaagcagtgtcaca

SEQ ID NO: 7494469 - DNA, 22 bp, Homo sapiens
agcacagtaaagcagtgtcaca

SEQ ID NO: 7494470 - DNA, 22 bp, Homo sapiens
agcacagtaaagcagtgtcaca

SEQ ID NO: 7494471 - DNA, 22 bp, Homo sapiens
agcacagtgcctgacatatatg

SEQ ID NO: 7494472 - DNA, 22 bp, Homo sapiens
agcacagtgcctgacatatatg

SEQ ID NO: 7494473 - DNA, 22 bp, Homo sapiens
agcacagtgaatggtttactca

SEQ ID NO: 7494474 - DNA, 22 bp, Homo sapiens
agcacagtaattgatattactg

SEQ ID NO: 7494475 - DNA, 22 bp, Homo sapiens
agcacagtaattgatattactg

SEQ ID NO: 7494476 - DNA, 22 bp, Homo sapiens
agcacagtaattgatattactg

SEQ ID NO: 7494477 - DNA, 22 bp, Homo sapiens
agcacagtaattgatattactg

SEQ ID NO: 7494478 - DNA, 22 bp, Homo sapiens
cacctagggtttcgcctttctt

SEQ ID NO: 7494479 - DNA, 22 bp, Homo sapiens
cacctagggcatccctgcccca

SEQ ID NO: 7494480 - DNA, 22 bp, Homo sapiens
cacctagggtttcgcctttctt

SEQ ID NO: 7494481 - DNA, 22 bp, Homo sapiens
cacctagggtttcgcctttctt

SEQ ID NO: 7494482 - DNA, 22 bp, Homo sapiens
cacctcaggcagcaaagtctca

SEQ ID NO: 7494483 - DNA, 22 bp, Homo sapiens
cacctagggcatccctgcccca

SEQ ID NO: 7494484 - DNA, 22 bp, Homo sapiens
cacctagcatgaaattcagcag

SEQ ID NO: 7494485 - DNA, 22 bp, Homo sapiens
cacctagcattcctcttcctca

SEQ ID NO: 7494486 - DNA, 22 bp, Homo sapiens
cacctagcagagcactactgca

SEQ ID NO: 7494487 - DNA, 22 bp, Homo sapiens
cacctagcagagcactactgca

SEQ ID NO: 7494488 - DNA, 22 bp, Homo sapiens
cacctagcagaacagaggtgct

SEQ ID NO: 7494489 - DNA, 22 bp, Homo sapiens
cacctagcagaacagaggtgct

SEQ ID NO: 7494490 - DNA, 22 bp, Homo sapiens
caccctttgctgctcttcctcc

SEQ ID NO: 7494491 - DNA, 22 bp, Homo sapiens
cacccttcagctttcttagctc

SEQ ID NO: 7494492 - DNA, 22 bp, Homo sapiens
caccctttgctgctcttcctcc

SEQ ID NO: 7494493 - DNA, 22 bp, Homo sapiens
caccgagtgacagtagccatca

SEQ ID NO: 7494494 - DNA, 22 bp, Homo sapiens
caccgcggagtgatggagaaac

SEQ ID NO: 7494495 - DNA, 22 bp, Homo sapiens
caccgtggaggagctggagggc

SEQ ID NO: 7494496 - DNA, 22 bp, Homo sapiens
caccgtggaggagctggagggc

SEQ ID NO: 7494497 - DNA, 22 bp, Homo sapiens
cacctacttccaagagtttcca

SEQ ID NO: 7494498 - DNA, 22 bp, Homo sapiens
cacctactttgtgcagatttta

SEQ ID NO: 7494499 - DNA, 19 bp, Homo sapiens
cacctacttttggatttgc

SEQ ID NO: 7494500 - DNA, 22 bp, Homo sapiens
cacccaggctggagtgcagtgg

SEQ ID NO: 7494501 - DNA, 22 bp, Homo sapiens
cacccaggctggagtgcagtgg

SEQ ID NO: 7494502 - DNA, 22 bp, Homo sapiens
cacccaggctggagtgcattgg

SEQ ID NO: 7494503 - DNA, 22 bp, Homo sapiens
cacccaggctggagtgcattgg

SEQ ID NO: 7494504 - DNA, 22 bp, Homo sapiens
cacccaggctggagtgcagtgg

SEQ ID NO: 7494505 - DNA, 22 bp, Homo sapiens
cacccaggctggagtgcagtgg

SEQ ID NO: 7494506 - DNA, 22 bp, Homo sapiens
cacccaggctggagtgcagtgg

SEQ ID NO: 7494507 - DNA, 22 bp, Homo sapiens
cacccaggctggattgcagtgg

SEQ ID NO: 7494508 - DNA, 22 bp, Homo sapiens
cacccagggctgtgcctgccca

SEQ ID NO: 7494509 - DNA, 22 bp, Homo sapiens
cacccaggctggattgcagtgg

SEQ ID NO: 7494510 - DNA, 22 bp, Homo sapiens
cacccaggctggattgcagtgg

SEQ ID NO: 7494511 - DNA, 22 bp, Homo sapiens
cacccaggctggattgcagtgg

SEQ ID NO: 7494512 - DNA, 22 bp, Homo sapiens
caccctgtcagttgcaggatag

SEQ ID NO: 7494513 - DNA, 22 bp, Homo sapiens
caccctgtcagttgcaggatag

SEQ ID NO: 7494514 - DNA, 22 bp, Homo sapiens
cacccagggctgtgcctgccca

SEQ ID NO: 7494515 - DNA, 22 bp, Homo sapiens
cacccagggctgtgcctgccca

SEQ ID NO: 7494516 - DNA, 22 bp, Homo sapiens
cacctctgctgtccacaggatg

SEQ ID NO: 7494517 - DNA, 22 bp, Homo sapiens
cacctctgctgtccacaggatg

SEQ ID NO: 7494518 - DNA, 22 bp, Homo sapiens
cacctctgctgtccacaggatg

SEQ ID NO: 7494519 - DNA, 22 bp, Homo sapiens
cacctctgctgtccacaggatg

SEQ ID NO: 7494520 - DNA, 22 bp, Homo sapiens
cacctctgctgtccacaggatg

SEQ ID NO: 7494521 - DNA, 22 bp, Homo sapiens
cacctctgctgtccacaggatg

SEQ ID NO: 7494522 - DNA, 22 bp, Homo sapiens
cacctctttgatttgaggcaag

SEQ ID NO: 7494523 - DNA, 22 bp, Homo sapiens
cacctctgctgtccacaggatg

SEQ ID NO: 7494524 - DNA, 22 bp, Homo sapiens
cacctctttgatttgaggcaag

SEQ ID NO: 7494525 - DNA, 22 bp, Homo sapiens
cacctctttgatttgaggcaag

SEQ ID NO: 7494526 - DNA, 22 bp, Homo sapiens
cacctctttgatttgaggcaag

SEQ ID NO: 7494527 - DNA, 22 bp, Homo sapiens
cacctctgcctcaagcttccca

SEQ ID NO: 7494528 - DNA, 22 bp, Homo sapiens
cacctctgcctcaagcttccca

SEQ ID NO: 7494529 - DNA, 22 bp, Homo sapiens
cacctctgcctcaagcttccca

SEQ ID NO: 7494530 - DNA, 22 bp, Homo sapiens
cacctctcatttctacagattc

SEQ ID NO: 7494531 - DNA, 22 bp, Homo sapiens
cacctctcagctaggagtaagt

SEQ ID NO: 7494532 - DNA, 20 bp, Homo sapiens
cacctctgaaagtttccagc

SEQ ID NO: 7494533 - DNA, 20 bp, Homo sapiens
cacctctgaaagtttccagc

SEQ ID NO: 7494534 - DNA, 22 bp, Homo sapiens
cacctagggtttcgcctttctt

SEQ ID NO: 7494535 - DNA, 22 bp, Homo sapiens
cacctctcagctaggagtaagt

SEQ ID NO: 7494536 - DNA, 22 bp, Homo sapiens
cacctctcatttctacagattc

SEQ ID NO: 7494537 - DNA, 22 bp, Homo sapiens
cacctcatgtcatcagtaaaat

SEQ ID NO: 7494538 - DNA, 22 bp, Homo sapiens
cacctcatggataagataaact

SEQ ID NO: 7494539 - DNA, 22 bp, Homo sapiens
cacctcaggcagcaaagtctca

SEQ ID NO: 7494540 - DNA, 22 bp, Homo sapiens
cacctcaggcagcaaagtctca

SEQ ID NO: 7494541 - DNA, 22 bp, Homo sapiens
cacctcatggataagataaact

SEQ ID NO: 7494542 - DNA, 22 bp, Homo sapiens
cacctgagcactggggccgccc

SEQ ID NO: 7494543 - DNA, 22 bp, Homo sapiens
cacctgagactcctcaccatga

SEQ ID NO: 7494544 - DNA, 22 bp, Homo sapiens
cacctgagactcctcaccatga

SEQ ID NO: 7494545 - DNA, 22 bp, Homo sapiens
cactgcacttcagcctgggtga

SEQ ID NO: 7494546 - DNA, 22 bp, Homo sapiens
cactgcacttcagcctgggtga

SEQ ID NO: 7494547 - DNA, 22 bp, Homo sapiens
cactgcacttcagcctgggtga

SEQ ID NO: 7494548 - DNA, 22 bp, Homo sapiens
cacctgagcactggggccgccc

SEQ ID NO: 7494549 - DNA, 22 bp, Homo sapiens
cacctgagcaaccctgtgcggg

SEQ ID NO: 7494550 - DNA, 22 bp, Homo sapiens
cacctgagcaaccctgtgcggg

SEQ ID NO: 7494551 - DNA, 22 bp, Homo sapiens
cacctgagcactggggccgccc

SEQ ID NO: 7494552 - DNA, 22 bp, Homo sapiens
cacctgagcactggggccgccc

SEQ ID NO: 7494553 - DNA, 22 bp, Homo sapiens
cactgcctgtgagctgtgtgcc

SEQ ID NO: 7494554 - DNA, 22 bp, Homo sapiens
cactgcctgtgagctgtgtgcc

SEQ ID NO: 7494555 - DNA, 22 bp, Homo sapiens
cactgcctgtgagctgtgtgcc

SEQ ID NO: 7494556 - DNA, 22 bp, Homo sapiens
cactgcctgtgagctgtgtgcc

SEQ ID NO: 7494557 - DNA, 22 bp, Homo sapiens
cactgcctgtgagctgtgtgcc

SEQ ID NO: 7494558 - DNA, 22 bp, Homo sapiens
cactgcagatcagaggctgaga

SEQ ID NO: 7494559 - DNA, 22 bp, Homo sapiens
cactgcacttcagcctgggtga

SEQ ID NO: 7494560 - DNA, 22 bp, Homo sapiens
cactgcacttcagcctgggtga

SEQ ID NO: 7494561 - DNA, 22 bp, Homo sapiens
cactgcagatcagaggctgaga

SEQ ID NO: 7494562 - DNA, 22 bp, Homo sapiens
cactgcagatcagaggctgaga

SEQ ID NO: 7494563 - DNA, 23 bp, Homo sapiens
cactgccttcagttgcttcacct

SEQ ID NO: 7494564 - DNA, 23 bp, Homo sapiens
cactgccttcagttgcttcacct

SEQ ID NO: 7494565 - DNA, 23 bp, Homo sapiens
cactgccttcagttgcttcacct

SEQ ID NO: 7494566 - DNA, 23 bp, Homo sapiens
cactgccttcagttgcttcacct

SEQ ID NO: 7494567 - DNA, 22 bp, Homo sapiens
cactgccttcacctgccctatc

SEQ ID NO: 7494568 - DNA, 22 bp, Homo sapiens
cactgccttcacctgccctatc

SEQ ID NO: 7494569 - DNA, 22 bp, Homo sapiens
cactgccttcacctgccctatc

SEQ ID NO: 7494570 - DNA, 23 bp, Homo sapiens
cactgccttcagttgcttcacct

SEQ ID NO: 7494571 - DNA, 22 bp, Homo sapiens
cactgcctttggtgggaacact

SEQ ID NO: 7494572 - DNA, 22 bp, Homo sapiens
cactgcctttggtgggaacact

SEQ ID NO: 7494573 - DNA, 22 bp, Homo sapiens
cactgcctttggtgggaacact

SEQ ID NO: 7494574 - DNA, 22 bp, Homo sapiens
cactgctacctctgcctcccgg

SEQ ID NO: 7494575 - DNA, 22 bp, Homo sapiens
cactgctacctctgcctcccgg

SEQ ID NO: 7494576 - DNA, 22 bp, Homo sapiens
cactgctacctctgcctcccgg

SEQ ID NO: 7494577 - DNA, 22 bp, Homo sapiens
cactgctacctctgcctcccgg

SEQ ID NO: 7494578 - DNA, 22 bp, Homo sapiens
cactgctcgctgcagcatggcc

SEQ ID NO: 7494579 - DNA, 22 bp, Homo sapiens
cactgctattattagacaatgt

SEQ ID NO: 7494580 - DNA, 22 bp, Homo sapiens
cactgctatgatgatgatattt

SEQ ID NO: 7494581 - DNA, 22 bp, Homo sapiens
cactgctagtctgaagtactgg

SEQ ID NO: 7494582 - DNA, 22 bp, Homo sapiens
cactgctacctctgcctcccgg

SEQ ID NO: 7494583 - DNA, 22 bp, Homo sapiens
cactgctacctctgcctcccgg

SEQ ID NO: 7494584 - DNA, 22 bp, Homo sapiens
cactgctacctctgcctcccgg

SEQ ID NO: 7494585 - DNA, 22 bp, Homo sapiens
cactgctacctctgcctcccgg

SEQ ID NO: 7494586 - DNA, 22 bp, Homo sapiens
cactgctacctctgcctcccgg

SEQ ID NO: 7494587 - DNA, 22 bp, Homo sapiens
cactgctcgctgcagcatggcc

SEQ ID NO: 7494588 - DNA, 22 bp, Homo sapiens
cactgctgatttcataggcagg

SEQ ID NO: 7494589 - DNA, 22 bp, Homo sapiens
cactgctgatttcataggcagg

SEQ ID NO: 7494590 - DNA, 22 bp, Homo sapiens
cactgctgatttcataggcagg

SEQ ID NO: 7494591 - DNA, 22 bp, Homo sapiens
cactgctcgctgcagcatggcc

SEQ ID NO: 7494592 - DNA, 22 bp, Homo sapiens
cactgctgtttttaccacactg

SEQ ID NO: 7494593 - DNA, 22 bp, Homo sapiens
cactgcttagatcttccttcaa

SEQ ID NO: 7494594 - DNA, 22 bp, Homo sapiens
cactgcttagatcttccttcaa

SEQ ID NO: 7494595 - DNA, 22 bp, Homo sapiens
cactgctgatttcataggcagg

SEQ ID NO: 7494596 - DNA, 22 bp, Homo sapiens
cactgctgatttcataggcagg

SEQ ID NO: 7494597 - DNA, 22 bp, Homo sapiens
cactgcttatgtctccttttca

SEQ ID NO: 7494598 - DNA, 22 bp, Homo sapiens
cactgcttatgtctccttttca

SEQ ID NO: 7494599 - DNA, 22 bp, Homo sapiens
cactgcttagttggtaaatgtg

SEQ ID NO: 7494600 - DNA, 22 bp, Homo sapiens
cactgcttataaattctaggca

SEQ ID NO: 7494601 - DNA, 22 bp, Homo sapiens
agcatacaccctaaactgctta

SEQ ID NO: 7494602 - DNA, 22 bp, Homo sapiens
agcatacaccctaaactgctta

SEQ ID NO: 7494603 - DNA, 22 bp, Homo sapiens
agcatacaggtctgaaacagct

SEQ ID NO: 7494604 - DNA, 22 bp, Homo sapiens
cactgctttaaggctgagtaac

SEQ ID NO: 7494605 - DNA, 22 bp, Homo sapiens
cactgctttaaggctgagtaac

SEQ ID NO: 7494606 - DNA, 22 bp, Homo sapiens
cactgctttaaggctgagtaac

SEQ ID NO: 7494607 - DNA, 22 bp, Homo sapiens
agcatacaaacatttgaggcag

SEQ ID NO: 7494608 - DNA, 22 bp, Homo sapiens
agcatacaaacatttgaggcag

SEQ ID NO: 7494609 - DNA, 22 bp, Homo sapiens
cactgcttggttgcaacattgc

SEQ ID NO: 7494610 - DNA, 22 bp, Homo sapiens
cactgcttggttgcaacattgc

SEQ ID NO: 7494611 - DNA, 22 bp, Homo sapiens
cactgcttgcagtatgagtgga

SEQ ID NO: 7494612 - DNA, 22 bp, Homo sapiens
cactgcttgcagtatgagtgga

SEQ ID NO: 7494613 - DNA, 22 bp, Homo sapiens
cactgcttctggaggaatttgg

SEQ ID NO: 7494614 - DNA, 22 bp, Homo sapiens
cactgcttgattgacatgcacg

SEQ ID NO: 7494615 - DNA, 22 bp, Homo sapiens
cactgcttctggaggaatttgg

SEQ ID NO: 7494616 - DNA, 22 bp, Homo sapiens
agcatacagtaggtgctcagtt

SEQ ID NO: 7494617 - DNA, 22 bp, Homo sapiens
agcatacagttgaaagtggctt

SEQ ID NO: 7494618 - DNA, 22 bp, Homo sapiens
agcatacagttgaaagtggctt

SEQ ID NO: 7494619 - DNA, 22 bp, Homo sapiens
agcatacagttgaaagtggctt

SEQ ID NO: 7494620 - DNA, 22 bp, Homo sapiens
agcatacaggtctgaaacagct

SEQ ID NO: 7494621 - DNA, 22 bp, Homo sapiens
agcatacaggtctgaaacagct

SEQ ID NO: 7494622 - DNA, 22 bp, Homo sapiens
agcatacaggtctgaaacagct

SEQ ID NO: 7494623 - DNA, 22 bp, Homo sapiens
agcatacaggtctgaaacagct

SEQ ID NO: 7494624 - DNA, 22 bp, Homo sapiens
agcatacaggtctgaaacagct

SEQ ID NO: 7494625 - DNA, 22 bp, Homo sapiens
agcatagaaaagattcccagag

SEQ ID NO: 7494626 - DNA, 22 bp, Homo sapiens
agcatagaataagctgaagtca

SEQ ID NO: 7494627 - DNA, 19 bp, Homo sapiens
agcatagacttctcaggaa

SEQ ID NO: 7494628 - DNA, 22 bp, Homo sapiens
agcatagagcaggaagttaaga

SEQ ID NO: 7494629 - DNA, 22 bp, Homo sapiens
agcatagagcaggaagttaaga

SEQ ID NO: 7494630 - DNA, 22 bp, Homo sapiens
agcatacttgacacttctctat

SEQ ID NO: 7494631 - DNA, 22 bp, Homo sapiens
agcatacattggtatgtggttt

SEQ ID NO: 7494632 - DNA, 20 bp, Homo sapiens
agcatacatcataagaaacc

SEQ ID NO: 7494633 - DNA, 20 bp, Homo sapiens
agcatacatcataagaaacc

SEQ ID NO: 7494634 - DNA, 20 bp, Homo sapiens
agcatacatcataagaaacc

SEQ ID NO: 7494635 - DNA, 22 bp, Homo sapiens
agcaggggcagggttttgtgct

SEQ ID NO: 7494636 - DNA, 22 bp, Homo sapiens
agcaggggcagggttttgtgct

SEQ ID NO: 7494637 - DNA, 22 bp, Homo sapiens
agcaggggcagggttttgtgct

SEQ ID NO: 7494638 - DNA, 22 bp, Homo sapiens
agcaggggcagggttttgtgct

SEQ ID NO: 7494639 - DNA, 22 bp, Homo sapiens
agcaggggcagggttttgtgct

SEQ ID NO: 7494640 - DNA, 22 bp, Homo sapiens
agcagggctttgtctctgtgaa

SEQ ID NO: 7494641 - DNA, 17 bp, Homo sapiens
agcaggctgcagaggcc

SEQ ID NO: 7494642 - DNA, 22 bp, Homo sapiens
agcaggggctcctccacagcca

SEQ ID NO: 7494643 - DNA, 22 bp, Homo sapiens
agcaggggctcctccacagcca

SEQ ID NO: 7494644 - DNA, 22 bp, Homo sapiens
agcaggggctcctccacagcca

SEQ ID NO: 7494645 - DNA, 22 bp, Homo sapiens
agcaggggctcctccacagcca

SEQ ID NO: 7494646 - DNA, 22 bp, Homo sapiens
agcaggggctcctccacagcca

SEQ ID NO: 7494647 - DNA, 22 bp, Homo sapiens
agcaggggctcctccacagcca

SEQ ID NO: 7494648 - DNA, 22 bp, Homo sapiens
agcaggggctcctccacagcca

SEQ ID NO: 7494649 - DNA, 22 bp, Homo sapiens
agcaggggctcctccacagcca

SEQ ID NO: 7494650 - DNA, 22 bp, Homo sapiens
agcaggggctcctccacagcca

SEQ ID NO: 7494651 - DNA, 22 bp, Homo sapiens
agcaggggcagggttttgtgct

SEQ ID NO: 7494652 - DNA, 22 bp, Homo sapiens
agcaggggctcctccacagcca

SEQ ID NO: 7494653 - DNA, 22 bp, Homo sapiens
agcaggggctcctccacagcca

SEQ ID NO: 7494654 - DNA, 22 bp, Homo sapiens
agcaggctgccttccaaagcct

SEQ ID NO: 7494655 - DNA, 23 bp, Homo sapiens
agcaggctgcttctccacagctg

SEQ ID NO: 7494656 - DNA, 22 bp, Homo sapiens
agcaggctgccttccaaagcct

SEQ ID NO: 7494657 - DNA, 23 bp, Homo sapiens
agcaggctgcttctccacagctg

SEQ ID NO: 7494658 - DNA, 23 bp, Homo sapiens
agcaggctgcttctccacagctg

SEQ ID NO: 7494659 - DNA, 23 bp, Homo sapiens
agcaggctgcttctccacagctg

SEQ ID NO: 7494660 - DNA, 23 bp, Homo sapiens
agcaggctgcttctccacagctg

SEQ ID NO: 7494661 - DNA, 22 bp, Homo sapiens
agcagggctggggcacgagcca

SEQ ID NO: 7494662 - DNA, 22 bp, Homo sapiens
agcagggctggggcacgagcca

SEQ ID NO: 7494663 - DNA, 23 bp, Homo sapiens
agcaggctgcttctccacagctg

SEQ ID NO: 7494664 - DNA, 22 bp, Homo sapiens
agcagggctggggcacgagcca

SEQ ID NO: 7494665 - DNA, 23 bp, Homo sapiens
agcaggctgcttctccacagctg

SEQ ID NO: 7494666 - DNA, 22 bp, Homo sapiens
agcagggctggggcacgagcca

SEQ ID NO: 7494667 - DNA, 22 bp, Homo sapiens
agcagggggcatccttgccctt

SEQ ID NO: 7494668 - DNA, 22 bp, Homo sapiens
agcagggggcatccttgccctt

SEQ ID NO: 7494669 - DNA, 22 bp, Homo sapiens
agcagggggcatccttgccctt

SEQ ID NO: 7494670 - DNA, 22 bp, Homo sapiens
agcagggggcatccttgccctt

SEQ ID NO: 7494671 - DNA, 22 bp, Homo sapiens
agcagggggcatccttgccctt

SEQ ID NO: 7494672 - DNA, 22 bp, Homo sapiens
agcagggggcatccttgccctt

SEQ ID NO: 7494673 - DNA, 22 bp, Homo sapiens
agcagggggcatccttgccctt

SEQ ID NO: 7494674 - DNA, 22 bp, Homo sapiens
agcagggggagttagactagat

SEQ ID NO: 7494675 - DNA, 22 bp, Homo sapiens
agcagggggagttagactagat

SEQ ID NO: 7494676 - DNA, 22 bp, Homo sapiens
agcagggggagttagactagat

SEQ ID NO: 7494677 - DNA, 22 bp, Homo sapiens
agcagggggagttagactagat

SEQ ID NO: 7494678 - DNA, 22 bp, Homo sapiens
agcagggggagttagactagat

SEQ ID NO: 7494679 - DNA, 22 bp, Homo sapiens
agcagggggagttagactagat

SEQ ID NO: 7494680 - DNA, 22 bp, Homo sapiens
agcagggggagttagactagat

SEQ ID NO: 7494681 - DNA, 22 bp, Homo sapiens
agcagggggagttagactagat

SEQ ID NO: 7494682 - DNA, 22 bp, Homo sapiens
agcagggggagttagactagat

SEQ ID NO: 7494683 - DNA, 22 bp, Homo sapiens
agcagggggagttagactagat

SEQ ID NO: 7494684 - DNA, 22 bp, Homo sapiens
agcagggggagttagactagat

SEQ ID NO: 7494685 - DNA, 22 bp, Homo sapiens
agcagggggccacagtcacagc

SEQ ID NO: 7494686 - DNA, 22 bp, Homo sapiens
agcagggggccacagtcacagc

SEQ ID NO: 7494687 - DNA, 22 bp, Homo sapiens
agcagggggccacagtcacagc

SEQ ID NO: 7494688 - DNA, 22 bp, Homo sapiens
agcagggggccacagtcacagc

SEQ ID NO: 7494689 - DNA, 22 bp, Homo sapiens
agcagggggccacagtcacagc

SEQ ID NO: 7494690 - DNA, 22 bp, Homo sapiens
agcaggggtctctgctaatgaa

SEQ ID NO: 7494691 - DNA, 22 bp, Homo sapiens
agcaggggtaacagaaggaaag

SEQ ID NO: 7494692 - DNA, 22 bp, Homo sapiens
agcaggggtaacagaaggaaag

SEQ ID NO: 7494693 - DNA, 22 bp, Homo sapiens
agcaggggtaacagaaggaaag

SEQ ID NO: 7494694 - DNA, 22 bp, Homo sapiens
agcaggggtaacagaaggaaag

SEQ ID NO: 7494695 - DNA, 22 bp, Homo sapiens
agcagggggccacagtcacagc

SEQ ID NO: 7494696 - DNA, 22 bp, Homo sapiens
agcaggggtaacagaaggaaag

SEQ ID NO: 7494697 - DNA, 22 bp, Homo sapiens
agcagggtgtggtggccctgga

SEQ ID NO: 7494698 - DNA, 22 bp, Homo sapiens
agcagggtgtggtggccctgga

SEQ ID NO: 7494699 - DNA, 22 bp, Homo sapiens
agcagggtgtggtggccctgga

SEQ ID NO: 7494700 - DNA, 22 bp, Homo sapiens
agcagggtgtggtggccctgga

SEQ ID NO: 7494701 - DNA, 22 bp, Homo sapiens
agcagggtcctgaggtgagtca

SEQ ID NO: 7494702 - DNA, 22 bp, Homo sapiens
agcagggtcctgaggtgagtca

SEQ ID NO: 7494703 - DNA, 22 bp, Homo sapiens
agcagggtcctgaggtgagtca

SEQ ID NO: 7494704 - DNA, 22 bp, Homo sapiens
agcagggtcctgaggtgagtca

SEQ ID NO: 7494705 - DNA, 22 bp, Homo sapiens
agcagggtcctgaggtgagtca

SEQ ID NO: 7494706 - DNA, 22 bp, Homo sapiens
agcagggtatgttagagctgta

SEQ ID NO: 7494707 - DNA, 22 bp, Homo sapiens
agcagggttccttaaggccata

SEQ ID NO: 7494708 - DNA, 22 bp, Homo sapiens
agcagggttccttaaggccata

SEQ ID NO: 7494709 - DNA, 22 bp, Homo sapiens
agcagggttccaggagttgcag

SEQ ID NO: 7494710 - DNA, 22 bp, Homo sapiens
agcagggttccaggagttgcag

SEQ ID NO: 7494711 - DNA, 22 bp, Homo sapiens
agcagggttctcagttggtgct

SEQ ID NO: 7494712 - DNA, 22 bp, Homo sapiens
agcagggttctcagttggtgct

SEQ ID NO: 7494713 - DNA, 22 bp, Homo sapiens
agcagggtttggggattggcac

SEQ ID NO: 7494714 - DNA, 22 bp, Homo sapiens
agcagggtttggggattggcac

SEQ ID NO: 7494715 - DNA, 22 bp, Homo sapiens
agcagggtttggggattggcac

SEQ ID NO: 7494716 - DNA, 22 bp, Homo sapiens
agcagggttctcagttggtgct

SEQ ID NO: 7494717 - DNA, 22 bp, Homo sapiens
agcaggggtctctgctaatgaa

SEQ ID NO: 7494718 - DNA, 22 bp, Homo sapiens
agcaggggtggaaggtagcttt

SEQ ID NO: 7494719 - DNA, 22 bp, Homo sapiens
agcaggggtggaaggtagcttt

SEQ ID NO: 7494720 - DNA, 22 bp, Homo sapiens
agcaggggtctctgctaatgaa

SEQ ID NO: 7494721 - DNA, 22 bp, Homo sapiens
agcaggggtctctgctaatgaa

SEQ ID NO: 7494722 - DNA, 22 bp, Homo sapiens
agcaggggtctctgctaatgaa

SEQ ID NO: 7494723 - DNA, 22 bp, Homo sapiens
agcaggggtctctgctaatgaa

SEQ ID NO: 7494724 - DNA, 22 bp, Homo sapiens
agcaggggtaacagaaggaaag

SEQ ID NO: 7494725 - DNA, 22 bp, Homo sapiens
agcaggggtctctgctaatgaa

SEQ ID NO: 7494726 - DNA, 22 bp, Homo sapiens
agcaggggtggaaggtagcttt

SEQ ID NO: 7494727 - DNA, 22 bp, Homo sapiens
agcagggtatgttagagctgta

SEQ ID NO: 7494728 - DNA, 22 bp, Homo sapiens
agcagggtatgttagagctgta

SEQ ID NO: 7494729 - DNA, 22 bp, Homo sapiens
agcagggtatgttagagctgta

SEQ ID NO: 7494730 - DNA, 22 bp, Homo sapiens
agcaggggtggaaggtagcttt

SEQ ID NO: 7494731 - DNA, 22 bp, Homo sapiens
agcaggggtggaaggtagcttt

SEQ ID NO: 7494732 - DNA, 22 bp, Homo sapiens
agcaggggtggaaggtagcttt

SEQ ID NO: 7494733 - DNA, 22 bp, Homo sapiens
agcaggggtctctgctaatgaa

SEQ ID NO: 7494734 - DNA, 22 bp, Homo sapiens
agcaggggtggaaggtagcttt

SEQ ID NO: 7494735 - DNA, 22 bp, Homo sapiens
agcaggggtggaaggtagcttt

SEQ ID NO: 7494736 - DNA, 22 bp, Homo sapiens
cacccaggctggagtgcagtgg

SEQ ID NO: 7494737 - DNA, 22 bp, Homo sapiens
cacccaggctggagtgcagtgg

SEQ ID NO: 7494738 - DNA, 22 bp, Homo sapiens
cacccaggctggagtgcagtgg

SEQ ID NO: 7494739 - DNA, 22 bp, Homo sapiens
cacccaggctggagtgcagtga

SEQ ID NO: 7494740 - DNA, 22 bp, Homo sapiens
cacccaggctggagtgcagtga

SEQ ID NO: 7494741 - DNA, 22 bp, Homo sapiens
cacccaggctggagtgcagtgg

SEQ ID NO: 7494742 - DNA, 22 bp, Homo sapiens
cacccaggctggagtgcagtga

SEQ ID NO: 7494743 - DNA, 22 bp, Homo sapiens
cacccaggctggagtgcagtga

SEQ ID NO: 7494744 - DNA, 22 bp, Homo sapiens
cacccaggctggagtgcagtga

SEQ ID NO: 7494745 - DNA, 22 bp, Homo sapiens
cacccaggctggagtgcagtga

SEQ ID NO: 7494746 - DNA, 22 bp, Homo sapiens
cacccaggctggagtgcagtga

SEQ ID NO: 7494747 - DNA, 22 bp, Homo sapiens
cacccaggctggagtgcagtga

SEQ ID NO: 7494748 - DNA, 22 bp, Homo sapiens
cacccaggctggagtgcagggg

SEQ ID NO: 7494749 - DNA, 22 bp, Homo sapiens
cacccaggctggagtgcagtga

SEQ ID NO: 7494750 - DNA, 22 bp, Homo sapiens
cacccaggctggagtgcagggg

SEQ ID NO: 7494751 - DNA, 22 bp, Homo sapiens
cacccaggctggagtgcagggg

SEQ ID NO: 7494752 - DNA, 22 bp, Homo sapiens
cacccaggctggagtgcagggg

SEQ ID NO: 7494753 - DNA, 22 bp, Homo sapiens
cacccaggctggagtgcagggg

SEQ ID NO: 7494754 - DNA, 22 bp, Homo sapiens
cacccaggctggagtgcagggg

SEQ ID NO: 7494755 - DNA, 22 bp, Homo sapiens
cacccaggctggagtgcagggg

SEQ ID NO: 7494756 - DNA, 22 bp, Homo sapiens
cacccaggctggagagcagtgg

SEQ ID NO: 7494757 - DNA, 22 bp, Homo sapiens
cacccaggctggagagcagtgg

SEQ ID NO: 7494758 - DNA, 22 bp, Homo sapiens
cacccaggctggagagcagtgg

SEQ ID NO: 7494759 - DNA, 22 bp, Homo sapiens
cacccaggctggagagcagtgg

SEQ ID NO: 7494760 - DNA, 22 bp, Homo sapiens
cacccaggctggagagcagtgg

SEQ ID NO: 7494761 - DNA, 22 bp, Homo sapiens
cacccaggctggagagcagtgg

SEQ ID NO: 7494762 - DNA, 22 bp, Homo sapiens
cacccaggctggagagcagtgg

SEQ ID NO: 7494763 - DNA, 22 bp, Homo sapiens
cacccaggctggagagcagtgg

SEQ ID NO: 7494764 - DNA, 22 bp, Homo sapiens
caccaggttccgggcagagctg

SEQ ID NO: 7494765 - DNA, 22 bp, Homo sapiens
caccaggttccgggcagagctg

SEQ ID NO: 7494766 - DNA, 22 bp, Homo sapiens
cacccaggctggagagcagtgg

SEQ ID NO: 7494767 - DNA, 22 bp, Homo sapiens
cacccaggctggaatgcagtgg

SEQ ID NO: 7494768 - DNA, 20 bp, Homo sapiens
agcaggtaaggcacagcagt

SEQ ID NO: 7494769 - DNA, 20 bp, Homo sapiens
agcaggtaaggcacagcagt

SEQ ID NO: 7494770 - DNA, 20 bp, Homo sapiens
agcaggtaaggcacagcagt

SEQ ID NO: 7494771 - DNA, 22 bp, Homo sapiens
caccaggtggaaatgtcacagc

SEQ ID NO: 7494772 - DNA, 22 bp, Homo sapiens
agcaggctccttccttctctgg

SEQ ID NO: 7494773 - DNA, 22 bp, Homo sapiens
agcaggctccttccttctctgg

SEQ ID NO: 7494774 - DNA, 22 bp, Homo sapiens
agcaggctccaggctggccatc

SEQ ID NO: 7494775 - DNA, 22 bp, Homo sapiens
agcaggctccaggctggccatc

SEQ ID NO: 7494776 - DNA, 22 bp, Homo sapiens
agcaggctccaggctggccatc

SEQ ID NO: 7494777 - DNA, 22 bp, Homo sapiens
cacagtttggttttgctgtaat

SEQ ID NO: 7494778 - DNA, 22 bp, Homo sapiens
agcaggctccaggctggccatc

SEQ ID NO: 7494779 - DNA, 22 bp, Homo sapiens
agcaggctgagcacccaggggg

SEQ ID NO: 7494780 - DNA, 22 bp, Homo sapiens
agcaggctgagcacccaggggg

SEQ ID NO: 7494781 - DNA, 22 bp, Homo sapiens
agcaggctgagcacccaggggg

SEQ ID NO: 7494782 - DNA, 22 bp, Homo sapiens
agcaggctccttccttctctgg

SEQ ID NO: 7494783 - DNA, 22 bp, Homo sapiens
agcaggctccttccttctctgg

SEQ ID NO: 7494784 - DNA, 22 bp, Homo sapiens
agcaggctccaggctggccatc

SEQ ID NO: 7494785 - DNA, 22 bp, Homo sapiens
agcaggctccttccttctctgg

SEQ ID NO: 7494786 - DNA, 22 bp, Homo sapiens
agcaggctccttccttctctgg

SEQ ID NO: 7494787 - DNA, 17 bp, Homo sapiens
agcaggctgcagaggcc

SEQ ID NO: 7494788 - DNA, 17 bp, Homo sapiens
agcaggctgcagaggcc

SEQ ID NO: 7494789 - DNA, 20 bp, Homo sapiens
agcaggctgcagggtgaaat

SEQ ID NO: 7494790 - DNA, 20 bp, Homo sapiens
agcaggctgcagggtgaaat

SEQ ID NO: 7494791 - DNA, 17 bp, Homo sapiens
agcaggctgcagaggcc

SEQ ID NO: 7494792 - DNA, 17 bp, Homo sapiens
agcaggctgcagaggcc

SEQ ID NO: 7494793 - DNA, 17 bp, Homo sapiens
agcaggctgcagaggcc

SEQ ID NO: 7494794 - DNA, 17 bp, Homo sapiens
agcaggctgcagaggcc

SEQ ID NO: 7494795 - DNA, 22 bp, Homo sapiens
agcaggctgatgggcatgcttg

SEQ ID NO: 7494796 - DNA, 22 bp, Homo sapiens
agcaggctgatgggcatgcttg

SEQ ID NO: 7494797 - DNA, 22 bp, Homo sapiens
agcaggctgatgggcatgcttg

SEQ ID NO: 7494798 - DNA, 22 bp, Homo sapiens
agcaggctgatgggcatgcttg

SEQ ID NO: 7494799 - DNA, 22 bp, Homo sapiens
agcaggctgatgggcatgcttg

SEQ ID NO: 7494800 - DNA, 22 bp, Homo sapiens
agcaggctgagcacccaggggg

SEQ ID NO: 7494801 - DNA, 22 bp, Homo sapiens
cacagtttgggtctccggggca

SEQ ID NO: 7494802 - DNA, 22 bp, Homo sapiens
cacagtttgggtctccggggca

SEQ ID NO: 7494803 - DNA, 22 bp, Homo sapiens
cacagtttgggtctccggggca

SEQ ID NO: 7494804 - DNA, 22 bp, Homo sapiens
cacagtttggtatagaagtgat

SEQ ID NO: 7494805 - DNA, 22 bp, Homo sapiens
cacagtttggtatagaagtgat

SEQ ID NO: 7494806 - DNA, 22 bp, Homo sapiens
cacagtttggtatagaagtgat

SEQ ID NO: 7494807 - DNA, 22 bp, Homo sapiens
cacagtttggtatagaagtgat

SEQ ID NO: 7494808 - DNA, 22 bp, Homo sapiens
cacagtttggtatagaagtgat

SEQ ID NO: 7494809 - DNA, 22 bp, Homo sapiens
cacagtttgcataggaaaaaca

SEQ ID NO: 7494810 - DNA, 22 bp, Homo sapiens
cacagtttctgaacactttgca

SEQ ID NO: 7494811 - DNA, 22 bp, Homo sapiens
cacagtttgcataggaaaaaca

SEQ ID NO: 7494812 - DNA, 22 bp, Homo sapiens
cacagtttgcataggaaaaaca

SEQ ID NO: 7494813 - DNA, 22 bp, Homo sapiens
cacagtttctataggtcagaat

SEQ ID NO: 7494814 - DNA, 22 bp, Homo sapiens
cacagtttctgaacactttgca

SEQ ID NO: 7494815 - DNA, 22 bp, Homo sapiens
cacagtttctataggtcagaat

SEQ ID NO: 7494816 - DNA, 22 bp, Homo sapiens
cacagtttctataggtcagaat

SEQ ID NO: 7494817 - DNA, 22 bp, Homo sapiens
cacagtttctataggtcagaat

SEQ ID NO: 7494818 - DNA, 22 bp, Homo sapiens
cacagtttctataggtcagaat

SEQ ID NO: 7494819 - DNA, 22 bp, Homo sapiens
cacagtttcaataattattctt

SEQ ID NO: 7494820 - DNA, 22 bp, Homo sapiens
cacagtttcaataattattctt

SEQ ID NO: 7494821 - DNA, 22 bp, Homo sapiens
cacagtttatgatctcagtgaa

SEQ ID NO: 7494822 - DNA, 22 bp, Homo sapiens
cacagtttatgatctcagtgaa

SEQ ID NO: 7494823 - DNA, 22 bp, Homo sapiens
cacagttgtttgttcataagaa

SEQ ID NO: 7494824 - DNA, 22 bp, Homo sapiens
cacagttgttcatattttccca

SEQ ID NO: 7494825 - DNA, 22 bp, Homo sapiens
cacagttgaggtctggttgttt

SEQ ID NO: 7494826 - DNA, 22 bp, Homo sapiens
cacagttgaggtctggttgttt

SEQ ID NO: 7494827 - DNA, 22 bp, Homo sapiens
cacagttcctgaatatatcaca

SEQ ID NO: 7494828 - DNA, 22 bp, Homo sapiens
cacagttgtctgatttcttcct

SEQ ID NO: 7494829 - DNA, 22 bp, Homo sapiens
cacagttgtctgatttcttcct

SEQ ID NO: 7494830 - DNA, 22 bp, Homo sapiens
cacagttatgggaaacgtagtt

SEQ ID NO: 7494831 - DNA, 22 bp, Homo sapiens
cacagttatatgttcacaagga

SEQ ID NO: 7494832 - DNA, 22 bp, Homo sapiens
cacagttcctgaatatatcaca

SEQ ID NO: 7494833 - DNA, 22 bp, Homo sapiens
agcaggcagctgggggagttga

SEQ ID NO: 7494834 - DNA, 22 bp, Homo sapiens
agcaggcagcctaggaagtgaa

SEQ ID NO: 7494835 - DNA, 22 bp, Homo sapiens
agcaggcagcctaggaagtgaa

SEQ ID NO: 7494836 - DNA, 22 bp, Homo sapiens
agcaggcagcctaggaagtgaa

SEQ ID NO: 7494837 - DNA, 22 bp, Homo sapiens
agcaggcagcctaggaagtgaa

SEQ ID NO: 7494838 - DNA, 22 bp, Homo sapiens
agcaggcagcctaggaagtgaa

SEQ ID NO: 7494839 - DNA, 22 bp, Homo sapiens
agcaggcagcctaggaagtgaa

SEQ ID NO: 7494840 - DNA, 22 bp, Homo sapiens
agcaggcagcctaggaagtgaa

SEQ ID NO: 7494841 - DNA, 22 bp, Homo sapiens
agcaggcagctgggggagttga

SEQ ID NO: 7494842 - DNA, 22 bp, Homo sapiens
agcaggcagctgggggagttga

SEQ ID NO: 7494843 - DNA, 22 bp, Homo sapiens
agcaggcagctgggggagttga

SEQ ID NO: 7494844 - DNA, 22 bp, Homo sapiens
agcaggcaggaaggcagcactg

SEQ ID NO: 7494845 - DNA, 22 bp, Homo sapiens
agcaggcagctgggggagttga

SEQ ID NO: 7494846 - DNA, 22 bp, Homo sapiens
agcaggcaggaaggcagcactg

SEQ ID NO: 7494847 - DNA, 22 bp, Homo sapiens
agcaggcaggaaggcagcactg

SEQ ID NO: 7494848 - DNA, 22 bp, Homo sapiens
agcaggcaggaaggcagcactg

SEQ ID NO: 7494849 - DNA, 22 bp, Homo sapiens
agcaggcaggaaggcagcactg

SEQ ID NO: 7494850 - DNA, 22 bp, Homo sapiens
agcaggcagccatttggaaggc

SEQ ID NO: 7494851 - DNA, 22 bp, Homo sapiens
agcaggcagccatttggaaggc

SEQ ID NO: 7494852 - DNA, 22 bp, Homo sapiens
agcaggcagccatttggaaggc

SEQ ID NO: 7494853 - DNA, 22 bp, Homo sapiens
agcaggcagcatgggaccctcc

SEQ ID NO: 7494854 - DNA, 22 bp, Homo sapiens
agcaggcagcatgggaccctcc

SEQ ID NO: 7494855 - DNA, 22 bp, Homo sapiens
agcaggcacttcatagggttcc

SEQ ID NO: 7494856 - DNA, 22 bp, Homo sapiens
agcaggcacttcatagggttcc

SEQ ID NO: 7494857 - DNA, 22 bp, Homo sapiens
agcaggcacttcatagggttcc

SEQ ID NO: 7494858 - DNA, 22 bp, Homo sapiens
agcaggcagcatgggaccctcc

SEQ ID NO: 7494859 - DNA, 22 bp, Homo sapiens
agcaggcagcatgggaccctcc

SEQ ID NO: 7494860 - DNA, 22 bp, Homo sapiens
agcaggcactatgccaggatct

SEQ ID NO: 7494861 - DNA, 22 bp, Homo sapiens
agcaggcactatgccaggatct

SEQ ID NO: 7494862 - DNA, 22 bp, Homo sapiens
agcaggcactatgccaggatct

SEQ ID NO: 7494863 - DNA, 17 bp, Homo sapiens
agcaggcacgtcagcac

SEQ ID NO: 7494864 - DNA, 22 bp, Homo sapiens
agcaggcactatgccaggatct

SEQ ID NO: 7494865 - DNA, 22 bp, Homo sapiens
agcaggcactatgccaggatct

SEQ ID NO: 7494866 - DNA, 22 bp, Homo sapiens
agcaggcactatgccaggatct

SEQ ID NO: 7494867 - DNA, 22 bp, Homo sapiens
agcaggcaggaaggcagcactg

SEQ ID NO: 7494868 - DNA, 22 bp, Homo sapiens
agcaggcaggaaggcagcactg

SEQ ID NO: 7494869 - DNA, 22 bp, Homo sapiens
agcaggcaggaaggcagcactg

SEQ ID NO: 7494870 - DNA, 22 bp, Homo sapiens
agcaggcaggaaggcagcactg

SEQ ID NO: 7494871 - DNA, 22 bp, Homo sapiens
agcaggcaggaatggtggaaca

SEQ ID NO: 7494872 - DNA, 22 bp, Homo sapiens
agcaggcaggaatggtggaaca

SEQ ID NO: 7494873 - DNA, 22 bp, Homo sapiens
agcaggcaggaaggcagcactg

SEQ ID NO: 7494874 - DNA, 22 bp, Homo sapiens
agcaggcaggaatggtggaaca

SEQ ID NO: 7494875 - DNA, 22 bp, Homo sapiens
agcaggcaggaggctactaagg

SEQ ID NO: 7494876 - DNA, 22 bp, Homo sapiens
agcaggcaggaatggtggaaca

SEQ ID NO: 7494877 - DNA, 22 bp, Homo sapiens
agcaggcaggaggctactaagg

SEQ ID NO: 7494878 - DNA, 22 bp, Homo sapiens
agcaggcaggcccagcggctgg

SEQ ID NO: 7494879 - DNA, 22 bp, Homo sapiens
cacagtcccgtgcttaccatgt

SEQ ID NO: 7494880 - DNA, 22 bp, Homo sapiens
agcaggcaggaggctactaagg

SEQ ID NO: 7494881 - DNA, 22 bp, Homo sapiens
cacagtcctacagagatcagag

SEQ ID NO: 7494882 - DNA, 22 bp, Homo sapiens
cacagtcctacagagatcagag

SEQ ID NO: 7494883 - DNA, 22 bp, Homo sapiens
cacagtcctacagagatcagag

SEQ ID NO: 7494884 - DNA, 22 bp, Homo sapiens
cacagttaagggatgtcatgtt

SEQ ID NO: 7494885 - DNA, 22 bp, Homo sapiens
cacagttagaggtagagtccag

SEQ ID NO: 7494886 - DNA, 22 bp, Homo sapiens
cacagttagctccagtcttagc

SEQ ID NO: 7494887 - DNA, 22 bp, Homo sapiens
cacagttagctccagtcttagc

SEQ ID NO: 7494888 - DNA, 22 bp, Homo sapiens
cacagttagctccagtcttagc

SEQ ID NO: 7494889 - DNA, 22 bp, Homo sapiens
cacagttatatgttcacaagga

SEQ ID NO: 7494890 - DNA, 22 bp, Homo sapiens
cacagttatatgttcacaagga

SEQ ID NO: 7494891 - DNA, 22 bp, Homo sapiens
cacagtcctgccagagggcctt

SEQ ID NO: 7494892 - DNA, 22 bp, Homo sapiens
cacagtcctacagagatcagag

SEQ ID NO: 7494893 - DNA, 22 bp, Homo sapiens
cacagtcctgccagagggcctt

SEQ ID NO: 7494894 - DNA, 22 bp, Homo sapiens
cacagtgttccagagcagtggt

SEQ ID NO: 7494895 - DNA, 19 bp, Homo sapiens
cacagtcctatgtttatca

SEQ ID NO: 7494896 - DNA, 22 bp, Homo sapiens
agcaggcaaggtccgtgcctcg

SEQ ID NO: 7494897 - DNA, 22 bp, Homo sapiens
agcaggcaaggtccgtgcctcg

SEQ ID NO: 7494898 - DNA, 22 bp, Homo sapiens
agcaggcaagcgtgagttctct

SEQ ID NO: 7494899 - DNA, 22 bp, Homo sapiens
agcaggcaaggtccgtgcctcg

SEQ ID NO: 7494900 - DNA, 21 bp, Homo sapiens
agcaggcaaaggtgaagtctt

SEQ ID NO: 7494901 - DNA, 22 bp, Homo sapiens
agcaggcaagcgtgagttctct

SEQ ID NO: 7494902 - DNA, 21 bp, Homo sapiens
agcaggcaaaggtgaagtctt

SEQ ID NO: 7494903 - DNA, 22 bp, Homo sapiens
agcaggagtttgatgcttttat

SEQ ID NO: 7494904 - DNA, 22 bp, Homo sapiens
agcaggagtttgatgcttttat

SEQ ID NO: 7494905 - DNA, 23 bp, Homo sapiens
agcaggataattttattatgccc

SEQ ID NO: 7494906 - DNA, 21 bp, Homo sapiens
agcaggcaaaggtgaagtctt

SEQ ID NO: 7494907 - DNA, 21 bp, Homo sapiens
agcaggcaaaggtgaagtctt

SEQ ID NO: 7494908 - DNA, 21 bp, Homo sapiens
agcaggcaaaggtgaagtctt

SEQ ID NO: 7494909 - DNA, 22 bp, Homo sapiens
agcaggattttgaagtgcaagt

SEQ ID NO: 7494910 - DNA, 22 bp, Homo sapiens
agcaggattttgaagtgcaagt

SEQ ID NO: 7494911 - DNA, 22 bp, Homo sapiens
agcaggcaccagggctcgtcct

SEQ ID NO: 7494912 - DNA, 22 bp, Homo sapiens
agcaggcaccagggctcgtcct

SEQ ID NO: 7494913 - DNA, 22 bp, Homo sapiens
agcaggcaccagggctcgtcct

SEQ ID NO: 7494914 - DNA, 22 bp, Homo sapiens
agcaggcacaagaaagggaggt

SEQ ID NO: 7494915 - DNA, 22 bp, Homo sapiens
agcaggcacaagaaagggaggt

SEQ ID NO: 7494916 - DNA, 22 bp, Homo sapiens
agcaggcacaagaaagggaggt

SEQ ID NO: 7494917 - DNA, 22 bp, Homo sapiens
agcaggcaccagggctcgtcct

SEQ ID NO: 7494918 - DNA, 22 bp, Homo sapiens
agcaggcaccagggctcgtcct

SEQ ID NO: 7494919 - DNA, 22 bp, Homo sapiens
agcaggcacgctccctgcgcga

SEQ ID NO: 7494920 - DNA, 22 bp, Homo sapiens
agcaggcacgctccctgcgcga

SEQ ID NO: 7494921 - DNA, 22 bp, Homo sapiens
agcaggcacgctccctgcgcga

SEQ ID NO: 7494922 - DNA, 22 bp, Homo sapiens
agcaggcacgctccctgcgcga

SEQ ID NO: 7494923 - DNA, 17 bp, Homo sapiens
agcaggcacgtcagcac

SEQ ID NO: 7494924 - DNA, 17 bp, Homo sapiens
agcaggcacgtcagcac

SEQ ID NO: 7494925 - DNA, 17 bp, Homo sapiens
agcaggcacgtcagcac

SEQ ID NO: 7494926 - DNA, 22 bp, Homo sapiens
cacacacagttttgtattctgt

SEQ ID NO: 7494927 - DNA, 22 bp, Homo sapiens
cacacacagttttgtattctgt

SEQ ID NO: 7494928 - DNA, 22 bp, Homo sapiens
cacacaccaatcaaatgtcaga

SEQ ID NO: 7494929 - DNA, 22 bp, Homo sapiens
cacacaaatattctggaggcaa

SEQ ID NO: 7494930 - DNA, 22 bp, Homo sapiens
cacacacagttttgtattctgt

SEQ ID NO: 7494931 - DNA, 22 bp, Homo sapiens
cacacacagttttgtattctgt

SEQ ID NO: 7494932 - DNA, 22 bp, Homo sapiens
cacacacagttttgtattctgt

SEQ ID NO: 7494933 - DNA, 22 bp, Homo sapiens
cacacactcttcctggcaccta

SEQ ID NO: 7494934 - DNA, 22 bp, Homo sapiens
cacacaccaatcaaatgtcaga

SEQ ID NO: 7494935 - DNA, 22 bp, Homo sapiens
cacacaccaatcaaatgtcaga

SEQ ID NO: 7494936 - DNA, 22 bp, Homo sapiens
cacacactgacaccttatcttg

SEQ ID NO: 7494937 - DNA, 22 bp, Homo sapiens
cacacactgacaccttatcttg

SEQ ID NO: 7494938 - DNA, 22 bp, Homo sapiens
cacacactggagcaaggagatg

SEQ ID NO: 7494939 - DNA, 22 bp, Homo sapiens
cacacactggagcaaggagatg

SEQ ID NO: 7494940 - DNA, 22 bp, Homo sapiens
cacacactgacaccttatcttg

SEQ ID NO: 7494941 - DNA, 22 bp, Homo sapiens
agcaggagtgtcccctggctgt

SEQ ID NO: 7494942 - DNA, 22 bp, Homo sapiens
agcaggagtgtcccctggctgt

SEQ ID NO: 7494943 - DNA, 22 bp, Homo sapiens
agcaggagtgtcccctggctgt

SEQ ID NO: 7494944 - DNA, 22 bp, Homo sapiens
agcaggagtttgatgcttttat

SEQ ID NO: 7494945 - DNA, 22 bp, Homo sapiens
agcaggagcatttccatgattc

SEQ ID NO: 7494946 - DNA, 22 bp, Homo sapiens
agcaggagcccttatcaccagg

SEQ ID NO: 7494947 - DNA, 22 bp, Homo sapiens
agcaggagcccttatcaccagg

SEQ ID NO: 7494948 - DNA, 22 bp, Homo sapiens
agcaggagcccttatcaccagg

SEQ ID NO: 7494949 - DNA, 22 bp, Homo sapiens
cacacactgttaatgtaggagt

SEQ ID NO: 7494950 - DNA, 22 bp, Homo sapiens
agcaggagcatttccatgattc

SEQ ID NO: 7494951 - DNA, 22 bp, Homo sapiens
agcaggagcatttccatgattc

SEQ ID NO: 7494952 - DNA, 22 bp, Homo sapiens
agcaggagcatttccatgattc

SEQ ID NO: 7494953 - DNA, 22 bp, Homo sapiens
cacacagaaccgctcgccactt

SEQ ID NO: 7494954 - DNA, 22 bp, Homo sapiens
agcagctgcagagggctccccc

SEQ ID NO: 7494955 - DNA, 22 bp, Homo sapiens
agcagctgcagagggctccccc

SEQ ID NO: 7494956 - DNA, 22 bp, Homo sapiens
agcagctgcagagggctccccc

SEQ ID NO: 7494957 - DNA, 22 bp, Homo sapiens
agcagctgcagagggctccccc

SEQ ID NO: 7494958 - DNA, 22 bp, Homo sapiens
agcagctgcagggagggtctgc

SEQ ID NO: 7494959 - DNA, 22 bp, Homo sapiens
agcagctgcagggagggtctgc

SEQ ID NO: 7494960 - DNA, 22 bp, Homo sapiens
agcagctgcagggagggtctgc

SEQ ID NO: 7494961 - DNA, 22 bp, Homo sapiens
agcagctgcagagggctccccc

SEQ ID NO: 7494962 - DNA, 22 bp, Homo sapiens
agcagctgcagagggctccccc

SEQ ID NO: 7494963 - DNA, 22 bp, Homo sapiens
agcagctgcagagggctccccc

SEQ ID NO: 7494964 - DNA, 22 bp, Homo sapiens
agcagctgatggggaaggagtt

SEQ ID NO: 7494965 - DNA, 22 bp, Homo sapiens
agcagctgcagagggctccccc

SEQ ID NO: 7494966 - DNA, 22 bp, Homo sapiens
agcagctgcagggagggtctgc

SEQ ID NO: 7494967 - DNA, 22 bp, Homo sapiens
agcagctgcagggagggtctgc

SEQ ID NO: 7494968 - DNA, 22 bp, Homo sapiens
agcagctgcagggagggtctgc

SEQ ID NO: 7494969 - DNA, 21 bp, Homo sapiens
agcagctgcagtttctatctg

SEQ ID NO: 7494970 - DNA, 21 bp, Homo sapiens
agcagctgcagtttctatctg

SEQ ID NO: 7494971 - DNA, 22 bp, Homo sapiens
agcagctgcagggagggtctgc

SEQ ID NO: 7494972 - DNA, 22 bp, Homo sapiens
agcagctgcagggagggtctgc

SEQ ID NO: 7494973 - DNA, 22 bp, Homo sapiens
agcagctgatcaaagcacttat

SEQ ID NO: 7494974 - DNA, 22 bp, Homo sapiens
agcagctgatcaaagcacttat

SEQ ID NO: 7494975 - DNA, 22 bp, Homo sapiens
agcagctgatcaaagcacttat

SEQ ID NO: 7494976 - DNA, 22 bp, Homo sapiens
agcagctgatcaaagcacttat

SEQ ID NO: 7494977 - DNA, 22 bp, Homo sapiens
agcagctgagccccagctgtga

SEQ ID NO: 7494978 - DNA, 22 bp, Homo sapiens
agcagctgatcaaagcacttat

SEQ ID NO: 7494979 - DNA, 22 bp, Homo sapiens
agcagctgatcaaagcacttat

SEQ ID NO: 7494980 - DNA, 22 bp, Homo sapiens
agcagctgatggggaaggagtt

SEQ ID NO: 7494981 - DNA, 22 bp, Homo sapiens
agcagctgatcaaagcacttat

SEQ ID NO: 7494982 - DNA, 22 bp, Homo sapiens
agcagctgatggggaaggagtt

SEQ ID NO: 7494983 - DNA, 22 bp, Homo sapiens
agcagctgatggggaaggagtt

SEQ ID NO: 7494984 - DNA, 22 bp, Homo sapiens
agcagctgatggggaaggagtt

SEQ ID NO: 7494985 - DNA, 22 bp, Homo sapiens
agcagctgatggggaaggagtt

SEQ ID NO: 7494986 - DNA, 22 bp, Homo sapiens
agcagctgatggggaaggagtt

SEQ ID NO: 7494987 - DNA, 22 bp, Homo sapiens
agcagctgatggggaaggagtt

SEQ ID NO: 7494988 - DNA, 22 bp, Homo sapiens
agcagctgatggggaaggagtt

SEQ ID NO: 7494989 - DNA, 22 bp, Homo sapiens
agcagctgatggggaaggagtt

SEQ ID NO: 7494990 - DNA, 22 bp, Homo sapiens
agcagctgatggggaaggagtt

SEQ ID NO: 7494991 - DNA, 22 bp, Homo sapiens
agcagctgatggggaaggagtt

SEQ ID NO: 7494992 - DNA, 22 bp, Homo sapiens
agcagctgccagagagagttcc

SEQ ID NO: 7494993 - DNA, 22 bp, Homo sapiens
agcagctgccagagagagttcc

SEQ ID NO: 7494994 - DNA, 22 bp, Homo sapiens
agcagctgccagagagagttcc

SEQ ID NO: 7494995 - DNA, 22 bp, Homo sapiens
agcagctgccagagagagttcc

SEQ ID NO: 7494996 - DNA, 22 bp, Homo sapiens
agcagctgccagagagagttcc

SEQ ID NO: 7494997 - DNA, 22 bp, Homo sapiens
agcagctgctccacttgcttaa

SEQ ID NO: 7494998 - DNA, 22 bp, Homo sapiens
agcagctgccagagagagttcc

SEQ ID NO: 7494999 - DNA, 22 bp, Homo sapiens
agcagctgccagagagagttcc

SEQ ID NO: 7495000 - DNA, 22 bp, Homo sapiens
agcagctgccagagagagttcc

SEQ ID NO: 7495001 - DNA, 22 bp, Homo sapiens
agcagctgccagagagagttcc

SEQ ID NO: 7495002 - DNA, 22 bp, Homo sapiens
agcagctgccactggaatagga

SEQ ID NO: 7495003 - DNA, 22 bp, Homo sapiens
agcagctgccactggaatagga

SEQ ID NO: 7495004 - DNA, 22 bp, Homo sapiens
agcagctgccactggaatagga

SEQ ID NO: 7495005 - DNA, 22 bp, Homo sapiens
agcagctgccactggaatagga

SEQ ID NO: 7495006 - DNA, 22 bp, Homo sapiens
agcagctgccactggaatagga

SEQ ID NO: 7495007 - DNA, 22 bp, Homo sapiens
agcagctgccactggaatagga

SEQ ID NO: 7495008 - DNA, 22 bp, Homo sapiens
agcagctgccactggaatagga

SEQ ID NO: 7495009 - DNA, 22 bp, Homo sapiens
agcagctgccactggaatagga

SEQ ID NO: 7495010 - DNA, 21 bp, Homo sapiens
agcagctgcagtttctatctg

SEQ ID NO: 7495011 - DNA, 21 bp, Homo sapiens
agcagctgcagtttctatctg

SEQ ID NO: 7495012 - DNA, 21 bp, Homo sapiens
agcagctgcagtttctatctg

SEQ ID NO: 7495013 - DNA, 22 bp, Homo sapiens
agcagctgctccacttgcttaa

SEQ ID NO: 7495014 - DNA, 22 bp, Homo sapiens
cacaattttcctttaagtgtat

SEQ ID NO: 7495015 - DNA, 22 bp, Homo sapiens
agcagctgctccacttgcttaa

SEQ ID NO: 7495016 - DNA, 22 bp, Homo sapiens
cacaattttcctttaagtgtat

SEQ ID NO: 7495017 - DNA, 22 bp, Homo sapiens
cacacacagttttgtattctgt

SEQ ID NO: 7495018 - DNA, 22 bp, Homo sapiens
cacacacagttttgtattctgt

SEQ ID NO: 7495019 - DNA, 22 bp, Homo sapiens
cacacaaatattctggaggcaa

SEQ ID NO: 7495020 - DNA, 22 bp, Homo sapiens
cacacaaatattctggaggcaa

SEQ ID NO: 7495021 - DNA, 22 bp, Homo sapiens
cacacaaatattctggaggcaa

SEQ ID NO: 7495022 - DNA, 22 bp, Homo sapiens
cacacaaatattctggaggcaa

SEQ ID NO: 7495023 - DNA, 22 bp, Homo sapiens
cacacaaatattctggaggcaa

SEQ ID NO: 7495024 - DNA, 22 bp, Homo sapiens
cacacaaatattctggaggcaa

SEQ ID NO: 7495025 - DNA, 22 bp, Homo sapiens
cacacaattatgtgtgcacaat

SEQ ID NO: 7495026 - DNA, 22 bp, Homo sapiens
cacacaattatgtgtgcacaat

SEQ ID NO: 7495027 - DNA, 22 bp, Homo sapiens
aacttacaaggatgatagctgc

SEQ ID NO: 7495028 - DNA, 23 bp, Homo sapiens
aacttaatactgggataagatgc

SEQ ID NO: 7495029 - DNA, 23 bp, Homo sapiens
aacttaatactgggataagatgc

SEQ ID NO: 7495030 - DNA, 22 bp, Homo sapiens
aacttacaatgttagagtctca

SEQ ID NO: 7495031 - DNA, 22 bp, Homo sapiens
aacttacaaggatgatagctgc

SEQ ID NO: 7495032 - DNA, 22 bp, Homo sapiens
aacttacaaggatgatagctgc

SEQ ID NO: 7495033 - DNA, 22 bp, Homo sapiens
aacttacaaggatgatagctgc

SEQ ID NO: 7495034 - DNA, 22 bp, Homo sapiens
aacttaggaaaataaggcatga

SEQ ID NO: 7495035 - DNA, 22 bp, Homo sapiens
aacttaggaaaataaggcatga

SEQ ID NO: 7495036 - DNA, 22 bp, Homo sapiens
aacttaggaaaataaggcatga

SEQ ID NO: 7495037 - DNA, 22 bp, Homo sapiens
aacttagagctctcctaaatga

SEQ ID NO: 7495038 - DNA, 22 bp, Homo sapiens
aacttagacttgtttcttggta

SEQ ID NO: 7495039 - DNA, 22 bp, Homo sapiens
aacttaggaaaataaggcatga

SEQ ID NO: 7495040 - DNA, 22 bp, Homo sapiens
aacttaggaaaataaggcatga

SEQ ID NO: 7495041 - DNA, 22 bp, Homo sapiens
aacttaggaaaataaggcatga

SEQ ID NO: 7495042 - DNA, 22 bp, Homo sapiens
aacttagtacccaggcgttcgg

SEQ ID NO: 7495043 - DNA, 22 bp, Homo sapiens
aacttagtctttcaatttgata

SEQ ID NO: 7495044 - DNA, 22 bp, Homo sapiens
aacttagttaagattaagtctc

SEQ ID NO: 7495045 - DNA, 22 bp, Homo sapiens
aactgtttttcacgtgtctcat

SEQ ID NO: 7495046 - DNA, 22 bp, Homo sapiens
aacttaaacaagctcccaagtt

SEQ ID NO: 7495047 - DNA, 22 bp, Homo sapiens
aacttaaacaagctcccaagtt

SEQ ID NO: 7495048 - DNA, 22 bp, Homo sapiens
aacttaaacccactcatgtaga

SEQ ID NO: 7495049 - DNA, 22 bp, Homo sapiens
aacttaaacccactcatgtaga

SEQ ID NO: 7495050 - DNA, 22 bp, Homo sapiens
aacttaaacccactcatgtaga

SEQ ID NO: 7495051 - DNA, 22 bp, Homo sapiens
aacttaagtgtgaagagactct

SEQ ID NO: 7495052 - DNA, 22 bp, Homo sapiens
aacttaagaggttaagggcttg

SEQ ID NO: 7495053 - DNA, 22 bp, Homo sapiens
aacttaaacccactcatgtaga

SEQ ID NO: 7495054 - DNA, 22 bp, Homo sapiens
aacttaaacccactcatgtaga

SEQ ID NO: 7495055 - DNA, 22 bp, Homo sapiens
aacttaaacccactcatgtaga

SEQ ID NO: 7495056 - DNA, 22 bp, Homo sapiens
aacttaaacccactcatgtaga

SEQ ID NO: 7495057 - DNA, 22 bp, Homo sapiens
aactgtttggaactcttccaca

SEQ ID NO: 7495058 - DNA, 22 bp, Homo sapiens
aactgtttcagaaatattgttg

SEQ ID NO: 7495059 - DNA, 22 bp, Homo sapiens
aactgtttcagaaatattgttg

SEQ ID NO: 7495060 - DNA, 22 bp, Homo sapiens
aactgtttggaactcttccaca

SEQ ID NO: 7495061 - DNA, 22 bp, Homo sapiens
aactgtttggaactcttccaca

SEQ ID NO: 7495062 - DNA, 22 bp, Homo sapiens
aactgtttttcacgtgtctcat

SEQ ID NO: 7495063 - DNA, 22 bp, Homo sapiens
aactgtttatgtaagtatgcag

SEQ ID NO: 7495064 - DNA, 22 bp, Homo sapiens
aactgtttaccatacacagtga

SEQ ID NO: 7495065 - DNA, 22 bp, Homo sapiens
aactgtttaccatacacagtga

SEQ ID NO: 7495066 - DNA, 18 bp, Homo sapiens
aactgttgaaatagcttg

SEQ ID NO: 7495067 - DNA, 22 bp, Homo sapiens
aactgttgcttgtaatatgtgc

SEQ ID NO: 7495068 - DNA, 22 bp, Homo sapiens
aactgttggaggattattttgc

SEQ ID NO: 7495069 - DNA, 22 bp, Homo sapiens
aactgttggaggattattttgc

SEQ ID NO: 7495070 - DNA, 22 bp, Homo sapiens
aactgttggaggattattttgc

SEQ ID NO: 7495071 - DNA, 22 bp, Homo sapiens
aactgttgtcatatggtcttaa

SEQ ID NO: 7495072 - DNA, 22 bp, Homo sapiens
aactgttgtcatatggtcttaa

SEQ ID NO: 7495073 - DNA, 22 bp, Homo sapiens
aactgttacatagttatagatc

SEQ ID NO: 7495074 - DNA, 22 bp, Homo sapiens
aactgttccttaagatgttaat

SEQ ID NO: 7495075 - DNA, 22 bp, Homo sapiens
aactgttctacccttcatttca

SEQ ID NO: 7495076 - DNA, 22 bp, Homo sapiens
aactgttacatagttatagatc

SEQ ID NO: 7495077 - DNA, 22 bp, Homo sapiens
aactgttacatagttatagatc

SEQ ID NO: 7495078 - DNA, 22 bp, Homo sapiens
aactgttcttgtgtttgctatg

SEQ ID NO: 7495079 - DNA, 22 bp, Homo sapiens
aactgttcttcattttcagtat

SEQ ID NO: 7495080 - DNA, 22 bp, Homo sapiens
aactgttcttcattttcagtat

SEQ ID NO: 7495081 - DNA, 22 bp, Homo sapiens
aactggttctcttttgcttgtg

SEQ ID NO: 7495082 - DNA, 22 bp, Homo sapiens
aactggttctcttttgcttgtg

SEQ ID NO: 7495083 - DNA, 23 bp, Homo sapiens
aactggttgaaggctgttaattg

SEQ ID NO: 7495084 - DNA, 19 bp, Homo sapiens
aactgtaaagatctgtagc

SEQ ID NO: 7495085 - DNA, 19 bp, Homo sapiens
aactgtaaagatctgtagc

SEQ ID NO: 7495086 - DNA, 19 bp, Homo sapiens
aactgtaaagatctgtagc

SEQ ID NO: 7495087 - DNA, 22 bp, Homo sapiens
aactgtgtgttttgctattagt

SEQ ID NO: 7495088 - DNA, 22 bp, Homo sapiens
aactgtgtgttttgctattagt

SEQ ID NO: 7495089 - DNA, 22 bp, Homo sapiens
aactgtgtggtatacctgtgat

SEQ ID NO: 7495090 - DNA, 19 bp, Homo sapiens
aactgtgtgtgatattgac

SEQ ID NO: 7495091 - DNA, 19 bp, Homo sapiens
aactgtaaagatctgtagc

SEQ ID NO: 7495092 - DNA, 19 bp, Homo sapiens
aactgtaaagatctgtagc

SEQ ID NO: 7495093 - DNA, 19 bp, Homo sapiens
aactgtaaagatctgtagc

SEQ ID NO: 7495094 - DNA, 22 bp, Homo sapiens
aactgcgattacttttgcacca

SEQ ID NO: 7495095 - DNA, 22 bp, Homo sapiens
aactgctaactggtttgatact

SEQ ID NO: 7495096 - DNA, 22 bp, Homo sapiens
aactgctaactggtttgatact

SEQ ID NO: 7495097 - DNA, 22 bp, Homo sapiens
aactgctaagcaaagaagcagg

SEQ ID NO: 7495098 - DNA, 22 bp, Homo sapiens
aactgctaagcaaagaagcagg

SEQ ID NO: 7495099 - DNA, 22 bp, Homo sapiens
aactgctagattgttattcaag

SEQ ID NO: 7495100 - DNA, 22 bp, Homo sapiens
aactgcctgtaaaatcttgggt

SEQ ID NO: 7495101 - DNA, 22 bp, Homo sapiens
aactgcctggccaggctgcaac

SEQ ID NO: 7495102 - DNA, 22 bp, Homo sapiens
aactgcctggccaggctgcaac

SEQ ID NO: 7495103 - DNA, 22 bp, Homo sapiens
aactgcctcaggtcatatatca

SEQ ID NO: 7495104 - DNA, 20 bp, Homo sapiens
aactgcctgcccagaggtgg

SEQ ID NO: 7495105 - DNA, 20 bp, Homo sapiens
aactgcctgcccagaggtgg

SEQ ID NO: 7495106 - DNA, 22 bp, Homo sapiens
aactgcatttgcataagtccat

SEQ ID NO: 7495107 - DNA, 22 bp, Homo sapiens
aactgctggggaggccaaactc

SEQ ID NO: 7495108 - DNA, 22 bp, Homo sapiens
aactgctctgcatgcaatggaa

SEQ ID NO: 7495109 - DNA, 22 bp, Homo sapiens
aactgctgacaagtgaccagtg

SEQ ID NO: 7495110 - DNA, 22 bp, Homo sapiens
aactgctcatttgagagtatgc

SEQ ID NO: 7495111 - DNA, 21 bp, Homo sapiens
aactgctggtcttttctgtct

SEQ ID NO: 7495112 - DNA, 22 bp, Homo sapiens
aactgcttagtgatggatgacc

SEQ ID NO: 7495113 - DNA, 22 bp, Homo sapiens
aactgcttcacttggcatttgg

SEQ ID NO: 7495114 - DNA, 22 bp, Homo sapiens
aactgcttatctttggtagatg

SEQ ID NO: 7495115 - DNA, 22 bp, Homo sapiens
aactgcttcttactgctgggca

SEQ ID NO: 7495116 - DNA, 22 bp, Homo sapiens
aatgatacaaagggttttattt

SEQ ID NO: 7495117 - DNA, 22 bp, Homo sapiens
aatgataagacatgagtagagg

SEQ ID NO: 7495118 - DNA, 22 bp, Homo sapiens
aatgataccaaacatgtagata

SEQ ID NO: 7495119 - DNA, 22 bp, Homo sapiens
aatgataccgccaatattacca

SEQ ID NO: 7495120 - DNA, 22 bp, Homo sapiens
aatgatacatatgtatcgttag

SEQ ID NO: 7495121 - DNA, 22 bp, Homo sapiens
aatgatacatatgtatcgttag

SEQ ID NO: 7495122 - DNA, 22 bp, Homo sapiens
aatgatacatatgtatcgttag

SEQ ID NO: 7495123 - DNA, 22 bp, Homo sapiens
aatgataccaaacatgtagata

SEQ ID NO: 7495124 - DNA, 22 bp, Homo sapiens
aatgatacatatgtatcgttag

SEQ ID NO: 7495125 - DNA, 22 bp, Homo sapiens
aatgatatagcagacatagcct

SEQ ID NO: 7495126 - DNA, 22 bp, Homo sapiens
aatgatatagcagacatagcct

SEQ ID NO: 7495127 - DNA, 22 bp, Homo sapiens
aatgatatagcagacatagcct

SEQ ID NO: 7495128 - DNA, 22 bp, Homo sapiens
aatgataccgccaatattacca

SEQ ID NO: 7495129 - DNA, 22 bp, Homo sapiens
aatgataccgccaatattacca

SEQ ID NO: 7495130 - DNA, 22 bp, Homo sapiens
aatgataccgccaatattacca

SEQ ID NO: 7495131 - DNA, 22 bp, Homo sapiens
aatgataccgccaatattacca

SEQ ID NO: 7495132 - DNA, 20 bp, Homo sapiens
aatgatcagcatagcaagga

SEQ ID NO: 7495133 - DNA, 22 bp, Homo sapiens
aatgatcactgcagttgatgag

SEQ ID NO: 7495134 - DNA, 22 bp, Homo sapiens
aatgatcattataaagtgctct

SEQ ID NO: 7495135 - DNA, 20 bp, Homo sapiens
aatgatcagcatagcaagga

SEQ ID NO: 7495136 - DNA, 20 bp, Homo sapiens
aatgatcagcatagcaagga

SEQ ID NO: 7495137 - DNA, 22 bp, Homo sapiens
aatgatcactgcagttgatgag

SEQ ID NO: 7495138 - DNA, 22 bp, Homo sapiens
aatgatcacctggtaaagagag

SEQ ID NO: 7495139 - DNA, 22 bp, Homo sapiens
aatgatcacctggtaaagagag

SEQ ID NO: 7495140 - DNA, 22 bp, Homo sapiens
aatgatcacctggtaaagagag

SEQ ID NO: 7495141 - DNA, 22 bp, Homo sapiens
aatgatatttattgaatagatg

SEQ ID NO: 7495142 - DNA, 22 bp, Homo sapiens
aatgatcattataaagtgctct

SEQ ID NO: 7495143 - DNA, 20 bp, Homo sapiens
aatgatcagcatagcaagga

SEQ ID NO: 7495144 - DNA, 22 bp, Homo sapiens
aatgatcattataaagtgctct

SEQ ID NO: 7495145 - DNA, 22 bp, Homo sapiens
aatgatcattataaagtgctct

SEQ ID NO: 7495146 - DNA, 22 bp, Homo sapiens
aatgatcattataaagtgctct

SEQ ID NO: 7495147 - DNA, 22 bp, Homo sapiens
aactggttatgttacctatgtc

SEQ ID NO: 7495148 - DNA, 21 bp, Homo sapiens
aactggttcaattcaactaga

SEQ ID NO: 7495149 - DNA, 21 bp, Homo sapiens
aatgatgaaagatgacagagt

SEQ ID NO: 7495150 - DNA, 22 bp, Homo sapiens
aatgatctactctcattatctc

SEQ ID NO: 7495151 - DNA, 22 bp, Homo sapiens
aatgatcctacacatggaattc

SEQ ID NO: 7495152 - DNA, 22 bp, Homo sapiens
aatgatatagcagacatagcct

SEQ ID NO: 7495153 - DNA, 22 bp, Homo sapiens
aatgatatagcagacatagcct

SEQ ID NO: 7495154 - DNA, 22 bp, Homo sapiens
aatgatatagcagacatagcct

SEQ ID NO: 7495155 - DNA, 22 bp, Homo sapiens
aatgatatgcaaattatcatca

SEQ ID NO: 7495156 - DNA, 22 bp, Homo sapiens
aatgatatgcaaattatcatca

SEQ ID NO: 7495157 - DNA, 22 bp, Homo sapiens
aatgatatgcaaattatcatca

SEQ ID NO: 7495158 - DNA, 22 bp, Homo sapiens
aatgatatttattgaatagatg

SEQ ID NO: 7495159 - DNA, 22 bp, Homo sapiens
aatgatatttattgaatagatg

SEQ ID NO: 7495160 - DNA, 22 bp, Homo sapiens
aatgatcacctggtaaagagag

SEQ ID NO: 7495161 - DNA, 22 bp, Homo sapiens
aatgatatttattgaatagatg

SEQ ID NO: 7495162 - DNA, 22 bp, Homo sapiens
aatgatatgcaaattatcatca

SEQ ID NO: 7495163 - DNA, 22 bp, Homo sapiens
aatgatatttattgaatagatg

SEQ ID NO: 7495164 - DNA, 22 bp, Homo sapiens
aatgatatgcaaattatcatca

SEQ ID NO: 7495165 - DNA, 22 bp, Homo sapiens
aactgaaacttaggaagtaatc

SEQ ID NO: 7495166 - DNA, 22 bp, Homo sapiens
aactgcaacttcgtaaagtgag

SEQ ID NO: 7495167 - DNA, 22 bp, Homo sapiens
aactgaaacgtatttttgagat

SEQ ID NO: 7495168 - DNA, 22 bp, Homo sapiens
aactgaaacttaggaagtaatc

SEQ ID NO: 7495169 - DNA, 22 bp, Homo sapiens
aatccacacatctggcatgtga

SEQ ID NO: 7495170 - DNA, 22 bp, Homo sapiens
aactgaaacgtatttttgagat

SEQ ID NO: 7495171 - DNA, 22 bp, Homo sapiens
aactgaaacggtgatcttttaa

SEQ ID NO: 7495172 - DNA, 23 bp, Homo sapiens
aactgcaaggttgctgggaagta

SEQ ID NO: 7495173 - DNA, 22 bp, Homo sapiens
aactgcaagtggggcttgtcat

SEQ ID NO: 7495174 - DNA, 22 bp, Homo sapiens
aactgcaagtggggcttgtcat

SEQ ID NO: 7495175 - DNA, 22 bp, Homo sapiens
aactgcaataacttgtgcacca

SEQ ID NO: 7495176 - DNA, 22 bp, Homo sapiens
aactgcaagctctttactgcta

SEQ ID NO: 7495177 - DNA, 22 bp, Homo sapiens
aactgcaagctctttactgcta

SEQ ID NO: 7495178 - DNA, 22 bp, Homo sapiens
aactgcaagctctttactgcta

SEQ ID NO: 7495179 - DNA, 23 bp, Homo sapiens
aactgcaaggttgctgggaagta

SEQ ID NO: 7495180 - DNA, 22 bp, Homo sapiens
aactgcaacttcgtaaagtgag

SEQ ID NO: 7495181 - DNA, 22 bp, Homo sapiens
aactgcaacttcgtaaagtgag

SEQ ID NO: 7495182 - DNA, 22 bp, Homo sapiens
aactgcaacttgtttgattctt

SEQ ID NO: 7495183 - DNA, 22 bp, Homo sapiens
aactgcaacttgtttgattctt

SEQ ID NO: 7495184 - DNA, 22 bp, Homo sapiens
aactgcaacttgtttgattctt

SEQ ID NO: 7495185 - DNA, 22 bp, Homo sapiens
aactgcaagagtaaatgtctag

SEQ ID NO: 7495186 - DNA, 22 bp, Homo sapiens
aactgcaagagtaaatgtctag

SEQ ID NO: 7495187 - DNA, 22 bp, Homo sapiens
aactgcaagagtaaatgtctag

SEQ ID NO: 7495188 - DNA, 22 bp, Homo sapiens
aactgcaagagtaaatgtctag

SEQ ID NO: 7495189 - DNA, 22 bp, Homo sapiens
aactgcaagagtaaatgtctag

SEQ ID NO: 7495190 - DNA, 22 bp, Homo sapiens
aactgcagttaacaagtcttca

SEQ ID NO: 7495191 - DNA, 22 bp, Homo sapiens
aactgcagttaacaagtcttca

SEQ ID NO: 7495192 - DNA, 22 bp, Homo sapiens
aactgcagttaacaagtcttca

SEQ ID NO: 7495193 - DNA, 22 bp, Homo sapiens
aactgcagttacctttgcacca

SEQ ID NO: 7495194 - DNA, 22 bp, Homo sapiens
aactgcagttacttttgcacca

SEQ ID NO: 7495195 - DNA, 22 bp, Homo sapiens
aactgcattagctaacgtgagt

SEQ ID NO: 7495196 - DNA, 22 bp, Homo sapiens
aactgcattcagaaagctcact

SEQ ID NO: 7495197 - DNA, 22 bp, Homo sapiens
aactgcattcagaaagctcact

SEQ ID NO: 7495198 - DNA, 22 bp, Homo sapiens
aactgcatttaacaaatactct

SEQ ID NO: 7495199 - DNA, 22 bp, Homo sapiens
aactgcagagaacatctgggtt

SEQ ID NO: 7495200 - DNA, 22 bp, Homo sapiens
aactgcaattacttttgcgcca

SEQ ID NO: 7495201 - DNA, 22 bp, Homo sapiens
aactgcactgttcttttctaca

SEQ ID NO: 7495202 - DNA, 22 bp, Homo sapiens
aactgcaattacttttgcacta

SEQ ID NO: 7495203 - DNA, 22 bp, Homo sapiens
aactgcaattacttttgcacta

SEQ ID NO: 7495204 - DNA, 22 bp, Homo sapiens
aactgcaattacttttgcacta

SEQ ID NO: 7495205 - DNA, 22 bp, Homo sapiens
aactgcaattacttttgcacta

SEQ ID NO: 7495206 - DNA, 22 bp, Homo sapiens
aactgcaattacttttgcgcca

SEQ ID NO: 7495207 - DNA, 22 bp, Homo sapiens
aactgcaattacttttgcacca

SEQ ID NO: 7495208 - DNA, 22 bp, Homo sapiens
aactgcaatcacttttgcacca

SEQ ID NO: 7495209 - DNA, 22 bp, Homo sapiens
aactgcaatcacttttgcacca

SEQ ID NO: 7495210 - DNA, 22 bp, Homo sapiens
aactgcaattacttttgcacca

SEQ ID NO: 7495211 - DNA, 22 bp, Homo sapiens
aactgcaattacttttgcacca

SEQ ID NO: 7495212 - DNA, 22 bp, Homo sapiens
aactgcaattacttttgcacca

SEQ ID NO: 7495213 - DNA, 22 bp, Homo sapiens
aactgcaatcacttttgcacca

SEQ ID NO: 7495214 - DNA, 22 bp, Homo sapiens
aactgcaatcacttttgcacca

SEQ ID NO: 7495215 - DNA, 22 bp, Homo sapiens
aactgcaataacttgtgcacca

SEQ ID NO: 7495216 - DNA, 22 bp, Homo sapiens
aatccacacatctggcatgtga

SEQ ID NO: 7495217 - DNA, 22 bp, Homo sapiens
aatcatgtttcagatgagtttt

SEQ ID NO: 7495218 - DNA, 22 bp, Homo sapiens
aatcatgtttacgtgacatgtc

SEQ ID NO: 7495219 - DNA, 22 bp, Homo sapiens
aatcattctcatgccagtttcc

SEQ ID NO: 7495220 - DNA, 22 bp, Homo sapiens
aatcattcttatttcacagcaa

SEQ ID NO: 7495221 - DNA, 22 bp, Homo sapiens
aatcattctcatgccagtttcc

SEQ ID NO: 7495222 - DNA, 22 bp, Homo sapiens
aatcattcttatttcacagcaa

SEQ ID NO: 7495223 - DNA, 22 bp, Homo sapiens
aatcattgagacaaattagctt

SEQ ID NO: 7495224 - DNA, 22 bp, Homo sapiens
aatcattgagacaaattagctt

SEQ ID NO: 7495225 - DNA, 22 bp, Homo sapiens
aatccaatcctactcagaaagt

SEQ ID NO: 7495226 - DNA, 22 bp, Homo sapiens
aatccaatcctactcagaaagt

SEQ ID NO: 7495227 - DNA, 22 bp, Homo sapiens
aatcatggcgtgtttagcttaa

SEQ ID NO: 7495228 - DNA, 22 bp, Homo sapiens
aatcatgacaggaatagaaggg

SEQ ID NO: 7495229 - DNA, 22 bp, Homo sapiens
aatcatgacaggaatagaaggg

SEQ ID NO: 7495230 - DNA, 22 bp, Homo sapiens
aatcatcttcatcttacacaga

SEQ ID NO: 7495231 - DNA, 22 bp, Homo sapiens
aatcatcttcatcttacacaga

SEQ ID NO: 7495232 - DNA, 22 bp, Homo sapiens
aatcatcttcatcttacacaga

SEQ ID NO: 7495233 - DNA, 22 bp, Homo sapiens
aatcatgaaatatcagttcttt

SEQ ID NO: 7495234 - DNA, 22 bp, Homo sapiens
aatcatcacgaacacaacagcg

SEQ ID NO: 7495235 - DNA, 22 bp, Homo sapiens
aatcatcacgaacacaacagcg

SEQ ID NO: 7495236 - DNA, 21 bp, Homo sapiens
aatcatacaaaacatgtcagg

SEQ ID NO: 7495237 - DNA, 21 bp, Homo sapiens
aatcatacaaaacatgtcagg

SEQ ID NO: 7495238 - DNA, 21 bp, Homo sapiens
aatcatacaaaacatgtcagg

SEQ ID NO: 7495239 - DNA, 21 bp, Homo sapiens
aatcatacaaaacatgtcagg

SEQ ID NO: 7495240 - DNA, 22 bp, Homo sapiens
aatcatcctgaagtcaataaag

SEQ ID NO: 7495241 - DNA, 22 bp, Homo sapiens
aatcatctccgaaaaaagagta

SEQ ID NO: 7495242 - DNA, 22 bp, Homo sapiens
aatcatctccgaaaaaagagta

SEQ ID NO: 7495243 - DNA, 22 bp, Homo sapiens
aactacattttacagaagatga

SEQ ID NO: 7495244 - DNA, 22 bp, Homo sapiens
aactacatcaccctatttctgt

SEQ ID NO: 7495245 - DNA, 22 bp, Homo sapiens
aactacattgtcctttctgaag

SEQ ID NO: 7495246 - DNA, 22 bp, Homo sapiens
aactacattttacagaagatga

SEQ ID NO: 7495247 - DNA, 22 bp, Homo sapiens
aactactaccacagtcaagaca

SEQ ID NO: 7495248 - DNA, 22 bp, Homo sapiens
aatcataattttgtgaatgtag

SEQ ID NO: 7495249 - DNA, 22 bp, Homo sapiens
aactacatagaaattagtattt

SEQ ID NO: 7495250 - DNA, 22 bp, Homo sapiens
aactacatcaccctatttctgt

SEQ ID NO: 7495251 - DNA, 22 bp, Homo sapiens
aactacatcaccctatttctgt

SEQ ID NO: 7495252 - DNA, 22 bp, Homo sapiens
aactacatcaccctatttctgt

SEQ ID NO: 7495253 - DNA, 22 bp, Homo sapiens
aactacagtgggcagaggcaat

SEQ ID NO: 7495254 - DNA, 22 bp, Homo sapiens
aactacatagaaattagtattt

SEQ ID NO: 7495255 - DNA, 22 bp, Homo sapiens
aactacatagaaattagtattt

SEQ ID NO: 7495256 - DNA, 22 bp, Homo sapiens
aactacatagaaattagtattt

SEQ ID NO: 7495257 - DNA, 22 bp, Homo sapiens
aactacatagaaattagtattt

SEQ ID NO: 7495258 - DNA, 22 bp, Homo sapiens
aactacagtagtttgcccttct

SEQ ID NO: 7495259 - DNA, 22 bp, Homo sapiens
aactacagtagtttgcccttct

SEQ ID NO: 7495260 - DNA, 22 bp, Homo sapiens
aactacagtatgtccaaagaat

SEQ ID NO: 7495261 - DNA, 22 bp, Homo sapiens
aactacagtatgtccaaagaat

SEQ ID NO: 7495262 - DNA, 22 bp, Homo sapiens
aactacagtgggcagaggcaat

SEQ ID NO: 7495263 - DNA, 22 bp, Homo sapiens
aactacagtatgtccaaagaat

SEQ ID NO: 7495264 - DNA, 22 bp, Homo sapiens
aactacagtgggcagaggcaat

SEQ ID NO: 7495265 - DNA, 22 bp, Homo sapiens
aactacagtgggcagaggcaat

SEQ ID NO: 7495266 - DNA, 21 bp, Homo sapiens
aactacagttgttccttcatt

SEQ ID NO: 7495267 - DNA, 22 bp, Homo sapiens
aactacagcatctatacaaata

SEQ ID NO: 7495268 - DNA, 22 bp, Homo sapiens
aactacagcatctatacaaata

SEQ ID NO: 7495269 - DNA, 22 bp, Homo sapiens
aactacagcatctatacaaata

SEQ ID NO: 7495270 - DNA, 22 bp, Homo sapiens
aactacagaatcatagaaaata

SEQ ID NO: 7495271 - DNA, 22 bp, Homo sapiens
aactacagcatctatacaaata

SEQ ID NO: 7495272 - DNA, 22 bp, Homo sapiens
aactacagcatctatacaaata

SEQ ID NO: 7495273 - DNA, 22 bp, Homo sapiens
aactacagcatctatacaaata

SEQ ID NO: 7495274 - DNA, 19 bp, Homo sapiens
aactacagcgcactgtcct

SEQ ID NO: 7495275 - DNA, 19 bp, Homo sapiens
aactacagcgcactgtcct

SEQ ID NO: 7495276 - DNA, 19 bp, Homo sapiens
aactacagcgcactgtcct

SEQ ID NO: 7495277 - DNA, 22 bp, Homo sapiens
aactacagctcttgtctttctg

SEQ ID NO: 7495278 - DNA, 22 bp, Homo sapiens
aactacagggggtggcaggcgg

SEQ ID NO: 7495279 - DNA, 22 bp, Homo sapiens
aactacagctcttgtctttctg

SEQ ID NO: 7495280 - DNA, 22 bp, Homo sapiens
aactacagctcttgtctttctg

SEQ ID NO: 7495281 - DNA, 22 bp, Homo sapiens
aactacagctcttgtctttctg

SEQ ID NO: 7495282 - DNA, 22 bp, Homo sapiens
aacgtcttctctccaagtaaat

SEQ ID NO: 7495283 - DNA, 22 bp, Homo sapiens
aacgtcttctctccaagtaaat

SEQ ID NO: 7495284 - DNA, 22 bp, Homo sapiens
aactacaatatgtatgtatgta

SEQ ID NO: 7495285 - DNA, 22 bp, Homo sapiens
aacgcccgtggttgccaaggta

SEQ ID NO: 7495286 - DNA, 22 bp, Homo sapiens
aacggctgtggctggcggcagc

SEQ ID NO: 7495287 - DNA, 22 bp, Homo sapiens
aacggctgtggctggcggcagc

SEQ ID NO: 7495288 - DNA, 22 bp, Homo sapiens
aacgtagaggaagtagttttca

SEQ ID NO: 7495289 - DNA, 22 bp, Homo sapiens
aactacaatatgtatgtatgta

SEQ ID NO: 7495290 - DNA, 22 bp, Homo sapiens
aactacaatatgtatgtatgta

SEQ ID NO: 7495291 - DNA, 22 bp, Homo sapiens
aactacagaaaaggtaagctct

SEQ ID NO: 7495292 - DNA, 22 bp, Homo sapiens
aactacagaaaaggtaagctct

SEQ ID NO: 7495293 - DNA, 22 bp, Homo sapiens
aactacagaaaaggtaagctct

SEQ ID NO: 7495294 - DNA, 22 bp, Homo sapiens
aactacagaaaaggtaagctct

SEQ ID NO: 7495295 - DNA, 22 bp, Homo sapiens
aactacagaatcatagaaaata

SEQ ID NO: 7495296 - DNA, 22 bp, Homo sapiens
aactacagaatcatagaaaata

SEQ ID NO: 7495297 - DNA, 22 bp, Homo sapiens
aactacagcatctatacaaata

SEQ ID NO: 7495298 - DNA, 22 bp, Homo sapiens
aactacagaatcatagaaaata

SEQ ID NO: 7495299 - DNA, 22 bp, Homo sapiens
aactacagaatcatagaaaata

SEQ ID NO: 7495300 - DNA, 22 bp, Homo sapiens
aatataacacagatggcctgtt

SEQ ID NO: 7495301 - DNA, 22 bp, Homo sapiens
aatataacacagatggcctgtt

SEQ ID NO: 7495302 - DNA, 22 bp, Homo sapiens
aatataatgctgttttatgcca

SEQ ID NO: 7495303 - DNA, 22 bp, Homo sapiens
aatataatgctgttttatgcca

SEQ ID NO: 7495304 - DNA, 22 bp, Homo sapiens
aatataaattcctgggcccagc

SEQ ID NO: 7495305 - DNA, 22 bp, Homo sapiens
aatataaattcctgggcccagc

SEQ ID NO: 7495306 - DNA, 22 bp, Homo sapiens
aatataaattcctgggcccagc

SEQ ID NO: 7495307 - DNA, 22 bp, Homo sapiens
aatataatgctgttttatgcca

SEQ ID NO: 7495308 - DNA, 22 bp, Homo sapiens
aatataatgctgttttatgcca

SEQ ID NO: 7495309 - DNA, 20 bp, Homo sapiens
aatataattctctgaattta

SEQ ID NO: 7495310 - DNA, 20 bp, Homo sapiens
aatataattctctgaattta

SEQ ID NO: 7495311 - DNA, 22 bp, Homo sapiens
aatataatgctgttttatgcca

SEQ ID NO: 7495312 - DNA, 22 bp, Homo sapiens
aatataatgctgttttatgcca

SEQ ID NO: 7495313 - DNA, 22 bp, Homo sapiens
aatataatgctgttttatgcca

SEQ ID NO: 7495314 - DNA, 22 bp, Homo sapiens
aatagtttgaatttatcagatg

SEQ ID NO: 7495315 - DNA, 22 bp, Homo sapiens
aatagtttgaatttatcagatg

SEQ ID NO: 7495316 - DNA, 22 bp, Homo sapiens
aatagtttgaatttatcagatg

SEQ ID NO: 7495317 - DNA, 22 bp, Homo sapiens
aatagttgtgaatcaggactag

SEQ ID NO: 7495318 - DNA, 22 bp, Homo sapiens
aatagttctagctcagaagctc

SEQ ID NO: 7495319 - DNA, 22 bp, Homo sapiens
aatagtttgaatttatcagatg

SEQ ID NO: 7495320 - DNA, 22 bp, Homo sapiens
aatagtttgaatttatcagatg

SEQ ID NO: 7495321 - DNA, 22 bp, Homo sapiens
aatagtttgaatttatcagatg

SEQ ID NO: 7495322 - DNA, 22 bp, Homo sapiens
aatagtttgaatttatcagatg

SEQ ID NO: 7495323 - DNA, 22 bp, Homo sapiens
aatagtttgaatttatcagatg

SEQ ID NO: 7495324 - DNA, 22 bp, Homo sapiens
aatagtttgaatttatcagatg

SEQ ID NO: 7495325 - DNA, 22 bp, Homo sapiens
aatataaattcctgggcccagc

SEQ ID NO: 7495326 - DNA, 22 bp, Homo sapiens
aatataaattcctgggcccagc

SEQ ID NO: 7495327 - DNA, 22 bp, Homo sapiens
aatataaattcctgggcccagc

SEQ ID NO: 7495328 - DNA, 22 bp, Homo sapiens
aatataaattcctgggcccagc

SEQ ID NO: 7495329 - DNA, 22 bp, Homo sapiens
aatataaattcctgggcccagc

SEQ ID NO: 7495330 - DNA, 22 bp, Homo sapiens
aatagttttataggtgggatta

SEQ ID NO: 7495331 - DNA, 22 bp, Homo sapiens
aatagttttataggtgggatta

SEQ ID NO: 7495332 - DNA, 22 bp, Homo sapiens
aatagtttgaatttatcagatg

SEQ ID NO: 7495333 - DNA, 22 bp, Homo sapiens
aatataaattcctgggcccagc

SEQ ID NO: 7495334 - DNA, 22 bp, Homo sapiens
aatataaattcctgggcccagc

SEQ ID NO: 7495335 - DNA, 22 bp, Homo sapiens
aatataaattcctgggcccagc

SEQ ID NO: 7495336 - DNA, 22 bp, Homo sapiens
aatagttttataggtgggatta

SEQ ID NO: 7495337 - DNA, 22 bp, Homo sapiens
aatagtgctgctgtggacatgg

SEQ ID NO: 7495338 - DNA, 22 bp, Homo sapiens
aatagtgcttacattatcatga

SEQ ID NO: 7495339 - DNA, 22 bp, Homo sapiens
aatagtgcttttgtacatagga

SEQ ID NO: 7495340 - DNA, 17 bp, Homo sapiens
aatagtgtattatacat

SEQ ID NO: 7495341 - DNA, 22 bp, Homo sapiens
aatagtgttgttcactcaggag

SEQ ID NO: 7495342 - DNA, 22 bp, Homo sapiens
aatagtgttgttcactcaggag

SEQ ID NO: 7495343 - DNA, 22 bp, Homo sapiens
aatagtgcttacattatcatga

SEQ ID NO: 7495344 - DNA, 22 bp, Homo sapiens
aatagtgtatttttcaaaatta

SEQ ID NO: 7495345 - DNA, 22 bp, Homo sapiens
aatagtgtatttttcaaaatta

SEQ ID NO: 7495346 - DNA, 22 bp, Homo sapiens
aatagttaagcaactttttcca

SEQ ID NO: 7495347 - DNA, 22 bp, Homo sapiens
aatagttaagcaactttttcca

SEQ ID NO: 7495348 - DNA, 22 bp, Homo sapiens
aatagttaagcaactttttcca

SEQ ID NO: 7495349 - DNA, 22 bp, Homo sapiens
aatagttagcttagttctgtat

SEQ ID NO: 7495350 - DNA, 22 bp, Homo sapiens
aatagttctagctcagaagctc

SEQ ID NO: 7495351 - DNA, 22 bp, Homo sapiens
aaccagaggggccctgcctggg

SEQ ID NO: 7495352 - DNA, 22 bp, Homo sapiens
aaccagaggcagcagtacctga

SEQ ID NO: 7495353 - DNA, 22 bp, Homo sapiens
aatagtctctcccacaccatcc

SEQ ID NO: 7495354 - DNA, 20 bp, Homo sapiens
aatagtgctatatattttgt

SEQ ID NO: 7495355 - DNA, 21 bp, Homo sapiens
aaccagaggcagaaaggggaa

SEQ ID NO: 7495356 - DNA, 21 bp, Homo sapiens
aaccagaggcagaaaggggaa

SEQ ID NO: 7495357 - DNA, 22 bp, Homo sapiens
aaccagaggcagcagtacctga

SEQ ID NO: 7495358 - DNA, 22 bp, Homo sapiens
aaccagaggcagcagtacctga

SEQ ID NO: 7495359 - DNA, 21 bp, Homo sapiens
aaccagagccaggctctcagc

SEQ ID NO: 7495360 - DNA, 22 bp, Homo sapiens
aaccagagaagaattatattgt

SEQ ID NO: 7495361 - DNA, 22 bp, Homo sapiens
aaccagagagtcttcttcattg

SEQ ID NO: 7495362 - DNA, 21 bp, Homo sapiens
aaccagagccaggctctcagc

SEQ ID NO: 7495363 - DNA, 21 bp, Homo sapiens
aaccagagccaggctctcagc

SEQ ID NO: 7495364 - DNA, 21 bp, Homo sapiens
aaccagagccaggctctcagc

SEQ ID NO: 7495365 - DNA, 21 bp, Homo sapiens
aaccagagccaggctctcagc

SEQ ID NO: 7495366 - DNA, 22 bp, Homo sapiens
aaccagagctttaaaaatctgt

SEQ ID NO: 7495367 - DNA, 22 bp, Homo sapiens
aaccagagctttaaaaatctgt

SEQ ID NO: 7495368 - DNA, 22 bp, Homo sapiens
aaccagagaaatggagtgataa

SEQ ID NO: 7495369 - DNA, 22 bp, Homo sapiens
aaccagagaaatggagtgataa

SEQ ID NO: 7495370 - DNA, 22 bp, Homo sapiens
aaccagagaagaattatattgt

SEQ ID NO: 7495371 - DNA, 22 bp, Homo sapiens
aaccacttatttaagctctgat

SEQ ID NO: 7495372 - DNA, 22 bp, Homo sapiens
aaccagaaggaatctgagctga

SEQ ID NO: 7495373 - DNA, 22 bp, Homo sapiens
aaccagaaggaatctgagctga

SEQ ID NO: 7495374 - DNA, 22 bp, Homo sapiens
aaccactggtctgaggtacaag

SEQ ID NO: 7495375 - DNA, 22 bp, Homo sapiens
aaccactggtctgaggtacaag

SEQ ID NO: 7495376 - DNA, 22 bp, Homo sapiens
aaccactggtctgaggtacaag

SEQ ID NO: 7495377 - DNA, 22 bp, Homo sapiens
aaccaccattctctcctcttcc

SEQ ID NO: 7495378 - DNA, 22 bp, Homo sapiens
aaccaccattctctcctcttcc

SEQ ID NO: 7495379 - DNA, 22 bp, Homo sapiens
aaccactggctctaacattttg

SEQ ID NO: 7495380 - DNA, 22 bp, Homo sapiens
aaccaccattctctcctcttcc

SEQ ID NO: 7495381 - DNA, 22 bp, Homo sapiens
aaccaccattctctcctcttcc

SEQ ID NO: 7495382 - DNA, 22 bp, Homo sapiens
aaccaccattctctcctcttcc

SEQ ID NO: 7495383 - DNA, 22 bp, Homo sapiens
aaccaccattctctcctcttcc

SEQ ID NO: 7495384 - DNA, 22 bp, Homo sapiens
aaccaccattctctcctcttcc

SEQ ID NO: 7495385 - DNA, 22 bp, Homo sapiens
aaccaccattctctcctcttcc

SEQ ID NO: 7495386 - DNA, 22 bp, Homo sapiens
aaccaccattctctcctcttcc

SEQ ID NO: 7495387 - DNA, 22 bp, Homo sapiens
aaccaccaccatctagttccaa

SEQ ID NO: 7495388 - DNA, 22 bp, Homo sapiens
aaccaccaccgtaatttaccca

SEQ ID NO: 7495389 - DNA, 22 bp, Homo sapiens
aaccacatggctcagtggacat

SEQ ID NO: 7495390 - DNA, 22 bp, Homo sapiens
aaccacatggctcagtggacat

SEQ ID NO: 7495391 - DNA, 22 bp, Homo sapiens
aaccacatggctcagtggacat

SEQ ID NO: 7495392 - DNA, 22 bp, Homo sapiens
aaccacatgaaaagagtaatat

SEQ ID NO: 7495393 - DNA, 21 bp, Homo sapiens
aaccacatggattagtcagag

SEQ ID NO: 7495394 - DNA, 22 bp, Homo sapiens
aaccaacataggaatgcagaga

SEQ ID NO: 7495395 - DNA, 22 bp, Homo sapiens
aaccaacataggaatgcagaga

SEQ ID NO: 7495396 - DNA, 22 bp, Homo sapiens
aaccaacataggaatgcagaga

SEQ ID NO: 7495397 - DNA, 22 bp, Homo sapiens
aaccaagagggttttccttgaa

SEQ ID NO: 7495398 - DNA, 22 bp, Homo sapiens
aaccaagagggttttccttgaa

SEQ ID NO: 7495399 - DNA, 22 bp, Homo sapiens
aaccaaggacagctagtgatgc

SEQ ID NO: 7495400 - DNA, 22 bp, Homo sapiens
aaccaagctcaatggtctgagt

SEQ ID NO: 7495401 - DNA, 22 bp, Homo sapiens
aaccaattaatagataggaaac

SEQ ID NO: 7495402 - DNA, 22 bp, Homo sapiens
aaccaatttaaatataaagact

SEQ ID NO: 7495403 - DNA, 22 bp, Homo sapiens
aaccaattaatagataggaaac

SEQ ID NO: 7495404 - DNA, 22 bp, Homo sapiens
aaccaagtttattccaagttac

SEQ ID NO: 7495405 - DNA, 22 bp, Homo sapiens
aaccaagtttattccaagttac

SEQ ID NO: 7495406 - DNA, 22 bp, Homo sapiens
aaccacatgaaaagagtaatat

SEQ ID NO: 7495407 - DNA, 22 bp, Homo sapiens
aaccacagagccccctcagatg

SEQ ID NO: 7495408 - DNA, 22 bp, Homo sapiens
aaccacagagccccctcagatg

SEQ ID NO: 7495409 - DNA, 22 bp, Homo sapiens
aaccacagacccagactagaga

SEQ ID NO: 7495410 - DNA, 22 bp, Homo sapiens
aaccacagacccagactagaga

SEQ ID NO: 7495411 - DNA, 22 bp, Homo sapiens
aaccacagagccccctcagatg

SEQ ID NO: 7495412 - DNA, 22 bp, Homo sapiens
aaccacagagccccctcagatg

SEQ ID NO: 7495413 - DNA, 22 bp, Homo sapiens
aaccacagacccagactagaga

SEQ ID NO: 7495414 - DNA, 22 bp, Homo sapiens
aaccacagacccagactagaga

SEQ ID NO: 7495415 - DNA, 22 bp, Homo sapiens
aaccacaacactaaatgctggt

SEQ ID NO: 7495416 - DNA, 22 bp, Homo sapiens
aaccacaacactaaatgctggt

SEQ ID NO: 7495417 - DNA, 22 bp, Homo sapiens
aaccacagacccagactagaga

SEQ ID NO: 7495418 - DNA, 22 bp, Homo sapiens
aaccacaacactaaatgctggt

SEQ ID NO: 7495419 - DNA, 22 bp, Homo sapiens
aaccaatttaaatataaagact

SEQ ID NO: 7495420 - DNA, 22 bp, Homo sapiens
aataacttcatcttcaggatag

SEQ ID NO: 7495421 - DNA, 22 bp, Homo sapiens
aataacttcatgtaacatttaa

SEQ ID NO: 7495422 - DNA, 22 bp, Homo sapiens
aataacttcatgtaacatttaa

SEQ ID NO: 7495423 - DNA, 22 bp, Homo sapiens
aataacttcatcttcaggatag

SEQ ID NO: 7495424 - DNA, 22 bp, Homo sapiens
aataacttcatgtaacatttaa

SEQ ID NO: 7495425 - DNA, 22 bp, Homo sapiens
aataacttcatgtaacatttaa

SEQ ID NO: 7495426 - DNA, 22 bp, Homo sapiens
aataacttcatgtaacatttaa

SEQ ID NO: 7495427 - DNA, 22 bp, Homo sapiens
aataacttcatcttcaggatag

SEQ ID NO: 7495428 - DNA, 22 bp, Homo sapiens
aataacttcatgtaacatttaa

SEQ ID NO: 7495429 - DNA, 22 bp, Homo sapiens
aataacttcatgtaacatttaa

SEQ ID NO: 7495430 - DNA, 22 bp, Homo sapiens
aataacttcatgtaacatttaa

SEQ ID NO: 7495431 - DNA, 22 bp, Homo sapiens
aataacttgaagatctcttcca

SEQ ID NO: 7495432 - DNA, 22 bp, Homo sapiens
aataacttgaagatctcttcca

SEQ ID NO: 7495433 - DNA, 22 bp, Homo sapiens
aataacttgaagatctcttcca

SEQ ID NO: 7495434 - DNA, 22 bp, Homo sapiens
aataacttgaagatctcttcca

SEQ ID NO: 7495435 - DNA, 22 bp, Homo sapiens
aataacttgtatggttattcca

SEQ ID NO: 7495436 - DNA, 22 bp, Homo sapiens
aataacttttaaaagaccctgg

SEQ ID NO: 7495437 - DNA, 22 bp, Homo sapiens
aataacttttaaaagaccctgg

SEQ ID NO: 7495438 - DNA, 22 bp, Homo sapiens
aataacttgtatggttattcca

SEQ ID NO: 7495439 - DNA, 22 bp, Homo sapiens
aataacttgtatggttattcca

SEQ ID NO: 7495440 - DNA, 22 bp, Homo sapiens
aataacttcagttcttacatta

SEQ ID NO: 7495441 - DNA, 22 bp, Homo sapiens
aataacttcatcttcaggatag

SEQ ID NO: 7495442 - DNA, 22 bp, Homo sapiens
aataacttcatcttcaggatag

SEQ ID NO: 7495443 - DNA, 22 bp, Homo sapiens
aataacttcagttcttacatta

SEQ ID NO: 7495444 - DNA, 22 bp, Homo sapiens
aataacttcagttcttacatta

SEQ ID NO: 7495445 - DNA, 22 bp, Homo sapiens
aacatgtaaatatcattgtact

SEQ ID NO: 7495446 - DNA, 22 bp, Homo sapiens
aacatgtaaatatcattgtact

SEQ ID NO: 7495447 - DNA, 22 bp, Homo sapiens
aataacttcagttcttacatta

SEQ ID NO: 7495448 - DNA, 22 bp, Homo sapiens
aacatggctcatgagagatttg

SEQ ID NO: 7495449 - DNA, 22 bp, Homo sapiens
aacatggaggcagacagacgtg

SEQ ID NO: 7495450 - DNA, 22 bp, Homo sapiens
aacatggaggcagacagacgtg

SEQ ID NO: 7495451 - DNA, 19 bp, Homo sapiens
aacatggaactggagaggg

SEQ ID NO: 7495452 - DNA, 19 bp, Homo sapiens
aacatggaactggagaggg

SEQ ID NO: 7495453 - DNA, 19 bp, Homo sapiens
aacatggaactggagaggg

SEQ ID NO: 7495454 - DNA, 19 bp, Homo sapiens
aacatggaactggagaggg

SEQ ID NO: 7495455 - DNA, 22 bp, Homo sapiens
aacatgctttgataaataaaag

SEQ ID NO: 7495456 - DNA, 22 bp, Homo sapiens
aacatgcttgcttagaatcagc

SEQ ID NO: 7495457 - DNA, 22 bp, Homo sapiens
aacatgctttgataaataaaag

SEQ ID NO: 7495458 - DNA, 22 bp, Homo sapiens
aataagaaagagtcagcttcag

SEQ ID NO: 7495459 - DNA, 22 bp, Homo sapiens
aataagaaagagtcagcttcag

SEQ ID NO: 7495460 - DNA, 22 bp, Homo sapiens
aataagaaagagtcagcttcag

SEQ ID NO: 7495461 - DNA, 22 bp, Homo sapiens
aataacttttaaaagaccctgg

SEQ ID NO: 7495462 - DNA, 22 bp, Homo sapiens
aataagaacaactaaggtttat

SEQ ID NO: 7495463 - DNA, 22 bp, Homo sapiens
aataagaacaactaaggtttat

SEQ ID NO: 7495464 - DNA, 22 bp, Homo sapiens
aataagaacaactaaggtttat

SEQ ID NO: 7495465 - DNA, 22 bp, Homo sapiens
aataagaacaactaaggtttat

SEQ ID NO: 7495466 - DNA, 22 bp, Homo sapiens
aataagaacaactaaggtttat

SEQ ID NO: 7495467 - DNA, 22 bp, Homo sapiens
aataagaaagagtcagcttcag

SEQ ID NO: 7495468 - DNA, 22 bp, Homo sapiens
aataagaaagagtcagcttcag

SEQ ID NO: 7495469 - DNA, 22 bp, Homo sapiens
aataagaactccatttactcgt

SEQ ID NO: 7495470 - DNA, 22 bp, Homo sapiens
aataagaactccatttactcgt

SEQ ID NO: 7495471 - DNA, 22 bp, Homo sapiens
aataagaactccatttactcgt

SEQ ID NO: 7495472 - DNA, 22 bp, Homo sapiens
aataagaacaactaaggtttat

SEQ ID NO: 7495473 - DNA, 22 bp, Homo sapiens
aataagaacaactaaggtttat

SEQ ID NO: 7495474 - DNA, 22 bp, Homo sapiens
aataagaactccatttactcgt

SEQ ID NO: 7495475 - DNA, 22 bp, Homo sapiens
aataagaactccatttactcgt

SEQ ID NO: 7495476 - DNA, 22 bp, Homo sapiens
aataagaactccatttactcgt

SEQ ID NO: 7495477 - DNA, 21 bp, Homo sapiens
aacatttcaggatccaaattg

SEQ ID NO: 7495478 - DNA, 21 bp, Homo sapiens
aacatttcaggatccaaattg

SEQ ID NO: 7495479 - DNA, 21 bp, Homo sapiens
aacatttcaggatccaaattg

SEQ ID NO: 7495480 - DNA, 22 bp, Homo sapiens
aacatttcataacttgactttt

SEQ ID NO: 7495481 - DNA, 22 bp, Homo sapiens
aacatttttaagaccaagtgct

SEQ ID NO: 7495482 - DNA, 22 bp, Homo sapiens
aacatttttaagaccaagtgct

SEQ ID NO: 7495483 - DNA, 22 bp, Homo sapiens
aacatttttaagaccaagtgct

SEQ ID NO: 7495484 - DNA, 21 bp, Homo sapiens
aacatttcaggatccaaattg

SEQ ID NO: 7495485 - DNA, 22 bp, Homo sapiens
aacatttcataacttgactttt

SEQ ID NO: 7495486 - DNA, 22 bp, Homo sapiens
aaccaaatggatggtaagaggg

SEQ ID NO: 7495487 - DNA, 22 bp, Homo sapiens
aaccaaaggaacctgattttct

SEQ ID NO: 7495488 - DNA, 22 bp, Homo sapiens
aaccaaatggatggtaagaggg

SEQ ID NO: 7495489 - DNA, 20 bp, Homo sapiens
aaccaacagaatcatgtctc

SEQ ID NO: 7495490 - DNA, 20 bp, Homo sapiens
aaccaacagaatcatgtctc

SEQ ID NO: 7495491 - DNA, 22 bp, Homo sapiens
aaccaacaggagtggggattgg

SEQ ID NO: 7495492 - DNA, 22 bp, Homo sapiens
aaccaacaggagtggggattgg

SEQ ID NO: 7495493 - DNA, 20 bp, Homo sapiens
aaccaacagaatcatgtctc

SEQ ID NO: 7495494 - DNA, 22 bp, Homo sapiens
aaccaaaggaacctgattttct

SEQ ID NO: 7495495 - DNA, 22 bp, Homo sapiens
aacatttttaagaccaagtgct

SEQ ID NO: 7495496 - DNA, 22 bp, Homo sapiens
aaccaaagaaaactgtggtgag

SEQ ID NO: 7495497 - DNA, 22 bp, Homo sapiens
aaccaaagaaaactgtggtgag

SEQ ID NO: 7495498 - DNA, 22 bp, Homo sapiens
aacatttttaagaccaagtgct

SEQ ID NO: 7495499 - DNA, 22 bp, Homo sapiens
aacatttttaagaccaagtgct

SEQ ID NO: 7495500 - DNA, 18 bp, Homo sapiens
aacatgcattagaactgc

SEQ ID NO: 7495501 - DNA, 18 bp, Homo sapiens
aacatgcattagaactgc

SEQ ID NO: 7495502 - DNA, 18 bp, Homo sapiens
aacatgcattagaactgc

SEQ ID NO: 7495503 - DNA, 22 bp, Homo sapiens
aacatgctatgtgtctgaatca

SEQ ID NO: 7495504 - DNA, 22 bp, Homo sapiens
aacatgcatttgtgggatggaa

SEQ ID NO: 7495505 - DNA, 22 bp, Homo sapiens
aacatgcatgttatttatcagt

SEQ ID NO: 7495506 - DNA, 22 bp, Homo sapiens
aacatgcatgaagaagttatat

SEQ ID NO: 7495507 - DNA, 22 bp, Homo sapiens
aacatgcatgaagaagttatat

SEQ ID NO: 7495508 - DNA, 22 bp, Homo sapiens
aacatgcatgaagaagttatat

SEQ ID NO: 7495509 - DNA, 22 bp, Homo sapiens
aacatgcatgaagaagttatat

SEQ ID NO: 7495510 - DNA, 22 bp, Homo sapiens
aacatgcatgaagaagttatat

SEQ ID NO: 7495511 - DNA, 18 bp, Homo sapiens
aacatgcattagaactgc

SEQ ID NO: 7495512 - DNA, 18 bp, Homo sapiens
aacatgcattagaactgc

SEQ ID NO: 7495513 - DNA, 18 bp, Homo sapiens
aacatgcattagaactgc

SEQ ID NO: 7495514 - DNA, 18 bp, Homo sapiens
aacatgcattagaactgc

SEQ ID NO: 7495515 - DNA, 22 bp, Homo sapiens
aacatgcatgttatttatcagt

SEQ ID NO: 7495516 - DNA, 22 bp, Homo sapiens
aacatgcatgttatttatcagt

SEQ ID NO: 7495517 - DNA, 22 bp, Homo sapiens
aacatgcatgttatttatcagt

SEQ ID NO: 7495518 - DNA, 22 bp, Homo sapiens
aacatgctctgtttcttggatg

SEQ ID NO: 7495519 - DNA, 22 bp, Homo sapiens
aacatgctcttcctggctagtc

SEQ ID NO: 7495520 - DNA, 22 bp, Homo sapiens
aacatgctctgtttcttggatg

SEQ ID NO: 7495521 - DNA, 22 bp, Homo sapiens
aacatgctctggattgctgtga

SEQ ID NO: 7495522 - DNA, 22 bp, Homo sapiens
aacatgctatgtgtctgaatca

SEQ ID NO: 7495523 - DNA, 22 bp, Homo sapiens
aacatgctgcctttctacgagt

SEQ ID NO: 7495524 - DNA, 22 bp, Homo sapiens
aacatgctgcctttctacgagt

SEQ ID NO: 7495525 - DNA, 22 bp, Homo sapiens
aacatgctgggtgtttttgatg

SEQ ID NO: 7495526 - DNA, 22 bp, Homo sapiens
aacatgcttgcttagaatcagc

SEQ ID NO: 7495527 - DNA, 22 bp, Homo sapiens
aacatgaaaagcccagagaggt

SEQ ID NO: 7495528 - DNA, 22 bp, Homo sapiens
aacagtaaaaatcatttagttg

SEQ ID NO: 7495529 - DNA, 22 bp, Homo sapiens
aacagtaaagacagaatttatc

SEQ ID NO: 7495530 - DNA, 22 bp, Homo sapiens
aacatgaaacccaaacagaata

SEQ ID NO: 7495531 - DNA, 22 bp, Homo sapiens
aacatgaaacccaaacagaata

SEQ ID NO: 7495532 - DNA, 22 bp, Homo sapiens
aacatgaaacccaaacagaata

SEQ ID NO: 7495533 - DNA, 22 bp, Homo sapiens
aacatgaaacccaaacagaata

SEQ ID NO: 7495534 - DNA, 22 bp, Homo sapiens
aacatgaaacccaaacagaata

SEQ ID NO: 7495535 - DNA, 22 bp, Homo sapiens
aacatgaaacccaaacagaata

SEQ ID NO: 7495536 - DNA, 22 bp, Homo sapiens
aacatgcacatcatagctcgtg

SEQ ID NO: 7495537 - DNA, 22 bp, Homo sapiens
aacatgcatgaagaagttatat

SEQ ID NO: 7495538 - DNA, 22 bp, Homo sapiens
aacatgcatataggtaaatgga

SEQ ID NO: 7495539 - DNA, 22 bp, Homo sapiens
aacatgcatataggtaaatgga

SEQ ID NO: 7495540 - DNA, 22 bp, Homo sapiens
aacatgcatataggtaaatgga

SEQ ID NO: 7495541 - DNA, 22 bp, Homo sapiens
aacatgcagattccccgggccc

SEQ ID NO: 7495542 - DNA, 22 bp, Homo sapiens
aacatgcaggttttagggttgc

SEQ ID NO: 7495543 - DNA, 22 bp, Homo sapiens
aacatgcaggttttagggttgc

SEQ ID NO: 7495544 - DNA, 22 bp, Homo sapiens
aacatgcagtgagccgatgagg

SEQ ID NO: 7495545 - DNA, 22 bp, Homo sapiens
aacagtaaaaatcatttagttg

SEQ ID NO: 7495546 - DNA, 22 bp, Homo sapiens
aacagtaaaaatcatttagttg

SEQ ID NO: 7495547 - DNA, 22 bp, Homo sapiens
aacagtaaaaatcatttagttg

SEQ ID NO: 7495548 - DNA, 22 bp, Homo sapiens
aacaggtagggttttccttaga

SEQ ID NO: 7495549 - DNA, 22 bp, Homo sapiens
aacaggggtgggtgctactgga

SEQ ID NO: 7495550 - DNA, 22 bp, Homo sapiens
aacaggggtgggtgctactgga

SEQ ID NO: 7495551 - DNA, 20 bp, Homo sapiens
aacagggggctgcagagggc

SEQ ID NO: 7495552 - DNA, 20 bp, Homo sapiens
aacagggggctgcagagggc

SEQ ID NO: 7495553 - DNA, 20 bp, Homo sapiens
aacagggggctgcagagggc

SEQ ID NO: 7495554 - DNA, 20 bp, Homo sapiens
aacagggggctgcagagggc

SEQ ID NO: 7495555 - DNA, 20 bp, Homo sapiens
aacagggggctgcagagggc

SEQ ID NO: 7495556 - DNA, 22 bp, Homo sapiens
aacaggggctggttgaaagagc

SEQ ID NO: 7495557 - DNA, 22 bp, Homo sapiens
aacaggggctggttgaaagagc

SEQ ID NO: 7495558 - DNA, 22 bp, Homo sapiens
aacaggggattagatagcaggc

SEQ ID NO: 7495559 - DNA, 22 bp, Homo sapiens
aacaggggattagatagcaggc

SEQ ID NO: 7495560 - DNA, 22 bp, Homo sapiens
aacaggggattagatagcaggc

SEQ ID NO: 7495561 - DNA, 22 bp, Homo sapiens
aacaggcaacagttgactctga

SEQ ID NO: 7495562 - DNA, 22 bp, Homo sapiens
aacaggcaatttaggactcttt

SEQ ID NO: 7495563 - DNA, 22 bp, Homo sapiens
aacaggcaaactgtgggatccc

SEQ ID NO: 7495564 - DNA, 22 bp, Homo sapiens
aacaggcaacagttgactctga

SEQ ID NO: 7495565 - DNA, 22 bp, Homo sapiens
aacaggcaatttaggactcttt

SEQ ID NO: 7495566 - DNA, 22 bp, Homo sapiens
aacaggcaatttaggactcttt

SEQ ID NO: 7495567 - DNA, 22 bp, Homo sapiens
aacaggcactaagcatgtgggg

SEQ ID NO: 7495568 - DNA, 22 bp, Homo sapiens
aacaggcactaagcatgtgggg

SEQ ID NO: 7495569 - DNA, 22 bp, Homo sapiens
aacaggcactaagcatgtgggg

SEQ ID NO: 7495570 - DNA, 22 bp, Homo sapiens
aacaggatgtcatttctcatgt

SEQ ID NO: 7495571 - DNA, 18 bp, Homo sapiens
aacaggatcctccacttc

SEQ ID NO: 7495572 - DNA, 22 bp, Homo sapiens
aacaggagtcattgtcattatt

SEQ ID NO: 7495573 - DNA, 22 bp, Homo sapiens
aacaggcaaactgtgggatccc

SEQ ID NO: 7495574 - DNA, 23 bp, Homo sapiens
aacaggatgtgcttcatcttttg

SEQ ID NO: 7495575 - DNA, 23 bp, Homo sapiens
aacaggatgtgcttcatcttttg

SEQ ID NO: 7495576 - DNA, 22 bp, Homo sapiens
aacaggcaacagttgactctga

SEQ ID NO: 7495577 - DNA, 22 bp, Homo sapiens
aacaggcaaactgtgggatccc

SEQ ID NO: 7495578 - DNA, 22 bp, Homo sapiens
aacaggcaaactgtgggatccc

SEQ ID NO: 7495579 - DNA, 22 bp, Homo sapiens
aacaggcaacagttgactctga

SEQ ID NO: 7495580 - DNA, 22 bp, Homo sapiens
aacaggcaacagttgactctga

SEQ ID NO: 7495581 - DNA, 22 bp, Homo sapiens
aacaggcaacagttgactctga

SEQ ID NO: 7495582 - DNA, 22 bp, Homo sapiens
aacaggaattgcaggcagatct

SEQ ID NO: 7495583 - DNA, 22 bp, Homo sapiens
aacaggaattgatgggagtcct

SEQ ID NO: 7495584 - DNA, 22 bp, Homo sapiens
aacaggaattgatgggagtcct

SEQ ID NO: 7495585 - DNA, 22 bp, Homo sapiens
aacaggaattgcaggcagatct

SEQ ID NO: 7495586 - DNA, 22 bp, Homo sapiens
aacaggaattgcaggcagatct

SEQ ID NO: 7495587 - DNA, 22 bp, Homo sapiens
aacaggaattgcaggcagatct

SEQ ID NO: 7495588 - DNA, 22 bp, Homo sapiens
aacaggaattgcaggcagatct

SEQ ID NO: 7495589 - DNA, 22 bp, Homo sapiens
aacaggagaggggaatgtagag

SEQ ID NO: 7495590 - DNA, 22 bp, Homo sapiens
aacaggaccttccaatccatca

SEQ ID NO: 7495591 - DNA, 22 bp, Homo sapiens
aacaggaccttccaatccatca

SEQ ID NO: 7495592 - DNA, 22 bp, Homo sapiens
aacaggaccccgcgtggtgtct

SEQ ID NO: 7495593 - DNA, 22 bp, Homo sapiens
aacaggaattgatgggagtcct

SEQ ID NO: 7495594 - DNA, 22 bp, Homo sapiens
aacaggacactgggatggctac

SEQ ID NO: 7495595 - DNA, 22 bp, Homo sapiens
aacaggaggccttccagtccag

SEQ ID NO: 7495596 - DNA, 22 bp, Homo sapiens
aacaggaggccttccagtccag

SEQ ID NO: 7495597 - DNA, 22 bp, Homo sapiens
aacaggaggccttccagtccag

SEQ ID NO: 7495598 - DNA, 22 bp, Homo sapiens
aacaggagtcattgtcattatt

SEQ ID NO: 7495599 - DNA, 22 bp, Homo sapiens
aacaggagtcattgtcattatt

SEQ ID NO: 7495600 - DNA, 22 bp, Homo sapiens
aacaggagtcattgtcattatt

SEQ ID NO: 7495601 - DNA, 22 bp, Homo sapiens
aacaggagagtaaatatatgat

SEQ ID NO: 7495602 - DNA, 22 bp, Homo sapiens
aacaggagagtaaatatatgat

SEQ ID NO: 7495603 - DNA, 22 bp, Homo sapiens
aacaggagaggggaatgtagag

SEQ ID NO: 7495604 - DNA, 22 bp, Homo sapiens
aacaggagagtaaatatatgat

SEQ ID NO: 7495605 - DNA, 22 bp, Homo sapiens
aacaggaggccttccagtccag

SEQ ID NO: 7495606 - DNA, 22 bp, Homo sapiens
aacagggctttggaagtctccg

SEQ ID NO: 7495607 - DNA, 20 bp, Homo sapiens
aacagggcagaagcggagac

SEQ ID NO: 7495608 - DNA, 20 bp, Homo sapiens
aacagggcagaagcggagac

SEQ ID NO: 7495609 - DNA, 22 bp, Homo sapiens
aacaggcttttggaaagttaca

SEQ ID NO: 7495610 - DNA, 22 bp, Homo sapiens
aacaggcttttggaaagttaca

SEQ ID NO: 7495611 - DNA, 22 bp, Homo sapiens
aacaggcttttggaaagttaca

SEQ ID NO: 7495612 - DNA, 22 bp, Homo sapiens
aacagggacaaggatagagaaa

SEQ ID NO: 7495613 - DNA, 22 bp, Homo sapiens
aacagggacaaggatagagaaa

SEQ ID NO: 7495614 - DNA, 22 bp, Homo sapiens
aacagggacaaggatagagaaa

SEQ ID NO: 7495615 - DNA, 22 bp, Homo sapiens
aacagggacaaggatagagaaa

SEQ ID NO: 7495616 - DNA, 22 bp, Homo sapiens
aacaggcttccaggagggacga

SEQ ID NO: 7495617 - DNA, 22 bp, Homo sapiens
aacaggctggccttgaagcagt

SEQ ID NO: 7495618 - DNA, 22 bp, Homo sapiens
aacaggcttccaggagggacga

SEQ ID NO: 7495619 - DNA, 22 bp, Homo sapiens
aacaggcttccaggagggacga

SEQ ID NO: 7495620 - DNA, 22 bp, Homo sapiens
aacaggcttcttctgggctcct

SEQ ID NO: 7495621 - DNA, 22 bp, Homo sapiens
aacaggctggccttgaagcagt

SEQ ID NO: 7495622 - DNA, 22 bp, Homo sapiens
aacaggctggccttgaagcagt

SEQ ID NO: 7495623 - DNA, 22 bp, Homo sapiens
aacaggctcttcatttccagag

SEQ ID NO: 7495624 - DNA, 22 bp, Homo sapiens
aacaggctccatgaacaacgtg

SEQ ID NO: 7495625 - DNA, 22 bp, Homo sapiens
aacaggctaagtatttggtagc

SEQ ID NO: 7495626 - DNA, 22 bp, Homo sapiens
aacaggcctcattccagctctc

SEQ ID NO: 7495627 - DNA, 22 bp, Homo sapiens
aacaggctaaattgtccatttc

SEQ ID NO: 7495628 - DNA, 22 bp, Homo sapiens
aacaggcctatagggaaggcgc

SEQ ID NO: 7495629 - DNA, 22 bp, Homo sapiens
aacaggcctatggtttattcat

SEQ ID NO: 7495630 - DNA, 22 bp, Homo sapiens
aacaggcctatggtttattcat

SEQ ID NO: 7495631 - DNA, 22 bp, Homo sapiens
aacaggccttgtttttgttcat

SEQ ID NO: 7495632 - DNA, 22 bp, Homo sapiens
aacaggccttgtttttgttcat

SEQ ID NO: 7495633 - DNA, 22 bp, Homo sapiens
aacaggctcactctgacttcta

SEQ ID NO: 7495634 - DNA, 22 bp, Homo sapiens
aacaggctagttttaaagcata

SEQ ID NO: 7495635 - DNA, 22 bp, Homo sapiens
aacaggctagttttaaagcata

SEQ ID NO: 7495636 - DNA, 22 bp, Homo sapiens
aacaggctagttttaaagcata

SEQ ID NO: 7495637 - DNA, 22 bp, Homo sapiens
aacaggcagcagactgaatctg

SEQ ID NO: 7495638 - DNA, 22 bp, Homo sapiens
aacaggcactaagcatgtgggg

SEQ ID NO: 7495639 - DNA, 22 bp, Homo sapiens
aacaggcagcagactgaatctg

SEQ ID NO: 7495640 - DNA, 22 bp, Homo sapiens
aacaggcctatagggaaggcgc

SEQ ID NO: 7495641 - DNA, 22 bp, Homo sapiens
aacaggccctaggaattgggcc

SEQ ID NO: 7495642 - DNA, 22 bp, Homo sapiens
aacaggccctgccatttatcca

SEQ ID NO: 7495643 - DNA, 22 bp, Homo sapiens
aacaggccctgccatttatcca

SEQ ID NO: 7495644 - DNA, 22 bp, Homo sapiens
aacaggcaggagaattctgcct

SEQ ID NO: 7495645 - DNA, 22 bp, Homo sapiens
aacaaagatgggtgggaaagag

SEQ ID NO: 7495646 - DNA, 22 bp, Homo sapiens
aacaaagatgggtgggaaagag

SEQ ID NO: 7495647 - DNA, 22 bp, Homo sapiens
aacaaagaagactggttatttt

SEQ ID NO: 7495648 - DNA, 22 bp, Homo sapiens
aacaaagatgggtgggaaagag

SEQ ID NO: 7495649 - DNA, 22 bp, Homo sapiens
aacaaagatgggtgggaaagag

SEQ ID NO: 7495650 - DNA, 22 bp, Homo sapiens
aacaaagatgggtgggaaagag

SEQ ID NO: 7495651 - DNA, 22 bp, Homo sapiens
aacaaagcaccactgagtcagt

SEQ ID NO: 7495652 - DNA, 22 bp, Homo sapiens
aacaaagcaccactgagtcagt

SEQ ID NO: 7495653 - DNA, 22 bp, Homo sapiens
aacaaagatgggtgggaaagag

SEQ ID NO: 7495654 - DNA, 20 bp, Homo sapiens
aacaaactacaaaattatgt

SEQ ID NO: 7495655 - DNA, 22 bp, Homo sapiens
aacaaactcaaatggaagagtg

SEQ ID NO: 7495656 - DNA, 20 bp, Homo sapiens
aacaaactacaaaattatgt

SEQ ID NO: 7495657 - DNA, 22 bp, Homo sapiens
aacaaactcaaatggaagagtg

SEQ ID NO: 7495658 - DNA, 22 bp, Homo sapiens
aacaaactcaaatggaagagtg

SEQ ID NO: 7495659 - DNA, 22 bp, Homo sapiens
aacaaagaagactggttatttt

SEQ ID NO: 7495660 - DNA, 22 bp, Homo sapiens
aacaaagaagactggttatttt

SEQ ID NO: 7495661 - DNA, 22 bp, Homo sapiens
aacaaagaagactggttatttt

SEQ ID NO: 7495662 - DNA, 22 bp, Homo sapiens
aacaaagtacttttcagtgctt

SEQ ID NO: 7495663 - DNA, 22 bp, Homo sapiens
aacaaagtacttttcagtgctt

SEQ ID NO: 7495664 - DNA, 22 bp, Homo sapiens
aacaaagtacttttcagtgctt

SEQ ID NO: 7495665 - DNA, 21 bp, Homo sapiens
aacaaagggatgctcatcttt

SEQ ID NO: 7495666 - DNA, 21 bp, Homo sapiens
aacaaagggatgctcatcttt

SEQ ID NO: 7495667 - DNA, 22 bp, Homo sapiens
aacaaaggccgttaataaccac

SEQ ID NO: 7495668 - DNA, 21 bp, Homo sapiens
aacaaagggatgctcatcttt

SEQ ID NO: 7495669 - DNA, 22 bp, Homo sapiens
aacaaaggccgttaataaccac

SEQ ID NO: 7495670 - DNA, 22 bp, Homo sapiens
aacaaagcaccactgagtcagt

SEQ ID NO: 7495671 - DNA, 22 bp, Homo sapiens
aacaaagccctgcccaagagct

SEQ ID NO: 7495672 - DNA, 22 bp, Homo sapiens
aacaaagccctgcccaagagct

SEQ ID NO: 7495673 - DNA, 22 bp, Homo sapiens
aacaaagtagctgctgttctta

SEQ ID NO: 7495674 - DNA, 22 bp, Homo sapiens
aacaaagtagctgctgttctta

SEQ ID NO: 7495675 - DNA, 22 bp, Homo sapiens
aacaaagtagctgctgttctta

SEQ ID NO: 7495676 - DNA, 22 bp, Homo sapiens
aacaaagtacttttcagtgctt

SEQ ID NO: 7495677 - DNA, 22 bp, Homo sapiens
aacaaagtacttttcagtgctt

SEQ ID NO: 7495678 - DNA, 22 bp, Homo sapiens
aacaaagtcgttgcctagaaga

SEQ ID NO: 7495679 - DNA, 22 bp, Homo sapiens
aacaaagtcgttgcctagaaga

SEQ ID NO: 7495680 - DNA, 22 bp, Homo sapiens
aacaaagtcgttgcctagaaga

SEQ ID NO: 7495681 - DNA, 22 bp, Homo sapiens
aacaaagtcgttgcctagaaga

SEQ ID NO: 7495682 - DNA, 22 bp, Homo sapiens
aacaaagtagctgctgttctta

SEQ ID NO: 7495683 - DNA, 22 bp, Homo sapiens
aacaaacagttaagtgtggatg

SEQ ID NO: 7495684 - DNA, 22 bp, Homo sapiens
aacaaacagttaagtgtggatg

SEQ ID NO: 7495685 - DNA, 22 bp, Homo sapiens
aacaaacagttaagtgtggatg

SEQ ID NO: 7495686 - DNA, 22 bp, Homo sapiens
aacaaacagttaagtgtggatg

SEQ ID NO: 7495687 - DNA, 22 bp, Homo sapiens
aacaaacagttaagtgtggatg

SEQ ID NO: 7495688 - DNA, 22 bp, Homo sapiens
aaattttagactcctgggtcta

SEQ ID NO: 7495689 - DNA, 22 bp, Homo sapiens
aaattttagaccaggcaaaact

SEQ ID NO: 7495690 - DNA, 22 bp, Homo sapiens
aaattttagaccaggcaaaact

SEQ ID NO: 7495691 - DNA, 22 bp, Homo sapiens
aaattttagaccaggcaaaact

SEQ ID NO: 7495692 - DNA, 22 bp, Homo sapiens
aaattgcattcaggatgcagga

SEQ ID NO: 7495693 - DNA, 22 bp, Homo sapiens
aaattgcattcaggatgcagga

SEQ ID NO: 7495694 - DNA, 22 bp, Homo sapiens
aaattgcattcaggatgcagga

SEQ ID NO: 7495695 - DNA, 22 bp, Homo sapiens
aaattgcaggtaggtgggtgat

SEQ ID NO: 7495696 - DNA, 22 bp, Homo sapiens
aaattgcattgagctgcttatt

SEQ ID NO: 7495697 - DNA, 22 bp, Homo sapiens
aaattgcattgagctgcttatt

SEQ ID NO: 7495698 - DNA, 22 bp, Homo sapiens
aaattgcattcttgtcttgata

SEQ ID NO: 7495699 - DNA, 22 bp, Homo sapiens
aaattttagaccaggcaaaact

SEQ ID NO: 7495700 - DNA, 22 bp, Homo sapiens
aacaaacattacctggtgctgg

SEQ ID NO: 7495701 - DNA, 22 bp, Homo sapiens
aacaaacattacctggtgctgg

SEQ ID NO: 7495702 - DNA, 22 bp, Homo sapiens
aacaaacattacctggtgctgg

SEQ ID NO: 7495703 - DNA, 22 bp, Homo sapiens
aacaaacattacctggtgctgg

SEQ ID NO: 7495704 - DNA, 22 bp, Homo sapiens
aacaaacagttaagtgtggatg

SEQ ID NO: 7495705 - DNA, 22 bp, Homo sapiens
aacaaacagttaagtgtggatg

SEQ ID NO: 7495706 - DNA, 22 bp, Homo sapiens
aacaaacattacctggtgctgg

SEQ ID NO: 7495707 - DNA, 22 bp, Homo sapiens
aacaaacattacctggtgctgg

SEQ ID NO: 7495708 - DNA, 22 bp, Homo sapiens
aacaaacattacctggtgctgg

SEQ ID NO: 7495709 - DNA, 22 bp, Homo sapiens
aacaaacattacctggtgctgg

SEQ ID NO: 7495710 - DNA, 22 bp, Homo sapiens
aacaaacattacctggtgctgg

SEQ ID NO: 7495711 - DNA, 20 bp, Homo sapiens
aacaaactacaaaattatgt

SEQ ID NO: 7495712 - DNA, 20 bp, Homo sapiens
aacaaactacaaaattatgt

SEQ ID NO: 7495713 - DNA, 20 bp, Homo sapiens
aacaaactacaaaattatgt

SEQ ID NO: 7495714 - DNA, 20 bp, Homo sapiens
aacaaactacaaaattatgt

SEQ ID NO: 7495715 - DNA, 20 bp, Homo sapiens
aacaaactacaaaattatgt

SEQ ID NO: 7495716 - DNA, 20 bp, Homo sapiens
aacaaactacaaaattatgt

SEQ ID NO: 7495717 - DNA, 20 bp, Homo sapiens
aacaaactacaaaattatgt

SEQ ID NO: 7495718 - DNA, 22 bp, Homo sapiens
aacaaaccttccctatacgtct

SEQ ID NO: 7495719 - DNA, 22 bp, Homo sapiens
aacaaaccttccctatacgtct

SEQ ID NO: 7495720 - DNA, 22 bp, Homo sapiens
aacaaacctgggtggagaaagg

SEQ ID NO: 7495721 - DNA, 22 bp, Homo sapiens
aacaaacctgggtggagaaagg

SEQ ID NO: 7495722 - DNA, 22 bp, Homo sapiens
aaattgaatttgggaaacattg

SEQ ID NO: 7495723 - DNA, 22 bp, Homo sapiens
aaattgaatttgggaaacattg

SEQ ID NO: 7495724 - DNA, 22 bp, Homo sapiens
aaattgaatttgggaaacattg

SEQ ID NO: 7495725 - DNA, 22 bp, Homo sapiens
aaattgaatttgggaaacattg

SEQ ID NO: 7495726 - DNA, 22 bp, Homo sapiens
aaattgaatgattaagtggtga

SEQ ID NO: 7495727 - DNA, 22 bp, Homo sapiens
aaattgaatgattaagtggtga

SEQ ID NO: 7495728 - DNA, 22 bp, Homo sapiens
aaattctttggcctactttgaa

SEQ ID NO: 7495729 - DNA, 22 bp, Homo sapiens
aaattcttttgtgcggtgaagt

SEQ ID NO: 7495730 - DNA, 22 bp, Homo sapiens
aaattctttggcctactttgaa

SEQ ID NO: 7495731 - DNA, 22 bp, Homo sapiens
aaattctttggcctactttgaa

SEQ ID NO: 7495732 - DNA, 22 bp, Homo sapiens
aaattctttggcctactttgaa

SEQ ID NO: 7495733 - DNA, 22 bp, Homo sapiens
aaattctttggcctactttgaa

SEQ ID NO: 7495734 - DNA, 22 bp, Homo sapiens
aaattctttggcctactttgaa

SEQ ID NO: 7495735 - DNA, 22 bp, Homo sapiens
aaattctttggcctactttgaa

SEQ ID NO: 7495736 - DNA, 22 bp, Homo sapiens
aaattctttcatggctaataag

SEQ ID NO: 7495737 - DNA, 22 bp, Homo sapiens
aaattctttcatggctaataag

SEQ ID NO: 7495738 - DNA, 22 bp, Homo sapiens
aaattctttggcctactttgaa

SEQ ID NO: 7495739 - DNA, 22 bp, Homo sapiens
aaattctttggcctactttgaa

SEQ ID NO: 7495740 - DNA, 22 bp, Homo sapiens
aaattgcaaaagtacttttagg

SEQ ID NO: 7495741 - DNA, 22 bp, Homo sapiens
aaattgcaaaagtacttttagg

SEQ ID NO: 7495742 - DNA, 22 bp, Homo sapiens
aaattgcaaaagtacttttagg

SEQ ID NO: 7495743 - DNA, 22 bp, Homo sapiens
aaattgcaaaagtacttttagg

SEQ ID NO: 7495744 - DNA, 22 bp, Homo sapiens
aaattgcaaaagtacttttagg

SEQ ID NO: 7495745 - DNA, 22 bp, Homo sapiens
aaattgcaaaagtacttttagg

SEQ ID NO: 7495746 - DNA, 22 bp, Homo sapiens
aaattgagctcatttcctctgt

SEQ ID NO: 7495747 - DNA, 22 bp, Homo sapiens
aaattgaatttgggaaacattg

SEQ ID NO: 7495748 - DNA, 22 bp, Homo sapiens
aaattgatgttcccagttgaaa

SEQ ID NO: 7495749 - DNA, 22 bp, Homo sapiens
aaattgatgttcccagttgaaa

SEQ ID NO: 7495750 - DNA, 22 bp, Homo sapiens
aaattgcaaaagtacttttagg

SEQ ID NO: 7495751 - DNA, 22 bp, Homo sapiens
aaattgcacaatatagacatga

SEQ ID NO: 7495752 - DNA, 22 bp, Homo sapiens
aaattgcaaccaggtctctgtc

SEQ ID NO: 7495753 - DNA, 22 bp, Homo sapiens
aaattgcaaaagtacttttagg

SEQ ID NO: 7495754 - DNA, 22 bp, Homo sapiens
aaattgcacaatatagacatga

SEQ ID NO: 7495755 - DNA, 22 bp, Homo sapiens
aaattgcacccgaggaggaggt

SEQ ID NO: 7495756 - DNA, 22 bp, Homo sapiens
aaattgcacaatatagacatga

SEQ ID NO: 7495757 - DNA, 22 bp, Homo sapiens
aaattgcagatgctaaatgact

SEQ ID NO: 7495758 - DNA, 22 bp, Homo sapiens
aaattgcagatgctaaatgact

SEQ ID NO: 7495759 - DNA, 22 bp, Homo sapiens
aaattgcagatgctaaatgact

SEQ ID NO: 7495760 - DNA, 19 bp, Homo sapiens
aaattctgacagtctttta

SEQ ID NO: 7495761 - DNA, 19 bp, Homo sapiens
aaattctgacagtctttta

SEQ ID NO: 7495762 - DNA, 19 bp, Homo sapiens
aaattctgacagtctttta

SEQ ID NO: 7495763 - DNA, 19 bp, Homo sapiens
aaattctgacagtctttta

SEQ ID NO: 7495764 - DNA, 22 bp, Homo sapiens
aaattctgatttaataagtgta

SEQ ID NO: 7495765 - DNA, 22 bp, Homo sapiens
aaattctggcctatcacagtga

SEQ ID NO: 7495766 - DNA, 22 bp, Homo sapiens
aaattctgcaatttgacaagat

SEQ ID NO: 7495767 - DNA, 22 bp, Homo sapiens
aaattctgcaatttgacaagat

SEQ ID NO: 7495768 - DNA, 22 bp, Homo sapiens
aaattctggcctatcacagtga

SEQ ID NO: 7495769 - DNA, 22 bp, Homo sapiens
aaattctggcctatcacagtga

SEQ ID NO: 7495770 - DNA, 22 bp, Homo sapiens
aaattcttcaggtaattttgat

SEQ ID NO: 7495771 - DNA, 22 bp, Homo sapiens
aaattcttcaggtaattttgat

SEQ ID NO: 7495772 - DNA, 22 bp, Homo sapiens
aaattcttcaggtaattttgat

SEQ ID NO: 7495773 - DNA, 22 bp, Homo sapiens
aaattctttcatggctaataag

SEQ ID NO: 7495774 - DNA, 22 bp, Homo sapiens
aaattctttcatggctaataag

SEQ ID NO: 7495775 - DNA, 22 bp, Homo sapiens
aaattctttcatggctaataag

SEQ ID NO: 7495776 - DNA, 22 bp, Homo sapiens
aaattctatgtcaatgtttatt

SEQ ID NO: 7495777 - DNA, 22 bp, Homo sapiens
aaattctatgtcaatgtttatt

SEQ ID NO: 7495778 - DNA, 22 bp, Homo sapiens
aaattctatgtcaatgtttatt

SEQ ID NO: 7495779 - DNA, 22 bp, Homo sapiens
aaattctctaaagaaaacatga

SEQ ID NO: 7495780 - DNA, 22 bp, Homo sapiens
aaattctcaagtgatcctgttg

SEQ ID NO: 7495781 - DNA, 22 bp, Homo sapiens
aaattctctaaagaaaacatga

SEQ ID NO: 7495782 - DNA, 22 bp, Homo sapiens
aaattctatgtcaatgtttatt

SEQ ID NO: 7495783 - DNA, 22 bp, Homo sapiens
aaattctatgtcaatgtttatt

SEQ ID NO: 7495784 - DNA, 22 bp, Homo sapiens
aaattctatgtcaatgtttatt

SEQ ID NO: 7495785 - DNA, 22 bp, Homo sapiens
aaattctatgtcaatgtttatt

SEQ ID NO: 7495786 - DNA, 22 bp, Homo sapiens
aaattctaaggtcacaatgttg

SEQ ID NO: 7495787 - DNA, 22 bp, Homo sapiens
aaattctaaggtcacaatgttg

SEQ ID NO: 7495788 - DNA, 22 bp, Homo sapiens
aaattctaaggtcacaatgttg

SEQ ID NO: 7495789 - DNA, 22 bp, Homo sapiens
aaattctaaggtcacaatgttg

SEQ ID NO: 7495790 - DNA, 22 bp, Homo sapiens
aaatgtgtcagtttcattctct

SEQ ID NO: 7495791 - DNA, 22 bp, Homo sapiens
aaatgtgtcagtttcattctct

SEQ ID NO: 7495792 - DNA, 22 bp, Homo sapiens
aaatgtgtcagtttcattctct

SEQ ID NO: 7495793 - DNA, 22 bp, Homo sapiens
aaatgtgtcatattcaaagtca

SEQ ID NO: 7495794 - DNA, 22 bp, Homo sapiens
aaatgtgtatatgaaacatgat

SEQ ID NO: 7495795 - DNA, 22 bp, Homo sapiens
aaatgtgtcagtttcattctct

SEQ ID NO: 7495796 - DNA, 22 bp, Homo sapiens
aaatgtgtatatgaaacatgat

SEQ ID NO: 7495797 - DNA, 22 bp, Homo sapiens
aaatgtgtatatgaaacatgat

SEQ ID NO: 7495798 - DNA, 22 bp, Homo sapiens
aaatgtgcttgtgatcagctgt

SEQ ID NO: 7495799 - DNA, 22 bp, Homo sapiens
aaatgtgcttgtgatcagctgt

SEQ ID NO: 7495800 - DNA, 22 bp, Homo sapiens
aaatgtgcttcttactctcaat

SEQ ID NO: 7495801 - DNA, 22 bp, Homo sapiens
aaatgtgcttcttactctcaat

SEQ ID NO: 7495802 - DNA, 22 bp, Homo sapiens
aaatgtgtatatgaaacatgat

SEQ ID NO: 7495803 - DNA, 22 bp, Homo sapiens
aaatgtgtatatgaaacatgat

SEQ ID NO: 7495804 - DNA, 22 bp, Homo sapiens
aaatgtgggtaatgggactgga

SEQ ID NO: 7495805 - DNA, 22 bp, Homo sapiens
aaatgtgggtaatgggactgga

SEQ ID NO: 7495806 - DNA, 22 bp, Homo sapiens
aaatgtgcttgtgatcagctgt

SEQ ID NO: 7495807 - DNA, 22 bp, Homo sapiens
aaatgtgtgtatgtacatatat

SEQ ID NO: 7495808 - DNA, 22 bp, Homo sapiens
aaatgtgtgtatgtacatatat

SEQ ID NO: 7495809 - DNA, 22 bp, Homo sapiens
aaatgtgtgtatgtacatatat

SEQ ID NO: 7495810 - DNA, 22 bp, Homo sapiens
aaatgtgtgtatgtacatatat

SEQ ID NO: 7495811 - DNA, 21 bp, Homo sapiens
aaatgtgttccataatgcttt

SEQ ID NO: 7495812 - DNA, 21 bp, Homo sapiens
aaatgtgttccataatgcttt

SEQ ID NO: 7495813 - DNA, 22 bp, Homo sapiens
aaatgtgttcctttgctacaga

SEQ ID NO: 7495814 - DNA, 21 bp, Homo sapiens
aaatgtgttccataatgcttt

SEQ ID NO: 7495815 - DNA, 22 bp, Homo sapiens
aaatgtgttcctttgctacaga

SEQ ID NO: 7495816 - DNA, 22 bp, Homo sapiens
aaatgtgttcctttgctacaga

SEQ ID NO: 7495817 - DNA, 22 bp, Homo sapiens
aaatgtgtgcacaaagacagct

SEQ ID NO: 7495818 - DNA, 22 bp, Homo sapiens
aaatgtgtgcacaaagacagct

SEQ ID NO: 7495819 - DNA, 22 bp, Homo sapiens
aaatgtgtcatattcaaagtca

SEQ ID NO: 7495820 - DNA, 22 bp, Homo sapiens
aaatgtgtgcacaaagacagct

SEQ ID NO: 7495821 - DNA, 22 bp, Homo sapiens
aaatgtgtgtatgtacatatat

SEQ ID NO: 7495822 - DNA, 22 bp, Homo sapiens
aaatgtgtgtatgtacatatat

SEQ ID NO: 7495823 - DNA, 22 bp, Homo sapiens
aaatgtgtgtatgtacatatat

SEQ ID NO: 7495824 - DNA, 22 bp, Homo sapiens
aaatgtctatctggcatattcc

SEQ ID NO: 7495825 - DNA, 22 bp, Homo sapiens
aaatgtctatctggcatattcc

SEQ ID NO: 7495826 - DNA, 22 bp, Homo sapiens
aaatgtctatctggcatattcc

SEQ ID NO: 7495827 - DNA, 22 bp, Homo sapiens
aaatgtctatctggcatattcc

SEQ ID NO: 7495828 - DNA, 22 bp, Homo sapiens
aaatgtctatctggcatattcc

SEQ ID NO: 7495829 - DNA, 19 bp, Homo sapiens
aaatgtgatggtacaattc

SEQ ID NO: 7495830 - DNA, 22 bp, Homo sapiens
aaatgtgatactgttcttttta

SEQ ID NO: 7495831 - DNA, 22 bp, Homo sapiens
aaatgtgatactgttcttttta

SEQ ID NO: 7495832 - DNA, 22 bp, Homo sapiens
aaatgtgctaaagtattaacat

SEQ ID NO: 7495833 - DNA, 22 bp, Homo sapiens
aaatgtgcatgagtcagaagtg

SEQ ID NO: 7495834 - DNA, 22 bp, Homo sapiens
aaatgtgcatgagtcagaagtg

SEQ ID NO: 7495835 - DNA, 22 bp, Homo sapiens
aaatgtgctcatttataaaagt

SEQ ID NO: 7495836 - DNA, 22 bp, Homo sapiens
aaatgtgctcatttataaaagt

SEQ ID NO: 7495837 - DNA, 22 bp, Homo sapiens
aaatgtgctaaagtattaacat

SEQ ID NO: 7495838 - DNA, 22 bp, Homo sapiens
aaatgtgctaaagtattaacat

SEQ ID NO: 7495839 - DNA, 19 bp, Homo sapiens
aaatgtgatggtacaattc

SEQ ID NO: 7495840 - DNA, 19 bp, Homo sapiens
aaatgtgatggtacaattc

SEQ ID NO: 7495841 - DNA, 22 bp, Homo sapiens
aaatgtctacttcccatctgta

SEQ ID NO: 7495842 - DNA, 22 bp, Homo sapiens
aagctgaggtcaagtagctagt

SEQ ID NO: 7495843 - DNA, 22 bp, Homo sapiens
aagctgaggtcaagtagctagt

SEQ ID NO: 7495844 - DNA, 19 bp, Homo sapiens
aagctgagggctgtccacc

SEQ ID NO: 7495845 - DNA, 19 bp, Homo sapiens
aagctgagggctgtccacc

SEQ ID NO: 7495846 - DNA, 22 bp, Homo sapiens
aagctgaggcccatggcaaggt

SEQ ID NO: 7495847 - DNA, 22 bp, Homo sapiens
aagctgaggctcccctgaggga

SEQ ID NO: 7495848 - DNA, 22 bp, Homo sapiens
aagctgaggctcccctgaggga

SEQ ID NO: 7495849 - DNA, 22 bp, Homo sapiens
aagctgaggctcccctgaggga

SEQ ID NO: 7495850 - DNA, 22 bp, Homo sapiens
aagctgaggctcccctgaggga

SEQ ID NO: 7495851 - DNA, 22 bp, Homo sapiens
aagctgaggctcccctgaggga

SEQ ID NO: 7495852 - DNA, 19 bp, Homo sapiens
aagctgagggctgtccacc

SEQ ID NO: 7495853 - DNA, 22 bp, Homo sapiens
aagctgaggatacatgaagcct

SEQ ID NO: 7495854 - DNA, 22 bp, Homo sapiens
aagctgagccagtggcaagtgc

SEQ ID NO: 7495855 - DNA, 22 bp, Homo sapiens
aagctgagccagtggcaagtgc

SEQ ID NO: 7495856 - DNA, 22 bp, Homo sapiens
aagctgaggcccatggcaaggt

SEQ ID NO: 7495857 - DNA, 22 bp, Homo sapiens
aagctgaggcccatggcaaggt

SEQ ID NO: 7495858 - DNA, 22 bp, Homo sapiens
aagctgaggcccatggcaaggt

SEQ ID NO: 7495859 - DNA, 22 bp, Homo sapiens
aagctgaggatacatgaagcct

SEQ ID NO: 7495860 - DNA, 22 bp, Homo sapiens
aagctgaggcccatggcaaggt

SEQ ID NO: 7495861 - DNA, 22 bp, Homo sapiens
aaattcacttgcctgcttagct

SEQ ID NO: 7495862 - DNA, 22 bp, Homo sapiens
aaattcacttgcctgcttagct

SEQ ID NO: 7495863 - DNA, 22 bp, Homo sapiens
aaattcacttgcctgcttagct

SEQ ID NO: 7495864 - DNA, 22 bp, Homo sapiens
aaattcacttgcctgcttagct

SEQ ID NO: 7495865 - DNA, 22 bp, Homo sapiens
aaattccattttgtgactattc

SEQ ID NO: 7495866 - DNA, 22 bp, Homo sapiens
aaattccattttgtgactattc

SEQ ID NO: 7495867 - DNA, 22 bp, Homo sapiens
aaattccattttgtgactattc

SEQ ID NO: 7495868 - DNA, 22 bp, Homo sapiens
aaattcctctgatcataagaat

SEQ ID NO: 7495869 - DNA, 22 bp, Homo sapiens
aaattcctctgatcataagaat

SEQ ID NO: 7495870 - DNA, 22 bp, Homo sapiens
aaattcctctgatcataagaat

SEQ ID NO: 7495871 - DNA, 22 bp, Homo sapiens
aaattctaaggtcacaatgttg

SEQ ID NO: 7495872 - DNA, 22 bp, Homo sapiens
aaattctaaggtcacaatgttg

SEQ ID NO: 7495873 - DNA, 22 bp, Homo sapiens
aaattctaaggtcacaatgttg

SEQ ID NO: 7495874 - DNA, 23 bp, Homo sapiens
aaattccttgcagataggtattg

SEQ ID NO: 7495875 - DNA, 22 bp, Homo sapiens
aaattctaaggtcacaatgttg

SEQ ID NO: 7495876 - DNA, 22 bp, Homo sapiens
aaattctaaggtcacaatgttg

SEQ ID NO: 7495877 - DNA, 22 bp, Homo sapiens
aaattctaaggtcacaatgttg

SEQ ID NO: 7495878 - DNA, 22 bp, Homo sapiens
aaattccttgagacgcaggttt

SEQ ID NO: 7495879 - DNA, 23 bp, Homo sapiens
aaattccttgcagataggtattg

SEQ ID NO: 7495880 - DNA, 23 bp, Homo sapiens
aaattccttgcagataggtattg

SEQ ID NO: 7495881 - DNA, 22 bp, Homo sapiens
aaattcctgtcatttgcacttt

SEQ ID NO: 7495882 - DNA, 22 bp, Homo sapiens
aaattccttgagacgcaggttt

SEQ ID NO: 7495883 - DNA, 22 bp, Homo sapiens
aaattcctgtcatttgcacttt

SEQ ID NO: 7495884 - DNA, 22 bp, Homo sapiens
aaattcctgtcatttgcacttt

SEQ ID NO: 7495885 - DNA, 22 bp, Homo sapiens
aaattcctgtcatttgcacttt

SEQ ID NO: 7495886 - DNA, 22 bp, Homo sapiens
aaatgttttgctcccatgtggt

SEQ ID NO: 7495887 - DNA, 22 bp, Homo sapiens
aaatgttttgctcccatgtggt

SEQ ID NO: 7495888 - DNA, 22 bp, Homo sapiens
aaattcactctgttcctcatgg

SEQ ID NO: 7495889 - DNA, 22 bp, Homo sapiens
aaattcactctgttcctcatgg

SEQ ID NO: 7495890 - DNA, 22 bp, Homo sapiens
aaattcactctgttcctcatgg

SEQ ID NO: 7495891 - DNA, 22 bp, Homo sapiens
aaattcactctgttcctcatgg

SEQ ID NO: 7495892 - DNA, 22 bp, Homo sapiens
aaattcactctgttcctcatgg

SEQ ID NO: 7495893 - DNA, 22 bp, Homo sapiens
aaatgtttctacttgtgagcat

SEQ ID NO: 7495894 - DNA, 22 bp, Homo sapiens
aaatgtttctacttgtgagcat

SEQ ID NO: 7495895 - DNA, 22 bp, Homo sapiens
aaatgtttctacttgtgagcat

SEQ ID NO: 7495896 - DNA, 22 bp, Homo sapiens
aaatgtttctacttgtgagcat

SEQ ID NO: 7495897 - DNA, 22 bp, Homo sapiens
aaatgtttctacttgtgagcat

SEQ ID NO: 7495898 - DNA, 22 bp, Homo sapiens
aaatgtttaagtgtaggagcaa

SEQ ID NO: 7495899 - DNA, 22 bp, Homo sapiens
aaatgttctactttgataatta

SEQ ID NO: 7495900 - DNA, 22 bp, Homo sapiens
aaatgtgtttgataggaatatt

SEQ ID NO: 7495901 - DNA, 22 bp, Homo sapiens
aaatgtgtttgataggaatatt

SEQ ID NO: 7495902 - DNA, 22 bp, Homo sapiens
aaatgtgtttgataggaatatt

SEQ ID NO: 7495903 - DNA, 22 bp, Homo sapiens
aaatgtgtttctttgtgaatgg

SEQ ID NO: 7495904 - DNA, 22 bp, Homo sapiens
aaatgttaggttgtactgagtc

SEQ ID NO: 7495905 - DNA, 22 bp, Homo sapiens
aaatgtgtttgataggaatatt

SEQ ID NO: 7495906 - DNA, 22 bp, Homo sapiens
aaatgttaggttgtactgagtc

SEQ ID NO: 7495907 - DNA, 22 bp, Homo sapiens
aaatgtgtttgataggaatatt

SEQ ID NO: 7495908 - DNA, 22 bp, Homo sapiens
aaatgtgtttagatggtttatt

SEQ ID NO: 7495909 - DNA, 22 bp, Homo sapiens
aaatgtgtttcgaaaactggtg

SEQ ID NO: 7495910 - DNA, 22 bp, Homo sapiens
aaatgtgttcctttgctacaga

SEQ ID NO: 7495911 - DNA, 22 bp, Homo sapiens
aaatgttcccaatatgaagctg

SEQ ID NO: 7495912 - DNA, 22 bp, Homo sapiens
aaatgttcccaatatgaagctg

SEQ ID NO: 7495913 - DNA, 22 bp, Homo sapiens
aaatgttccgggtaaggagaaa

SEQ ID NO: 7495914 - DNA, 22 bp, Homo sapiens
aaatgttccgggtaaggagaaa

SEQ ID NO: 7495915 - DNA, 22 bp, Homo sapiens
aaatgttccgggtaaggagaaa

SEQ ID NO: 7495916 - DNA, 22 bp, Homo sapiens
aaatgttcctttggattaaact

SEQ ID NO: 7495917 - DNA, 22 bp, Homo sapiens
aaatgttcctttggattaaact

SEQ ID NO: 7495918 - DNA, 22 bp, Homo sapiens
aaatgttctactttgataatta

SEQ ID NO: 7495919 - DNA, 22 bp, Homo sapiens
aaatgttctgaaagacccgctc

SEQ ID NO: 7495920 - DNA, 22 bp, Homo sapiens
aaatgttctgaaagacccgctc

SEQ ID NO: 7495921 - DNA, 22 bp, Homo sapiens
aaatgttctaaattacatgtga

SEQ ID NO: 7495922 - DNA, 22 bp, Homo sapiens
aaatgttctaaattacatgtga

SEQ ID NO: 7495923 - DNA, 22 bp, Homo sapiens
aaatgttcatttctcactcaca

SEQ ID NO: 7495924 - DNA, 22 bp, Homo sapiens
aaatgttcatttctcactcaca

SEQ ID NO: 7495925 - DNA, 22 bp, Homo sapiens
aaatgttccattattgtgtaat

SEQ ID NO: 7495926 - DNA, 22 bp, Homo sapiens
aaatgttccattattgtgtaat

SEQ ID NO: 7495927 - DNA, 22 bp, Homo sapiens
aaatgttcccaatatgaagctg

SEQ ID NO: 7495928 - DNA, 22 bp, Homo sapiens
aaatgttcaccagatccatgac

SEQ ID NO: 7495929 - DNA, 22 bp, Homo sapiens
aaatgttcattaagggcctgtt

SEQ ID NO: 7495930 - DNA, 22 bp, Homo sapiens
aaatgttaggttgtactgagtc

SEQ ID NO: 7495931 - DNA, 22 bp, Homo sapiens
aaatgttcaccagatccatgac

SEQ ID NO: 7495932 - DNA, 22 bp, Homo sapiens
aaatgttaggttgtactgagtc

SEQ ID NO: 7495933 - DNA, 22 bp, Homo sapiens
aaggtatatgtacaatagacat

SEQ ID NO: 7495934 - DNA, 22 bp, Homo sapiens
aaggtatagcttgcatacagaa

SEQ ID NO: 7495935 - DNA, 22 bp, Homo sapiens
aaggtatagagtttggaaaaat

SEQ ID NO: 7495936 - DNA, 20 bp, Homo sapiens
aacactgaggcctactcttc

SEQ ID NO: 7495937 - DNA, 22 bp, Homo sapiens
aacactgagctattacggtgga

SEQ ID NO: 7495938 - DNA, 22 bp, Homo sapiens
aacactgagaggggagtggcac

SEQ ID NO: 7495939 - DNA, 22 bp, Homo sapiens
aacactgacgacgtgaactaaa

SEQ ID NO: 7495940 - DNA, 22 bp, Homo sapiens
aacactgagaacaatacagagt

SEQ ID NO: 7495941 - DNA, 22 bp, Homo sapiens
aacactgagaacaatacagagt

SEQ ID NO: 7495942 - DNA, 22 bp, Homo sapiens
aacactgacgacgtgaactaaa

SEQ ID NO: 7495943 - DNA, 22 bp, Homo sapiens
aacactgacctctaccctcagt

SEQ ID NO: 7495944 - DNA, 22 bp, Homo sapiens
aacactgacctctaccctcagt

SEQ ID NO: 7495945 - DNA, 22 bp, Homo sapiens
aacactgaagtagtgaatactg

SEQ ID NO: 7495946 - DNA, 22 bp, Homo sapiens
aacactgaagtagtgaatactg

SEQ ID NO: 7495947 - DNA, 22 bp, Homo sapiens
aacactgaagtagtgaatactg

SEQ ID NO: 7495948 - DNA, 22 bp, Homo sapiens
aacactgaagccgttaaacctt

SEQ ID NO: 7495949 - DNA, 22 bp, Homo sapiens
aacactgaaatgtcttaagatt

SEQ ID NO: 7495950 - DNA, 22 bp, Homo sapiens
aacactgaaatgtcttaagatt

SEQ ID NO: 7495951 - DNA, 22 bp, Homo sapiens
aacactgaaatgtcttaagatt

SEQ ID NO: 7495952 - DNA, 22 bp, Homo sapiens
aaggtcacactcccagagctga

SEQ ID NO: 7495953 - DNA, 23 bp, Homo sapiens
aaggtcacagaacttagcaagcc

SEQ ID NO: 7495954 - DNA, 23 bp, Homo sapiens
aaggtcacagaacttagcaagcc

SEQ ID NO: 7495955 - DNA, 22 bp, Homo sapiens
aaggtcacactcccagagctga

SEQ ID NO: 7495956 - DNA, 22 bp, Homo sapiens
aaggtcacacagtgattaagtg

SEQ ID NO: 7495957 - DNA, 22 bp, Homo sapiens
aaggtcagagcaggaaggagtc

SEQ ID NO: 7495958 - DNA, 22 bp, Homo sapiens
aaggtcagagcaggaaggagtc

SEQ ID NO: 7495959 - DNA, 22 bp, Homo sapiens
aaggtcagagcaggaaggagtc

SEQ ID NO: 7495960 - DNA, 22 bp, Homo sapiens
aaggtcagagcaggaaggagtc

SEQ ID NO: 7495961 - DNA, 22 bp, Homo sapiens
aaggtcactgatcagttgagta

SEQ ID NO: 7495962 - DNA, 22 bp, Homo sapiens
aaggtcacttttattcctgaga

SEQ ID NO: 7495963 - DNA, 22 bp, Homo sapiens
aaggtcacttttattcctgaga

SEQ ID NO: 7495964 - DNA, 22 bp, Homo sapiens
aaggtcacttttattcctgaga

SEQ ID NO: 7495965 - DNA, 22 bp, Homo sapiens
aaggtcattggttctgaattct

SEQ ID NO: 7495966 - DNA, 22 bp, Homo sapiens
aaggtcatttaacaatttatga

SEQ ID NO: 7495967 - DNA, 22 bp, Homo sapiens
aaggtcatggcaaattactttt

SEQ ID NO: 7495968 - DNA, 22 bp, Homo sapiens
aaggtcagagtgagctgtggcc

SEQ ID NO: 7495969 - DNA, 22 bp, Homo sapiens
aaggtcagagcaggaaggagtc

SEQ ID NO: 7495970 - DNA, 22 bp, Homo sapiens
aaggtcattttttcctctgttg

SEQ ID NO: 7495971 - DNA, 20 bp, Homo sapiens
aaggtccaaactctgtgttc

SEQ ID NO: 7495972 - DNA, 20 bp, Homo sapiens
aaggtccaaactctgtgttc

SEQ ID NO: 7495973 - DNA, 22 bp, Homo sapiens
aaggtccacaactggtaaatgg

SEQ ID NO: 7495974 - DNA, 22 bp, Homo sapiens
aaggtccacaactggtaaatgg

SEQ ID NO: 7495975 - DNA, 22 bp, Homo sapiens
aaggtccagaggtcccgtcacc

SEQ ID NO: 7495976 - DNA, 22 bp, Homo sapiens
aaggtccagaggtcccgtcacc

SEQ ID NO: 7495977 - DNA, 20 bp, Homo sapiens
aaggtccaaactctgtgttc

SEQ ID NO: 7495978 - DNA, 22 bp, Homo sapiens
aaggtccagtggaaactagagt

SEQ ID NO: 7495979 - DNA, 22 bp, Homo sapiens
aaggtattttctaatgtatact

SEQ ID NO: 7495980 - DNA, 22 bp, Homo sapiens
aaggtcaagacacaggaatcta

SEQ ID NO: 7495981 - DNA, 22 bp, Homo sapiens
aaggtcaagacacaggaatcta

SEQ ID NO: 7495982 - DNA, 22 bp, Homo sapiens
aaggtcaaagacagtaactttt

SEQ ID NO: 7495983 - DNA, 22 bp, Homo sapiens
aaggtcaacactgattttagtc

SEQ ID NO: 7495984 - DNA, 22 bp, Homo sapiens
aaggtattgttccctagtttct

SEQ ID NO: 7495985 - DNA, 22 bp, Homo sapiens
aaggtattggggaatatttgac

SEQ ID NO: 7495986 - DNA, 22 bp, Homo sapiens
aaggtatatgtacaatagacat

SEQ ID NO: 7495987 - DNA, 22 bp, Homo sapiens
aaggtatcagtaaagctctgcc

SEQ ID NO: 7495988 - DNA, 22 bp, Homo sapiens
aaggtattatttgcaatcattt

SEQ ID NO: 7495989 - DNA, 22 bp, Homo sapiens
aacacataggcagagcatgaca

SEQ ID NO: 7495990 - DNA, 22 bp, Homo sapiens
aacacataggcagagcatgaca

SEQ ID NO: 7495991 - DNA, 19 bp, Homo sapiens
aacaccagagtcaggagtc

SEQ ID NO: 7495992 - DNA, 22 bp, Homo sapiens
aacacataggcagagcatgaca

SEQ ID NO: 7495993 - DNA, 22 bp, Homo sapiens
aacacatagacgtttgatatca

SEQ ID NO: 7495994 - DNA, 22 bp, Homo sapiens
aacaccttgcagggattatgac

SEQ ID NO: 7495995 - DNA, 22 bp, Homo sapiens
aacactaaaggtcagttagaag

SEQ ID NO: 7495996 - DNA, 22 bp, Homo sapiens
aacaccgcaattacttttgtgc

SEQ ID NO: 7495997 - DNA, 22 bp, Homo sapiens
aacaccttctccttgcaggcca

SEQ ID NO: 7495998 - DNA, 22 bp, Homo sapiens
aacaaatgtaaaatgcagatgc

SEQ ID NO: 7495999 - DNA, 22 bp, Homo sapiens
aacaaatgtaaaatgcagatgc

SEQ ID NO: 7496000 - DNA, 22 bp, Homo sapiens
aacaaatgtaaaatgcagatgc

SEQ ID NO: 7496001 - DNA, 22 bp, Homo sapiens
aacacatagacgtttgatatca

SEQ ID NO: 7496002 - DNA, 22 bp, Homo sapiens
aacacatagacgtttgatatca

SEQ ID NO: 7496003 - DNA, 22 bp, Homo sapiens
aacacatagacgtttgatatca

SEQ ID NO: 7496004 - DNA, 22 bp, Homo sapiens
aacacatagacgtttgatatca

SEQ ID NO: 7496005 - DNA, 22 bp, Homo sapiens
aacacatagacgtttgatatca

SEQ ID NO: 7496006 - DNA, 22 bp, Homo sapiens
aacacatagacgtttgatatca

SEQ ID NO: 7496007 - DNA, 22 bp, Homo sapiens
aacacagttttccaaaatagag

SEQ ID NO: 7496008 - DNA, 22 bp, Homo sapiens
aacactctacgtgcagctccta

SEQ ID NO: 7496009 - DNA, 22 bp, Homo sapiens
aacactctacgtgcagctccta

SEQ ID NO: 7496010 - DNA, 22 bp, Homo sapiens
aacactctctgttggtaaggct

SEQ ID NO: 7496011 - DNA, 22 bp, Homo sapiens
aacactctacgtgcagctccta

SEQ ID NO: 7496012 - DNA, 22 bp, Homo sapiens
aacactctctgttggtaaggct

SEQ ID NO: 7496013 - DNA, 22 bp, Homo sapiens
aacactctctgttggtaaggct

SEQ ID NO: 7496014 - DNA, 22 bp, Homo sapiens
aacactctgagtatagaccact

SEQ ID NO: 7496015 - DNA, 22 bp, Homo sapiens
aacactgaaacattgattgaca

SEQ ID NO: 7496016 - DNA, 22 bp, Homo sapiens
aacactctctgttggtaaggct

SEQ ID NO: 7496017 - DNA, 22 bp, Homo sapiens
aacactctctgttggtaaggct

SEQ ID NO: 7496018 - DNA, 22 bp, Homo sapiens
aacactctgagtatagaccact

SEQ ID NO: 7496019 - DNA, 22 bp, Homo sapiens
aacactaatgggagaacaaccc

SEQ ID NO: 7496020 - DNA, 22 bp, Homo sapiens
aacactaatgggagaacaaccc

SEQ ID NO: 7496021 - DNA, 22 bp, Homo sapiens
aacactccgtggaggcatgcag

SEQ ID NO: 7496022 - DNA, 22 bp, Homo sapiens
aacactcaatttacaaactctg

SEQ ID NO: 7496023 - DNA, 22 bp, Homo sapiens
aacactatctgccttacaggga

SEQ ID NO: 7496024 - DNA, 22 bp, Homo sapiens
aacactatctgccttacaggga

SEQ ID NO: 7496025 - DNA, 22 bp, Homo sapiens
aacactatctgccttacaggga

SEQ ID NO: 7496026 - DNA, 22 bp, Homo sapiens
aacactatctgccttacaggga

SEQ ID NO: 7496027 - DNA, 22 bp, Homo sapiens
aacactcaatttacaaactctg

SEQ ID NO: 7496028 - DNA, 22 bp, Homo sapiens
aacaaatgacctgatttcttcc

SEQ ID NO: 7496029 - DNA, 22 bp, Homo sapiens
aacaaatgacctgatttcttcc

SEQ ID NO: 7496030 - DNA, 22 bp, Homo sapiens
aacaaatgacctgatttcttcc

SEQ ID NO: 7496031 - DNA, 22 bp, Homo sapiens
aacaaatgacctgatttcttcc

SEQ ID NO: 7496032 - DNA, 22 bp, Homo sapiens
aacaaatcttaaagtaattcaa

SEQ ID NO: 7496033 - DNA, 22 bp, Homo sapiens
aacaaatgacctgatttcttcc

SEQ ID NO: 7496034 - DNA, 22 bp, Homo sapiens
aacaaatgacctgatttcttcc

SEQ ID NO: 7496035 - DNA, 22 bp, Homo sapiens
aacaaatgacctgatttcttcc

SEQ ID NO: 7496036 - DNA, 22 bp, Homo sapiens
aacaaagtttcaggaagataga

SEQ ID NO: 7496037 - DNA, 22 bp, Homo sapiens
aacaaagtttcaggaagataga

SEQ ID NO: 7496038 - DNA, 22 bp, Homo sapiens
aacaaagtttcaggaagataga

SEQ ID NO: 7496039 - DNA, 22 bp, Homo sapiens
aacaaagtgtacttccatactg

SEQ ID NO: 7496040 - DNA, 22 bp, Homo sapiens
aacaaagtttcaggaagataga

SEQ ID NO: 7496041 - DNA, 22 bp, Homo sapiens
aacaaagtttcaggaagataga

SEQ ID NO: 7496042 - DNA, 22 bp, Homo sapiens
aacaaagtttcaggaagataga

SEQ ID NO: 7496043 - DNA, 22 bp, Homo sapiens
aacaaatgattgttggttggag

SEQ ID NO: 7496044 - DNA, 22 bp, Homo sapiens
aacaaatgattgttggttggag

SEQ ID NO: 7496045 - DNA, 22 bp, Homo sapiens
aacaaatggaacacaaatcttt

SEQ ID NO: 7496046 - DNA, 22 bp, Homo sapiens
aacaaatggaacacaaatcttt

SEQ ID NO: 7496047 - DNA, 22 bp, Homo sapiens
aacaaatggaacacaaatcttt

SEQ ID NO: 7496048 - DNA, 22 bp, Homo sapiens
aacaaatggaacacaaatcttt

SEQ ID NO: 7496049 - DNA, 22 bp, Homo sapiens
aacaaatgattgttggttggag

SEQ ID NO: 7496050 - DNA, 22 bp, Homo sapiens
aacaaatgataccagttctcaa

SEQ ID NO: 7496051 - DNA, 22 bp, Homo sapiens
aacaaatgataccagttctcaa

SEQ ID NO: 7496052 - DNA, 22 bp, Homo sapiens
aacaaatgataccagttctcaa

SEQ ID NO: 7496053 - DNA, 22 bp, Homo sapiens
aacaaatgataccagttctcaa

SEQ ID NO: 7496054 - DNA, 22 bp, Homo sapiens
aacaaatggggccttgtatgaa

SEQ ID NO: 7496055 - DNA, 22 bp, Homo sapiens
aacaaatggggccttgtatgaa

SEQ ID NO: 7496056 - DNA, 22 bp, Homo sapiens
aacaaatggggccttgtatgaa

SEQ ID NO: 7496057 - DNA, 22 bp, Homo sapiens
aacaaatggggccttgtatgaa

SEQ ID NO: 7496058 - DNA, 22 bp, Homo sapiens
aacaaatggggccttgtatgaa

SEQ ID NO: 7496059 - DNA, 22 bp, Homo sapiens
aacaaatggaacacaaatcttt

SEQ ID NO: 7496060 - DNA, 22 bp, Homo sapiens
aacaaatggaacacaaatcttt

SEQ ID NO: 7496061 - DNA, 22 bp, Homo sapiens
aacaaatggaacacaaatcttt

SEQ ID NO: 7496062 - DNA, 22 bp, Homo sapiens
aacaaatggaacacaaatcttt

SEQ ID NO: 7496063 - DNA, 22 bp, Homo sapiens
aacaaatggaacacaaatcttt

SEQ ID NO: 7496064 - DNA, 22 bp, Homo sapiens
aagtcatgtggaagaataacct

SEQ ID NO: 7496065 - DNA, 22 bp, Homo sapiens
aagtcatgagtcctcttctgtg

SEQ ID NO: 7496066 - DNA, 22 bp, Homo sapiens
aagtcattatctcttctaatct

SEQ ID NO: 7496067 - DNA, 22 bp, Homo sapiens
aagtcattatctcttctaatct

SEQ ID NO: 7496068 - DNA, 22 bp, Homo sapiens
aagtcatcttgagtctaagatt

SEQ ID NO: 7496069 - DNA, 22 bp, Homo sapiens
aagtcatgagtcctcttctgtg

SEQ ID NO: 7496070 - DNA, 22 bp, Homo sapiens
aagtcatcttgagtctaagatt

SEQ ID NO: 7496071 - DNA, 22 bp, Homo sapiens
aacagcctcagtgagattagga

SEQ ID NO: 7496072 - DNA, 22 bp, Homo sapiens
aagtcatcttgagtctaagatt

SEQ ID NO: 7496073 - DNA, 23 bp, Homo sapiens
aacagccacactgctgagattca

SEQ ID NO: 7496074 - DNA, 22 bp, Homo sapiens
aacagccactgatactgaatag

SEQ ID NO: 7496075 - DNA, 23 bp, Homo sapiens
aacagccacactgctgagattca

SEQ ID NO: 7496076 - DNA, 22 bp, Homo sapiens
aacagcctcagtgagattagga

SEQ ID NO: 7496077 - DNA, 22 bp, Homo sapiens
aacagcatcaccccataacatt

SEQ ID NO: 7496078 - DNA, 22 bp, Homo sapiens
aacagcatgctgggtaacattg

SEQ ID NO: 7496079 - DNA, 22 bp, Homo sapiens
aacagcatgctgggtaacattg

SEQ ID NO: 7496080 - DNA, 22 bp, Homo sapiens
aacagcatgctgggtaacattg

SEQ ID NO: 7496081 - DNA, 23 bp, Homo sapiens
aacagccaactttagcgggtggc

SEQ ID NO: 7496082 - DNA, 23 bp, Homo sapiens
aacagccacactgctgagattca

SEQ ID NO: 7496083 - DNA, 23 bp, Homo sapiens
aacagccacactgctgagattca

SEQ ID NO: 7496084 - DNA, 22 bp, Homo sapiens
aagtccaaggtcaccattcaca

SEQ ID NO: 7496085 - DNA, 22 bp, Homo sapiens
aagtccaaggtcaccattcaca

SEQ ID NO: 7496086 - DNA, 22 bp, Homo sapiens
aagtccaaggctgggtgcagtg

SEQ ID NO: 7496087 - DNA, 23 bp, Homo sapiens
aagtccacacgtagtgaaacagt

SEQ ID NO: 7496088 - DNA, 22 bp, Homo sapiens
aagtccaccagtcagactagga

SEQ ID NO: 7496089 - DNA, 23 bp, Homo sapiens
aagtccacacgtagtgaaacagt

SEQ ID NO: 7496090 - DNA, 22 bp, Homo sapiens
aagtcattatctcttctaatct

SEQ ID NO: 7496091 - DNA, 22 bp, Homo sapiens
aagtcattcctgcttgttgccc

SEQ ID NO: 7496092 - DNA, 22 bp, Homo sapiens
aagtcattctatttctctatgt

SEQ ID NO: 7496093 - DNA, 22 bp, Homo sapiens
aagtcattggtagcttgatagg

SEQ ID NO: 7496094 - DNA, 22 bp, Homo sapiens
aagtcattctatttctctatgt

SEQ ID NO: 7496095 - DNA, 22 bp, Homo sapiens
aagtccaagaggaaaggtttcc

SEQ ID NO: 7496096 - DNA, 22 bp, Homo sapiens
aagtccagctgtagctcaacag

SEQ ID NO: 7496097 - DNA, 22 bp, Homo sapiens
aagtccagctgtagctcaacag

SEQ ID NO: 7496098 - DNA, 17 bp, Homo sapiens
aagtccagcctgcagct

SEQ ID NO: 7496099 - DNA, 17 bp, Homo sapiens
aagtccagcctgcagct

SEQ ID NO: 7496100 - DNA, 17 bp, Homo sapiens
aagtccagcctgcagct

SEQ ID NO: 7496101 - DNA, 17 bp, Homo sapiens
aagtccagcctgcagct

SEQ ID NO: 7496102 - DNA, 22 bp, Homo sapiens
aagtccagcagtgcttgttgat

SEQ ID NO: 7496103 - DNA, 22 bp, Homo sapiens
aagtccagcagtgcttgttgat

SEQ ID NO: 7496104 - DNA, 17 bp, Homo sapiens
aagtccagagttgagca

SEQ ID NO: 7496105 - DNA, 17 bp, Homo sapiens
aagtccagagttgagca

SEQ ID NO: 7496106 - DNA, 17 bp, Homo sapiens
aagtccagagttgagca

SEQ ID NO: 7496107 - DNA, 22 bp, Homo sapiens
aagtccagacctgaggccctca

SEQ ID NO: 7496108 - DNA, 22 bp, Homo sapiens
aagtccagactcctttgcgtgg

SEQ ID NO: 7496109 - DNA, 22 bp, Homo sapiens
aagtccagaactcctgtgatag

SEQ ID NO: 7496110 - DNA, 22 bp, Homo sapiens
aagtccagaactcctgtgatag

SEQ ID NO: 7496111 - DNA, 22 bp, Homo sapiens
aagtccagaactcctgtgatag

SEQ ID NO: 7496112 - DNA, 22 bp, Homo sapiens
aagtccagaactcctgtgatag

SEQ ID NO: 7496113 - DNA, 22 bp, Homo sapiens
aagtccagacctgaggccctca

SEQ ID NO: 7496114 - DNA, 22 bp, Homo sapiens
aagtccagacctgaggccctca

SEQ ID NO: 7496115 - DNA, 22 bp, Homo sapiens
aagtccagacctgaggccctca

SEQ ID NO: 7496116 - DNA, 22 bp, Homo sapiens
aagtccagacctgaggccctca

SEQ ID NO: 7496117 - DNA, 22 bp, Homo sapiens
aagtccagggatcaaagtaggc

SEQ ID NO: 7496118 - DNA, 22 bp, Homo sapiens
aagtccaggtcccgggctctgg

SEQ ID NO: 7496119 - DNA, 22 bp, Homo sapiens
aacagcttgaggaatatcatca

SEQ ID NO: 7496120 - DNA, 22 bp, Homo sapiens
aagtccaggtcccgggctctgg

SEQ ID NO: 7496121 - DNA, 22 bp, Homo sapiens
aagtccaggtcccgggctctgg

SEQ ID NO: 7496122 - DNA, 22 bp, Homo sapiens
aagtccaggctggcgtagagtc

SEQ ID NO: 7496123 - DNA, 22 bp, Homo sapiens
aagtccagggatcaaagtaggc

SEQ ID NO: 7496124 - DNA, 22 bp, Homo sapiens
aacaggaatgaggagaaaaggt

SEQ ID NO: 7496125 - DNA, 22 bp, Homo sapiens
aacaggaattgatgggagtcct

SEQ ID NO: 7496126 - DNA, 22 bp, Homo sapiens
aacaggaattgatgggagtcct

SEQ ID NO: 7496127 - DNA, 22 bp, Homo sapiens
aacaggaattgatgggagtcct

SEQ ID NO: 7496128 - DNA, 22 bp, Homo sapiens
aacaggaattgatgggagtcct

SEQ ID NO: 7496129 - DNA, 22 bp, Homo sapiens
aacagcttgaggaatatcatca

SEQ ID NO: 7496130 - DNA, 22 bp, Homo sapiens
aacagcttgaggaatatcatca

SEQ ID NO: 7496131 - DNA, 22 bp, Homo sapiens
aacaggaatgaggagaaaaggt

SEQ ID NO: 7496132 - DNA, 22 bp, Homo sapiens
aacagcaggcatttcttagctc

SEQ ID NO: 7496133 - DNA, 22 bp, Homo sapiens
aacagcaggcatttcttagctc

SEQ ID NO: 7496134 - DNA, 22 bp, Homo sapiens
aacagcaggcaccaaggctatg

SEQ ID NO: 7496135 - DNA, 22 bp, Homo sapiens
aacagcaggcaccaaggctatg

SEQ ID NO: 7496136 - DNA, 22 bp, Homo sapiens
aacagcaggcaccaaggctatg

SEQ ID NO: 7496137 - DNA, 22 bp, Homo sapiens
aacagcaggcaccaaggctatg

SEQ ID NO: 7496138 - DNA, 23 bp, Homo sapiens
aacagcaggatgatagaggaggt

SEQ ID NO: 7496139 - DNA, 23 bp, Homo sapiens
aacagcaggatgatagaggaggt

SEQ ID NO: 7496140 - DNA, 23 bp, Homo sapiens
aacagcaggatgatagaggaggt

SEQ ID NO: 7496141 - DNA, 22 bp, Homo sapiens
aacagcaggcaccaaggctatg

SEQ ID NO: 7496142 - DNA, 23 bp, Homo sapiens
aacagcaggatgatagaggaggt

SEQ ID NO: 7496143 - DNA, 22 bp, Homo sapiens
aacagcagctttcaggatcatc

SEQ ID NO: 7496144 - DNA, 22 bp, Homo sapiens
aacagcagctttcaggatcatc

SEQ ID NO: 7496145 - DNA, 22 bp, Homo sapiens
aacagcagctttcaggatcatc

SEQ ID NO: 7496146 - DNA, 22 bp, Homo sapiens
aacagcagctttcaggatcatc

SEQ ID NO: 7496147 - DNA, 22 bp, Homo sapiens
aacagcagctgcctgaatttgc

SEQ ID NO: 7496148 - DNA, 22 bp, Homo sapiens
aacagcagctgcctgaatttgc

SEQ ID NO: 7496149 - DNA, 22 bp, Homo sapiens
aacagcagctgcctgaatttgc

SEQ ID NO: 7496150 - DNA, 22 bp, Homo sapiens
aacagagtggagccaaactttg

SEQ ID NO: 7496151 - DNA, 22 bp, Homo sapiens
aacagaggctccctgcacttgt

SEQ ID NO: 7496152 - DNA, 22 bp, Homo sapiens
aacagaggatgtttgaaattca

SEQ ID NO: 7496153 - DNA, 22 bp, Homo sapiens
aacagaggctccctgcacttgt

SEQ ID NO: 7496154 - DNA, 22 bp, Homo sapiens
aacagagctggtgactccaggt

SEQ ID NO: 7496155 - DNA, 22 bp, Homo sapiens
aacagagctgaccagtgagggc

SEQ ID NO: 7496156 - DNA, 22 bp, Homo sapiens
aaggtctggatgatgggtgtgc

SEQ ID NO: 7496157 - DNA, 22 bp, Homo sapiens
aaggtctcaagttttccaaagt

SEQ ID NO: 7496158 - DNA, 22 bp, Homo sapiens
aaggtctcaagttttccaaagt

SEQ ID NO: 7496159 - DNA, 22 bp, Homo sapiens
aaggtctcaagttttccaaagt

SEQ ID NO: 7496160 - DNA, 22 bp, Homo sapiens
aaggtctatggagaagactgag

SEQ ID NO: 7496161 - DNA, 22 bp, Homo sapiens
aaggtcctgtagccacagagcc

SEQ ID NO: 7496162 - DNA, 22 bp, Homo sapiens
aaggtcctgtagccacagagcc

SEQ ID NO: 7496163 - DNA, 22 bp, Homo sapiens
aaggtcctgtagccacagagcc

SEQ ID NO: 7496164 - DNA, 22 bp, Homo sapiens
aaggtccttttgcagtgtgatc

SEQ ID NO: 7496165 - DNA, 22 bp, Homo sapiens
aaggtccatgactcggcatagt

SEQ ID NO: 7496166 - DNA, 22 bp, Homo sapiens
aaggtccagtttgaattactgt

SEQ ID NO: 7496167 - DNA, 22 bp, Homo sapiens
aaggtccatgactcggcatagt

SEQ ID NO: 7496168 - DNA, 22 bp, Homo sapiens
aaggtcctgtagccacagagcc

SEQ ID NO: 7496169 - DNA, 22 bp, Homo sapiens
aacagcataagtatttatttca

SEQ ID NO: 7496170 - DNA, 22 bp, Homo sapiens
aacagcataagtatttatttca

SEQ ID NO: 7496171 - DNA, 22 bp, Homo sapiens
aacagcagttacttttgcatca

SEQ ID NO: 7496172 - DNA, 22 bp, Homo sapiens
aacagcataagtatttatttca

SEQ ID NO: 7496173 - DNA, 22 bp, Homo sapiens
aacagcataccaatgtacatat

SEQ ID NO: 7496174 - DNA, 22 bp, Homo sapiens
aacagcataccaatgtacatat

SEQ ID NO: 7496175 - DNA, 22 bp, Homo sapiens
aacagcataccaatgtacatat

SEQ ID NO: 7496176 - DNA, 22 bp, Homo sapiens
aacagcataccaatgtacatat

SEQ ID NO: 7496177 - DNA, 22 bp, Homo sapiens
aacagcagtggcaggagaaggc

SEQ ID NO: 7496178 - DNA, 22 bp, Homo sapiens
aacagcagtggcaggagaaggc

SEQ ID NO: 7496179 - DNA, 22 bp, Homo sapiens
aacagcaggtcctggcatgggt

SEQ ID NO: 7496180 - DNA, 22 bp, Homo sapiens
aacagcagttacttttgcatca

SEQ ID NO: 7496181 - DNA, 22 bp, Homo sapiens
aacagcagtggcaggagaaggc

SEQ ID NO: 7496182 - DNA, 22 bp, Homo sapiens
aacagcagttacttttgcatca

SEQ ID NO: 7496183 - DNA, 22 bp, Homo sapiens
aacagcatatttcatatattga

SEQ ID NO: 7496184 - DNA, 22 bp, Homo sapiens
aacagcatatttcatatattga

SEQ ID NO: 7496185 - DNA, 22 bp, Homo sapiens
aacagcatatttcatatattga

SEQ ID NO: 7496186 - DNA, 22 bp, Homo sapiens
aacagcatatttcatatattga

SEQ ID NO: 7496187 - DNA, 22 bp, Homo sapiens
aacagcataccaatgtacatat

SEQ ID NO: 7496188 - DNA, 22 bp, Homo sapiens
aacagcataccaatgtacatat

SEQ ID NO: 7496189 - DNA, 22 bp, Homo sapiens
aacagcatcaccccataacatt

SEQ ID NO: 7496190 - DNA, 22 bp, Homo sapiens
aacagcatgctgggtaacattg

SEQ ID NO: 7496191 - DNA, 22 bp, Homo sapiens
aacagcatgctgggtaacattg

SEQ ID NO: 7496192 - DNA, 22 bp, Homo sapiens
aacagcatcaccccataacatt

SEQ ID NO: 7496193 - DNA, 22 bp, Homo sapiens
aacagcatcaccccataacatt

SEQ ID NO: 7496194 - DNA, 22 bp, Homo sapiens
aacagcatcaccccataacatt

SEQ ID NO: 7496195 - DNA, 22 bp, Homo sapiens
aacagcatatttcatatattga

SEQ ID NO: 7496196 - DNA, 22 bp, Homo sapiens
aacagcagggacttgaatggaa

SEQ ID NO: 7496197 - DNA, 22 bp, Homo sapiens
aacagcagggaaattccaagtc

SEQ ID NO: 7496198 - DNA, 22 bp, Homo sapiens
aacagcagggaaattccaagtc

SEQ ID NO: 7496199 - DNA, 22 bp, Homo sapiens
aacagcagggatgacatggcca

SEQ ID NO: 7496200 - DNA, 22 bp, Homo sapiens
aacagcagggatgacatggcca

SEQ ID NO: 7496201 - DNA, 22 bp, Homo sapiens
aacagcagggacttgaatggaa

SEQ ID NO: 7496202 - DNA, 22 bp, Homo sapiens
aacagcagggacttgaatggaa

SEQ ID NO: 7496203 - DNA, 22 bp, Homo sapiens
aacagcagggacttgaatggaa

SEQ ID NO: 7496204 - DNA, 22 bp, Homo sapiens
aacagcagggacttgaatggaa

SEQ ID NO: 7496205 - DNA, 22 bp, Homo sapiens
aacagcagggacttgaatggaa

SEQ ID NO: 7496206 - DNA, 22 bp, Homo sapiens
aacagcagggatggggtggcca

SEQ ID NO: 7496207 - DNA, 22 bp, Homo sapiens
aacagcagggatggggtggcca

SEQ ID NO: 7496208 - DNA, 22 bp, Homo sapiens
aacagcagggatgacatggcca

SEQ ID NO: 7496209 - DNA, 22 bp, Homo sapiens
aacagcagggatgacatggcca

SEQ ID NO: 7496210 - DNA, 22 bp, Homo sapiens
aacagcagggggacctgctggt

SEQ ID NO: 7496211 - DNA, 22 bp, Homo sapiens
aacagcagggggacctgctggt

SEQ ID NO: 7496212 - DNA, 22 bp, Homo sapiens
aacagcagggggacctgctggt

SEQ ID NO: 7496213 - DNA, 22 bp, Homo sapiens
aacagcaggtcctggcatgggt

SEQ ID NO: 7496214 - DNA, 22 bp, Homo sapiens
aacagcaggtcctggcatgggt

SEQ ID NO: 7496215 - DNA, 22 bp, Homo sapiens
aacagcaggtcctggcatgggt

SEQ ID NO: 7496216 - DNA, 22 bp, Homo sapiens
aattggaaaatgctacatatca

SEQ ID NO: 7496217 - DNA, 22 bp, Homo sapiens
aagaatatagattttttgaagt

SEQ ID NO: 7496218 - DNA, 22 bp, Homo sapiens
aagaatatagattttttgaagt

SEQ ID NO: 7496219 - DNA, 22 bp, Homo sapiens
aattggaaaatgctacatatca

SEQ ID NO: 7496220 - DNA, 22 bp, Homo sapiens
aagaatacttcgtaagtaggat

SEQ ID NO: 7496221 - DNA, 23 bp, Homo sapiens
aattggacttgctgtcaaacttc

SEQ ID NO: 7496222 - DNA, 22 bp, Homo sapiens
aattggaaaatgctacatatca

SEQ ID NO: 7496223 - DNA, 22 bp, Homo sapiens
aattggactgtgctgctcaaaa

SEQ ID NO: 7496224 - DNA, 22 bp, Homo sapiens
aagaatatagattttttgaagt

SEQ ID NO: 7496225 - DNA, 22 bp, Homo sapiens
aattggcttccattttctgttt

SEQ ID NO: 7496226 - DNA, 22 bp, Homo sapiens
aattggtttgaataaataaaga

SEQ ID NO: 7496227 - DNA, 22 bp, Homo sapiens
aattggttattctgtccttttt

SEQ ID NO: 7496228 - DNA, 22 bp, Homo sapiens
aattggtttgaataaataaaga

SEQ ID NO: 7496229 - DNA, 22 bp, Homo sapiens
aattgggagagttagcaatgct

SEQ ID NO: 7496230 - DNA, 22 bp, Homo sapiens
aagaataagaggatttagaaca

SEQ ID NO: 7496231 - DNA, 22 bp, Homo sapiens
aagaataagaggatttagaaca

SEQ ID NO: 7496232 - DNA, 22 bp, Homo sapiens
aagaataagaggatttagaaca

SEQ ID NO: 7496233 - DNA, 22 bp, Homo sapiens
aagaataagtagatgggagaag

SEQ ID NO: 7496234 - DNA, 22 bp, Homo sapiens
aagaataagaggatttagaaca

SEQ ID NO: 7496235 - DNA, 22 bp, Homo sapiens
aagaataagtagatgggagaag

SEQ ID NO: 7496236 - DNA, 22 bp, Homo sapiens
aagaataagaggatttagaaca

SEQ ID NO: 7496237 - DNA, 22 bp, Homo sapiens
aagaataagaggatttagaaca

SEQ ID NO: 7496238 - DNA, 22 bp, Homo sapiens
aagaataagaggatttagaaca

SEQ ID NO: 7496239 - DNA, 22 bp, Homo sapiens
aagaataagaggatttagaaca

SEQ ID NO: 7496240 - DNA, 22 bp, Homo sapiens
aagaataagtagatgggagaag

SEQ ID NO: 7496241 - DNA, 22 bp, Homo sapiens
aagaataagtagatgggagaag

SEQ ID NO: 7496242 - DNA, 22 bp, Homo sapiens
aagaataagtagatgggagaag

SEQ ID NO: 7496243 - DNA, 22 bp, Homo sapiens
aagaataagtagatgggagaag

SEQ ID NO: 7496244 - DNA, 22 bp, Homo sapiens
aagaatacgtatcaacaatggt

SEQ ID NO: 7496245 - DNA, 22 bp, Homo sapiens
aagaatacgtatcaacaatggt

SEQ ID NO: 7496246 - DNA, 22 bp, Homo sapiens
aagaatacgtatcaacaatggt

SEQ ID NO: 7496247 - DNA, 22 bp, Homo sapiens
aagaatacgtatcaacaatggt

SEQ ID NO: 7496248 - DNA, 23 bp, Homo sapiens
aagaataaatgacattaaaggtg

SEQ ID NO: 7496249 - DNA, 23 bp, Homo sapiens
aagaataaatgacattaaaggtg

SEQ ID NO: 7496250 - DNA, 23 bp, Homo sapiens
aagaataaatgacattaaaggtg

SEQ ID NO: 7496251 - DNA, 23 bp, Homo sapiens
aagaataaatgacattaaaggtg

SEQ ID NO: 7496252 - DNA, 23 bp, Homo sapiens
aagaataaatgacattaaaggtg

SEQ ID NO: 7496253 - DNA, 22 bp, Homo sapiens
aagaataaattaagatacttag

SEQ ID NO: 7496254 - DNA, 23 bp, Homo sapiens
aagaataaatgacattaaaggtg

SEQ ID NO: 7496255 - DNA, 23 bp, Homo sapiens
aagaataaatgacattaaaggtg

SEQ ID NO: 7496256 - DNA, 21 bp, Homo sapiens
aagaagtttggattttgtcct

SEQ ID NO: 7496257 - DNA, 21 bp, Homo sapiens
aagaagtttggattttgtcct

SEQ ID NO: 7496258 - DNA, 21 bp, Homo sapiens
aagaagtttggattttgtcct

SEQ ID NO: 7496259 - DNA, 20 bp, Homo sapiens
aagaagttggtaagcagtgc

SEQ ID NO: 7496260 - DNA, 21 bp, Homo sapiens
aagaagtttggattttgtcct

SEQ ID NO: 7496261 - DNA, 20 bp, Homo sapiens
aagaagttggtaagcagtgc

SEQ ID NO: 7496262 - DNA, 20 bp, Homo sapiens
aagaagttggtaagcagtgc

SEQ ID NO: 7496263 - DNA, 22 bp, Homo sapiens
aagaagcagagctgtgggtgtt

SEQ ID NO: 7496264 - DNA, 22 bp, Homo sapiens
aagaagcagagctgtgggtgtt

SEQ ID NO: 7496265 - DNA, 18 bp, Homo sapiens
aagaagttggccaaagag

SEQ ID NO: 7496266 - DNA, 18 bp, Homo sapiens
aagaagttggccaaagag

SEQ ID NO: 7496267 - DNA, 22 bp, Homo sapiens
aagaataacacttaggttttgc

SEQ ID NO: 7496268 - DNA, 22 bp, Homo sapiens
aagaataaattaagatacttag

SEQ ID NO: 7496269 - DNA, 22 bp, Homo sapiens
aagaataacacttaggttttgc

SEQ ID NO: 7496270 - DNA, 22 bp, Homo sapiens
aagaataaattaagatacttag

SEQ ID NO: 7496271 - DNA, 22 bp, Homo sapiens
aagaataagaggatttagaaca

SEQ ID NO: 7496272 - DNA, 22 bp, Homo sapiens
aagaataagaggatttagaaca

SEQ ID NO: 7496273 - DNA, 22 bp, Homo sapiens
aagaataacacttaggttttgc

SEQ ID NO: 7496274 - DNA, 22 bp, Homo sapiens
aagaataacacttaggttttgc

SEQ ID NO: 7496275 - DNA, 22 bp, Homo sapiens
aagaataaattaagatacttag

SEQ ID NO: 7496276 - DNA, 22 bp, Homo sapiens
aagaataaattaagatacttag

SEQ ID NO: 7496277 - DNA, 22 bp, Homo sapiens
aagaataaattaagatacttag

SEQ ID NO: 7496278 - DNA, 22 bp, Homo sapiens
aagaataaattaagatacttag

SEQ ID NO: 7496279 - DNA, 22 bp, Homo sapiens
aagaataaattaagatacttag

SEQ ID NO: 7496280 - DNA, 22 bp, Homo sapiens
aagaataaattaagatacttag

SEQ ID NO: 7496281 - DNA, 22 bp, Homo sapiens
aagaataaattaagatacttag

SEQ ID NO: 7496282 - DNA, 22 bp, Homo sapiens
aagaataaattaagatacttag

SEQ ID NO: 7496283 - DNA, 22 bp, Homo sapiens
aagaataaattaagatacttag

SEQ ID NO: 7496284 - DNA, 22 bp, Homo sapiens
aagaataaattaagatacttag

SEQ ID NO: 7496285 - DNA, 22 bp, Homo sapiens
aattgtcaaacacaaataagag

SEQ ID NO: 7496286 - DNA, 22 bp, Homo sapiens
aattgtcaaacacaaataagag

SEQ ID NO: 7496287 - DNA, 17 bp, Homo sapiens
aattgtcagcagtagct

SEQ ID NO: 7496288 - DNA, 22 bp, Homo sapiens
aattgtcaaacacaaataagag

SEQ ID NO: 7496289 - DNA, 22 bp, Homo sapiens
aattgtcttgaaagcaacactt

SEQ ID NO: 7496290 - DNA, 22 bp, Homo sapiens
aattgtcttctccttcctggca

SEQ ID NO: 7496291 - DNA, 22 bp, Homo sapiens
aattgtcttggtgcaatcatga

SEQ ID NO: 7496292 - DNA, 22 bp, Homo sapiens
aattgtaactacattgagaaca

SEQ ID NO: 7496293 - DNA, 22 bp, Homo sapiens
aattggttattctgtccttttt

SEQ ID NO: 7496294 - DNA, 22 bp, Homo sapiens
aattgtaactacattgagaaca

SEQ ID NO: 7496295 - DNA, 22 bp, Homo sapiens
aattgtaagtgctgagttaagg

SEQ ID NO: 7496296 - DNA, 22 bp, Homo sapiens
aattgtaagtgctgagttaagg

SEQ ID NO: 7496297 - DNA, 22 bp, Homo sapiens
aattgtaagtgctgagttaagg

SEQ ID NO: 7496298 - DNA, 22 bp, Homo sapiens
aattgtacaagccttgtgccat

SEQ ID NO: 7496299 - DNA, 22 bp, Homo sapiens
aattgtacaagccttgtgccat

SEQ ID NO: 7496300 - DNA, 22 bp, Homo sapiens
aattgtacaagccttgtgccat

SEQ ID NO: 7496301 - DNA, 22 bp, Homo sapiens
aattgtacaggaagttgctgga

SEQ ID NO: 7496302 - DNA, 22 bp, Homo sapiens
aattgtacaggaagttgctgga

SEQ ID NO: 7496303 - DNA, 22 bp, Homo sapiens
aattgtacaggaagttgctgga

SEQ ID NO: 7496304 - DNA, 22 bp, Homo sapiens
aattgtacataaaccatttggc

SEQ ID NO: 7496305 - DNA, 22 bp, Homo sapiens
aattgtacataaaccatttggc

SEQ ID NO: 7496306 - DNA, 22 bp, Homo sapiens
aattgtacataaaccatttggc

SEQ ID NO: 7496307 - DNA, 22 bp, Homo sapiens
aattgtacatatttatgagcga

SEQ ID NO: 7496308 - DNA, 22 bp, Homo sapiens
aattgtacatatttatgagcga

SEQ ID NO: 7496309 - DNA, 22 bp, Homo sapiens
aattgtcaaaaattgcaattgt

SEQ ID NO: 7496310 - DNA, 22 bp, Homo sapiens
aattgtgaacctttacagttgt

SEQ ID NO: 7496311 - DNA, 22 bp, Homo sapiens
aattgtgcatttttaaatcacg

SEQ ID NO: 7496312 - DNA, 22 bp, Homo sapiens
aattgtgatgacagctggtggt

SEQ ID NO: 7496313 - DNA, 22 bp, Homo sapiens
aattgtgcccgtgacatttcat

SEQ ID NO: 7496314 - DNA, 22 bp, Homo sapiens
aattgtgcatttttaaatcacg

SEQ ID NO: 7496315 - DNA, 22 bp, Homo sapiens
aattgtgcccgtgacatttcat

SEQ ID NO: 7496316 - DNA, 22 bp, Homo sapiens
aattgtgctatgattatgaaag

SEQ ID NO: 7496317 - DNA, 21 bp, Homo sapiens
aattgtgctattctgctttta

SEQ ID NO: 7496318 - DNA, 22 bp, Homo sapiens
aattgtgctatgattatgaaag

SEQ ID NO: 7496319 - DNA, 22 bp, Homo sapiens
aattgtgctgctataggattaa

SEQ ID NO: 7496320 - DNA, 21 bp, Homo sapiens
aattgtgctattctgctttta

SEQ ID NO: 7496321 - DNA, 22 bp, Homo sapiens
aattgtgctgtaggctcgttaa

SEQ ID NO: 7496322 - DNA, 22 bp, Homo sapiens
aattgtgctgctataggattaa

SEQ ID NO: 7496323 - DNA, 22 bp, Homo sapiens
aattgtgctgtaggctcgttaa

SEQ ID NO: 7496324 - DNA, 22 bp, Homo sapiens
aattgttgggtattcctgtgac

SEQ ID NO: 7496325 - DNA, 23 bp, Homo sapiens
aattgtgcttcccaggggctatt

SEQ ID NO: 7496326 - DNA, 23 bp, Homo sapiens
aattgtgcttcccaggggctatt

SEQ ID NO: 7496327 - DNA, 22 bp, Homo sapiens
aattgtgctgtgatcaattact

SEQ ID NO: 7496328 - DNA, 22 bp, Homo sapiens
aattgtgctgtgatcaattact

SEQ ID NO: 7496329 - DNA, 22 bp, Homo sapiens
aagacagtgacagtcacaattg

SEQ ID NO: 7496330 - DNA, 22 bp, Homo sapiens
aagacagtgacagtcacaattg

SEQ ID NO: 7496331 - DNA, 22 bp, Homo sapiens
aagacaggaacatagcaaatcc

SEQ ID NO: 7496332 - DNA, 22 bp, Homo sapiens
aagacaggaacatagcaaatcc

SEQ ID NO: 7496333 - DNA, 22 bp, Homo sapiens
aagacagtgtgtcaggcaggtg

SEQ ID NO: 7496334 - DNA, 22 bp, Homo sapiens
aagacagtgatctctgagagat

SEQ ID NO: 7496335 - DNA, 22 bp, Homo sapiens
aagacagtgacagtcacaattg

SEQ ID NO: 7496336 - DNA, 22 bp, Homo sapiens
aagacaggaaaagctccaggcc

SEQ ID NO: 7496337 - DNA, 22 bp, Homo sapiens
aagacaggaacatagcaaatcc

SEQ ID NO: 7496338 - DNA, 22 bp, Homo sapiens
aagacaggaaaagctccaggcc

SEQ ID NO: 7496339 - DNA, 22 bp, Homo sapiens
aagacaggaaaagctccaggcc

SEQ ID NO: 7496340 - DNA, 22 bp, Homo sapiens
aagacaggaaaagctccaggcc

SEQ ID NO: 7496341 - DNA, 22 bp, Homo sapiens
aagacaggaaaagctccaggcc

SEQ ID NO: 7496342 - DNA, 22 bp, Homo sapiens
aagacagcagcacctctcgttt

SEQ ID NO: 7496343 - DNA, 22 bp, Homo sapiens
aagacagcagcacctctcgttt

SEQ ID NO: 7496344 - DNA, 22 bp, Homo sapiens
aagacagcagcacctctcgttt

SEQ ID NO: 7496345 - DNA, 22 bp, Homo sapiens
aagacagcattgctgagggctt

SEQ ID NO: 7496346 - DNA, 22 bp, Homo sapiens
aagacagcattgctgagggctt

SEQ ID NO: 7496347 - DNA, 22 bp, Homo sapiens
aagacagcattgctgagggctt

SEQ ID NO: 7496348 - DNA, 22 bp, Homo sapiens
aagacagcattgctgagggctt

SEQ ID NO: 7496349 - DNA, 22 bp, Homo sapiens
aagacagcctttccctggtgcc

SEQ ID NO: 7496350 - DNA, 22 bp, Homo sapiens
aagacagcctttccctggtgcc

SEQ ID NO: 7496351 - DNA, 22 bp, Homo sapiens
aagacagcctttccctggtgcc

SEQ ID NO: 7496352 - DNA, 22 bp, Homo sapiens
aagacagcattttaccccaaca

SEQ ID NO: 7496353 - DNA, 22 bp, Homo sapiens
aagacagcattttaccccaaca

SEQ ID NO: 7496354 - DNA, 22 bp, Homo sapiens
aagacagccagctccatgggat

SEQ ID NO: 7496355 - DNA, 22 bp, Homo sapiens
aagacagccagctccatgggat

SEQ ID NO: 7496356 - DNA, 22 bp, Homo sapiens
aagacagccagctccatgggat

SEQ ID NO: 7496357 - DNA, 22 bp, Homo sapiens
aagacagcctttccctggtgcc

SEQ ID NO: 7496358 - DNA, 22 bp, Homo sapiens
aagacagcctttccctggtgcc

SEQ ID NO: 7496359 - DNA, 22 bp, Homo sapiens
aagacagctcaggacagattca

SEQ ID NO: 7496360 - DNA, 22 bp, Homo sapiens
aagacagctcaggacagattca

SEQ ID NO: 7496361 - DNA, 20 bp, Homo sapiens
aagacaccagtggcagcccc

SEQ ID NO: 7496362 - DNA, 20 bp, Homo sapiens
aagacaccagtggcagcccc

SEQ ID NO: 7496363 - DNA, 20 bp, Homo sapiens
aagacaccagtggcagcccc

SEQ ID NO: 7496364 - DNA, 22 bp, Homo sapiens
aagacacagcgaaatgttcctg

SEQ ID NO: 7496365 - DNA, 20 bp, Homo sapiens
aagacaccagtggcagcccc

SEQ ID NO: 7496366 - DNA, 22 bp, Homo sapiens
aagacactaagctttcaggata

SEQ ID NO: 7496367 - DNA, 20 bp, Homo sapiens
aagacaccagtggcagcccc

SEQ ID NO: 7496368 - DNA, 22 bp, Homo sapiens
aagacagcactggcattttcaa

SEQ ID NO: 7496369 - DNA, 22 bp, Homo sapiens
aagacagcactggcattttcaa

SEQ ID NO: 7496370 - DNA, 22 bp, Homo sapiens
aagaaatggaagatccatggtg

SEQ ID NO: 7496371 - DNA, 22 bp, Homo sapiens
aagaaatggcttcatctgagta

SEQ ID NO: 7496372 - DNA, 22 bp, Homo sapiens
aagaaatggcttcatctgagta

SEQ ID NO: 7496373 - DNA, 22 bp, Homo sapiens
aagaaatggcttcatctgagta

SEQ ID NO: 7496374 - DNA, 22 bp, Homo sapiens
aagaaatggaagatccatggtg

SEQ ID NO: 7496375 - DNA, 22 bp, Homo sapiens
aagaaatggaagatccatggtg

SEQ ID NO: 7496376 - DNA, 22 bp, Homo sapiens
aagaaatgctgatgttggatgg

SEQ ID NO: 7496377 - DNA, 22 bp, Homo sapiens
aagaaatgctgatgttggatgg

SEQ ID NO: 7496378 - DNA, 22 bp, Homo sapiens
aagaaatgctgatgttggatgg

SEQ ID NO: 7496379 - DNA, 22 bp, Homo sapiens
aagaaatgctgatgttggatgg

SEQ ID NO: 7496380 - DNA, 22 bp, Homo sapiens
aagaaatgcagaaatgtgctgg

SEQ ID NO: 7496381 - DNA, 22 bp, Homo sapiens
aagaaatgcagaaatgtgctgg

SEQ ID NO: 7496382 - DNA, 22 bp, Homo sapiens
aagaaatgcagaaatgtgctgg

SEQ ID NO: 7496383 - DNA, 22 bp, Homo sapiens
aagaaatgcagaaatgtgctgg

SEQ ID NO: 7496384 - DNA, 22 bp, Homo sapiens
aagaaatgcagaaatgtgctgg

SEQ ID NO: 7496385 - DNA, 22 bp, Homo sapiens
aagaaatgcagaaatgtgctgg

SEQ ID NO: 7496386 - DNA, 22 bp, Homo sapiens
aagaaatgcagaaatgtgctgg

SEQ ID NO: 7496387 - DNA, 22 bp, Homo sapiens
aagaaatgcacacaactgctgg

SEQ ID NO: 7496388 - DNA, 22 bp, Homo sapiens
aagaaatgcacacaactgctgg

SEQ ID NO: 7496389 - DNA, 22 bp, Homo sapiens
aagaaatgcacacaactgctgg

SEQ ID NO: 7496390 - DNA, 22 bp, Homo sapiens
aagaaatgcacacaactgctgg

SEQ ID NO: 7496391 - DNA, 22 bp, Homo sapiens
aagaaatggcttcatctgagta

SEQ ID NO: 7496392 - DNA, 22 bp, Homo sapiens
aagaaatggcttcatctgagta

SEQ ID NO: 7496393 - DNA, 22 bp, Homo sapiens
aagaaatggcttcatctgagta

SEQ ID NO: 7496394 - DNA, 22 bp, Homo sapiens
aagaaatggcttcatctgagta

SEQ ID NO: 7496395 - DNA, 22 bp, Homo sapiens
aagaaatggcttcatctgagta

SEQ ID NO: 7496396 - DNA, 22 bp, Homo sapiens
aagaaatggcttcatctgagta

SEQ ID NO: 7496397 - DNA, 22 bp, Homo sapiens
aatgttttaaaagagattgaga

SEQ ID NO: 7496398 - DNA, 22 bp, Homo sapiens
aatgttttaaaagagattgaga

SEQ ID NO: 7496399 - DNA, 22 bp, Homo sapiens
aatgttttacagatcccattag

SEQ ID NO: 7496400 - DNA, 22 bp, Homo sapiens
aatgttttagattactgctggg

SEQ ID NO: 7496401 - DNA, 22 bp, Homo sapiens
aatgttttatagctcaagcaat

SEQ ID NO: 7496402 - DNA, 22 bp, Homo sapiens
aatgttttatagctcaagcaat

SEQ ID NO: 7496403 - DNA, 22 bp, Homo sapiens
aatgttttatagctcaagcaat

SEQ ID NO: 7496404 - DNA, 22 bp, Homo sapiens
aatgttttatagctcaagcaat

SEQ ID NO: 7496405 - DNA, 22 bp, Homo sapiens
aatgttttacagatcccattag

SEQ ID NO: 7496406 - DNA, 22 bp, Homo sapiens
aatgttttagattactgctggg

SEQ ID NO: 7496407 - DNA, 22 bp, Homo sapiens
aatgttttagattactgctggg

SEQ ID NO: 7496408 - DNA, 22 bp, Homo sapiens
aatgttttagattactgctggg

SEQ ID NO: 7496409 - DNA, 22 bp, Homo sapiens
aatgttttcccagtgcagacga

SEQ ID NO: 7496410 - DNA, 22 bp, Homo sapiens
aatgttttcccagtgcagacga

SEQ ID NO: 7496411 - DNA, 22 bp, Homo sapiens
aatgttttcccagtgcagacga

SEQ ID NO: 7496412 - DNA, 22 bp, Homo sapiens
aatgttttcccagtgcagacga

SEQ ID NO: 7496413 - DNA, 22 bp, Homo sapiens
aatgttttcattatcctaactg

SEQ ID NO: 7496414 - DNA, 22 bp, Homo sapiens
aatgttttctctgtgaacacat

SEQ ID NO: 7496415 - DNA, 22 bp, Homo sapiens
aatgttttctctgtgaacacat

SEQ ID NO: 7496416 - DNA, 22 bp, Homo sapiens
aatgttttctctgtgaacacat

SEQ ID NO: 7496417 - DNA, 22 bp, Homo sapiens
aatgttttctctgtgaacacat

SEQ ID NO: 7496418 - DNA, 22 bp, Homo sapiens
aatgttttctctgtgaacacat

SEQ ID NO: 7496419 - DNA, 22 bp, Homo sapiens
aatgttttctctgtgaacacat

SEQ ID NO: 7496420 - DNA, 22 bp, Homo sapiens
aatgttttcattatcctaactg

SEQ ID NO: 7496421 - DNA, 22 bp, Homo sapiens
aatgttttcattatcctaactg

SEQ ID NO: 7496422 - DNA, 22 bp, Homo sapiens
aatgttttcattatcctaactg

SEQ ID NO: 7496423 - DNA, 22 bp, Homo sapiens
aatgttttcattatcctaactg

SEQ ID NO: 7496424 - DNA, 22 bp, Homo sapiens
aatgttttatagctcaagcaat

SEQ ID NO: 7496425 - DNA, 22 bp, Homo sapiens
aatgttttatagctcaagcaat

SEQ ID NO: 7496426 - DNA, 22 bp, Homo sapiens
aatgttttgcattagttttcta

SEQ ID NO: 7496427 - DNA, 22 bp, Homo sapiens
aatgttttgcattagttttcta

SEQ ID NO: 7496428 - DNA, 22 bp, Homo sapiens
aatgttttgcattagttttcta

SEQ ID NO: 7496429 - DNA, 22 bp, Homo sapiens
aatgttttgcattagttttcta

SEQ ID NO: 7496430 - DNA, 22 bp, Homo sapiens
aatgttttgcattagttttcta

SEQ ID NO: 7496431 - DNA, 22 bp, Homo sapiens
aatgttttctgactgctaactt

SEQ ID NO: 7496432 - DNA, 22 bp, Homo sapiens
aatgttttctgactgctaactt

SEQ ID NO: 7496433 - DNA, 22 bp, Homo sapiens
aatgttttctgactgctaactt

SEQ ID NO: 7496434 - DNA, 22 bp, Homo sapiens
aatgttttctgactgctaactt

SEQ ID NO: 7496435 - DNA, 22 bp, Homo sapiens
aatgttttctctgtgaacacat

SEQ ID NO: 7496436 - DNA, 22 bp, Homo sapiens
aatgttttctgactgctaactt

SEQ ID NO: 7496437 - DNA, 22 bp, Homo sapiens
aatgttttgcattagttttcta

SEQ ID NO: 7496438 - DNA, 22 bp, Homo sapiens
aatgttttgcattagttttcta

SEQ ID NO: 7496439 - DNA, 22 bp, Homo sapiens
aatgttttgcattagttttcta

SEQ ID NO: 7496440 - DNA, 22 bp, Homo sapiens
aatgttttgcattagttttcta

SEQ ID NO: 7496441 - DNA, 22 bp, Homo sapiens
aagaagcactttcctacatgtt

SEQ ID NO: 7496442 - DNA, 22 bp, Homo sapiens
aagaagcactttcctacatgtt

SEQ ID NO: 7496443 - DNA, 22 bp, Homo sapiens
aagaagcactttcctacatgtt

SEQ ID NO: 7496444 - DNA, 22 bp, Homo sapiens
aagaagcactttcctacatgtt

SEQ ID NO: 7496445 - DNA, 22 bp, Homo sapiens
aagaagcactttcctacatgtt

SEQ ID NO: 7496446 - DNA, 22 bp, Homo sapiens
aacttcagagctgtgtggtttg

SEQ ID NO: 7496447 - DNA, 22 bp, Homo sapiens
aacttcagagctgtgtggtttg

SEQ ID NO: 7496448 - DNA, 22 bp, Homo sapiens
aacttcaagcttcgtcccttcg

SEQ ID NO: 7496449 - DNA, 22 bp, Homo sapiens
aacttcaagcttcgtcccttcg

SEQ ID NO: 7496450 - DNA, 22 bp, Homo sapiens
aacttcacctttttgccacact

SEQ ID NO: 7496451 - DNA, 18 bp, Homo sapiens
aacttcaactacaatgga

SEQ ID NO: 7496452 - DNA, 22 bp, Homo sapiens
aacttcaaatgtgactttgcat

SEQ ID NO: 7496453 - DNA, 22 bp, Homo sapiens
aacttcaaatgtgactttgcat

SEQ ID NO: 7496454 - DNA, 22 bp, Homo sapiens
aacttattgaacattctcgaat

SEQ ID NO: 7496455 - DNA, 22 bp, Homo sapiens
aacttattgaacattctcgaat

SEQ ID NO: 7496456 - DNA, 18 bp, Homo sapiens
aacttcaactacaatgga

SEQ ID NO: 7496457 - DNA, 22 bp, Homo sapiens
aacttcaaatgtgactttgcat

SEQ ID NO: 7496458 - DNA, 22 bp, Homo sapiens
aacttagtttagggtattgatt

SEQ ID NO: 7496459 - DNA, 22 bp, Homo sapiens
aacttagtttagggtattgatt

SEQ ID NO: 7496460 - DNA, 22 bp, Homo sapiens
aacttagttggggacaccatgg

SEQ ID NO: 7496461 - DNA, 22 bp, Homo sapiens
aacttatacccagggcagaaat

SEQ ID NO: 7496462 - DNA, 22 bp, Homo sapiens
aacttatacccagggcagaaat

SEQ ID NO: 7496463 - DNA, 22 bp, Homo sapiens
aacttatcagactgatgtatgg

SEQ ID NO: 7496464 - DNA, 22 bp, Homo sapiens
aacttattccataggctcactg

SEQ ID NO: 7496465 - DNA, 22 bp, Homo sapiens
aacttattccataggctcactg

SEQ ID NO: 7496466 - DNA, 22 bp, Homo sapiens
aacttcagggacagaaaagagc

SEQ ID NO: 7496467 - DNA, 22 bp, Homo sapiens
aacttcagttgagaaaggcatg

SEQ ID NO: 7496468 - DNA, 22 bp, Homo sapiens
aacttcagggacagaaaagagc

SEQ ID NO: 7496469 - DNA, 22 bp, Homo sapiens
aacttcagggggcacattcaag

SEQ ID NO: 7496470 - DNA, 22 bp, Homo sapiens
aacttcagggggcacattcaag

SEQ ID NO: 7496471 - DNA, 22 bp, Homo sapiens
aacttcatgggttcaaagctgg

SEQ ID NO: 7496472 - DNA, 22 bp, Homo sapiens
aacttcatgggttcaaagctgg

SEQ ID NO: 7496473 - DNA, 22 bp, Homo sapiens
aacttcatgtaatttaaaacag

SEQ ID NO: 7496474 - DNA, 22 bp, Homo sapiens
aacttcatgtaatttaaaacag

SEQ ID NO: 7496475 - DNA, 22 bp, Homo sapiens
aacttcagttgagaaaggcatg

SEQ ID NO: 7496476 - DNA, 22 bp, Homo sapiens
aagaaagcattagacaggcatt

SEQ ID NO: 7496477 - DNA, 22 bp, Homo sapiens
aagaaagcattagacaggcatt

SEQ ID NO: 7496478 - DNA, 22 bp, Homo sapiens
aagaaagcattagacaggcatt

SEQ ID NO: 7496479 - DNA, 21 bp, Homo sapiens
aagaaagataattaaggaccc

SEQ ID NO: 7496480 - DNA, 22 bp, Homo sapiens
aacttcagttgagaaaggcatg

SEQ ID NO: 7496481 - DNA, 21 bp, Homo sapiens
aagaaagataattaaggaccc

SEQ ID NO: 7496482 - DNA, 22 bp, Homo sapiens
aacttcatgtaatttaaaacag

SEQ ID NO: 7496483 - DNA, 21 bp, Homo sapiens
aagaaagataattaaggaccc

SEQ ID NO: 7496484 - DNA, 21 bp, Homo sapiens
aagaaagataattaaggaccc

SEQ ID NO: 7496485 - DNA, 22 bp, Homo sapiens
aagaaatattgggccttataaa

SEQ ID NO: 7496486 - DNA, 22 bp, Homo sapiens
aagaaatattgggccttataaa

SEQ ID NO: 7496487 - DNA, 22 bp, Homo sapiens
aagaaatattgggccttataaa

SEQ ID NO: 7496488 - DNA, 22 bp, Homo sapiens
aagaaatattgggccttataaa

SEQ ID NO: 7496489 - DNA, 22 bp, Homo sapiens
aagaaatattgggccttataaa

SEQ ID NO: 7496490 - DNA, 22 bp, Homo sapiens
aagaaatattgggccttataaa

SEQ ID NO: 7496491 - DNA, 22 bp, Homo sapiens
aagaaatattgggccttataaa

SEQ ID NO: 7496492 - DNA, 22 bp, Homo sapiens
aagaaatattgggccttataaa

SEQ ID NO: 7496493 - DNA, 22 bp, Homo sapiens
aagaaatgcacacaactgctgg

SEQ ID NO: 7496494 - DNA, 22 bp, Homo sapiens
aagaaatgcacacaactgctgg

SEQ ID NO: 7496495 - DNA, 22 bp, Homo sapiens
aagaaatctgatatttgtttca

SEQ ID NO: 7496496 - DNA, 22 bp, Homo sapiens
aagaaatcatatcatttcttgg

SEQ ID NO: 7496497 - DNA, 22 bp, Homo sapiens
aagaaatcatatcatttcttgg

SEQ ID NO: 7496498 - DNA, 22 bp, Homo sapiens
aagaaatcatatcatttcttgg

SEQ ID NO: 7496499 - DNA, 22 bp, Homo sapiens
aagaaatcatatcatttcttgg

SEQ ID NO: 7496500 - DNA, 22 bp, Homo sapiens
aagaaatcagaaaagcattcgt

SEQ ID NO: 7496501 - DNA, 22 bp, Homo sapiens
aagaaatcagaaaagcattcgt

SEQ ID NO: 7496502 - DNA, 22 bp, Homo sapiens
aagaaatcagaaaagcattcgt

SEQ ID NO: 7496503 - DNA, 22 bp, Homo sapiens
aagaaatcagaaaagcattcgt

SEQ ID NO: 7496504 - DNA, 22 bp, Homo sapiens
aagaaataagacttctctgtcc

SEQ ID NO: 7496505 - DNA, 22 bp, Homo sapiens
aagaaataagacttctctgtcc

SEQ ID NO: 7496506 - DNA, 22 bp, Homo sapiens
aagaaatacatggtttttgagt

SEQ ID NO: 7496507 - DNA, 22 bp, Homo sapiens
aagaaatacatggtttttgagt

SEQ ID NO: 7496508 - DNA, 22 bp, Homo sapiens
aagaaatacatggtttttgagt

SEQ ID NO: 7496509 - DNA, 22 bp, Homo sapiens
aagaaatacatggtttttgagt

SEQ ID NO: 7496510 - DNA, 22 bp, Homo sapiens
aagaaatacatggtttttgagt

SEQ ID NO: 7496511 - DNA, 22 bp, Homo sapiens
aagaaatacatggtttttgagt

SEQ ID NO: 7496512 - DNA, 22 bp, Homo sapiens
aagaaatacatggtttttgagt

SEQ ID NO: 7496513 - DNA, 22 bp, Homo sapiens
aagaaagcattagacaggcatt

SEQ ID NO: 7496514 - DNA, 22 bp, Homo sapiens
aagaaagccaaagttcatacct

SEQ ID NO: 7496515 - DNA, 22 bp, Homo sapiens
aagaaagccaaagttcatacct

SEQ ID NO: 7496516 - DNA, 22 bp, Homo sapiens
aagaaataagacttctctgtcc

SEQ ID NO: 7496517 - DNA, 22 bp, Homo sapiens
aagaaatacatggtttttgagt

SEQ ID NO: 7496518 - DNA, 22 bp, Homo sapiens
aagaaatacatggtttttgagt

SEQ ID NO: 7496519 - DNA, 22 bp, Homo sapiens
aagaaatattgggccttataaa

SEQ ID NO: 7496520 - DNA, 22 bp, Homo sapiens
aagaaatattgggccttataaa

SEQ ID NO: 7496521 - DNA, 22 bp, Homo sapiens
aagaaatacatggtttttgagt

SEQ ID NO: 7496522 - DNA, 22 bp, Homo sapiens
aagaaatattgggccttataaa

SEQ ID NO: 7496523 - DNA, 22 bp, Homo sapiens
aagaaatattgggccttataaa

SEQ ID NO: 7496524 - DNA, 22 bp, Homo sapiens
aagaaatattgggccttataaa

SEQ ID NO: 7496525 - DNA, 22 bp, Homo sapiens
aagagctggatggaatctggga

SEQ ID NO: 7496526 - DNA, 22 bp, Homo sapiens
aagagctggatggaatctggga

SEQ ID NO: 7496527 - DNA, 21 bp, Homo sapiens
aagagctggatcaaggataag

SEQ ID NO: 7496528 - DNA, 21 bp, Homo sapiens
aagagctggatcaaggataag

SEQ ID NO: 7496529 - DNA, 21 bp, Homo sapiens
aagagctggatcaaggataag

SEQ ID NO: 7496530 - DNA, 22 bp, Homo sapiens
aagagctggatgaagaaatcaa

SEQ ID NO: 7496531 - DNA, 22 bp, Homo sapiens
aagagctggcccaatctgagca

SEQ ID NO: 7496532 - DNA, 22 bp, Homo sapiens
aagagctggattgtgctgcaga

SEQ ID NO: 7496533 - DNA, 22 bp, Homo sapiens
aagagctggattgtgctgcaga

SEQ ID NO: 7496534 - DNA, 22 bp, Homo sapiens
aagagctggattgtgctgcaga

SEQ ID NO: 7496535 - DNA, 22 bp, Homo sapiens
aagagctggattgtgctgcaga

SEQ ID NO: 7496536 - DNA, 21 bp, Homo sapiens
aagagctggatcaaggataag

SEQ ID NO: 7496537 - DNA, 21 bp, Homo sapiens
aagagctggatcaaggataag

SEQ ID NO: 7496538 - DNA, 21 bp, Homo sapiens
aagagctggatcaaggataag

SEQ ID NO: 7496539 - DNA, 22 bp, Homo sapiens
aagagctggagtttgcagccct

SEQ ID NO: 7496540 - DNA, 22 bp, Homo sapiens
aagagctggagtttgcagccct

SEQ ID NO: 7496541 - DNA, 22 bp, Homo sapiens
aagagctggagtttgcagccct

SEQ ID NO: 7496542 - DNA, 22 bp, Homo sapiens
aagagctggagctgctacagga

SEQ ID NO: 7496543 - DNA, 22 bp, Homo sapiens
aagagctggagctgctacagga

SEQ ID NO: 7496544 - DNA, 22 bp, Homo sapiens
aagagctggaagtgaagataac

SEQ ID NO: 7496545 - DNA, 22 bp, Homo sapiens
aagagctggaagtgaagataac

SEQ ID NO: 7496546 - DNA, 22 bp, Homo sapiens
aagagctggagctgctacagga

SEQ ID NO: 7496547 - DNA, 22 bp, Homo sapiens
aagagctggagctgctacagga

SEQ ID NO: 7496548 - DNA, 22 bp, Homo sapiens
aagagctggagctgctacagga

SEQ ID NO: 7496549 - DNA, 22 bp, Homo sapiens
aagagctggagctgctacagga

SEQ ID NO: 7496550 - DNA, 22 bp, Homo sapiens
aagagctggagctgctacagga

SEQ ID NO: 7496551 - DNA, 22 bp, Homo sapiens
aagagctgtatgccatatgatt

SEQ ID NO: 7496552 - DNA, 22 bp, Homo sapiens
aagagctgtatgccatatgatt

SEQ ID NO: 7496553 - DNA, 22 bp, Homo sapiens
aagagctgtatgccatatgatt

SEQ ID NO: 7496554 - DNA, 22 bp, Homo sapiens
aagagctgtgggtggtagtcct

SEQ ID NO: 7496555 - DNA, 21 bp, Homo sapiens
aagagctgtcaggaaggctgc

SEQ ID NO: 7496556 - DNA, 21 bp, Homo sapiens
aagagctgtcaggaaggctgc

SEQ ID NO: 7496557 - DNA, 22 bp, Homo sapiens
aagagctggctcttgcagcagc

SEQ ID NO: 7496558 - DNA, 22 bp, Homo sapiens
aagagctggcccaatctgagca

SEQ ID NO: 7496559 - DNA, 22 bp, Homo sapiens
aagagctggcccaatctgagca

SEQ ID NO: 7496560 - DNA, 22 bp, Homo sapiens
aagagctggctcttgcagcagc

SEQ ID NO: 7496561 - DNA, 22 bp, Homo sapiens
aagagctggctcttgcagcagc

SEQ ID NO: 7496562 - DNA, 22 bp, Homo sapiens
aagagctggctcttgcagcagc

SEQ ID NO: 7496563 - DNA, 22 bp, Homo sapiens
aagagctggtcacaggtccatt

SEQ ID NO: 7496564 - DNA, 22 bp, Homo sapiens
aagagctggtcacaggtccatt

SEQ ID NO: 7496565 - DNA, 22 bp, Homo sapiens
aagagctggtcacaggtccatt

SEQ ID NO: 7496566 - DNA, 22 bp, Homo sapiens
aagaggaactgggggctgagtc

SEQ ID NO: 7496567 - DNA, 22 bp, Homo sapiens
aagaggaactgggggctgagtc

SEQ ID NO: 7496568 - DNA, 22 bp, Homo sapiens
aagaggaaatgattgactatat

SEQ ID NO: 7496569 - DNA, 22 bp, Homo sapiens
aagagctgttgtctgcttactg

SEQ ID NO: 7496570 - DNA, 22 bp, Homo sapiens
aagaggaaatgattgactatat

SEQ ID NO: 7496571 - DNA, 22 bp, Homo sapiens
aagaggaaatgattgactatat

SEQ ID NO: 7496572 - DNA, 22 bp, Homo sapiens
aagaggaactgggggctgagtc

SEQ ID NO: 7496573 - DNA, 22 bp, Homo sapiens
aagaggaactgggggctgagtc

SEQ ID NO: 7496574 - DNA, 22 bp, Homo sapiens
aagaggaactgggggctgagtc

SEQ ID NO: 7496575 - DNA, 22 bp, Homo sapiens
aagaggaactgggggctgagtc

SEQ ID NO: 7496576 - DNA, 22 bp, Homo sapiens
aagaggaactgggggctgagtc

SEQ ID NO: 7496577 - DNA, 22 bp, Homo sapiens
aagaggaactgggggctgagtc

SEQ ID NO: 7496578 - DNA, 22 bp, Homo sapiens
aagaggaactgggggctgagtc

SEQ ID NO: 7496579 - DNA, 22 bp, Homo sapiens
aagagcttcctctttcattgct

SEQ ID NO: 7496580 - DNA, 22 bp, Homo sapiens
aagagcttccctgttgtagagg

SEQ ID NO: 7496581 - DNA, 18 bp, Homo sapiens
aagagcttcgcatataca

SEQ ID NO: 7496582 - DNA, 22 bp, Homo sapiens
aagagcttggactttcaagtca

SEQ ID NO: 7496583 - DNA, 22 bp, Homo sapiens
aagagctgttgtctgcttactg

SEQ ID NO: 7496584 - DNA, 22 bp, Homo sapiens
aagagctgtgggtggtagtcct

SEQ ID NO: 7496585 - DNA, 22 bp, Homo sapiens
aagagctgtgggtggtagtcct

SEQ ID NO: 7496586 - DNA, 22 bp, Homo sapiens
aagagctgtgggtggtagtcct

SEQ ID NO: 7496587 - DNA, 22 bp, Homo sapiens
acaaggcactttatgaagagga

SEQ ID NO: 7496588 - DNA, 22 bp, Homo sapiens
acaaggcactttatgaagagga

SEQ ID NO: 7496589 - DNA, 22 bp, Homo sapiens
acaaggcaattcctggtgaatt

SEQ ID NO: 7496590 - DNA, 22 bp, Homo sapiens
acaaggcaattcctggtgaatt

SEQ ID NO: 7496591 - DNA, 22 bp, Homo sapiens
acaaggcaattcctggtgaatt

SEQ ID NO: 7496592 - DNA, 23 bp, Homo sapiens
acaaggcaacatagatcagggca

SEQ ID NO: 7496593 - DNA, 22 bp, Homo sapiens
acaaggcaatggcaggatttca

SEQ ID NO: 7496594 - DNA, 23 bp, Homo sapiens
acaaggcaacatagatcagggca

SEQ ID NO: 7496595 - DNA, 22 bp, Homo sapiens
acaaggcaatggcaggatttca

SEQ ID NO: 7496596 - DNA, 23 bp, Homo sapiens
acaaggcaacatagatcagggca

SEQ ID NO: 7496597 - DNA, 23 bp, Homo sapiens
acaaggcaacatagatcagggca

SEQ ID NO: 7496598 - DNA, 22 bp, Homo sapiens
acaaggatttgttcctaatgtt

SEQ ID NO: 7496599 - DNA, 22 bp, Homo sapiens
acaaggcagtacaatgatgaca

SEQ ID NO: 7496600 - DNA, 22 bp, Homo sapiens
acaaggcagtacaatgatgaca

SEQ ID NO: 7496601 - DNA, 22 bp, Homo sapiens
acaaggcagtacaatgatgaca

SEQ ID NO: 7496602 - DNA, 22 bp, Homo sapiens
acaaggcagttaaaatggttaa

SEQ ID NO: 7496603 - DNA, 22 bp, Homo sapiens
acaaggcagttaaaatggttaa

SEQ ID NO: 7496604 - DNA, 22 bp, Homo sapiens
acaaggccaagcattctagcaa

SEQ ID NO: 7496605 - DNA, 22 bp, Homo sapiens
acaaggcattccggaagtaacc

SEQ ID NO: 7496606 - DNA, 22 bp, Homo sapiens
acaaggccaagcattctagcaa

SEQ ID NO: 7496607 - DNA, 22 bp, Homo sapiens
acaaggcattccggaagtaacc

SEQ ID NO: 7496608 - DNA, 22 bp, Homo sapiens
acaaggcagttaaaatggttaa

SEQ ID NO: 7496609 - DNA, 22 bp, Homo sapiens
acaaggcagttaaaatggttaa

SEQ ID NO: 7496610 - DNA, 22 bp, Homo sapiens
acaaggcattccggaagtaacc

SEQ ID NO: 7496611 - DNA, 22 bp, Homo sapiens
acaaggctgtgggagaacctct

SEQ ID NO: 7496612 - DNA, 19 bp, Homo sapiens
acaaggctgggagagcgcc

SEQ ID NO: 7496613 - DNA, 23 bp, Homo sapiens
acaaggctctgttctgcagtttc

SEQ ID NO: 7496614 - DNA, 23 bp, Homo sapiens
acaaggctctgttctgcagtttc

SEQ ID NO: 7496615 - DNA, 23 bp, Homo sapiens
acaaggctctgttctgcagtttc

SEQ ID NO: 7496616 - DNA, 22 bp, Homo sapiens
acaaggctgaacagtgaagccg

SEQ ID NO: 7496617 - DNA, 22 bp, Homo sapiens
acaaggctgaacagtgaagccg

SEQ ID NO: 7496618 - DNA, 22 bp, Homo sapiens
acaaggctgaacagtgaagccg

SEQ ID NO: 7496619 - DNA, 22 bp, Homo sapiens
acaaggctaatttggaagatac

SEQ ID NO: 7496620 - DNA, 22 bp, Homo sapiens
acaaggctctggagaagcagaa

SEQ ID NO: 7496621 - DNA, 22 bp, Homo sapiens
acaaggctctaatttcattgaa

SEQ ID NO: 7496622 - DNA, 22 bp, Homo sapiens
acaaggcattccggaagtaacc

SEQ ID NO: 7496623 - DNA, 22 bp, Homo sapiens
acaaggctgttggtcacaaacc

SEQ ID NO: 7496624 - DNA, 22 bp, Homo sapiens
acaaggctgttggtcacaaacc

SEQ ID NO: 7496625 - DNA, 22 bp, Homo sapiens
acaaggctgttggtcacaaacc

SEQ ID NO: 7496626 - DNA, 23 bp, Homo sapiens
aagagcagggaatatttatttgc

SEQ ID NO: 7496627 - DNA, 22 bp, Homo sapiens
aagagcagtgttttactcagct

SEQ ID NO: 7496628 - DNA, 22 bp, Homo sapiens
aagagcagtgttttactcagct

SEQ ID NO: 7496629 - DNA, 22 bp, Homo sapiens
aagagcagtgttttactcagct

SEQ ID NO: 7496630 - DNA, 20 bp, Homo sapiens
aagagctacttagcctttcc

SEQ ID NO: 7496631 - DNA, 23 bp, Homo sapiens
aagagctatacattcacctggta

SEQ ID NO: 7496632 - DNA, 22 bp, Homo sapiens
aagagctatgttaaggaagaga

SEQ ID NO: 7496633 - DNA, 22 bp, Homo sapiens
aagagctatgttaaggaagaga

SEQ ID NO: 7496634 - DNA, 20 bp, Homo sapiens
aagagctgactcacagtggt

SEQ ID NO: 7496635 - DNA, 20 bp, Homo sapiens
aagagctgactcacagtggt

SEQ ID NO: 7496636 - DNA, 20 bp, Homo sapiens
aagagctgactcacagtggt

SEQ ID NO: 7496637 - DNA, 22 bp, Homo sapiens
aagagctcttcataaaggcata

SEQ ID NO: 7496638 - DNA, 22 bp, Homo sapiens
aagagctgattaagtcatgagg

SEQ ID NO: 7496639 - DNA, 22 bp, Homo sapiens
aagagctgattaagtcatgagg

SEQ ID NO: 7496640 - DNA, 22 bp, Homo sapiens
aagagctgattaagtcatgagg

SEQ ID NO: 7496641 - DNA, 20 bp, Homo sapiens
aagagctgactcacagtggt

SEQ ID NO: 7496642 - DNA, 20 bp, Homo sapiens
aagagctgactcacagtggt

SEQ ID NO: 7496643 - DNA, 22 bp, Homo sapiens
aagagctgattaagtcatgagg

SEQ ID NO: 7496644 - DNA, 22 bp, Homo sapiens
aagagctgattaagtcatgagg

SEQ ID NO: 7496645 - DNA, 22 bp, Homo sapiens
aagagctgattaagtcatgagg

SEQ ID NO: 7496646 - DNA, 22 bp, Homo sapiens
aagagctgattaagtcatgagg

SEQ ID NO: 7496647 - DNA, 22 bp, Homo sapiens
aagagctgcacatatttatatc

SEQ ID NO: 7496648 - DNA, 22 bp, Homo sapiens
aagagctgcacatatttatatc

SEQ ID NO: 7496649 - DNA, 22 bp, Homo sapiens
aagagctgcatctaagccatga

SEQ ID NO: 7496650 - DNA, 22 bp, Homo sapiens
aagagctgcatctaagccatga

SEQ ID NO: 7496651 - DNA, 22 bp, Homo sapiens
aagagaggggttgcatggaaat

SEQ ID NO: 7496652 - DNA, 22 bp, Homo sapiens
aagagaggggttgcatggaaat

SEQ ID NO: 7496653 - DNA, 22 bp, Homo sapiens
aagagaggggttgcatggaaat

SEQ ID NO: 7496654 - DNA, 22 bp, Homo sapiens
aagagaggggttgcatggaaat

SEQ ID NO: 7496655 - DNA, 22 bp, Homo sapiens
aagagagggacttattaaagtc

SEQ ID NO: 7496656 - DNA, 22 bp, Homo sapiens
aagagagggatttggtttattg

SEQ ID NO: 7496657 - DNA, 22 bp, Homo sapiens
aagagagggatttggtttattg

SEQ ID NO: 7496658 - DNA, 22 bp, Homo sapiens
aagagagggatttggtttattg

SEQ ID NO: 7496659 - DNA, 22 bp, Homo sapiens
aagagagggatttggtttattg

SEQ ID NO: 7496660 - DNA, 22 bp, Homo sapiens
aagagaggggttgcatggaaat

SEQ ID NO: 7496661 - DNA, 22 bp, Homo sapiens
aagagaggggttgcatggaaat

SEQ ID NO: 7496662 - DNA, 22 bp, Homo sapiens
aagagaggggttgcatggaaat

SEQ ID NO: 7496663 - DNA, 22 bp, Homo sapiens
aagagaggggttgcatggaaat

SEQ ID NO: 7496664 - DNA, 22 bp, Homo sapiens
aagagaggggttgcatggaaat

SEQ ID NO: 7496665 - DNA, 22 bp, Homo sapiens
aagagagtcagtctgagcacca

SEQ ID NO: 7496666 - DNA, 17 bp, Homo sapiens
aagagaggctgagctgg

SEQ ID NO: 7496667 - DNA, 22 bp, Homo sapiens
aagagagggacttattaaagtc

SEQ ID NO: 7496668 - DNA, 22 bp, Homo sapiens
aagagagggacttattaaagtc

SEQ ID NO: 7496669 - DNA, 22 bp, Homo sapiens
aagagagggacttattaaagtc

SEQ ID NO: 7496670 - DNA, 17 bp, Homo sapiens
aagagaggctgagctgg

SEQ ID NO: 7496671 - DNA, 17 bp, Homo sapiens
aagagaggctgagctgg

SEQ ID NO: 7496672 - DNA, 17 bp, Homo sapiens
aagagaggctgagctgg

SEQ ID NO: 7496673 - DNA, 17 bp, Homo sapiens
aagagaggctgagctgg

SEQ ID NO: 7496674 - DNA, 17 bp, Homo sapiens
aagagaggctgagctgg

SEQ ID NO: 7496675 - DNA, 17 bp, Homo sapiens
aagagaggctgagctgg

SEQ ID NO: 7496676 - DNA, 17 bp, Homo sapiens
aagagaggctgagctgg

SEQ ID NO: 7496677 - DNA, 22 bp, Homo sapiens
aagagaggacatggtgaacctg

SEQ ID NO: 7496678 - DNA, 22 bp, Homo sapiens
aagagaggacatggtgaacctg

SEQ ID NO: 7496679 - DNA, 22 bp, Homo sapiens
aagagaggacatggtgaacctg

SEQ ID NO: 7496680 - DNA, 22 bp, Homo sapiens
aagagatgctttacatcggatg

SEQ ID NO: 7496681 - DNA, 22 bp, Homo sapiens
aagagatgctttacatcggatg

SEQ ID NO: 7496682 - DNA, 22 bp, Homo sapiens
aagagatgtggaatcatttaca

SEQ ID NO: 7496683 - DNA, 22 bp, Homo sapiens
aagagatgtggaatcatttaca

SEQ ID NO: 7496684 - DNA, 22 bp, Homo sapiens
aagagatgatggcagccagagg

SEQ ID NO: 7496685 - DNA, 22 bp, Homo sapiens
aagagatgatggcagccagagg

SEQ ID NO: 7496686 - DNA, 22 bp, Homo sapiens
aagagatgatggcagccagagg

SEQ ID NO: 7496687 - DNA, 22 bp, Homo sapiens
aagagatgaaggtcctgactgt

SEQ ID NO: 7496688 - DNA, 22 bp, Homo sapiens
aagagattcctcactcagaatg

SEQ ID NO: 7496689 - DNA, 22 bp, Homo sapiens
aagagattcctcactcagaatg

SEQ ID NO: 7496690 - DNA, 22 bp, Homo sapiens
aagagattggttataagagatt

SEQ ID NO: 7496691 - DNA, 22 bp, Homo sapiens
aagagattggttataagagatt

SEQ ID NO: 7496692 - DNA, 22 bp, Homo sapiens
aagagattcctcactcagaatg

SEQ ID NO: 7496693 - DNA, 22 bp, Homo sapiens
aagagattaaagtaacttgcct

SEQ ID NO: 7496694 - DNA, 22 bp, Homo sapiens
aagagatgtgggctgctgtgca

SEQ ID NO: 7496695 - DNA, 22 bp, Homo sapiens
aagagatgtgggctgctgtgca

SEQ ID NO: 7496696 - DNA, 22 bp, Homo sapiens
aagagatgtgggctgctgtgca

SEQ ID NO: 7496697 - DNA, 22 bp, Homo sapiens
aagagatgtgggctgctgtgca

SEQ ID NO: 7496698 - DNA, 22 bp, Homo sapiens
aagagatgttgaagtttattag

SEQ ID NO: 7496699 - DNA, 22 bp, Homo sapiens
aagagatgttgaagtttattag

SEQ ID NO: 7496700 - DNA, 22 bp, Homo sapiens
aagagatgttgaagtttattag

SEQ ID NO: 7496701 - DNA, 22 bp, Homo sapiens
acaaggacataggaaactacaa

SEQ ID NO: 7496702 - DNA, 22 bp, Homo sapiens
acaaggacataggaaactacaa

SEQ ID NO: 7496703 - DNA, 22 bp, Homo sapiens
acaaggacataggaaactacaa

SEQ ID NO: 7496704 - DNA, 22 bp, Homo sapiens
acaaggacatgcaatttggatt

SEQ ID NO: 7496705 - DNA, 22 bp, Homo sapiens
acaaggacatgcaatttggatt

SEQ ID NO: 7496706 - DNA, 22 bp, Homo sapiens
aagagattgtcagagatatgcc

SEQ ID NO: 7496707 - DNA, 22 bp, Homo sapiens
aagagattgtcagagatatgcc

SEQ ID NO: 7496708 - DNA, 20 bp, Homo sapiens
acaaggaaccaggaggtggc

SEQ ID NO: 7496709 - DNA, 22 bp, Homo sapiens
aagagattggttataagagatt

SEQ ID NO: 7496710 - DNA, 22 bp, Homo sapiens
aagagattggttataagagatt

SEQ ID NO: 7496711 - DNA, 22 bp, Homo sapiens
acaaggaccatgaggcagaccc

SEQ ID NO: 7496712 - DNA, 18 bp, Homo sapiens
acaaggacgcgctgtgtg

SEQ ID NO: 7496713 - DNA, 22 bp, Homo sapiens
acaaggacgtcacttccacggt

SEQ ID NO: 7496714 - DNA, 22 bp, Homo sapiens
acaaggacgtcacttccacggt

SEQ ID NO: 7496715 - DNA, 22 bp, Homo sapiens
acaaggagagcacacatgggga

SEQ ID NO: 7496716 - DNA, 22 bp, Homo sapiens
acaaggagagcacacatgggga

SEQ ID NO: 7496717 - DNA, 22 bp, Homo sapiens
acaaggaggatatgtttaaggg

SEQ ID NO: 7496718 - DNA, 22 bp, Homo sapiens
acaaagagaccatgagccaaac

SEQ ID NO: 7496719 - DNA, 22 bp, Homo sapiens
acaaagagggaccagtgacttg

SEQ ID NO: 7496720 - DNA, 22 bp, Homo sapiens
acaaagagaccatgagccaaac

SEQ ID NO: 7496721 - DNA, 22 bp, Homo sapiens
acaaagataagtcagaaagtca

SEQ ID NO: 7496722 - DNA, 22 bp, Homo sapiens
acaaagagggaccagtgacttg

SEQ ID NO: 7496723 - DNA, 22 bp, Homo sapiens
acaaagagggaccagtgacttg

SEQ ID NO: 7496724 - DNA, 22 bp, Homo sapiens
acaaagagggaccagtgacttg

SEQ ID NO: 7496725 - DNA, 22 bp, Homo sapiens
aagacattactggaatctgact

SEQ ID NO: 7496726 - DNA, 22 bp, Homo sapiens
aagacattactggaatctgact

SEQ ID NO: 7496727 - DNA, 22 bp, Homo sapiens
aagacattactggaatctgact

SEQ ID NO: 7496728 - DNA, 20 bp, Homo sapiens
acaaagactggaaaagcaag

SEQ ID NO: 7496729 - DNA, 20 bp, Homo sapiens
acaaagactggaaaagcaag

SEQ ID NO: 7496730 - DNA, 20 bp, Homo sapiens
acaaagactggaaaagcaag

SEQ ID NO: 7496731 - DNA, 20 bp, Homo sapiens
acaaagactggaaaagcaag

SEQ ID NO: 7496732 - DNA, 20 bp, Homo sapiens
acaaagactggaaaagcaag

SEQ ID NO: 7496733 - DNA, 22 bp, Homo sapiens
aagacattactggaatctgact

SEQ ID NO: 7496734 - DNA, 22 bp, Homo sapiens
aagacattactggaatctgact

SEQ ID NO: 7496735 - DNA, 22 bp, Homo sapiens
aagacatgttttaagaatattt

SEQ ID NO: 7496736 - DNA, 22 bp, Homo sapiens
aagacatgttttaagaatattt

SEQ ID NO: 7496737 - DNA, 22 bp, Homo sapiens
aagacatgcagtttgttccatt

SEQ ID NO: 7496738 - DNA, 22 bp, Homo sapiens
aagacatgcagtttgttccatt

SEQ ID NO: 7496739 - DNA, 22 bp, Homo sapiens
aagacatgcaattagcaaggaa

SEQ ID NO: 7496740 - DNA, 22 bp, Homo sapiens
aagacatgcaattagcaaggaa

SEQ ID NO: 7496741 - DNA, 22 bp, Homo sapiens
aagacatgactgcacagccaaa

SEQ ID NO: 7496742 - DNA, 22 bp, Homo sapiens
aagacatgcaattagcaaggaa

SEQ ID NO: 7496743 - DNA, 22 bp, Homo sapiens
aagacatgcaattagcaaggaa

SEQ ID NO: 7496744 - DNA, 22 bp, Homo sapiens
aagacatatagttctccccaag

SEQ ID NO: 7496745 - DNA, 22 bp, Homo sapiens
aagacatatagttctccccaag

SEQ ID NO: 7496746 - DNA, 22 bp, Homo sapiens
aagacatcagtgatgacatttg

SEQ ID NO: 7496747 - DNA, 22 bp, Homo sapiens
aagacatcagtgatgacatttg

SEQ ID NO: 7496748 - DNA, 22 bp, Homo sapiens
aagacatcagtgatgacatttg

SEQ ID NO: 7496749 - DNA, 22 bp, Homo sapiens
aagacatcagtgatgacatttg

SEQ ID NO: 7496750 - DNA, 22 bp, Homo sapiens
aagacatcagtgatgacatttg

SEQ ID NO: 7496751 - DNA, 22 bp, Homo sapiens
aagacatacagacagtgagcca

SEQ ID NO: 7496752 - DNA, 22 bp, Homo sapiens
aagacatacagacagtgagcca

SEQ ID NO: 7496753 - DNA, 22 bp, Homo sapiens
aagacagtgatctctgagagat

SEQ ID NO: 7496754 - DNA, 22 bp, Homo sapiens
aagacagtgtgtcaggcaggtg

SEQ ID NO: 7496755 - DNA, 22 bp, Homo sapiens
aagacataaaacagtcagcgaa

SEQ ID NO: 7496756 - DNA, 22 bp, Homo sapiens
acaaagataagtcagaaagtca

SEQ ID NO: 7496757 - DNA, 22 bp, Homo sapiens
acaaagataagtcagaaagtca

SEQ ID NO: 7496758 - DNA, 22 bp, Homo sapiens
acaaagataagtcagaaagtca

SEQ ID NO: 7496759 - DNA, 22 bp, Homo sapiens
acaaagataagtcagaaagtca

SEQ ID NO: 7496760 - DNA, 22 bp, Homo sapiens
acaaagataagtcagaaagtca

SEQ ID NO: 7496761 - DNA, 22 bp, Homo sapiens
acaaagatcttgctttcctact

SEQ ID NO: 7496762 - DNA, 22 bp, Homo sapiens
acaaagatcttgctttcctact

SEQ ID NO: 7496763 - DNA, 22 bp, Homo sapiens
acaaagataagtcagaaagtca

SEQ ID NO: 7496764 - DNA, 22 bp, Homo sapiens
acaaagataagtcagaaagtca

SEQ ID NO: 7496765 - DNA, 22 bp, Homo sapiens
acaaagataagtcagaaagtca

SEQ ID NO: 7496766 - DNA, 22 bp, Homo sapiens
acaaagatgtttaaagcattta

SEQ ID NO: 7496767 - DNA, 22 bp, Homo sapiens
acaaagatgtttaaagcattta

SEQ ID NO: 7496768 - DNA, 22 bp, Homo sapiens
acaaagatgtttaaagcattta

SEQ ID NO: 7496769 - DNA, 22 bp, Homo sapiens
acaaagatgtttaaagcattta

SEQ ID NO: 7496770 - DNA, 22 bp, Homo sapiens
acaaagatgtttaaagcattta

SEQ ID NO: 7496771 - DNA, 22 bp, Homo sapiens
aagagagaacacagcttgggca

SEQ ID NO: 7496772 - DNA, 20 bp, Homo sapiens
aagagaggaagttatactag

SEQ ID NO: 7496773 - DNA, 22 bp, Homo sapiens
aagagagaactcccttcgccag

SEQ ID NO: 7496774 - DNA, 22 bp, Homo sapiens
acaaagctagagaagagaattg

SEQ ID NO: 7496775 - DNA, 22 bp, Homo sapiens
acaaagctagagaagagaattg

SEQ ID NO: 7496776 - DNA, 22 bp, Homo sapiens
acaaagctagagaagagaattg

SEQ ID NO: 7496777 - DNA, 22 bp, Homo sapiens
aagagagaacacagcttgggca

SEQ ID NO: 7496778 - DNA, 22 bp, Homo sapiens
aagagagaacacagcttgggca

SEQ ID NO: 7496779 - DNA, 22 bp, Homo sapiens
acaaagccagattctggagcac

SEQ ID NO: 7496780 - DNA, 22 bp, Homo sapiens
acaaagccagattctggagcac

SEQ ID NO: 7496781 - DNA, 22 bp, Homo sapiens
acaaagcacgagtgccatggac

SEQ ID NO: 7496782 - DNA, 22 bp, Homo sapiens
acaaagcacgagtgccatggac

SEQ ID NO: 7496783 - DNA, 22 bp, Homo sapiens
acaaagattcatttgcattatt

SEQ ID NO: 7496784 - DNA, 22 bp, Homo sapiens
acaaagattcatttgcattatt

SEQ ID NO: 7496785 - DNA, 22 bp, Homo sapiens
acaaagattcatttgcattatt

SEQ ID NO: 7496786 - DNA, 22 bp, Homo sapiens
acaaagattcatttgcattatt

SEQ ID NO: 7496787 - DNA, 22 bp, Homo sapiens
acaaagattcatttgcattatt

SEQ ID NO: 7496788 - DNA, 22 bp, Homo sapiens
acaaagattcatttgcattatt

SEQ ID NO: 7496789 - DNA, 22 bp, Homo sapiens
acaaagattcatttgcattatt

SEQ ID NO: 7496790 - DNA, 22 bp, Homo sapiens
acaaagcacgagtgccatggac

SEQ ID NO: 7496791 - DNA, 22 bp, Homo sapiens
acaaagattcatttgcattatt

SEQ ID NO: 7496792 - DNA, 22 bp, Homo sapiens
acaaagcacgagtgccatggac

SEQ ID NO: 7496793 - DNA, 22 bp, Homo sapiens
acaaagcacgagtgccatggac

SEQ ID NO: 7496794 - DNA, 22 bp, Homo sapiens
aagcatagagacacaaatttgg

SEQ ID NO: 7496795 - DNA, 22 bp, Homo sapiens
acagagtattggaaaggcagtg

SEQ ID NO: 7496796 - DNA, 22 bp, Homo sapiens
acagagtattggaaaggcagtg

SEQ ID NO: 7496797 - DNA, 21 bp, Homo sapiens
acagagtagttgaaacagaga

SEQ ID NO: 7496798 - DNA, 22 bp, Homo sapiens
acagagtaggtgctcagtaaat

SEQ ID NO: 7496799 - DNA, 22 bp, Homo sapiens
acagagtaggtgctcagtaaat

SEQ ID NO: 7496800 - DNA, 22 bp, Homo sapiens
acagagtagctcaagaagattg

SEQ ID NO: 7496801 - DNA, 22 bp, Homo sapiens
acagagtaggtgctcagtaaat

SEQ ID NO: 7496802 - DNA, 22 bp, Homo sapiens
acagagtaggtgctcagtaaat

SEQ ID NO: 7496803 - DNA, 21 bp, Homo sapiens
acagagtagttgaaacagaga

SEQ ID NO: 7496804 - DNA, 22 bp, Homo sapiens
acagagtacagacaaaggtcag

SEQ ID NO: 7496805 - DNA, 23 bp, Homo sapiens
acagagtacagtgtgcttagtgg

SEQ ID NO: 7496806 - DNA, 22 bp, Homo sapiens
acagagtacagacaaaggtcag

SEQ ID NO: 7496807 - DNA, 22 bp, Homo sapiens
acagagtacagacaaaggtcag

SEQ ID NO: 7496808 - DNA, 22 bp, Homo sapiens
acagaggtttccattgaggttt

SEQ ID NO: 7496809 - DNA, 17 bp, Homo sapiens
acagaggttatacagac

SEQ ID NO: 7496810 - DNA, 22 bp, Homo sapiens
acagaggtttccattgaggttt

SEQ ID NO: 7496811 - DNA, 22 bp, Homo sapiens
acagaggtttccattgaggttt

SEQ ID NO: 7496812 - DNA, 22 bp, Homo sapiens
acagaggtttccattgaggttt

SEQ ID NO: 7496813 - DNA, 20 bp, Homo sapiens
acagagtagaacatatgcca

SEQ ID NO: 7496814 - DNA, 20 bp, Homo sapiens
acagagtagaacatatgcca

SEQ ID NO: 7496815 - DNA, 22 bp, Homo sapiens
acagagtacattcagagactat

SEQ ID NO: 7496816 - DNA, 22 bp, Homo sapiens
acagagtacattcagagactat

SEQ ID NO: 7496817 - DNA, 22 bp, Homo sapiens
acagagtagctcaagaagattg

SEQ ID NO: 7496818 - DNA, 22 bp, Homo sapiens
acagagtagctcaagaagattg

SEQ ID NO: 7496819 - DNA, 22 bp, Homo sapiens
acagagtagctcaagaagattg

SEQ ID NO: 7496820 - DNA, 20 bp, Homo sapiens
acagagtagaacatatgcca

SEQ ID NO: 7496821 - DNA, 22 bp, Homo sapiens
aagcagctgatttcacagctca

SEQ ID NO: 7496822 - DNA, 22 bp, Homo sapiens
aagcagctgatttcacagctca

SEQ ID NO: 7496823 - DNA, 22 bp, Homo sapiens
aagcagctgaaggattcagggt

SEQ ID NO: 7496824 - DNA, 22 bp, Homo sapiens
aagcagctgaaggattcagggt

SEQ ID NO: 7496825 - DNA, 22 bp, Homo sapiens
aagcagctgatttcacagctca

SEQ ID NO: 7496826 - DNA, 22 bp, Homo sapiens
aagcagctgatttcacagctca

SEQ ID NO: 7496827 - DNA, 22 bp, Homo sapiens
aagcagctgatttcacagctca

SEQ ID NO: 7496828 - DNA, 22 bp, Homo sapiens
acagaggtgtgtgtaggacagt

SEQ ID NO: 7496829 - DNA, 22 bp, Homo sapiens
acagaggtgttccagacctagg

SEQ ID NO: 7496830 - DNA, 22 bp, Homo sapiens
acagaggttaggatgggttgta

SEQ ID NO: 7496831 - DNA, 22 bp, Homo sapiens
acagaggtgttccagacctagg

SEQ ID NO: 7496832 - DNA, 17 bp, Homo sapiens
acagaggttatacagac

SEQ ID NO: 7496833 - DNA, 22 bp, Homo sapiens
acagaggtgttccagacctagg

SEQ ID NO: 7496834 - DNA, 22 bp, Homo sapiens
acagaggtgtgtgtaggacagt

SEQ ID NO: 7496835 - DNA, 22 bp, Homo sapiens
aagcagctgaaggattcagggt

SEQ ID NO: 7496836 - DNA, 22 bp, Homo sapiens
aagcagcctggcatgatgcttt

SEQ ID NO: 7496837 - DNA, 19 bp, Homo sapiens
aagcagccctggcaagagc

SEQ ID NO: 7496838 - DNA, 22 bp, Homo sapiens
aagcagcctggcatgatgcttt

SEQ ID NO: 7496839 - DNA, 22 bp, Homo sapiens
aagcagccagccatcatgcccg

SEQ ID NO: 7496840 - DNA, 22 bp, Homo sapiens
aagcagcctggacttgggctgg

SEQ ID NO: 7496841 - DNA, 19 bp, Homo sapiens
aagcagccctggcaagagc

SEQ ID NO: 7496842 - DNA, 22 bp, Homo sapiens
aagcagcctggacttgggctgg

SEQ ID NO: 7496843 - DNA, 22 bp, Homo sapiens
aagcagccacctcatctccact

SEQ ID NO: 7496844 - DNA, 22 bp, Homo sapiens
aagcagcattgtggtaggggag

SEQ ID NO: 7496845 - DNA, 22 bp, Homo sapiens
aagcagcattgtggtaggggag

SEQ ID NO: 7496846 - DNA, 22 bp, Homo sapiens
aagcagccacctcatctccact

SEQ ID NO: 7496847 - DNA, 22 bp, Homo sapiens
aagcagccagccatcatgcccg

SEQ ID NO: 7496848 - DNA, 23 bp, Homo sapiens
acagacaacactgatgagagaaa

SEQ ID NO: 7496849 - DNA, 22 bp, Homo sapiens
aagcagaggtagggtgtgcagt

SEQ ID NO: 7496850 - DNA, 22 bp, Homo sapiens
aagcagagtccccttcccatgg

SEQ ID NO: 7496851 - DNA, 22 bp, Homo sapiens
aagcagagtccccttcccatgg

SEQ ID NO: 7496852 - DNA, 22 bp, Homo sapiens
aagcagaggtagggtgtgcagt

SEQ ID NO: 7496853 - DNA, 18 bp, Homo sapiens
acagacaaaatggaaatg

SEQ ID NO: 7496854 - DNA, 18 bp, Homo sapiens
acagacaaaatggaaatg

SEQ ID NO: 7496855 - DNA, 18 bp, Homo sapiens
acagacaaaatggaaatg

SEQ ID NO: 7496856 - DNA, 18 bp, Homo sapiens
acagacaaaatggaaatg

SEQ ID NO: 7496857 - DNA, 18 bp, Homo sapiens
acagacaaaatggaaatg

SEQ ID NO: 7496858 - DNA, 22 bp, Homo sapiens
aagcagcatcctgggcagacct

SEQ ID NO: 7496859 - DNA, 22 bp, Homo sapiens
aagcagagtgatataaacatgg

SEQ ID NO: 7496860 - DNA, 22 bp, Homo sapiens
aagcagcatcctgggcagacct

SEQ ID NO: 7496861 - DNA, 22 bp, Homo sapiens
aagcagcatgattgtaatacta

SEQ ID NO: 7496862 - DNA, 22 bp, Homo sapiens
aagcagcatgattgtaatacta

SEQ ID NO: 7496863 - DNA, 22 bp, Homo sapiens
aagcagagtgatataaacatgg

SEQ ID NO: 7496864 - DNA, 22 bp, Homo sapiens
aagcagagtgatataaacatgg

SEQ ID NO: 7496865 - DNA, 22 bp, Homo sapiens
aagcagcatcctgggcagacct

SEQ ID NO: 7496866 - DNA, 22 bp, Homo sapiens
aagcagcatcctgggcagacct

SEQ ID NO: 7496867 - DNA, 22 bp, Homo sapiens
aagcagagtccccttcccatgg

SEQ ID NO: 7496868 - DNA, 22 bp, Homo sapiens
aagcagagtccccttcccatgg

SEQ ID NO: 7496869 - DNA, 22 bp, Homo sapiens
aagcagagtccccttcccatgg

SEQ ID NO: 7496870 - DNA, 22 bp, Homo sapiens
aagcagagtgatataaacatgg

SEQ ID NO: 7496871 - DNA, 22 bp, Homo sapiens
aagcagcatgtgggttatcggg

SEQ ID NO: 7496872 - DNA, 22 bp, Homo sapiens
aagcagcatgtgggttatcggg

SEQ ID NO: 7496873 - DNA, 22 bp, Homo sapiens
aagcagcatgtgggttatcggg

SEQ ID NO: 7496874 - DNA, 22 bp, Homo sapiens
aagcagcatgctatgctggtgg

SEQ ID NO: 7496875 - DNA, 22 bp, Homo sapiens
aagcagcatgattgtaatacta

SEQ ID NO: 7496876 - DNA, 22 bp, Homo sapiens
aagcagcatgctatgctggtgg

SEQ ID NO: 7496877 - DNA, 22 bp, Homo sapiens
aagcagcatgattgtaatacta

SEQ ID NO: 7496878 - DNA, 22 bp, Homo sapiens
aagcagcattcagtgaaatgtg

SEQ ID NO: 7496879 - DNA, 22 bp, Homo sapiens
aagcagcattcagtgaaatgtg

SEQ ID NO: 7496880 - DNA, 22 bp, Homo sapiens
aagcagcattcagtgaaatgtg

SEQ ID NO: 7496881 - DNA, 22 bp, Homo sapiens
aagcagcatgtgggttatcggg

SEQ ID NO: 7496882 - DNA, 22 bp, Homo sapiens
aagcagcattgtaaccaatgcc

SEQ ID NO: 7496883 - DNA, 22 bp, Homo sapiens
aagcagcattcagtgaaatgtg

SEQ ID NO: 7496884 - DNA, 22 bp, Homo sapiens
aagcagcattgtaaccaatgcc

SEQ ID NO: 7496885 - DNA, 22 bp, Homo sapiens
aagcagcattgtaaccaatgcc

SEQ ID NO: 7496886 - DNA, 22 bp, Homo sapiens
aagcagcattgtaaccaatgcc

SEQ ID NO: 7496887 - DNA, 22 bp, Homo sapiens
acagaattatcaggaaatgtta

SEQ ID NO: 7496888 - DNA, 22 bp, Homo sapiens
acagaattctagtatgtggctt

SEQ ID NO: 7496889 - DNA, 22 bp, Homo sapiens
acagaattctagtatgtggctt

SEQ ID NO: 7496890 - DNA, 22 bp, Homo sapiens
acagaattatcaggaaatgtta

SEQ ID NO: 7496891 - DNA, 22 bp, Homo sapiens
acagaattatcaggaaatgtta

SEQ ID NO: 7496892 - DNA, 22 bp, Homo sapiens
acagaattatcaggaaatgtta

SEQ ID NO: 7496893 - DNA, 22 bp, Homo sapiens
acagaattatcaggaaatgtta

SEQ ID NO: 7496894 - DNA, 22 bp, Homo sapiens
acagaattgaaagtataatctg

SEQ ID NO: 7496895 - DNA, 22 bp, Homo sapiens
acagaattgaaagtataatctg

SEQ ID NO: 7496896 - DNA, 22 bp, Homo sapiens
acagaattgaaagtataatctg

SEQ ID NO: 7496897 - DNA, 22 bp, Homo sapiens
acagaattctctctgcagaggc

SEQ ID NO: 7496898 - DNA, 22 bp, Homo sapiens
acagaattctctctgcagaggc

SEQ ID NO: 7496899 - DNA, 22 bp, Homo sapiens
acagaattctctctgcagaggc

SEQ ID NO: 7496900 - DNA, 22 bp, Homo sapiens
acagaattctagtatgtggctt

SEQ ID NO: 7496901 - DNA, 22 bp, Homo sapiens
acagaattgaaagtataatctg

SEQ ID NO: 7496902 - DNA, 22 bp, Homo sapiens
acagaattgaaagtataatctg

SEQ ID NO: 7496903 - DNA, 22 bp, Homo sapiens
acagaattgaaagtataatctg

SEQ ID NO: 7496904 - DNA, 22 bp, Homo sapiens
acagaattgaaagtataatctg

SEQ ID NO: 7496905 - DNA, 22 bp, Homo sapiens
acagaattgaaagtataatctg

SEQ ID NO: 7496906 - DNA, 22 bp, Homo sapiens
acagaattgaagctgagtaaat

SEQ ID NO: 7496907 - DNA, 22 bp, Homo sapiens
acagaattgaagctgagtaaat

SEQ ID NO: 7496908 - DNA, 22 bp, Homo sapiens
acagaattgaagctgagtaaat

SEQ ID NO: 7496909 - DNA, 22 bp, Homo sapiens
acagaattgaagctgagtaaat

SEQ ID NO: 7496910 - DNA, 22 bp, Homo sapiens
acagaattgatggaaatctcag

SEQ ID NO: 7496911 - DNA, 22 bp, Homo sapiens
acagaattgatggaaatctcag

SEQ ID NO: 7496912 - DNA, 22 bp, Homo sapiens
acagaattgatggaaatctcag

SEQ ID NO: 7496913 - DNA, 22 bp, Homo sapiens
acagaattgaagctgagtaaat

SEQ ID NO: 7496914 - DNA, 22 bp, Homo sapiens
acagaattgaagctgagtaaat

SEQ ID NO: 7496915 - DNA, 22 bp, Homo sapiens
acagaattgaagctgagtaaat

SEQ ID NO: 7496916 - DNA, 22 bp, Homo sapiens
acagaatttacacatctctaaa

SEQ ID NO: 7496917 - DNA, 22 bp, Homo sapiens
acagaatttacacatctctaaa

SEQ ID NO: 7496918 - DNA, 22 bp, Homo sapiens
acagaatttacacatctctaaa

SEQ ID NO: 7496919 - DNA, 22 bp, Homo sapiens
acagaatttaaagctctagact

SEQ ID NO: 7496920 - DNA, 22 bp, Homo sapiens
acagaatttaaagctctagact

SEQ ID NO: 7496921 - DNA, 22 bp, Homo sapiens
acagaatttaaagctctagact

SEQ ID NO: 7496922 - DNA, 22 bp, Homo sapiens
acagaattggggttcttgggga

SEQ ID NO: 7496923 - DNA, 22 bp, Homo sapiens
acagaattggggttcttgggga

SEQ ID NO: 7496924 - DNA, 22 bp, Homo sapiens
acagaattggggttcttgggga

SEQ ID NO: 7496925 - DNA, 22 bp, Homo sapiens
acagaattgatggaaatctcag

SEQ ID NO: 7496926 - DNA, 22 bp, Homo sapiens
acagaattgatggaaatctcag

SEQ ID NO: 7496927 - DNA, 22 bp, Homo sapiens
acagaatttttacacagggtaa

SEQ ID NO: 7496928 - DNA, 22 bp, Homo sapiens
acagaatttttacacagggtaa

SEQ ID NO: 7496929 - DNA, 22 bp, Homo sapiens
acagaatttgcttgggcaatgg

SEQ ID NO: 7496930 - DNA, 22 bp, Homo sapiens
acagaatttacacatctctaaa

SEQ ID NO: 7496931 - DNA, 22 bp, Homo sapiens
acagaatttgcttgggcaatgg

SEQ ID NO: 7496932 - DNA, 22 bp, Homo sapiens
acagaatttacacatctctaaa

SEQ ID NO: 7496933 - DNA, 18 bp, Homo sapiens
acagacaaaatggaaatg

SEQ ID NO: 7496934 - DNA, 18 bp, Homo sapiens
acagacaaaatggaaatg

SEQ ID NO: 7496935 - DNA, 18 bp, Homo sapiens
acagacaaaatggaaatg

SEQ ID NO: 7496936 - DNA, 18 bp, Homo sapiens
acagacaaaatggaaatg

SEQ ID NO: 7496937 - DNA, 18 bp, Homo sapiens
acagacaaaatggaaatg

SEQ ID NO: 7496938 - DNA, 18 bp, Homo sapiens
acagacaaaatggaaatg

SEQ ID NO: 7496939 - DNA, 22 bp, Homo sapiens
acagcagctaacccctgggcca

SEQ ID NO: 7496940 - DNA, 22 bp, Homo sapiens
acagcagctgccttcaggctct

SEQ ID NO: 7496941 - DNA, 22 bp, Homo sapiens
acagcagctaacccctgggcca

SEQ ID NO: 7496942 - DNA, 22 bp, Homo sapiens
acagcagctaacccctgggcca

SEQ ID NO: 7496943 - DNA, 22 bp, Homo sapiens
acagcagctgccttcaggctct

SEQ ID NO: 7496944 - DNA, 22 bp, Homo sapiens
acagcagctgccttcaggctct

SEQ ID NO: 7496945 - DNA, 22 bp, Homo sapiens
acagcagctgccttcaggctct

SEQ ID NO: 7496946 - DNA, 22 bp, Homo sapiens
acagcagctgccttcaggctct

SEQ ID NO: 7496947 - DNA, 22 bp, Homo sapiens
acagcagctgccttcaggctct

SEQ ID NO: 7496948 - DNA, 22 bp, Homo sapiens
acagcagcttcctgactgtact

SEQ ID NO: 7496949 - DNA, 22 bp, Homo sapiens
acagcagctgggttcccaccat

SEQ ID NO: 7496950 - DNA, 22 bp, Homo sapiens
acagcagctgggttcccaccat

SEQ ID NO: 7496951 - DNA, 22 bp, Homo sapiens
acagcagctgggttcccaccat

SEQ ID NO: 7496952 - DNA, 22 bp, Homo sapiens
acagcagctgggttcccaccat

SEQ ID NO: 7496953 - DNA, 22 bp, Homo sapiens
acagcagctgggttcccaccat

SEQ ID NO: 7496954 - DNA, 22 bp, Homo sapiens
acagcagctgggttcccaccat

SEQ ID NO: 7496955 - DNA, 22 bp, Homo sapiens
acagcagctgccttcaggctct

SEQ ID NO: 7496956 - DNA, 22 bp, Homo sapiens
acagcagctgccttcaggctct

SEQ ID NO: 7496957 - DNA, 22 bp, Homo sapiens
acagcagctgccttcaggctct

SEQ ID NO: 7496958 - DNA, 22 bp, Homo sapiens
acagcagcttcctgactgtact

SEQ ID NO: 7496959 - DNA, 22 bp, Homo sapiens
acagcagcttcctgactgtact

SEQ ID NO: 7496960 - DNA, 22 bp, Homo sapiens
acagcagcttcctgactgtact

SEQ ID NO: 7496961 - DNA, 22 bp, Homo sapiens
acagcagcttcctgactgtact

SEQ ID NO: 7496962 - DNA, 22 bp, Homo sapiens
acagcagcttcctgactgtact

SEQ ID NO: 7496963 - DNA, 22 bp, Homo sapiens
acagcagcttgcgtgtctggtc

SEQ ID NO: 7496964 - DNA, 22 bp, Homo sapiens
acagcagcttgcgtgtctggtc

SEQ ID NO: 7496965 - DNA, 22 bp, Homo sapiens
acagcagcttgcgtgtctggtc

SEQ ID NO: 7496966 - DNA, 22 bp, Homo sapiens
acagcagcttgcgtgtctggtc

SEQ ID NO: 7496967 - DNA, 22 bp, Homo sapiens
acagcagcttgcgtgtctggtc

SEQ ID NO: 7496968 - DNA, 22 bp, Homo sapiens
acagcagcttgtctgttcttta

SEQ ID NO: 7496969 - DNA, 22 bp, Homo sapiens
acagcagcttgtctgttcttta

SEQ ID NO: 7496970 - DNA, 22 bp, Homo sapiens
acagcagcttgtctgttcttta

SEQ ID NO: 7496971 - DNA, 22 bp, Homo sapiens
acagcagcttgtctgttcttta

SEQ ID NO: 7496972 - DNA, 22 bp, Homo sapiens
acagcagcttgcgtgtctggtc

SEQ ID NO: 7496973 - DNA, 22 bp, Homo sapiens
acagcagcttgtctgttcttta

SEQ ID NO: 7496974 - DNA, 22 bp, Homo sapiens
acagcagcttgtctgttcttta

SEQ ID NO: 7496975 - DNA, 22 bp, Homo sapiens
acagcagcttgtctgttcttta

SEQ ID NO: 7496976 - DNA, 22 bp, Homo sapiens
acagcaggaagctggagggaaa

SEQ ID NO: 7496977 - DNA, 22 bp, Homo sapiens
acagcagcttgtctgttcttta

SEQ ID NO: 7496978 - DNA, 22 bp, Homo sapiens
acagcagcttgtctgttcttta

SEQ ID NO: 7496979 - DNA, 22 bp, Homo sapiens
aagccaggcatgcttggacagt

SEQ ID NO: 7496980 - DNA, 22 bp, Homo sapiens
aagccaggataaagttgtttta

SEQ ID NO: 7496981 - DNA, 22 bp, Homo sapiens
aagccaggcatgcttggacagt

SEQ ID NO: 7496982 - DNA, 22 bp, Homo sapiens
aagccaggataaagttgtttta

SEQ ID NO: 7496983 - DNA, 22 bp, Homo sapiens
aagccaggataaagttgtttta

SEQ ID NO: 7496984 - DNA, 22 bp, Homo sapiens
aagccaggagcgaggcctcggc

SEQ ID NO: 7496985 - DNA, 22 bp, Homo sapiens
aagccaggagcgaggcctcggc

SEQ ID NO: 7496986 - DNA, 22 bp, Homo sapiens
aagccaggagcgaggcctcggc

SEQ ID NO: 7496987 - DNA, 22 bp, Homo sapiens
aagccaggagcgaggcctcggc

SEQ ID NO: 7496988 - DNA, 22 bp, Homo sapiens
aagccaggaatggagtcttcgc

SEQ ID NO: 7496989 - DNA, 22 bp, Homo sapiens
aagccaggagcgaggcctcggc

SEQ ID NO: 7496990 - DNA, 22 bp, Homo sapiens
aagccaggaagggagctgtccc

SEQ ID NO: 7496991 - DNA, 22 bp, Homo sapiens
aagccaggaagggagctgtccc

SEQ ID NO: 7496992 - DNA, 22 bp, Homo sapiens
aagccaggaatggagtcttcgc

SEQ ID NO: 7496993 - DNA, 22 bp, Homo sapiens
aagccaggaatggagtcttcgc

SEQ ID NO: 7496994 - DNA, 22 bp, Homo sapiens
aagccaggaccaaactcatcct

SEQ ID NO: 7496995 - DNA, 22 bp, Homo sapiens
aagccaggaccaaactcatcct

SEQ ID NO: 7496996 - DNA, 22 bp, Homo sapiens
aagccaggaatggagtcttcgc

SEQ ID NO: 7496997 - DNA, 22 bp, Homo sapiens
aagccaggagcgaggcctcggc

SEQ ID NO: 7496998 - DNA, 22 bp, Homo sapiens
aagccaatcgtgtgaacttagt

SEQ ID NO: 7496999 - DNA, 22 bp, Homo sapiens
aagccaagtgctggccatgggc

SEQ ID NO: 7497000 - DNA, 22 bp, Homo sapiens
aagccaagtgctggccatgggc

SEQ ID NO: 7497001 - DNA, 22 bp, Homo sapiens
aagccaagtgctggccatgggc

SEQ ID NO: 7497002 - DNA, 22 bp, Homo sapiens
aagccaagttggaagactgaat

SEQ ID NO: 7497003 - DNA, 22 bp, Homo sapiens
aagccaagttggaagactgaat

SEQ ID NO: 7497004 - DNA, 22 bp, Homo sapiens
aagccaatcgtgtgaacttagt

SEQ ID NO: 7497005 - DNA, 22 bp, Homo sapiens
aagccaatgagagaggcctcag

SEQ ID NO: 7497006 - DNA, 21 bp, Homo sapiens
aagccagcccacagtggtttg

SEQ ID NO: 7497007 - DNA, 22 bp, Homo sapiens
aagccagcctgtttccttcttc

SEQ ID NO: 7497008 - DNA, 22 bp, Homo sapiens
aagccagcctgtttccttcttc

SEQ ID NO: 7497009 - DNA, 22 bp, Homo sapiens
aagccagcctgtttccttcttc

SEQ ID NO: 7497010 - DNA, 22 bp, Homo sapiens
aagccagctccagcatatcact

SEQ ID NO: 7497011 - DNA, 22 bp, Homo sapiens
aagccagctccagcatatcact

SEQ ID NO: 7497012 - DNA, 19 bp, Homo sapiens
aagccagctgccagctcgg

SEQ ID NO: 7497013 - DNA, 22 bp, Homo sapiens
aagccaggaagagagccttcac

SEQ ID NO: 7497014 - DNA, 22 bp, Homo sapiens
aagccaggaagagagccttcac

SEQ ID NO: 7497015 - DNA, 22 bp, Homo sapiens
aagccaggaagagagccttcac

SEQ ID NO: 7497016 - DNA, 22 bp, Homo sapiens
aagccaggaagggagctgtccc

SEQ ID NO: 7497017 - DNA, 22 bp, Homo sapiens
acagcagctaacccctgggcca

SEQ ID NO: 7497018 - DNA, 22 bp, Homo sapiens
acagcagctaacccctgggcca

SEQ ID NO: 7497019 - DNA, 22 bp, Homo sapiens
acagcagctaacccctgggcca

SEQ ID NO: 7497020 - DNA, 22 bp, Homo sapiens
acagcagctaacccctgggcca

SEQ ID NO: 7497021 - DNA, 22 bp, Homo sapiens
acagcagctaaaggtgtctcct

SEQ ID NO: 7497022 - DNA, 22 bp, Homo sapiens
acagcagctaacccctgggcca

SEQ ID NO: 7497023 - DNA, 22 bp, Homo sapiens
acagcagctaaaggtgtctcct

SEQ ID NO: 7497024 - DNA, 22 bp, Homo sapiens
acagcagctaaaggtgtctcct

SEQ ID NO: 7497025 - DNA, 22 bp, Homo sapiens
acagcagctaaaggtgtctcct

SEQ ID NO: 7497026 - DNA, 22 bp, Homo sapiens
aagcatttggcatgaaactctt

SEQ ID NO: 7497027 - DNA, 22 bp, Homo sapiens
aagcatttggttctgaagactc

SEQ ID NO: 7497028 - DNA, 22 bp, Homo sapiens
aagcatttggttctgaagactc

SEQ ID NO: 7497029 - DNA, 22 bp, Homo sapiens
aagcatttggcatgaaactctt

SEQ ID NO: 7497030 - DNA, 22 bp, Homo sapiens
aagcatttggttctgaagactc

SEQ ID NO: 7497031 - DNA, 22 bp, Homo sapiens
aagcatttggttctgaagactc

SEQ ID NO: 7497032 - DNA, 22 bp, Homo sapiens
aagcatttgtgaaattcagatg

SEQ ID NO: 7497033 - DNA, 22 bp, Homo sapiens
aagcatttgtgaaattcagatg

SEQ ID NO: 7497034 - DNA, 22 bp, Homo sapiens
aagcatttggttctgaagactc

SEQ ID NO: 7497035 - DNA, 22 bp, Homo sapiens
aagcatttggttctgaagactc

SEQ ID NO: 7497036 - DNA, 22 bp, Homo sapiens
aagcatttgtgaaattcagatg

SEQ ID NO: 7497037 - DNA, 22 bp, Homo sapiens
aagcatttcaatataatattca

SEQ ID NO: 7497038 - DNA, 22 bp, Homo sapiens
aagcatttcaatataatattca

SEQ ID NO: 7497039 - DNA, 22 bp, Homo sapiens
aagcatttcaatataatattca

SEQ ID NO: 7497040 - DNA, 22 bp, Homo sapiens
aagcatttcaggtagagatatt

SEQ ID NO: 7497041 - DNA, 22 bp, Homo sapiens
aagcatttcaggtagagatatt

SEQ ID NO: 7497042 - DNA, 22 bp, Homo sapiens
aagcatttcaggtagagatatt

SEQ ID NO: 7497043 - DNA, 22 bp, Homo sapiens
aagcatttcaggtagagatatt

SEQ ID NO: 7497044 - DNA, 22 bp, Homo sapiens
aagcatttcaggtagagatatt

SEQ ID NO: 7497045 - DNA, 22 bp, Homo sapiens
aagcatttctgtttatctatcg

SEQ ID NO: 7497046 - DNA, 22 bp, Homo sapiens
aagcatttcaggtagagatatt

SEQ ID NO: 7497047 - DNA, 22 bp, Homo sapiens
aagcatttcaggtagagatatt

SEQ ID NO: 7497048 - DNA, 22 bp, Homo sapiens
aagcatttctgtttatctatcg

SEQ ID NO: 7497049 - DNA, 22 bp, Homo sapiens
aagcatttctgtttatctatcg

SEQ ID NO: 7497050 - DNA, 22 bp, Homo sapiens
aagcatttggcatgaaactctt

SEQ ID NO: 7497051 - DNA, 22 bp, Homo sapiens
aagcatttggcatgaaactctt

SEQ ID NO: 7497052 - DNA, 22 bp, Homo sapiens
aagcatttctgtttatctatcg

SEQ ID NO: 7497053 - DNA, 22 bp, Homo sapiens
aagcatttctgtttatctatcg

SEQ ID NO: 7497054 - DNA, 19 bp, Homo sapiens
aagcattagccaaagcatt

SEQ ID NO: 7497055 - DNA, 19 bp, Homo sapiens
aagcattagccaaagcatt

SEQ ID NO: 7497056 - DNA, 19 bp, Homo sapiens
aagcattagccaaagcatt

SEQ ID NO: 7497057 - DNA, 22 bp, Homo sapiens
aagcattgtaagcagaagatgc

SEQ ID NO: 7497058 - DNA, 19 bp, Homo sapiens
aagcattagccaaagcatt

SEQ ID NO: 7497059 - DNA, 22 bp, Homo sapiens
aagcatgtgtataagctgggca

SEQ ID NO: 7497060 - DNA, 22 bp, Homo sapiens
aagcatgtgctggggctttttg

SEQ ID NO: 7497061 - DNA, 22 bp, Homo sapiens
aagcatgtactcaagcaaatgt

SEQ ID NO: 7497062 - DNA, 22 bp, Homo sapiens
aagcatagagacacaaatttgg

SEQ ID NO: 7497063 - DNA, 22 bp, Homo sapiens
aagcatattttaattagccaca

SEQ ID NO: 7497064 - DNA, 22 bp, Homo sapiens
aagcatatattttatatgttgt

SEQ ID NO: 7497065 - DNA, 22 bp, Homo sapiens
aagcatcaacactatattgatg

SEQ ID NO: 7497066 - DNA, 22 bp, Homo sapiens
aagcatcaacactatattgatg

SEQ ID NO: 7497067 - DNA, 22 bp, Homo sapiens
aagcatggtttctgacgtcatg

SEQ ID NO: 7497068 - DNA, 23 bp, Homo sapiens
aagcatggttcacagttagtact

SEQ ID NO: 7497069 - DNA, 22 bp, Homo sapiens
aagcatgtactcaagcaaatgt

SEQ ID NO: 7497070 - DNA, 22 bp, Homo sapiens
aagcatggtttctgacgtcatg

SEQ ID NO: 7497071 - DNA, 22 bp, Homo sapiens
aagcatttatagataagaattt

SEQ ID NO: 7497072 - DNA, 22 bp, Homo sapiens
aagcatttatagataagaattt

SEQ ID NO: 7497073 - DNA, 22 bp, Homo sapiens
aagcatttatagataagaattt

SEQ ID NO: 7497074 - DNA, 22 bp, Homo sapiens
aagcatttatagataagaattt

SEQ ID NO: 7497075 - DNA, 17 bp, Homo sapiens
aagcatttaatttgcta

SEQ ID NO: 7497076 - DNA, 22 bp, Homo sapiens
aagcattgtaagcagaagatgc

SEQ ID NO: 7497077 - DNA, 22 bp, Homo sapiens
aagcattgtaagcagaagatgc

SEQ ID NO: 7497078 - DNA, 22 bp, Homo sapiens
aagcatttatagataagaattt

SEQ ID NO: 7497079 - DNA, 22 bp, Homo sapiens
aagcatttatagataagaattt

SEQ ID NO: 7497080 - DNA, 22 bp, Homo sapiens
aagcatttcaatataatattca

SEQ ID NO: 7497081 - DNA, 22 bp, Homo sapiens
aagcatttcaatataatattca

SEQ ID NO: 7497082 - DNA, 22 bp, Homo sapiens
aagcatttatagataagaattt

SEQ ID NO: 7497083 - DNA, 22 bp, Homo sapiens
aagcatttcaatataatattca

SEQ ID NO: 7497084 - DNA, 22 bp, Homo sapiens
aagcatttcaatataatattca

SEQ ID NO: 7497085 - DNA, 22 bp, Homo sapiens
aagcatttcaatataatattca

SEQ ID NO: 7497086 - DNA, 22 bp, Homo sapiens
aagcatttcaatataatattca

SEQ ID NO: 7497087 - DNA, 22 bp, Homo sapiens
aagattctgtatttctaacaat

SEQ ID NO: 7497088 - DNA, 22 bp, Homo sapiens
aagattctgtatttctaacaat

SEQ ID NO: 7497089 - DNA, 22 bp, Homo sapiens
aagattctgtatttctaacaat

SEQ ID NO: 7497090 - DNA, 22 bp, Homo sapiens
aagattctgtatttctaacaat

SEQ ID NO: 7497091 - DNA, 22 bp, Homo sapiens
aagattctgtatttctaacaat

SEQ ID NO: 7497092 - DNA, 22 bp, Homo sapiens
aagattctgtatttctaacaat

SEQ ID NO: 7497093 - DNA, 22 bp, Homo sapiens
aagattctgtcagttaggagga

SEQ ID NO: 7497094 - DNA, 22 bp, Homo sapiens
aagattctgtcagttaggagga

SEQ ID NO: 7497095 - DNA, 22 bp, Homo sapiens
aagattcttaaatttgtttctc

SEQ ID NO: 7497096 - DNA, 22 bp, Homo sapiens
aagattcttaaatttgtttctc

SEQ ID NO: 7497097 - DNA, 22 bp, Homo sapiens
aagattctgtcagttaggagga

SEQ ID NO: 7497098 - DNA, 22 bp, Homo sapiens
aagattcttaaatttgtttctc

SEQ ID NO: 7497099 - DNA, 22 bp, Homo sapiens
aagattcttaaatttgtttctc

SEQ ID NO: 7497100 - DNA, 22 bp, Homo sapiens
aagattcttattaggtaatttt

SEQ ID NO: 7497101 - DNA, 22 bp, Homo sapiens
aagattcttattaggtaatttt

SEQ ID NO: 7497102 - DNA, 22 bp, Homo sapiens
aagattcttattaggtaatttt

SEQ ID NO: 7497103 - DNA, 22 bp, Homo sapiens
aagattcttacctatacccagt

SEQ ID NO: 7497104 - DNA, 22 bp, Homo sapiens
aagattcttacctatacccagt

SEQ ID NO: 7497105 - DNA, 22 bp, Homo sapiens
aagatgttgactcctttgatgt

SEQ ID NO: 7497106 - DNA, 22 bp, Homo sapiens
aagatgttgactcctttgatgt

SEQ ID NO: 7497107 - DNA, 22 bp, Homo sapiens
aagatgttgactcctttgatgt

SEQ ID NO: 7497108 - DNA, 22 bp, Homo sapiens
aagatgttctattttcactttt

SEQ ID NO: 7497109 - DNA, 22 bp, Homo sapiens
aagatgttctattttcactttt

SEQ ID NO: 7497110 - DNA, 22 bp, Homo sapiens
aagatgttgactcctttgatgt

SEQ ID NO: 7497111 - DNA, 20 bp, Homo sapiens
aagattctgatttgtagcgt

SEQ ID NO: 7497112 - DNA, 18 bp, Homo sapiens
aagattctgcttctctct

SEQ ID NO: 7497113 - DNA, 18 bp, Homo sapiens
aagattctgcttctctct

SEQ ID NO: 7497114 - DNA, 22 bp, Homo sapiens
aagatttactagcataatagct

SEQ ID NO: 7497115 - DNA, 22 bp, Homo sapiens
aagatttaccactttattcaag

SEQ ID NO: 7497116 - DNA, 22 bp, Homo sapiens
aagatttaccactttattcaag

SEQ ID NO: 7497117 - DNA, 22 bp, Homo sapiens
aagatttaccactttattcaag

SEQ ID NO: 7497118 - DNA, 22 bp, Homo sapiens
aagatttaccactttattcaag

SEQ ID NO: 7497119 - DNA, 22 bp, Homo sapiens
aagatttaccactttattcaag

SEQ ID NO: 7497120 - DNA, 22 bp, Homo sapiens
aagatttaccactttattcaag

SEQ ID NO: 7497121 - DNA, 22 bp, Homo sapiens
aagatttaccactttattcaag

SEQ ID NO: 7497122 - DNA, 22 bp, Homo sapiens
aagattgtcaggcttgctgtat

SEQ ID NO: 7497123 - DNA, 19 bp, Homo sapiens
aagattgccttgttccatt

SEQ ID NO: 7497124 - DNA, 22 bp, Homo sapiens
aagattgtccaccacctggatt

SEQ ID NO: 7497125 - DNA, 22 bp, Homo sapiens
aagattgacggctttgagtgct

SEQ ID NO: 7497126 - DNA, 22 bp, Homo sapiens
aagattctttgaggattttact

SEQ ID NO: 7497127 - DNA, 22 bp, Homo sapiens
aagattctttgaggattttact

SEQ ID NO: 7497128 - DNA, 22 bp, Homo sapiens
aagattcttgactagaatgatt

SEQ ID NO: 7497129 - DNA, 22 bp, Homo sapiens
aagattcttgactagaatgatt

SEQ ID NO: 7497130 - DNA, 22 bp, Homo sapiens
aagattcttgactagaatgatt

SEQ ID NO: 7497131 - DNA, 22 bp, Homo sapiens
aagattctttgaggattttact

SEQ ID NO: 7497132 - DNA, 22 bp, Homo sapiens
aagattctttgaggattttact

SEQ ID NO: 7497133 - DNA, 22 bp, Homo sapiens
aagattcttgactagaatgatt

SEQ ID NO: 7497134 - DNA, 22 bp, Homo sapiens
aagattctttgaggattttact

SEQ ID NO: 7497135 - DNA, 22 bp, Homo sapiens
aagaggctagccggctcactaa

SEQ ID NO: 7497136 - DNA, 22 bp, Homo sapiens
aagaggcgccgggtacgtggcg

SEQ ID NO: 7497137 - DNA, 22 bp, Homo sapiens
aagaggcgctcctcacttccta

SEQ ID NO: 7497138 - DNA, 22 bp, Homo sapiens
aagaggcctggaggcagaggtg

SEQ ID NO: 7497139 - DNA, 22 bp, Homo sapiens
aagaggcctggaggcagaggtg

SEQ ID NO: 7497140 - DNA, 22 bp, Homo sapiens
aagaggcctcacctcactgccc

SEQ ID NO: 7497141 - DNA, 22 bp, Homo sapiens
aagaggccccccagcaggtgaa

SEQ ID NO: 7497142 - DNA, 22 bp, Homo sapiens
aagaggctagccggctcactaa

SEQ ID NO: 7497143 - DNA, 22 bp, Homo sapiens
aagaggctagccggctcactaa

SEQ ID NO: 7497144 - DNA, 22 bp, Homo sapiens
aagaggctagccggctcactaa

SEQ ID NO: 7497145 - DNA, 22 bp, Homo sapiens
aagaggctagccggctcactaa

SEQ ID NO: 7497146 - DNA, 22 bp, Homo sapiens
aagaggctagccggctcactaa

SEQ ID NO: 7497147 - DNA, 22 bp, Homo sapiens
aagaggctgaatgagaaagtac

SEQ ID NO: 7497148 - DNA, 22 bp, Homo sapiens
aagaggctggaggatactgcgc

SEQ ID NO: 7497149 - DNA, 22 bp, Homo sapiens
aagaggctggaggatactgcgc

SEQ ID NO: 7497150 - DNA, 22 bp, Homo sapiens
aagaggctgaatgagaaagtac

SEQ ID NO: 7497151 - DNA, 22 bp, Homo sapiens
aagaggctggaggatactgcgc

SEQ ID NO: 7497152 - DNA, 22 bp, Homo sapiens
aagaggctgaatgagaaagtac

SEQ ID NO: 7497153 - DNA, 22 bp, Homo sapiens
aagaggctgaatgagaaagtac

SEQ ID NO: 7497154 - DNA, 22 bp, Homo sapiens
aagaggctgaatgagaaagtac

SEQ ID NO: 7497155 - DNA, 22 bp, Homo sapiens
aagaggccccccagcaggtgaa

SEQ ID NO: 7497156 - DNA, 22 bp, Homo sapiens
aagaggcttcagatccttcaga

SEQ ID NO: 7497157 - DNA, 22 bp, Homo sapiens
aagaggcttcagatccttcaga

SEQ ID NO: 7497158 - DNA, 22 bp, Homo sapiens
aagaggcttcagatccttcaga

SEQ ID NO: 7497159 - DNA, 22 bp, Homo sapiens
aagaggcttatagtcttcctgt

SEQ ID NO: 7497160 - DNA, 22 bp, Homo sapiens
aagaggcttatagtcttcctgt

SEQ ID NO: 7497161 - DNA, 22 bp, Homo sapiens
aagaggcttatagtcttcctgt

SEQ ID NO: 7497162 - DNA, 22 bp, Homo sapiens
aagaggcttcagatccttcaga

SEQ ID NO: 7497163 - DNA, 22 bp, Homo sapiens
aagatgttctattttcactttt

SEQ ID NO: 7497164 - DNA, 22 bp, Homo sapiens
aagatgttctattttcactttt

SEQ ID NO: 7497165 - DNA, 18 bp, Homo sapiens
aagaggctgttctgtggg

SEQ ID NO: 7497166 - DNA, 18 bp, Homo sapiens
aagaggctgttctgtggg

SEQ ID NO: 7497167 - DNA, 18 bp, Homo sapiens
aagaggctgttctgtggg

SEQ ID NO: 7497168 - DNA, 18 bp, Homo sapiens
aagaggctgttctgtggg

SEQ ID NO: 7497169 - DNA, 22 bp, Homo sapiens
aagaggctggcattgatggtag

SEQ ID NO: 7497170 - DNA, 20 bp, Homo sapiens
aagaggctgtggatcctact

SEQ ID NO: 7497171 - DNA, 22 bp, Homo sapiens
aagaggctggcattgatggtag

SEQ ID NO: 7497172 - DNA, 22 bp, Homo sapiens
aagaggctggcattgatggtag

SEQ ID NO: 7497173 - DNA, 18 bp, Homo sapiens
acacaggttattctctcc

SEQ ID NO: 7497174 - DNA, 22 bp, Homo sapiens
acacaggttaaaataattggga

SEQ ID NO: 7497175 - DNA, 22 bp, Homo sapiens
acacaggttaaaataattggga

SEQ ID NO: 7497176 - DNA, 22 bp, Homo sapiens
acacagggtctagagttaggcc

SEQ ID NO: 7497177 - DNA, 22 bp, Homo sapiens
acacagggtctagagttaggcc

SEQ ID NO: 7497178 - DNA, 22 bp, Homo sapiens
acacagggtctagagttaggcc

SEQ ID NO: 7497179 - DNA, 22 bp, Homo sapiens
acacaggtacacatatgtacct

SEQ ID NO: 7497180 - DNA, 22 bp, Homo sapiens
acacaggtacacatatgtacct

SEQ ID NO: 7497181 - DNA, 22 bp, Homo sapiens
acacaggggctcggctgggtgc

SEQ ID NO: 7497182 - DNA, 22 bp, Homo sapiens
acacagggggcattctaggagt

SEQ ID NO: 7497183 - DNA, 22 bp, Homo sapiens
acacagggtctagagttaggcc

SEQ ID NO: 7497184 - DNA, 22 bp, Homo sapiens
acacagggggcattctaggagt

SEQ ID NO: 7497185 - DNA, 22 bp, Homo sapiens
acacagggggcattctaggagt

SEQ ID NO: 7497186 - DNA, 22 bp, Homo sapiens
acacagggggcattctaggagt

SEQ ID NO: 7497187 - DNA, 22 bp, Homo sapiens
acacagggggcattctaggagt

SEQ ID NO: 7497188 - DNA, 22 bp, Homo sapiens
acacaggggctcggctgggtgc

SEQ ID NO: 7497189 - DNA, 22 bp, Homo sapiens
acacaggggctcggctgggtgc

SEQ ID NO: 7497190 - DNA, 22 bp, Homo sapiens
acacaggggaaagtggagctga

SEQ ID NO: 7497191 - DNA, 22 bp, Homo sapiens
acacaggggaaagtggagctga

SEQ ID NO: 7497192 - DNA, 22 bp, Homo sapiens
acacagggctgcgcctgacccc

SEQ ID NO: 7497193 - DNA, 22 bp, Homo sapiens
acacagggctgcgcctgacccc

SEQ ID NO: 7497194 - DNA, 22 bp, Homo sapiens
acacagggctgcgcctgacccc

SEQ ID NO: 7497195 - DNA, 22 bp, Homo sapiens
acacaggggaaagtggagctga

SEQ ID NO: 7497196 - DNA, 22 bp, Homo sapiens
acacaggggaaagtggagctga

SEQ ID NO: 7497197 - DNA, 22 bp, Homo sapiens
acacaggaactctgagaggtgg

SEQ ID NO: 7497198 - DNA, 22 bp, Homo sapiens
acacaggaactcaagctcgctt

SEQ ID NO: 7497199 - DNA, 22 bp, Homo sapiens
acacagggctgcgcctgacccc

SEQ ID NO: 7497200 - DNA, 22 bp, Homo sapiens
acacaggaactcaagctcgctt

SEQ ID NO: 7497201 - DNA, 22 bp, Homo sapiens
acacaggaactcaagctcgctt

SEQ ID NO: 7497202 - DNA, 22 bp, Homo sapiens
acacaggaactcaagctcgctt

SEQ ID NO: 7497203 - DNA, 22 bp, Homo sapiens
acacaggaaatggtttagtttt

SEQ ID NO: 7497204 - DNA, 22 bp, Homo sapiens
acacaggaactcaagctcgctt

SEQ ID NO: 7497205 - DNA, 22 bp, Homo sapiens
acacaggaaatggtttagtttt

SEQ ID NO: 7497206 - DNA, 22 bp, Homo sapiens
acacagctttgtgttgctccac

SEQ ID NO: 7497207 - DNA, 22 bp, Homo sapiens
acacaggaaatggtttagtttt

SEQ ID NO: 7497208 - DNA, 22 bp, Homo sapiens
acacaggaaatggtttagtttt

SEQ ID NO: 7497209 - DNA, 22 bp, Homo sapiens
acacagctttcagtcattatct

SEQ ID NO: 7497210 - DNA, 22 bp, Homo sapiens
acacagctttgtgttgctccac

SEQ ID NO: 7497211 - DNA, 22 bp, Homo sapiens
aagaggccacagctgacagcac

SEQ ID NO: 7497212 - DNA, 22 bp, Homo sapiens
aagaggccacagctgacagcac

SEQ ID NO: 7497213 - DNA, 22 bp, Homo sapiens
aagaggccacagctgacagcac

SEQ ID NO: 7497214 - DNA, 22 bp, Homo sapiens
acacagtagtttgtcattgcta

SEQ ID NO: 7497215 - DNA, 22 bp, Homo sapiens
acacagtagtttgtcattgcta

SEQ ID NO: 7497216 - DNA, 22 bp, Homo sapiens
acacagtagtttgtcattgcta

SEQ ID NO: 7497217 - DNA, 22 bp, Homo sapiens
acacagtagtttgtcattgcta

SEQ ID NO: 7497218 - DNA, 22 bp, Homo sapiens
acacagtagtttgtcattgcta

SEQ ID NO: 7497219 - DNA, 22 bp, Homo sapiens
acacagtaggccaccatgtcat

SEQ ID NO: 7497220 - DNA, 22 bp, Homo sapiens
acacagtagtgtggaaaaacat

SEQ ID NO: 7497221 - DNA, 22 bp, Homo sapiens
acacagtaggccaccatgtcat

SEQ ID NO: 7497222 - DNA, 22 bp, Homo sapiens
acacagtaggccaccatgtcat

SEQ ID NO: 7497223 - DNA, 22 bp, Homo sapiens
acacagtaggccaccatgtcat

SEQ ID NO: 7497224 - DNA, 22 bp, Homo sapiens
acacagtagtgtggaaaaacat

SEQ ID NO: 7497225 - DNA, 22 bp, Homo sapiens
acacagtaggccaccatgtcat

SEQ ID NO: 7497226 - DNA, 22 bp, Homo sapiens
acacagtaggccaccatgtcat

SEQ ID NO: 7497227 - DNA, 22 bp, Homo sapiens
acacagtaggatagtttgagga

SEQ ID NO: 7497228 - DNA, 20 bp, Homo sapiens
acacagtagcaattagtgca

SEQ ID NO: 7497229 - DNA, 20 bp, Homo sapiens
acacagtagcaattagtgca

SEQ ID NO: 7497230 - DNA, 20 bp, Homo sapiens
acacagtagcaattagtgca

SEQ ID NO: 7497231 - DNA, 18 bp, Homo sapiens
acacaggttattctctcc

SEQ ID NO: 7497232 - DNA, 18 bp, Homo sapiens
acacaggttattctctcc

SEQ ID NO: 7497233 - DNA, 18 bp, Homo sapiens
acacaggttattctctcc

SEQ ID NO: 7497234 - DNA, 22 bp, Homo sapiens
acacagtaaatatgtattgaat

SEQ ID NO: 7497235 - DNA, 22 bp, Homo sapiens
acacagtaaatatgtattgaat

SEQ ID NO: 7497236 - DNA, 22 bp, Homo sapiens
acacaggttccatctccacctt

SEQ ID NO: 7497237 - DNA, 22 bp, Homo sapiens
acacaggttccatctccacctt

SEQ ID NO: 7497238 - DNA, 22 bp, Homo sapiens
acacagtaaatattgtctcctc

SEQ ID NO: 7497239 - DNA, 22 bp, Homo sapiens
acacagtaaatattgtctcctc

SEQ ID NO: 7497240 - DNA, 22 bp, Homo sapiens
acacagtaaatattgtctcctc

SEQ ID NO: 7497241 - DNA, 22 bp, Homo sapiens
acacagtaaatattgtctcctc

SEQ ID NO: 7497242 - DNA, 22 bp, Homo sapiens
acacagtaaatattgtctcctc

SEQ ID NO: 7497243 - DNA, 22 bp, Homo sapiens
acacagtaaatattgtctcctc

SEQ ID NO: 7497244 - DNA, 20 bp, Homo sapiens
acacagtagatgagtgactg

SEQ ID NO: 7497245 - DNA, 17 bp, Homo sapiens
acacagtacttttttgc

SEQ ID NO: 7497246 - DNA, 17 bp, Homo sapiens
acacagtacttttttgc

SEQ ID NO: 7497247 - DNA, 17 bp, Homo sapiens
acacagtacttttttgc

SEQ ID NO: 7497248 - DNA, 17 bp, Homo sapiens
acacagtacttttttgc

SEQ ID NO: 7497249 - DNA, 22 bp, Homo sapiens
acacagtaccccaaggctgggc

SEQ ID NO: 7497250 - DNA, 22 bp, Homo sapiens
acacagtaccccaaggctgggc

SEQ ID NO: 7497251 - DNA, 22 bp, Homo sapiens
acacagtaccccaaggctgggc

SEQ ID NO: 7497252 - DNA, 21 bp, Homo sapiens
acacagtaactgggcgcaggg

SEQ ID NO: 7497253 - DNA, 21 bp, Homo sapiens
acacagtaactgggcgcaggg

SEQ ID NO: 7497254 - DNA, 21 bp, Homo sapiens
acacagtaactgggcgcaggg

SEQ ID NO: 7497255 - DNA, 22 bp, Homo sapiens
aagatttctctcctggaaagca

SEQ ID NO: 7497256 - DNA, 22 bp, Homo sapiens
aagatttctctcctggaaagca

SEQ ID NO: 7497257 - DNA, 22 bp, Homo sapiens
aagatttctctcctggaaagca

SEQ ID NO: 7497258 - DNA, 22 bp, Homo sapiens
aagatttctgctcctgagagaa

SEQ ID NO: 7497259 - DNA, 22 bp, Homo sapiens
aagatttctgcttttggaggca

SEQ ID NO: 7497260 - DNA, 22 bp, Homo sapiens
aagatttcttacttattgatgc

SEQ ID NO: 7497261 - DNA, 22 bp, Homo sapiens
aagatttattagatgcttacct

SEQ ID NO: 7497262 - DNA, 17 bp, Homo sapiens
aagatttcattagctga

SEQ ID NO: 7497263 - DNA, 17 bp, Homo sapiens
aagatttcattagctga

SEQ ID NO: 7497264 - DNA, 17 bp, Homo sapiens
aagatttcattagctga

SEQ ID NO: 7497265 - DNA, 22 bp, Homo sapiens
aagatttccttcagtagagcta

SEQ ID NO: 7497266 - DNA, 22 bp, Homo sapiens
aagatttcctggatgtaattcc

SEQ ID NO: 7497267 - DNA, 22 bp, Homo sapiens
aagatttcctggatgtaattcc

SEQ ID NO: 7497268 - DNA, 22 bp, Homo sapiens
aagatttcctggatgtaattcc

SEQ ID NO: 7497269 - DNA, 17 bp, Homo sapiens
aagatttcattagctga

SEQ ID NO: 7497270 - DNA, 17 bp, Homo sapiens
aagatttcattagctga

SEQ ID NO: 7497271 - DNA, 22 bp, Homo sapiens
aagatttactttctttgtaata

SEQ ID NO: 7497272 - DNA, 22 bp, Homo sapiens
aagatttactttctttgtaata

SEQ ID NO: 7497273 - DNA, 22 bp, Homo sapiens
aagatttactttctttgtaata

SEQ ID NO: 7497274 - DNA, 22 bp, Homo sapiens
aagatttactttctttgtaata

SEQ ID NO: 7497275 - DNA, 22 bp, Homo sapiens
aagatttactttctttgtaata

SEQ ID NO: 7497276 - DNA, 22 bp, Homo sapiens
aagatttagggccagtttacat

SEQ ID NO: 7497277 - DNA, 22 bp, Homo sapiens
aagatttagggccagtttacat

SEQ ID NO: 7497278 - DNA, 22 bp, Homo sapiens
aagatttattagatgcttacct

SEQ ID NO: 7497279 - DNA, 22 bp, Homo sapiens
aagatttattagatgcttacct

SEQ ID NO: 7497280 - DNA, 22 bp, Homo sapiens
aagattgacggctttgagtgct

SEQ ID NO: 7497281 - DNA, 22 bp, Homo sapiens
aagatttagggccagtttacat

SEQ ID NO: 7497282 - DNA, 22 bp, Homo sapiens
aagatttagggccagtttacat

SEQ ID NO: 7497283 - DNA, 22 bp, Homo sapiens
aagatttactttctttgtaata

SEQ ID NO: 7497284 - DNA, 22 bp, Homo sapiens
aagatttactagcataatagct

SEQ ID NO: 7497285 - DNA, 22 bp, Homo sapiens
aagatttactagcataatagct

SEQ ID NO: 7497286 - DNA, 22 bp, Homo sapiens
aagatttactttctttgtaata

SEQ ID NO: 7497287 - DNA, 22 bp, Homo sapiens
aagatttactttctttgtaata

SEQ ID NO: 7497288 - DNA, 22 bp, Homo sapiens
aagatttactttctttgtaata

SEQ ID NO: 7497289 - DNA, 22 bp, Homo sapiens
aagatttactttctttgtaata

SEQ ID NO: 7497290 - DNA, 22 bp, Homo sapiens
aagatttactagcataatagct

SEQ ID NO: 7497291 - DNA, 22 bp, Homo sapiens
aagatttactagcataatagct

SEQ ID NO: 7497292 - DNA, 22 bp, Homo sapiens
aagatttactagcataatagct

SEQ ID NO: 7497293 - DNA, 22 bp, Homo sapiens
acactgcatttcaacaaggccc

SEQ ID NO: 7497294 - DNA, 22 bp, Homo sapiens
acactgcatttcaacaaggccc

SEQ ID NO: 7497295 - DNA, 22 bp, Homo sapiens
acactgcatttcaacaaggccc

SEQ ID NO: 7497296 - DNA, 22 bp, Homo sapiens
acactgctaaacagtaaagatg

SEQ ID NO: 7497297 - DNA, 22 bp, Homo sapiens
acactgcatttcaacaaggccc

SEQ ID NO: 7497298 - DNA, 21 bp, Homo sapiens
acactgcaggtgaagtgcact

SEQ ID NO: 7497299 - DNA, 21 bp, Homo sapiens
acactgcaggtgaagtgcact

SEQ ID NO: 7497300 - DNA, 21 bp, Homo sapiens
acactgcaggtgaagtgcact

SEQ ID NO: 7497301 - DNA, 21 bp, Homo sapiens
acactgcaggtgaagtgcact

SEQ ID NO: 7497302 - DNA, 22 bp, Homo sapiens
acactgctcacttcttcccttg

SEQ ID NO: 7497303 - DNA, 21 bp, Homo sapiens
acactgctgtagcatattggg

SEQ ID NO: 7497304 - DNA, 22 bp, Homo sapiens
acactgctcacttcttcccttg

SEQ ID NO: 7497305 - DNA, 22 bp, Homo sapiens
acactgctcacttcttcccttg

SEQ ID NO: 7497306 - DNA, 22 bp, Homo sapiens
acactgctcacttcttcccttg

SEQ ID NO: 7497307 - DNA, 22 bp, Homo sapiens
acactgcttctctggcagagcc

SEQ ID NO: 7497308 - DNA, 22 bp, Homo sapiens
acactgctcacttcttcccttg

SEQ ID NO: 7497309 - DNA, 22 bp, Homo sapiens
acactgcttctctggcagagcc

SEQ ID NO: 7497310 - DNA, 22 bp, Homo sapiens
acactgcttctctggcagagcc

SEQ ID NO: 7497311 - DNA, 22 bp, Homo sapiens
acactgcttctctggcagagcc

SEQ ID NO: 7497312 - DNA, 22 bp, Homo sapiens
acactggaaatagggaggtttt

SEQ ID NO: 7497313 - DNA, 19 bp, Homo sapiens
acactgggagaagactgct

SEQ ID NO: 7497314 - DNA, 19 bp, Homo sapiens
acactgggagaagactgct

SEQ ID NO: 7497315 - DNA, 22 bp, Homo sapiens
acactggatgaagcaagctaaa

SEQ ID NO: 7497316 - DNA, 22 bp, Homo sapiens
acactggattcttgtagtgaag

SEQ ID NO: 7497317 - DNA, 22 bp, Homo sapiens
acactggagggtccagggatgt

SEQ ID NO: 7497318 - DNA, 22 bp, Homo sapiens
acactggaggagagctgttgct

SEQ ID NO: 7497319 - DNA, 22 bp, Homo sapiens
acactggaggagagctgttgct

SEQ ID NO: 7497320 - DNA, 22 bp, Homo sapiens
acactggatgaagcaagctaaa

SEQ ID NO: 7497321 - DNA, 22 bp, Homo sapiens
acactggagggtccagggatgt

SEQ ID NO: 7497322 - DNA, 22 bp, Homo sapiens
acactggataccactgttatta

SEQ ID NO: 7497323 - DNA, 22 bp, Homo sapiens
acactggaggagagctgttgct

SEQ ID NO: 7497324 - DNA, 22 bp, Homo sapiens
acactggagcttctagcccacg

SEQ ID NO: 7497325 - DNA, 22 bp, Homo sapiens
acactggactcagaggccagaa

SEQ ID NO: 7497326 - DNA, 22 bp, Homo sapiens
acactggactcagaggccagaa

SEQ ID NO: 7497327 - DNA, 22 bp, Homo sapiens
acactggacactgaactccctg

SEQ ID NO: 7497328 - DNA, 22 bp, Homo sapiens
acactggaaatagggaggtttt

SEQ ID NO: 7497329 - DNA, 22 bp, Homo sapiens
acactggaaatagggaggtttt

SEQ ID NO: 7497330 - DNA, 22 bp, Homo sapiens
acactggaccatttaaacttga

SEQ ID NO: 7497331 - DNA, 22 bp, Homo sapiens
acactggaccatttaaacttga

SEQ ID NO: 7497332 - DNA, 21 bp, Homo sapiens
acactggtgcctgatgtcagg

SEQ ID NO: 7497333 - DNA, 22 bp, Homo sapiens
acactggtcatgcctgggtgtt

SEQ ID NO: 7497334 - DNA, 22 bp, Homo sapiens
acactggtatgactgttccagt

SEQ ID NO: 7497335 - DNA, 22 bp, Homo sapiens
acactggtaggaagagatggct

SEQ ID NO: 7497336 - DNA, 22 bp, Homo sapiens
acactgggcttgttacgttgca

SEQ ID NO: 7497337 - DNA, 22 bp, Homo sapiens
acactgggttacctgtactatt

SEQ ID NO: 7497338 - DNA, 22 bp, Homo sapiens
acactgggttacctgtactatt

SEQ ID NO: 7497339 - DNA, 22 bp, Homo sapiens
acactgggtaacatatctgtta

SEQ ID NO: 7497340 - DNA, 22 bp, Homo sapiens
acactgggcttgttacgttgca

SEQ ID NO: 7497341 - DNA, 22 bp, Homo sapiens
acactgggtaacatatctgtta

SEQ ID NO: 7497342 - DNA, 22 bp, Homo sapiens
aagcacagaaaaggagcatgga

SEQ ID NO: 7497343 - DNA, 22 bp, Homo sapiens
aagcacagaaaaggagcatgga

SEQ ID NO: 7497344 - DNA, 22 bp, Homo sapiens
acactggtgtagttttctgcag

SEQ ID NO: 7497345 - DNA, 22 bp, Homo sapiens
aagcacagaaaaggagcatgga

SEQ ID NO: 7497346 - DNA, 22 bp, Homo sapiens
aagcacagaaaaggagcatgga

SEQ ID NO: 7497347 - DNA, 22 bp, Homo sapiens
aagcacagaaaaggagcatgga

SEQ ID NO: 7497348 - DNA, 22 bp, Homo sapiens
aagcacagaaaaggagcatgga

SEQ ID NO: 7497349 - DNA, 22 bp, Homo sapiens
aagcacaggatcttgaggagcg

SEQ ID NO: 7497350 - DNA, 22 bp, Homo sapiens
aagcacaggatcttgaggagcg

SEQ ID NO: 7497351 - DNA, 22 bp, Homo sapiens
aagcacaggatcttgaggagcg

SEQ ID NO: 7497352 - DNA, 22 bp, Homo sapiens
aagcacaggatcttgaggagcg

SEQ ID NO: 7497353 - DNA, 22 bp, Homo sapiens
aagcacaggatcttgaggagcg

SEQ ID NO: 7497354 - DNA, 22 bp, Homo sapiens
aagcacaggatcttgaggagcg

SEQ ID NO: 7497355 - DNA, 22 bp, Homo sapiens
aagcacagggactcaggaccgg

SEQ ID NO: 7497356 - DNA, 22 bp, Homo sapiens
aagcacagggactcaggaccgg

SEQ ID NO: 7497357 - DNA, 22 bp, Homo sapiens
aagcacaggatcttgaggagcg

SEQ ID NO: 7497358 - DNA, 22 bp, Homo sapiens
aagcacaggatcttgaggagcg

SEQ ID NO: 7497359 - DNA, 22 bp, Homo sapiens
aagcacaggagacgcacagcca

SEQ ID NO: 7497360 - DNA, 22 bp, Homo sapiens
aagcacaggagacgcacagcca

SEQ ID NO: 7497361 - DNA, 22 bp, Homo sapiens
aagcacaggagacgcacagcca

SEQ ID NO: 7497362 - DNA, 22 bp, Homo sapiens
aagcacaggagacgcacagcca

SEQ ID NO: 7497363 - DNA, 22 bp, Homo sapiens
aagcacaggagacgcacagcca

SEQ ID NO: 7497364 - DNA, 22 bp, Homo sapiens
aagcacaggagacgcacagcca

SEQ ID NO: 7497365 - DNA, 22 bp, Homo sapiens
aagcacaggagacgcacagcca

SEQ ID NO: 7497366 - DNA, 22 bp, Homo sapiens
aagcacaggggaaataagttgt

SEQ ID NO: 7497367 - DNA, 22 bp, Homo sapiens
aagcacaggggaaataagttgt

SEQ ID NO: 7497368 - DNA, 22 bp, Homo sapiens
aagcacaggggaaataagttgt

SEQ ID NO: 7497369 - DNA, 22 bp, Homo sapiens
aagcacagggactttaggaata

SEQ ID NO: 7497370 - DNA, 22 bp, Homo sapiens
aagcacagggactttaggaata

SEQ ID NO: 7497371 - DNA, 22 bp, Homo sapiens
aagcacagggactttaggaata

SEQ ID NO: 7497372 - DNA, 22 bp, Homo sapiens
aagcacagggactttaggaata

SEQ ID NO: 7497373 - DNA, 22 bp, Homo sapiens
aagcacagggactcaggaccgg

SEQ ID NO: 7497374 - DNA, 22 bp, Homo sapiens
aagcacagggactcaggaccgg

SEQ ID NO: 7497375 - DNA, 22 bp, Homo sapiens
aagcacagggtgtctgcattca

SEQ ID NO: 7497376 - DNA, 22 bp, Homo sapiens
aagcacagggtgtctgcattca

SEQ ID NO: 7497377 - DNA, 22 bp, Homo sapiens
aagcacagggtgtctgcattca

SEQ ID NO: 7497378 - DNA, 22 bp, Homo sapiens
aagcacagggactttaggaata

SEQ ID NO: 7497379 - DNA, 22 bp, Homo sapiens
aagcacaggttgaggattattc

SEQ ID NO: 7497380 - DNA, 22 bp, Homo sapiens
aagcacaggttgaggattattc

SEQ ID NO: 7497381 - DNA, 22 bp, Homo sapiens
aagcacaggttgaggattattc

SEQ ID NO: 7497382 - DNA, 22 bp, Homo sapiens
aagcacaggttgaggattattc

SEQ ID NO: 7497383 - DNA, 18 bp, Homo sapiens
aagcacaggtgtttcagg

SEQ ID NO: 7497384 - DNA, 18 bp, Homo sapiens
aagcacaggtgtttcagg

SEQ ID NO: 7497385 - DNA, 18 bp, Homo sapiens
aagcacaggtgtttcagg

SEQ ID NO: 7497386 - DNA, 18 bp, Homo sapiens
aagcacaggtgtttcagg

SEQ ID NO: 7497387 - DNA, 22 bp, Homo sapiens
aagcacagtgggcagagcagcc

SEQ ID NO: 7497388 - DNA, 22 bp, Homo sapiens
aagcacagtgggcagagcagcc

SEQ ID NO: 7497389 - DNA, 22 bp, Homo sapiens
aagcacagtgggcagagcagcc

SEQ ID NO: 7497390 - DNA, 22 bp, Homo sapiens
aagcacagtgggcagagcagcc

SEQ ID NO: 7497391 - DNA, 22 bp, Homo sapiens
acagaattaggagatcctcttg

SEQ ID NO: 7497392 - DNA, 22 bp, Homo sapiens
acagaattaggagatcctcttg

SEQ ID NO: 7497393 - DNA, 22 bp, Homo sapiens
acagaattaggagatcctcttg

SEQ ID NO: 7497394 - DNA, 22 bp, Homo sapiens
acagaattaggagatcctcttg

SEQ ID NO: 7497395 - DNA, 22 bp, Homo sapiens
aagcacagtgggcagagcagcc

SEQ ID NO: 7497396 - DNA, 22 bp, Homo sapiens
aagcacagtaaaagcagatttt

SEQ ID NO: 7497397 - DNA, 22 bp, Homo sapiens
aagcacagtaaaagcagatttt

SEQ ID NO: 7497398 - DNA, 22 bp, Homo sapiens
aagcacaggttgaggattattc

SEQ ID NO: 7497399 - DNA, 22 bp, Homo sapiens
aagcacagtaaaagcagatttt

SEQ ID NO: 7497400 - DNA, 22 bp, Homo sapiens
aagcacagtaaaagcagatttt

SEQ ID NO: 7497401 - DNA, 22 bp, Homo sapiens
aagcacagtgccaagttctatt

SEQ ID NO: 7497402 - DNA, 22 bp, Homo sapiens
aagcacagtgccaagttctatt

SEQ ID NO: 7497403 - DNA, 22 bp, Homo sapiens
aagcacagtaaaagcagatttt

SEQ ID NO: 7497404 - DNA, 22 bp, Homo sapiens
aagcacagtgccaagttctatt

SEQ ID NO: 7497405 - DNA, 22 bp, Homo sapiens
aagcacagtgccaagttctatt

SEQ ID NO: 7497406 - DNA, 22 bp, Homo sapiens
aagcacagtgccaagttctatt

SEQ ID NO: 7497407 - DNA, 22 bp, Homo sapiens
aagcacagtgccaagttctatt

SEQ ID NO: 7497408 - DNA, 22 bp, Homo sapiens
aagcatcaacactatattgatg

SEQ ID NO: 7497409 - DNA, 22 bp, Homo sapiens
aagcatcaacctgtatgctgca

SEQ ID NO: 7497410 - DNA, 22 bp, Homo sapiens
aaatgcatgagaaagtattctg

SEQ ID NO: 7497411 - DNA, 22 bp, Homo sapiens
aaatgcatgagaaagtattctg

SEQ ID NO: 7497412 - DNA, 22 bp, Homo sapiens
aaatgcatcagctcataagaga

SEQ ID NO: 7497413 - DNA, 22 bp, Homo sapiens
aaatgcatgagaaagtattctg

SEQ ID NO: 7497414 - DNA, 22 bp, Homo sapiens
aaatgcatcagctcataagaga

SEQ ID NO: 7497415 - DNA, 22 bp, Homo sapiens
aaatgcatgagaaagtattctg

SEQ ID NO: 7497416 - DNA, 22 bp, Homo sapiens
aaatgcatatcaaagacttgaa

SEQ ID NO: 7497417 - DNA, 22 bp, Homo sapiens
aaatgcatatcaaagacttgaa

SEQ ID NO: 7497418 - DNA, 22 bp, Homo sapiens
aaatgcagtttcctgagaccca

SEQ ID NO: 7497419 - DNA, 22 bp, Homo sapiens
aaatgcatatcaaagacttgaa

SEQ ID NO: 7497420 - DNA, 22 bp, Homo sapiens
aaatgcatcagctcataagaga

SEQ ID NO: 7497421 - DNA, 22 bp, Homo sapiens
aaatgcatcagctcataagaga

SEQ ID NO: 7497422 - DNA, 22 bp, Homo sapiens
aaatgcagtttcctgagaccca

SEQ ID NO: 7497423 - DNA, 22 bp, Homo sapiens
aaatgcagtttcctgagaccca

SEQ ID NO: 7497424 - DNA, 22 bp, Homo sapiens
aaatgcagttggtggggatatg

SEQ ID NO: 7497425 - DNA, 22 bp, Homo sapiens
aaatgcagttggtggggatatg

SEQ ID NO: 7497426 - DNA, 22 bp, Homo sapiens
aaatgcagtggttctacttctc

SEQ ID NO: 7497427 - DNA, 22 bp, Homo sapiens
aaatgcagttggtggggatatg

SEQ ID NO: 7497428 - DNA, 20 bp, Homo sapiens
aaatgcagggctgctgcgga

SEQ ID NO: 7497429 - DNA, 23 bp, Homo sapiens
aaatgcagggtcgcaggttacag

SEQ ID NO: 7497430 - DNA, 22 bp, Homo sapiens
aaatgcaggtagtatttatttt

SEQ ID NO: 7497431 - DNA, 22 bp, Homo sapiens
aaatgcaggtagtatttatttt

SEQ ID NO: 7497432 - DNA, 22 bp, Homo sapiens
aaatgcaggttcttgagccaag

SEQ ID NO: 7497433 - DNA, 22 bp, Homo sapiens
aaatgcaggtagtatttatttt

SEQ ID NO: 7497434 - DNA, 22 bp, Homo sapiens
aaatgcaggtagtatttatttt

SEQ ID NO: 7497435 - DNA, 22 bp, Homo sapiens
aaatgcaggttcttgagccaag

SEQ ID NO: 7497436 - DNA, 22 bp, Homo sapiens
aaatgcaggtagtatttatttt

SEQ ID NO: 7497437 - DNA, 22 bp, Homo sapiens
aaatgcaggttcttgagccaag

SEQ ID NO: 7497438 - DNA, 21 bp, Homo sapiens
aaatgcagtctctgagatctg

SEQ ID NO: 7497439 - DNA, 20 bp, Homo sapiens
aaatgcagttctgccttggc

SEQ ID NO: 7497440 - DNA, 20 bp, Homo sapiens
aaatgcagttctgccttggc

SEQ ID NO: 7497441 - DNA, 22 bp, Homo sapiens
aaatgcagtggttctacttctc

SEQ ID NO: 7497442 - DNA, 22 bp, Homo sapiens
aaatgcagtggttctacttctc

SEQ ID NO: 7497443 - DNA, 21 bp, Homo sapiens
aaatgcagtctctgagatctg

SEQ ID NO: 7497444 - DNA, 22 bp, Homo sapiens
aagcacagatgcaagggggacc

SEQ ID NO: 7497445 - DNA, 22 bp, Homo sapiens
aagcacagattgctgcatccat

SEQ ID NO: 7497446 - DNA, 22 bp, Homo sapiens
aagcacagattgctgcatccat

SEQ ID NO: 7497447 - DNA, 22 bp, Homo sapiens
aagcacagatgcaagggggacc

SEQ ID NO: 7497448 - DNA, 22 bp, Homo sapiens
aagcacagatgcaagggggacc

SEQ ID NO: 7497449 - DNA, 22 bp, Homo sapiens
aagcacagataaaacaggattc

SEQ ID NO: 7497450 - DNA, 22 bp, Homo sapiens
aagcacagatgcaagggggacc

SEQ ID NO: 7497451 - DNA, 22 bp, Homo sapiens
aagcacagatgcaagggggacc

SEQ ID NO: 7497452 - DNA, 22 bp, Homo sapiens
aagcacagatgcaagggggacc

SEQ ID NO: 7497453 - DNA, 22 bp, Homo sapiens
aagcacagataaaacaggattc

SEQ ID NO: 7497454 - DNA, 22 bp, Homo sapiens
aagcacagataaaacaggattc

SEQ ID NO: 7497455 - DNA, 22 bp, Homo sapiens
aagcacagccaggttaggggct

SEQ ID NO: 7497456 - DNA, 22 bp, Homo sapiens
aagcacagcagagccttgcttg

SEQ ID NO: 7497457 - DNA, 22 bp, Homo sapiens
aagcacagcagagccttgcttg

SEQ ID NO: 7497458 - DNA, 22 bp, Homo sapiens
aagcacagattgctgcatccat

SEQ ID NO: 7497459 - DNA, 22 bp, Homo sapiens
aaatgcacaggttttaaatcct

SEQ ID NO: 7497460 - DNA, 22 bp, Homo sapiens
aagcacagctggaacagcagga

SEQ ID NO: 7497461 - DNA, 22 bp, Homo sapiens
aagcacagctggaacagcagga

SEQ ID NO: 7497462 - DNA, 22 bp, Homo sapiens
aagcacagctggaacagcagga

SEQ ID NO: 7497463 - DNA, 22 bp, Homo sapiens
aagcacagctggaacagcagga

SEQ ID NO: 7497464 - DNA, 22 bp, Homo sapiens
aagcacagctggaacagcagga

SEQ ID NO: 7497465 - DNA, 22 bp, Homo sapiens
aagcacagctggaacagcagga

SEQ ID NO: 7497466 - DNA, 22 bp, Homo sapiens
aagcacagctggaacagcagga

SEQ ID NO: 7497467 - DNA, 22 bp, Homo sapiens
aagcacagctggaacagcagga

SEQ ID NO: 7497468 - DNA, 22 bp, Homo sapiens
aaatgcaggattaacagctttg

SEQ ID NO: 7497469 - DNA, 22 bp, Homo sapiens
aaatgcaggattaacagctttg

SEQ ID NO: 7497470 - DNA, 22 bp, Homo sapiens
aaatgcaggaaattatgctttt

SEQ ID NO: 7497471 - DNA, 22 bp, Homo sapiens
aaatgcaggaaattatgctttt

SEQ ID NO: 7497472 - DNA, 22 bp, Homo sapiens
aaatgcaggattaacagctttg

SEQ ID NO: 7497473 - DNA, 22 bp, Homo sapiens
aaatgcaggattaacagctttg

SEQ ID NO: 7497474 - DNA, 22 bp, Homo sapiens
aaatgcaggattaacagctttg

SEQ ID NO: 7497475 - DNA, 22 bp, Homo sapiens
aaatgcaggaaattatgctttt

SEQ ID NO: 7497476 - DNA, 22 bp, Homo sapiens
aaatgcaggaaattatgctttt

SEQ ID NO: 7497477 - DNA, 22 bp, Homo sapiens
aaatgcaggaaattatgctttt

SEQ ID NO: 7497478 - DNA, 22 bp, Homo sapiens
aaatgcagctgggcatgagagg

SEQ ID NO: 7497479 - DNA, 22 bp, Homo sapiens
aaatgcaggaaattatgctttt

SEQ ID NO: 7497480 - DNA, 22 bp, Homo sapiens
aaatgcaggaaattatgctttt

SEQ ID NO: 7497481 - DNA, 22 bp, Homo sapiens
aaatgcagctgggcatgagagg

SEQ ID NO: 7497482 - DNA, 22 bp, Homo sapiens
aaatgcaccttgctgtgagact

SEQ ID NO: 7497483 - DNA, 23 bp, Homo sapiens
aaatgcacagtattgatttttaa

SEQ ID NO: 7497484 - DNA, 22 bp, Homo sapiens
aaatgcaggaaattatgctttt

SEQ ID NO: 7497485 - DNA, 22 bp, Homo sapiens
aaatgcaccttgctgtgagact

SEQ ID NO: 7497486 - DNA, 23 bp, Homo sapiens
aaatgcacagtattgatttttaa

SEQ ID NO: 7497487 - DNA, 22 bp, Homo sapiens
aaatgcacaggttttaaatcct

SEQ ID NO: 7497488 - DNA, 22 bp, Homo sapiens
aaatgcacaggttttaaatcct

SEQ ID NO: 7497489 - DNA, 23 bp, Homo sapiens
aaatgcacagtattgatttttaa

SEQ ID NO: 7497490 - DNA, 22 bp, Homo sapiens
aaatcctgtccatttaccagat

SEQ ID NO: 7497491 - DNA, 22 bp, Homo sapiens
aaatcctggcctcaagtggtcc

SEQ ID NO: 7497492 - DNA, 23 bp, Homo sapiens
aaatcctgcctcttgtatttatc

SEQ ID NO: 7497493 - DNA, 22 bp, Homo sapiens
aaatcctgtccatttaccagat

SEQ ID NO: 7497494 - DNA, 22 bp, Homo sapiens
aaatccttgatagtttgcccta

SEQ ID NO: 7497495 - DNA, 22 bp, Homo sapiens
aaatcctttggaggacatgatg

SEQ ID NO: 7497496 - DNA, 22 bp, Homo sapiens
aaatccttttctatacagcata

SEQ ID NO: 7497497 - DNA, 22 bp, Homo sapiens
aaatccttttctatacagcata

SEQ ID NO: 7497498 - DNA, 22 bp, Homo sapiens
aaatcgcttgaacccaggaagt

SEQ ID NO: 7497499 - DNA, 22 bp, Homo sapiens
aaatcgcttgaacccaggaagt

SEQ ID NO: 7497500 - DNA, 22 bp, Homo sapiens
aaatctcaaaggcttagcatct

SEQ ID NO: 7497501 - DNA, 22 bp, Homo sapiens
aaatctcaaaggcttagcatct

SEQ ID NO: 7497502 - DNA, 22 bp, Homo sapiens
aaatctcaaaggcttagcatct

SEQ ID NO: 7497503 - DNA, 22 bp, Homo sapiens
aaatctaggccgggtgcggtgg

SEQ ID NO: 7497504 - DNA, 22 bp, Homo sapiens
aaatctaggctcatcctggtcc

SEQ ID NO: 7497505 - DNA, 22 bp, Homo sapiens
aaatctagtacctttttgatta

SEQ ID NO: 7497506 - DNA, 22 bp, Homo sapiens
aaatcggttggttcaaggtaat

SEQ ID NO: 7497507 - DNA, 22 bp, Homo sapiens
aaatcgtggaagacaccagtgg

SEQ ID NO: 7497508 - DNA, 22 bp, Homo sapiens
aaatctagaagtttaaaaggat

SEQ ID NO: 7497509 - DNA, 22 bp, Homo sapiens
aaatcctaatgacaagtttagt

SEQ ID NO: 7497510 - DNA, 22 bp, Homo sapiens
aaatcctaatgacaagtttagt

SEQ ID NO: 7497511 - DNA, 22 bp, Homo sapiens
aaatcctaatgacaagtttagt

SEQ ID NO: 7497512 - DNA, 22 bp, Homo sapiens
aaatcctaaggagaatatgatt

SEQ ID NO: 7497513 - DNA, 23 bp, Homo sapiens
aaatcctgcctcttgtatttatc

SEQ ID NO: 7497514 - DNA, 23 bp, Homo sapiens
aaatcctgcctcttgtatttatc

SEQ ID NO: 7497515 - DNA, 22 bp, Homo sapiens
aaatcccttgctctctcagacc

SEQ ID NO: 7497516 - DNA, 22 bp, Homo sapiens
aaatccctgataatgtaggtct

SEQ ID NO: 7497517 - DNA, 22 bp, Homo sapiens
aaatcccatcggagaggaggat

SEQ ID NO: 7497518 - DNA, 22 bp, Homo sapiens
aaatcctaaggagaatatgatt

SEQ ID NO: 7497519 - DNA, 22 bp, Homo sapiens
aaatcctaaggagaatatgatt

SEQ ID NO: 7497520 - DNA, 22 bp, Homo sapiens
aaatctcaaaggcttagcatct

SEQ ID NO: 7497521 - DNA, 22 bp, Homo sapiens
aaatctcaaaggcttagcatct

SEQ ID NO: 7497522 - DNA, 23 bp, Homo sapiens
aagcacagaatggtttaggagtt

SEQ ID NO: 7497523 - DNA, 23 bp, Homo sapiens
aagcacagaatggtttaggagtt

SEQ ID NO: 7497524 - DNA, 22 bp, Homo sapiens
aagcacagacacaaaaggcttt

SEQ ID NO: 7497525 - DNA, 23 bp, Homo sapiens
aagcacagaatggtttaggagtt

SEQ ID NO: 7497526 - DNA, 22 bp, Homo sapiens
aagcacagaccagatctccagg

SEQ ID NO: 7497527 - DNA, 22 bp, Homo sapiens
aagcacagacacaaaaggcttt

SEQ ID NO: 7497528 - DNA, 22 bp, Homo sapiens
aagcacagacacaaaaggcttt

SEQ ID NO: 7497529 - DNA, 22 bp, Homo sapiens
aagcacagacacaaaaggcttt

SEQ ID NO: 7497530 - DNA, 22 bp, Homo sapiens
aagcacagacacaaaaggcttt

SEQ ID NO: 7497531 - DNA, 22 bp, Homo sapiens
aagcacagactccctctgagtg

SEQ ID NO: 7497532 - DNA, 22 bp, Homo sapiens
aagcacagactccctctgagtg

SEQ ID NO: 7497533 - DNA, 22 bp, Homo sapiens
aagcacagaccagatctccagg

SEQ ID NO: 7497534 - DNA, 22 bp, Homo sapiens
aagcacagactccctctgagtg

SEQ ID NO: 7497535 - DNA, 22 bp, Homo sapiens
aagcacagactccctctgagtg

SEQ ID NO: 7497536 - DNA, 22 bp, Homo sapiens
aagcacagactccctctgagtg

SEQ ID NO: 7497537 - DNA, 22 bp, Homo sapiens
aagcacagagaggtaaagtaac

SEQ ID NO: 7497538 - DNA, 22 bp, Homo sapiens
aagcacagagaggtaaagtaac

SEQ ID NO: 7497539 - DNA, 22 bp, Homo sapiens
aagcacagagaggtaaagtaac

SEQ ID NO: 7497540 - DNA, 22 bp, Homo sapiens
aagcacagagaggtaaagtaac

SEQ ID NO: 7497541 - DNA, 22 bp, Homo sapiens
aagcacagactccctctgagtg

SEQ ID NO: 7497542 - DNA, 22 bp, Homo sapiens
aagcacagactccctctgagtg

SEQ ID NO: 7497543 - DNA, 22 bp, Homo sapiens
aagcacagactccctctgagtg

SEQ ID NO: 7497544 - DNA, 22 bp, Homo sapiens
aagcacagactccctctgagtg

SEQ ID NO: 7497545 - DNA, 22 bp, Homo sapiens
aagcacagataaaacaggattc

SEQ ID NO: 7497546 - DNA, 22 bp, Homo sapiens
aagcacagataaaacaggattc

SEQ ID NO: 7497547 - DNA, 22 bp, Homo sapiens
aagcacagataaaacaggattc

SEQ ID NO: 7497548 - DNA, 22 bp, Homo sapiens
aagcacagagatgggcacgcct

SEQ ID NO: 7497549 - DNA, 22 bp, Homo sapiens
aagcacagagatgggcacgcct

SEQ ID NO: 7497550 - DNA, 22 bp, Homo sapiens
aagcacagagatgggcacgcct

SEQ ID NO: 7497551 - DNA, 22 bp, Homo sapiens
aagcacagagatgggcacgcct

SEQ ID NO: 7497552 - DNA, 22 bp, Homo sapiens
aagcacagagatgggcacgcct

SEQ ID NO: 7497553 - DNA, 22 bp, Homo sapiens
aaatgtcaaagacgtgtttttg

SEQ ID NO: 7497554 - DNA, 22 bp, Homo sapiens
aagctcttgttgaatcttgtca

SEQ ID NO: 7497555 - DNA, 22 bp, Homo sapiens
aagctctttaatagtctaaaaa

SEQ ID NO: 7497556 - DNA, 22 bp, Homo sapiens
aagctcttgttgaatcttgtca

SEQ ID NO: 7497557 - DNA, 22 bp, Homo sapiens
aagctctttaatagtctaaaaa

SEQ ID NO: 7497558 - DNA, 22 bp, Homo sapiens
aagctctttccactaaaccact

SEQ ID NO: 7497559 - DNA, 22 bp, Homo sapiens
aagctctttccactaaaccact

SEQ ID NO: 7497560 - DNA, 22 bp, Homo sapiens
aaatgtcaaagacgtgtttttg

SEQ ID NO: 7497561 - DNA, 22 bp, Homo sapiens
aaatgtcaaagacgtgtttttg

SEQ ID NO: 7497562 - DNA, 22 bp, Homo sapiens
aaatgtcaaagacgtgtttttg

SEQ ID NO: 7497563 - DNA, 22 bp, Homo sapiens
aagctcttgagtaaactagttt

SEQ ID NO: 7497564 - DNA, 22 bp, Homo sapiens
aagctcttgaatgggatcaagg

SEQ ID NO: 7497565 - DNA, 22 bp, Homo sapiens
aagctcttttcaccattaaagt

SEQ ID NO: 7497566 - DNA, 22 bp, Homo sapiens
aagctcttttcataagagcaaa

SEQ ID NO: 7497567 - DNA, 22 bp, Homo sapiens
aagctcttttcaccattaaagt

SEQ ID NO: 7497568 - DNA, 22 bp, Homo sapiens
aagctcttttcaccattaaagt

SEQ ID NO: 7497569 - DNA, 22 bp, Homo sapiens
aagctcttttacaatcctaggc

SEQ ID NO: 7497570 - DNA, 22 bp, Homo sapiens
aagctcttttcaccattaaagt

SEQ ID NO: 7497571 - DNA, 22 bp, Homo sapiens
aagctcttttacaatcctaggc

SEQ ID NO: 7497572 - DNA, 22 bp, Homo sapiens
aagctctttgacctgggcctgg

SEQ ID NO: 7497573 - DNA, 22 bp, Homo sapiens
aagctctttccctcttcagaac

SEQ ID NO: 7497574 - DNA, 22 bp, Homo sapiens
aagctctttccctcttcagaac

SEQ ID NO: 7497575 - DNA, 22 bp, Homo sapiens
aagctctttccactaaaccact

SEQ ID NO: 7497576 - DNA, 22 bp, Homo sapiens
aagctctttccctcttcagaac

SEQ ID NO: 7497577 - DNA, 23 bp, Homo sapiens
aagctgaacttgtttgctgggag

SEQ ID NO: 7497578 - DNA, 22 bp, Homo sapiens
aagctgaagacacagctccagt

SEQ ID NO: 7497579 - DNA, 22 bp, Homo sapiens
aagctgaagatgccagtgggag

SEQ ID NO: 7497580 - DNA, 22 bp, Homo sapiens
aagctgaaaatgagactctaca

SEQ ID NO: 7497581 - DNA, 22 bp, Homo sapiens
aagctgaaacattagcctaaac

SEQ ID NO: 7497582 - DNA, 22 bp, Homo sapiens
aagctgaaataatatctatgtt

SEQ ID NO: 7497583 - DNA, 22 bp, Homo sapiens
aagctcttttctgcctcaccca

SEQ ID NO: 7497584 - DNA, 22 bp, Homo sapiens
aagctcttttctgcctcaccca

SEQ ID NO: 7497585 - DNA, 22 bp, Homo sapiens
aagctcttttctgcctcaccca

SEQ ID NO: 7497586 - DNA, 22 bp, Homo sapiens
aagctcttttctgcctcaccca

SEQ ID NO: 7497587 - DNA, 22 bp, Homo sapiens
aagctgaattttctaaaagaat

SEQ ID NO: 7497588 - DNA, 22 bp, Homo sapiens
aagctgaatctgaaatagaatt

SEQ ID NO: 7497589 - DNA, 22 bp, Homo sapiens
aagctgaattttctaaaagaat

SEQ ID NO: 7497590 - DNA, 22 bp, Homo sapiens
aagctgaatctgaaatagaatt

SEQ ID NO: 7497591 - DNA, 22 bp, Homo sapiens
aagctgaagccggatcaaaaag

SEQ ID NO: 7497592 - DNA, 22 bp, Homo sapiens
aagctgaagccggatcaaaaag

SEQ ID NO: 7497593 - DNA, 22 bp, Homo sapiens
aagctgaagccggatcaaaaag

SEQ ID NO: 7497594 - DNA, 22 bp, Homo sapiens
aaatgtagttgaaaagttaagg

SEQ ID NO: 7497595 - DNA, 22 bp, Homo sapiens
aaatgtagtatgttgcatgtat

SEQ ID NO: 7497596 - DNA, 20 bp, Homo sapiens
aaatgtataggacccttcta

SEQ ID NO: 7497597 - DNA, 20 bp, Homo sapiens
aaatgtataggacccttcta

SEQ ID NO: 7497598 - DNA, 22 bp, Homo sapiens
aaatgtagttgaaaagttaagg

SEQ ID NO: 7497599 - DNA, 22 bp, Homo sapiens
aaatgtattgcataggatattt

SEQ ID NO: 7497600 - DNA, 22 bp, Homo sapiens
aaatgtatcctacttcctgagt

SEQ ID NO: 7497601 - DNA, 22 bp, Homo sapiens
aaatgtatcctacttcctgagt

SEQ ID NO: 7497602 - DNA, 22 bp, Homo sapiens
aaatgtatcctacttcctgagt

SEQ ID NO: 7497603 - DNA, 22 bp, Homo sapiens
aaatgtattgcataggatattt

SEQ ID NO: 7497604 - DNA, 22 bp, Homo sapiens
aaatgtattgcataggatattt

SEQ ID NO: 7497605 - DNA, 22 bp, Homo sapiens
aaatgtattgcataggatattt

SEQ ID NO: 7497606 - DNA, 22 bp, Homo sapiens
aaatgtattgcataggatattt

SEQ ID NO: 7497607 - DNA, 22 bp, Homo sapiens
aaatgtattgcataggatattt

SEQ ID NO: 7497608 - DNA, 22 bp, Homo sapiens
aaatgtattgcataggatattt

SEQ ID NO: 7497609 - DNA, 22 bp, Homo sapiens
aaatgtattgcataggatattt

SEQ ID NO: 7497610 - DNA, 22 bp, Homo sapiens
aaatgtattgcataggatattt

SEQ ID NO: 7497611 - DNA, 18 bp, Homo sapiens
aaatgtactgtccatggc

SEQ ID NO: 7497612 - DNA, 22 bp, Homo sapiens
aaatgtagacctatagggacct

SEQ ID NO: 7497613 - DNA, 22 bp, Homo sapiens
aaatgtagtatgttgcatgtat

SEQ ID NO: 7497614 - DNA, 22 bp, Homo sapiens
aaatgtagtatgttgcatgtat

SEQ ID NO: 7497615 - DNA, 22 bp, Homo sapiens
aaatgtagtatgttgcatgtat

SEQ ID NO: 7497616 - DNA, 22 bp, Homo sapiens
aaatgtactgatacttatttta

SEQ ID NO: 7497617 - DNA, 22 bp, Homo sapiens
aaatgtactgatacttatttta

SEQ ID NO: 7497618 - DNA, 18 bp, Homo sapiens
aaatgtactgtccatggc

SEQ ID NO: 7497619 - DNA, 22 bp, Homo sapiens
aaatgtactgatacttatttta

SEQ ID NO: 7497620 - DNA, 18 bp, Homo sapiens
aaatgtactgtccatggc

SEQ ID NO: 7497621 - DNA, 22 bp, Homo sapiens
aaatgtaccttgatagtttggt

SEQ ID NO: 7497622 - DNA, 22 bp, Homo sapiens
aaatgtaccttgatagtttggt

SEQ ID NO: 7497623 - DNA, 22 bp, Homo sapiens
aaatgtacgggagtagaattag

SEQ ID NO: 7497624 - DNA, 22 bp, Homo sapiens
aaatgtacgggagtagaattag

SEQ ID NO: 7497625 - DNA, 22 bp, Homo sapiens
aaatgtacgggagtagaattag

SEQ ID NO: 7497626 - DNA, 22 bp, Homo sapiens
aaatgtacgggagtagaattag

SEQ ID NO: 7497627 - DNA, 22 bp, Homo sapiens
aagcatgaatcgactcggcaac

SEQ ID NO: 7497628 - DNA, 23 bp, Homo sapiens
aagcatcttttcctagctccatc

SEQ ID NO: 7497629 - DNA, 23 bp, Homo sapiens
aagcatcttttcctagctccatc

SEQ ID NO: 7497630 - DNA, 19 bp, Homo sapiens
aagcatctttgaaactggg

SEQ ID NO: 7497631 - DNA, 22 bp, Homo sapiens
aagcatcttctatcagttagac

SEQ ID NO: 7497632 - DNA, 22 bp, Homo sapiens
aagcatgcaatctgtgataagg

SEQ ID NO: 7497633 - DNA, 22 bp, Homo sapiens
aagcatgagctttcaaaccaga

SEQ ID NO: 7497634 - DNA, 22 bp, Homo sapiens
aagcatgcaatctgtgataagg

SEQ ID NO: 7497635 - DNA, 22 bp, Homo sapiens
aagcatgcaatctgtgataagg

SEQ ID NO: 7497636 - DNA, 22 bp, Homo sapiens
aagcatgcactccaaacagctt

SEQ ID NO: 7497637 - DNA, 22 bp, Homo sapiens
aagcatcttaaaaagtatcaga

SEQ ID NO: 7497638 - DNA, 22 bp, Homo sapiens
aagcatcttaaaaagtatcaga

SEQ ID NO: 7497639 - DNA, 22 bp, Homo sapiens
aagcatcttctatcagttagac

SEQ ID NO: 7497640 - DNA, 22 bp, Homo sapiens
aagcatcttagacctgagttcc

SEQ ID NO: 7497641 - DNA, 20 bp, Homo sapiens
aagcatctggatgtagcaat

SEQ ID NO: 7497642 - DNA, 20 bp, Homo sapiens
aagcatctggatgtagcaat

SEQ ID NO: 7497643 - DNA, 20 bp, Homo sapiens
aagcatctggatgtagcaat

SEQ ID NO: 7497644 - DNA, 22 bp, Homo sapiens
aagcatctgtaaagacccttat

SEQ ID NO: 7497645 - DNA, 20 bp, Homo sapiens
aagcatctggatgtagcaat

SEQ ID NO: 7497646 - DNA, 20 bp, Homo sapiens
aagcatctggatgtagcaat

SEQ ID NO: 7497647 - DNA, 22 bp, Homo sapiens
aagcatctgtaaagacccttat

SEQ ID NO: 7497648 - DNA, 22 bp, Homo sapiens
aagcatctaggtgactgacata

SEQ ID NO: 7497649 - DNA, 22 bp, Homo sapiens
aagcatctataggttctaggag

SEQ ID NO: 7497650 - DNA, 22 bp, Homo sapiens
aagcatctataggttctaggag

SEQ ID NO: 7497651 - DNA, 22 bp, Homo sapiens
aagcatctataggttctaggag

SEQ ID NO: 7497652 - DNA, 22 bp, Homo sapiens
aagcatctatattccactgtga

SEQ ID NO: 7497653 - DNA, 22 bp, Homo sapiens
aagcatcaacctgtatgctgca

SEQ ID NO: 7497654 - DNA, 22 bp, Homo sapiens
aagcatcaacctgtatgctgca

SEQ ID NO: 7497655 - DNA, 22 bp, Homo sapiens
aagcatcctatatgtaaactgt

SEQ ID NO: 7497656 - DNA, 22 bp, Homo sapiens
aagcatccggggctccaggtgc

SEQ ID NO: 7497657 - DNA, 22 bp, Homo sapiens
aagcatccggggctccaggtgc

SEQ ID NO: 7497658 - DNA, 22 bp, Homo sapiens
aagcatcaacactatattgatg

SEQ ID NO: 7497659 - DNA, 22 bp, Homo sapiens
aagcatcattcacttccttctg

SEQ ID NO: 7497660 - DNA, 22 bp, Homo sapiens
aagcatctcattcttgcctgtc

SEQ ID NO: 7497661 - DNA, 22 bp, Homo sapiens
aagcatctcctcatcatttggg

SEQ ID NO: 7497662 - DNA, 22 bp, Homo sapiens
aagcatctcattcttgcctgtc

SEQ ID NO: 7497663 - DNA, 22 bp, Homo sapiens
aagcatctcacctgcccccacg

SEQ ID NO: 7497664 - DNA, 22 bp, Homo sapiens
aagcatctatattccactgtga

SEQ ID NO: 7497665 - DNA, 22 bp, Homo sapiens
aagcatctatattccactgtga

SEQ ID NO: 7497666 - DNA, 20 bp, Homo sapiens
aagcatctggatgtagcaat

SEQ ID NO: 7497667 - DNA, 22 bp, Homo sapiens
aagcatctcctcatcatttggg

SEQ ID NO: 7497668 - DNA, 22 bp, Homo sapiens
aagcatctctatgtggagagtg

SEQ ID NO: 7497669 - DNA, 22 bp, Homo sapiens
aagcatctctatgtggagagtg

SEQ ID NO: 7497670 - DNA, 22 bp, Homo sapiens
aagcatctcctcatcatttggg

SEQ ID NO: 7497671 - DNA, 22 bp, Homo sapiens
aagcatctcctcatcatttggg

SEQ ID NO: 7497672 - DNA, 22 bp, Homo sapiens
aagcatcattcacttccttctg

SEQ ID NO: 7497673 - DNA, 22 bp, Homo sapiens
aagcatgggaggcctggaggag

SEQ ID NO: 7497674 - DNA, 22 bp, Homo sapiens
aagcatgggaggcctggaggag

SEQ ID NO: 7497675 - DNA, 20 bp, Homo sapiens
aagcatggtcaaaacttatg

SEQ ID NO: 7497676 - DNA, 20 bp, Homo sapiens
aagcatggtcaaaacttatg

SEQ ID NO: 7497677 - DNA, 22 bp, Homo sapiens
aagcatgggaggcctggaggag

SEQ ID NO: 7497678 - DNA, 19 bp, Homo sapiens
aagcatggtgcctcacctc

SEQ ID NO: 7497679 - DNA, 19 bp, Homo sapiens
aagcatggtgcctcacctc

SEQ ID NO: 7497680 - DNA, 20 bp, Homo sapiens
aagcatggtcaaaacttatg

SEQ ID NO: 7497681 - DNA, 22 bp, Homo sapiens
aagcatggagcaatagaatgac

SEQ ID NO: 7497682 - DNA, 22 bp, Homo sapiens
aagcatggagcaatagaatgac

SEQ ID NO: 7497683 - DNA, 22 bp, Homo sapiens
aagcatggctgagtgcaatggt

SEQ ID NO: 7497684 - DNA, 22 bp, Homo sapiens
aagcatggctgagtgcaatggt

SEQ ID NO: 7497685 - DNA, 22 bp, Homo sapiens
aagcatggcctctccgctcccc

SEQ ID NO: 7497686 - DNA, 22 bp, Homo sapiens
aagcatggcctctccgctcccc

SEQ ID NO: 7497687 - DNA, 22 bp, Homo sapiens
aagcatgggaggcctggaggag

SEQ ID NO: 7497688 - DNA, 22 bp, Homo sapiens
aagcatgggaatcccacagggt

SEQ ID NO: 7497689 - DNA, 22 bp, Homo sapiens
aagcatgggaatcccacagggt

SEQ ID NO: 7497690 - DNA, 22 bp, Homo sapiens
aagcatgggaatcccacagggt

SEQ ID NO: 7497691 - DNA, 22 bp, Homo sapiens
aagcatggctgttctagctata

SEQ ID NO: 7497692 - DNA, 22 bp, Homo sapiens
aagcatggctgttctagctata

SEQ ID NO: 7497693 - DNA, 22 bp, Homo sapiens
aagcatggctgttctagctata

SEQ ID NO: 7497694 - DNA, 22 bp, Homo sapiens
aaatgtaagtctttgtttctta

SEQ ID NO: 7497695 - DNA, 22 bp, Homo sapiens
aaatgtaagtctttgtttctta

SEQ ID NO: 7497696 - DNA, 22 bp, Homo sapiens
aaatgtaagtctttgtttctta

SEQ ID NO: 7497697 - DNA, 22 bp, Homo sapiens
aaatgtaagtctttgtttctta

SEQ ID NO: 7497698 - DNA, 22 bp, Homo sapiens
aaatggcaggctctttgctagt

SEQ ID NO: 7497699 - DNA, 22 bp, Homo sapiens
aaatgtaagtctttgtttctta

SEQ ID NO: 7497700 - DNA, 22 bp, Homo sapiens
aaatgtaagtctttgtttctta

SEQ ID NO: 7497701 - DNA, 22 bp, Homo sapiens
aaatgtacaacatccatatata

SEQ ID NO: 7497702 - DNA, 22 bp, Homo sapiens
aaatgtacaacatccatatata

SEQ ID NO: 7497703 - DNA, 22 bp, Homo sapiens
aaatgtacaacatccatatata

SEQ ID NO: 7497704 - DNA, 22 bp, Homo sapiens
aaatgtaagtctttgtttctta

SEQ ID NO: 7497705 - DNA, 22 bp, Homo sapiens
aaatgtaagtctttgtttctta

SEQ ID NO: 7497706 - DNA, 22 bp, Homo sapiens
aaatgtacactttgcatcttga

SEQ ID NO: 7497707 - DNA, 22 bp, Homo sapiens
aaatgtacaacatccatatata

SEQ ID NO: 7497708 - DNA, 22 bp, Homo sapiens
aaatgtacactttgcatcttga

SEQ ID NO: 7497709 - DNA, 22 bp, Homo sapiens
aaatagcattgtatttagctga

SEQ ID NO: 7497710 - DNA, 22 bp, Homo sapiens
aaatagctacatgatctctagg

SEQ ID NO: 7497711 - DNA, 22 bp, Homo sapiens
aaatagctacatgatctctagg

SEQ ID NO: 7497712 - DNA, 22 bp, Homo sapiens
aaatagctacatgatctctagg

SEQ ID NO: 7497713 - DNA, 22 bp, Homo sapiens
aaatagcataaaataggaagct

SEQ ID NO: 7497714 - DNA, 22 bp, Homo sapiens
aaatagcattgtatttagctga

SEQ ID NO: 7497715 - DNA, 22 bp, Homo sapiens
aaatagcagctttgacagcaca

SEQ ID NO: 7497716 - DNA, 22 bp, Homo sapiens
aaatagcagctttgacagcaca

SEQ ID NO: 7497717 - DNA, 22 bp, Homo sapiens
aaatagcagctttgacagcaca

SEQ ID NO: 7497718 - DNA, 22 bp, Homo sapiens
aaatagcagctttgacagcaca

SEQ ID NO: 7497719 - DNA, 22 bp, Homo sapiens
aaatagcagctttgacagcaca

SEQ ID NO: 7497720 - DNA, 22 bp, Homo sapiens
aaatagcagcctttagttaaca

SEQ ID NO: 7497721 - DNA, 22 bp, Homo sapiens
aaatagcagctttgacagcaca

SEQ ID NO: 7497722 - DNA, 22 bp, Homo sapiens
aaatagcagcctttagttaaca

SEQ ID NO: 7497723 - DNA, 22 bp, Homo sapiens
aaatagctgtatttaccctgta

SEQ ID NO: 7497724 - DNA, 22 bp, Homo sapiens
aaatagctgaaagttcctagat

SEQ ID NO: 7497725 - DNA, 22 bp, Homo sapiens
aaatagctacatgatctctagg

SEQ ID NO: 7497726 - DNA, 22 bp, Homo sapiens
aaatagcattgtatttagctga

SEQ ID NO: 7497727 - DNA, 22 bp, Homo sapiens
aaatagctacatgatctctagg

SEQ ID NO: 7497728 - DNA, 23 bp, Homo sapiens
aaatagctccgtggcacactctc

SEQ ID NO: 7497729 - DNA, 22 bp, Homo sapiens
aaatagcttctaagccttttga

SEQ ID NO: 7497730 - DNA, 22 bp, Homo sapiens
aaatagcttttcataattctca

SEQ ID NO: 7497731 - DNA, 22 bp, Homo sapiens
aaatagcttttcataattctca

SEQ ID NO: 7497732 - DNA, 22 bp, Homo sapiens
aaatagcttttcataattctca

SEQ ID NO: 7497733 - DNA, 22 bp, Homo sapiens
aaataggagcttaagcacttct

SEQ ID NO: 7497734 - DNA, 22 bp, Homo sapiens
aaataggagcttaagcacttct

SEQ ID NO: 7497735 - DNA, 22 bp, Homo sapiens
aaatagcttttcataattctca

SEQ ID NO: 7497736 - DNA, 22 bp, Homo sapiens
aaataggagcttaagcacttct

SEQ ID NO: 7497737 - DNA, 23 bp, Homo sapiens
aaataggagtatctggatcatga

SEQ ID NO: 7497738 - DNA, 23 bp, Homo sapiens
aaataggagtatctggatcatga

SEQ ID NO: 7497739 - DNA, 23 bp, Homo sapiens
aaataggagtatctggatcatga

SEQ ID NO: 7497740 - DNA, 23 bp, Homo sapiens
aaataggagtatctggatcatga

SEQ ID NO: 7497741 - DNA, 23 bp, Homo sapiens
aaataggagtatctggatcatga

SEQ ID NO: 7497742 - DNA, 23 bp, Homo sapiens
aaataggagtatctggatcatga

SEQ ID NO: 7497743 - DNA, 22 bp, Homo sapiens
aaatcagagtggttggtcatcc

SEQ ID NO: 7497744 - DNA, 22 bp, Homo sapiens
aaatcagagtggttggtcatcc

SEQ ID NO: 7497745 - DNA, 22 bp, Homo sapiens
aaatcagatcttacacaattgt

SEQ ID NO: 7497746 - DNA, 22 bp, Homo sapiens
aaatcagatgcttcctagttgg

SEQ ID NO: 7497747 - DNA, 22 bp, Homo sapiens
aaatcagatgcttcctagttgg

SEQ ID NO: 7497748 - DNA, 22 bp, Homo sapiens
aaatcccactcagaaactgcca

SEQ ID NO: 7497749 - DNA, 22 bp, Homo sapiens
aaatcccactcagaaactgcca

SEQ ID NO: 7497750 - DNA, 22 bp, Homo sapiens
aaatcccactcagaaactgcca

SEQ ID NO: 7497751 - DNA, 22 bp, Homo sapiens
aaatcccagatagtaatgtatt

SEQ ID NO: 7497752 - DNA, 22 bp, Homo sapiens
aaatcccagatagtaatgtatt

SEQ ID NO: 7497753 - DNA, 22 bp, Homo sapiens
aaatcccactcacgagttttgc

SEQ ID NO: 7497754 - DNA, 22 bp, Homo sapiens
aaatcccaatgctagacccggt

SEQ ID NO: 7497755 - DNA, 22 bp, Homo sapiens
aaatccatggtaatctgttaca

SEQ ID NO: 7497756 - DNA, 22 bp, Homo sapiens
aaatccattctgttttaaaagt

SEQ ID NO: 7497757 - DNA, 22 bp, Homo sapiens
aaatccattctgttttaaaagt

SEQ ID NO: 7497758 - DNA, 22 bp, Homo sapiens
aaatccattctgttttaaaagt

SEQ ID NO: 7497759 - DNA, 22 bp, Homo sapiens
aaatccatcaaatcttctagaa

SEQ ID NO: 7497760 - DNA, 22 bp, Homo sapiens
aaatcagtaaatgttcattaac

SEQ ID NO: 7497761 - DNA, 22 bp, Homo sapiens
aaatcagattatttgattggca

SEQ ID NO: 7497762 - DNA, 22 bp, Homo sapiens
aaatcagtaaatgttcattaac

SEQ ID NO: 7497763 - DNA, 22 bp, Homo sapiens
aaatccatggtaatctgttaca

SEQ ID NO: 7497764 - DNA, 22 bp, Homo sapiens
aaatccatggtaatctgttaca

SEQ ID NO: 7497765 - DNA, 22 bp, Homo sapiens
aaatccatcaaatcttctagaa

SEQ ID NO: 7497766 - DNA, 22 bp, Homo sapiens
aaatccatcaaatcttctagaa

SEQ ID NO: 7497767 - DNA, 22 bp, Homo sapiens
aaatccatcaaatcttctagaa

SEQ ID NO: 7497768 - DNA, 22 bp, Homo sapiens
aaatccatggtaatctgttaca

SEQ ID NO: 7497769 - DNA, 22 bp, Homo sapiens
aaatccatggtaatctgttaca

SEQ ID NO: 7497770 - DNA, 22 bp, Homo sapiens
aaatagatttaacatccatccc

SEQ ID NO: 7497771 - DNA, 22 bp, Homo sapiens
aaatagattgctgaggcattac

SEQ ID NO: 7497772 - DNA, 22 bp, Homo sapiens
aaatagatttaacatccatccc

SEQ ID NO: 7497773 - DNA, 22 bp, Homo sapiens
aaatagatttaacatccatccc

SEQ ID NO: 7497774 - DNA, 22 bp, Homo sapiens
aaatagattgctgaggcattac

SEQ ID NO: 7497775 - DNA, 22 bp, Homo sapiens
aaatagatttaacatccatccc

SEQ ID NO: 7497776 - DNA, 22 bp, Homo sapiens
aaatagatttcctagcattgga

SEQ ID NO: 7497777 - DNA, 22 bp, Homo sapiens
aaatagatttcctagcattgga

SEQ ID NO: 7497778 - DNA, 22 bp, Homo sapiens
aaatagatttcctagcattgga

SEQ ID NO: 7497779 - DNA, 22 bp, Homo sapiens
aaatagatttcctagcattgga

SEQ ID NO: 7497780 - DNA, 22 bp, Homo sapiens
aaatagattgctgaggcattac

SEQ ID NO: 7497781 - DNA, 22 bp, Homo sapiens
aaatagattgctgaggcattac

SEQ ID NO: 7497782 - DNA, 22 bp, Homo sapiens
aaatagattgctgaggcattac

SEQ ID NO: 7497783 - DNA, 22 bp, Homo sapiens
aaatagagctgggttaaacttt

SEQ ID NO: 7497784 - DNA, 23 bp, Homo sapiens
aaatagagataggccagctttgc

SEQ ID NO: 7497785 - DNA, 22 bp, Homo sapiens
aaatagagctgggttaaacttt

SEQ ID NO: 7497786 - DNA, 22 bp, Homo sapiens
aaatagagctgggttaaacttt

SEQ ID NO: 7497787 - DNA, 22 bp, Homo sapiens
aaatagagctgggttaaacttt

SEQ ID NO: 7497788 - DNA, 22 bp, Homo sapiens
aaatagcaatgtgaaaagagga

SEQ ID NO: 7497789 - DNA, 22 bp, Homo sapiens
aaatagcaatgtgaaaagagga

SEQ ID NO: 7497790 - DNA, 22 bp, Homo sapiens
aaatagatttctctgggtttgt

SEQ ID NO: 7497791 - DNA, 22 bp, Homo sapiens
aaatagatttctctgggtttgt

SEQ ID NO: 7497792 - DNA, 22 bp, Homo sapiens
aaatagatttcctagcattgga

SEQ ID NO: 7497793 - DNA, 22 bp, Homo sapiens
aaatagatttcctagcattgga

SEQ ID NO: 7497794 - DNA, 22 bp, Homo sapiens
aaatagatttcctagcattgga

SEQ ID NO: 7497795 - DNA, 22 bp, Homo sapiens
aaatagatttcctagcattgga

SEQ ID NO: 7497796 - DNA, 22 bp, Homo sapiens
aaatagcagcctttagttaaca

SEQ ID NO: 7497797 - DNA, 22 bp, Homo sapiens
aaatagcagcctttagttaaca

SEQ ID NO: 7497798 - DNA, 22 bp, Homo sapiens
aaatagcagcctttagttaaca

SEQ ID NO: 7497799 - DNA, 22 bp, Homo sapiens
aaatagatttcctagcattgga

SEQ ID NO: 7497800 - DNA, 22 bp, Homo sapiens
aaatagcaatgtgaaaagagga

SEQ ID NO: 7497801 - DNA, 22 bp, Homo sapiens
aaatagcaatgtgaaaagagga

SEQ ID NO: 7497802 - DNA, 22 bp, Homo sapiens
aaatagcagaagcagagggggt

SEQ ID NO: 7497803 - DNA, 22 bp, Homo sapiens
aaatagacaggcttaaatagga

SEQ ID NO: 7497804 - DNA, 22 bp, Homo sapiens
aaatagacaggcttaaatagga

SEQ ID NO: 7497805 - DNA, 22 bp, Homo sapiens
aaatagacaggcttaaatagga

SEQ ID NO: 7497806 - DNA, 23 bp, Homo sapiens
aaatagagataggccagctttgc

SEQ ID NO: 7497807 - DNA, 23 bp, Homo sapiens
aaatagagataggccagctttgc

SEQ ID NO: 7497808 - DNA, 23 bp, Homo sapiens
aaatagagataggccagctttgc

SEQ ID NO: 7497809 - DNA, 22 bp, Homo sapiens
aaatagacaggcttaaatagga

SEQ ID NO: 7497810 - DNA, 22 bp, Homo sapiens
aaatagacaggcttaaatagga

SEQ ID NO: 7497811 - DNA, 22 bp, Homo sapiens
aaatagacaggcttaaatagga

SEQ ID NO: 7497812 - DNA, 22 bp, Homo sapiens
aaatagacaggcttaaatagga

SEQ ID NO: 7497813 - DNA, 22 bp, Homo sapiens
aaatagacacttggacagacaa

SEQ ID NO: 7497814 - DNA, 22 bp, Homo sapiens
aaatagacacttggacagacaa

SEQ ID NO: 7497815 - DNA, 22 bp, Homo sapiens
aaatagacacatgcgttcatat

SEQ ID NO: 7497816 - DNA, 22 bp, Homo sapiens
aaatagaattggaagcagagtt

SEQ ID NO: 7497817 - DNA, 22 bp, Homo sapiens
aaatagaattggaagcagagtt

SEQ ID NO: 7497818 - DNA, 22 bp, Homo sapiens
aaatactgtagataatagagtt

SEQ ID NO: 7497819 - DNA, 22 bp, Homo sapiens
aaatactgtagataatagagtt

SEQ ID NO: 7497820 - DNA, 22 bp, Homo sapiens
aaatacaaaaattagccaggca

SEQ ID NO: 7497821 - DNA, 22 bp, Homo sapiens
aaatactgtagataatagagtt

SEQ ID NO: 7497822 - DNA, 22 bp, Homo sapiens
aaatactgtagataatagagtt

SEQ ID NO: 7497823 - DNA, 22 bp, Homo sapiens
aaatactgtagataatagagtt

SEQ ID NO: 7497824 - DNA, 22 bp, Homo sapiens
aaataattgagttggtcaatat

SEQ ID NO: 7497825 - DNA, 22 bp, Homo sapiens
aaataattgagttggtcaatat

SEQ ID NO: 7497826 - DNA, 22 bp, Homo sapiens
aaataattgagttggtcaatat

SEQ ID NO: 7497827 - DNA, 22 bp, Homo sapiens
aaataattgagttggtcaatat

SEQ ID NO: 7497828 - DNA, 22 bp, Homo sapiens
aaatacaaaaattagccaggca

SEQ ID NO: 7497829 - DNA, 22 bp, Homo sapiens
aaatacaaaaattagccaggca

SEQ ID NO: 7497830 - DNA, 22 bp, Homo sapiens
aaataattgagttggtcaatat

SEQ ID NO: 7497831 - DNA, 22 bp, Homo sapiens
aaataattgagttggtcaatat

SEQ ID NO: 7497832 - DNA, 22 bp, Homo sapiens
aaataattgagttggtcaatat

SEQ ID NO: 7497833 - DNA, 22 bp, Homo sapiens
aaataattgagttggtcaatat

SEQ ID NO: 7497834 - DNA, 22 bp, Homo sapiens
aaataattatagcgagtctatc

SEQ ID NO: 7497835 - DNA, 22 bp, Homo sapiens
aaataattatagcgagtctatc

SEQ ID NO: 7497836 - DNA, 22 bp, Homo sapiens
aaataattatagcgagtctatc

SEQ ID NO: 7497837 - DNA, 22 bp, Homo sapiens
aaataattatagcgagtctatc

SEQ ID NO: 7497838 - DNA, 22 bp, Homo sapiens
aaataattatagcgagtctatc

SEQ ID NO: 7497839 - DNA, 22 bp, Homo sapiens
aaagtgttgggattacaggtgt

SEQ ID NO: 7497840 - DNA, 22 bp, Homo sapiens
aaagtgttgggattacaggtgt

SEQ ID NO: 7497841 - DNA, 22 bp, Homo sapiens
aaagtgttgggattacaggcat

SEQ ID NO: 7497842 - DNA, 22 bp, Homo sapiens
aaagtgttgggattacaggcat

SEQ ID NO: 7497843 - DNA, 22 bp, Homo sapiens
aaagtgttgggattacaggcat

SEQ ID NO: 7497844 - DNA, 22 bp, Homo sapiens
aaagtgttgggattacaggcat

SEQ ID NO: 7497845 - DNA, 22 bp, Homo sapiens
aaagtgttgggattacaggcat

SEQ ID NO: 7497846 - DNA, 22 bp, Homo sapiens
aaagtgttgggattacaggcat

SEQ ID NO: 7497847 - DNA, 22 bp, Homo sapiens
aaagtgtttacattgctataag

SEQ ID NO: 7497848 - DNA, 22 bp, Homo sapiens
aaagtgtttacattgctataag

SEQ ID NO: 7497849 - DNA, 22 bp, Homo sapiens
aaagtgtttacattgctataag

SEQ ID NO: 7497850 - DNA, 22 bp, Homo sapiens
aaagtgttgggattataggcgt

SEQ ID NO: 7497851 - DNA, 22 bp, Homo sapiens
aaagtgttgggattataggcgt

SEQ ID NO: 7497852 - DNA, 22 bp, Homo sapiens
aaagtgttgggattataggcgt

SEQ ID NO: 7497853 - DNA, 22 bp, Homo sapiens
aaagtgttgggattataggcgt

SEQ ID NO: 7497854 - DNA, 22 bp, Homo sapiens
aaagtgttgggattacaggtgt

SEQ ID NO: 7497855 - DNA, 22 bp, Homo sapiens
aaagtgttgggattacaggtgt

SEQ ID NO: 7497856 - DNA, 22 bp, Homo sapiens
aaagtgttgggattacaggtgt

SEQ ID NO: 7497857 - DNA, 22 bp, Homo sapiens
aaagtgttgggattacaggtgt

SEQ ID NO: 7497858 - DNA, 22 bp, Homo sapiens
aaagtgtttacattgctataag

SEQ ID NO: 7497859 - DNA, 19 bp, Homo sapiens
aaagtgttttaaagaggat

SEQ ID NO: 7497860 - DNA, 22 bp, Homo sapiens
aaagtgtttacattgctataag

SEQ ID NO: 7497861 - DNA, 22 bp, Homo sapiens
aaagtgtttacattgctataag

SEQ ID NO: 7497862 - DNA, 22 bp, Homo sapiens
aaagtgtttacattgctataag

SEQ ID NO: 7497863 - DNA, 22 bp, Homo sapiens
aaagtgtttacattgctataag

SEQ ID NO: 7497864 - DNA, 22 bp, Homo sapiens
aaagtgttttccatgcaatgaa

SEQ ID NO: 7497865 - DNA, 19 bp, Homo sapiens
aaagtgttttaaagaggat

SEQ ID NO: 7497866 - DNA, 22 bp, Homo sapiens
aaagtgttttccatgcaatgaa

SEQ ID NO: 7497867 - DNA, 22 bp, Homo sapiens
aaagtgttttccatgcaatgaa

SEQ ID NO: 7497868 - DNA, 22 bp, Homo sapiens
aaagtgttttctgatgtgttct

SEQ ID NO: 7497869 - DNA, 22 bp, Homo sapiens
aaagtgttttctgatgtgttct

SEQ ID NO: 7497870 - DNA, 22 bp, Homo sapiens
aaagtgttttccatgcaatgaa

SEQ ID NO: 7497871 - DNA, 22 bp, Homo sapiens
aaagtgttttccatgcaatgaa

SEQ ID NO: 7497872 - DNA, 22 bp, Homo sapiens
aaataacagtcagggacaacat

SEQ ID NO: 7497873 - DNA, 22 bp, Homo sapiens
aaataacagtcagggacaacat

SEQ ID NO: 7497874 - DNA, 22 bp, Homo sapiens
aaataacttatgatcgtctggc

SEQ ID NO: 7497875 - DNA, 22 bp, Homo sapiens
aaagttttatatgctgcagcga

SEQ ID NO: 7497876 - DNA, 22 bp, Homo sapiens
aaagttttattcaagcattagt

SEQ ID NO: 7497877 - DNA, 22 bp, Homo sapiens
aaagttttattcaagcattagt

SEQ ID NO: 7497878 - DNA, 22 bp, Homo sapiens
aaagttttattcaagcattagt

SEQ ID NO: 7497879 - DNA, 22 bp, Homo sapiens
aaagttttattcaagcattagt

SEQ ID NO: 7497880 - DNA, 22 bp, Homo sapiens
aaagttttattcaagcattagt

SEQ ID NO: 7497881 - DNA, 22 bp, Homo sapiens
aaagttttattcaagcattagt

SEQ ID NO: 7497882 - DNA, 22 bp, Homo sapiens
aaataacagtcagggacaacat

SEQ ID NO: 7497883 - DNA, 22 bp, Homo sapiens
aaagttttatatgctgcagcga

SEQ ID NO: 7497884 - DNA, 22 bp, Homo sapiens
aaagttttatatgctgcagcga

SEQ ID NO: 7497885 - DNA, 22 bp, Homo sapiens
aaagtgtttttgagctgtagtt

SEQ ID NO: 7497886 - DNA, 22 bp, Homo sapiens
aaagtgtttttgagctgtagtt

SEQ ID NO: 7497887 - DNA, 22 bp, Homo sapiens
aaagtgttttgtgagcagtctg

SEQ ID NO: 7497888 - DNA, 22 bp, Homo sapiens
aaagtgtttttgagctgtagtt

SEQ ID NO: 7497889 - DNA, 22 bp, Homo sapiens
aaagtgttttctgatgtgttct

SEQ ID NO: 7497890 - DNA, 19 bp, Homo sapiens
aaagtgttttcttttctgt

SEQ ID NO: 7497891 - DNA, 19 bp, Homo sapiens
aaagtgttttcttttctgt

SEQ ID NO: 7497892 - DNA, 19 bp, Homo sapiens
aaagtgttttcttttctgt

SEQ ID NO: 7497893 - DNA, 19 bp, Homo sapiens
aaagtgttttcttttctgt

SEQ ID NO: 7497894 - DNA, 22 bp, Homo sapiens
aaagtgttttgtgagcagtctg

SEQ ID NO: 7497895 - DNA, 22 bp, Homo sapiens
aaagtgttttgtgagcagtctg

SEQ ID NO: 7497896 - DNA, 22 bp, Homo sapiens
aaagtgttttgatttagtggta

SEQ ID NO: 7497897 - DNA, 21 bp, Homo sapiens
aaagtgtgtggggaagaagga

SEQ ID NO: 7497898 - DNA, 22 bp, Homo sapiens
aaagtgttatgagaactaagtg

SEQ ID NO: 7497899 - DNA, 22 bp, Homo sapiens
aaagtgttatgagaactaagtg

SEQ ID NO: 7497900 - DNA, 22 bp, Homo sapiens
aaagtgttatgagaactaagtg

SEQ ID NO: 7497901 - DNA, 22 bp, Homo sapiens
aaagtgttaacactggctactt

SEQ ID NO: 7497902 - DNA, 22 bp, Homo sapiens
aaagtgttaacactggctactt

SEQ ID NO: 7497903 - DNA, 23 bp, Homo sapiens
aaagtgtagccaggttaagaacc

SEQ ID NO: 7497904 - DNA, 23 bp, Homo sapiens
aaagtgtagccaggttaagaacc

SEQ ID NO: 7497905 - DNA, 22 bp, Homo sapiens
aaagtgtggagattgaactaaa

SEQ ID NO: 7497906 - DNA, 22 bp, Homo sapiens
aaagtgtggagattgaactaaa

SEQ ID NO: 7497907 - DNA, 23 bp, Homo sapiens
aaagtgtagccaggttaagaacc

SEQ ID NO: 7497908 - DNA, 22 bp, Homo sapiens
aaagtgttatgcaaaactctgt

SEQ ID NO: 7497909 - DNA, 22 bp, Homo sapiens
aaagtgttatgcaaaactctgt

SEQ ID NO: 7497910 - DNA, 22 bp, Homo sapiens
aaagtgttatgcaaaactctgt

SEQ ID NO: 7497911 - DNA, 22 bp, Homo sapiens
aaagtgttatgagaactaagtg

SEQ ID NO: 7497912 - DNA, 22 bp, Homo sapiens
aaagtgttgaagaaaatgttca

SEQ ID NO: 7497913 - DNA, 22 bp, Homo sapiens
aaagtgttgaagaaaatgttca

SEQ ID NO: 7497914 - DNA, 22 bp, Homo sapiens
aaagtgttgaagaaaatgttca

SEQ ID NO: 7497915 - DNA, 21 bp, Homo sapiens
aaagtgttcagaccagttctg

SEQ ID NO: 7497916 - DNA, 22 bp, Homo sapiens
aaagtgttgaagaaaatgttca

SEQ ID NO: 7497917 - DNA, 22 bp, Homo sapiens
aaagtgttgatatgtgacatcc

SEQ ID NO: 7497918 - DNA, 22 bp, Homo sapiens
aaagtgttgatatgtgacatcc

SEQ ID NO: 7497919 - DNA, 22 bp, Homo sapiens
aaagtgttgaagaaaatgttca

SEQ ID NO: 7497920 - DNA, 22 bp, Homo sapiens
aaagtgttgatatgtgacatcc

SEQ ID NO: 7497921 - DNA, 22 bp, Homo sapiens
aaagtgttgatatgtgacatcc

SEQ ID NO: 7497922 - DNA, 22 bp, Homo sapiens
aaagtgttgatatgtgacatcc

SEQ ID NO: 7497923 - DNA, 22 bp, Homo sapiens
aaagtgttgatatgtgacatcc

SEQ ID NO: 7497924 - DNA, 22 bp, Homo sapiens
aaagtgttgattttatagtgca

SEQ ID NO: 7497925 - DNA, 22 bp, Homo sapiens
aaagtgttgattttatagtgca

SEQ ID NO: 7497926 - DNA, 22 bp, Homo sapiens
aaagtgttgattttatagtgca

SEQ ID NO: 7497927 - DNA, 22 bp, Homo sapiens
aaagtgttgattttatagtgca

SEQ ID NO: 7497928 - DNA, 22 bp, Homo sapiens
aaagtgttgattttatagtgca

SEQ ID NO: 7497929 - DNA, 22 bp, Homo sapiens
aaagtgttgggaagaaagtgca

SEQ ID NO: 7497930 - DNA, 22 bp, Homo sapiens
aaataagtgtgggccagtcaaa

SEQ ID NO: 7497931 - DNA, 22 bp, Homo sapiens
aaataagtgtgggccagtcaaa

SEQ ID NO: 7497932 - DNA, 22 bp, Homo sapiens
aaataagtgtgggccagtcaaa

SEQ ID NO: 7497933 - DNA, 22 bp, Homo sapiens
aaataagtgtgggccagtcaaa

SEQ ID NO: 7497934 - DNA, 22 bp, Homo sapiens
aaataagtgtgggccagtcaaa

SEQ ID NO: 7497935 - DNA, 22 bp, Homo sapiens
aaataagtgtgggccagtcaaa

SEQ ID NO: 7497936 - DNA, 22 bp, Homo sapiens
aaataagtagtttagtgttgtg

SEQ ID NO: 7497937 - DNA, 22 bp, Homo sapiens
aaataagtagtttagtgttgtg

SEQ ID NO: 7497938 - DNA, 22 bp, Homo sapiens
aaataagtaatgtcttcctttt

SEQ ID NO: 7497939 - DNA, 22 bp, Homo sapiens
aaataagtaatgtcttcctttt

SEQ ID NO: 7497940 - DNA, 22 bp, Homo sapiens
aaataagtagtttagtgttgtg

SEQ ID NO: 7497941 - DNA, 22 bp, Homo sapiens
aaataagtagtttagtgttgtg

SEQ ID NO: 7497942 - DNA, 22 bp, Homo sapiens
aaataagtagtttagtgttgtg

SEQ ID NO: 7497943 - DNA, 22 bp, Homo sapiens
aaataagttaaactagaatgat

SEQ ID NO: 7497944 - DNA, 22 bp, Homo sapiens
aaataagttaaactagaatgat

SEQ ID NO: 7497945 - DNA, 22 bp, Homo sapiens
aaataagttaaactagaatgat

SEQ ID NO: 7497946 - DNA, 22 bp, Homo sapiens
aaataagttaaactagaatgat

SEQ ID NO: 7497947 - DNA, 22 bp, Homo sapiens
aaataagttaaactagaatgat

SEQ ID NO: 7497948 - DNA, 22 bp, Homo sapiens
aaataagttaaactagaatgat

SEQ ID NO: 7497949 - DNA, 22 bp, Homo sapiens
aaataagtgtgggccagtcaaa

SEQ ID NO: 7497950 - DNA, 22 bp, Homo sapiens
aaataagttaaactagaatgat

SEQ ID NO: 7497951 - DNA, 22 bp, Homo sapiens
aaataagttaaactagaatgat

SEQ ID NO: 7497952 - DNA, 22 bp, Homo sapiens
aaataagttaaactagaatgat

SEQ ID NO: 7497953 - DNA, 22 bp, Homo sapiens
aaataagttaaactagaatgat

SEQ ID NO: 7497954 - DNA, 22 bp, Homo sapiens
aaataagttagcagattccagt

SEQ ID NO: 7497955 - DNA, 22 bp, Homo sapiens
aaataagttagcagattccagt

SEQ ID NO: 7497956 - DNA, 22 bp, Homo sapiens
aaataagttagcagattccagt

SEQ ID NO: 7497957 - DNA, 22 bp, Homo sapiens
aaataatcaatttttgtagata

SEQ ID NO: 7497958 - DNA, 22 bp, Homo sapiens
aaataatcaatttttgtagata

SEQ ID NO: 7497959 - DNA, 22 bp, Homo sapiens
aaataagttagcagattccagt

SEQ ID NO: 7497960 - DNA, 22 bp, Homo sapiens
aaataagttagcagattccagt

SEQ ID NO: 7497961 - DNA, 22 bp, Homo sapiens
aaataagttagcagattccagt

SEQ ID NO: 7497962 - DNA, 22 bp, Homo sapiens
aaataagttagcagattccagt

SEQ ID NO: 7497963 - DNA, 22 bp, Homo sapiens
aaataattatagcgagtctatc

SEQ ID NO: 7497964 - DNA, 22 bp, Homo sapiens
aaataattatagcgagtctatc

SEQ ID NO: 7497965 - DNA, 22 bp, Homo sapiens
aaataatgttaggcctttgctc

SEQ ID NO: 7497966 - DNA, 22 bp, Homo sapiens
aaataatgttaggcctttgctc

SEQ ID NO: 7497967 - DNA, 22 bp, Homo sapiens
aaataatcaatttttgtagata

SEQ ID NO: 7497968 - DNA, 22 bp, Homo sapiens
aaataatcaatttttgtagata

SEQ ID NO: 7497969 - DNA, 22 bp, Homo sapiens
aaataagtaatgtcttcctttt

SEQ ID NO: 7497970 - DNA, 22 bp, Homo sapiens
aaataagtaatgtcttcctttt

SEQ ID NO: 7497971 - DNA, 21 bp, Homo sapiens
aaataaggatagatggtttgg

SEQ ID NO: 7497972 - DNA, 21 bp, Homo sapiens
aaataaggatagatggtttgg

SEQ ID NO: 7497973 - DNA, 22 bp, Homo sapiens
aaataagcacttaactgtatca

SEQ ID NO: 7497974 - DNA, 22 bp, Homo sapiens
aaataagcacttaactgtatca

SEQ ID NO: 7497975 - DNA, 22 bp, Homo sapiens
aaataagcacttaactgtatca

SEQ ID NO: 7497976 - DNA, 22 bp, Homo sapiens
aaataagaggacagatgtttgg

SEQ ID NO: 7497977 - DNA, 22 bp, Homo sapiens
aaataagaggacagatgtttgg

SEQ ID NO: 7497978 - DNA, 22 bp, Homo sapiens
aaataagaggacagatgtttgg

SEQ ID NO: 7497979 - DNA, 22 bp, Homo sapiens
aaataagaaattcttctttgca

SEQ ID NO: 7497980 - DNA, 22 bp, Homo sapiens
aaataagaggacagatgtttgg

SEQ ID NO: 7497981 - DNA, 22 bp, Homo sapiens
aaataagaggacagatgtttgg

SEQ ID NO: 7497982 - DNA, 22 bp, Homo sapiens
aaataagaggacagatgtttgg

SEQ ID NO: 7497983 - DNA, 22 bp, Homo sapiens
aaataagaggacagatgtttgg

SEQ ID NO: 7497984 - DNA, 22 bp, Homo sapiens
aaataagaaattcttctttgca

SEQ ID NO: 7497985 - DNA, 22 bp, Homo sapiens
aaataagaaattcttctttgca

SEQ ID NO: 7497986 - DNA, 22 bp, Homo sapiens
aaataagaaattcttctttgca

SEQ ID NO: 7497987 - DNA, 22 bp, Homo sapiens
aaataagaaattcttctttgca

SEQ ID NO: 7497988 - DNA, 22 bp, Homo sapiens
aaataactttctgtgtatagtc

SEQ ID NO: 7497989 - DNA, 22 bp, Homo sapiens
aaataagaaattcttctttgca

SEQ ID NO: 7497990 - DNA, 22 bp, Homo sapiens
aaataagaaattcttctttgca

SEQ ID NO: 7497991 - DNA, 22 bp, Homo sapiens
aaataactttctgtgtatagtc

SEQ ID NO: 7497992 - DNA, 22 bp, Homo sapiens
aaataactttctgtgtatagtc

SEQ ID NO: 7497993 - DNA, 22 bp, Homo sapiens
aaataactttctgtgtatagtc

SEQ ID NO: 7497994 - DNA, 22 bp, Homo sapiens
aaataactttctgtgtatagtc

SEQ ID NO: 7497995 - DNA, 22 bp, Homo sapiens
aaataactttctgtgtatagtc

SEQ ID NO: 7497996 - DNA, 22 bp, Homo sapiens
aaataactttctgtgtatagtc

SEQ ID NO: 7497997 - DNA, 22 bp, Homo sapiens
aaataactttctgtgtatagtc

SEQ ID NO: 7497998 - DNA, 22 bp, Homo sapiens
aaataactttctgtgtatagtc

SEQ ID NO: 7497999 - DNA, 22 bp, Homo sapiens
aaataacttggtttcatcagag

SEQ ID NO: 7498000 - DNA, 22 bp, Homo sapiens
aaataacttggtttcatcagag

SEQ ID NO: 7498001 - DNA, 22 bp, Homo sapiens
aaataacttggtttcatcagag

SEQ ID NO: 7498002 - DNA, 22 bp, Homo sapiens
aaataacttggtttcatcagag

SEQ ID NO: 7498003 - DNA, 22 bp, Homo sapiens
aaataacttggtttcatcagag

SEQ ID NO: 7498004 - DNA, 22 bp, Homo sapiens
aaataacttggtttcatcagag

SEQ ID NO: 7498005 - DNA, 22 bp, Homo sapiens
aaataacttggtttcatcagag

SEQ ID NO: 7498006 - DNA, 22 bp, Homo sapiens
aaataacttggtttcatcagag

SEQ ID NO: 7498007 - DNA, 22 bp, Homo sapiens
aaataacttggtttcatcagag

SEQ ID NO: 7498008 - DNA, 22 bp, Homo sapiens
aaagtcaatgatttctcctgga

SEQ ID NO: 7498009 - DNA, 22 bp, Homo sapiens
aaagtcaaggtttagactagag

SEQ ID NO: 7498010 - DNA, 22 bp, Homo sapiens
aaagtcaaggtttagactagag

SEQ ID NO: 7498011 - DNA, 22 bp, Homo sapiens
aaagtcaatgatttctcctgga

SEQ ID NO: 7498012 - DNA, 22 bp, Homo sapiens
aaagtcacatagcatcacttct

SEQ ID NO: 7498013 - DNA, 22 bp, Homo sapiens
aaagtcacagtttaggggatat

SEQ ID NO: 7498014 - DNA, 22 bp, Homo sapiens
aaagtcacagtttaggggatat

SEQ ID NO: 7498015 - DNA, 22 bp, Homo sapiens
aaagtcacagtttaggggatat

SEQ ID NO: 7498016 - DNA, 22 bp, Homo sapiens
aaagtcacaatattggaaggtg

SEQ ID NO: 7498017 - DNA, 22 bp, Homo sapiens
aaagtcacaatattggaaggtg

SEQ ID NO: 7498018 - DNA, 22 bp, Homo sapiens
aaagtcacaatattggaaggtg

SEQ ID NO: 7498019 - DNA, 22 bp, Homo sapiens
aaagtcacatagcatcacttct

SEQ ID NO: 7498020 - DNA, 22 bp, Homo sapiens
aaagtcacagtttaggggatat

SEQ ID NO: 7498021 - DNA, 22 bp, Homo sapiens
aaagtcacatagcatcacttct

SEQ ID NO: 7498022 - DNA, 22 bp, Homo sapiens
aaagtgcagcttgtgatcccta

SEQ ID NO: 7498023 - DNA, 22 bp, Homo sapiens
aaagtgcagcttgtgatcccta

SEQ ID NO: 7498024 - DNA, 22 bp, Homo sapiens
aaagtgcagtaacttgcccaag

SEQ ID NO: 7498025 - DNA, 22 bp, Homo sapiens
aaagtgcagggtgctctggtat

SEQ ID NO: 7498026 - DNA, 22 bp, Homo sapiens
aaagtgcagtaacttgcccaag

SEQ ID NO: 7498027 - DNA, 22 bp, Homo sapiens
aaagtgcagggtgctctggtat

SEQ ID NO: 7498028 - DNA, 22 bp, Homo sapiens
aaagtgcagggtgctctggtat

SEQ ID NO: 7498029 - DNA, 22 bp, Homo sapiens
aaagtgctttcccacatttgtt

SEQ ID NO: 7498030 - DNA, 22 bp, Homo sapiens
aaagtgctttaggatatttgga

SEQ ID NO: 7498031 - DNA, 22 bp, Homo sapiens
aaagtgctttcccacatttgtt

SEQ ID NO: 7498032 - DNA, 22 bp, Homo sapiens
aaagtgctttcccacatttgtt

SEQ ID NO: 7498033 - DNA, 22 bp, Homo sapiens
aaagtgctttcccacatttgtt

SEQ ID NO: 7498034 - DNA, 22 bp, Homo sapiens
aaagtgctttaggatatttgga

SEQ ID NO: 7498035 - DNA, 22 bp, Homo sapiens
aaagtgctttaggatatttgga

SEQ ID NO: 7498036 - DNA, 22 bp, Homo sapiens
aaagtgctttaggatatttgga

SEQ ID NO: 7498037 - DNA, 23 bp, Homo sapiens
aaagtgcttggcacgacacctgg

SEQ ID NO: 7498038 - DNA, 22 bp, Homo sapiens
aaagtgcttctctttggtgggt

SEQ ID NO: 7498039 - DNA, 22 bp, Homo sapiens
aaagtgcagtccatgaaattaa

SEQ ID NO: 7498040 - DNA, 22 bp, Homo sapiens
aaagtgcagtccatgaaattaa

SEQ ID NO: 7498041 - DNA, 22 bp, Homo sapiens
aaagtgctggtattacaggtgt

SEQ ID NO: 7498042 - DNA, 22 bp, Homo sapiens
aaagtgctgtgattacaggcat

SEQ ID NO: 7498043 - DNA, 22 bp, Homo sapiens
aaagtgctgtgattacaggcat

SEQ ID NO: 7498044 - DNA, 22 bp, Homo sapiens
aaagtgctgtgggctgtaagtg

SEQ ID NO: 7498045 - DNA, 22 bp, Homo sapiens
aaagtgctgtgggctgtaagtg

SEQ ID NO: 7498046 - DNA, 22 bp, Homo sapiens
aaagtgctgtgggctgtaagtg

SEQ ID NO: 7498047 - DNA, 22 bp, Homo sapiens
aaagtgctgtgggctgtaagtg

SEQ ID NO: 7498048 - DNA, 22 bp, Homo sapiens
aaagtgcttcctttttgagggt

SEQ ID NO: 7498049 - DNA, 22 bp, Homo sapiens
aaagtgcttcctttttgagggt

SEQ ID NO: 7498050 - DNA, 22 bp, Homo sapiens
aaagtgcttccttttagaggct

SEQ ID NO: 7498051 - DNA, 22 bp, Homo sapiens
aaagtgggaacaatggagagtg

SEQ ID NO: 7498052 - DNA, 22 bp, Homo sapiens
aaagtgggaacaatggagagtg

SEQ ID NO: 7498053 - DNA, 22 bp, Homo sapiens
aaagtggcgaagctgagtttta

SEQ ID NO: 7498054 - DNA, 22 bp, Homo sapiens
aaagtgggaacaatggagagtg

SEQ ID NO: 7498055 - DNA, 22 bp, Homo sapiens
aaagtgggaacaatggagagtg

SEQ ID NO: 7498056 - DNA, 21 bp, Homo sapiens
aaagtggtaaggattattttg

SEQ ID NO: 7498057 - DNA, 22 bp, Homo sapiens
aaagtggtttttcagactttga

SEQ ID NO: 7498058 - DNA, 22 bp, Homo sapiens
aaagtggtttcccagttcagta

SEQ ID NO: 7498059 - DNA, 22 bp, Homo sapiens
aaagtggtttcccagttcagta

SEQ ID NO: 7498060 - DNA, 22 bp, Homo sapiens
aaagtggtttatgatattccaa

SEQ ID NO: 7498061 - DNA, 22 bp, Homo sapiens
aaagtggtgggcgaactcatca

SEQ ID NO: 7498062 - DNA, 22 bp, Homo sapiens
aaagtggtcaccttctcatttc

SEQ ID NO: 7498063 - DNA, 21 bp, Homo sapiens
aaagtggtaaggattattttg

SEQ ID NO: 7498064 - DNA, 20 bp, Homo sapiens
aaagtgtaagcatataatta

SEQ ID NO: 7498065 - DNA, 22 bp, Homo sapiens
aaagtgtaaaagcatgttaggg

SEQ ID NO: 7498066 - DNA, 22 bp, Homo sapiens
aaagtgtaaaagcatgttaggg

SEQ ID NO: 7498067 - DNA, 22 bp, Homo sapiens
aaagtgtaaaagcatgttaggg

SEQ ID NO: 7498068 - DNA, 22 bp, Homo sapiens
aaagtgtaaaagcatgttaggg

SEQ ID NO: 7498069 - DNA, 22 bp, Homo sapiens
aaagtgtaaaagcatgttaggg

SEQ ID NO: 7498070 - DNA, 20 bp, Homo sapiens
aaagtgtaagcatataatta

SEQ ID NO: 7498071 - DNA, 20 bp, Homo sapiens
aaagtgtaagcatataatta

SEQ ID NO: 7498072 - DNA, 20 bp, Homo sapiens
aaagtgtaagcatataatta

SEQ ID NO: 7498073 - DNA, 20 bp, Homo sapiens
aaagtgtaaggcaaagttgt

SEQ ID NO: 7498074 - DNA, 22 bp, Homo sapiens
aaagtgtaaggaatttaagtaa

SEQ ID NO: 7498075 - DNA, 22 bp, Homo sapiens
aaagtgtaaggaatttaagtaa

SEQ ID NO: 7498076 - DNA, 20 bp, Homo sapiens
aaagtgtaagcatataatta

SEQ ID NO: 7498077 - DNA, 22 bp, Homo sapiens
aaagtgtactatgtcatgaaca

SEQ ID NO: 7498078 - DNA, 22 bp, Homo sapiens
aaagtgtactatgtcatgaaca

SEQ ID NO: 7498079 - DNA, 20 bp, Homo sapiens
aaagtgtaaggcaaagttgt

SEQ ID NO: 7498080 - DNA, 22 bp, Homo sapiens
aaagtgtaaggaatttaagtaa

SEQ ID NO: 7498081 - DNA, 22 bp, Homo sapiens
aaagtgtactatgtcatgaaca

SEQ ID NO: 7498082 - DNA, 22 bp, Homo sapiens
aaagtgtagagactttggaacc

SEQ ID NO: 7498083 - DNA, 22 bp, Homo sapiens
aaagtgtagagtgcctcaaaat

SEQ ID NO: 7498084 - DNA, 22 bp, Homo sapiens
aaagtatttttgacaggcatta

SEQ ID NO: 7498085 - DNA, 22 bp, Homo sapiens
aaagtatttttgacaggcatta

SEQ ID NO: 7498086 - DNA, 22 bp, Homo sapiens
aaagtatttttgacaggcatta

SEQ ID NO: 7498087 - DNA, 22 bp, Homo sapiens
aaagtatttttgacaggcatta

SEQ ID NO: 7498088 - DNA, 22 bp, Homo sapiens
aaagtatttttgacaggcatta

SEQ ID NO: 7498089 - DNA, 22 bp, Homo sapiens
aaagtattcttgactgtttttc

SEQ ID NO: 7498090 - DNA, 22 bp, Homo sapiens
aaagtatttgtgatttttacca

SEQ ID NO: 7498091 - DNA, 22 bp, Homo sapiens
aaagtatttgtgatttttacca

SEQ ID NO: 7498092 - DNA, 22 bp, Homo sapiens
aaagtatttgtgatttttacca

SEQ ID NO: 7498093 - DNA, 22 bp, Homo sapiens
aaagtatttgtgatttttacca

SEQ ID NO: 7498094 - DNA, 22 bp, Homo sapiens
aaagtatttgtgatttttacca

SEQ ID NO: 7498095 - DNA, 22 bp, Homo sapiens
aaagtatttttgacaggcatta

SEQ ID NO: 7498096 - DNA, 22 bp, Homo sapiens
aaagtcaaaatgctctcctgtc

SEQ ID NO: 7498097 - DNA, 22 bp, Homo sapiens
aaagtcaaggtttagactagag

SEQ ID NO: 7498098 - DNA, 22 bp, Homo sapiens
aaagtcaaggtttagactagag

SEQ ID NO: 7498099 - DNA, 22 bp, Homo sapiens
aaagtcaaaatgctctcctgtc

SEQ ID NO: 7498100 - DNA, 22 bp, Homo sapiens
aaagtcaaggtttagactagag

SEQ ID NO: 7498101 - DNA, 22 bp, Homo sapiens
aaagtcaaggtttagactagag

SEQ ID NO: 7498102 - DNA, 22 bp, Homo sapiens
aaagtcaaggtttagactagag

SEQ ID NO: 7498103 - DNA, 22 bp, Homo sapiens
aaagtcaaggtttagactagag

SEQ ID NO: 7498104 - DNA, 22 bp, Homo sapiens
aaagtattcttgactgtttttc

SEQ ID NO: 7498105 - DNA, 22 bp, Homo sapiens
aaagtattcttgactgtttttc

SEQ ID NO: 7498106 - DNA, 22 bp, Homo sapiens
aaagtattcttgactgtttttc

SEQ ID NO: 7498107 - DNA, 22 bp, Homo sapiens
aaagtattcttgactgtttttc

SEQ ID NO: 7498108 - DNA, 22 bp, Homo sapiens
aaagtattcttgactgtttttc

SEQ ID NO: 7498109 - DNA, 22 bp, Homo sapiens
aaagtattcttgactgtttttc

SEQ ID NO: 7498110 - DNA, 22 bp, Homo sapiens
aaagtattcttgactgtttttc

SEQ ID NO: 7498111 - DNA, 22 bp, Homo sapiens
aaagtattcttgactgtttttc

SEQ ID NO: 7498112 - DNA, 22 bp, Homo sapiens
aaagtattcttgactgtttttc

SEQ ID NO: 7498113 - DNA, 22 bp, Homo sapiens
aaagtattcaaaaatatttggt

SEQ ID NO: 7498114 - DNA, 22 bp, Homo sapiens
aaagtattcaaaaatatttggt

SEQ ID NO: 7498115 - DNA, 22 bp, Homo sapiens
aaagtattcaaaaatatttggt

SEQ ID NO: 7498116 - DNA, 22 bp, Homo sapiens
aaagtattcaaaaatatttggt

SEQ ID NO: 7498117 - DNA, 22 bp, Homo sapiens
aaagtattcaaaaatatttggt

SEQ ID NO: 7498118 - DNA, 22 bp, Homo sapiens
aaagtatgttgtggcttttaaa

SEQ ID NO: 7498119 - DNA, 22 bp, Homo sapiens
aaagtattcaaaaatatttggt

SEQ ID NO: 7498120 - DNA, 22 bp, Homo sapiens
aaagtattcaaaaatatttggt

SEQ ID NO: 7498121 - DNA, 22 bp, Homo sapiens
aaagtatgattggggattattt

SEQ ID NO: 7498122 - DNA, 22 bp, Homo sapiens
aaagtatgttgtggcttttaaa

SEQ ID NO: 7498123 - DNA, 22 bp, Homo sapiens
aaagtatgttgtggcttttaaa

SEQ ID NO: 7498124 - DNA, 22 bp, Homo sapiens
aaagtatgttgtggcttttaaa

SEQ ID NO: 7498125 - DNA, 22 bp, Homo sapiens
aaagtatatatgcactttagaa

SEQ ID NO: 7498126 - DNA, 22 bp, Homo sapiens
aaagtatatatgcactttagaa

SEQ ID NO: 7498127 - DNA, 22 bp, Homo sapiens
aaagtagtctctttcatctttt

SEQ ID NO: 7498128 - DNA, 22 bp, Homo sapiens
aaagtagtataaaattcatgtg

SEQ ID NO: 7498129 - DNA, 22 bp, Homo sapiens
aaagtagtccttggagcgaaat

SEQ ID NO: 7498130 - DNA, 22 bp, Homo sapiens
aaagtagcttagttgatatttc

SEQ ID NO: 7498131 - DNA, 22 bp, Homo sapiens
aaagtagcttagttgatatttc

SEQ ID NO: 7498132 - DNA, 22 bp, Homo sapiens
aaagtagcttagttgatatttc

SEQ ID NO: 7498133 - DNA, 22 bp, Homo sapiens
aaagtagctttgtaggtacagt

SEQ ID NO: 7498134 - DNA, 22 bp, Homo sapiens
aaagtagcttagttgatatttc

SEQ ID NO: 7498135 - DNA, 22 bp, Homo sapiens
aaagtagatttctcatggcgaa

SEQ ID NO: 7498136 - DNA, 22 bp, Homo sapiens
aaagtagatttctcatggcgaa

SEQ ID NO: 7498137 - DNA, 22 bp, Homo sapiens
aaagtagcagtaattatgaaat

SEQ ID NO: 7498138 - DNA, 22 bp, Homo sapiens
aaagtagcccttctggaattta

SEQ ID NO: 7498139 - DNA, 22 bp, Homo sapiens
aaagtagcccttctggaattta

SEQ ID NO: 7498140 - DNA, 22 bp, Homo sapiens
aaagtagagttgtggaattact

SEQ ID NO: 7498141 - DNA, 22 bp, Homo sapiens
aaagtagaggcattgatcaggt

SEQ ID NO: 7498142 - DNA, 22 bp, Homo sapiens
aaagtagagttgtggaattact

SEQ ID NO: 7498143 - DNA, 22 bp, Homo sapiens
aaagtagagttgtggaattact

SEQ ID NO: 7498144 - DNA, 22 bp, Homo sapiens
aaagtagagttgtggaattact

SEQ ID NO: 7498145 - DNA, 22 bp, Homo sapiens
aaagtatatttacttactgtga

SEQ ID NO: 7498146 - DNA, 22 bp, Homo sapiens
aaagtatatttacttactgtga

SEQ ID NO: 7498147 - DNA, 22 bp, Homo sapiens
aaagtatctgaccgattataaa

SEQ ID NO: 7498148 - DNA, 22 bp, Homo sapiens
aaagtatctgaccgattataaa

SEQ ID NO: 7498149 - DNA, 22 bp, Homo sapiens
aaagtatgattggggattattt

SEQ ID NO: 7498150 - DNA, 22 bp, Homo sapiens
aaagtatatatgcactttagaa

SEQ ID NO: 7498151 - DNA, 22 bp, Homo sapiens
aaagtatatatgcactttagaa

SEQ ID NO: 7498152 - DNA, 22 bp, Homo sapiens
aaagtatatatgcactttagaa

SEQ ID NO: 7498153 - DNA, 22 bp, Homo sapiens
aaagtagttagtcatgtgaaaa

SEQ ID NO: 7498154 - DNA, 22 bp, Homo sapiens
aaagtatatatgcactttagaa

SEQ ID NO: 7498155 - DNA, 22 bp, Homo sapiens
aaagtatatttacttactgtga

SEQ ID NO: 7498156 - DNA, 22 bp, Homo sapiens
aaagtatatttacttactgtga

SEQ ID NO: 7498157 - DNA, 22 bp, Homo sapiens
aaagtatatttacttactgtga

SEQ ID NO: 7498158 - DNA, 22 bp, Homo sapiens
aaagtatatttacttactgtga

SEQ ID NO: 7498159 - DNA, 22 bp, Homo sapiens
aaagtatatttacttactgtga

SEQ ID NO: 7498160 - DNA, 22 bp, Homo sapiens
aaagctttgtaaataaacaggt

SEQ ID NO: 7498161 - DNA, 22 bp, Homo sapiens
aaagctttgtaaataaacaggt

SEQ ID NO: 7498162 - DNA, 22 bp, Homo sapiens
aaagctttgtaaataaacaggt

SEQ ID NO: 7498163 - DNA, 22 bp, Homo sapiens
aaagctttgtaaataaacaggt

SEQ ID NO: 7498164 - DNA, 22 bp, Homo sapiens
aaagctttgtaaataaacaggt

SEQ ID NO: 7498165 - DNA, 22 bp, Homo sapiens
aaagcttttcagtatgttcatg

SEQ ID NO: 7498166 - DNA, 22 bp, Homo sapiens
aaagcttttcagtatgttcatg

SEQ ID NO: 7498167 - DNA, 22 bp, Homo sapiens
aaagcttttcagtatgttcatg

SEQ ID NO: 7498168 - DNA, 22 bp, Homo sapiens
aaagcttttgttttcgtaactg

SEQ ID NO: 7498169 - DNA, 22 bp, Homo sapiens
aaagcttttcagtatgttcatg

SEQ ID NO: 7498170 - DNA, 22 bp, Homo sapiens
aaagcttttcagtatgttcatg

SEQ ID NO: 7498171 - DNA, 22 bp, Homo sapiens
aaagcttttgttttcgtaactg

SEQ ID NO: 7498172 - DNA, 22 bp, Homo sapiens
aaaggaaaataagtagttccat

SEQ ID NO: 7498173 - DNA, 22 bp, Homo sapiens
aaaggaaaataagtagttccat

SEQ ID NO: 7498174 - DNA, 22 bp, Homo sapiens
aaaggaaaataagtagttccat

SEQ ID NO: 7498175 - DNA, 22 bp, Homo sapiens
aaaggaaaataagtagttccat

SEQ ID NO: 7498176 - DNA, 22 bp, Homo sapiens
aaaggaaaataagtagttccat

SEQ ID NO: 7498177 - DNA, 22 bp, Homo sapiens
aaaggaagatctatacacccca

SEQ ID NO: 7498178 - DNA, 22 bp, Homo sapiens
aaaggaaaataagtagttccat

SEQ ID NO: 7498179 - DNA, 22 bp, Homo sapiens
aaaggaaaataagtagttccat

SEQ ID NO: 7498180 - DNA, 22 bp, Homo sapiens
aaagggcctccgcctgggcagg

SEQ ID NO: 7498181 - DNA, 22 bp, Homo sapiens
aaagggcctccgcctgggcagg

SEQ ID NO: 7498182 - DNA, 22 bp, Homo sapiens
aaagggctcccaggatcatctc

SEQ ID NO: 7498183 - DNA, 22 bp, Homo sapiens
aaagggccaatggagagtgtgg

SEQ ID NO: 7498184 - DNA, 22 bp, Homo sapiens
aaagggcagagttcactagaaa

SEQ ID NO: 7498185 - DNA, 22 bp, Homo sapiens
aaagggccaatggagagtgtgg

SEQ ID NO: 7498186 - DNA, 22 bp, Homo sapiens
aaagggcctccgcctgggcagg

SEQ ID NO: 7498187 - DNA, 22 bp, Homo sapiens
aaaggttctacttttaaagaat

SEQ ID NO: 7498188 - DNA, 22 bp, Homo sapiens
aaaggttattattactattgtc

SEQ ID NO: 7498189 - DNA, 22 bp, Homo sapiens
aaaggttattattactattgtc

SEQ ID NO: 7498190 - DNA, 22 bp, Homo sapiens
aaaggttattattactattgtc

SEQ ID NO: 7498191 - DNA, 22 bp, Homo sapiens
aaaggttagttcttagaagtgc

SEQ ID NO: 7498192 - DNA, 22 bp, Homo sapiens
aaagggctgaagtagtctctgt

SEQ ID NO: 7498193 - DNA, 22 bp, Homo sapiens
aaagggctgaagtagtctctgt

SEQ ID NO: 7498194 - DNA, 22 bp, Homo sapiens
aaagggcagagttcactagaaa

SEQ ID NO: 7498195 - DNA, 22 bp, Homo sapiens
aaaggaagattgagcttttcca

SEQ ID NO: 7498196 - DNA, 22 bp, Homo sapiens
aaaggaagattgagcttttcca

SEQ ID NO: 7498197 - DNA, 22 bp, Homo sapiens
aaaggaagattgagcttttcca

SEQ ID NO: 7498198 - DNA, 22 bp, Homo sapiens
aaaggaagattgagcttttcca

SEQ ID NO: 7498199 - DNA, 22 bp, Homo sapiens
aaaggaagatgccaggactctg

SEQ ID NO: 7498200 - DNA, 22 bp, Homo sapiens
aaaggaagatgccaggactctg

SEQ ID NO: 7498201 - DNA, 22 bp, Homo sapiens
aaaggaagatctatacacccca

SEQ ID NO: 7498202 - DNA, 22 bp, Homo sapiens
aaaggaagatgccaggactctg

SEQ ID NO: 7498203 - DNA, 22 bp, Homo sapiens
aaaggaagatgccaggactctg

SEQ ID NO: 7498204 - DNA, 22 bp, Homo sapiens
aaaggaagatgccaggactctg

SEQ ID NO: 7498205 - DNA, 22 bp, Homo sapiens
aaaggaagatgccaggactctg

SEQ ID NO: 7498206 - DNA, 22 bp, Homo sapiens
aaaggaagatgccaggactctg

SEQ ID NO: 7498207 - DNA, 22 bp, Homo sapiens
aaaggtttatttaatcagggag

SEQ ID NO: 7498208 - DNA, 22 bp, Homo sapiens
aaaggtttatttaatcagggag

SEQ ID NO: 7498209 - DNA, 22 bp, Homo sapiens
aaaggtttattgctatggttgt

SEQ ID NO: 7498210 - DNA, 22 bp, Homo sapiens
aaaggtttatttgttgctcaca

SEQ ID NO: 7498211 - DNA, 22 bp, Homo sapiens
aaaggtttatttaatcagggag

SEQ ID NO: 7498212 - DNA, 22 bp, Homo sapiens
aaaggtttatttgttgctcaca

SEQ ID NO: 7498213 - DNA, 22 bp, Homo sapiens
aaaggtttccgagctttaattt

SEQ ID NO: 7498214 - DNA, 22 bp, Homo sapiens
aaaggtttattgctatggttgt

SEQ ID NO: 7498215 - DNA, 22 bp, Homo sapiens
aaaggtttattgctatggttgt

SEQ ID NO: 7498216 - DNA, 22 bp, Homo sapiens
aaaggtttattgattctgctct

SEQ ID NO: 7498217 - DNA, 22 bp, Homo sapiens
aaaggtttattgattctgctct

SEQ ID NO: 7498218 - DNA, 22 bp, Homo sapiens
aaaggttgtgttctggggtgag

SEQ ID NO: 7498219 - DNA, 22 bp, Homo sapiens
aaaggttgaattcaggatccac

SEQ ID NO: 7498220 - DNA, 22 bp, Homo sapiens
aaaggttgaattcaggatccac

SEQ ID NO: 7498221 - DNA, 22 bp, Homo sapiens
aaaggtttccgagctttaattt

SEQ ID NO: 7498222 - DNA, 22 bp, Homo sapiens
aaaggtttgaggtgggaagagg

SEQ ID NO: 7498223 - DNA, 22 bp, Homo sapiens
aaaggtttatttgttgctcaca

SEQ ID NO: 7498224 - DNA, 22 bp, Homo sapiens
aaaggtttccgagctttaattt

SEQ ID NO: 7498225 - DNA, 22 bp, Homo sapiens
aaaggtttgcatggaatttacc

SEQ ID NO: 7498226 - DNA, 22 bp, Homo sapiens
aaaggtttgaggtgggaagagg

SEQ ID NO: 7498227 - DNA, 22 bp, Homo sapiens
aaaggtttgcatggaatttacc

SEQ ID NO: 7498228 - DNA, 22 bp, Homo sapiens
aaaggtttgcatggaatttacc

SEQ ID NO: 7498229 - DNA, 22 bp, Homo sapiens
aaaggtttgccgacctctgctt

SEQ ID NO: 7498230 - DNA, 22 bp, Homo sapiens
aaaggtttgcatggaatttacc

SEQ ID NO: 7498231 - DNA, 22 bp, Homo sapiens
aaaggttttatgttttccactt

SEQ ID NO: 7498232 - DNA, 22 bp, Homo sapiens
aaaggtttgccgacctctgctt

SEQ ID NO: 7498233 - DNA, 22 bp, Homo sapiens
aaaggttttattctgagctctg

SEQ ID NO: 7498234 - DNA, 22 bp, Homo sapiens
aaaggttttatgttttccactt

SEQ ID NO: 7498235 - DNA, 22 bp, Homo sapiens
aaaggttttcatcacagcaaga

SEQ ID NO: 7498236 - DNA, 22 bp, Homo sapiens
aaaggttttattctgagctctg

SEQ ID NO: 7498237 - DNA, 22 bp, Homo sapiens
aactaaaggctgttgcagggaa

SEQ ID NO: 7498238 - DNA, 22 bp, Homo sapiens
aactaaaccatgacattatatt

SEQ ID NO: 7498239 - DNA, 22 bp, Homo sapiens
aactaaaccatgacattatatt

SEQ ID NO: 7498240 - DNA, 18 bp, Homo sapiens
aactaaagatctttaagc

SEQ ID NO: 7498241 - DNA, 18 bp, Homo sapiens
aactaaagatctttaagc

SEQ ID NO: 7498242 - DNA, 22 bp, Homo sapiens
aactaaatctggcatttagagc

SEQ ID NO: 7498243 - DNA, 22 bp, Homo sapiens
aactaaatctggcatttagagc

SEQ ID NO: 7498244 - DNA, 22 bp, Homo sapiens
aactaaatctggcatttagagc

SEQ ID NO: 7498245 - DNA, 22 bp, Homo sapiens
aactaaatgtgtatctactcaa

SEQ ID NO: 7498246 - DNA, 22 bp, Homo sapiens
aactaaatctggcatttagagc

SEQ ID NO: 7498247 - DNA, 22 bp, Homo sapiens
aactaaatgtgtatctactcaa

SEQ ID NO: 7498248 - DNA, 22 bp, Homo sapiens
aactaacagtcattaaaagaac

SEQ ID NO: 7498249 - DNA, 22 bp, Homo sapiens
aactaaatctggcatttagagc

SEQ ID NO: 7498250 - DNA, 22 bp, Homo sapiens
aactaaatctggcatttagagc

SEQ ID NO: 7498251 - DNA, 22 bp, Homo sapiens
aactaaatctggcatttagagc

SEQ ID NO: 7498252 - DNA, 22 bp, Homo sapiens
aactaaaactggtttgttctct

SEQ ID NO: 7498253 - DNA, 22 bp, Homo sapiens
aactaaaactggtttgttctct

SEQ ID NO: 7498254 - DNA, 22 bp, Homo sapiens
aactaaaactggtttgttctct

SEQ ID NO: 7498255 - DNA, 22 bp, Homo sapiens
aactaaaactggtttgttctct

SEQ ID NO: 7498256 - DNA, 22 bp, Homo sapiens
aacgttttatcgtgtgctcttc

SEQ ID NO: 7498257 - DNA, 22 bp, Homo sapiens
aacgttctttattggctctccc

SEQ ID NO: 7498258 - DNA, 22 bp, Homo sapiens
aaaggttttcatcacagcaaga

SEQ ID NO: 7498259 - DNA, 22 bp, Homo sapiens
aaaggttttctagggttgaggg

SEQ ID NO: 7498260 - DNA, 22 bp, Homo sapiens
aaaggttttcatcacagcaaga

SEQ ID NO: 7498261 - DNA, 22 bp, Homo sapiens
aactaaaccatgacattatatt

SEQ ID NO: 7498262 - DNA, 22 bp, Homo sapiens
aactaaaccatgacattatatt

SEQ ID NO: 7498263 - DNA, 18 bp, Homo sapiens
aactaaagatctttaagc

SEQ ID NO: 7498264 - DNA, 22 bp, Homo sapiens
aactaaaagtgtgtctcttgta

SEQ ID NO: 7498265 - DNA, 22 bp, Homo sapiens
aactaaaagtgtgtctcttgta

SEQ ID NO: 7498266 - DNA, 22 bp, Homo sapiens
aactaaaactggtttgttctct

SEQ ID NO: 7498267 - DNA, 22 bp, Homo sapiens
aactaaaactggtttgttctct

SEQ ID NO: 7498268 - DNA, 22 bp, Homo sapiens
aaagtactgatgccatcagcac

SEQ ID NO: 7498269 - DNA, 22 bp, Homo sapiens
aaagtactgggattacaggtct

SEQ ID NO: 7498270 - DNA, 22 bp, Homo sapiens
aaagtactgggattacaggtct

SEQ ID NO: 7498271 - DNA, 22 bp, Homo sapiens
aaagtacttacagtatgcttgg

SEQ ID NO: 7498272 - DNA, 22 bp, Homo sapiens
aaagtacttacagtatgcttgg

SEQ ID NO: 7498273 - DNA, 22 bp, Homo sapiens
aaagtactaatgaatattttgc

SEQ ID NO: 7498274 - DNA, 22 bp, Homo sapiens
aaagtactgatgccatcagcac

SEQ ID NO: 7498275 - DNA, 22 bp, Homo sapiens
aaagtactgatgccatcagcac

SEQ ID NO: 7498276 - DNA, 22 bp, Homo sapiens
aaagtactaatgaatattttgc

SEQ ID NO: 7498277 - DNA, 22 bp, Homo sapiens
aaagtactaatgaatattttgc

SEQ ID NO: 7498278 - DNA, 22 bp, Homo sapiens
aaagtactaatgaatattttgc

SEQ ID NO: 7498279 - DNA, 22 bp, Homo sapiens
aaagtagaacattttcttatct

SEQ ID NO: 7498280 - DNA, 22 bp, Homo sapiens
aaagtagaggcattgatcaggt

SEQ ID NO: 7498281 - DNA, 22 bp, Homo sapiens
aaagtagaggcattgatcaggt

SEQ ID NO: 7498282 - DNA, 22 bp, Homo sapiens
aaagtagaggcattgatcaggt

SEQ ID NO: 7498283 - DNA, 22 bp, Homo sapiens
aaagtactttgggctatgtttg

SEQ ID NO: 7498284 - DNA, 23 bp, Homo sapiens
aaagtacttccacagctatgatc

SEQ ID NO: 7498285 - DNA, 23 bp, Homo sapiens
aaagtacttccacagctatgatc

SEQ ID NO: 7498286 - DNA, 22 bp, Homo sapiens
aaagtacttgatgctacagagt

SEQ ID NO: 7498287 - DNA, 22 bp, Homo sapiens
aaagtacttgatgctacagagt

SEQ ID NO: 7498288 - DNA, 22 bp, Homo sapiens
aaagtacttgatgctacagagt

SEQ ID NO: 7498289 - DNA, 22 bp, Homo sapiens
aactaagtcatagagtccctca

SEQ ID NO: 7498290 - DNA, 22 bp, Homo sapiens
aactaacagtcattaaaagaac

SEQ ID NO: 7498291 - DNA, 22 bp, Homo sapiens
aactaacagtcattaaaagaac

SEQ ID NO: 7498292 - DNA, 22 bp, Homo sapiens
aactaacagtcattaaaagaac

SEQ ID NO: 7498293 - DNA, 22 bp, Homo sapiens
aactaacagtcattaaaagaac

SEQ ID NO: 7498294 - DNA, 22 bp, Homo sapiens
aactaacagtcattaaaagaac

SEQ ID NO: 7498295 - DNA, 22 bp, Homo sapiens
aactaacagtcattaaaagaac

SEQ ID NO: 7498296 - DNA, 22 bp, Homo sapiens
aaagtaattgtggtttctgtca

SEQ ID NO: 7498297 - DNA, 22 bp, Homo sapiens
aaagtaattgtggtttctgtca

SEQ ID NO: 7498298 - DNA, 22 bp, Homo sapiens
aaagtaattgtggttcttgcca

SEQ ID NO: 7498299 - DNA, 21 bp, Homo sapiens
aactaaggaactgaaaaatgg

SEQ ID NO: 7498300 - DNA, 22 bp, Homo sapiens
aaagtacaaggaaaggatctga

SEQ ID NO: 7498301 - DNA, 22 bp, Homo sapiens
aaagtacccaagaacagagtga

SEQ ID NO: 7498302 - DNA, 22 bp, Homo sapiens
aaagtacaaatgttctagccat

SEQ ID NO: 7498303 - DNA, 22 bp, Homo sapiens
aaagtacaaatgttctagccat

SEQ ID NO: 7498304 - DNA, 22 bp, Homo sapiens
aaagtacaaatgttctagccat

SEQ ID NO: 7498305 - DNA, 22 bp, Homo sapiens
aaagagtttggagacaagatca

SEQ ID NO: 7498306 - DNA, 22 bp, Homo sapiens
aaagagtttggagacaagatca

SEQ ID NO: 7498307 - DNA, 22 bp, Homo sapiens
aaagagtttggagacaagatca

SEQ ID NO: 7498308 - DNA, 22 bp, Homo sapiens
aaagagtttggagacaagatca

SEQ ID NO: 7498309 - DNA, 22 bp, Homo sapiens
aaagataatgtttccttattct

SEQ ID NO: 7498310 - DNA, 22 bp, Homo sapiens
aaagataatgtttccttattct

SEQ ID NO: 7498311 - DNA, 22 bp, Homo sapiens
aaagataatgtttccttattct

SEQ ID NO: 7498312 - DNA, 22 bp, Homo sapiens
aaagataatgtttccttattct

SEQ ID NO: 7498313 - DNA, 22 bp, Homo sapiens
aaagatacttaatagttgtctg

SEQ ID NO: 7498314 - DNA, 22 bp, Homo sapiens
aaagatacttaatagttgtctg

SEQ ID NO: 7498315 - DNA, 22 bp, Homo sapiens
aacaaacaaacattttgtcatc

SEQ ID NO: 7498316 - DNA, 22 bp, Homo sapiens
aaagagtttccattgacatttc

SEQ ID NO: 7498317 - DNA, 22 bp, Homo sapiens
aaagagtttccattgacatttc

SEQ ID NO: 7498318 - DNA, 22 bp, Homo sapiens
aaagagtttccattgacatttc

SEQ ID NO: 7498319 - DNA, 22 bp, Homo sapiens
aacaaacaaacattttgtcatc

SEQ ID NO: 7498320 - DNA, 22 bp, Homo sapiens
aacaaacaaacattttgtcatc

SEQ ID NO: 7498321 - DNA, 22 bp, Homo sapiens
aacaaacaaacattttgtcatc

SEQ ID NO: 7498322 - DNA, 22 bp, Homo sapiens
aacaaacaaacattttgtcatc

SEQ ID NO: 7498323 - DNA, 22 bp, Homo sapiens
aacaaaacatttgtcttgtttc

SEQ ID NO: 7498324 - DNA, 22 bp, Homo sapiens
aacaaaacatttgtcttgtttc

SEQ ID NO: 7498325 - DNA, 22 bp, Homo sapiens
aacaaaacatttgtcttgtttc

SEQ ID NO: 7498326 - DNA, 22 bp, Homo sapiens
aacaaaacatttgtcttgtttc

SEQ ID NO: 7498327 - DNA, 22 bp, Homo sapiens
aacaaaacatttgtcttgtttc

SEQ ID NO: 7498328 - DNA, 22 bp, Homo sapiens
aacaaaacatttgtcttgtttc

SEQ ID NO: 7498329 - DNA, 22 bp, Homo sapiens
aacaaaacatttgtcttgtttc

SEQ ID NO: 7498330 - DNA, 22 bp, Homo sapiens
aacaaaacatttgtcttgtttc

SEQ ID NO: 7498331 - DNA, 22 bp, Homo sapiens
aacaaaacatttgtcttgtttc

SEQ ID NO: 7498332 - DNA, 22 bp, Homo sapiens
aacaaacaaacattttgtcatc

SEQ ID NO: 7498333 - DNA, 22 bp, Homo sapiens
aacaaacaaacattttgtcatc

SEQ ID NO: 7498334 - DNA, 22 bp, Homo sapiens
aacaaacaaacattttgtcatc

SEQ ID NO: 7498335 - DNA, 22 bp, Homo sapiens
aacaaacaaacattttgtcatc

SEQ ID NO: 7498336 - DNA, 22 bp, Homo sapiens
aacaaacaaacattttgtcatc

SEQ ID NO: 7498337 - DNA, 22 bp, Homo sapiens
aacaaacaaacattttgtcatc

SEQ ID NO: 7498338 - DNA, 22 bp, Homo sapiens
aacaaacaaacattttgtcatc

SEQ ID NO: 7498339 - DNA, 22 bp, Homo sapiens
aacaaacaaacattttgtcatc

SEQ ID NO: 7498340 - DNA, 22 bp, Homo sapiens
aacaaaagccgaagtaggtgtc

SEQ ID NO: 7498341 - DNA, 22 bp, Homo sapiens
aacaaaagccgaagtaggtgtc

SEQ ID NO: 7498342 - DNA, 22 bp, Homo sapiens
aacaaaagccgaagtaggtgtc

SEQ ID NO: 7498343 - DNA, 22 bp, Homo sapiens
aaattttagtaaggaagttgag

SEQ ID NO: 7498344 - DNA, 22 bp, Homo sapiens
aaattttagtaaggaagttgag

SEQ ID NO: 7498345 - DNA, 22 bp, Homo sapiens
aaattttagtaaggaagttgag

SEQ ID NO: 7498346 - DNA, 22 bp, Homo sapiens
aaattttagtaaggaagttgag

SEQ ID NO: 7498347 - DNA, 22 bp, Homo sapiens
aaattttagtaaggaagttgag

SEQ ID NO: 7498348 - DNA, 22 bp, Homo sapiens
aaattttagtaaggaagttgag

SEQ ID NO: 7498349 - DNA, 22 bp, Homo sapiens
aaattttagtaaggaagttgag

SEQ ID NO: 7498350 - DNA, 22 bp, Homo sapiens
aaattttagactcctgggtcta

SEQ ID NO: 7498351 - DNA, 22 bp, Homo sapiens
aaattttagtaaggaagttgag

SEQ ID NO: 7498352 - DNA, 22 bp, Homo sapiens
aaattttagactcctgggtcta

SEQ ID NO: 7498353 - DNA, 22 bp, Homo sapiens
aaattgtggcgtctgtaagagt

SEQ ID NO: 7498354 - DNA, 22 bp, Homo sapiens
aaattgtgctcacactgatatt

SEQ ID NO: 7498355 - DNA, 22 bp, Homo sapiens
aaattgtggcgtctgtaagagt

SEQ ID NO: 7498356 - DNA, 22 bp, Homo sapiens
aaattttagactcctgggtcta

SEQ ID NO: 7498357 - DNA, 22 bp, Homo sapiens
aaattttagactcctgggtcta

SEQ ID NO: 7498358 - DNA, 22 bp, Homo sapiens
aaattgtgctcacactgatatt

SEQ ID NO: 7498359 - DNA, 22 bp, Homo sapiens
aaattgtgctcacactgatatt

SEQ ID NO: 7498360 - DNA, 22 bp, Homo sapiens
aaattgtgagctatagatctag

SEQ ID NO: 7498361 - DNA, 22 bp, Homo sapiens
aaattgtgcatccttggcatat

SEQ ID NO: 7498362 - DNA, 21 bp, Homo sapiens
aaattttcttggctgtagtgt

SEQ ID NO: 7498363 - DNA, 22 bp, Homo sapiens
aaattttctctctaagacttaa

SEQ ID NO: 7498364 - DNA, 21 bp, Homo sapiens
aaattttcttggctgtagtgt

SEQ ID NO: 7498365 - DNA, 21 bp, Homo sapiens
aaattttcttggctgtagtgt

SEQ ID NO: 7498366 - DNA, 22 bp, Homo sapiens
aaattttgtattctagttctag

SEQ ID NO: 7498367 - DNA, 22 bp, Homo sapiens
aaattttgtattctagttctag

SEQ ID NO: 7498368 - DNA, 22 bp, Homo sapiens
aaattttgtattctagttctag

SEQ ID NO: 7498369 - DNA, 22 bp, Homo sapiens
aaattttgtattctagttctag

SEQ ID NO: 7498370 - DNA, 22 bp, Homo sapiens
aaattttgtattctagttctag

SEQ ID NO: 7498371 - DNA, 22 bp, Homo sapiens
aaattttgtattctagttctag

SEQ ID NO: 7498372 - DNA, 22 bp, Homo sapiens
aaattttctctctaagacttaa

SEQ ID NO: 7498373 - DNA, 22 bp, Homo sapiens
aaattttctctctaagacttaa

SEQ ID NO: 7498374 - DNA, 22 bp, Homo sapiens
aaattttcctggtaaagatgga

SEQ ID NO: 7498375 - DNA, 22 bp, Homo sapiens
aaattttctctctaagacttaa

SEQ ID NO: 7498376 - DNA, 22 bp, Homo sapiens
aaattttctctctaagacttaa

SEQ ID NO: 7498377 - DNA, 22 bp, Homo sapiens
aaattttcctggtaaagatgga

SEQ ID NO: 7498378 - DNA, 22 bp, Homo sapiens
aaattttcctggtaaagatgga

SEQ ID NO: 7498379 - DNA, 22 bp, Homo sapiens
aaattttcctggtaaagatgga

SEQ ID NO: 7498380 - DNA, 22 bp, Homo sapiens
aaattttcagagcactagagaa

SEQ ID NO: 7498381 - DNA, 22 bp, Homo sapiens
aaattttcagagcactagagaa

SEQ ID NO: 7498382 - DNA, 22 bp, Homo sapiens
aaattttcagagcactagagaa

SEQ ID NO: 7498383 - DNA, 22 bp, Homo sapiens
aaattttcagagcactagagaa

SEQ ID NO: 7498384 - DNA, 22 bp, Homo sapiens
aaattttcagagcactagagaa

SEQ ID NO: 7498385 - DNA, 22 bp, Homo sapiens
aaagatcagaggatagctgagt

SEQ ID NO: 7498386 - DNA, 22 bp, Homo sapiens
aaagatcacgtcccaggactcg

SEQ ID NO: 7498387 - DNA, 22 bp, Homo sapiens
aaagatcacgtcccaggactcg

SEQ ID NO: 7498388 - DNA, 22 bp, Homo sapiens
aaagatcacgtcccaggactcg

SEQ ID NO: 7498389 - DNA, 22 bp, Homo sapiens
aaagatcacgtcccaggactcg

SEQ ID NO: 7498390 - DNA, 22 bp, Homo sapiens
aaagatcacgtcccaggactcg

SEQ ID NO: 7498391 - DNA, 22 bp, Homo sapiens
aaagatcaatagataaagctac

SEQ ID NO: 7498392 - DNA, 23 bp, Homo sapiens
aaagatcaaagtggcaggcctgt

SEQ ID NO: 7498393 - DNA, 22 bp, Homo sapiens
aaagatcaatagataaagctac

SEQ ID NO: 7498394 - DNA, 22 bp, Homo sapiens
aaagccacagttctatgtctgc

SEQ ID NO: 7498395 - DNA, 22 bp, Homo sapiens
aaagatcagaggatagctgagt

SEQ ID NO: 7498396 - DNA, 22 bp, Homo sapiens
aaagatcagaggatagctgagt

SEQ ID NO: 7498397 - DNA, 22 bp, Homo sapiens
aaagatcagaggatagctgagt

SEQ ID NO: 7498398 - DNA, 22 bp, Homo sapiens
aaagatcagaggatagctgagt

SEQ ID NO: 7498399 - DNA, 22 bp, Homo sapiens
aaagccacgtggcctggggagc

SEQ ID NO: 7498400 - DNA, 22 bp, Homo sapiens
aaagccacgtggcctggggagc

SEQ ID NO: 7498401 - DNA, 22 bp, Homo sapiens
aaagccaggggagggattccca

SEQ ID NO: 7498402 - DNA, 22 bp, Homo sapiens
aaagccaggggagggattccca

SEQ ID NO: 7498403 - DNA, 22 bp, Homo sapiens
aaagatatgtctccaaagagat

SEQ ID NO: 7498404 - DNA, 22 bp, Homo sapiens
aaagatatgtctccaaagagat

SEQ ID NO: 7498405 - DNA, 22 bp, Homo sapiens
aaagatcaatagataaagctac

SEQ ID NO: 7498406 - DNA, 22 bp, Homo sapiens
aaagatatgtctccaaagagat

SEQ ID NO: 7498407 - DNA, 23 bp, Homo sapiens
aaagatcaaagtggcaggcctgt

SEQ ID NO: 7498408 - DNA, 22 bp, Homo sapiens
aaagatcaatagataaagctac

SEQ ID NO: 7498409 - DNA, 22 bp, Homo sapiens
aaagatcaatagataaagctac

SEQ ID NO: 7498410 - DNA, 22 bp, Homo sapiens
aaagatcaatagataaagctac

SEQ ID NO: 7498411 - DNA, 22 bp, Homo sapiens
aaagatcaatagataaagctac

SEQ ID NO: 7498412 - DNA, 20 bp, Homo sapiens
aaagatactttttgtaatgg

SEQ ID NO: 7498413 - DNA, 20 bp, Homo sapiens
aaagatactttttgtaatgg

SEQ ID NO: 7498414 - DNA, 20 bp, Homo sapiens
aaagatactttttgtaatgg

SEQ ID NO: 7498415 - DNA, 20 bp, Homo sapiens
aaagatactttttgtaatgg

SEQ ID NO: 7498416 - DNA, 20 bp, Homo sapiens
aaagatactttttgtaatgg

SEQ ID NO: 7498417 - DNA, 22 bp, Homo sapiens
aaagatacttaatagttgtctg

SEQ ID NO: 7498418 - DNA, 22 bp, Homo sapiens
aaagatatgtctccaaagagat

SEQ ID NO: 7498419 - DNA, 22 bp, Homo sapiens
aaagatatgtctccaaagagat

SEQ ID NO: 7498420 - DNA, 20 bp, Homo sapiens
aaagatactttttgtaatgg

SEQ ID NO: 7498421 - DNA, 22 bp, Homo sapiens
aaagatatgtctccaaagagat

SEQ ID NO: 7498422 - DNA, 22 bp, Homo sapiens
aaagatatgtctccaaagagat

SEQ ID NO: 7498423 - DNA, 22 bp, Homo sapiens
aaagccatcagtaaaatgattt

SEQ ID NO: 7498424 - DNA, 22 bp, Homo sapiens
aaagccatcagtaaaatgattt

SEQ ID NO: 7498425 - DNA, 22 bp, Homo sapiens
aaagccatcagtaaaatgattt

SEQ ID NO: 7498426 - DNA, 22 bp, Homo sapiens
aaagccatcagtaaaatgattt

SEQ ID NO: 7498427 - DNA, 22 bp, Homo sapiens
aaagccataagcctaatactaa

SEQ ID NO: 7498428 - DNA, 22 bp, Homo sapiens
aaagccatatctattctattct

SEQ ID NO: 7498429 - DNA, 22 bp, Homo sapiens
aaagccatatctattctattct

SEQ ID NO: 7498430 - DNA, 22 bp, Homo sapiens
aaagccagtttctggaagtacc

SEQ ID NO: 7498431 - DNA, 22 bp, Homo sapiens
aaagccagtttctggaagtacc

SEQ ID NO: 7498432 - DNA, 22 bp, Homo sapiens
aaagccagtttctggaagtacc

SEQ ID NO: 7498433 - DNA, 22 bp, Homo sapiens
aaagccagtttgtctctttaaa

SEQ ID NO: 7498434 - DNA, 22 bp, Homo sapiens
aaagccagtttgtctctttaaa

SEQ ID NO: 7498435 - DNA, 22 bp, Homo sapiens
aaagccagttcttttatattgg

SEQ ID NO: 7498436 - DNA, 22 bp, Homo sapiens
aaagccagtttctggaagtacc

SEQ ID NO: 7498437 - DNA, 22 bp, Homo sapiens
aaagccagtttctggaagtacc

SEQ ID NO: 7498438 - DNA, 22 bp, Homo sapiens
aaagccagtttctggaagtacc

SEQ ID NO: 7498439 - DNA, 22 bp, Homo sapiens
aaagccagttcttagagaaagc

SEQ ID NO: 7498440 - DNA, 22 bp, Homo sapiens
aaagccagttcttagagaaagc

SEQ ID NO: 7498441 - DNA, 22 bp, Homo sapiens
aaagccagttcttagagaaagc

SEQ ID NO: 7498442 - DNA, 22 bp, Homo sapiens
aaagccagttcttagagaaagc

SEQ ID NO: 7498443 - DNA, 22 bp, Homo sapiens
aaagccagttcttagagaaagc

SEQ ID NO: 7498444 - DNA, 22 bp, Homo sapiens
aaagccagtggtatgagagaaa

SEQ ID NO: 7498445 - DNA, 22 bp, Homo sapiens
aaagccagtggtatgagagaaa

SEQ ID NO: 7498446 - DNA, 22 bp, Homo sapiens
aaagccagtggtatgagagaaa

SEQ ID NO: 7498447 - DNA, 22 bp, Homo sapiens
aaagccagtggtatgagagaaa

SEQ ID NO: 7498448 - DNA, 22 bp, Homo sapiens
aaagccagtggtatgagagaaa

SEQ ID NO: 7498449 - DNA, 22 bp, Homo sapiens
aaagccaggttgtgtgcaggaa

SEQ ID NO: 7498450 - DNA, 22 bp, Homo sapiens
aaagccagtggtatgagagaaa

SEQ ID NO: 7498451 - DNA, 22 bp, Homo sapiens
aaagccaggttgtgtgcaggaa

SEQ ID NO: 7498452 - DNA, 22 bp, Homo sapiens
aaagccaggttgtgtgcaggaa

SEQ ID NO: 7498453 - DNA, 22 bp, Homo sapiens
aaagccaggttgtgtgcaggaa

SEQ ID NO: 7498454 - DNA, 22 bp, Homo sapiens
aaagccagggtccaggcctgcc

SEQ ID NO: 7498455 - DNA, 22 bp, Homo sapiens
aaagccagggtccaggcctgcc

SEQ ID NO: 7498456 - DNA, 22 bp, Homo sapiens
aaagccagggtccaggcctgcc

SEQ ID NO: 7498457 - DNA, 22 bp, Homo sapiens
aaagccaggggagggattccca

SEQ ID NO: 7498458 - DNA, 22 bp, Homo sapiens
aaagccagggtccaggcctgcc

SEQ ID NO: 7498459 - DNA, 22 bp, Homo sapiens
aacagatataggcagaactttg

SEQ ID NO: 7498460 - DNA, 22 bp, Homo sapiens
aacagatataggcagaactttg

SEQ ID NO: 7498461 - DNA, 22 bp, Homo sapiens
aacagatgagagaattgaggct

SEQ ID NO: 7498462 - DNA, 22 bp, Homo sapiens
aacagatgagagaattgaggct

SEQ ID NO: 7498463 - DNA, 22 bp, Homo sapiens
aacagatgagagaattgaggct

SEQ ID NO: 7498464 - DNA, 22 bp, Homo sapiens
aacagatgagagaattgaggct

SEQ ID NO: 7498465 - DNA, 22 bp, Homo sapiens
aacagattgtaacctgatagcc

SEQ ID NO: 7498466 - DNA, 22 bp, Homo sapiens
aacagattgtaacctgatagcc

SEQ ID NO: 7498467 - DNA, 22 bp, Homo sapiens
aacagattgtaacctgatagcc

SEQ ID NO: 7498468 - DNA, 22 bp, Homo sapiens
aacagatttaagaagccaaggt

SEQ ID NO: 7498469 - DNA, 22 bp, Homo sapiens
aacagatttaagaagccaaggt

SEQ ID NO: 7498470 - DNA, 22 bp, Homo sapiens
aacagattgtaacctgatagcc

SEQ ID NO: 7498471 - DNA, 22 bp, Homo sapiens
aacagatttaagaagccaaggt

SEQ ID NO: 7498472 - DNA, 19 bp, Homo sapiens
aacagcaacttcctagtca

SEQ ID NO: 7498473 - DNA, 19 bp, Homo sapiens
aacagcaacttcctagtca

SEQ ID NO: 7498474 - DNA, 22 bp, Homo sapiens
aacagcaagggcggggtcaaga

SEQ ID NO: 7498475 - DNA, 19 bp, Homo sapiens
aacagcaacttcctagtca

SEQ ID NO: 7498476 - DNA, 22 bp, Homo sapiens
aacagcaagggcggggtcaaga

SEQ ID NO: 7498477 - DNA, 22 bp, Homo sapiens
aacagcaagggcggggtcaaga

SEQ ID NO: 7498478 - DNA, 22 bp, Homo sapiens
aacagcaagggcggggtcaaga

SEQ ID NO: 7498479 - DNA, 22 bp, Homo sapiens
aacagcaagggcggggtcaaga

SEQ ID NO: 7498480 - DNA, 19 bp, Homo sapiens
aacagcaacttcctagtca

SEQ ID NO: 7498481 - DNA, 19 bp, Homo sapiens
aacagcaacttcctagtca

SEQ ID NO: 7498482 - DNA, 19 bp, Homo sapiens
aacagcaacttcctagtca

SEQ ID NO: 7498483 - DNA, 22 bp, Homo sapiens
aacagatttgtgaagctactca

SEQ ID NO: 7498484 - DNA, 22 bp, Homo sapiens
aacagatttgtgaagctactca

SEQ ID NO: 7498485 - DNA, 22 bp, Homo sapiens
aacagagtttcaaataacatct

SEQ ID NO: 7498486 - DNA, 22 bp, Homo sapiens
aacagataagtatatctatgta

SEQ ID NO: 7498487 - DNA, 22 bp, Homo sapiens
aacagagtttcaaataacatct

SEQ ID NO: 7498488 - DNA, 22 bp, Homo sapiens
aacagataagtatatctatgta

SEQ ID NO: 7498489 - DNA, 22 bp, Homo sapiens
aacagataatttctaagttact

SEQ ID NO: 7498490 - DNA, 22 bp, Homo sapiens
aacagataagtatatctatgta

SEQ ID NO: 7498491 - DNA, 22 bp, Homo sapiens
aacagataatttctaagttact

SEQ ID NO: 7498492 - DNA, 22 bp, Homo sapiens
aacagataatttctaagttact

SEQ ID NO: 7498493 - DNA, 22 bp, Homo sapiens
aacagatataggcagaactttg

SEQ ID NO: 7498494 - DNA, 22 bp, Homo sapiens
aaagccatctgtattaagtgaa

SEQ ID NO: 7498495 - DNA, 22 bp, Homo sapiens
aaagccatgaatgttatagagg

SEQ ID NO: 7498496 - DNA, 22 bp, Homo sapiens
aaagccatgggtctttggcata

SEQ ID NO: 7498497 - DNA, 22 bp, Homo sapiens
aaagccatgaatgttatagagg

SEQ ID NO: 7498498 - DNA, 22 bp, Homo sapiens
aaagccatgaatgttatagagg

SEQ ID NO: 7498499 - DNA, 22 bp, Homo sapiens
aacagcaatagcactattcatt

SEQ ID NO: 7498500 - DNA, 22 bp, Homo sapiens
aacagcaatagcactattcatt

SEQ ID NO: 7498501 - DNA, 22 bp, Homo sapiens
aacagcaatagcactattcatt

SEQ ID NO: 7498502 - DNA, 22 bp, Homo sapiens
aacagcaatagcactattcatt

SEQ ID NO: 7498503 - DNA, 22 bp, Homo sapiens
aacagcaatagcactattcatt

SEQ ID NO: 7498504 - DNA, 22 bp, Homo sapiens
aacagcaatagcactattcatt

SEQ ID NO: 7498505 - DNA, 22 bp, Homo sapiens
aacagcaatagcactattcatt

SEQ ID NO: 7498506 - DNA, 22 bp, Homo sapiens
aacagcaatagcactattcatt

SEQ ID NO: 7498507 - DNA, 22 bp, Homo sapiens
aacagcaatagcactattcatt

SEQ ID NO: 7498508 - DNA, 22 bp, Homo sapiens
aacagcagcaagtaagcaggtc

SEQ ID NO: 7498509 - DNA, 22 bp, Homo sapiens
aacagcagcaagtaagcaggtc

SEQ ID NO: 7498510 - DNA, 22 bp, Homo sapiens
aacagcagcaagtaagcaggtc

SEQ ID NO: 7498511 - DNA, 22 bp, Homo sapiens
aacagcagaaactgcaagctac

SEQ ID NO: 7498512 - DNA, 22 bp, Homo sapiens
aacagcagaggagcgatggctg

SEQ ID NO: 7498513 - DNA, 22 bp, Homo sapiens
aacagcagaaactgcaagctac

SEQ ID NO: 7498514 - DNA, 22 bp, Homo sapiens
aacagcagaaactgcaagctac

SEQ ID NO: 7498515 - DNA, 22 bp, Homo sapiens
aacagcagaaactgcaagctac

SEQ ID NO: 7498516 - DNA, 22 bp, Homo sapiens
aacagcagaaactgcaagctac

SEQ ID NO: 7498517 - DNA, 22 bp, Homo sapiens
aacagcaatagcactattcatt

SEQ ID NO: 7498518 - DNA, 22 bp, Homo sapiens
aacagcaatagcactattcatt

SEQ ID NO: 7498519 - DNA, 22 bp, Homo sapiens
aaagctcttggattttagactc

SEQ ID NO: 7498520 - DNA, 22 bp, Homo sapiens
aaagctcttggattttagactc

SEQ ID NO: 7498521 - DNA, 22 bp, Homo sapiens
aaagctcttatgtaaacagaaa

SEQ ID NO: 7498522 - DNA, 22 bp, Homo sapiens
aaagctcttggattttagactc

SEQ ID NO: 7498523 - DNA, 22 bp, Homo sapiens
aaagctcttatgtaaacagaaa

SEQ ID NO: 7498524 - DNA, 22 bp, Homo sapiens
aaagctcttatgtaaacagaaa

SEQ ID NO: 7498525 - DNA, 22 bp, Homo sapiens
aaagctcttatagcagagtgtg

SEQ ID NO: 7498526 - DNA, 22 bp, Homo sapiens
aaagctcttatagcagagtgtg

SEQ ID NO: 7498527 - DNA, 22 bp, Homo sapiens
aaagctagaaggaaattttatg

SEQ ID NO: 7498528 - DNA, 22 bp, Homo sapiens
aaagctcttatagcagagtgtg

SEQ ID NO: 7498529 - DNA, 22 bp, Homo sapiens
aaagctacctttgtgttcatag

SEQ ID NO: 7498530 - DNA, 22 bp, Homo sapiens
aaagctacctttgtgttcatag

SEQ ID NO: 7498531 - DNA, 22 bp, Homo sapiens
aaagctacctttgtgttcatag

SEQ ID NO: 7498532 - DNA, 22 bp, Homo sapiens
aaagcgacctctaatctagtgc

SEQ ID NO: 7498533 - DNA, 22 bp, Homo sapiens
aaagcgcttccctttggagcgt

SEQ ID NO: 7498534 - DNA, 22 bp, Homo sapiens
aaagcgtaagttatattctgta

SEQ ID NO: 7498535 - DNA, 22 bp, Homo sapiens
aaagcgctatataaatgttaac

SEQ ID NO: 7498536 - DNA, 22 bp, Homo sapiens
aacagcagcaagtaagcaggtc

SEQ ID NO: 7498537 - DNA, 22 bp, Homo sapiens
aacagcagcatgacagctgggt

SEQ ID NO: 7498538 - DNA, 22 bp, Homo sapiens
aacagcagcatgacagctgggt

SEQ ID NO: 7498539 - DNA, 22 bp, Homo sapiens
aacagcagcatgacagctgggt

SEQ ID NO: 7498540 - DNA, 22 bp, Homo sapiens
aacagcagcatgacagctgggt

SEQ ID NO: 7498541 - DNA, 18 bp, Homo sapiens
aaagctgttattccagaa

SEQ ID NO: 7498542 - DNA, 23 bp, Homo sapiens
aaagcttaactgggtaataaagc

SEQ ID NO: 7498543 - DNA, 18 bp, Homo sapiens
aaagctgttattccagaa

SEQ ID NO: 7498544 - DNA, 22 bp, Homo sapiens
aaagctgttaaatgcataatgc

SEQ ID NO: 7498545 - DNA, 18 bp, Homo sapiens
aaagctgttattccagaa

SEQ ID NO: 7498546 - DNA, 22 bp, Homo sapiens
aaagctgttaaatgcataatgc

SEQ ID NO: 7498547 - DNA, 22 bp, Homo sapiens
aaagctgtagaatcatcttaat

SEQ ID NO: 7498548 - DNA, 22 bp, Homo sapiens
aaagctgtagaatcatcttaat

SEQ ID NO: 7498549 - DNA, 22 bp, Homo sapiens
aaagctgtagaatcatcttaat

SEQ ID NO: 7498550 - DNA, 22 bp, Homo sapiens
aaagctgtagaatcatcttaat

SEQ ID NO: 7498551 - DNA, 22 bp, Homo sapiens
aaagctgtagaatcatcttaat

SEQ ID NO: 7498552 - DNA, 22 bp, Homo sapiens
aaagctgtaatgcatgctttct

SEQ ID NO: 7498553 - DNA, 22 bp, Homo sapiens
aaagctgtaatgcatgctttct

SEQ ID NO: 7498554 - DNA, 22 bp, Homo sapiens
aaagctgtaatgcatgctttct

SEQ ID NO: 7498555 - DNA, 22 bp, Homo sapiens
aaagctggttattctgaggcag

SEQ ID NO: 7498556 - DNA, 22 bp, Homo sapiens
aaagctggttattctgaggcag

SEQ ID NO: 7498557 - DNA, 22 bp, Homo sapiens
aaagctggttattctgaggcag

SEQ ID NO: 7498558 - DNA, 22 bp, Homo sapiens
aaagctgggggccctggtctag

SEQ ID NO: 7498559 - DNA, 22 bp, Homo sapiens
aaagctgggggccctggtctag

SEQ ID NO: 7498560 - DNA, 22 bp, Homo sapiens
aaagctgggggccctggtctag

SEQ ID NO: 7498561 - DNA, 22 bp, Homo sapiens
aaagctttgggtaggaatggga

SEQ ID NO: 7498562 - DNA, 22 bp, Homo sapiens
aaagctttgctggaaggaagag

SEQ ID NO: 7498563 - DNA, 22 bp, Homo sapiens
aaagctttgctggaaggaagag

SEQ ID NO: 7498564 - DNA, 22 bp, Homo sapiens
aaagcttgtgctgtagtattta

SEQ ID NO: 7498565 - DNA, 22 bp, Homo sapiens
aaagctttctagctatgttcta

SEQ ID NO: 7498566 - DNA, 22 bp, Homo sapiens
aaagctttctagctatgttcta

SEQ ID NO: 7498567 - DNA, 22 bp, Homo sapiens
aaagcttgtgctgtagtattta

SEQ ID NO: 7498568 - DNA, 22 bp, Homo sapiens
aaagcttagcattttcaaaatg

SEQ ID NO: 7498569 - DNA, 22 bp, Homo sapiens
aaagcttaccttttcagtcttt

SEQ ID NO: 7498570 - DNA, 22 bp, Homo sapiens
aaagcttaccttttcagtcttt

SEQ ID NO: 7498571 - DNA, 22 bp, Homo sapiens
aaagctgcccttgtgaaacaag

SEQ ID NO: 7498572 - DNA, 22 bp, Homo sapiens
aaagctgcccttgtgaaacaag

SEQ ID NO: 7498573 - DNA, 22 bp, Homo sapiens
aaagctgccctacacggaagca

SEQ ID NO: 7498574 - DNA, 22 bp, Homo sapiens
aaagctgctatgaacattctat

SEQ ID NO: 7498575 - DNA, 22 bp, Homo sapiens
aaagctgctatgaacattctat

SEQ ID NO: 7498576 - DNA, 22 bp, Homo sapiens
aaagctgctgccaatcaggctt

SEQ ID NO: 7498577 - DNA, 22 bp, Homo sapiens
aaagctgctgtgaatggtttgg

SEQ ID NO: 7498578 - DNA, 22 bp, Homo sapiens
aaagctgctttaaacatctatg

SEQ ID NO: 7498579 - DNA, 22 bp, Homo sapiens
aaagctggcctctcaggcttta

SEQ ID NO: 7498580 - DNA, 22 bp, Homo sapiens
aaagctgctgccaatcaggctt

SEQ ID NO: 7498581 - DNA, 22 bp, Homo sapiens
aaagctgctttaaacatctatg

SEQ ID NO: 7498582 - DNA, 22 bp, Homo sapiens
aaagctggcttttacaggggct

SEQ ID NO: 7498583 - DNA, 22 bp, Homo sapiens
aaagctggcttttacaggggct

SEQ ID NO: 7498584 - DNA, 22 bp, Homo sapiens
aaagctggcctctcaggcttta

SEQ ID NO: 7498585 - DNA, 22 bp, Homo sapiens
aaagctgggctggccaacccag

SEQ ID NO: 7498586 - DNA, 22 bp, Homo sapiens
aaagctcttttccaagtattga

SEQ ID NO: 7498587 - DNA, 22 bp, Homo sapiens
aaagctcttttccaagtattga

SEQ ID NO: 7498588 - DNA, 22 bp, Homo sapiens
aaagctcttttccaagtattga

SEQ ID NO: 7498589 - DNA, 22 bp, Homo sapiens
aaagctcttttccaagtattga

SEQ ID NO: 7498590 - DNA, 22 bp, Homo sapiens
aaagctcttttccaagtattga

SEQ ID NO: 7498591 - DNA, 22 bp, Homo sapiens
aaagctgatgtctactagagaa

SEQ ID NO: 7498592 - DNA, 22 bp, Homo sapiens
aaagctctttgtatagtggaat

SEQ ID NO: 7498593 - DNA, 22 bp, Homo sapiens
aaagctctttgtatagtggaat

SEQ ID NO: 7498594 - DNA, 22 bp, Homo sapiens
aaagctctttcttctttggcat

SEQ ID NO: 7498595 - DNA, 22 bp, Homo sapiens
aaagctctttcttctttggcat

SEQ ID NO: 7498596 - DNA, 22 bp, Homo sapiens
aaagctctttcacttccgttct

SEQ ID NO: 7498597 - DNA, 22 bp, Homo sapiens
aaagctctttcacttccgttct

SEQ ID NO: 7498598 - DNA, 22 bp, Homo sapiens
aaagctcttgggagggttaatt

SEQ ID NO: 7498599 - DNA, 22 bp, Homo sapiens
aaagctcttgggagggttaatt

SEQ ID NO: 7498600 - DNA, 22 bp, Homo sapiens
aaagctgcccagctgcctgttt

SEQ ID NO: 7498601 - DNA, 22 bp, Homo sapiens
aaagctgccctacacggaagca

SEQ ID NO: 7498602 - DNA, 22 bp, Homo sapiens
aaagctgcccttgtgaaacaag

SEQ ID NO: 7498603 - DNA, 22 bp, Homo sapiens
aaagctgccaaggagaatacta

SEQ ID NO: 7498604 - DNA, 22 bp, Homo sapiens
aaagctgattgcaggaagagag

SEQ ID NO: 7498605 - DNA, 22 bp, Homo sapiens
aaagctgattgcaggaagagag

SEQ ID NO: 7498606 - DNA, 22 bp, Homo sapiens
aaagctgcaagctcctgaggaa

SEQ ID NO: 7498607 - DNA, 23 bp, Homo sapiens
aaaatcttctgcctatgaagaaa

SEQ ID NO: 7498608 - DNA, 23 bp, Homo sapiens
aaaatcttctgcctatgaagaaa

SEQ ID NO: 7498609 - DNA, 23 bp, Homo sapiens
aaaatcttctgcctatgaagaaa

SEQ ID NO: 7498610 - DNA, 23 bp, Homo sapiens
aaaatcttctgcctatgaagaaa

SEQ ID NO: 7498611 - DNA, 22 bp, Homo sapiens
aaaatagttaacgttcagagta

SEQ ID NO: 7498612 - DNA, 22 bp, Homo sapiens
aaaatcttgactgtttttagaa

SEQ ID NO: 7498613 - DNA, 22 bp, Homo sapiens
aaaatcttgactgtttttagaa

SEQ ID NO: 7498614 - DNA, 22 bp, Homo sapiens
aaaatcttgactgtttttagaa

SEQ ID NO: 7498615 - DNA, 22 bp, Homo sapiens
aaaatcttgactgtttttagaa

SEQ ID NO: 7498616 - DNA, 22 bp, Homo sapiens
aaaatcttgactgtttttagaa

SEQ ID NO: 7498617 - DNA, 22 bp, Homo sapiens
aaaatcttgtgacttaggaagg

SEQ ID NO: 7498618 - DNA, 22 bp, Homo sapiens
aaaatcttgtgacttaggaagg

SEQ ID NO: 7498619 - DNA, 22 bp, Homo sapiens
aaaatcttgtgacttaggaagg

SEQ ID NO: 7498620 - DNA, 22 bp, Homo sapiens
aaaatcttgactgtttttagaa

SEQ ID NO: 7498621 - DNA, 22 bp, Homo sapiens
aaaatcttgactgtttttagaa

SEQ ID NO: 7498622 - DNA, 22 bp, Homo sapiens
aaaatgaacagaacaatgggga

SEQ ID NO: 7498623 - DNA, 22 bp, Homo sapiens
aaaatgaacagaacaatgggga

SEQ ID NO: 7498624 - DNA, 22 bp, Homo sapiens
aaaatgaacagaacaatgggga

SEQ ID NO: 7498625 - DNA, 22 bp, Homo sapiens
aaaatgaacagaacaatgggga

SEQ ID NO: 7498626 - DNA, 22 bp, Homo sapiens
aaaatgaacagaacaatgggga

SEQ ID NO: 7498627 - DNA, 22 bp, Homo sapiens
aaaatgaacagaacaatgggga

SEQ ID NO: 7498628 - DNA, 22 bp, Homo sapiens
aaaatgaacagaacaatgggga

SEQ ID NO: 7498629 - DNA, 22 bp, Homo sapiens
aaaatcttgtgacttaggaagg

SEQ ID NO: 7498630 - DNA, 22 bp, Homo sapiens
aaaatcttgtgacttaggaagg

SEQ ID NO: 7498631 - DNA, 22 bp, Homo sapiens
aaaatcttgtgacttaggaagg

SEQ ID NO: 7498632 - DNA, 22 bp, Homo sapiens
aaaatcttgtgacttaggaagg

SEQ ID NO: 7498633 - DNA, 22 bp, Homo sapiens
aaaatcttgtgacttaggaagg

SEQ ID NO: 7498634 - DNA, 22 bp, Homo sapiens
aaaatcttgtgacttaggaagg

SEQ ID NO: 7498635 - DNA, 22 bp, Homo sapiens
aaaatgaagcaaaggcattcag

SEQ ID NO: 7498636 - DNA, 22 bp, Homo sapiens
aaaatgaacagaacaatgggga

SEQ ID NO: 7498637 - DNA, 22 bp, Homo sapiens
aaaatgaacagaacaatgggga

SEQ ID NO: 7498638 - DNA, 22 bp, Homo sapiens
aaaatgaacagaacaatgggga

SEQ ID NO: 7498639 - DNA, 22 bp, Homo sapiens
aaaatgaagcaaaggcattcag

SEQ ID NO: 7498640 - DNA, 22 bp, Homo sapiens
aaaatgaagcaaaggcattcag

SEQ ID NO: 7498641 - DNA, 22 bp, Homo sapiens
aaaatgaataagttaacccagg

SEQ ID NO: 7498642 - DNA, 22 bp, Homo sapiens
aaaatgaagcaaaggcattcag

SEQ ID NO: 7498643 - DNA, 22 bp, Homo sapiens
aaaatgaagcaaaggcattcag

SEQ ID NO: 7498644 - DNA, 22 bp, Homo sapiens
aaaatagttaacgttcagagta

SEQ ID NO: 7498645 - DNA, 22 bp, Homo sapiens
aaaatagttaacgttcagagta

SEQ ID NO: 7498646 - DNA, 22 bp, Homo sapiens
aaaatctggtaatttgaatgtg

SEQ ID NO: 7498647 - DNA, 22 bp, Homo sapiens
aaaatagttaacgttcagagta

SEQ ID NO: 7498648 - DNA, 22 bp, Homo sapiens
aaaatagttaacgttcagagta

SEQ ID NO: 7498649 - DNA, 22 bp, Homo sapiens
aaaaactgcaattacttttgtc

SEQ ID NO: 7498650 - DNA, 22 bp, Homo sapiens
aaaatagttaacgttcagagta

SEQ ID NO: 7498651 - DNA, 22 bp, Homo sapiens
aaaatagttaacgttcagagta

SEQ ID NO: 7498652 - DNA, 22 bp, Homo sapiens
aaaatagttaacgttcagagta

SEQ ID NO: 7498653 - DNA, 22 bp, Homo sapiens
aaaatagttaacgttcagagta

SEQ ID NO: 7498654 - DNA, 22 bp, Homo sapiens
aaaatagttaacgttcagagta

SEQ ID NO: 7498655 - DNA, 22 bp, Homo sapiens
aaaaacctttcccatactaaga

SEQ ID NO: 7498656 - DNA, 22 bp, Homo sapiens
aaaaacctttcccatactaaga

SEQ ID NO: 7498657 - DNA, 22 bp, Homo sapiens
aaaaacctttcccatactaaga

SEQ ID NO: 7498658 - DNA, 22 bp, Homo sapiens
aaaaacctttcattgcaaatgt

SEQ ID NO: 7498659 - DNA, 22 bp, Homo sapiens
aaaaacctttcattgcaaatgt

SEQ ID NO: 7498660 - DNA, 22 bp, Homo sapiens
aaaaacctttcattgcaaatgt

SEQ ID NO: 7498661 - DNA, 22 bp, Homo sapiens
aaaaactgcaattacttttgtc

SEQ ID NO: 7498662 - DNA, 22 bp, Homo sapiens
aaaaactgcaattacttttgtc

SEQ ID NO: 7498663 - DNA, 22 bp, Homo sapiens
aaaaactgcaattacttttgtc

SEQ ID NO: 7498664 - DNA, 22 bp, Homo sapiens
aaaaactgcaattacttttgtc

SEQ ID NO: 7498665 - DNA, 22 bp, Homo sapiens
aaaaactgcaattacttttgtc

SEQ ID NO: 7498666 - DNA, 22 bp, Homo sapiens
aaaaacctttcccatactaaga

SEQ ID NO: 7498667 - DNA, 22 bp, Homo sapiens
aaaaacctttcccatactaaga

SEQ ID NO: 7498668 - DNA, 22 bp, Homo sapiens
aaaaacctttcccatactaaga

SEQ ID NO: 7498669 - DNA, 22 bp, Homo sapiens
aaaaaccattgtcttcagtctc

SEQ ID NO: 7498670 - DNA, 22 bp, Homo sapiens
aaaaaccattgtcttcagtctc

SEQ ID NO: 7498671 - DNA, 22 bp, Homo sapiens
aaaaaccattgtcttcagtctc

SEQ ID NO: 7498672 - DNA, 22 bp, Homo sapiens
aaaaaccattgtcttcagtctc

SEQ ID NO: 7498673 - DNA, 22 bp, Homo sapiens
aaaaaccattgtcttcagtctc

SEQ ID NO: 7498674 - DNA, 20 bp, Homo sapiens
aaaaacagtaatgctgaaga

SEQ ID NO: 7498675 - DNA, 20 bp, Homo sapiens
aaaaacagtaatgctgaaga

SEQ ID NO: 7498676 - DNA, 20 bp, Homo sapiens
aaaaacagtaatgctgaaga

SEQ ID NO: 7498677 - DNA, 22 bp, Homo sapiens
aaaaacctcaattacttttgca

SEQ ID NO: 7498678 - DNA, 22 bp, Homo sapiens
aaaaacctcaattacttttgca

SEQ ID NO: 7498679 - DNA, 22 bp, Homo sapiens
aaaaacctcaattacttttgca

SEQ ID NO: 7498680 - DNA, 22 bp, Homo sapiens
aaaaacctttcattgcaaatgt

SEQ ID NO: 7498681 - DNA, 22 bp, Homo sapiens
aaaaaccattgtcttcagtctc

SEQ ID NO: 7498682 - DNA, 22 bp, Homo sapiens
aaaaaccattgtcttcagtctc

SEQ ID NO: 7498683 - DNA, 22 bp, Homo sapiens
aaaaaccattgtcttcagtctc

SEQ ID NO: 7498684 - DNA, 22 bp, Homo sapiens
aaaaaccattgtcttcagtctc

SEQ ID NO: 7498685 - DNA, 22 bp, Homo sapiens
aaaaacctcaattacttttgca

SEQ ID NO: 7498686 - DNA, 22 bp, Homo sapiens
aaaaacactgggctgggagtca

SEQ ID NO: 7498687 - DNA, 22 bp, Homo sapiens
aaaaacactgggctgggagtca

SEQ ID NO: 7498688 - DNA, 22 bp, Homo sapiens
aaaaacactgggctgggagtca

SEQ ID NO: 7498689 - DNA, 22 bp, Homo sapiens
aaaaacacaagtggcttggtct

SEQ ID NO: 7498690 - DNA, 22 bp, Homo sapiens
aaaaacagaatgtgtctaactc

SEQ ID NO: 7498691 - DNA, 22 bp, Homo sapiens
aaaaacagaatgtgtctaactc

SEQ ID NO: 7498692 - DNA, 22 bp, Homo sapiens
aaaaacagaatgtgtctaactc

SEQ ID NO: 7498693 - DNA, 22 bp, Homo sapiens
aaaaacagaatgtgtctaactc

SEQ ID NO: 7498694 - DNA, 22 bp, Homo sapiens
aaaaacagaatgtgtctaactc

SEQ ID NO: 7498695 - DNA, 22 bp, Homo sapiens
aaaaacactgggctgggagtca

SEQ ID NO: 7498696 - DNA, 20 bp, Homo sapiens
aaaaacagtaatgctgaaga

SEQ ID NO: 7498697 - DNA, 20 bp, Homo sapiens
aaaaacagtaatgctgaaga

SEQ ID NO: 7498698 - DNA, 20 bp, Homo sapiens
aaaaacagtaatgctgaaga

SEQ ID NO: 7498699 - DNA, 22 bp, Homo sapiens
aaaaacagaatgtgtctaactc

SEQ ID NO: 7498700 - DNA, 20 bp, Homo sapiens
aaaaacagtaatgctgaaga

SEQ ID NO: 7498701 - DNA, 20 bp, Homo sapiens
aaaaacagtaatgctgaaga

SEQ ID NO: 7498702 - DNA, 20 bp, Homo sapiens
aaaaacagtaatgctgaaga

SEQ ID NO: 7498703 - DNA, 20 bp, Homo sapiens
aaaaacagtaatgctgaaga

SEQ ID NO: 7498704 - DNA, 22 bp, Homo sapiens
aaaaaattccattctgtgcctt

SEQ ID NO: 7498705 - DNA, 22 bp, Homo sapiens
aaaaaattccattctgtgcctt

SEQ ID NO: 7498706 - DNA, 22 bp, Homo sapiens
aaaaaattccattctgtgcctt

SEQ ID NO: 7498707 - DNA, 22 bp, Homo sapiens
aaaaaattccattctgtgcctt

SEQ ID NO: 7498708 - DNA, 22 bp, Homo sapiens
aaaaaattccattctgtgcctt

SEQ ID NO: 7498709 - DNA, 22 bp, Homo sapiens
aaaaaattccattctgtgcctt

SEQ ID NO: 7498710 - DNA, 22 bp, Homo sapiens
aaaaacacaactgtctttctct

SEQ ID NO: 7498711 - DNA, 22 bp, Homo sapiens
aaaaacacaactgtctttctct

SEQ ID NO: 7498712 - DNA, 22 bp, Homo sapiens
aaaaacacaactgtctttctct

SEQ ID NO: 7498713 - DNA, 22 bp, Homo sapiens
aaaaacacaactgtctttctct

SEQ ID NO: 7498714 - DNA, 22 bp, Homo sapiens
aaaaacacaactgtctttctct

SEQ ID NO: 7498715 - DNA, 22 bp, Homo sapiens
aaaaaattccattctgtgcctt

SEQ ID NO: 7498716 - DNA, 22 bp, Homo sapiens
aaaaaattccattctgtgcctt

SEQ ID NO: 7498717 - DNA, 22 bp, Homo sapiens
aaaaacacaactgtctttctct

SEQ ID NO: 7498718 - DNA, 22 bp, Homo sapiens
aaaaacacaactgtctttctct

SEQ ID NO: 7498719 - DNA, 22 bp, Homo sapiens
aaaaacacaactgtctttctct

SEQ ID NO: 7498720 - DNA, 22 bp, Homo sapiens
aaaaacacaactgtctttctct

SEQ ID NO: 7498721 - DNA, 22 bp, Homo sapiens
aaaaacacaactgtctttctct

SEQ ID NO: 7498722 - DNA, 22 bp, Homo sapiens
aaaaacacaagtggcttggtct

SEQ ID NO: 7498723 - DNA, 22 bp, Homo sapiens
aaaaacacaactgtctttctct

SEQ ID NO: 7498724 - DNA, 22 bp, Homo sapiens
aaaaacacaactgtctttctct

SEQ ID NO: 7498725 - DNA, 22 bp, Homo sapiens
aaaaacacaactgtctttctct

SEQ ID NO: 7498726 - DNA, 22 bp, Homo sapiens
aaaaacacaactgtctttctct

SEQ ID NO: 7498727 - DNA, 22 bp, Homo sapiens
aaaaaattatcatagttcctga

SEQ ID NO: 7498728 - DNA, 22 bp, Homo sapiens
aaaaaattatcatagttcctga

SEQ ID NO: 7498729 - DNA, 22 bp, Homo sapiens
aaaaaattatcatagttcctga

SEQ ID NO: 7498730 - DNA, 22 bp, Homo sapiens
aaaaaattatcatagttcctga

SEQ ID NO: 7498731 - DNA, 22 bp, Homo sapiens
aaaaaattatcatagttcctga

SEQ ID NO: 7498732 - DNA, 22 bp, Homo sapiens
aaaaaattccattctgtgcctt

SEQ ID NO: 7498733 - DNA, 22 bp, Homo sapiens
aaaaaattatcatagttcctga

SEQ ID NO: 7498734 - DNA, 22 bp, Homo sapiens
aaaaaattatcatagttcctga

SEQ ID NO: 7498735 - DNA, 22 bp, Homo sapiens
aaaaaattatcatagttcctga

SEQ ID NO: 7498736 - DNA, 22 bp, Homo sapiens
aaaaaattatcatagttcctga

SEQ ID NO: 7498737 - DNA, 22 bp, Homo sapiens
aaaaaattatcatagttcctga

SEQ ID NO: 7498738 - DNA, 22 bp, Homo sapiens
aaaaaattatcatagttcctga

SEQ ID NO: 7498739 - DNA, 22 bp, Homo sapiens
aaaaaatcagatctttggttaa

SEQ ID NO: 7498740 - DNA, 22 bp, Homo sapiens
aaaaaatcagatctttggttaa

SEQ ID NO: 7498741 - DNA, 22 bp, Homo sapiens
aaaaaatcagatctttggttaa

SEQ ID NO: 7498742 - DNA, 22 bp, Homo sapiens
aaaaaatcagatctttggttaa

SEQ ID NO: 7498743 - DNA, 22 bp, Homo sapiens
aaaaaatcagatctttggttaa

SEQ ID NO: 7498744 - DNA, 22 bp, Homo sapiens
aaaaaagattgatggtggatgc

SEQ ID NO: 7498745 - DNA, 22 bp, Homo sapiens
aaaaaagattgatggtggatgc

SEQ ID NO: 7498746 - DNA, 22 bp, Homo sapiens
aaaaaagattgatggtggatgc

SEQ ID NO: 7498747 - DNA, 22 bp, Homo sapiens
aaaaaatcagatctttggttaa

SEQ ID NO: 7498748 - DNA, 22 bp, Homo sapiens
aaaaaatcagatctttggttaa

SEQ ID NO: 7498749 - DNA, 22 bp, Homo sapiens
aaaaaagattgatggtggatgc

SEQ ID NO: 7498750 - DNA, 22 bp, Homo sapiens
aaaaaagattgatggtggatgc

SEQ ID NO: 7498751 - DNA, 22 bp, Homo sapiens
aaaaaagattgatggtggatgc

SEQ ID NO: 7498752 - DNA, 22 bp, Homo sapiens
aaaaaagattgatggtggatgc

SEQ ID NO: 7498753 - DNA, 23 bp, Homo sapiens
aaaaaaccatgtaggcactcagt

SEQ ID NO: 7498754 - DNA, 23 bp, Homo sapiens
aaaaaaccatgtaggcactcagt

SEQ ID NO: 7498755 - DNA, 23 bp, Homo sapiens
aaaaaaccatgtaggcactcagt

SEQ ID NO: 7498756 - DNA, 23 bp, Homo sapiens
aaaaaaccatgtaggcactcagt

SEQ ID NO: 7498757 - DNA, 23 bp, Homo sapiens
aaaaaaccatgtaggcactcagt

SEQ ID NO: 7498758 - DNA, 23 bp, Homo sapiens
aaaaaaccatgtaggcactcagt

SEQ ID NO: 7498759 - DNA, 22 bp, Homo sapiens
aaacactgtgtcaaactggggc

SEQ ID NO: 7498760 - DNA, 22 bp, Homo sapiens
aaacacttcaaggacttctgtc

SEQ ID NO: 7498761 - DNA, 22 bp, Homo sapiens
aaacacttcaaggacttctgtc

SEQ ID NO: 7498762 - DNA, 22 bp, Homo sapiens
aaacacttcaaggacttctgtc

SEQ ID NO: 7498763 - DNA, 22 bp, Homo sapiens
aaacacttcaaggacttctgtc

SEQ ID NO: 7498764 - DNA, 22 bp, Homo sapiens
aaacacttcaaggacttctgtc

SEQ ID NO: 7498765 - DNA, 22 bp, Homo sapiens
aaacacttcaaggacttctgtc

SEQ ID NO: 7498766 - DNA, 22 bp, Homo sapiens
aaacacttcaaggacttctgtc

SEQ ID NO: 7498767 - DNA, 22 bp, Homo sapiens
aaacacttcaaggacttctgtc

SEQ ID NO: 7498768 - DNA, 22 bp, Homo sapiens
aaacacttcaaggacttctgtc

SEQ ID NO: 7498769 - DNA, 22 bp, Homo sapiens
aaacacttcaaggacttctgtc

SEQ ID NO: 7498770 - DNA, 22 bp, Homo sapiens
aaacacttcaaggacttctgtc

SEQ ID NO: 7498771 - DNA, 22 bp, Homo sapiens
aaacacttcctgtaacatgaca

SEQ ID NO: 7498772 - DNA, 22 bp, Homo sapiens
aaacacttcctgtaacatgaca

SEQ ID NO: 7498773 - DNA, 22 bp, Homo sapiens
aaacacttcctgtaacatgaca

SEQ ID NO: 7498774 - DNA, 22 bp, Homo sapiens
aaacacttcctgtaacatgaca

SEQ ID NO: 7498775 - DNA, 22 bp, Homo sapiens
aaacacttcttaggtcttaagt

SEQ ID NO: 7498776 - DNA, 22 bp, Homo sapiens
aaacacttcttaggtcttaagt

SEQ ID NO: 7498777 - DNA, 22 bp, Homo sapiens
aaacacttcctgtaacatgaca

SEQ ID NO: 7498778 - DNA, 22 bp, Homo sapiens
aaacacttcctgtaacatgaca

SEQ ID NO: 7498779 - DNA, 22 bp, Homo sapiens
aaacacttcctgtaacatgaca

SEQ ID NO: 7498780 - DNA, 22 bp, Homo sapiens
aaacacttcctgtaacatgaca

SEQ ID NO: 7498781 - DNA, 22 bp, Homo sapiens
aaacacttcctgtaacatgaca

SEQ ID NO: 7498782 - DNA, 22 bp, Homo sapiens
aaacacttcctgtaacatgaca

SEQ ID NO: 7498783 - DNA, 22 bp, Homo sapiens
aaacacttcctgtaacatgaca

SEQ ID NO: 7498784 - DNA, 22 bp, Homo sapiens
aaacacttcttaggtcttaagt

SEQ ID NO: 7498785 - DNA, 22 bp, Homo sapiens
aaacacttcttaggtcttaagt

SEQ ID NO: 7498786 - DNA, 22 bp, Homo sapiens
aaacacttcttaggtcttaagt

SEQ ID NO: 7498787 - DNA, 22 bp, Homo sapiens
aaacacttcttaggtcttaagt

SEQ ID NO: 7498788 - DNA, 22 bp, Homo sapiens
aaacacttgcaaaatggttcct

SEQ ID NO: 7498789 - DNA, 22 bp, Homo sapiens
aaacacttgcaaaatggttcct

SEQ ID NO: 7498790 - DNA, 22 bp, Homo sapiens
aaacacttgcaaaatggttcct

SEQ ID NO: 7498791 - DNA, 22 bp, Homo sapiens
aaacacttgcaaaatggttcct

SEQ ID NO: 7498792 - DNA, 22 bp, Homo sapiens
aaacactttagaaagggacttg

SEQ ID NO: 7498793 - DNA, 22 bp, Homo sapiens
aaacactttagaaagggacttg

SEQ ID NO: 7498794 - DNA, 22 bp, Homo sapiens
aaacagaaatttcctcatgctc

SEQ ID NO: 7498795 - DNA, 22 bp, Homo sapiens
aaacagaaatttcctcatgctc

SEQ ID NO: 7498796 - DNA, 22 bp, Homo sapiens
aaacagaaatttcctcatgctc

SEQ ID NO: 7498797 - DNA, 22 bp, Homo sapiens
aaacagaaatttcctcatgctc

SEQ ID NO: 7498798 - DNA, 22 bp, Homo sapiens
aaacagaaatttcctcatgctc

SEQ ID NO: 7498799 - DNA, 22 bp, Homo sapiens
aaacagaaatttcctcatgctc

SEQ ID NO: 7498800 - DNA, 22 bp, Homo sapiens
aaacagaaatttcctcatgctc

SEQ ID NO: 7498801 - DNA, 22 bp, Homo sapiens
aaacagaagggtaggtaaacat

SEQ ID NO: 7498802 - DNA, 22 bp, Homo sapiens
aaacagaagggtaggtaaacat

SEQ ID NO: 7498803 - DNA, 22 bp, Homo sapiens
aaacagaaatttcctcatgctc

SEQ ID NO: 7498804 - DNA, 22 bp, Homo sapiens
aaacagaaatttcctcatgctc

SEQ ID NO: 7498805 - DNA, 22 bp, Homo sapiens
aaacagaaatttcctcatgctc

SEQ ID NO: 7498806 - DNA, 22 bp, Homo sapiens
aaacagaagggtaggtaaacat

SEQ ID NO: 7498807 - DNA, 22 bp, Homo sapiens
aaacagaagggtaggtaaacat

SEQ ID NO: 7498808 - DNA, 22 bp, Homo sapiens
aaacagactgaagagttgaagc

SEQ ID NO: 7498809 - DNA, 22 bp, Homo sapiens
aaacagactgaagagttgaagc

SEQ ID NO: 7498810 - DNA, 22 bp, Homo sapiens
aaacagaagggtaggtaaacat

SEQ ID NO: 7498811 - DNA, 22 bp, Homo sapiens
aaacagaagggtaggtaaacat

SEQ ID NO: 7498812 - DNA, 22 bp, Homo sapiens
aaacagagagatgtatgtggag

SEQ ID NO: 7498813 - DNA, 22 bp, Homo sapiens
aaacagactgcactgccagtca

SEQ ID NO: 7498814 - DNA, 22 bp, Homo sapiens
aaacagactgaagagttgaagc

SEQ ID NO: 7498815 - DNA, 22 bp, Homo sapiens
aaacagactgcactgccagtca

SEQ ID NO: 7498816 - DNA, 22 bp, Homo sapiens
aaacagagggccactgaggctc

SEQ ID NO: 7498817 - DNA, 22 bp, Homo sapiens
aaacagagggccactgaggctc

SEQ ID NO: 7498818 - DNA, 21 bp, Homo sapiens
aaacagagctgagtaatagat

SEQ ID NO: 7498819 - DNA, 21 bp, Homo sapiens
aaacagagctgagtaatagat

SEQ ID NO: 7498820 - DNA, 22 bp, Homo sapiens
aaacagagagatgtatgtggag

SEQ ID NO: 7498821 - DNA, 22 bp, Homo sapiens
aaacagagagatgtatgtggag

SEQ ID NO: 7498822 - DNA, 22 bp, Homo sapiens
aaaagacaggtgtctgcggccc

SEQ ID NO: 7498823 - DNA, 22 bp, Homo sapiens
aaaagacaggtgtctgcggccc

SEQ ID NO: 7498824 - DNA, 22 bp, Homo sapiens
aaaagacaggtgtctgcggccc

SEQ ID NO: 7498825 - DNA, 22 bp, Homo sapiens
aaaagaacctagctcctcagtc

SEQ ID NO: 7498826 - DNA, 22 bp, Homo sapiens
aaacagagggccactgaggctc

SEQ ID NO: 7498827 - DNA, 22 bp, Homo sapiens
aaaagacatctatttcaggcag

SEQ ID NO: 7498828 - DNA, 22 bp, Homo sapiens
aaaagacatctatttcaggcag

SEQ ID NO: 7498829 - DNA, 22 bp, Homo sapiens
aaaagacatctatttcaggcag

SEQ ID NO: 7498830 - DNA, 22 bp, Homo sapiens
aaaagacatatgtgggcattct

SEQ ID NO: 7498831 - DNA, 22 bp, Homo sapiens
aaaagacatatgtgggcattct

SEQ ID NO: 7498832 - DNA, 22 bp, Homo sapiens
aaaagacatatgtgggcattct

SEQ ID NO: 7498833 - DNA, 22 bp, Homo sapiens
aaacagagagatgtatgtggag

SEQ ID NO: 7498834 - DNA, 22 bp, Homo sapiens
aaaagacatatgtgggcattct

SEQ ID NO: 7498835 - DNA, 22 bp, Homo sapiens
aaaagacatatgtgggcattct

SEQ ID NO: 7498836 - DNA, 22 bp, Homo sapiens
aaaagacaggtgtctgcggccc

SEQ ID NO: 7498837 - DNA, 22 bp, Homo sapiens
aaaagacaggtgtctgcggccc

SEQ ID NO: 7498838 - DNA, 22 bp, Homo sapiens
aaaagacatctatttcaggcag

SEQ ID NO: 7498839 - DNA, 22 bp, Homo sapiens
aaaagacatctatttcaggcag

SEQ ID NO: 7498840 - DNA, 22 bp, Homo sapiens
aaaagagaaagtggcaggcttt

SEQ ID NO: 7498841 - DNA, 22 bp, Homo sapiens
aaaagagaaagtggcaggcttt

SEQ ID NO: 7498842 - DNA, 22 bp, Homo sapiens
aaaagagaaagtggcaggcttt

SEQ ID NO: 7498843 - DNA, 22 bp, Homo sapiens
aaaagacatctatttcaggcag

SEQ ID NO: 7498844 - DNA, 22 bp, Homo sapiens
aaaagacatctatttcaggcag

SEQ ID NO: 7498845 - DNA, 22 bp, Homo sapiens
aaaagacatctatttcaggcag

SEQ ID NO: 7498846 - DNA, 22 bp, Homo sapiens
aaaagacatctatttcaggcag

SEQ ID NO: 7498847 - DNA, 22 bp, Homo sapiens
aaaatgaataagttaacccagg

SEQ ID NO: 7498848 - DNA, 22 bp, Homo sapiens
aaaatgaataagttaacccagg

SEQ ID NO: 7498849 - DNA, 22 bp, Homo sapiens
aaaatgaataagttaacccagg

SEQ ID NO: 7498850 - DNA, 22 bp, Homo sapiens
aaaatgaataagttaacccagg

SEQ ID NO: 7498851 - DNA, 22 bp, Homo sapiens
aaaatgaataagttaacccagg

SEQ ID NO: 7498852 - DNA, 22 bp, Homo sapiens
aaaatgaataagttaacccagg

SEQ ID NO: 7498853 - DNA, 22 bp, Homo sapiens
aaaatgaataagttaacccagg

SEQ ID NO: 7498854 - DNA, 22 bp, Homo sapiens
aaaatgaataagttaacccagg

SEQ ID NO: 7498855 - DNA, 22 bp, Homo sapiens
aaaatgaataagttaacccagg

SEQ ID NO: 7498856 - DNA, 22 bp, Homo sapiens
aaaatgaataagttaacccagg

SEQ ID NO: 7498857 - DNA, 22 bp, Homo sapiens
aaaatgaataagttaacccagg

SEQ ID NO: 7498858 - DNA, 22 bp, Homo sapiens
aaaatgaataagttaacccagg

SEQ ID NO: 7498859 - DNA, 22 bp, Homo sapiens
aaaaatagaaggattgactgag

SEQ ID NO: 7498860 - DNA, 22 bp, Homo sapiens
aaaaatagaaggattgactgag

SEQ ID NO: 7498861 - DNA, 22 bp, Homo sapiens
aaaaatagaaggattgactgag

SEQ ID NO: 7498862 - DNA, 22 bp, Homo sapiens
aaaaatagaaggattgactgag

SEQ ID NO: 7498863 - DNA, 22 bp, Homo sapiens
aaaaatacttcacttctgggtg

SEQ ID NO: 7498864 - DNA, 22 bp, Homo sapiens
aaaatgacattccagtgatatt

SEQ ID NO: 7498865 - DNA, 22 bp, Homo sapiens
aaaatgaataagttaacccagg

SEQ ID NO: 7498866 - DNA, 22 bp, Homo sapiens
aaaatgacattccagtgatatt

SEQ ID NO: 7498867 - DNA, 22 bp, Homo sapiens
aaaatgacattccagtgatatt

SEQ ID NO: 7498868 - DNA, 22 bp, Homo sapiens
aaaatgaataagttaacccagg

SEQ ID NO: 7498869 - DNA, 22 bp, Homo sapiens
aaaatgacattccagtgatatt

SEQ ID NO: 7498870 - DNA, 22 bp, Homo sapiens
aaaatgacattccagtgatatt

SEQ ID NO: 7498871 - DNA, 22 bp, Homo sapiens
aaaatgacattccagtgatatt

SEQ ID NO: 7498872 - DNA, 22 bp, Homo sapiens
aaaatgacattccagtgatatt

SEQ ID NO: 7498873 - DNA, 22 bp, Homo sapiens
aaaaatagcttctcttgtccct

SEQ ID NO: 7498874 - DNA, 22 bp, Homo sapiens
aaaaatagcttctcttgtccct

SEQ ID NO: 7498875 - DNA, 22 bp, Homo sapiens
aaaaatagcttctcttgtccct

SEQ ID NO: 7498876 - DNA, 22 bp, Homo sapiens
aaaaatagcttctcttgtccct

SEQ ID NO: 7498877 - DNA, 22 bp, Homo sapiens
aaaaatagcttctcttgtccct

SEQ ID NO: 7498878 - DNA, 22 bp, Homo sapiens
aaaaataggtcaaccgtgtatg

SEQ ID NO: 7498879 - DNA, 22 bp, Homo sapiens
aaaaataggtcaaccgtgtatg

SEQ ID NO: 7498880 - DNA, 22 bp, Homo sapiens
aaaaatagcttctcttgtccct

SEQ ID NO: 7498881 - DNA, 22 bp, Homo sapiens
aaaaatagcttctcttgtccct

SEQ ID NO: 7498882 - DNA, 22 bp, Homo sapiens
aaaaataggtcaaccgtgtatg

SEQ ID NO: 7498883 - DNA, 22 bp, Homo sapiens
aaaaatagaaggattgactgag

SEQ ID NO: 7498884 - DNA, 22 bp, Homo sapiens
aaaaatagaaggattgactgag

SEQ ID NO: 7498885 - DNA, 22 bp, Homo sapiens
aaaaatagcttctcttgtccct

SEQ ID NO: 7498886 - DNA, 22 bp, Homo sapiens
aaaaatagcttctcttgtccct

SEQ ID NO: 7498887 - DNA, 22 bp, Homo sapiens
aaaaatagcttctcttgtccct

SEQ ID NO: 7498888 - DNA, 22 bp, Homo sapiens
aaaaatagaaggattgactgag

SEQ ID NO: 7498889 - DNA, 22 bp, Homo sapiens
aaaaatagaaggattgactgag

SEQ ID NO: 7498890 - DNA, 22 bp, Homo sapiens
aaaaatagaaggattgactgag

SEQ ID NO: 7498891 - DNA, 22 bp, Homo sapiens
aaaaatagaaggattgactgag

SEQ ID NO: 7498892 - DNA, 22 bp, Homo sapiens
aaaaatcacttttataggcagc

SEQ ID NO: 7498893 - DNA, 22 bp, Homo sapiens
aaaaatcacttttataggcagc

SEQ ID NO: 7498894 - DNA, 22 bp, Homo sapiens
aaaaatcacttttataggcagc

SEQ ID NO: 7498895 - DNA, 22 bp, Homo sapiens
aaaaatcacttttataggcagc

SEQ ID NO: 7498896 - DNA, 22 bp, Homo sapiens
aaaaatcacttttataggcagc

SEQ ID NO: 7498897 - DNA, 22 bp, Homo sapiens
aaaaatcacttttataggcagc

SEQ ID NO: 7498898 - DNA, 22 bp, Homo sapiens
aaaaatcacttttataggcagc

SEQ ID NO: 7498899 - DNA, 22 bp, Homo sapiens
aaaaatcacttttataggcagc

SEQ ID NO: 7498900 - DNA, 22 bp, Homo sapiens
aaaaatcacttttataggcagc

SEQ ID NO: 7498901 - DNA, 22 bp, Homo sapiens
aaaaatcacttttataggcagc

SEQ ID NO: 7498902 - DNA, 22 bp, Homo sapiens
aaaaatcacttttataggcagc

SEQ ID NO: 7498903 - DNA, 22 bp, Homo sapiens
aaaaatcacttttataggcagc

SEQ ID NO: 7498904 - DNA, 22 bp, Homo sapiens
aaaaatcacttttataggcagc

SEQ ID NO: 7498905 - DNA, 22 bp, Homo sapiens
aaaaataggtcaaccgtgtatg

SEQ ID NO: 7498906 - DNA, 22 bp, Homo sapiens
aaaaataggtcaaccgtgtatg

SEQ ID NO: 7498907 - DNA, 22 bp, Homo sapiens
aaaaataggtcaaccgtgtatg

SEQ ID NO: 7498908 - DNA, 22 bp, Homo sapiens
aaaaatcacttttataggcagc

SEQ ID NO: 7498909 - DNA, 22 bp, Homo sapiens
aaacactgtgggacatcttact

SEQ ID NO: 7498910 - DNA, 22 bp, Homo sapiens
aaacactgtgggacatcttact

SEQ ID NO: 7498911 - DNA, 22 bp, Homo sapiens
aaacacatcattcatgtcgtca

SEQ ID NO: 7498912 - DNA, 22 bp, Homo sapiens
aaacacaggtactgcagaagtg

SEQ ID NO: 7498913 - DNA, 22 bp, Homo sapiens
aaacacatcattcatgtcgtca

SEQ ID NO: 7498914 - DNA, 22 bp, Homo sapiens
aaacacatcattcatgtcgtca

SEQ ID NO: 7498915 - DNA, 22 bp, Homo sapiens
aaacacaggtactgcagaagtg

SEQ ID NO: 7498916 - DNA, 22 bp, Homo sapiens
aaaaatctatgactgcttctcc

SEQ ID NO: 7498917 - DNA, 22 bp, Homo sapiens
aaaaatctatgactgcttctcc

SEQ ID NO: 7498918 - DNA, 22 bp, Homo sapiens
aaaaatctatgactgcttctcc

SEQ ID NO: 7498919 - DNA, 22 bp, Homo sapiens
aaaaatctatgactgcttctcc

SEQ ID NO: 7498920 - DNA, 22 bp, Homo sapiens
aaaaatcacttttataggcagc

SEQ ID NO: 7498921 - DNA, 22 bp, Homo sapiens
aaaaatcacttttataggcagc

SEQ ID NO: 7498922 - DNA, 22 bp, Homo sapiens
aaaaatcacttttataggcagc

SEQ ID NO: 7498923 - DNA, 22 bp, Homo sapiens
aaaaatcacttttataggcagc

SEQ ID NO: 7498924 - DNA, 22 bp, Homo sapiens
aaaaatcacttttataggcagc

SEQ ID NO: 7498925 - DNA, 22 bp, Homo sapiens
aaaaatcacttttataggcagc

SEQ ID NO: 7498926 - DNA, 22 bp, Homo sapiens
aaaagtatagggtttggagtca

SEQ ID NO: 7498927 - DNA, 22 bp, Homo sapiens
aaaagtatagggtttggagtca

SEQ ID NO: 7498928 - DNA, 22 bp, Homo sapiens
aaaagtatccacagctcaggag

SEQ ID NO: 7498929 - DNA, 22 bp, Homo sapiens
aaaagtatccacagctcaggag

SEQ ID NO: 7498930 - DNA, 22 bp, Homo sapiens
aaaagtatggtggtccttttta

SEQ ID NO: 7498931 - DNA, 22 bp, Homo sapiens
aaaagtatggtggtccttttta

SEQ ID NO: 7498932 - DNA, 22 bp, Homo sapiens
aaaagtatccacagctcaggag

SEQ ID NO: 7498933 - DNA, 22 bp, Homo sapiens
aaaagtatggtggtccttttta

SEQ ID NO: 7498934 - DNA, 22 bp, Homo sapiens
aaaagtatccacagctcaggag

SEQ ID NO: 7498935 - DNA, 22 bp, Homo sapiens
aaaagtatggtggtccttttta

SEQ ID NO: 7498936 - DNA, 22 bp, Homo sapiens
aaaagtatggtggtccttttta

SEQ ID NO: 7498937 - DNA, 22 bp, Homo sapiens
aaaagtatggtggtccttttta

SEQ ID NO: 7498938 - DNA, 22 bp, Homo sapiens
aaaagtatggtggtccttttta

SEQ ID NO: 7498939 - DNA, 22 bp, Homo sapiens
aaaagtatggtggtccttttta

SEQ ID NO: 7498940 - DNA, 22 bp, Homo sapiens
aaaagtatggtggtccttttta

SEQ ID NO: 7498941 - DNA, 22 bp, Homo sapiens
aaaagtattggccaccatttct

SEQ ID NO: 7498942 - DNA, 22 bp, Homo sapiens
aaaagtattggccaccatttct

SEQ ID NO: 7498943 - DNA, 22 bp, Homo sapiens
aaaagtattggccaccatttct

SEQ ID NO: 7498944 - DNA, 22 bp, Homo sapiens
aaaagtattggccaccatttct

SEQ ID NO: 7498945 - DNA, 22 bp, Homo sapiens
aaaagtattggccaccatttct

SEQ ID NO: 7498946 - DNA, 22 bp, Homo sapiens
aaaagtattggccaccatttct

SEQ ID NO: 7498947 - DNA, 22 bp, Homo sapiens
aaaagtattggccaccatttct

SEQ ID NO: 7498948 - DNA, 22 bp, Homo sapiens
aaaagtattggccaccatttct

SEQ ID NO: 7498949 - DNA, 22 bp, Homo sapiens
aaaagtattggccaccatttct

SEQ ID NO: 7498950 - DNA, 22 bp, Homo sapiens
aaaagtattggccaccatttct

SEQ ID NO: 7498951 - DNA, 22 bp, Homo sapiens
aaaagtatggtggtccttttta

SEQ ID NO: 7498952 - DNA, 22 bp, Homo sapiens
aaaagtattggccaccatttct

SEQ ID NO: 7498953 - DNA, 22 bp, Homo sapiens
aaagacatggaactagagatgg

SEQ ID NO: 7498954 - DNA, 22 bp, Homo sapiens
aaagacatggaactagagatgg

SEQ ID NO: 7498955 - DNA, 22 bp, Homo sapiens
aaagaaggtagggctggtgact

SEQ ID NO: 7498956 - DNA, 22 bp, Homo sapiens
aaagacatggaactagagatgg

SEQ ID NO: 7498957 - DNA, 22 bp, Homo sapiens
aaagacatggaactagagatgg

SEQ ID NO: 7498958 - DNA, 22 bp, Homo sapiens
aaagacatggaactagagatgg

SEQ ID NO: 7498959 - DNA, 22 bp, Homo sapiens
aaagacatggaactagagatgg

SEQ ID NO: 7498960 - DNA, 22 bp, Homo sapiens
aaagacatggaactagagatgg

SEQ ID NO: 7498961 - DNA, 22 bp, Homo sapiens
aaagaagggacagactgcctct

SEQ ID NO: 7498962 - DNA, 22 bp, Homo sapiens
aaagaagggacagactgcctct

SEQ ID NO: 7498963 - DNA, 22 bp, Homo sapiens
aaagaaggggtctacatccaat

SEQ ID NO: 7498964 - DNA, 22 bp, Homo sapiens
aaagaaggggtctacatccaat

SEQ ID NO: 7498965 - DNA, 22 bp, Homo sapiens
aaagaaggggtctacatccaat

SEQ ID NO: 7498966 - DNA, 22 bp, Homo sapiens
aaagaaggggtctacatccaat

SEQ ID NO: 7498967 - DNA, 22 bp, Homo sapiens
aaaagtatttatggctatgtaa

SEQ ID NO: 7498968 - DNA, 22 bp, Homo sapiens
aaaagtatttatggctatgtaa

SEQ ID NO: 7498969 - DNA, 22 bp, Homo sapiens
aaaagtatttatggctatgtaa

SEQ ID NO: 7498970 - DNA, 22 bp, Homo sapiens
aaaagtatttatggctatgtaa

SEQ ID NO: 7498971 - DNA, 22 bp, Homo sapiens
aaaagtaattgtggtttttgct

SEQ ID NO: 7498972 - DNA, 22 bp, Homo sapiens
aaaagtaattgtggtttttgct

SEQ ID NO: 7498973 - DNA, 22 bp, Homo sapiens
aaaagtaattgtggtttttgct

SEQ ID NO: 7498974 - DNA, 22 bp, Homo sapiens
aaaagtaattgtggtttttgct

SEQ ID NO: 7498975 - DNA, 22 bp, Homo sapiens
aaaagtaattgtggtttttgct

SEQ ID NO: 7498976 - DNA, 22 bp, Homo sapiens
aaaagtaattgtggtttttgct

SEQ ID NO: 7498977 - DNA, 22 bp, Homo sapiens
aaaagtaattgtggtttttgct

SEQ ID NO: 7498978 - DNA, 22 bp, Homo sapiens
aaaagtactattttaacaaagt

SEQ ID NO: 7498979 - DNA, 22 bp, Homo sapiens
aaaagtactattttaacaaagt

SEQ ID NO: 7498980 - DNA, 22 bp, Homo sapiens
aaaagtactattttaacaaagt

SEQ ID NO: 7498981 - DNA, 22 bp, Homo sapiens
aaaagtactattttaacaaagt

SEQ ID NO: 7498982 - DNA, 22 bp, Homo sapiens
aaaagtactattttaacaaagt

SEQ ID NO: 7498983 - DNA, 22 bp, Homo sapiens
aaaagtactattttaacaaagt

SEQ ID NO: 7498984 - DNA, 22 bp, Homo sapiens
aaaagtactattttaacaaagt

SEQ ID NO: 7498985 - DNA, 22 bp, Homo sapiens
aaaagtactattttaacaaagt

SEQ ID NO: 7498986 - DNA, 22 bp, Homo sapiens
aaaagtactattttaacaaagt

SEQ ID NO: 7498987 - DNA, 22 bp, Homo sapiens
aaaagtatagggtttggagtca

SEQ ID NO: 7498988 - DNA, 22 bp, Homo sapiens
aaaagtatagggtttggagtca

SEQ ID NO: 7498989 - DNA, 22 bp, Homo sapiens
aaaagtatagggtttggagtca

SEQ ID NO: 7498990 - DNA, 22 bp, Homo sapiens
aaaagtatagggtttggagtca

SEQ ID NO: 7498991 - DNA, 22 bp, Homo sapiens
aaactctaagacactgtacaat

SEQ ID NO: 7498992 - DNA, 22 bp, Homo sapiens
aaactctaagacactgtacaat

SEQ ID NO: 7498993 - DNA, 22 bp, Homo sapiens
aaactctaagacactgtacaat

SEQ ID NO: 7498994 - DNA, 22 bp, Homo sapiens
aaactcctgggctcaagcagtt

SEQ ID NO: 7498995 - DNA, 22 bp, Homo sapiens
aaactccagtgaatactagaat

SEQ ID NO: 7498996 - DNA, 22 bp, Homo sapiens
aaactcctgcatactcagaagc

SEQ ID NO: 7498997 - DNA, 22 bp, Homo sapiens
aaactccagtgaatactagaat

SEQ ID NO: 7498998 - DNA, 22 bp, Homo sapiens
aaactcatgccattaatccttt

SEQ ID NO: 7498999 - DNA, 22 bp, Homo sapiens
aaactccagtgaatactagaat

SEQ ID NO: 7499000 - DNA, 22 bp, Homo sapiens
aaactctaatcaaatatagcat

SEQ ID NO: 7499001 - DNA, 22 bp, Homo sapiens
aaactctaagacactgtacaat

SEQ ID NO: 7499002 - DNA, 22 bp, Homo sapiens
aaactctaatcaaatatagcat

SEQ ID NO: 7499003 - DNA, 22 bp, Homo sapiens
aaactctactgaggaaataaga

SEQ ID NO: 7499004 - DNA, 22 bp, Homo sapiens
aaactctactgaggaaataaga

SEQ ID NO: 7499005 - DNA, 22 bp, Homo sapiens
aaactctactgaggaaataaga

SEQ ID NO: 7499006 - DNA, 22 bp, Homo sapiens
aaactctagctactaggataac

SEQ ID NO: 7499007 - DNA, 22 bp, Homo sapiens
aaactctagctactaggataac

SEQ ID NO: 7499008 - DNA, 22 bp, Homo sapiens
aaactctagctactaggataac

SEQ ID NO: 7499009 - DNA, 22 bp, Homo sapiens
aaactctagctactaggataac

SEQ ID NO: 7499010 - DNA, 22 bp, Homo sapiens
aaaagagaaagtggcaggcttt

SEQ ID NO: 7499011 - DNA, 22 bp, Homo sapiens
aaaagagaaagtggcaggcttt

SEQ ID NO: 7499012 - DNA, 22 bp, Homo sapiens
aaaagaccacctcctggtcgaa

SEQ ID NO: 7499013 - DNA, 22 bp, Homo sapiens
aaaagagaatcctgtacagaga

SEQ ID NO: 7499014 - DNA, 22 bp, Homo sapiens
aaaagagaaagtggcaggcttt

SEQ ID NO: 7499015 - DNA, 22 bp, Homo sapiens
aaaagagaatcctgtacagaga

SEQ ID NO: 7499016 - DNA, 22 bp, Homo sapiens
aaaagagaatcctgtacagaga

SEQ ID NO: 7499017 - DNA, 22 bp, Homo sapiens
aaaagagaatcctgtacagaga

SEQ ID NO: 7499018 - DNA, 22 bp, Homo sapiens
aaaagagaatcctgtacagaga

SEQ ID NO: 7499019 - DNA, 22 bp, Homo sapiens
aaaagagagctgaggagctcca

SEQ ID NO: 7499020 - DNA, 22 bp, Homo sapiens
aaaagagaatcctgtacagaga

SEQ ID NO: 7499021 - DNA, 22 bp, Homo sapiens
aaaagagaatcctgtacagaga

SEQ ID NO: 7499022 - DNA, 22 bp, Homo sapiens
aaaagagaatcctgtacagaga

SEQ ID NO: 7499023 - DNA, 22 bp, Homo sapiens
aaaagagagttgccagtctgta

SEQ ID NO: 7499024 - DNA, 22 bp, Homo sapiens
aaaagagagctgaggagctcca

SEQ ID NO: 7499025 - DNA, 22 bp, Homo sapiens
aaaagagagctgaggagctcca

SEQ ID NO: 7499026 - DNA, 22 bp, Homo sapiens
aaaagagagctgaggagctcca

SEQ ID NO: 7499027 - DNA, 22 bp, Homo sapiens
aaactagattaccactgctaga

SEQ ID NO: 7499028 - DNA, 22 bp, Homo sapiens
aaactagattaccactgctaga

SEQ ID NO: 7499029 - DNA, 22 bp, Homo sapiens
aaactagattaccactgctaga

SEQ ID NO: 7499030 - DNA, 22 bp, Homo sapiens
aaacccagggttttgtcttccc

SEQ ID NO: 7499031 - DNA, 22 bp, Homo sapiens
aaacccagggttttgtcttccc

SEQ ID NO: 7499032 - DNA, 22 bp, Homo sapiens
aaacccagggttttgtcttccc

SEQ ID NO: 7499033 - DNA, 22 bp, Homo sapiens
aaacccagagactagaaagacc

SEQ ID NO: 7499034 - DNA, 22 bp, Homo sapiens
aaacccagagactagaaagacc

SEQ ID NO: 7499035 - DNA, 22 bp, Homo sapiens
aaacccagagactagaaagacc

SEQ ID NO: 7499036 - DNA, 22 bp, Homo sapiens
aaacccagagactagaaagacc

SEQ ID NO: 7499037 - DNA, 18 bp, Homo sapiens
aaacccactcagcgctga

SEQ ID NO: 7499038 - DNA, 22 bp, Homo sapiens
aaaagagagttgccagtctgta

SEQ ID NO: 7499039 - DNA, 22 bp, Homo sapiens
aaaagagagttgccagtctgta

SEQ ID NO: 7499040 - DNA, 22 bp, Homo sapiens
aaaagagagttgccagtctgta

SEQ ID NO: 7499041 - DNA, 22 bp, Homo sapiens
aaaagagagttgccagtctgta

SEQ ID NO: 7499042 - DNA, 22 bp, Homo sapiens
aaaagagcaaacatgtaatagt

SEQ ID NO: 7499043 - DNA, 22 bp, Homo sapiens
aaaagagccacttatgacctca

SEQ ID NO: 7499044 - DNA, 22 bp, Homo sapiens
aaaccatttgaattattactga

SEQ ID NO: 7499045 - DNA, 22 bp, Homo sapiens
aaaagagcaaacatgtaatagt

SEQ ID NO: 7499046 - DNA, 22 bp, Homo sapiens
aaaagagcaaacatgtaatagt

SEQ ID NO: 7499047 - DNA, 22 bp, Homo sapiens
aaaagagagttgccagtctgta

SEQ ID NO: 7499048 - DNA, 22 bp, Homo sapiens
aaaagagcaaacatgtaatagt

SEQ ID NO: 7499049 - DNA, 22 bp, Homo sapiens
aaaagagcaaacatgtaatagt

SEQ ID NO: 7499050 - DNA, 22 bp, Homo sapiens
aaactcaaagtcagatcagaga

SEQ ID NO: 7499051 - DNA, 22 bp, Homo sapiens
aaactaggttctgatttccaag

SEQ ID NO: 7499052 - DNA, 21 bp, Homo sapiens
aaactagcagcaaccatgatc

SEQ ID NO: 7499053 - DNA, 20 bp, Homo sapiens
aaactagattagcagggcag

SEQ ID NO: 7499054 - DNA, 22 bp, Homo sapiens
aaactcaagtctatgaacaagg

SEQ ID NO: 7499055 - DNA, 22 bp, Homo sapiens
aaactcaagtctatgaacaagg

SEQ ID NO: 7499056 - DNA, 22 bp, Homo sapiens
aaactcaagtctatgaacaagg

SEQ ID NO: 7499057 - DNA, 22 bp, Homo sapiens
aaactcaagtctatgaacaagg

SEQ ID NO: 7499058 - DNA, 22 bp, Homo sapiens
aaactcaaattaaactagctta

SEQ ID NO: 7499059 - DNA, 22 bp, Homo sapiens
aaactcaaagtcagatcagaga

SEQ ID NO: 7499060 - DNA, 22 bp, Homo sapiens
aaactcaaagtcagatcagaga

SEQ ID NO: 7499061 - DNA, 22 bp, Homo sapiens
aaactcaaattaaactagctta

SEQ ID NO: 7499062 - DNA, 22 bp, Homo sapiens
aaactcagaaggtacagaaggg

SEQ ID NO: 7499063 - DNA, 22 bp, Homo sapiens
aaactcagaaggtacagaaggg

SEQ ID NO: 7499064 - DNA, 22 bp, Homo sapiens
aaactcagaaggtacagaaggg

SEQ ID NO: 7499065 - DNA, 22 bp, Homo sapiens
aaactcagaaggtacagaaggg

SEQ ID NO: 7499066 - DNA, 22 bp, Homo sapiens
aaactcagaaggtacagaaggg

SEQ ID NO: 7499067 - DNA, 22 bp, Homo sapiens
aaactcagacacagtatctgtt

SEQ ID NO: 7499068 - DNA, 22 bp, Homo sapiens
aaactcaagtttcttaatgtca

SEQ ID NO: 7499069 - DNA, 22 bp, Homo sapiens
aaactcaagtttcttaatgtca

SEQ ID NO: 7499070 - DNA, 22 bp, Homo sapiens
aaactcaagtctatgaacaagg

SEQ ID NO: 7499071 - DNA, 22 bp, Homo sapiens
aaactcaagtctatgaacaagg

SEQ ID NO: 7499072 - DNA, 22 bp, Homo sapiens
aaactcatgccattaatccttt

SEQ ID NO: 7499073 - DNA, 19 bp, Homo sapiens
aaactcatagactcatatt

SEQ ID NO: 7499074 - DNA, 19 bp, Homo sapiens
aaactcatagactcatatt

SEQ ID NO: 7499075 - DNA, 19 bp, Homo sapiens
aaactcatagactcatatt

SEQ ID NO: 7499076 - DNA, 19 bp, Homo sapiens
aaactcatagactcatatt

SEQ ID NO: 7499077 - DNA, 22 bp, Homo sapiens
aaactcagatgtggtgaagacc

SEQ ID NO: 7499078 - DNA, 22 bp, Homo sapiens
aaactcagacacagtatctgtt

SEQ ID NO: 7499079 - DNA, 22 bp, Homo sapiens
aaactcagacacagtatctgtt

SEQ ID NO: 7499080 - DNA, 22 bp, Homo sapiens
aaactcagatgtggtgaagacc

SEQ ID NO: 7499081 - DNA, 22 bp, Homo sapiens
aaaatcctctaattctagaata

SEQ ID NO: 7499082 - DNA, 22 bp, Homo sapiens
aaaatcctctaattctagaata

SEQ ID NO: 7499083 - DNA, 22 bp, Homo sapiens
aaaatcctctaattctagaata

SEQ ID NO: 7499084 - DNA, 22 bp, Homo sapiens
aaaatccacaacgctcatttca

SEQ ID NO: 7499085 - DNA, 22 bp, Homo sapiens
aaaatccacaacgctcatttca

SEQ ID NO: 7499086 - DNA, 22 bp, Homo sapiens
aaaatccacaacgctcatttca

SEQ ID NO: 7499087 - DNA, 23 bp, Homo sapiens
aaaatcattaatttaccctgaaa

SEQ ID NO: 7499088 - DNA, 23 bp, Homo sapiens
aaaatcattaatttaccctgaaa

SEQ ID NO: 7499089 - DNA, 22 bp, Homo sapiens
aaaatcctgctgactcgagatg

SEQ ID NO: 7499090 - DNA, 22 bp, Homo sapiens
aaaatcctgctgactcgagatg

SEQ ID NO: 7499091 - DNA, 22 bp, Homo sapiens
aaaatcctgctgactcgagatg

SEQ ID NO: 7499092 - DNA, 22 bp, Homo sapiens
aaaatcctctaattctagaata

SEQ ID NO: 7499093 - DNA, 22 bp, Homo sapiens
aaaatcctctaattctagaata

SEQ ID NO: 7499094 - DNA, 22 bp, Homo sapiens
aaaatcctctaattctagaata

SEQ ID NO: 7499095 - DNA, 22 bp, Homo sapiens
aaaatcctctaattctagaata

SEQ ID NO: 7499096 - DNA, 22 bp, Homo sapiens
aaagactaaatgaatgagctca

SEQ ID NO: 7499097 - DNA, 22 bp, Homo sapiens
aaagactaaccagttgtcaaaa

SEQ ID NO: 7499098 - DNA, 22 bp, Homo sapiens
aaagactaaccagttgtcaaaa

SEQ ID NO: 7499099 - DNA, 22 bp, Homo sapiens
aaagactaaatgaatgagctca

SEQ ID NO: 7499100 - DNA, 22 bp, Homo sapiens
aaagactaaccagttgtcaaaa

SEQ ID NO: 7499101 - DNA, 22 bp, Homo sapiens
aaagactaaccagttgtcaaaa

SEQ ID NO: 7499102 - DNA, 22 bp, Homo sapiens
aaagactaagaagagtattatt

SEQ ID NO: 7499103 - DNA, 22 bp, Homo sapiens
aaaatcacacaagtagatgggg

SEQ ID NO: 7499104 - DNA, 22 bp, Homo sapiens
aaaatcacacaagtagatgggg

SEQ ID NO: 7499105 - DNA, 22 bp, Homo sapiens
aaaatcacaagcttgggtcact

SEQ ID NO: 7499106 - DNA, 22 bp, Homo sapiens
aaaatcagtacactttattttg

SEQ ID NO: 7499107 - DNA, 22 bp, Homo sapiens
aaaatcagtacactttattttg

SEQ ID NO: 7499108 - DNA, 22 bp, Homo sapiens
aaaatcagtacactttattttg

SEQ ID NO: 7499109 - DNA, 22 bp, Homo sapiens
aaaatcagtacactttattttg

SEQ ID NO: 7499110 - DNA, 22 bp, Homo sapiens
aaaatcagtacactttattttg

SEQ ID NO: 7499111 - DNA, 22 bp, Homo sapiens
aaaatcagtacactttattttg

SEQ ID NO: 7499112 - DNA, 22 bp, Homo sapiens
aaaatcagtacactttattttg

SEQ ID NO: 7499113 - DNA, 21 bp, Homo sapiens
aaaatcaccttaggtcactgg

SEQ ID NO: 7499114 - DNA, 21 bp, Homo sapiens
aaaatcaccttaggtcactgg

SEQ ID NO: 7499115 - DNA, 22 bp, Homo sapiens
aaaatcacacaagtagatgggg

SEQ ID NO: 7499116 - DNA, 22 bp, Homo sapiens
aaagacattagcttagatgtca

SEQ ID NO: 7499117 - DNA, 22 bp, Homo sapiens
aaagacattagcttagatgtca

SEQ ID NO: 7499118 - DNA, 22 bp, Homo sapiens
aaagacattagcttagatgtca

SEQ ID NO: 7499119 - DNA, 22 bp, Homo sapiens
aaagacattagcttagatgtca

SEQ ID NO: 7499120 - DNA, 22 bp, Homo sapiens
aaagacattagcttagatgtca

SEQ ID NO: 7499121 - DNA, 22 bp, Homo sapiens
aaagacattagcttagatgtca

SEQ ID NO: 7499122 - DNA, 22 bp, Homo sapiens
aaagacattagcttagatgtca

SEQ ID NO: 7499123 - DNA, 22 bp, Homo sapiens
aaagacattagcttagatgtca

SEQ ID NO: 7499124 - DNA, 22 bp, Homo sapiens
aaagacattagcttagatgtca

SEQ ID NO: 7499125 - DNA, 22 bp, Homo sapiens
aaagacattagcttagatgtca

SEQ ID NO: 7499126 - DNA, 22 bp, Homo sapiens
aaagacattagcttagatgtca

SEQ ID NO: 7499127 - DNA, 22 bp, Homo sapiens
aaagacattagcttagatgtca

SEQ ID NO: 7499128 - DNA, 22 bp, Homo sapiens
aaagacattagattaacgtaca

SEQ ID NO: 7499129 - DNA, 22 bp, Homo sapiens
aaagacattagattaacgtaca

SEQ ID NO: 7499130 - DNA, 22 bp, Homo sapiens
aaagacatggaactagagatgg

SEQ ID NO: 7499131 - DNA, 22 bp, Homo sapiens
aaagacatggcaagagatgggg

SEQ ID NO: 7499132 - DNA, 22 bp, Homo sapiens
aaagacattagattaacgtaca

SEQ ID NO: 7499133 - DNA, 22 bp, Homo sapiens
aaagacatggcaagagatgggg

SEQ ID NO: 7499134 - DNA, 22 bp, Homo sapiens
aaagaccatgtttacagctagg

SEQ ID NO: 7499135 - DNA, 22 bp, Homo sapiens
aaagaccatgtttacagctagg

SEQ ID NO: 7499136 - DNA, 22 bp, Homo sapiens
aaagacattgaagaaggactta

SEQ ID NO: 7499137 - DNA, 22 bp, Homo sapiens
aaagaccatgtttacagctagg

SEQ ID NO: 7499138 - DNA, 22 bp, Homo sapiens
aaagaccatgtttacagctagg

SEQ ID NO: 7499139 - DNA, 22 bp, Homo sapiens
aaagacattgaagaaggactta

SEQ ID NO: 7499140 - DNA, 22 bp, Homo sapiens
aaagacattgaagaaggactta

SEQ ID NO: 7499141 - DNA, 22 bp, Homo sapiens
aaagacattagcttagatgtca

SEQ ID NO: 7499142 - DNA, 22 bp, Homo sapiens
aaagacattgaagaaggactta

SEQ ID NO: 7499143 - DNA, 22 bp, Homo sapiens
aaagactaaatgaatgagctca

SEQ ID NO: 7499144 - DNA, 22 bp, Homo sapiens
aaagactaaatgaatgagctca

SEQ ID NO: 7499145 - DNA, 22 bp, Homo sapiens
aaagactaaacaaccaatatct

SEQ ID NO: 7499146 - DNA, 22 bp, Homo sapiens
aaagactaaacaaccaatatct

SEQ ID NO: 7499147 - DNA, 22 bp, Homo sapiens
aaagactaaacaaccaatatct

SEQ ID NO: 7499148 - DNA, 22 bp, Homo sapiens
aaagacctgtggtagctctaaa

SEQ ID NO: 7499149 - DNA, 22 bp, Homo sapiens
aaagacctgtggtagctctaaa

SEQ ID NO: 7499150 - DNA, 23 bp, Homo sapiens
aaagacctaggatgagggagacg

SEQ ID NO: 7499151 - DNA, 22 bp, Homo sapiens
aaacaaacaattagttgtgtgg

SEQ ID NO: 7499152 - DNA, 22 bp, Homo sapiens
aaaattttgccctatccttcat

SEQ ID NO: 7499153 - DNA, 22 bp, Homo sapiens
aaacaaacaattagttgtgtgg

SEQ ID NO: 7499154 - DNA, 22 bp, Homo sapiens
aaaatctgcttccttttacaga

SEQ ID NO: 7499155 - DNA, 20 bp, Homo sapiens
aaaatctcccagaaacttat

SEQ ID NO: 7499156 - DNA, 20 bp, Homo sapiens
aaaatctcccagaaacttat

SEQ ID NO: 7499157 - DNA, 22 bp, Homo sapiens
aaaatctcattatcaggaaggg

SEQ ID NO: 7499158 - DNA, 22 bp, Homo sapiens
aaaatctaagtagcgagtaagg

SEQ ID NO: 7499159 - DNA, 20 bp, Homo sapiens
aaaatctcccagaaacttat

SEQ ID NO: 7499160 - DNA, 20 bp, Homo sapiens
aaaatctcccagaaacttat

SEQ ID NO: 7499161 - DNA, 22 bp, Homo sapiens
aaaatctcattatcaggaaggg

SEQ ID NO: 7499162 - DNA, 22 bp, Homo sapiens
aaaatctaagtagcgagtaagg

SEQ ID NO: 7499163 - DNA, 22 bp, Homo sapiens
aaaatctaagtagcgagtaagg

SEQ ID NO: 7499164 - DNA, 22 bp, Homo sapiens
aaaatccttagccgagtgaggt

SEQ ID NO: 7499165 - DNA, 22 bp, Homo sapiens
aaaatctaagtagcgagtaagg

SEQ ID NO: 7499166 - DNA, 22 bp, Homo sapiens
aaacaaggtacacagtaatggt

SEQ ID NO: 7499167 - DNA, 22 bp, Homo sapiens
aaacaagctgcagacaagccat

SEQ ID NO: 7499168 - DNA, 22 bp, Homo sapiens
aaacaaggtacacagtaatggt

SEQ ID NO: 7499169 - DNA, 22 bp, Homo sapiens
aaacaagctgcagacaagccat

SEQ ID NO: 7499170 - DNA, 22 bp, Homo sapiens
aaacaagagtcttgctccacct

SEQ ID NO: 7499171 - DNA, 22 bp, Homo sapiens
aaacaagagtcttgctccacct

SEQ ID NO: 7499172 - DNA, 22 bp, Homo sapiens
aaacaaacaattagttgtgtgg

SEQ ID NO: 7499173 - DNA, 23 bp, Homo sapiens
aaacaagccctaatgaagagtcc

SEQ ID NO: 7499174 - DNA, 22 bp, Homo sapiens
aaacaagtttgtagactagcca

SEQ ID NO: 7499175 - DNA, 22 bp, Homo sapiens
aaacaagtttagaataatgaat

SEQ ID NO: 7499176 - DNA, 22 bp, Homo sapiens
aaacaagtttagaataatgaat

SEQ ID NO: 7499177 - DNA, 22 bp, Homo sapiens
aaacaagtttgtagactagcca

SEQ ID NO: 7499178 - DNA, 22 bp, Homo sapiens
aaacaagtttgtagactagcca

SEQ ID NO: 7499179 - DNA, 22 bp, Homo sapiens
aaacaatccaggaacctgttta

SEQ ID NO: 7499180 - DNA, 22 bp, Homo sapiens
aaacaatccaggaacctgttta

SEQ ID NO: 7499181 - DNA, 22 bp, Homo sapiens
aaacaatccaggaacctgttta

SEQ ID NO: 7499182 - DNA, 22 bp, Homo sapiens
aaacaatgaaattcattcttca

SEQ ID NO: 7499183 - DNA, 22 bp, Homo sapiens
aaacaatgaaattcattcttca

SEQ ID NO: 7499184 - DNA, 22 bp, Homo sapiens
aaacaatgaaattcattcttca

SEQ ID NO: 7499185 - DNA, 22 bp, Homo sapiens
aaacaatgaaattcattcttca

SEQ ID NO: 7499186 - DNA, 22 bp, Homo sapiens
aaacaatgaaattcattcttca

SEQ ID NO: 7499187 - DNA, 22 bp, Homo sapiens
aaacaatgaaattcattcttca

SEQ ID NO: 7499188 - DNA, 22 bp, Homo sapiens
aaacaatgaaatatttttatgg

SEQ ID NO: 7499189 - DNA, 22 bp, Homo sapiens
aaacaatgaaatatttttatgg

SEQ ID NO: 7499190 - DNA, 22 bp, Homo sapiens
aaacaatgaaatatttttatgg

SEQ ID NO: 7499191 - DNA, 22 bp, Homo sapiens
aaacaatccaggaacctgttta

SEQ ID NO: 7499192 - DNA, 22 bp, Homo sapiens
aaacaatgaaatatttttatgg

SEQ ID NO: 7499193 - DNA, 22 bp, Homo sapiens
aaacaatgaaatatttttatgg

SEQ ID NO: 7499194 - DNA, 22 bp, Homo sapiens
aaacaatgaaatatttttatgg

SEQ ID NO: 7499195 - DNA, 23 bp, Homo sapiens
aaacaagtctctcaatggcttgc

SEQ ID NO: 7499196 - DNA, 23 bp, Homo sapiens
aaacaagtctctcaatggcttgc

SEQ ID NO: 7499197 - DNA, 23 bp, Homo sapiens
aaacaagtctctcaatggcttgc

SEQ ID NO: 7499198 - DNA, 23 bp, Homo sapiens
aaacaagtctctcaatggcttgc

SEQ ID NO: 7499199 - DNA, 22 bp, Homo sapiens
aaacaagtcactttatcttgaa

SEQ ID NO: 7499200 - DNA, 22 bp, Homo sapiens
aaacaagtcactttatcttgaa

SEQ ID NO: 7499201 - DNA, 22 bp, Homo sapiens
aaacaagtcactttatcttgaa

SEQ ID NO: 7499202 - DNA, 22 bp, Homo sapiens
aaacaagtcactttatcttgaa

SEQ ID NO: 7499203 - DNA, 22 bp, Homo sapiens
aaacaagtcactttatcttgaa

SEQ ID NO: 7499204 - DNA, 22 bp, Homo sapiens
aaacaagtttagaataatgaat

SEQ ID NO: 7499205 - DNA, 22 bp, Homo sapiens
aaacaagtttagaataatgaat

SEQ ID NO: 7499206 - DNA, 22 bp, Homo sapiens
aaacaagtttagaataatgaat

SEQ ID NO: 7499207 - DNA, 22 bp, Homo sapiens
aaacaagtttagaataatgaat

SEQ ID NO: 7499208 - DNA, 22 bp, Homo sapiens
aaacaagtgtaaactagtctgt

SEQ ID NO: 7499209 - DNA, 22 bp, Homo sapiens
aaacaagtgtaaactagtctgt

SEQ ID NO: 7499210 - DNA, 22 bp, Homo sapiens
aaacaagtgtaaactagtctgt

SEQ ID NO: 7499211 - DNA, 22 bp, Homo sapiens
aaactgagattgctgctgtctg

SEQ ID NO: 7499212 - DNA, 22 bp, Homo sapiens
aaactgaggaacaaggaaggat

SEQ ID NO: 7499213 - DNA, 22 bp, Homo sapiens
aaactgagaccgaaaggggtag

SEQ ID NO: 7499214 - DNA, 16 bp, Homo sapiens
aaactgacggcatctg

SEQ ID NO: 7499215 - DNA, 21 bp, Homo sapiens
aaactgaccttgcctgagaca

SEQ ID NO: 7499216 - DNA, 22 bp, Homo sapiens
aaactgaggaacaaggaaggat

SEQ ID NO: 7499217 - DNA, 22 bp, Homo sapiens
aaactgaggaacaaggaaggat

SEQ ID NO: 7499218 - DNA, 21 bp, Homo sapiens
aaactgaggagatgaggacta

SEQ ID NO: 7499219 - DNA, 22 bp, Homo sapiens
aaactgaggagttagactaggg

SEQ ID NO: 7499220 - DNA, 22 bp, Homo sapiens
aaactgaggagttagactaggg

SEQ ID NO: 7499221 - DNA, 22 bp, Homo sapiens
aaactgaggagttagactaggg

SEQ ID NO: 7499222 - DNA, 22 bp, Homo sapiens
aaactgaggagttagactaggg

SEQ ID NO: 7499223 - DNA, 22 bp, Homo sapiens
aaactgaggagttagactaggg

SEQ ID NO: 7499224 - DNA, 22 bp, Homo sapiens
aaactgaggcccagagaggcag

SEQ ID NO: 7499225 - DNA, 22 bp, Homo sapiens
aaactgaggcccagagaggcag

SEQ ID NO: 7499226 - DNA, 22 bp, Homo sapiens
aaactgaggctcccgagggtgt

SEQ ID NO: 7499227 - DNA, 21 bp, Homo sapiens
aaactgaggcttcaagcagtg

SEQ ID NO: 7499228 - DNA, 21 bp, Homo sapiens
aaactgaggcttcaagcagtg

SEQ ID NO: 7499229 - DNA, 21 bp, Homo sapiens
aaactgaccttgcctgagaca

SEQ ID NO: 7499230 - DNA, 21 bp, Homo sapiens
aaactgaccttgcctgagaca

SEQ ID NO: 7499231 - DNA, 21 bp, Homo sapiens
aaactgaccttgcctgagaca

SEQ ID NO: 7499232 - DNA, 21 bp, Homo sapiens
aaactgaccttgcctgagaca

SEQ ID NO: 7499233 - DNA, 22 bp, Homo sapiens
aaactgaattcccaagggcatg

SEQ ID NO: 7499234 - DNA, 22 bp, Homo sapiens
aaactgacaatctcagtcctat

SEQ ID NO: 7499235 - DNA, 22 bp, Homo sapiens
aaactgaattcccaagggcatg

SEQ ID NO: 7499236 - DNA, 22 bp, Homo sapiens
aaactgaattcccaagggcatg

SEQ ID NO: 7499237 - DNA, 22 bp, Homo sapiens
aaactgaattcccaagggcatg

SEQ ID NO: 7499238 - DNA, 22 bp, Homo sapiens
aaactgaattcccaagggcatg

SEQ ID NO: 7499239 - DNA, 22 bp, Homo sapiens
aaactgaattcaagtatccagt

SEQ ID NO: 7499240 - DNA, 22 bp, Homo sapiens
aaactgaattcaagtatccagt

SEQ ID NO: 7499241 - DNA, 22 bp, Homo sapiens
aaactgaagttctggaggggta

SEQ ID NO: 7499242 - DNA, 22 bp, Homo sapiens
aaactgaagtagattctgaaat

SEQ ID NO: 7499243 - DNA, 22 bp, Homo sapiens
aaactgaagtagattctgaaat

SEQ ID NO: 7499244 - DNA, 22 bp, Homo sapiens
aaactgaagtagattctgaaat

SEQ ID NO: 7499245 - DNA, 22 bp, Homo sapiens
aaactgaagccttggagtgaca

SEQ ID NO: 7499246 - DNA, 22 bp, Homo sapiens
aaactgaagagctttttgacac

SEQ ID NO: 7499247 - DNA, 22 bp, Homo sapiens
aaactgaagccttggagtgaca

SEQ ID NO: 7499248 - DNA, 22 bp, Homo sapiens
aaactgaaacatcatcatgttg

SEQ ID NO: 7499249 - DNA, 22 bp, Homo sapiens
aaactgaaacatcatcatgttg

SEQ ID NO: 7499250 - DNA, 17 bp, Homo sapiens
aaactgaaaaattcact

SEQ ID NO: 7499251 - DNA, 22 bp, Homo sapiens
aaactgaaacatcatcatgttg

SEQ ID NO: 7499252 - DNA, 21 bp, Homo sapiens
aaactgaagagacaggaactt

SEQ ID NO: 7499253 - DNA, 21 bp, Homo sapiens
aaactgaagagacaggaactt

SEQ ID NO: 7499254 - DNA, 21 bp, Homo sapiens
aaactgaagagacaggaactt

SEQ ID NO: 7499255 - DNA, 21 bp, Homo sapiens
aaactgaagagacaggaactt

SEQ ID NO: 7499256 - DNA, 21 bp, Homo sapiens
aaactgaagagacaggaactt

SEQ ID NO: 7499257 - DNA, 22 bp, Homo sapiens
aaactgaaacatcatcatgttg

SEQ ID NO: 7499258 - DNA, 17 bp, Homo sapiens
aaactgaaaaattcact

SEQ ID NO: 7499259 - DNA, 17 bp, Homo sapiens
aaactgaaaaattcact

SEQ ID NO: 7499260 - DNA, 17 bp, Homo sapiens
aaactgaaaaattcact

SEQ ID NO: 7499261 - DNA, 22 bp, Homo sapiens
aaactcttttgcatattagagg

SEQ ID NO: 7499262 - DNA, 22 bp, Homo sapiens
aaactctttccacgattacttt

SEQ ID NO: 7499263 - DNA, 22 bp, Homo sapiens
aaactcttttgcatattagagg

SEQ ID NO: 7499264 - DNA, 17 bp, Homo sapiens
aaactgaaaaattcact

SEQ ID NO: 7499265 - DNA, 17 bp, Homo sapiens
aaactgaaaaattcact

SEQ ID NO: 7499266 - DNA, 17 bp, Homo sapiens
aaactgaaaaattcact

SEQ ID NO: 7499267 - DNA, 17 bp, Homo sapiens
aaactgaaaaattcact

SEQ ID NO: 7499268 - DNA, 22 bp, Homo sapiens
aaactctgtagctaaacataat

SEQ ID NO: 7499269 - DNA, 22 bp, Homo sapiens
aaactctggagatgtttatgca

SEQ ID NO: 7499270 - DNA, 22 bp, Homo sapiens
aaactctggagatgtttatgca

SEQ ID NO: 7499271 - DNA, 22 bp, Homo sapiens
aaactctggagatgtttatgca

SEQ ID NO: 7499272 - DNA, 22 bp, Homo sapiens
aaactctgttgagataatattt

SEQ ID NO: 7499273 - DNA, 22 bp, Homo sapiens
aaactctgttgagataatattt

SEQ ID NO: 7499274 - DNA, 22 bp, Homo sapiens
aaactctgttgagataatattt

SEQ ID NO: 7499275 - DNA, 22 bp, Homo sapiens
aaactcttcatatacatatgct

SEQ ID NO: 7499276 - DNA, 22 bp, Homo sapiens
aaactcttcatatacatatgct

SEQ ID NO: 7499277 - DNA, 22 bp, Homo sapiens
aaactctgttgagataatattt

SEQ ID NO: 7499278 - DNA, 22 bp, Homo sapiens
aaactcttcatatacatatgct

SEQ ID NO: 7499279 - DNA, 22 bp, Homo sapiens
aaactctttccacgattacttt

SEQ ID NO: 7499280 - DNA, 22 bp, Homo sapiens
aaactcttggtcaacatgagga

SEQ ID NO: 7499281 - DNA, 22 bp, Homo sapiens
aaagaatagcctttgtccaaat

SEQ ID NO: 7499282 - DNA, 22 bp, Homo sapiens
aaagaatagcctttgtccaaat

SEQ ID NO: 7499283 - DNA, 22 bp, Homo sapiens
aaagaatagcctttgtccaaat

SEQ ID NO: 7499284 - DNA, 22 bp, Homo sapiens
aaagaatagttaagtttagggc

SEQ ID NO: 7499285 - DNA, 22 bp, Homo sapiens
aaagaatagttaagtttagggc

SEQ ID NO: 7499286 - DNA, 22 bp, Homo sapiens
aaagaatagttaagtttagggc

SEQ ID NO: 7499287 - DNA, 22 bp, Homo sapiens
aaagaatcacatccttcagcaa

SEQ ID NO: 7499288 - DNA, 22 bp, Homo sapiens
aaagaatcacatccttcagcaa

SEQ ID NO: 7499289 - DNA, 22 bp, Homo sapiens
aaagaatagttaagtttagggc

SEQ ID NO: 7499290 - DNA, 22 bp, Homo sapiens
aaagaatcagaagtctcaaaca

SEQ ID NO: 7499291 - DNA, 22 bp, Homo sapiens
aaagaatcagaagtctcaaaca

SEQ ID NO: 7499292 - DNA, 22 bp, Homo sapiens
aaagaatactccttttgccttg

SEQ ID NO: 7499293 - DNA, 22 bp, Homo sapiens
aaagaatactccttttgccttg

SEQ ID NO: 7499294 - DNA, 22 bp, Homo sapiens
aaagaatactccttttgccttg

SEQ ID NO: 7499295 - DNA, 22 bp, Homo sapiens
aaagaatactccttttgccttg

SEQ ID NO: 7499296 - DNA, 22 bp, Homo sapiens
aaagaatactccttttgccttg

SEQ ID NO: 7499297 - DNA, 22 bp, Homo sapiens
aaagaatactccttttgccttg

SEQ ID NO: 7499298 - DNA, 22 bp, Homo sapiens
aaagaatagcctttgtccaaat

SEQ ID NO: 7499299 - DNA, 22 bp, Homo sapiens
aaagaatagcctttgtccaaat

SEQ ID NO: 7499300 - DNA, 22 bp, Homo sapiens
aaagaatagcctttgtccaaat

SEQ ID NO: 7499301 - DNA, 22 bp, Homo sapiens
aaagaatagcctttgtccaaat

SEQ ID NO: 7499302 - DNA, 22 bp, Homo sapiens
aaagaatagcctttgtccaaat

SEQ ID NO: 7499303 - DNA, 22 bp, Homo sapiens
aaagaatagcctttgtccaaat

SEQ ID NO: 7499304 - DNA, 22 bp, Homo sapiens
aaagaatgcagtgccttccagc

SEQ ID NO: 7499305 - DNA, 22 bp, Homo sapiens
aaagaatctatatatcaccacc

SEQ ID NO: 7499306 - DNA, 21 bp, Homo sapiens
aaagaatcatgggtaatttca

SEQ ID NO: 7499307 - DNA, 22 bp, Homo sapiens
aaagaatcgtgtgtagtttgaa

SEQ ID NO: 7499308 - DNA, 22 bp, Homo sapiens
aaagaatctatatatcaccacc

SEQ ID NO: 7499309 - DNA, 22 bp, Homo sapiens
aaagaatttgtacaccctacta

SEQ ID NO: 7499310 - DNA, 22 bp, Homo sapiens
aaagaatttgtacaccctacta

SEQ ID NO: 7499311 - DNA, 22 bp, Homo sapiens
aaagaatgtctgaacagctggc

SEQ ID NO: 7499312 - DNA, 22 bp, Homo sapiens
aaagaatgtctgaacagctggc

SEQ ID NO: 7499313 - DNA, 22 bp, Homo sapiens
aaagaatgtctgaacagctggc

SEQ ID NO: 7499314 - DNA, 22 bp, Homo sapiens
aaagacacaaatgtagaccaaa

SEQ ID NO: 7499315 - DNA, 22 bp, Homo sapiens
aaagacacaaatgtagaccaaa

SEQ ID NO: 7499316 - DNA, 22 bp, Homo sapiens
aaagacacaaatgtagaccaaa

SEQ ID NO: 7499317 - DNA, 22 bp, Homo sapiens
aaagacacaaatgtagaccaaa

SEQ ID NO: 7499318 - DNA, 22 bp, Homo sapiens
aaagacacaaatgtagaccaaa

SEQ ID NO: 7499319 - DNA, 22 bp, Homo sapiens
aaagaataccctgggtcataaa

SEQ ID NO: 7499320 - DNA, 22 bp, Homo sapiens
aaagaatactccttttgccttg

SEQ ID NO: 7499321 - DNA, 22 bp, Homo sapiens
aaagaataccctgggtcataaa

SEQ ID NO: 7499322 - DNA, 22 bp, Homo sapiens
aaagaataccctgggtcataaa

SEQ ID NO: 7499323 - DNA, 22 bp, Homo sapiens
aaagaataccctgggtcataaa

SEQ ID NO: 7499324 - DNA, 22 bp, Homo sapiens
aaagaataccctgggtcataaa

SEQ ID NO: 7499325 - DNA, 22 bp, Homo sapiens
aaagaataccctgggtcataaa

SEQ ID NO: 7499326 - DNA, 22 bp, Homo sapiens
aaagaataccctgggtcataaa

SEQ ID NO: 7499327 - DNA, 22 bp, Homo sapiens
aaagaataccctgggtcataaa

SEQ ID NO: 7499328 - DNA, 22 bp, Homo sapiens
aaagaataccctgggtcataaa

SEQ ID NO: 7499329 - DNA, 22 bp, Homo sapiens
aaagaagtgttgaatttgcaag

SEQ ID NO: 7499330 - DNA, 22 bp, Homo sapiens
aaagaagtgttgaatttgcaag

SEQ ID NO: 7499331 - DNA, 22 bp, Homo sapiens
aaagaagtgttgaatttgcaag

SEQ ID NO: 7499332 - DNA, 22 bp, Homo sapiens
aaagaactacctgtatgatatt

SEQ ID NO: 7499333 - DNA, 22 bp, Homo sapiens
aaagaagtgttgaatttgcaag

SEQ ID NO: 7499334 - DNA, 22 bp, Homo sapiens
aaagaagtgttgaatttgcaag

SEQ ID NO: 7499335 - DNA, 22 bp, Homo sapiens
aaagaagtgttgaatttgcaag

SEQ ID NO: 7499336 - DNA, 22 bp, Homo sapiens
aaagaagtgttgaatttgcaag

SEQ ID NO: 7499337 - DNA, 22 bp, Homo sapiens
aaagaaggtagggctggtgact

SEQ ID NO: 7499338 - DNA, 22 bp, Homo sapiens
aaagaaggtagggctggtgact

SEQ ID NO: 7499339 - DNA, 22 bp, Homo sapiens
aaagaactacctgtatgatatt

SEQ ID NO: 7499340 - DNA, 22 bp, Homo sapiens
aaagaactacctgtatgatatt

SEQ ID NO: 7499341 - DNA, 22 bp, Homo sapiens
aaagaactacctgtatgatatt

SEQ ID NO: 7499342 - DNA, 22 bp, Homo sapiens
aaagaacatcggagtgggcggg

SEQ ID NO: 7499343 - DNA, 22 bp, Homo sapiens
aaagaacatcggagtgggcggg

SEQ ID NO: 7499344 - DNA, 22 bp, Homo sapiens
aaagaactaatgtgcaaggttt

SEQ ID NO: 7499345 - DNA, 22 bp, Homo sapiens
aaactgataaaataagtacatt

SEQ ID NO: 7499346 - DNA, 22 bp, Homo sapiens
aaactgattttaacattgatat

SEQ ID NO: 7499347 - DNA, 22 bp, Homo sapiens
aaactgcaatgacaggtaggag

SEQ ID NO: 7499348 - DNA, 21 bp, Homo sapiens
aaagaacaggcagatgttctt

SEQ ID NO: 7499349 - DNA, 22 bp, Homo sapiens
aaactgataaaataagtacatt

SEQ ID NO: 7499350 - DNA, 22 bp, Homo sapiens
aaactgataaaataagtacatt

SEQ ID NO: 7499351 - DNA, 22 bp, Homo sapiens
aaactgagtggcttataaacaa

SEQ ID NO: 7499352 - DNA, 22 bp, Homo sapiens
aaactgagtggcttataaacaa

SEQ ID NO: 7499353 - DNA, 21 bp, Homo sapiens
aaactgaggcttcaagcagtg

SEQ ID NO: 7499354 - DNA, 23 bp, Homo sapiens
aaactgaggcttgatgaggcggt

SEQ ID NO: 7499355 - DNA, 22 bp, Homo sapiens
aaagagttctatgatctttcca

SEQ ID NO: 7499356 - DNA, 22 bp, Homo sapiens
aaagagttccaagtcattttat

SEQ ID NO: 7499357 - DNA, 22 bp, Homo sapiens
aaagagttctatgatctttcca

SEQ ID NO: 7499358 - DNA, 22 bp, Homo sapiens
aaagagttctatgatctttcca

SEQ ID NO: 7499359 - DNA, 22 bp, Homo sapiens
aaagagttccaagtcattttat

SEQ ID NO: 7499360 - DNA, 22 bp, Homo sapiens
aaagagttccaagtcattttat

SEQ ID NO: 7499361 - DNA, 22 bp, Homo sapiens
aaagagttaagagtcttaagct

SEQ ID NO: 7499362 - DNA, 22 bp, Homo sapiens
aaagagtctggcgttttaatgg

SEQ ID NO: 7499363 - DNA, 22 bp, Homo sapiens
aaagagtctggcgttttaatgg

SEQ ID NO: 7499364 - DNA, 22 bp, Homo sapiens
aaagagtctggcgttttaatgg

SEQ ID NO: 7499365 - DNA, 22 bp, Homo sapiens
aaagaggggactgttaattcca

SEQ ID NO: 7499366 - DNA, 22 bp, Homo sapiens
aaagagggacaggcgcagacac

SEQ ID NO: 7499367 - DNA, 22 bp, Homo sapiens
aaagagggacaggcgcagacac

SEQ ID NO: 7499368 - DNA, 22 bp, Homo sapiens
aaagagggacaggcgcagacac

SEQ ID NO: 7499369 - DNA, 22 bp, Homo sapiens
aaagagggacaggcgcagacac

SEQ ID NO: 7499370 - DNA, 22 bp, Homo sapiens
aaagaggctcaaggtgggccag

SEQ ID NO: 7499371 - DNA, 22 bp, Homo sapiens
aaagagggacaggcgcagacac

SEQ ID NO: 7499372 - DNA, 22 bp, Homo sapiens
aaagagtcaaaggcatgtctct

SEQ ID NO: 7499373 - DNA, 22 bp, Homo sapiens
aaagagtcaaaggcatgtctct

SEQ ID NO: 7499374 - DNA, 22 bp, Homo sapiens
aaagaggggactgttaattcca

SEQ ID NO: 7499375 - DNA, 21 bp, Homo sapiens
aaagaggttaatattgtaagt

SEQ ID NO: 7499376 - DNA, 21 bp, Homo sapiens
aaagaggttaatattgtaagt

SEQ ID NO: 7499377 - DNA, 21 bp, Homo sapiens
aaagaggttaatattgtaagt

SEQ ID NO: 7499378 - DNA, 21 bp, Homo sapiens
aaagaggttaatattgtaagt

SEQ ID NO: 7499379 - DNA, 22 bp, Homo sapiens
aaattaagagtaactctgtaga

SEQ ID NO: 7499380 - DNA, 22 bp, Homo sapiens
aaattaagagtaactctgtaga

SEQ ID NO: 7499381 - DNA, 22 bp, Homo sapiens
aaattaagagtaactctgtaga

SEQ ID NO: 7499382 - DNA, 22 bp, Homo sapiens
aaagagttgttgtataacagga

SEQ ID NO: 7499383 - DNA, 22 bp, Homo sapiens
aaagagttgttgtataacagga

SEQ ID NO: 7499384 - DNA, 22 bp, Homo sapiens
aaagagttgttgtataacagga

SEQ ID NO: 7499385 - DNA, 22 bp, Homo sapiens
aaagagttggactttctcaggc

SEQ ID NO: 7499386 - DNA, 22 bp, Homo sapiens
aaagagttggactttctcaggc

SEQ ID NO: 7499387 - DNA, 22 bp, Homo sapiens
aaagagttggactttctcaggc

SEQ ID NO: 7499388 - DNA, 22 bp, Homo sapiens
aaagagttgaggcagttatcca

SEQ ID NO: 7499389 - DNA, 22 bp, Homo sapiens
aaagagttccaagtcattttat

SEQ ID NO: 7499390 - DNA, 22 bp, Homo sapiens
aaagagttcttgtagctttgag

SEQ ID NO: 7499391 - DNA, 22 bp, Homo sapiens
aaagagttgaggcagttatcca

SEQ ID NO: 7499392 - DNA, 22 bp, Homo sapiens
aaagagttgaggcagttatcca

SEQ ID NO: 7499393 - DNA, 22 bp, Homo sapiens
aaattactttacactttcatct

SEQ ID NO: 7499394 - DNA, 20 bp, Homo sapiens
aaattactgccacacatttc

SEQ ID NO: 7499395 - DNA, 22 bp, Homo sapiens
aaattagaaatactttcaaagc

SEQ ID NO: 7499396 - DNA, 22 bp, Homo sapiens
aaattagaaatactttcaaagc

SEQ ID NO: 7499397 - DNA, 22 bp, Homo sapiens
aaattagaaatactttcaaagc

SEQ ID NO: 7499398 - DNA, 22 bp, Homo sapiens
aaattagaaatactttcaaagc

SEQ ID NO: 7499399 - DNA, 22 bp, Homo sapiens
aaattagaaatactttcaaagc

SEQ ID NO: 7499400 - DNA, 22 bp, Homo sapiens
aaattagaaatactttcaaagc

SEQ ID NO: 7499401 - DNA, 22 bp, Homo sapiens
aaattagaagtgctcaggaata

SEQ ID NO: 7499402 - DNA, 22 bp, Homo sapiens
aaattagaagtgctcaggaata

SEQ ID NO: 7499403 - DNA, 22 bp, Homo sapiens
aaattagaccagggctcctgga

SEQ ID NO: 7499404 - DNA, 22 bp, Homo sapiens
aaattagaccagggctcctgga

SEQ ID NO: 7499405 - DNA, 20 bp, Homo sapiens
aaattactgccacacatttc

SEQ ID NO: 7499406 - DNA, 20 bp, Homo sapiens
aaattactgccacacatttc

SEQ ID NO: 7499407 - DNA, 22 bp, Homo sapiens
aaattaccattgtaaagtattt

SEQ ID NO: 7499408 - DNA, 20 bp, Homo sapiens
aaattactgccacacatttc

SEQ ID NO: 7499409 - DNA, 22 bp, Homo sapiens
aaattacagccttgggtagctt

SEQ ID NO: 7499410 - DNA, 22 bp, Homo sapiens
aaattaccattgtaaagtattt

SEQ ID NO: 7499411 - DNA, 22 bp, Homo sapiens
aaattaccattgtaaagtattt

SEQ ID NO: 7499412 - DNA, 22 bp, Homo sapiens
aaattacagccttgggtagctt

SEQ ID NO: 7499413 - DNA, 22 bp, Homo sapiens
aaattacagccttgggtagctt

SEQ ID NO: 7499414 - DNA, 22 bp, Homo sapiens
aaattaagggtgagaagagttg

SEQ ID NO: 7499415 - DNA, 22 bp, Homo sapiens
aaattaagggtgagaagagttg

SEQ ID NO: 7499416 - DNA, 22 bp, Homo sapiens
aaattaagggtgagaagagttg

SEQ ID NO: 7499417 - DNA, 22 bp, Homo sapiens
aaattaagggtgagaagagttg

SEQ ID NO: 7499418 - DNA, 22 bp, Homo sapiens
aaattacagatcaccaatgcat

SEQ ID NO: 7499419 - DNA, 22 bp, Homo sapiens
aaattacagatcaccaatgcat

SEQ ID NO: 7499420 - DNA, 22 bp, Homo sapiens
aaattacagatcaccaatgcat

SEQ ID NO: 7499421 - DNA, 22 bp, Homo sapiens
aaattacagatcaccaatgcat

SEQ ID NO: 7499422 - DNA, 22 bp, Homo sapiens
aaattacagatcaccaatgcat

SEQ ID NO: 7499423 - DNA, 21 bp, Homo sapiens
aaagagcttttgtgctagtta

SEQ ID NO: 7499424 - DNA, 21 bp, Homo sapiens
aaagagcttttgtgctagtta

SEQ ID NO: 7499425 - DNA, 22 bp, Homo sapiens
aaagagcatggaaagttcagga

SEQ ID NO: 7499426 - DNA, 22 bp, Homo sapiens
aaagagcatggaaagttcagga

SEQ ID NO: 7499427 - DNA, 22 bp, Homo sapiens
aaagagcatggaaagttcagga

SEQ ID NO: 7499428 - DNA, 22 bp, Homo sapiens
aaagagcatggaaagttcagga

SEQ ID NO: 7499429 - DNA, 22 bp, Homo sapiens
aaagagcatggaaagttcagga

SEQ ID NO: 7499430 - DNA, 22 bp, Homo sapiens
aaagagcatggaaagttcagga

SEQ ID NO: 7499431 - DNA, 22 bp, Homo sapiens
aaagagctttccacactagtca

SEQ ID NO: 7499432 - DNA, 22 bp, Homo sapiens
aaatgcagcagctaattgaaaa

SEQ ID NO: 7499433 - DNA, 22 bp, Homo sapiens
aaatgcagcagctaattgaaaa

SEQ ID NO: 7499434 - DNA, 22 bp, Homo sapiens
aaatgcagcagctaattgaaaa

SEQ ID NO: 7499435 - DNA, 22 bp, Homo sapiens
aaatgcagcagctaattgaaaa

SEQ ID NO: 7499436 - DNA, 22 bp, Homo sapiens
aaagagcaccctcaatgtctga

SEQ ID NO: 7499437 - DNA, 22 bp, Homo sapiens
aaagagcaccctcaatgtctga

SEQ ID NO: 7499438 - DNA, 22 bp, Homo sapiens
aaagagcaccctcaatgtctga

SEQ ID NO: 7499439 - DNA, 22 bp, Homo sapiens
aaatgcagcctagctcagtttt

SEQ ID NO: 7499440 - DNA, 22 bp, Homo sapiens
aaagaggaaccaagagcacgtg

SEQ ID NO: 7499441 - DNA, 22 bp, Homo sapiens
aaagaggatggagtagtcagct

SEQ ID NO: 7499442 - DNA, 22 bp, Homo sapiens
aaagaggatggagtagtcagct

SEQ ID NO: 7499443 - DNA, 22 bp, Homo sapiens
aaagaggaaccaagagcacgtg

SEQ ID NO: 7499444 - DNA, 22 bp, Homo sapiens
aaagaggaaccaagagcacgtg

SEQ ID NO: 7499445 - DNA, 22 bp, Homo sapiens
aaagaggaaccaagagcacgtg

SEQ ID NO: 7499446 - DNA, 22 bp, Homo sapiens
aaagaggaaccaagagcacgtg

SEQ ID NO: 7499447 - DNA, 22 bp, Homo sapiens
aaagaggatggagtagtcagct

SEQ ID NO: 7499448 - DNA, 22 bp, Homo sapiens
aaagaggcaatcaatgtagcaa

SEQ ID NO: 7499449 - DNA, 22 bp, Homo sapiens
aaagaggcaatcaatgtagcaa

SEQ ID NO: 7499450 - DNA, 22 bp, Homo sapiens
aaagaggcaatcaatgtagcaa

SEQ ID NO: 7499451 - DNA, 22 bp, Homo sapiens
aaagaggcaggtgttactggaa

SEQ ID NO: 7499452 - DNA, 22 bp, Homo sapiens
aaagaggcaggtgttactggaa

SEQ ID NO: 7499453 - DNA, 22 bp, Homo sapiens
aaagaggctcaaggtgggccag

SEQ ID NO: 7499454 - DNA, 22 bp, Homo sapiens
aaagaggctcaaggtgggccag

SEQ ID NO: 7499455 - DNA, 22 bp, Homo sapiens
aaatgcactctgcttctgtgac

SEQ ID NO: 7499456 - DNA, 22 bp, Homo sapiens
aaatgcaccttgctgtgagact

SEQ ID NO: 7499457 - DNA, 22 bp, Homo sapiens
aaatgcactctgcttctgtgac

SEQ ID NO: 7499458 - DNA, 22 bp, Homo sapiens
aaatgcactctgcttctgtgac

SEQ ID NO: 7499459 - DNA, 22 bp, Homo sapiens
aaatgcactgaacacatgttgt

SEQ ID NO: 7499460 - DNA, 22 bp, Homo sapiens
aaatgcactctgcttctgtgac

SEQ ID NO: 7499461 - DNA, 22 bp, Homo sapiens
aaatgcactgaacacatgttgt

SEQ ID NO: 7499462 - DNA, 22 bp, Homo sapiens
aaatgcactgaacacatgttgt

SEQ ID NO: 7499463 - DNA, 22 bp, Homo sapiens
aaatgcactctgcttctgtgac

SEQ ID NO: 7499464 - DNA, 22 bp, Homo sapiens
aaagacacaaatgtagaccaaa

SEQ ID NO: 7499465 - DNA, 22 bp, Homo sapiens
aaatgcacgctacccagctaga

SEQ ID NO: 7499466 - DNA, 22 bp, Homo sapiens
aaatgcacgctacccagctaga

SEQ ID NO: 7499467 - DNA, 22 bp, Homo sapiens
aaatgcacgctacccagctaga

SEQ ID NO: 7499468 - DNA, 22 bp, Homo sapiens
aaatgcaccttgctgtgagact

SEQ ID NO: 7499469 - DNA, 22 bp, Homo sapiens
aaatgcaccttgctgtgagact

SEQ ID NO: 7499470 - DNA, 22 bp, Homo sapiens
aaatgcagaatctcagacccca

SEQ ID NO: 7499471 - DNA, 22 bp, Homo sapiens
aaatgcagaatgatttcatcta

SEQ ID NO: 7499472 - DNA, 22 bp, Homo sapiens
aaatgcagaatgatttcatcta

SEQ ID NO: 7499473 - DNA, 22 bp, Homo sapiens
aaatgcagaatgatttcatcta

SEQ ID NO: 7499474 - DNA, 22 bp, Homo sapiens
aaatgcagacagcttcacacac

SEQ ID NO: 7499475 - DNA, 22 bp, Homo sapiens
aaatgcactgaatattccaaat

SEQ ID NO: 7499476 - DNA, 22 bp, Homo sapiens
aaatgcactgaacacatgttgt

SEQ ID NO: 7499477 - DNA, 22 bp, Homo sapiens
aaatgcactgaacacatgttgt

SEQ ID NO: 7499478 - DNA, 22 bp, Homo sapiens
aaatgcactgaacacatgttgt

SEQ ID NO: 7499479 - DNA, 22 bp, Homo sapiens
aaatgcactgaacacatgttgt

SEQ ID NO: 7499480 - DNA, 22 bp, Homo sapiens
aaatgcactgaacacatgttgt

SEQ ID NO: 7499481 - DNA, 22 bp, Homo sapiens
aaatgcagattgtcattcagga

SEQ ID NO: 7499482 - DNA, 22 bp, Homo sapiens
aaatgcagattcttaggcccca

SEQ ID NO: 7499483 - DNA, 22 bp, Homo sapiens
aaatgcactgaatattccaaat

SEQ ID NO: 7499484 - DNA, 22 bp, Homo sapiens
aaatgcagattgtcattcagga

SEQ ID NO: 7499485 - DNA, 22 bp, Homo sapiens
aaatgcagattgtcattcagga

SEQ ID NO: 7499486 - DNA, 22 bp, Homo sapiens
aaatgcagattgtcattcagga

SEQ ID NO: 7499487 - DNA, 22 bp, Homo sapiens
aaatgcagcagctaattgaaaa

SEQ ID NO: 7499488 - DNA, 22 bp, Homo sapiens
aaatgcagcagctaattgaaaa

SEQ ID NO: 7499489 - DNA, 22 bp, Homo sapiens
aaatgcagattttgatgcagca

SEQ ID NO: 7499490 - DNA, 22 bp, Homo sapiens
aaatgcagattttgatgcagca

SEQ ID NO: 7499491 - DNA, 22 bp, Homo sapiens
aaatgcagattgtcattcagga

SEQ ID NO: 7499492 - DNA, 22 bp, Homo sapiens
aaatgcagattgtcattcagga

SEQ ID NO: 7499493 - DNA, 22 bp, Homo sapiens
aaatgcagattttgatgcagca

SEQ ID NO: 7499494 - DNA, 22 bp, Homo sapiens
aaatgcagatccctgaatctca

SEQ ID NO: 7499495 - DNA, 22 bp, Homo sapiens
aaatgcagatccctgaatctca

SEQ ID NO: 7499496 - DNA, 22 bp, Homo sapiens
aaatgcagatccctgaatctca

SEQ ID NO: 7499497 - DNA, 22 bp, Homo sapiens
aaatgcagattcatgagcccca

SEQ ID NO: 7499498 - DNA, 22 bp, Homo sapiens
aaatgcagattcctaggcccca

SEQ ID NO: 7499499 - DNA, 22 bp, Homo sapiens
aaatgcagatccctgaatctca

SEQ ID NO: 7499500 - DNA, 22 bp, Homo sapiens
aaatgcagatccctgaatctca

SEQ ID NO: 7499501 - DNA, 22 bp, Homo sapiens
aaatgcagatccctgaatctca

SEQ ID NO: 7499502 - DNA, 22 bp, Homo sapiens
aaatgcagatccctgaatctca

SEQ ID NO: 7499503 - DNA, 22 bp, Homo sapiens
aaatgcagatccctgaatctca

SEQ ID NO: 7499504 - DNA, 22 bp, Homo sapiens
aaagttcagtgccttctataca

SEQ ID NO: 7499505 - DNA, 22 bp, Homo sapiens
aaagttcagtgccttctataca

SEQ ID NO: 7499506 - DNA, 22 bp, Homo sapiens
aaagttcagtgccttctataca

SEQ ID NO: 7499507 - DNA, 22 bp, Homo sapiens
aaagttcagtgccttctataca

SEQ ID NO: 7499508 - DNA, 18 bp, Homo sapiens
aaagttcagggagagttg

SEQ ID NO: 7499509 - DNA, 22 bp, Homo sapiens
aaagttcagattagactcaaga

SEQ ID NO: 7499510 - DNA, 18 bp, Homo sapiens
aaagttcagggagagttg

SEQ ID NO: 7499511 - DNA, 22 bp, Homo sapiens
aaagttcagtgccttctataca

SEQ ID NO: 7499512 - DNA, 22 bp, Homo sapiens
aaagttcagtgccttctataca

SEQ ID NO: 7499513 - DNA, 22 bp, Homo sapiens
aaagttcactgaccagcactgg

SEQ ID NO: 7499514 - DNA, 22 bp, Homo sapiens
aaagttcactgaccagcactgg

SEQ ID NO: 7499515 - DNA, 22 bp, Homo sapiens
aaagttcactgaccagcactgg

SEQ ID NO: 7499516 - DNA, 22 bp, Homo sapiens
aaagttcactgaccagcactgg

SEQ ID NO: 7499517 - DNA, 22 bp, Homo sapiens
aaagttcactgaccagcactgg

SEQ ID NO: 7499518 - DNA, 22 bp, Homo sapiens
aaagttcagattagactcaaga

SEQ ID NO: 7499519 - DNA, 22 bp, Homo sapiens
aaagttcagattagactcaaga

SEQ ID NO: 7499520 - DNA, 22 bp, Homo sapiens
aaagttcagattagactcaaga

SEQ ID NO: 7499521 - DNA, 22 bp, Homo sapiens
aaagttagaatgatatcaacga

SEQ ID NO: 7499522 - DNA, 22 bp, Homo sapiens
aaagttagaatgatatcaacga

SEQ ID NO: 7499523 - DNA, 22 bp, Homo sapiens
aaagttactttgctgtgcttca

SEQ ID NO: 7499524 - DNA, 22 bp, Homo sapiens
aaagttactttgctgtgcttca

SEQ ID NO: 7499525 - DNA, 22 bp, Homo sapiens
aaagttagtaaaatgggatata

SEQ ID NO: 7499526 - DNA, 22 bp, Homo sapiens
aaagttagaatgatatcaacga

SEQ ID NO: 7499527 - DNA, 22 bp, Homo sapiens
aaagttaggtgtggatttctca

SEQ ID NO: 7499528 - DNA, 22 bp, Homo sapiens
aaagttcactatgtagcagcgt

SEQ ID NO: 7499529 - DNA, 22 bp, Homo sapiens
aaagttcactatgtagcagcgt

SEQ ID NO: 7499530 - DNA, 22 bp, Homo sapiens
aaagttcactatgtagcagcgt

SEQ ID NO: 7499531 - DNA, 22 bp, Homo sapiens
aaagttactttgctgtgcttca

SEQ ID NO: 7499532 - DNA, 22 bp, Homo sapiens
aaagttactttgctgtgcttca

SEQ ID NO: 7499533 - DNA, 22 bp, Homo sapiens
aaagttactatcacaatgaaat

SEQ ID NO: 7499534 - DNA, 22 bp, Homo sapiens
aaagttactatcacaatgaaat

SEQ ID NO: 7499535 - DNA, 22 bp, Homo sapiens
aaagttactatcacaatgaaat

SEQ ID NO: 7499536 - DNA, 21 bp, Homo sapiens
aaagttacagtcagtgggtgc

SEQ ID NO: 7499537 - DNA, 22 bp, Homo sapiens
aaagttacagtaattcagtgta

SEQ ID NO: 7499538 - DNA, 22 bp, Homo sapiens
aaagttacagtaattcagtgta

SEQ ID NO: 7499539 - DNA, 22 bp, Homo sapiens
aaaccttttcagctgaatggag

SEQ ID NO: 7499540 - DNA, 22 bp, Homo sapiens
aaactagatgattatgaagcat

SEQ ID NO: 7499541 - DNA, 22 bp, Homo sapiens
aaactagatgattatgaagcat

SEQ ID NO: 7499542 - DNA, 22 bp, Homo sapiens
aaactagatgattatgaagcat

SEQ ID NO: 7499543 - DNA, 22 bp, Homo sapiens
aaactagatgaaacgagtaaag

SEQ ID NO: 7499544 - DNA, 22 bp, Homo sapiens
aaactagatgaaacgagtaaag

SEQ ID NO: 7499545 - DNA, 22 bp, Homo sapiens
aaactagatgaaacgagtaaag

SEQ ID NO: 7499546 - DNA, 22 bp, Homo sapiens
aaactctagttatgaagtttgt

SEQ ID NO: 7499547 - DNA, 22 bp, Homo sapiens
aaactctagtaaaatgtattca

SEQ ID NO: 7499548 - DNA, 22 bp, Homo sapiens
aaactctagtaaaatgtattca

SEQ ID NO: 7499549 - DNA, 22 bp, Homo sapiens
aaactctcattttagtgcactg

SEQ ID NO: 7499550 - DNA, 22 bp, Homo sapiens
aaactctcttttcttcagtagg

SEQ ID NO: 7499551 - DNA, 22 bp, Homo sapiens
aaactctcttttcttcagtagg

SEQ ID NO: 7499552 - DNA, 22 bp, Homo sapiens
aaactctcattttagtgcactg

SEQ ID NO: 7499553 - DNA, 22 bp, Homo sapiens
aaactctatttctgttggctta

SEQ ID NO: 7499554 - DNA, 22 bp, Homo sapiens
aaactctcttttcttcagtagg

SEQ ID NO: 7499555 - DNA, 22 bp, Homo sapiens
aaactctatgaaccttctacca

SEQ ID NO: 7499556 - DNA, 22 bp, Homo sapiens
aaactctataaataagggctat

SEQ ID NO: 7499557 - DNA, 22 bp, Homo sapiens
aaactctataggcagaagcaat

SEQ ID NO: 7499558 - DNA, 22 bp, Homo sapiens
aaactctataggcagaagcaat

SEQ ID NO: 7499559 - DNA, 21 bp, Homo sapiens
aaagttcatgctttaatattc

SEQ ID NO: 7499560 - DNA, 22 bp, Homo sapiens
aaagttcatggtgttatagaaa

SEQ ID NO: 7499561 - DNA, 22 bp, Homo sapiens
aaagttcatggtgttatagaaa

SEQ ID NO: 7499562 - DNA, 22 bp, Homo sapiens
aaagttcatggtgttatagaaa

SEQ ID NO: 7499563 - DNA, 22 bp, Homo sapiens
aaagttcatggtgttatagaaa

SEQ ID NO: 7499564 - DNA, 22 bp, Homo sapiens
aaagttcatggtgttatagaaa

SEQ ID NO: 7499565 - DNA, 21 bp, Homo sapiens
aaagttcatgctttaatattc

SEQ ID NO: 7499566 - DNA, 21 bp, Homo sapiens
aaagttcatgctttaatattc

SEQ ID NO: 7499567 - DNA, 21 bp, Homo sapiens
aaagttcatgctttaatattc

SEQ ID NO: 7499568 - DNA, 21 bp, Homo sapiens
aaagttcatgctttaatattc

SEQ ID NO: 7499569 - DNA, 21 bp, Homo sapiens
aaagttcatgctttaatattc

SEQ ID NO: 7499570 - DNA, 21 bp, Homo sapiens
aaagttcatgctttaatattc

SEQ ID NO: 7499571 - DNA, 21 bp, Homo sapiens
aaagttcatgctttaatattc

SEQ ID NO: 7499572 - DNA, 20 bp, Homo sapiens
aaagttcatgtttgcacttt

SEQ ID NO: 7499573 - DNA, 20 bp, Homo sapiens
aaagttcatgtttgcacttt

SEQ ID NO: 7499574 - DNA, 22 bp, Homo sapiens
aaagttcatggtgttatagaaa

SEQ ID NO: 7499575 - DNA, 20 bp, Homo sapiens
aaagttcatgtttgcacttt

SEQ ID NO: 7499576 - DNA, 22 bp, Homo sapiens
aaagttcatggtgttatagaaa

SEQ ID NO: 7499577 - DNA, 22 bp, Homo sapiens
aaagttcattgatgactgaggt

SEQ ID NO: 7499578 - DNA, 20 bp, Homo sapiens
aaagttcatgtttgcacttt

SEQ ID NO: 7499579 - DNA, 21 bp, Homo sapiens
aaactagagtgtggcaaagct

SEQ ID NO: 7499580 - DNA, 22 bp, Homo sapiens
aaactagagatggcaggtggaa

SEQ ID NO: 7499581 - DNA, 22 bp, Homo sapiens
aaactagaaatcagcaagatag

SEQ ID NO: 7499582 - DNA, 22 bp, Homo sapiens
aaaggttaaggtgttcaagaaa

SEQ ID NO: 7499583 - DNA, 22 bp, Homo sapiens
aaaggtgttgccttggagacct

SEQ ID NO: 7499584 - DNA, 22 bp, Homo sapiens
aaaggtgcctcttacaaggctt

SEQ ID NO: 7499585 - DNA, 22 bp, Homo sapiens
aaaggtgctactgtgttcctca

SEQ ID NO: 7499586 - DNA, 22 bp, Homo sapiens
aaaggtggagttgtgcccattt

SEQ ID NO: 7499587 - DNA, 22 bp, Homo sapiens
aaaggtcttttttctaacacca

SEQ ID NO: 7499588 - DNA, 22 bp, Homo sapiens
aaaggtgactgcagcagctatt

SEQ ID NO: 7499589 - DNA, 22 bp, Homo sapiens
aaaggtcttcagtgctttcact

SEQ ID NO: 7499590 - DNA, 22 bp, Homo sapiens
aaaggtcttgtcttgacagagt

SEQ ID NO: 7499591 - DNA, 22 bp, Homo sapiens
aaaggtcttgtcttgacagagt

SEQ ID NO: 7499592 - DNA, 22 bp, Homo sapiens
aaaggtcttctcaaacatccca

SEQ ID NO: 7499593 - DNA, 22 bp, Homo sapiens
aaaggtcttgtcttgacagagt

SEQ ID NO: 7499594 - DNA, 22 bp, Homo sapiens
aaaggtctttattggtcagcca

SEQ ID NO: 7499595 - DNA, 22 bp, Homo sapiens
aaaggtcttttttctaacacca

SEQ ID NO: 7499596 - DNA, 22 bp, Homo sapiens
aaacccatctgtctgtctgcag

SEQ ID NO: 7499597 - DNA, 22 bp, Homo sapiens
aaacccatggctgatatcacta

SEQ ID NO: 7499598 - DNA, 22 bp, Homo sapiens
aaacccatggctgatatcacta

SEQ ID NO: 7499599 - DNA, 22 bp, Homo sapiens
aaaccctgcccttcccaagatg

SEQ ID NO: 7499600 - DNA, 22 bp, Homo sapiens
aaacccagggttttgtcttccc

SEQ ID NO: 7499601 - DNA, 22 bp, Homo sapiens
aaacccagggttttgtcttccc

SEQ ID NO: 7499602 - DNA, 22 bp, Homo sapiens
aaacattgttatgataaattac

SEQ ID NO: 7499603 - DNA, 22 bp, Homo sapiens
aaacattgtacattctgtagct

SEQ ID NO: 7499604 - DNA, 22 bp, Homo sapiens
aaacattgtacattctgtagct

SEQ ID NO: 7499605 - DNA, 22 bp, Homo sapiens
aaacattgtacattctgtagct

SEQ ID NO: 7499606 - DNA, 22 bp, Homo sapiens
aaaccgcaattacttttgcgtc

SEQ ID NO: 7499607 - DNA, 22 bp, Homo sapiens
aaacctagaaggaagggtctct

SEQ ID NO: 7499608 - DNA, 22 bp, Homo sapiens
aaaccctgcccttcccaagatg

SEQ ID NO: 7499609 - DNA, 22 bp, Homo sapiens
aaaccctgctcttatggaactt

SEQ ID NO: 7499610 - DNA, 22 bp, Homo sapiens
aaacctatatagtcttagaagc

SEQ ID NO: 7499611 - DNA, 22 bp, Homo sapiens
aaacctattggcaagaataata

SEQ ID NO: 7499612 - DNA, 22 bp, Homo sapiens
aaaccttcacatctactctaca

SEQ ID NO: 7499613 - DNA, 22 bp, Homo sapiens
aaacctttctgctctcagcgta

SEQ ID NO: 7499614 - DNA, 22 bp, Homo sapiens
aaacctttgtgtgtctgtgcct

SEQ ID NO: 7499615 - DNA, 22 bp, Homo sapiens
aaaccttttcagctgaatggag

SEQ ID NO: 7499616 - DNA, 22 bp, Homo sapiens
aaacctttgcctggaagggagt

SEQ ID NO: 7499617 - DNA, 22 bp, Homo sapiens
aaacctttgtgtgtctgtgcct

SEQ ID NO: 7499618 - DNA, 22 bp, Homo sapiens
aaacctgtctgattatggagac

SEQ ID NO: 7499619 - DNA, 19 bp, Homo sapiens
aaacctgttagtagagcac

SEQ ID NO: 7499620 - DNA, 22 bp, Homo sapiens
aaaccttcacatctactctaca

SEQ ID NO: 7499621 - DNA, 22 bp, Homo sapiens
aaaccttaaaccaagctcttga

SEQ ID NO: 7499622 - DNA, 22 bp, Homo sapiens
aaacctcttaatggcctgtaat

SEQ ID NO: 7499623 - DNA, 22 bp, Homo sapiens
aaacctcttaatggcctgtaat

SEQ ID NO: 7499624 - DNA, 22 bp, Homo sapiens
aaacctctgtgctatgacaccc

SEQ ID NO: 7499625 - DNA, 22 bp, Homo sapiens
aaacctctgtgctatgacaccc

SEQ ID NO: 7499626 - DNA, 22 bp, Homo sapiens
aaacctctgggttccgtggttt

SEQ ID NO: 7499627 - DNA, 22 bp, Homo sapiens
aaacctctgggttccgtggttt

SEQ ID NO: 7499628 - DNA, 22 bp, Homo sapiens
aaacctctgaatactgttggca

SEQ ID NO: 7499629 - DNA, 22 bp, Homo sapiens
aaacctctgaatactgttggca

SEQ ID NO: 7499630 - DNA, 22 bp, Homo sapiens
aaacctctgaatactgttggca

SEQ ID NO: 7499631 - DNA, 22 bp, Homo sapiens
aaacctctccactacatgacag

SEQ ID NO: 7499632 - DNA, 22 bp, Homo sapiens
aaacctctccactacatgacag

SEQ ID NO: 7499633 - DNA, 22 bp, Homo sapiens
aaacctctttccattagaggaa

SEQ ID NO: 7499634 - DNA, 22 bp, Homo sapiens
aaacctctttccattagaggaa

SEQ ID NO: 7499635 - DNA, 22 bp, Homo sapiens
aaacctgaagtacgttacataa

SEQ ID NO: 7499636 - DNA, 22 bp, Homo sapiens
aaacctgaaggatgatacaaca

SEQ ID NO: 7499637 - DNA, 22 bp, Homo sapiens
aaacctcttttaaggagttgtt

SEQ ID NO: 7499638 - DNA, 22 bp, Homo sapiens
aaacctgaaggatgatacaaca

SEQ ID NO: 7499639 - DNA, 22 bp, Homo sapiens
aaacctcttttaaggagttgtt

SEQ ID NO: 7499640 - DNA, 22 bp, Homo sapiens
aaacctcttttaaggagttgtt

SEQ ID NO: 7499641 - DNA, 22 bp, Homo sapiens
aaacctcttttaaggagttgtt

SEQ ID NO: 7499642 - DNA, 22 bp, Homo sapiens
aaacctctttccattagaggaa

SEQ ID NO: 7499643 - DNA, 22 bp, Homo sapiens
aaacctcttctcaagatttctg

SEQ ID NO: 7499644 - DNA, 22 bp, Homo sapiens
aaacctcttctcaagatttctg

SEQ ID NO: 7499645 - DNA, 22 bp, Homo sapiens
aaacctcttctcaagatttctg

SEQ ID NO: 7499646 - DNA, 22 bp, Homo sapiens
aaacctgaagtacgttacataa

SEQ ID NO: 7499647 - DNA, 22 bp, Homo sapiens
aaacctgaagtacgttacataa

SEQ ID NO: 7499648 - DNA, 22 bp, Homo sapiens
aaacctgaatgtatgtcagaag

SEQ ID NO: 7499649 - DNA, 22 bp, Homo sapiens
aaacctgaatgtatgtcagaag

SEQ ID NO: 7499650 - DNA, 22 bp, Homo sapiens
aaacctgaatgtatgtcagaag

SEQ ID NO: 7499651 - DNA, 22 bp, Homo sapiens
aaacctgatagattttcagaat

SEQ ID NO: 7499652 - DNA, 22 bp, Homo sapiens
aaacctgatagattttcagaat

SEQ ID NO: 7499653 - DNA, 22 bp, Homo sapiens
aaacctggtggaacggtgaata

SEQ ID NO: 7499654 - DNA, 22 bp, Homo sapiens
aaacctgtagcagtttgttaca

SEQ ID NO: 7499655 - DNA, 22 bp, Homo sapiens
aaacctgtagcagtttgttaca

SEQ ID NO: 7499656 - DNA, 22 bp, Homo sapiens
aaacctgatagattttcagaat

SEQ ID NO: 7499657 - DNA, 22 bp, Homo sapiens
aaacctgatagattttcagaat

SEQ ID NO: 7499658 - DNA, 22 bp, Homo sapiens
aaacagtgcctggcatggagga

SEQ ID NO: 7499659 - DNA, 22 bp, Homo sapiens
aaacagtgcctggcatggagga

SEQ ID NO: 7499660 - DNA, 22 bp, Homo sapiens
aaacagtgcctggcatggagga

SEQ ID NO: 7499661 - DNA, 22 bp, Homo sapiens
aaacagtggccaattctggaga

SEQ ID NO: 7499662 - DNA, 22 bp, Homo sapiens
aaacagtggccaattctggaga

SEQ ID NO: 7499663 - DNA, 22 bp, Homo sapiens
aaacagtggccaattctggaga

SEQ ID NO: 7499664 - DNA, 22 bp, Homo sapiens
aaacagtggccaattctggaga

SEQ ID NO: 7499665 - DNA, 22 bp, Homo sapiens
aaacagtggccaattctggaga

SEQ ID NO: 7499666 - DNA, 22 bp, Homo sapiens
aaacagtggccaattctggaga

SEQ ID NO: 7499667 - DNA, 22 bp, Homo sapiens
aaacagtgtaggtggccaggca

SEQ ID NO: 7499668 - DNA, 22 bp, Homo sapiens
aaacagtgtgtttcagagaggc

SEQ ID NO: 7499669 - DNA, 22 bp, Homo sapiens
aaacagttacgagcgcagacct

SEQ ID NO: 7499670 - DNA, 22 bp, Homo sapiens
aaacagttacgagcgcagacct

SEQ ID NO: 7499671 - DNA, 22 bp, Homo sapiens
aaacagttctcatttgtttaga

SEQ ID NO: 7499672 - DNA, 22 bp, Homo sapiens
aaacagttctcatttgtttaga

SEQ ID NO: 7499673 - DNA, 22 bp, Homo sapiens
aaacagttaattgctttcagtt

SEQ ID NO: 7499674 - DNA, 22 bp, Homo sapiens
aaacagtgtttttatgatttat

SEQ ID NO: 7499675 - DNA, 22 bp, Homo sapiens
aaacagtgtttttatgatttat

SEQ ID NO: 7499676 - DNA, 22 bp, Homo sapiens
aaacagtgtttttatgatttat

SEQ ID NO: 7499677 - DNA, 22 bp, Homo sapiens
aaacagtgtttttatgatttat

SEQ ID NO: 7499678 - DNA, 22 bp, Homo sapiens
aaacagtgtttttatgatttat

SEQ ID NO: 7499679 - DNA, 22 bp, Homo sapiens
aaacagtgtttttatgatttat

SEQ ID NO: 7499680 - DNA, 22 bp, Homo sapiens
aaacagttgttatttttatatg

SEQ ID NO: 7499681 - DNA, 22 bp, Homo sapiens
aaacagttgttatttttatatg

SEQ ID NO: 7499682 - DNA, 22 bp, Homo sapiens
aaacagttctccaggaagccag

SEQ ID NO: 7499683 - DNA, 22 bp, Homo sapiens
aaacagttctccaggaagccag

SEQ ID NO: 7499684 - DNA, 22 bp, Homo sapiens
aaacagttctcatttgtttaga

SEQ ID NO: 7499685 - DNA, 22 bp, Homo sapiens
aaacagttctcatttgtttaga

SEQ ID NO: 7499686 - DNA, 22 bp, Homo sapiens
aaacagttctcatttgtttaga

SEQ ID NO: 7499687 - DNA, 22 bp, Homo sapiens
aaacagttctcatttgtttaga

SEQ ID NO: 7499688 - DNA, 22 bp, Homo sapiens
aaacagtttataacatgatact

SEQ ID NO: 7499689 - DNA, 22 bp, Homo sapiens
aaacagtttataacatgatact

SEQ ID NO: 7499690 - DNA, 22 bp, Homo sapiens
aaacagtttataacatgatact

SEQ ID NO: 7499691 - DNA, 22 bp, Homo sapiens
aaacagtttataacatgatact

SEQ ID NO: 7499692 - DNA, 22 bp, Homo sapiens
aaacagttgttatttttatatg

SEQ ID NO: 7499693 - DNA, 22 bp, Homo sapiens
aaacagttgttatttttatatg

SEQ ID NO: 7499694 - DNA, 22 bp, Homo sapiens
aaacagttgttatttttatatg

SEQ ID NO: 7499695 - DNA, 22 bp, Homo sapiens
aaacagtttataacatgatact

SEQ ID NO: 7499696 - DNA, 22 bp, Homo sapiens
aaacagtttataacatgatact

SEQ ID NO: 7499697 - DNA, 22 bp, Homo sapiens
aaacagtttataacatgatact

SEQ ID NO: 7499698 - DNA, 22 bp, Homo sapiens
aaacagtttataacatgatact

SEQ ID NO: 7499699 - DNA, 22 bp, Homo sapiens
aaacagtttcattttcatgacc

SEQ ID NO: 7499700 - DNA, 22 bp, Homo sapiens
aaacagtttcattttcatgacc

SEQ ID NO: 7499701 - DNA, 22 bp, Homo sapiens
aaacagtttcattttcatgacc

SEQ ID NO: 7499702 - DNA, 22 bp, Homo sapiens
aaacagtttcattttcatgacc

SEQ ID NO: 7499703 - DNA, 22 bp, Homo sapiens
aaaggtcattgaaaaggaggaa

SEQ ID NO: 7499704 - DNA, 22 bp, Homo sapiens
aaaggtcttaaggttaagcagg

SEQ ID NO: 7499705 - DNA, 22 bp, Homo sapiens
aaaggtctacatcactgaaaga

SEQ ID NO: 7499706 - DNA, 22 bp, Homo sapiens
aaaggtcagacttaggctgggc

SEQ ID NO: 7499707 - DNA, 22 bp, Homo sapiens
aaaggtcaaaatcgtgacattg

SEQ ID NO: 7499708 - DNA, 22 bp, Homo sapiens
aaaggtatgatactgtgacatg

SEQ ID NO: 7499709 - DNA, 22 bp, Homo sapiens
aaaggtatgatactgtgacatg

SEQ ID NO: 7499710 - DNA, 22 bp, Homo sapiens
aaaggtagtacttctagaaggg

SEQ ID NO: 7499711 - DNA, 22 bp, Homo sapiens
aaaggtagtacttctagaaggg

SEQ ID NO: 7499712 - DNA, 22 bp, Homo sapiens
aaaggtagtacttctagaaggg

SEQ ID NO: 7499713 - DNA, 22 bp, Homo sapiens
aaaggtatcatgtccatacagt

SEQ ID NO: 7499714 - DNA, 22 bp, Homo sapiens
aaaggggtaatctaaggaattc

SEQ ID NO: 7499715 - DNA, 22 bp, Homo sapiens
aaagggtcagattctgctagtg

SEQ ID NO: 7499716 - DNA, 22 bp, Homo sapiens
aaagggctgtcaaataagcaac

SEQ ID NO: 7499717 - DNA, 22 bp, Homo sapiens
aaagggtccagatacttggaaa

SEQ ID NO: 7499718 - DNA, 22 bp, Homo sapiens
aaagggttgttgtaaggattat

SEQ ID NO: 7499719 - DNA, 22 bp, Homo sapiens
aaagggtcagattctgctagtg

SEQ ID NO: 7499720 - DNA, 22 bp, Homo sapiens
aaagggctttatatcagtgtgt

SEQ ID NO: 7499721 - DNA, 22 bp, Homo sapiens
aaaggtaactggggttttgcca

SEQ ID NO: 7499722 - DNA, 22 bp, Homo sapiens
aaaggtaacagttataaccagg

SEQ ID NO: 7499723 - DNA, 22 bp, Homo sapiens
aaacagtttctaatcatggaga

SEQ ID NO: 7499724 - DNA, 22 bp, Homo sapiens
aaacagtttctaatcatggaga

SEQ ID NO: 7499725 - DNA, 22 bp, Homo sapiens
aaacagtttctaatcatggaga

SEQ ID NO: 7499726 - DNA, 22 bp, Homo sapiens
aaacagtttctaatcatggaga

SEQ ID NO: 7499727 - DNA, 22 bp, Homo sapiens
aaacagttgttatttttatatg

SEQ ID NO: 7499728 - DNA, 22 bp, Homo sapiens
aaacagtttcattttcatgacc

SEQ ID NO: 7499729 - DNA, 22 bp, Homo sapiens
aaagggctgtcaaataagcaac

SEQ ID NO: 7499730 - DNA, 22 bp, Homo sapiens
aaagggctgtcaaataagcaac

SEQ ID NO: 7499731 - DNA, 22 bp, Homo sapiens
aaacagtttctaatcatggaga

SEQ ID NO: 7499732 - DNA, 22 bp, Homo sapiens
aaacagttttcctagctgtctg

SEQ ID NO: 7499733 - DNA, 22 bp, Homo sapiens
aaacagttttcctagctgtctg

SEQ ID NO: 7499734 - DNA, 22 bp, Homo sapiens
aaagggctgatgtgacatagct

SEQ ID NO: 7499735 - DNA, 18 bp, Homo sapiens
aaacagtgcctaagtgtc

SEQ ID NO: 7499736 - DNA, 22 bp, Homo sapiens
aaacagtgccaggcagatgcca

SEQ ID NO: 7499737 - DNA, 22 bp, Homo sapiens
aaacagtgccaggcagatgcca

SEQ ID NO: 7499738 - DNA, 22 bp, Homo sapiens
aaacagtgccaggcagatgcca

SEQ ID NO: 7499739 - DNA, 22 bp, Homo sapiens
aaacagtgcaggaagttaagca

SEQ ID NO: 7499740 - DNA, 22 bp, Homo sapiens
aaacagtgcaggaagttaagca

SEQ ID NO: 7499741 - DNA, 22 bp, Homo sapiens
aaacagtgcaggaagttaagca

SEQ ID NO: 7499742 - DNA, 22 bp, Homo sapiens
aaacagtgatgttgagtgtaaa

SEQ ID NO: 7499743 - DNA, 22 bp, Homo sapiens
aaacagtgcaggaagttaagca

SEQ ID NO: 7499744 - DNA, 22 bp, Homo sapiens
aaacagtgactggtacataata

SEQ ID NO: 7499745 - DNA, 17 bp, Homo sapiens
aaacagtgagtgttatg

SEQ ID NO: 7499746 - DNA, 17 bp, Homo sapiens
aaacagtgagtgttatg

SEQ ID NO: 7499747 - DNA, 17 bp, Homo sapiens
aaacagtgagtgttatg

SEQ ID NO: 7499748 - DNA, 22 bp, Homo sapiens
aaacagcttgtaaggtgtaatt

SEQ ID NO: 7499749 - DNA, 22 bp, Homo sapiens
aaacacaagaggcagggtacag

SEQ ID NO: 7499750 - DNA, 22 bp, Homo sapiens
aaacacaagaggcagggtacag

SEQ ID NO: 7499751 - DNA, 22 bp, Homo sapiens
aaacacaagaggcagggtacag

SEQ ID NO: 7499752 - DNA, 22 bp, Homo sapiens
aaacagtgactggtacataata

SEQ ID NO: 7499753 - DNA, 22 bp, Homo sapiens
aaacagtgactggtacataata

SEQ ID NO: 7499754 - DNA, 22 bp, Homo sapiens
aaacagcttgtttcaggaaagt

SEQ ID NO: 7499755 - DNA, 22 bp, Homo sapiens
aaacagtgactggtacataata

SEQ ID NO: 7499756 - DNA, 22 bp, Homo sapiens
aaacagtgactggtacataata

SEQ ID NO: 7499757 - DNA, 22 bp, Homo sapiens
aaacaatgttgctgggtgcggt

SEQ ID NO: 7499758 - DNA, 22 bp, Homo sapiens
aaacaatgttgtctccaagagg

SEQ ID NO: 7499759 - DNA, 22 bp, Homo sapiens
aaacaatgttgtctccaagagg

SEQ ID NO: 7499760 - DNA, 22 bp, Homo sapiens
aaacaatgttgtctccaagagg

SEQ ID NO: 7499761 - DNA, 22 bp, Homo sapiens
aaacaatttccacctctcctga

SEQ ID NO: 7499762 - DNA, 22 bp, Homo sapiens
aaacaatttccacctctcctga

SEQ ID NO: 7499763 - DNA, 22 bp, Homo sapiens
aaacaatgttcctatattagag

SEQ ID NO: 7499764 - DNA, 22 bp, Homo sapiens
aaacaatgttcctatattagag

SEQ ID NO: 7499765 - DNA, 22 bp, Homo sapiens
aaacaatgttcctatattagag

SEQ ID NO: 7499766 - DNA, 22 bp, Homo sapiens
aaacaatgttcctatattagag

SEQ ID NO: 7499767 - DNA, 22 bp, Homo sapiens
aaacaatgttcctatattagag

SEQ ID NO: 7499768 - DNA, 22 bp, Homo sapiens
aaacaatgttcctatattagag

SEQ ID NO: 7499769 - DNA, 22 bp, Homo sapiens
aaacaatgttcctatattagag

SEQ ID NO: 7499770 - DNA, 22 bp, Homo sapiens
aaacaatgttcctatattagag

SEQ ID NO: 7499771 - DNA, 22 bp, Homo sapiens
aaacaatgttcctatattagag

SEQ ID NO: 7499772 - DNA, 22 bp, Homo sapiens
aaacaatgtagattaccattta

SEQ ID NO: 7499773 - DNA, 23 bp, Homo sapiens
aaacaatgtcatcaggacttggt

SEQ ID NO: 7499774 - DNA, 22 bp, Homo sapiens
aaacaatgtctaaggtgcacag

SEQ ID NO: 7499775 - DNA, 22 bp, Homo sapiens
aaacaatgtagattaccattta

SEQ ID NO: 7499776 - DNA, 22 bp, Homo sapiens
aaacaatgtagattaccattta

SEQ ID NO: 7499777 - DNA, 22 bp, Homo sapiens
aaacaatgtagattaccattta

SEQ ID NO: 7499778 - DNA, 22 bp, Homo sapiens
aaacaatgtagattaccattta

SEQ ID NO: 7499779 - DNA, 22 bp, Homo sapiens
aaacaatgtagattaccattta

SEQ ID NO: 7499780 - DNA, 22 bp, Homo sapiens
aaacaatgtagattaccattta

SEQ ID NO: 7499781 - DNA, 22 bp, Homo sapiens
aaacaatgtagattaccattta

SEQ ID NO: 7499782 - DNA, 22 bp, Homo sapiens
aaacaatgtacatttataatgc

SEQ ID NO: 7499783 - DNA, 22 bp, Homo sapiens
aaacaatgtacatttataatgc

SEQ ID NO: 7499784 - DNA, 22 bp, Homo sapiens
aaacaatgtacatttataatgc

SEQ ID NO: 7499785 - DNA, 22 bp, Homo sapiens
aaacaatgtacatttataatgc

SEQ ID NO: 7499786 - DNA, 22 bp, Homo sapiens
aaacaatgtacatttataatgc

SEQ ID NO: 7499787 - DNA, 22 bp, Homo sapiens
aaacaatgtacatttataatgc

SEQ ID NO: 7499788 - DNA, 22 bp, Homo sapiens
aaacaatgtacatttataatgc

SEQ ID NO: 7499789 - DNA, 22 bp, Homo sapiens
aaacaatgtacatttataatgc

SEQ ID NO: 7499790 - DNA, 22 bp, Homo sapiens
aaacaatgtacatttataatgc

SEQ ID NO: 7499791 - DNA, 22 bp, Homo sapiens
aaacaatgtacacatgaatgtt

SEQ ID NO: 7499792 - DNA, 22 bp, Homo sapiens
aaacaatgtacacatgaatgtt

SEQ ID NO: 7499793 - DNA, 17 bp, Homo sapiens
aaacaatgcagacaagc

SEQ ID NO: 7499794 - DNA, 17 bp, Homo sapiens
aaacaatgcagacaagc

SEQ ID NO: 7499795 - DNA, 17 bp, Homo sapiens
aaacaatgcagacaagc

SEQ ID NO: 7499796 - DNA, 17 bp, Homo sapiens
aaacaatgcagacaagc

SEQ ID NO: 7499797 - DNA, 17 bp, Homo sapiens
aaacaatgcagacaagc

SEQ ID NO: 7499798 - DNA, 22 bp, Homo sapiens
aaacaatgagcttttacacact

SEQ ID NO: 7499799 - DNA, 22 bp, Homo sapiens
aaacaatgagcttttacacact

SEQ ID NO: 7499800 - DNA, 22 bp, Homo sapiens
aaacaatgagcttttacacact

SEQ ID NO: 7499801 - DNA, 22 bp, Homo sapiens
aaacaatgagcttttacacact

SEQ ID NO: 7499802 - DNA, 22 bp, Homo sapiens
aaacaatgagcttttacacact

SEQ ID NO: 7499803 - DNA, 22 bp, Homo sapiens
aaacaatgagcttttacacact

SEQ ID NO: 7499804 - DNA, 22 bp, Homo sapiens
aaacaatgagcttttacacact

SEQ ID NO: 7499805 - DNA, 22 bp, Homo sapiens
aaacaatgagcttttacacact

SEQ ID NO: 7499806 - DNA, 22 bp, Homo sapiens
aaacaatgagcttttacacact

SEQ ID NO: 7499807 - DNA, 22 bp, Homo sapiens
aaacaatgacaacacagctgcg

SEQ ID NO: 7499808 - DNA, 22 bp, Homo sapiens
aaacaatgaaattcattcttca

SEQ ID NO: 7499809 - DNA, 22 bp, Homo sapiens
aaacaatgaaattcattcttca

SEQ ID NO: 7499810 - DNA, 22 bp, Homo sapiens
aaacaatgacaacacagctgcg

SEQ ID NO: 7499811 - DNA, 22 bp, Homo sapiens
aaacaatgacaacacagctgcg

SEQ ID NO: 7499812 - DNA, 22 bp, Homo sapiens
aatgactctgctgcagagacac

SEQ ID NO: 7499813 - DNA, 22 bp, Homo sapiens
aatgactagtccacatttgtaa

SEQ ID NO: 7499814 - DNA, 22 bp, Homo sapiens
aatgactagtccacatttgtaa

SEQ ID NO: 7499815 - DNA, 22 bp, Homo sapiens
aatgactaataagttttactgt

SEQ ID NO: 7499816 - DNA, 20 bp, Homo sapiens
aatgactactatatccatgg

SEQ ID NO: 7499817 - DNA, 20 bp, Homo sapiens
aatgactactatatccatgg

SEQ ID NO: 7499818 - DNA, 22 bp, Homo sapiens
aatgactgaagcaattgcagtg

SEQ ID NO: 7499819 - DNA, 22 bp, Homo sapiens
aatgactgaagcaattgcagtg

SEQ ID NO: 7499820 - DNA, 22 bp, Homo sapiens
aatgactctgctgcagagacac

SEQ ID NO: 7499821 - DNA, 22 bp, Homo sapiens
aatgactgaagcaattgcagtg

SEQ ID NO: 7499822 - DNA, 22 bp, Homo sapiens
aatgactgaagcaattgcagtg

SEQ ID NO: 7499823 - DNA, 22 bp, Homo sapiens
aatgactctgctgcagagacac

SEQ ID NO: 7499824 - DNA, 19 bp, Homo sapiens
aatgactgagtacattgtc

SEQ ID NO: 7499825 - DNA, 22 bp, Homo sapiens
aatgacatggagcatcttttca

SEQ ID NO: 7499826 - DNA, 22 bp, Homo sapiens
aatgacatggagcatcttttca

SEQ ID NO: 7499827 - DNA, 22 bp, Homo sapiens
aatgacatggagcatcttttca

SEQ ID NO: 7499828 - DNA, 22 bp, Homo sapiens
aatgaatgtttgttgagtgaag

SEQ ID NO: 7499829 - DNA, 22 bp, Homo sapiens
aatgaatgtttgttgagtgaag

SEQ ID NO: 7499830 - DNA, 22 bp, Homo sapiens
aatgaccagcgcctgcagaggg

SEQ ID NO: 7499831 - DNA, 22 bp, Homo sapiens
aatgacctcagagcacccagaa

SEQ ID NO: 7499832 - DNA, 22 bp, Homo sapiens
aatgacatggagcatcttttca

SEQ ID NO: 7499833 - DNA, 22 bp, Homo sapiens
aatgacctgggtgtcatttcat

SEQ ID NO: 7499834 - DNA, 22 bp, Homo sapiens
aatgacctgggtgtcatttcat

SEQ ID NO: 7499835 - DNA, 22 bp, Homo sapiens
aatgactaaatctgaagatagg

SEQ ID NO: 7499836 - DNA, 22 bp, Homo sapiens
agaaatactgcctaagactgta

SEQ ID NO: 7499837 - DNA, 22 bp, Homo sapiens
agaaatactgcctaagactgta

SEQ ID NO: 7499838 - DNA, 22 bp, Homo sapiens
agaaatactgcctaagactgta

SEQ ID NO: 7499839 - DNA, 22 bp, Homo sapiens
agaaatactgcctaagactgta

SEQ ID NO: 7499840 - DNA, 22 bp, Homo sapiens
agaaatactgcctaagactgta

SEQ ID NO: 7499841 - DNA, 22 bp, Homo sapiens
agaaatactgcctaagactgta

SEQ ID NO: 7499842 - DNA, 22 bp, Homo sapiens
agaaatacttaatctttgcagg

SEQ ID NO: 7499843 - DNA, 22 bp, Homo sapiens
agaaatactgtgagagcagcct

SEQ ID NO: 7499844 - DNA, 22 bp, Homo sapiens
agaaatactgtgagagcagcct

SEQ ID NO: 7499845 - DNA, 22 bp, Homo sapiens
agaaatactgcctaagactgta

SEQ ID NO: 7499846 - DNA, 22 bp, Homo sapiens
agaaatactgcctaagactgta

SEQ ID NO: 7499847 - DNA, 22 bp, Homo sapiens
agaaatactgcctaagactgta

SEQ ID NO: 7499848 - DNA, 20 bp, Homo sapiens
agaaatactttggtataatg

SEQ ID NO: 7499849 - DNA, 20 bp, Homo sapiens
agaaatactttggtataatg

SEQ ID NO: 7499850 - DNA, 22 bp, Homo sapiens
agaaatactttgtaaatctcac

SEQ ID NO: 7499851 - DNA, 20 bp, Homo sapiens
agaaatactttggtataatg

SEQ ID NO: 7499852 - DNA, 22 bp, Homo sapiens
aatgaatgtgattaacttcaag

SEQ ID NO: 7499853 - DNA, 22 bp, Homo sapiens
aatgaatgtgattaacttcaag

SEQ ID NO: 7499854 - DNA, 22 bp, Homo sapiens
aatgaatgggtttaatatttta

SEQ ID NO: 7499855 - DNA, 22 bp, Homo sapiens
aatgaatgggtttaatatttta

SEQ ID NO: 7499856 - DNA, 22 bp, Homo sapiens
aatgaatgtttgttgagtgaag

SEQ ID NO: 7499857 - DNA, 22 bp, Homo sapiens
aatgaatgtttgttgagtgaag

SEQ ID NO: 7499858 - DNA, 22 bp, Homo sapiens
agaaatactttgtaaatctcac

SEQ ID NO: 7499859 - DNA, 22 bp, Homo sapiens
aatgaatgtgattaacttcaag

SEQ ID NO: 7499860 - DNA, 22 bp, Homo sapiens
aatgagagaagacaggcaagtg

SEQ ID NO: 7499861 - DNA, 22 bp, Homo sapiens
aatgagagaagacaggcaagtg

SEQ ID NO: 7499862 - DNA, 22 bp, Homo sapiens
aatgagacacgtgaagcagatg

SEQ ID NO: 7499863 - DNA, 22 bp, Homo sapiens
aatgagacacgtgaagcagatg

SEQ ID NO: 7499864 - DNA, 22 bp, Homo sapiens
aatgagaatgtaagtgaagaga

SEQ ID NO: 7499865 - DNA, 22 bp, Homo sapiens
aatgagaatgtaagtgaagaga

SEQ ID NO: 7499866 - DNA, 22 bp, Homo sapiens
aatgagaatgtaagtgaagaga

SEQ ID NO: 7499867 - DNA, 22 bp, Homo sapiens
aatgagaatgtaagtgaagaga

SEQ ID NO: 7499868 - DNA, 22 bp, Homo sapiens
aatgagaatgtaagtgaagaga

SEQ ID NO: 7499869 - DNA, 22 bp, Homo sapiens
aatgagaagcctaggtgtactg

SEQ ID NO: 7499870 - DNA, 22 bp, Homo sapiens
aatgagaaccttgaaaggaact

SEQ ID NO: 7499871 - DNA, 22 bp, Homo sapiens
aatgagaactgggagttggtgg

SEQ ID NO: 7499872 - DNA, 22 bp, Homo sapiens
aatgagaactgggagttggtgg

SEQ ID NO: 7499873 - DNA, 22 bp, Homo sapiens
aatgagaactgggagttggtgg

SEQ ID NO: 7499874 - DNA, 22 bp, Homo sapiens
aatgagaactgggagttggtgg

SEQ ID NO: 7499875 - DNA, 22 bp, Homo sapiens
aatgacttatgggtgaggagag

SEQ ID NO: 7499876 - DNA, 22 bp, Homo sapiens
aatgactgtagtcatattaagg

SEQ ID NO: 7499877 - DNA, 22 bp, Homo sapiens
aatgactttgaaatatttgagt

SEQ ID NO: 7499878 - DNA, 22 bp, Homo sapiens
aatgactttgaaatatttgagt

SEQ ID NO: 7499879 - DNA, 22 bp, Homo sapiens
aatgactttgaaatatttgagt

SEQ ID NO: 7499880 - DNA, 22 bp, Homo sapiens
aatgactgtagtcatattaagg

SEQ ID NO: 7499881 - DNA, 22 bp, Homo sapiens
aatgactgtagtcatattaagg

SEQ ID NO: 7499882 - DNA, 19 bp, Homo sapiens
aatgactgagtacattgtc

SEQ ID NO: 7499883 - DNA, 22 bp, Homo sapiens
aatgagaaaacacagaggaggt

SEQ ID NO: 7499884 - DNA, 22 bp, Homo sapiens
aatgagaaaacacagaggaggt

SEQ ID NO: 7499885 - DNA, 22 bp, Homo sapiens
aatgagaaaacacagaggaggt

SEQ ID NO: 7499886 - DNA, 22 bp, Homo sapiens
aatgagaaaacacagaggaggt

SEQ ID NO: 7499887 - DNA, 22 bp, Homo sapiens
aatgagaaaacacagaggaggt

SEQ ID NO: 7499888 - DNA, 22 bp, Homo sapiens
aatgagaaccttgaaaggaact

SEQ ID NO: 7499889 - DNA, 22 bp, Homo sapiens
aatgagaaaacacagaggaggt

SEQ ID NO: 7499890 - DNA, 22 bp, Homo sapiens
aatgagaaccttgaaaggaact

SEQ ID NO: 7499891 - DNA, 22 bp, Homo sapiens
aatgagaaccttgaaaggaact

SEQ ID NO: 7499892 - DNA, 20 bp, Homo sapiens
aatgagttattttgtatatg

SEQ ID NO: 7499893 - DNA, 22 bp, Homo sapiens
aatgagttattaggtgtaagtg

SEQ ID NO: 7499894 - DNA, 22 bp, Homo sapiens
aatgagttattaggtgtaagtg

SEQ ID NO: 7499895 - DNA, 22 bp, Homo sapiens
aatgagttattaggtgtaagtg

SEQ ID NO: 7499896 - DNA, 22 bp, Homo sapiens
aatgagttagatgagaaaataa

SEQ ID NO: 7499897 - DNA, 22 bp, Homo sapiens
aatgagttagatgagaaaataa

SEQ ID NO: 7499898 - DNA, 20 bp, Homo sapiens
aatgagtcctgctggatcac

SEQ ID NO: 7499899 - DNA, 22 bp, Homo sapiens
aatgagttagatgagaaaataa

SEQ ID NO: 7499900 - DNA, 22 bp, Homo sapiens
aatgagtcaaaacagcatatag

SEQ ID NO: 7499901 - DNA, 22 bp, Homo sapiens
aatgagtcaaaacagcatatag

SEQ ID NO: 7499902 - DNA, 18 bp, Homo sapiens
agaaggagctatgggcag

SEQ ID NO: 7499903 - DNA, 18 bp, Homo sapiens
agaaggagctatgggcag

SEQ ID NO: 7499904 - DNA, 20 bp, Homo sapiens
aatgagttattttgtatatg

SEQ ID NO: 7499905 - DNA, 19 bp, Homo sapiens
aatgagttccatgaaaaga

SEQ ID NO: 7499906 - DNA, 19 bp, Homo sapiens
aatgagttccatgaaaaga

SEQ ID NO: 7499907 - DNA, 20 bp, Homo sapiens
aatgagttattttgtatatg

SEQ ID NO: 7499908 - DNA, 22 bp, Homo sapiens
aatgagttctgacacttcacga

SEQ ID NO: 7499909 - DNA, 22 bp, Homo sapiens
agaagggaactcagagatgatt

SEQ ID NO: 7499910 - DNA, 22 bp, Homo sapiens
agaagggaactcagagatgatt

SEQ ID NO: 7499911 - DNA, 22 bp, Homo sapiens
agaagggaactcagagatgatt

SEQ ID NO: 7499912 - DNA, 22 bp, Homo sapiens
agaagggaactcagagatgatt

SEQ ID NO: 7499913 - DNA, 22 bp, Homo sapiens
agaagggaactcagagatgatt

SEQ ID NO: 7499914 - DNA, 18 bp, Homo sapiens
agaaggagctatgggcag

SEQ ID NO: 7499915 - DNA, 18 bp, Homo sapiens
agaaggagctatgggcag

SEQ ID NO: 7499916 - DNA, 22 bp, Homo sapiens
agaagggaactcagagatgatt

SEQ ID NO: 7499917 - DNA, 22 bp, Homo sapiens
agaagggaactcagagatgatt

SEQ ID NO: 7499918 - DNA, 22 bp, Homo sapiens
agaagggaactcagagatgatt

SEQ ID NO: 7499919 - DNA, 21 bp, Homo sapiens
agaagggattgtggtaaagat

SEQ ID NO: 7499920 - DNA, 21 bp, Homo sapiens
agaagggattgtggtaaagat

SEQ ID NO: 7499921 - DNA, 21 bp, Homo sapiens
agaagggattgtggtaaagat

SEQ ID NO: 7499922 - DNA, 21 bp, Homo sapiens
agaagggattgtggtaaagat

SEQ ID NO: 7499923 - DNA, 21 bp, Homo sapiens
agaagggattgtggtaaagat

SEQ ID NO: 7499924 - DNA, 21 bp, Homo sapiens
agaagggattgtggtaaagat

SEQ ID NO: 7499925 - DNA, 22 bp, Homo sapiens
agaagggagagaaagttggtta

SEQ ID NO: 7499926 - DNA, 22 bp, Homo sapiens
agaagggaactcagagatgatt

SEQ ID NO: 7499927 - DNA, 22 bp, Homo sapiens
agaagggagagaaagttggtta

SEQ ID NO: 7499928 - DNA, 22 bp, Homo sapiens
agaagggagagaaagttggtta

SEQ ID NO: 7499929 - DNA, 22 bp, Homo sapiens
aatgaggctggatttggagctc

SEQ ID NO: 7499930 - DNA, 22 bp, Homo sapiens
aatgaggctggatttggagctc

SEQ ID NO: 7499931 - DNA, 22 bp, Homo sapiens
aatgaggcttgcattgtgaact

SEQ ID NO: 7499932 - DNA, 22 bp, Homo sapiens
aatgaggccagtagaaggaagt

SEQ ID NO: 7499933 - DNA, 20 bp, Homo sapiens
aatgaggcaatggagggcat

SEQ ID NO: 7499934 - DNA, 23 bp, Homo sapiens
aatgaggcattgcattgattctg

SEQ ID NO: 7499935 - DNA, 23 bp, Homo sapiens
aatgaggcattgcattgattctg

SEQ ID NO: 7499936 - DNA, 21 bp, Homo sapiens
aatgaggcaaggaggaggata

SEQ ID NO: 7499937 - DNA, 22 bp, Homo sapiens
aatgagctgctgctgttccacc

SEQ ID NO: 7499938 - DNA, 22 bp, Homo sapiens
aatgaggcttgtggggtagggc

SEQ ID NO: 7499939 - DNA, 22 bp, Homo sapiens
aatgaggctggctatggattaa

SEQ ID NO: 7499940 - DNA, 22 bp, Homo sapiens
aatgaggctggctatggattaa

SEQ ID NO: 7499941 - DNA, 22 bp, Homo sapiens
aatgagggggatgggaaagtgt

SEQ ID NO: 7499942 - DNA, 22 bp, Homo sapiens
aatgagggggatgggaaagtgt

SEQ ID NO: 7499943 - DNA, 22 bp, Homo sapiens
aatgagggggatgggaaagtgt

SEQ ID NO: 7499944 - DNA, 22 bp, Homo sapiens
aatgagggggatgggaaagtgt

SEQ ID NO: 7499945 - DNA, 22 bp, Homo sapiens
aatgaggttggcataattaaat

SEQ ID NO: 7499946 - DNA, 22 bp, Homo sapiens
aatgaggtgttgagaccagcac

SEQ ID NO: 7499947 - DNA, 22 bp, Homo sapiens
aatgaggtgaggaaggcctcag

SEQ ID NO: 7499948 - DNA, 20 bp, Homo sapiens
aatgagatgacttagaggaa

SEQ ID NO: 7499949 - DNA, 22 bp, Homo sapiens
aatgagatcagagataactcaa

SEQ ID NO: 7499950 - DNA, 22 bp, Homo sapiens
aatgagatggaattcccgccta

SEQ ID NO: 7499951 - DNA, 22 bp, Homo sapiens
aatgagatggaattcccgccta

SEQ ID NO: 7499952 - DNA, 22 bp, Homo sapiens
aatgagatggaggactcttaat

SEQ ID NO: 7499953 - DNA, 22 bp, Homo sapiens
aatgagatggaattcccgccta

SEQ ID NO: 7499954 - DNA, 22 bp, Homo sapiens
aatgagatggaattcccgccta

SEQ ID NO: 7499955 - DNA, 22 bp, Homo sapiens
aatgagcaaatgaagacgctgt

SEQ ID NO: 7499956 - DNA, 20 bp, Homo sapiens
aatgagattccttatgatag

SEQ ID NO: 7499957 - DNA, 22 bp, Homo sapiens
aatgagatgttgaattattgtt

SEQ ID NO: 7499958 - DNA, 22 bp, Homo sapiens
aatgagattccaatagctcctg

SEQ ID NO: 7499959 - DNA, 22 bp, Homo sapiens
aatgagatggcaatgacttaaa

SEQ ID NO: 7499960 - DNA, 22 bp, Homo sapiens
aatgagatggcaatgacttaaa

SEQ ID NO: 7499961 - DNA, 22 bp, Homo sapiens
agaaaacataggagacaggaaa

SEQ ID NO: 7499962 - DNA, 22 bp, Homo sapiens
agaaaacataggagacaggaaa

SEQ ID NO: 7499963 - DNA, 22 bp, Homo sapiens
agaaaacataggagacaggaaa

SEQ ID NO: 7499964 - DNA, 22 bp, Homo sapiens
agaaaacattacataggtgtgt

SEQ ID NO: 7499965 - DNA, 22 bp, Homo sapiens
agaaaacattacataggtgtgt

SEQ ID NO: 7499966 - DNA, 22 bp, Homo sapiens
agaaaacattacataggtgtgt

SEQ ID NO: 7499967 - DNA, 22 bp, Homo sapiens
agaaaacataggagacaggaaa

SEQ ID NO: 7499968 - DNA, 22 bp, Homo sapiens
agaaaacataggagacaggaaa

SEQ ID NO: 7499969 - DNA, 22 bp, Homo sapiens
agaaaacataggagacaggaaa

SEQ ID NO: 7499970 - DNA, 22 bp, Homo sapiens
agaaaacagaaagtcattggtg

SEQ ID NO: 7499971 - DNA, 22 bp, Homo sapiens
agaaaacagaaagtcattggtg

SEQ ID NO: 7499972 - DNA, 22 bp, Homo sapiens
agaaaacagaaagtcattggtg

SEQ ID NO: 7499973 - DNA, 22 bp, Homo sapiens
agaaaacataggagacaggaaa

SEQ ID NO: 7499974 - DNA, 22 bp, Homo sapiens
agaaaacagaaagtcattggtg

SEQ ID NO: 7499975 - DNA, 22 bp, Homo sapiens
agaaaacagaaagtcattggtg

SEQ ID NO: 7499976 - DNA, 22 bp, Homo sapiens
agaaaacataggagacaggaaa

SEQ ID NO: 7499977 - DNA, 22 bp, Homo sapiens
agaaaacataggagacaggaaa

SEQ ID NO: 7499978 - DNA, 22 bp, Homo sapiens
agaaaacataggagacaggaaa

SEQ ID NO: 7499979 - DNA, 22 bp, Homo sapiens
agaaaacataggagacaggaaa

SEQ ID NO: 7499980 - DNA, 22 bp, Homo sapiens
agaaaacataggagacaggaaa

SEQ ID NO: 7499981 - DNA, 22 bp, Homo sapiens
agaaaacataggagacaggaaa

SEQ ID NO: 7499982 - DNA, 22 bp, Homo sapiens
agaaaaatcttggcgcttgtct

SEQ ID NO: 7499983 - DNA, 22 bp, Homo sapiens
agaaaacactgccccctctctc

SEQ ID NO: 7499984 - DNA, 22 bp, Homo sapiens
agaaaacactgccccctctctc

SEQ ID NO: 7499985 - DNA, 22 bp, Homo sapiens
agaaaacactgccccctctctc

SEQ ID NO: 7499986 - DNA, 22 bp, Homo sapiens
agaaaacagaaagtcattggtg

SEQ ID NO: 7499987 - DNA, 22 bp, Homo sapiens
agaaaacagaaagtcattggtg

SEQ ID NO: 7499988 - DNA, 22 bp, Homo sapiens
agaaaacagaaagtcattggtg

SEQ ID NO: 7499989 - DNA, 22 bp, Homo sapiens
agaaaacagaaagtcattggtg

SEQ ID NO: 7499990 - DNA, 22 bp, Homo sapiens
agaaaacactgccccctctctc

SEQ ID NO: 7499991 - DNA, 22 bp, Homo sapiens
agaaaacactgccccctctctc

SEQ ID NO: 7499992 - DNA, 22 bp, Homo sapiens
agaaaacactgccccctctctc

SEQ ID NO: 7499993 - DNA, 22 bp, Homo sapiens
agaaaacagaaagtcattggtg

SEQ ID NO: 7499994 - DNA, 22 bp, Homo sapiens
aatcctggcatgtgccttggga

SEQ ID NO: 7499995 - DNA, 22 bp, Homo sapiens
agaaaaatcttggcgcttgtct

SEQ ID NO: 7499996 - DNA, 22 bp, Homo sapiens
aatcctggcatgtgccttggga

SEQ ID NO: 7499997 - DNA, 22 bp, Homo sapiens
agaaaaatcttggcgcttgtct

SEQ ID NO: 7499998 - DNA, 22 bp, Homo sapiens
aatcctggaatgagtttgctga

SEQ ID NO: 7499999 - DNA, 22 bp, Homo sapiens
aatcctggaatgagtttgctga

SEQ ID NO: 7500000 - DNA, 22 bp, Homo sapiens
agaaaaatcttggcgcttgtct

SEQ ID NO: 7500001 - DNA, 22 bp, Homo sapiens
agaaaaatcttggcgcttgtct

SEQ ID NO: 7500002 - DNA, 22 bp, Homo sapiens
agaaaaatcttggcgcttgtct

SEQ ID NO: 7500003 - DNA, 22 bp, Homo sapiens
agaaaaatcttggcgcttgtct

SEQ ID NO: 7500004 - DNA, 22 bp, Homo sapiens
agaaaacattacataggtgtgt

SEQ ID NO: 7500005 - DNA, 22 bp, Homo sapiens
agaaaacattacataggtgtgt

SEQ ID NO: 7500006 - DNA, 22 bp, Homo sapiens
agaaaacattacataggtgtgt

SEQ ID NO: 7500007 - DNA, 22 bp, Homo sapiens
agaaaacattacataggtgtgt

SEQ ID NO: 7500008 - DNA, 22 bp, Homo sapiens
agaaaactctacatctgtatgt

SEQ ID NO: 7500009 - DNA, 22 bp, Homo sapiens
agaaaactctacatctgtatgt

SEQ ID NO: 7500010 - DNA, 22 bp, Homo sapiens
agaaaactctacatctgtatgt

SEQ ID NO: 7500011 - DNA, 22 bp, Homo sapiens
agaaaactctacatctgtatgt

SEQ ID NO: 7500012 - DNA, 22 bp, Homo sapiens
agaaaacattacataggtgtgt

SEQ ID NO: 7500013 - DNA, 22 bp, Homo sapiens
agaaaacattacataggtgtgt

SEQ ID NO: 7500014 - DNA, 22 bp, Homo sapiens
agaaaactggagcctggggttg

SEQ ID NO: 7500015 - DNA, 22 bp, Homo sapiens
aatgaaactagtagaatctttg

SEQ ID NO: 7500016 - DNA, 22 bp, Homo sapiens
aatgaaactatatttagagagg

SEQ ID NO: 7500017 - DNA, 22 bp, Homo sapiens
aatgaaactatatttagagagg

SEQ ID NO: 7500018 - DNA, 22 bp, Homo sapiens
aatgaaactatatttagagagg

SEQ ID NO: 7500019 - DNA, 22 bp, Homo sapiens
agaaaactctacatctgtatgt

SEQ ID NO: 7500020 - DNA, 22 bp, Homo sapiens
agaaaactgcagagtagcctca

SEQ ID NO: 7500021 - DNA, 22 bp, Homo sapiens
agaaaactctacatctgtatgt

SEQ ID NO: 7500022 - DNA, 22 bp, Homo sapiens
agaaaactgcagagtagcctca

SEQ ID NO: 7500023 - DNA, 22 bp, Homo sapiens
agaaaactgcagagtagcctca

SEQ ID NO: 7500024 - DNA, 22 bp, Homo sapiens
aatgaaactcgaaataatcaca

SEQ ID NO: 7500025 - DNA, 22 bp, Homo sapiens
aatgaaactcgaaataatcaca

SEQ ID NO: 7500026 - DNA, 22 bp, Homo sapiens
aatgaaactcgaaataatcaca

SEQ ID NO: 7500027 - DNA, 22 bp, Homo sapiens
aatgaaactcgaaataatcaca

SEQ ID NO: 7500028 - DNA, 22 bp, Homo sapiens
aatgaacaagaaagactttgag

SEQ ID NO: 7500029 - DNA, 22 bp, Homo sapiens
aatgaaactcgaaataatcaca

SEQ ID NO: 7500030 - DNA, 22 bp, Homo sapiens
aatgaacaagagagagaacttt

SEQ ID NO: 7500031 - DNA, 22 bp, Homo sapiens
aatgaacaagagagagaacttt

SEQ ID NO: 7500032 - DNA, 22 bp, Homo sapiens
aatgaacaagagagagaacttt

SEQ ID NO: 7500033 - DNA, 22 bp, Homo sapiens
aatgaacaagagagagaacttt

SEQ ID NO: 7500034 - DNA, 22 bp, Homo sapiens
aatgaacaagagagagaacttt

SEQ ID NO: 7500035 - DNA, 22 bp, Homo sapiens
aatgaacacatgtggtcagttt

SEQ ID NO: 7500036 - DNA, 22 bp, Homo sapiens
aatgaacacatgtggtcagttt

SEQ ID NO: 7500037 - DNA, 22 bp, Homo sapiens
aatgaacacgctggtggtgcaa

SEQ ID NO: 7500038 - DNA, 22 bp, Homo sapiens
aatgaacacagccctctacttt

SEQ ID NO: 7500039 - DNA, 22 bp, Homo sapiens
aatgaacacagccctctacttt

SEQ ID NO: 7500040 - DNA, 22 bp, Homo sapiens
aatgaacacagccctctacttt

SEQ ID NO: 7500041 - DNA, 22 bp, Homo sapiens
aatgaacacatgtggtcagttt

SEQ ID NO: 7500042 - DNA, 22 bp, Homo sapiens
aatgaacacagccctctacttt

SEQ ID NO: 7500043 - DNA, 22 bp, Homo sapiens
aatgaacacagccctctacttt

SEQ ID NO: 7500044 - DNA, 18 bp, Homo sapiens
agaaataccagtattgga

SEQ ID NO: 7500045 - DNA, 18 bp, Homo sapiens
agaaataccagtattgga

SEQ ID NO: 7500046 - DNA, 18 bp, Homo sapiens
agaaataccagtattgga

SEQ ID NO: 7500047 - DNA, 18 bp, Homo sapiens
agaaataccagtattgga

SEQ ID NO: 7500048 - DNA, 20 bp, Homo sapiens
agaaataccacatttggcaa

SEQ ID NO: 7500049 - DNA, 22 bp, Homo sapiens
agaaatacattctctggtgtgt

SEQ ID NO: 7500050 - DNA, 20 bp, Homo sapiens
agaaatacatgcatgcatga

SEQ ID NO: 7500051 - DNA, 20 bp, Homo sapiens
agaaatacatgcatgcatga

SEQ ID NO: 7500052 - DNA, 22 bp, Homo sapiens
agaaatactaggaatattcata

SEQ ID NO: 7500053 - DNA, 22 bp, Homo sapiens
agaaatactaggaatattcata

SEQ ID NO: 7500054 - DNA, 22 bp, Homo sapiens
agaaatactaggaatattcata

SEQ ID NO: 7500055 - DNA, 22 bp, Homo sapiens
agaaatactaggaatattcata

SEQ ID NO: 7500056 - DNA, 22 bp, Homo sapiens
agaaatactaggaatattcata

SEQ ID NO: 7500057 - DNA, 18 bp, Homo sapiens
agaaataccagtattgga

SEQ ID NO: 7500058 - DNA, 22 bp, Homo sapiens
agaaatactaggaatattcata

SEQ ID NO: 7500059 - DNA, 22 bp, Homo sapiens
agaaatactaggaatattcata

SEQ ID NO: 7500060 - DNA, 22 bp, Homo sapiens
agaaatactaggaatattcata

SEQ ID NO: 7500061 - DNA, 22 bp, Homo sapiens
agaaatactaggaatattcata

SEQ ID NO: 7500062 - DNA, 23 bp, Homo sapiens
aatgaactgagaatctgtacagt

SEQ ID NO: 7500063 - DNA, 22 bp, Homo sapiens
agaaataagagctttccttggg

SEQ ID NO: 7500064 - DNA, 22 bp, Homo sapiens
agaaataagagctttccttggg

SEQ ID NO: 7500065 - DNA, 22 bp, Homo sapiens
agaaataagagctttccttggg

SEQ ID NO: 7500066 - DNA, 22 bp, Homo sapiens
agaaataagagctttccttggg

SEQ ID NO: 7500067 - DNA, 22 bp, Homo sapiens
agaaataagagctttccttggg

SEQ ID NO: 7500068 - DNA, 22 bp, Homo sapiens
agaaataatcagcttaggggca

SEQ ID NO: 7500069 - DNA, 22 bp, Homo sapiens
agaaataagagctttccttggg

SEQ ID NO: 7500070 - DNA, 22 bp, Homo sapiens
agaaatacaaagtactaagata

SEQ ID NO: 7500071 - DNA, 22 bp, Homo sapiens
agaaatacaaagtactaagata

SEQ ID NO: 7500072 - DNA, 22 bp, Homo sapiens
agaaatacaaagtactaagata

SEQ ID NO: 7500073 - DNA, 22 bp, Homo sapiens
agaaatacaaagtactaagata

SEQ ID NO: 7500074 - DNA, 20 bp, Homo sapiens
agaaatacatgcatgcatga

SEQ ID NO: 7500075 - DNA, 20 bp, Homo sapiens
agaaatacatgcatgcatga

SEQ ID NO: 7500076 - DNA, 21 bp, Homo sapiens
agaaatacagcagggatgatc

SEQ ID NO: 7500077 - DNA, 21 bp, Homo sapiens
agaaatacagcagggatgatc

SEQ ID NO: 7500078 - DNA, 22 bp, Homo sapiens
agaaatacaaagtactaagata

SEQ ID NO: 7500079 - DNA, 22 bp, Homo sapiens
agaaatacaaagtactaagata

SEQ ID NO: 7500080 - DNA, 22 bp, Homo sapiens
agaaatacaaagtactaagata

SEQ ID NO: 7500081 - DNA, 22 bp, Homo sapiens
aatgaacaggtgaatgtcagat

SEQ ID NO: 7500082 - DNA, 22 bp, Homo sapiens
aatgaacaggtgaatgtcagat

SEQ ID NO: 7500083 - DNA, 22 bp, Homo sapiens
aatgaacagtgggtgaggtacc

SEQ ID NO: 7500084 - DNA, 22 bp, Homo sapiens
aatgaacagtgggtgaggtacc

SEQ ID NO: 7500085 - DNA, 22 bp, Homo sapiens
aatgaacagtgggtgaggtacc

SEQ ID NO: 7500086 - DNA, 22 bp, Homo sapiens
aatgaacagtgggtgaggtacc

SEQ ID NO: 7500087 - DNA, 22 bp, Homo sapiens
aatgaacatataaagagatctt

SEQ ID NO: 7500088 - DNA, 22 bp, Homo sapiens
aatgaacatataaagagatctt

SEQ ID NO: 7500089 - DNA, 22 bp, Homo sapiens
aatgaacatataaagagatctt

SEQ ID NO: 7500090 - DNA, 22 bp, Homo sapiens
aatgaacatataaagagatctt

SEQ ID NO: 7500091 - DNA, 22 bp, Homo sapiens
aatgaacatataaagagatctt

SEQ ID NO: 7500092 - DNA, 22 bp, Homo sapiens
aatgaacacttagcctttctat

SEQ ID NO: 7500093 - DNA, 22 bp, Homo sapiens
aatgaacacttagcctttctat

SEQ ID NO: 7500094 - DNA, 22 bp, Homo sapiens
aatgaacagatacacataggca

SEQ ID NO: 7500095 - DNA, 22 bp, Homo sapiens
aatgaacagatacacataggca

SEQ ID NO: 7500096 - DNA, 22 bp, Homo sapiens
aatgaacaggtgaatgtcagat

SEQ ID NO: 7500097 - DNA, 22 bp, Homo sapiens
aatgaacagatacacataggca

SEQ ID NO: 7500098 - DNA, 22 bp, Homo sapiens
aatgaacaggtgaatgtcagat

SEQ ID NO: 7500099 - DNA, 22 bp, Homo sapiens
aatgaacaggtgaatgtcagat

SEQ ID NO: 7500100 - DNA, 22 bp, Homo sapiens
aatgaacaggtgaatgtcagat

SEQ ID NO: 7500101 - DNA, 22 bp, Homo sapiens
aatgaacaggtgaatgtcagat

SEQ ID NO: 7500102 - DNA, 22 bp, Homo sapiens
aatgaacaggtgaatgtcagat

SEQ ID NO: 7500103 - DNA, 22 bp, Homo sapiens
aatgaacaggtgaatgtcagat

SEQ ID NO: 7500104 - DNA, 22 bp, Homo sapiens
aatgaactccgaacatttacat

SEQ ID NO: 7500105 - DNA, 23 bp, Homo sapiens
aatgaactgagaatctgtacagt

SEQ ID NO: 7500106 - DNA, 22 bp, Homo sapiens
aatgaacccttcaagctctgat

SEQ ID NO: 7500107 - DNA, 22 bp, Homo sapiens
aatgaacccttcaagctctgat

SEQ ID NO: 7500108 - DNA, 22 bp, Homo sapiens
aatgaacggtgtccatctgttt

SEQ ID NO: 7500109 - DNA, 22 bp, Homo sapiens
aatgaacatggacaagttaata

SEQ ID NO: 7500110 - DNA, 22 bp, Homo sapiens
aatgaacatggacaagttaata

SEQ ID NO: 7500111 - DNA, 22 bp, Homo sapiens
aatgaacatggacaagttaata

SEQ ID NO: 7500112 - DNA, 22 bp, Homo sapiens
aatgaacatgggagtactaata

SEQ ID NO: 7500113 - DNA, 22 bp, Homo sapiens
aatgaacatgggagtactaata

SEQ ID NO: 7500114 - DNA, 22 bp, Homo sapiens
aatgaacatcaaatgcctacca

SEQ ID NO: 7500115 - DNA, 22 bp, Homo sapiens
aatgaacatcaaatgcctacca

SEQ ID NO: 7500116 - DNA, 22 bp, Homo sapiens
aatgaacatataaagagatctt

SEQ ID NO: 7500117 - DNA, 22 bp, Homo sapiens
aatgaacatataaagagatctt

SEQ ID NO: 7500118 - DNA, 22 bp, Homo sapiens
aatgaacatggacaagttaata

SEQ ID NO: 7500119 - DNA, 22 bp, Homo sapiens
aatgaacatggacaagttaata

SEQ ID NO: 7500120 - DNA, 22 bp, Homo sapiens
aatgaacatggacaagttaata

SEQ ID NO: 7500121 - DNA, 22 bp, Homo sapiens
aatgaacatggacaagttaata

SEQ ID NO: 7500122 - DNA, 22 bp, Homo sapiens
aatgaacatggacaagttaata

SEQ ID NO: 7500123 - DNA, 22 bp, Homo sapiens
acttcctgctatgagcttctgt

SEQ ID NO: 7500124 - DNA, 22 bp, Homo sapiens
acttcctggattcccaagggct

SEQ ID NO: 7500125 - DNA, 22 bp, Homo sapiens
acttcctggattcccaagggct

SEQ ID NO: 7500126 - DNA, 22 bp, Homo sapiens
acttcttttcaaatcatgcaaa

SEQ ID NO: 7500127 - DNA, 19 bp, Homo sapiens
acttcttttcaacacagga

SEQ ID NO: 7500128 - DNA, 19 bp, Homo sapiens
acttcttttcaacacagga

SEQ ID NO: 7500129 - DNA, 19 bp, Homo sapiens
acttcttttcaacacagga

SEQ ID NO: 7500130 - DNA, 22 bp, Homo sapiens
acttcttttcaaatcatgcaaa

SEQ ID NO: 7500131 - DNA, 22 bp, Homo sapiens
acttcttttcaaatcatgcaaa

SEQ ID NO: 7500132 - DNA, 22 bp, Homo sapiens
aatacaatcaaattcactagca

SEQ ID NO: 7500133 - DNA, 22 bp, Homo sapiens
aatacactattttgtgctcagt

SEQ ID NO: 7500134 - DNA, 22 bp, Homo sapiens
aatacactattttgtgctcagt

SEQ ID NO: 7500135 - DNA, 22 bp, Homo sapiens
aatacaatcaaattcactagca

SEQ ID NO: 7500136 - DNA, 22 bp, Homo sapiens
aatacaatcaaattcactagca

SEQ ID NO: 7500137 - DNA, 22 bp, Homo sapiens
aatacaatcaaattcactagca

SEQ ID NO: 7500138 - DNA, 22 bp, Homo sapiens
aatacaatcaaattcactagca

SEQ ID NO: 7500139 - DNA, 22 bp, Homo sapiens
aatacaatcaaattcactagca

SEQ ID NO: 7500140 - DNA, 22 bp, Homo sapiens
aatacagagaatgttatttgga

SEQ ID NO: 7500141 - DNA, 22 bp, Homo sapiens
aatacagagaatgttatttgga

SEQ ID NO: 7500142 - DNA, 22 bp, Homo sapiens
aatacagagaatgttatttgga

SEQ ID NO: 7500143 - DNA, 21 bp, Homo sapiens
aatacagaaatgagtagttgc

SEQ ID NO: 7500144 - DNA, 22 bp, Homo sapiens
aatacagagaatgttatttgga

SEQ ID NO: 7500145 - DNA, 22 bp, Homo sapiens
aatacagagaatgttatttgga

SEQ ID NO: 7500146 - DNA, 21 bp, Homo sapiens
aatacagaaatgagtagttgc

SEQ ID NO: 7500147 - DNA, 21 bp, Homo sapiens
aatacagaaatgagtagttgc

SEQ ID NO: 7500148 - DNA, 21 bp, Homo sapiens
aatacagaaatgagtagttgc

SEQ ID NO: 7500149 - DNA, 21 bp, Homo sapiens
aatacagaaatgagtagttgc

SEQ ID NO: 7500150 - DNA, 21 bp, Homo sapiens
aatacagaaatgagtagttgc

SEQ ID NO: 7500151 - DNA, 22 bp, Homo sapiens
aatacactattttgtgctcagt

SEQ ID NO: 7500152 - DNA, 22 bp, Homo sapiens
acttgaaagaagtttccttaaa

SEQ ID NO: 7500153 - DNA, 19 bp, Homo sapiens
acttgaaagcagagagttt

SEQ ID NO: 7500154 - DNA, 22 bp, Homo sapiens
acttgaaaccttggcaaacaat

SEQ ID NO: 7500155 - DNA, 22 bp, Homo sapiens
acttgaaagaagtttccttaaa

SEQ ID NO: 7500156 - DNA, 19 bp, Homo sapiens
acttgaaagcagagagttt

SEQ ID NO: 7500157 - DNA, 19 bp, Homo sapiens
acttgaaagcagagagttt

SEQ ID NO: 7500158 - DNA, 19 bp, Homo sapiens
acttgaaagcagagagttt

SEQ ID NO: 7500159 - DNA, 19 bp, Homo sapiens
acttgaaagcagagagttt

SEQ ID NO: 7500160 - DNA, 22 bp, Homo sapiens
acttgaaaggaagctctaaaac

SEQ ID NO: 7500161 - DNA, 22 bp, Homo sapiens
acttgaattaggccttgagaga

SEQ ID NO: 7500162 - DNA, 22 bp, Homo sapiens
acttgaattcaaagcgaaagca

SEQ ID NO: 7500163 - DNA, 22 bp, Homo sapiens
acttgaattatatttctagaga

SEQ ID NO: 7500164 - DNA, 22 bp, Homo sapiens
acttgaataggtgtcaaggcca

SEQ ID NO: 7500165 - DNA, 22 bp, Homo sapiens
acttgaataggtgtcaaggcca

SEQ ID NO: 7500166 - DNA, 22 bp, Homo sapiens
acttgaataggaaagccacaaa

SEQ ID NO: 7500167 - DNA, 21 bp, Homo sapiens
acttgaagttggagtttctgt

SEQ ID NO: 7500168 - DNA, 21 bp, Homo sapiens
acttgaagttggagtttctgt

SEQ ID NO: 7500169 - DNA, 21 bp, Homo sapiens
acttgaagttggagtttctgt

SEQ ID NO: 7500170 - DNA, 22 bp, Homo sapiens
acttgaaaccctgagatgataa

SEQ ID NO: 7500171 - DNA, 22 bp, Homo sapiens
acttgaaaccctgagatgataa

SEQ ID NO: 7500172 - DNA, 22 bp, Homo sapiens
acttgaaaccctgagatgataa

SEQ ID NO: 7500173 - DNA, 22 bp, Homo sapiens
acttgaaaccctgagatgataa

SEQ ID NO: 7500174 - DNA, 22 bp, Homo sapiens
acttgaaaccttggcaaacaat

SEQ ID NO: 7500175 - DNA, 22 bp, Homo sapiens
acttgaaaccttggcaaacaat

SEQ ID NO: 7500176 - DNA, 22 bp, Homo sapiens
acttgaaaccctgagatgataa

SEQ ID NO: 7500177 - DNA, 22 bp, Homo sapiens
acttgaaaccctgagatgataa

SEQ ID NO: 7500178 - DNA, 22 bp, Homo sapiens
acttgaaaccctgagatgataa

SEQ ID NO: 7500179 - DNA, 22 bp, Homo sapiens
acttgaaaccctgagatgataa

SEQ ID NO: 7500180 - DNA, 22 bp, Homo sapiens
acttgaaacatctttaaatgta

SEQ ID NO: 7500181 - DNA, 22 bp, Homo sapiens
acttgaaacatctttaaatgta

SEQ ID NO: 7500182 - DNA, 22 bp, Homo sapiens
acttgaaacatctttaaatgta

SEQ ID NO: 7500183 - DNA, 22 bp, Homo sapiens
acttgaaaagctcagcagtagt

SEQ ID NO: 7500184 - DNA, 22 bp, Homo sapiens
acttgaaaagctcagcagtagt

SEQ ID NO: 7500185 - DNA, 22 bp, Homo sapiens
acttgaaaagctcagcagtagt

SEQ ID NO: 7500186 - DNA, 19 bp, Homo sapiens
acttcttttcaacacagga

SEQ ID NO: 7500187 - DNA, 19 bp, Homo sapiens
acttcttttcaacacagga

SEQ ID NO: 7500188 - DNA, 19 bp, Homo sapiens
acttcttttcaacacagga

SEQ ID NO: 7500189 - DNA, 22 bp, Homo sapiens
acttgaaacatctttaaatgta

SEQ ID NO: 7500190 - DNA, 22 bp, Homo sapiens
acttgaaacatctttaaatgta

SEQ ID NO: 7500191 - DNA, 22 bp, Homo sapiens
acttgaaacatctttaaatgta

SEQ ID NO: 7500192 - DNA, 22 bp, Homo sapiens
aatatatgactccactgcatga

SEQ ID NO: 7500193 - DNA, 22 bp, Homo sapiens
aatatatgaccaggaagttctg

SEQ ID NO: 7500194 - DNA, 22 bp, Homo sapiens
aatatatgaccaggaagttctg

SEQ ID NO: 7500195 - DNA, 22 bp, Homo sapiens
aatatatagaagtacccgttgt

SEQ ID NO: 7500196 - DNA, 22 bp, Homo sapiens
aatatatagaagtacccgttgt

SEQ ID NO: 7500197 - DNA, 22 bp, Homo sapiens
aatatatagaagtacccgttgt

SEQ ID NO: 7500198 - DNA, 22 bp, Homo sapiens
aatatatagaagtacccgttgt

SEQ ID NO: 7500199 - DNA, 22 bp, Homo sapiens
aatatatgagggagctatttga

SEQ ID NO: 7500200 - DNA, 21 bp, Homo sapiens
aatatatgcaatgctttctgc

SEQ ID NO: 7500201 - DNA, 22 bp, Homo sapiens
aatatatgagggagctatttga

SEQ ID NO: 7500202 - DNA, 21 bp, Homo sapiens
aatatatgcaatgctttctgc

SEQ ID NO: 7500203 - DNA, 22 bp, Homo sapiens
aatatatgactccactgcatga

SEQ ID NO: 7500204 - DNA, 22 bp, Homo sapiens
aatatatgactccactgcatga

SEQ ID NO: 7500205 - DNA, 22 bp, Homo sapiens
aatatatgactccactgcatga

SEQ ID NO: 7500206 - DNA, 22 bp, Homo sapiens
aatatatgactccactgcatga

SEQ ID NO: 7500207 - DNA, 22 bp, Homo sapiens
aatatatgactccactgcatga

SEQ ID NO: 7500208 - DNA, 22 bp, Homo sapiens
acttgaggaagcagcaagggat

SEQ ID NO: 7500209 - DNA, 22 bp, Homo sapiens
acttgagaaaccaagtagaaag

SEQ ID NO: 7500210 - DNA, 22 bp, Homo sapiens
acttgactttgtcatttgtgct

SEQ ID NO: 7500211 - DNA, 22 bp, Homo sapiens
acttgaatttagtttttcctaa

SEQ ID NO: 7500212 - DNA, 22 bp, Homo sapiens
acttgaatttagtttttcctaa

SEQ ID NO: 7500213 - DNA, 22 bp, Homo sapiens
acttgacacctaattagtcatc

SEQ ID NO: 7500214 - DNA, 22 bp, Homo sapiens
acttgaatttagtttttcctaa

SEQ ID NO: 7500215 - DNA, 22 bp, Homo sapiens
acttgacacttatattactcac

SEQ ID NO: 7500216 - DNA, 22 bp, Homo sapiens
acttgacagaagtcagtacttt

SEQ ID NO: 7500217 - DNA, 22 bp, Homo sapiens
aatatatagaagtacccgttgt

SEQ ID NO: 7500218 - DNA, 22 bp, Homo sapiens
aatatatagaagtacccgttgt

SEQ ID NO: 7500219 - DNA, 22 bp, Homo sapiens
aatatatagaagtacccgttgt

SEQ ID NO: 7500220 - DNA, 22 bp, Homo sapiens
aatatatagaagtacccgttgt

SEQ ID NO: 7500221 - DNA, 22 bp, Homo sapiens
aatatatagaagtacccgttgt

SEQ ID NO: 7500222 - DNA, 22 bp, Homo sapiens
acttgaggaagcagcaagggat

SEQ ID NO: 7500223 - DNA, 22 bp, Homo sapiens
acttgaggaagcagcaagggat

SEQ ID NO: 7500224 - DNA, 23 bp, Homo sapiens
acttgattattgttgatagattc

SEQ ID NO: 7500225 - DNA, 22 bp, Homo sapiens
acttgattgtatgaagttattt

SEQ ID NO: 7500226 - DNA, 22 bp, Homo sapiens
aatattcatttgcagaagaagt

SEQ ID NO: 7500227 - DNA, 22 bp, Homo sapiens
aatattcatttgcagaagaagt

SEQ ID NO: 7500228 - DNA, 22 bp, Homo sapiens
aatatcagaatgtaatggtcct

SEQ ID NO: 7500229 - DNA, 22 bp, Homo sapiens
aatatcagaatgtaatggtcct

SEQ ID NO: 7500230 - DNA, 18 bp, Homo sapiens
aatatcaataagggggag

SEQ ID NO: 7500231 - DNA, 22 bp, Homo sapiens
aatatcacaggaggagaccaag

SEQ ID NO: 7500232 - DNA, 22 bp, Homo sapiens
aatatcacaggaggagaccaag

SEQ ID NO: 7500233 - DNA, 19 bp, Homo sapiens
aatattttagcctcttcct

SEQ ID NO: 7500234 - DNA, 19 bp, Homo sapiens
aatattttagcctcttcct

SEQ ID NO: 7500235 - DNA, 19 bp, Homo sapiens
aatattttagcctcttcct

SEQ ID NO: 7500236 - DNA, 19 bp, Homo sapiens
aatattttagcctcttcct

SEQ ID NO: 7500237 - DNA, 19 bp, Homo sapiens
aatattttagcctcttcct

SEQ ID NO: 7500238 - DNA, 19 bp, Homo sapiens
aatattttagcctcttcct

SEQ ID NO: 7500239 - DNA, 19 bp, Homo sapiens
aatattttagcctcttcct

SEQ ID NO: 7500240 - DNA, 22 bp, Homo sapiens
aatattctaataaatgcccatc

SEQ ID NO: 7500241 - DNA, 23 bp, Homo sapiens
aatattcctgccattaatgactc

SEQ ID NO: 7500242 - DNA, 22 bp, Homo sapiens
aatatttgttagtgttttaatg

SEQ ID NO: 7500243 - DNA, 22 bp, Homo sapiens
aatatatttgaatcaggaacaa

SEQ ID NO: 7500244 - DNA, 22 bp, Homo sapiens
aatatcaacagtgtccttctaa

SEQ ID NO: 7500245 - DNA, 22 bp, Homo sapiens
aatatcaacagtgtccttctaa

SEQ ID NO: 7500246 - DNA, 22 bp, Homo sapiens
aatatcaacagtgtccttctaa

SEQ ID NO: 7500247 - DNA, 22 bp, Homo sapiens
aatatatttgaatcaggaacaa

SEQ ID NO: 7500248 - DNA, 22 bp, Homo sapiens
aatatcaacagtgtccttctaa

SEQ ID NO: 7500249 - DNA, 22 bp, Homo sapiens
aatatcaacagtgtccttctaa

SEQ ID NO: 7500250 - DNA, 22 bp, Homo sapiens
aatatcaacagtgtccttctaa

SEQ ID NO: 7500251 - DNA, 22 bp, Homo sapiens
aatatcaacagtgtccttctaa

SEQ ID NO: 7500252 - DNA, 23 bp, Homo sapiens
aatatcaaggtgatgttcccaga

SEQ ID NO: 7500253 - DNA, 22 bp, Homo sapiens
aatatcaacagtgtccttctaa

SEQ ID NO: 7500254 - DNA, 23 bp, Homo sapiens
aatatcaaggtgatgttcccaga

SEQ ID NO: 7500255 - DNA, 23 bp, Homo sapiens
aatatcaaggtgatgttcccaga

SEQ ID NO: 7500256 - DNA, 23 bp, Homo sapiens
aatatcaaggtgatgttcccaga

SEQ ID NO: 7500257 - DNA, 23 bp, Homo sapiens
aatatcaaggtgatgttcccaga

SEQ ID NO: 7500258 - DNA, 22 bp, Homo sapiens
aatatatttgaatcaggaacaa

SEQ ID NO: 7500259 - DNA, 22 bp, Homo sapiens
aatatatttgaatcaggaacaa

SEQ ID NO: 7500260 - DNA, 22 bp, Homo sapiens
aatatatttgaatcaggaacaa

SEQ ID NO: 7500261 - DNA, 22 bp, Homo sapiens
aatatatttgaatcaggaacaa

SEQ ID NO: 7500262 - DNA, 22 bp, Homo sapiens
aatatatttgaatcaggaacaa

SEQ ID NO: 7500263 - DNA, 22 bp, Homo sapiens
aatatatttgaatcaggaacaa

SEQ ID NO: 7500264 - DNA, 23 bp, Homo sapiens
aatatatgtgtttttctgcttca

SEQ ID NO: 7500265 - DNA, 22 bp, Homo sapiens
aatatatttgaatcaggaacaa

SEQ ID NO: 7500266 - DNA, 23 bp, Homo sapiens
aatatatgtgtttttctgcttca

SEQ ID NO: 7500267 - DNA, 22 bp, Homo sapiens
aatatatgtggtattgaccagc

SEQ ID NO: 7500268 - DNA, 22 bp, Homo sapiens
aatcaagagctgactatatttt

SEQ ID NO: 7500269 - DNA, 22 bp, Homo sapiens
aatcaagaggcgatggatggaa

SEQ ID NO: 7500270 - DNA, 22 bp, Homo sapiens
aatcaagaataagttgtaaagc

SEQ ID NO: 7500271 - DNA, 22 bp, Homo sapiens
aatcaagaataagttgtaaagc

SEQ ID NO: 7500272 - DNA, 22 bp, Homo sapiens
aatcaagaataagttgtaaagc

SEQ ID NO: 7500273 - DNA, 22 bp, Homo sapiens
aatcaagagctgactatatttt

SEQ ID NO: 7500274 - DNA, 22 bp, Homo sapiens
aatcaagaggcgatggatggaa

SEQ ID NO: 7500275 - DNA, 21 bp, Homo sapiens
aatcaagagtactggtgtggc

SEQ ID NO: 7500276 - DNA, 22 bp, Homo sapiens
acttgtaaacaaatctaatgta

SEQ ID NO: 7500277 - DNA, 21 bp, Homo sapiens
acttgtaacttgaaggggcat

SEQ ID NO: 7500278 - DNA, 22 bp, Homo sapiens
acttgtaaacaaatctaatgta

SEQ ID NO: 7500279 - DNA, 22 bp, Homo sapiens
acttgtaagtaacaagtgagaa

SEQ ID NO: 7500280 - DNA, 22 bp, Homo sapiens
acttgtaagctctgtatttgag

SEQ ID NO: 7500281 - DNA, 22 bp, Homo sapiens
acttgtaattcctggcccaggt

SEQ ID NO: 7500282 - DNA, 22 bp, Homo sapiens
acttgtaagtaacaagtgagaa

SEQ ID NO: 7500283 - DNA, 22 bp, Homo sapiens
acttgtctttaatccgaatgta

SEQ ID NO: 7500284 - DNA, 22 bp, Homo sapiens
acttgtctatggttacatccta

SEQ ID NO: 7500285 - DNA, 22 bp, Homo sapiens
acttgtctggcagatcatgcaa

SEQ ID NO: 7500286 - DNA, 22 bp, Homo sapiens
acttgtctttgtaaaatagaaa

SEQ ID NO: 7500287 - DNA, 22 bp, Homo sapiens
acttgtctttgtaaaatagaaa

SEQ ID NO: 7500288 - DNA, 22 bp, Homo sapiens
acttgtctttgtaaaatagaaa

SEQ ID NO: 7500289 - DNA, 22 bp, Homo sapiens
acttgtatggagacttggaacc

SEQ ID NO: 7500290 - DNA, 22 bp, Homo sapiens
acttgtacttaaaaattatttg

SEQ ID NO: 7500291 - DNA, 22 bp, Homo sapiens
acttgtacttaaaaattatttg

SEQ ID NO: 7500292 - DNA, 22 bp, Homo sapiens
acttgtacttaaaaattatttg

SEQ ID NO: 7500293 - DNA, 17 bp, Homo sapiens
acttgtattgtgcttta

SEQ ID NO: 7500294 - DNA, 17 bp, Homo sapiens
acttgtattgtgcttta

SEQ ID NO: 7500295 - DNA, 22 bp, Homo sapiens
acttgtctaccatgaatattta

SEQ ID NO: 7500296 - DNA, 22 bp, Homo sapiens
acttgtctaccatgaatattta

SEQ ID NO: 7500297 - DNA, 22 bp, Homo sapiens
acttgtctatggttacatccta

SEQ ID NO: 7500298 - DNA, 22 bp, Homo sapiens
acttgtgttaccaaggtttggt

SEQ ID NO: 7500299 - DNA, 22 bp, Homo sapiens
acttgttagttttatctgcatg

SEQ ID NO: 7500300 - DNA, 22 bp, Homo sapiens
acttgttaactctcaaagaaca

SEQ ID NO: 7500301 - DNA, 22 bp, Homo sapiens
acttgtgtaacacagaaagaac

SEQ ID NO: 7500302 - DNA, 22 bp, Homo sapiens
acttgttcattgagtacatatg

SEQ ID NO: 7500303 - DNA, 22 bp, Homo sapiens
acttgttcattgagtacatatg

SEQ ID NO: 7500304 - DNA, 22 bp, Homo sapiens
acttgttaactctcaaagaaca

SEQ ID NO: 7500305 - DNA, 22 bp, Homo sapiens
acttgtttacaagcagttctga

SEQ ID NO: 7500306 - DNA, 22 bp, Homo sapiens
acttgtttacaagcagttctga

SEQ ID NO: 7500307 - DNA, 22 bp, Homo sapiens
acttgtttacaagcagttctga

SEQ ID NO: 7500308 - DNA, 22 bp, Homo sapiens
aatattttaggctttccaggct

SEQ ID NO: 7500309 - DNA, 22 bp, Homo sapiens
aatattttaggctttccaggct

SEQ ID NO: 7500310 - DNA, 22 bp, Homo sapiens
aatattttaggctttccaggct

SEQ ID NO: 7500311 - DNA, 22 bp, Homo sapiens
aatattttaggctttccaggct

SEQ ID NO: 7500312 - DNA, 22 bp, Homo sapiens
aatattttaggctttccaggct

SEQ ID NO: 7500313 - DNA, 22 bp, Homo sapiens
aatattttaggctttccaggct

SEQ ID NO: 7500314 - DNA, 22 bp, Homo sapiens
aatattttaggctttccaggct

SEQ ID NO: 7500315 - DNA, 22 bp, Homo sapiens
aatattttaggctttccaggct

SEQ ID NO: 7500316 - DNA, 19 bp, Homo sapiens
aatattttagcctcttcct

SEQ ID NO: 7500317 - DNA, 19 bp, Homo sapiens
aatattttagcctcttcct

SEQ ID NO: 7500318 - DNA, 19 bp, Homo sapiens
aatattttagcctcttcct

SEQ ID NO: 7500319 - DNA, 19 bp, Homo sapiens
aatattttagcctcttcct

SEQ ID NO: 7500320 - DNA, 19 bp, Homo sapiens
aatattttagcctcttcct

SEQ ID NO: 7500321 - DNA, 22 bp, Homo sapiens
aatatttttgaggccctgttat

SEQ ID NO: 7500322 - DNA, 22 bp, Homo sapiens
aatatttttgaggccctgttat

SEQ ID NO: 7500323 - DNA, 22 bp, Homo sapiens
aatatttttgaggccctgttat

SEQ ID NO: 7500324 - DNA, 22 bp, Homo sapiens
aatatttttgaggccctgttat

SEQ ID NO: 7500325 - DNA, 22 bp, Homo sapiens
aatatttttgaggccctgttat

SEQ ID NO: 7500326 - DNA, 22 bp, Homo sapiens
aatatttttgaggccctgttat

SEQ ID NO: 7500327 - DNA, 22 bp, Homo sapiens
aatatttttgaggccctgttat

SEQ ID NO: 7500328 - DNA, 22 bp, Homo sapiens
aatatttttgaggccctgttat

SEQ ID NO: 7500329 - DNA, 22 bp, Homo sapiens
aatatttttgaggccctgttat

SEQ ID NO: 7500330 - DNA, 22 bp, Homo sapiens
aatatttttgaggccctgttat

SEQ ID NO: 7500331 - DNA, 22 bp, Homo sapiens
aatatttttgaggccctgttat

SEQ ID NO: 7500332 - DNA, 22 bp, Homo sapiens
aatatttttgaggccctgttat

SEQ ID NO: 7500333 - DNA, 22 bp, Homo sapiens
aatatttttgaggccctgttat

SEQ ID NO: 7500334 - DNA, 22 bp, Homo sapiens
aatattttaggctttccaggct

SEQ ID NO: 7500335 - DNA, 22 bp, Homo sapiens
aatcaaaacctacagaggtaat

SEQ ID NO: 7500336 - DNA, 22 bp, Homo sapiens
aatcaaagaatgggctagttgg

SEQ ID NO: 7500337 - DNA, 22 bp, Homo sapiens
aatcaaagaatgggctagttgg

SEQ ID NO: 7500338 - DNA, 22 bp, Homo sapiens
aatcaaaacctacagaggtaat

SEQ ID NO: 7500339 - DNA, 22 bp, Homo sapiens
aatcaaaacctacagaggtaat

SEQ ID NO: 7500340 - DNA, 22 bp, Homo sapiens
aatcaaagaatgggctagttgg

SEQ ID NO: 7500341 - DNA, 21 bp, Homo sapiens
aatcaaatgtcatatccccag

SEQ ID NO: 7500342 - DNA, 22 bp, Homo sapiens
aatcaacaggatgtgcattgta

SEQ ID NO: 7500343 - DNA, 22 bp, Homo sapiens
aatcaacattgttttaagtcaa

SEQ ID NO: 7500344 - DNA, 22 bp, Homo sapiens
aatcaacattgttttaagtcaa

SEQ ID NO: 7500345 - DNA, 22 bp, Homo sapiens
aatcaacaggatgtgcattgta

SEQ ID NO: 7500346 - DNA, 22 bp, Homo sapiens
aatcaacaggatgtgcattgta

SEQ ID NO: 7500347 - DNA, 22 bp, Homo sapiens
aatcaactgtttccacagggag

SEQ ID NO: 7500348 - DNA, 22 bp, Homo sapiens
aatcaacattgttttaagtcaa

SEQ ID NO: 7500349 - DNA, 22 bp, Homo sapiens
aatcaacattgttttaagtcaa

SEQ ID NO: 7500350 - DNA, 22 bp, Homo sapiens
aatcaacattgttttaagtcaa

SEQ ID NO: 7500351 - DNA, 22 bp, Homo sapiens
aatcctgacctgggcatgcttg

SEQ ID NO: 7500352 - DNA, 22 bp, Homo sapiens
aatcctgacctgggcatgcttg

SEQ ID NO: 7500353 - DNA, 22 bp, Homo sapiens
aatcctagaaatttatttgaag

SEQ ID NO: 7500354 - DNA, 22 bp, Homo sapiens
aatcctgaggcaaagagatgag

SEQ ID NO: 7500355 - DNA, 22 bp, Homo sapiens
aatcctgaggcaaagagatgag

SEQ ID NO: 7500356 - DNA, 22 bp, Homo sapiens
aatcctgaggcaaagagatgag

SEQ ID NO: 7500357 - DNA, 20 bp, Homo sapiens
aatcccttctctggactctt

SEQ ID NO: 7500358 - DNA, 22 bp, Homo sapiens
aatccctgaggcatcaagtaca

SEQ ID NO: 7500359 - DNA, 22 bp, Homo sapiens
aatcccttcccttctctgggac

SEQ ID NO: 7500360 - DNA, 22 bp, Homo sapiens
aatccatgcatgcaaggaaagg

SEQ ID NO: 7500361 - DNA, 22 bp, Homo sapiens
aatccatgttgatgtatatttt

SEQ ID NO: 7500362 - DNA, 22 bp, Homo sapiens
aatccatgcatgcaaggaaagg

SEQ ID NO: 7500363 - DNA, 22 bp, Homo sapiens
aatccatctctccgagaagttt

SEQ ID NO: 7500364 - DNA, 22 bp, Homo sapiens
aatccatctcagtagtaccctg

SEQ ID NO: 7500365 - DNA, 22 bp, Homo sapiens
aatccatgaagtgaacaatctg

SEQ ID NO: 7500366 - DNA, 22 bp, Homo sapiens
aatccatctcaatttattccta

SEQ ID NO: 7500367 - DNA, 22 bp, Homo sapiens
aatccatgttgatgtatatttt

SEQ ID NO: 7500368 - DNA, 22 bp, Homo sapiens
aatccattgctgtgctgccagg

SEQ ID NO: 7500369 - DNA, 22 bp, Homo sapiens
aatccattaaaaacaagcgcat

SEQ ID NO: 7500370 - DNA, 22 bp, Homo sapiens
aatccattaaaaacaagcgcat

SEQ ID NO: 7500371 - DNA, 22 bp, Homo sapiens
aatccattcagaaattgggaat

SEQ ID NO: 7500372 - DNA, 22 bp, Homo sapiens
aatccatttactctttacaaga

SEQ ID NO: 7500373 - DNA, 22 bp, Homo sapiens
aatccatttactctttacaaga

SEQ ID NO: 7500374 - DNA, 22 bp, Homo sapiens
aatccatttactctttacaaga

SEQ ID NO: 7500375 - DNA, 22 bp, Homo sapiens
aatccatttactctttacaaga

SEQ ID NO: 7500376 - DNA, 20 bp, Homo sapiens
aatccattggtctatatgtc

SEQ ID NO: 7500377 - DNA, 20 bp, Homo sapiens
aatccattggtctatatgtc

SEQ ID NO: 7500378 - DNA, 22 bp, Homo sapiens
aatccatttacctttgcttgaa

SEQ ID NO: 7500379 - DNA, 22 bp, Homo sapiens
aatccatttacctttgcttgaa

SEQ ID NO: 7500380 - DNA, 22 bp, Homo sapiens
aatcccattgtggaattaagga

SEQ ID NO: 7500381 - DNA, 22 bp, Homo sapiens
aatcccagctactcaggaagtt

SEQ ID NO: 7500382 - DNA, 22 bp, Homo sapiens
aatcccaagtccaggccattcc

SEQ ID NO: 7500383 - DNA, 22 bp, Homo sapiens
aatccatttactctttacaaga

SEQ ID NO: 7500384 - DNA, 22 bp, Homo sapiens
aatcccagctactcaggaagtt

SEQ ID NO: 7500385 - DNA, 22 bp, Homo sapiens
aatcccagctactcaggaagtt

SEQ ID NO: 7500386 - DNA, 22 bp, Homo sapiens
aatccagggtgtggcctttcca

SEQ ID NO: 7500387 - DNA, 22 bp, Homo sapiens
aatccagggtgtggcctttcca

SEQ ID NO: 7500388 - DNA, 22 bp, Homo sapiens
aatccagctgtgtcacaggtga

SEQ ID NO: 7500389 - DNA, 22 bp, Homo sapiens
aatccatagaataaaattgcag

SEQ ID NO: 7500390 - DNA, 22 bp, Homo sapiens
aatccatagaataaaattgcag

SEQ ID NO: 7500391 - DNA, 22 bp, Homo sapiens
aatccatagaataaaattgcag

SEQ ID NO: 7500392 - DNA, 22 bp, Homo sapiens
aatccataggtttttccaagag

SEQ ID NO: 7500393 - DNA, 22 bp, Homo sapiens
aatccataatgttgtggggttt

SEQ ID NO: 7500394 - DNA, 22 bp, Homo sapiens
actttaaaaagagccttctaac

SEQ ID NO: 7500395 - DNA, 22 bp, Homo sapiens
aatcataattgtatacattcat

SEQ ID NO: 7500396 - DNA, 22 bp, Homo sapiens
aatcataattgtatacattcat

SEQ ID NO: 7500397 - DNA, 22 bp, Homo sapiens
aatcataattgtatacattcat

SEQ ID NO: 7500398 - DNA, 22 bp, Homo sapiens
actttaaaaagagccttctaac

SEQ ID NO: 7500399 - DNA, 22 bp, Homo sapiens
acttgtttctattgattccagt

SEQ ID NO: 7500400 - DNA, 22 bp, Homo sapiens
acttgtttcaactgtactctcc

SEQ ID NO: 7500401 - DNA, 22 bp, Homo sapiens
acttgtttgaatctctctagag

SEQ ID NO: 7500402 - DNA, 22 bp, Homo sapiens
acttgtttgaatctctctagag

SEQ ID NO: 7500403 - DNA, 22 bp, Homo sapiens
acttgtttgaatctctctagag

SEQ ID NO: 7500404 - DNA, 22 bp, Homo sapiens
acttgtttgcctaaaattttga

SEQ ID NO: 7500405 - DNA, 22 bp, Homo sapiens
acttgtttcaactgtactctca

SEQ ID NO: 7500406 - DNA, 22 bp, Homo sapiens
acttgtttcaactgtactctca

SEQ ID NO: 7500407 - DNA, 22 bp, Homo sapiens
acttgtttcaactgtactctca

SEQ ID NO: 7500408 - DNA, 22 bp, Homo sapiens
acttgtttcaactgtactctcc

SEQ ID NO: 7500409 - DNA, 22 bp, Homo sapiens
acttgtttcaactgtactctca

SEQ ID NO: 7500410 - DNA, 22 bp, Homo sapiens
acttgtttcaactgtactctcc

SEQ ID NO: 7500411 - DNA, 22 bp, Homo sapiens
acttgtttcaactgtactctcc

SEQ ID NO: 7500412 - DNA, 22 bp, Homo sapiens
acttgttttatctgtcaataga

SEQ ID NO: 7500413 - DNA, 22 bp, Homo sapiens
acttgttttatctgtcaataga

SEQ ID NO: 7500414 - DNA, 22 bp, Homo sapiens
acttgtttggtctcatgtttaa

SEQ ID NO: 7500415 - DNA, 22 bp, Homo sapiens
acttgtttggtctcatgtttaa

SEQ ID NO: 7500416 - DNA, 22 bp, Homo sapiens
acttgtttggtctcatgtttaa

SEQ ID NO: 7500417 - DNA, 22 bp, Homo sapiens
acttgtttggtctcatgtttaa

SEQ ID NO: 7500418 - DNA, 22 bp, Homo sapiens
acttgtttggagccagctgtaa

SEQ ID NO: 7500419 - DNA, 22 bp, Homo sapiens
actttaaaaagagccttctaac

SEQ ID NO: 7500420 - DNA, 22 bp, Homo sapiens
actttaaaaagagccttctaac

SEQ ID NO: 7500421 - DNA, 19 bp, Homo sapiens
acttgttttggaggtgatg

SEQ ID NO: 7500422 - DNA, 22 bp, Homo sapiens
actttaaaaagagccttctaac

SEQ ID NO: 7500423 - DNA, 22 bp, Homo sapiens
actttaaaaagagccttctaac

SEQ ID NO: 7500424 - DNA, 22 bp, Homo sapiens
actttaaaaagagccttctaac

SEQ ID NO: 7500425 - DNA, 19 bp, Homo sapiens
acttgttttggaggtgatg

SEQ ID NO: 7500426 - DNA, 22 bp, Homo sapiens
acttgttttatctgtcaataga

SEQ ID NO: 7500427 - DNA, 22 bp, Homo sapiens
actgcctgtgtcccttcagtgc

SEQ ID NO: 7500428 - DNA, 22 bp, Homo sapiens
actgcctgtgtcccttcagtgc

SEQ ID NO: 7500429 - DNA, 22 bp, Homo sapiens
actgcctgtgtcccttcagtgc

SEQ ID NO: 7500430 - DNA, 22 bp, Homo sapiens
actgcctgtgtcccttcagtgc

SEQ ID NO: 7500431 - DNA, 22 bp, Homo sapiens
actgcctgtgtcccttcagtgc

SEQ ID NO: 7500432 - DNA, 22 bp, Homo sapiens
actgcctgtgtcccttcagtgc

SEQ ID NO: 7500433 - DNA, 23 bp, Homo sapiens
actgcctgtgccgatctctctca

SEQ ID NO: 7500434 - DNA, 22 bp, Homo sapiens
aataagattgacacaagtacct

SEQ ID NO: 7500435 - DNA, 22 bp, Homo sapiens
aataagattgacacaagtacct

SEQ ID NO: 7500436 - DNA, 22 bp, Homo sapiens
aataagcaagcctgtgtgcaag

SEQ ID NO: 7500437 - DNA, 22 bp, Homo sapiens
aataagattgacacaagtacct

SEQ ID NO: 7500438 - DNA, 22 bp, Homo sapiens
actgccttagaacaaagcagga

SEQ ID NO: 7500439 - DNA, 22 bp, Homo sapiens
actgcctgtttggcatggcccc

SEQ ID NO: 7500440 - DNA, 22 bp, Homo sapiens
actgcctgtttggcatggcccc

SEQ ID NO: 7500441 - DNA, 22 bp, Homo sapiens
actgcctgtttggcatggcccc

SEQ ID NO: 7500442 - DNA, 22 bp, Homo sapiens
actgcctgtttggcatggcccc

SEQ ID NO: 7500443 - DNA, 22 bp, Homo sapiens
actgcctgtgtcccttcagtgc

SEQ ID NO: 7500444 - DNA, 22 bp, Homo sapiens
actgcctgtgtcccttcagtgc

SEQ ID NO: 7500445 - DNA, 22 bp, Homo sapiens
actgcctgtttggcatggcccc

SEQ ID NO: 7500446 - DNA, 22 bp, Homo sapiens
aataagatgtgcttgagtttgg

SEQ ID NO: 7500447 - DNA, 22 bp, Homo sapiens
aataagatgtgcttgagtttgg

SEQ ID NO: 7500448 - DNA, 22 bp, Homo sapiens
aataagatgtgcttgagtttgg

SEQ ID NO: 7500449 - DNA, 22 bp, Homo sapiens
aataagatgtgcttgagtttgg

SEQ ID NO: 7500450 - DNA, 22 bp, Homo sapiens
aataagatcttaaaggttatat

SEQ ID NO: 7500451 - DNA, 22 bp, Homo sapiens
aataagatcttaaaggttatat

SEQ ID NO: 7500452 - DNA, 22 bp, Homo sapiens
aataagatcttaaaggttatat

SEQ ID NO: 7500453 - DNA, 22 bp, Homo sapiens
aataagatcctgaagatatgtt

SEQ ID NO: 7500454 - DNA, 22 bp, Homo sapiens
aataagatcctgaagatatgtt

SEQ ID NO: 7500455 - DNA, 22 bp, Homo sapiens
aataagatcctgaagatatgtt

SEQ ID NO: 7500456 - DNA, 22 bp, Homo sapiens
aataagatcttaaaggttatat

SEQ ID NO: 7500457 - DNA, 22 bp, Homo sapiens
aataagatcttaaaggttatat

SEQ ID NO: 7500458 - DNA, 22 bp, Homo sapiens
aataagattgacacaagtacct

SEQ ID NO: 7500459 - DNA, 22 bp, Homo sapiens
aataagattgacacaagtacct

SEQ ID NO: 7500460 - DNA, 22 bp, Homo sapiens
aataagattgacacaagtacct

SEQ ID NO: 7500461 - DNA, 22 bp, Homo sapiens
aataagattgacacaagtacct

SEQ ID NO: 7500462 - DNA, 22 bp, Homo sapiens
aataagattgacacaagtacct

SEQ ID NO: 7500463 - DNA, 22 bp, Homo sapiens
aataagattactggttgtctga

SEQ ID NO: 7500464 - DNA, 22 bp, Homo sapiens
aataagattactggttgtctga

SEQ ID NO: 7500465 - DNA, 22 bp, Homo sapiens
aataagatgtgcttgagtttgg

SEQ ID NO: 7500466 - DNA, 22 bp, Homo sapiens
actgccttcttggccttcaaaa

SEQ ID NO: 7500467 - DNA, 22 bp, Homo sapiens
actgccttctttaatcctagtt

SEQ ID NO: 7500468 - DNA, 22 bp, Homo sapiens
actgccttccacctatggatga

SEQ ID NO: 7500469 - DNA, 22 bp, Homo sapiens
actgccttctgctcagggttca

SEQ ID NO: 7500470 - DNA, 22 bp, Homo sapiens
actgccttgaaagattgttgag

SEQ ID NO: 7500471 - DNA, 22 bp, Homo sapiens
actgccttctttaatcctagtt

SEQ ID NO: 7500472 - DNA, 22 bp, Homo sapiens
actgccttgattcatgctgatg

SEQ ID NO: 7500473 - DNA, 22 bp, Homo sapiens
actgccttcatgcagacccctg

SEQ ID NO: 7500474 - DNA, 22 bp, Homo sapiens
actgccttccacctatggatga

SEQ ID NO: 7500475 - DNA, 22 bp, Homo sapiens
actgccttcaaacagcgccacc

SEQ ID NO: 7500476 - DNA, 22 bp, Homo sapiens
actgccttataatatgtcaaca

SEQ ID NO: 7500477 - DNA, 22 bp, Homo sapiens
actgccttatatgctgtgtgtg

SEQ ID NO: 7500478 - DNA, 22 bp, Homo sapiens
aataatagttgcaaagtgttta

SEQ ID NO: 7500479 - DNA, 22 bp, Homo sapiens
aataatagttgcaaagtgttta

SEQ ID NO: 7500480 - DNA, 22 bp, Homo sapiens
aataatattcctctgtgtgcgt

SEQ ID NO: 7500481 - DNA, 22 bp, Homo sapiens
aataatattcctctgtgtgcgt

SEQ ID NO: 7500482 - DNA, 22 bp, Homo sapiens
aataatagttgcaaagtgttta

SEQ ID NO: 7500483 - DNA, 22 bp, Homo sapiens
aataatagttgcaaagtgttta

SEQ ID NO: 7500484 - DNA, 22 bp, Homo sapiens
actgcgctccagcctgggtgac

SEQ ID NO: 7500485 - DNA, 22 bp, Homo sapiens
aataatagttgcaaagtgttta

SEQ ID NO: 7500486 - DNA, 22 bp, Homo sapiens
actgcgctccagcctgggtgac

SEQ ID NO: 7500487 - DNA, 20 bp, Homo sapiens
actgccttggttcagtaggt

SEQ ID NO: 7500488 - DNA, 22 bp, Homo sapiens
actgccttgattgccagtttcc

SEQ ID NO: 7500489 - DNA, 22 bp, Homo sapiens
actgccttgtctcttgcctgtt

SEQ ID NO: 7500490 - DNA, 20 bp, Homo sapiens
actgcctttaggtatccttg

SEQ ID NO: 7500491 - DNA, 22 bp, Homo sapiens
actgccttttccattacttaat

SEQ ID NO: 7500492 - DNA, 22 bp, Homo sapiens
actgccttttccattacttaat

SEQ ID NO: 7500493 - DNA, 22 bp, Homo sapiens
actgcgctccagcctgggtgac

SEQ ID NO: 7500494 - DNA, 22 bp, Homo sapiens
aataatgttgacgatagtctta

SEQ ID NO: 7500495 - DNA, 22 bp, Homo sapiens
aataatgtttatttgtattctc

SEQ ID NO: 7500496 - DNA, 22 bp, Homo sapiens
aataatgttgacgatagtctta

SEQ ID NO: 7500497 - DNA, 22 bp, Homo sapiens
aataatgttgacgatagtctta

SEQ ID NO: 7500498 - DNA, 22 bp, Homo sapiens
aataatgttgacgatagtctta

SEQ ID NO: 7500499 - DNA, 22 bp, Homo sapiens
aataatgttgacgatagtctta

SEQ ID NO: 7500500 - DNA, 22 bp, Homo sapiens
aataatgttgacgatagtctta

SEQ ID NO: 7500501 - DNA, 22 bp, Homo sapiens
aataatgtgatagataagggaa

SEQ ID NO: 7500502 - DNA, 22 bp, Homo sapiens
aataatgttatgtcattcttct

SEQ ID NO: 7500503 - DNA, 22 bp, Homo sapiens
aataatgtgtgctgcagtctta

SEQ ID NO: 7500504 - DNA, 19 bp, Homo sapiens
aataatgttcatgagattg

SEQ ID NO: 7500505 - DNA, 19 bp, Homo sapiens
aataatgttcatgagattg

SEQ ID NO: 7500506 - DNA, 22 bp, Homo sapiens
aataatgttatgtcattcttct

SEQ ID NO: 7500507 - DNA, 19 bp, Homo sapiens
aataatgttcatgagattg

SEQ ID NO: 7500508 - DNA, 22 bp, Homo sapiens
aataattacccatctttttgta

SEQ ID NO: 7500509 - DNA, 22 bp, Homo sapiens
aataattacccatctttttgta

SEQ ID NO: 7500510 - DNA, 22 bp, Homo sapiens
aataatgtttatttgtattctc

SEQ ID NO: 7500511 - DNA, 22 bp, Homo sapiens
aataattacccatctttttgta

SEQ ID NO: 7500512 - DNA, 22 bp, Homo sapiens
aataattagtgggacagagaac

SEQ ID NO: 7500513 - DNA, 22 bp, Homo sapiens
aataattagtgggacagagaac

SEQ ID NO: 7500514 - DNA, 22 bp, Homo sapiens
aataattagtgggacagagaac

SEQ ID NO: 7500515 - DNA, 22 bp, Homo sapiens
aataattagtgggacagagaac

SEQ ID NO: 7500516 - DNA, 22 bp, Homo sapiens
aataattagtgggacagagaac

SEQ ID NO: 7500517 - DNA, 22 bp, Homo sapiens
aataattagtgggacagagaac

SEQ ID NO: 7500518 - DNA, 22 bp, Homo sapiens
aataattagtgggacagagaac

SEQ ID NO: 7500519 - DNA, 22 bp, Homo sapiens
aataattagtgggacagagaac

SEQ ID NO: 7500520 - DNA, 22 bp, Homo sapiens
aataattagtgggacagagaac

SEQ ID NO: 7500521 - DNA, 22 bp, Homo sapiens
aataattagtgggacagagaac

SEQ ID NO: 7500522 - DNA, 22 bp, Homo sapiens
aatacaagatttatagttgttt

SEQ ID NO: 7500523 - DNA, 22 bp, Homo sapiens
aatacaagatttatagttgttt

SEQ ID NO: 7500524 - DNA, 22 bp, Homo sapiens
aatacaatcaaattcactagca

SEQ ID NO: 7500525 - DNA, 22 bp, Homo sapiens
aatacaatcaaattcactagca

SEQ ID NO: 7500526 - DNA, 22 bp, Homo sapiens
aatacaatcaaattcactagca

SEQ ID NO: 7500527 - DNA, 22 bp, Homo sapiens
aatacaatcaaattcactagca

SEQ ID NO: 7500528 - DNA, 22 bp, Homo sapiens
aataattttgagagcctggaaa

SEQ ID NO: 7500529 - DNA, 22 bp, Homo sapiens
aatacaagatttatagttgttt

SEQ ID NO: 7500530 - DNA, 22 bp, Homo sapiens
aataattttgagagcctggaaa

SEQ ID NO: 7500531 - DNA, 22 bp, Homo sapiens
aataattttgagagcctggaaa

SEQ ID NO: 7500532 - DNA, 22 bp, Homo sapiens
aataattttagctcagagttgt

SEQ ID NO: 7500533 - DNA, 22 bp, Homo sapiens
aataattttagctcagagttgt

SEQ ID NO: 7500534 - DNA, 22 bp, Homo sapiens
aataattttagctcagagttgt

SEQ ID NO: 7500535 - DNA, 22 bp, Homo sapiens
aataattttagctcagagttgt

SEQ ID NO: 7500536 - DNA, 22 bp, Homo sapiens
aataattttagctcagagttgt

SEQ ID NO: 7500537 - DNA, 22 bp, Homo sapiens
aataattttagctcagagttgt

SEQ ID NO: 7500538 - DNA, 22 bp, Homo sapiens
aataattttagctcagagttgt

SEQ ID NO: 7500539 - DNA, 22 bp, Homo sapiens
aataattatttgagagcagacc

SEQ ID NO: 7500540 - DNA, 22 bp, Homo sapiens
aataattatttgagagcagacc

SEQ ID NO: 7500541 - DNA, 22 bp, Homo sapiens
aataattatttgagagcagacc

SEQ ID NO: 7500542 - DNA, 22 bp, Homo sapiens
aataattatttgagagcagacc

SEQ ID NO: 7500543 - DNA, 22 bp, Homo sapiens
aataattatttgagagcagacc

SEQ ID NO: 7500544 - DNA, 21 bp, Homo sapiens
aataattcagacattgttgtt

SEQ ID NO: 7500545 - DNA, 21 bp, Homo sapiens
aataattcagacattgttgtt

SEQ ID NO: 7500546 - DNA, 21 bp, Homo sapiens
aataattcagacattgttgtt

SEQ ID NO: 7500547 - DNA, 22 bp, Homo sapiens
aataatttccagccaactggaa

SEQ ID NO: 7500548 - DNA, 22 bp, Homo sapiens
aataatttccagccaactggaa

SEQ ID NO: 7500549 - DNA, 22 bp, Homo sapiens
aataatttccagccaactggaa

SEQ ID NO: 7500550 - DNA, 22 bp, Homo sapiens
aataatttccagccaactggaa

SEQ ID NO: 7500551 - DNA, 22 bp, Homo sapiens
aataatttccagccaactggaa

SEQ ID NO: 7500552 - DNA, 22 bp, Homo sapiens
aataatttccagccaactggaa

SEQ ID NO: 7500553 - DNA, 22 bp, Homo sapiens
aagtttcaagaggttctttgaa

SEQ ID NO: 7500554 - DNA, 22 bp, Homo sapiens
aagtttcaagaggttctttgaa

SEQ ID NO: 7500555 - DNA, 22 bp, Homo sapiens
aagtttcaaatgttgattatgc

SEQ ID NO: 7500556 - DNA, 22 bp, Homo sapiens
aagtttcatgacttggttatta

SEQ ID NO: 7500557 - DNA, 22 bp, Homo sapiens
aagtttcatgacttggttatta

SEQ ID NO: 7500558 - DNA, 22 bp, Homo sapiens
aagtttcatgatgtaattattg

SEQ ID NO: 7500559 - DNA, 20 bp, Homo sapiens
aagtttcatgctctggggat

SEQ ID NO: 7500560 - DNA, 22 bp, Homo sapiens
aagtttcatgatgtaattattg

SEQ ID NO: 7500561 - DNA, 22 bp, Homo sapiens
aagtttcatgatgtaattattg

SEQ ID NO: 7500562 - DNA, 22 bp, Homo sapiens
aagtttctacatctccatcata

SEQ ID NO: 7500563 - DNA, 22 bp, Homo sapiens
aagtttctattattacattcgt

SEQ ID NO: 7500564 - DNA, 22 bp, Homo sapiens
aagtttctacatctccatcata

SEQ ID NO: 7500565 - DNA, 22 bp, Homo sapiens
aagtttccactggcagtccgta

SEQ ID NO: 7500566 - DNA, 22 bp, Homo sapiens
aagtttctacatctccatcata

SEQ ID NO: 7500567 - DNA, 22 bp, Homo sapiens
aagtttcatttctggatgctga

SEQ ID NO: 7500568 - DNA, 22 bp, Homo sapiens
aagtttcattgttcatgtaaca

SEQ ID NO: 7500569 - DNA, 22 bp, Homo sapiens
aagtttcatgtggaggtagact

SEQ ID NO: 7500570 - DNA, 22 bp, Homo sapiens
aagtttcatgtggaggtagact

SEQ ID NO: 7500571 - DNA, 22 bp, Homo sapiens
aagtttcatgtggaggtagact

SEQ ID NO: 7500572 - DNA, 20 bp, Homo sapiens
aagtttcatgctctggggat

SEQ ID NO: 7500573 - DNA, 22 bp, Homo sapiens
aagtttcatgtggaggtagact

SEQ ID NO: 7500574 - DNA, 22 bp, Homo sapiens
aagtttcaaatataaaattaca

SEQ ID NO: 7500575 - DNA, 22 bp, Homo sapiens
aagtttcaaatgttgattatgc

SEQ ID NO: 7500576 - DNA, 22 bp, Homo sapiens
aagtttcaaatgttgattatgc

SEQ ID NO: 7500577 - DNA, 22 bp, Homo sapiens
aagtttcaaatgttgattatgc

SEQ ID NO: 7500578 - DNA, 22 bp, Homo sapiens
aagtttcaaatataaaattaca

SEQ ID NO: 7500579 - DNA, 22 bp, Homo sapiens
aagtttcaaatataaaattaca

SEQ ID NO: 7500580 - DNA, 22 bp, Homo sapiens
aagtttatgttggtaagatatc

SEQ ID NO: 7500581 - DNA, 22 bp, Homo sapiens
aagtttatgttggtaagatatc

SEQ ID NO: 7500582 - DNA, 22 bp, Homo sapiens
aagtttatgttggtaagatatc

SEQ ID NO: 7500583 - DNA, 22 bp, Homo sapiens
aagtttatgttggtaagatatc

SEQ ID NO: 7500584 - DNA, 22 bp, Homo sapiens
aagtttattaattgacttgtgc

SEQ ID NO: 7500585 - DNA, 22 bp, Homo sapiens
aagtttattaattgacttgtgc

SEQ ID NO: 7500586 - DNA, 22 bp, Homo sapiens
aataagacacacaactgtcaag

SEQ ID NO: 7500587 - DNA, 22 bp, Homo sapiens
aataagacacacaactgtcaag

SEQ ID NO: 7500588 - DNA, 22 bp, Homo sapiens
aataagacacacaactgtcaag

SEQ ID NO: 7500589 - DNA, 22 bp, Homo sapiens
aataagaatttacttgtcaaga

SEQ ID NO: 7500590 - DNA, 22 bp, Homo sapiens
aataagaatttacttgtcaaga

SEQ ID NO: 7500591 - DNA, 22 bp, Homo sapiens
aataagaatttacttgtcaaga

SEQ ID NO: 7500592 - DNA, 22 bp, Homo sapiens
aataagacacgctattactaga

SEQ ID NO: 7500593 - DNA, 22 bp, Homo sapiens
aataagacacacaactgtcaag

SEQ ID NO: 7500594 - DNA, 22 bp, Homo sapiens
aataagacacgctattactaga

SEQ ID NO: 7500595 - DNA, 22 bp, Homo sapiens
aataagacacgctattactaga

SEQ ID NO: 7500596 - DNA, 22 bp, Homo sapiens
aataagataagatttctgctct

SEQ ID NO: 7500597 - DNA, 22 bp, Homo sapiens
aataagagcactggctttggag

SEQ ID NO: 7500598 - DNA, 22 bp, Homo sapiens
aataagacacgctattactaga

SEQ ID NO: 7500599 - DNA, 22 bp, Homo sapiens
aataagatcctgaagatatgtt

SEQ ID NO: 7500600 - DNA, 22 bp, Homo sapiens
aataagatcctgaagatatgtt

SEQ ID NO: 7500601 - DNA, 22 bp, Homo sapiens
aataagatcctgaagatatgtt

SEQ ID NO: 7500602 - DNA, 22 bp, Homo sapiens
aataagactctgctagaaattc

SEQ ID NO: 7500603 - DNA, 22 bp, Homo sapiens
aataagatcctgaagatatgtt

SEQ ID NO: 7500604 - DNA, 22 bp, Homo sapiens
aataagataagatttctgctct

SEQ ID NO: 7500605 - DNA, 22 bp, Homo sapiens
aataagatcctgaagatatgtt

SEQ ID NO: 7500606 - DNA, 22 bp, Homo sapiens
aataagatcctgaagatatgtt

SEQ ID NO: 7500607 - DNA, 22 bp, Homo sapiens
aataagatcctgaagatatgtt

SEQ ID NO: 7500608 - DNA, 22 bp, Homo sapiens
aagtttctattattacattcgt

SEQ ID NO: 7500609 - DNA, 22 bp, Homo sapiens
aagtttctcaatggcaactggg

SEQ ID NO: 7500610 - DNA, 22 bp, Homo sapiens
aataacttaagaaatttcccca

SEQ ID NO: 7500611 - DNA, 22 bp, Homo sapiens
aagtttctcaatggcaactggg

SEQ ID NO: 7500612 - DNA, 22 bp, Homo sapiens
aataacttaagaaatttcccca

SEQ ID NO: 7500613 - DNA, 22 bp, Homo sapiens
aataacttaagaaatttcccca

SEQ ID NO: 7500614 - DNA, 22 bp, Homo sapiens
aataacttcagttcttacatta

SEQ ID NO: 7500615 - DNA, 22 bp, Homo sapiens
aataacttcagttcttacatta

SEQ ID NO: 7500616 - DNA, 22 bp, Homo sapiens
aataacttcagttcttacatta

SEQ ID NO: 7500617 - DNA, 22 bp, Homo sapiens
aataacttcagttcttacatta

SEQ ID NO: 7500618 - DNA, 22 bp, Homo sapiens
aataacttcagttcttacatta

SEQ ID NO: 7500619 - DNA, 22 bp, Homo sapiens
aataagaatttacttgtcaaga

SEQ ID NO: 7500620 - DNA, 22 bp, Homo sapiens
aataagaatttacttgtcaaga

SEQ ID NO: 7500621 - DNA, 22 bp, Homo sapiens
aataagaatttacttgtcaaga

SEQ ID NO: 7500622 - DNA, 22 bp, Homo sapiens
aataagaatttacttgtcaaga

SEQ ID NO: 7500623 - DNA, 22 bp, Homo sapiens
aataagaatttacttgtcaaga

SEQ ID NO: 7500624 - DNA, 22 bp, Homo sapiens
aataagaatttacttgtcaaga

SEQ ID NO: 7500625 - DNA, 22 bp, Homo sapiens
aataagaatttacttgtcaaga

SEQ ID NO: 7500626 - DNA, 22 bp, Homo sapiens
aataagaattgccagatttgaa

SEQ ID NO: 7500627 - DNA, 22 bp, Homo sapiens
aataagaattgccagatttgaa

SEQ ID NO: 7500628 - DNA, 22 bp, Homo sapiens
aagtttaacttgaattctttct

SEQ ID NO: 7500629 - DNA, 22 bp, Homo sapiens
aagtttaacttgaattctttct

SEQ ID NO: 7500630 - DNA, 22 bp, Homo sapiens
aagtttaacttgaattctttct

SEQ ID NO: 7500631 - DNA, 22 bp, Homo sapiens
aagtttaacttgaattctttct

SEQ ID NO: 7500632 - DNA, 22 bp, Homo sapiens
aagtttaaggtggaagtggtgg

SEQ ID NO: 7500633 - DNA, 22 bp, Homo sapiens
aagtttaaggtggaagtggtgg

SEQ ID NO: 7500634 - DNA, 22 bp, Homo sapiens
aagtttacataagtgatgatga

SEQ ID NO: 7500635 - DNA, 22 bp, Homo sapiens
aagtttaaggtggaagtggtgg

SEQ ID NO: 7500636 - DNA, 22 bp, Homo sapiens
aagtttaacttgaattctttct

SEQ ID NO: 7500637 - DNA, 22 bp, Homo sapiens
aagttgttgttgaggtgggtaa

SEQ ID NO: 7500638 - DNA, 22 bp, Homo sapiens
aagttgttgttgaggtgggtaa

SEQ ID NO: 7500639 - DNA, 23 bp, Homo sapiens
aagttgtttttggccagggaaag

SEQ ID NO: 7500640 - DNA, 22 bp, Homo sapiens
aagtttaacttgaattctttct

SEQ ID NO: 7500641 - DNA, 22 bp, Homo sapiens
aagtttaacttgaattctttct

SEQ ID NO: 7500642 - DNA, 23 bp, Homo sapiens
aagttgtttttggccagggaaag

SEQ ID NO: 7500643 - DNA, 22 bp, Homo sapiens
aagtttaacttgaattctttct

SEQ ID NO: 7500644 - DNA, 22 bp, Homo sapiens
aagttgttgttgaggtgggtaa

SEQ ID NO: 7500645 - DNA, 21 bp, Homo sapiens
aagttgtctcttttggttcct

SEQ ID NO: 7500646 - DNA, 21 bp, Homo sapiens
aagttgtctcttttggttcct

SEQ ID NO: 7500647 - DNA, 22 bp, Homo sapiens
aagttgtatgtcttagaaagta

SEQ ID NO: 7500648 - DNA, 20 bp, Homo sapiens
aagttggctcctcctagcaa

SEQ ID NO: 7500649 - DNA, 22 bp, Homo sapiens
aagttggtaggagacagaaggt

SEQ ID NO: 7500650 - DNA, 22 bp, Homo sapiens
aagttctatagtctttctacta

SEQ ID NO: 7500651 - DNA, 22 bp, Homo sapiens
aagttggaatctggaactgatc

SEQ ID NO: 7500652 - DNA, 22 bp, Homo sapiens
aagttctactgtgggtaaaatg

SEQ ID NO: 7500653 - DNA, 22 bp, Homo sapiens
aagttctaggtagtgctctttc

SEQ ID NO: 7500654 - DNA, 22 bp, Homo sapiens
aagttctatagtctttctacta

SEQ ID NO: 7500655 - DNA, 22 bp, Homo sapiens
aagttctagaggttgatttggt

SEQ ID NO: 7500656 - DNA, 22 bp, Homo sapiens
aagttctactgtgggtaaaatg

SEQ ID NO: 7500657 - DNA, 22 bp, Homo sapiens
aagttctaattttgcattcagg

SEQ ID NO: 7500658 - DNA, 22 bp, Homo sapiens
aagttggtaggagacagaaggt

SEQ ID NO: 7500659 - DNA, 22 bp, Homo sapiens
aagttggtgtatgagacagaag

SEQ ID NO: 7500660 - DNA, 22 bp, Homo sapiens
aagttggtgtatgagacagaag

SEQ ID NO: 7500661 - DNA, 22 bp, Homo sapiens
aagttgtagtcagatgtcagtt

SEQ ID NO: 7500662 - DNA, 22 bp, Homo sapiens
aagttgtatataccgctttaag

SEQ ID NO: 7500663 - DNA, 22 bp, Homo sapiens
aagttgtagatgaagtaattca

SEQ ID NO: 7500664 - DNA, 22 bp, Homo sapiens
aagttggttctgtgacatgttg

SEQ ID NO: 7500665 - DNA, 22 bp, Homo sapiens
aagttgtaacagaaatttaatg

SEQ ID NO: 7500666 - DNA, 22 bp, Homo sapiens
aagttggttctgtgacatgttg

SEQ ID NO: 7500667 - DNA, 22 bp, Homo sapiens
aagtttatgttggtaagatatc

SEQ ID NO: 7500668 - DNA, 22 bp, Homo sapiens
aagtttatgttggtaagatatc

SEQ ID NO: 7500669 - DNA, 22 bp, Homo sapiens
aagtttatgttctttgaaggca

SEQ ID NO: 7500670 - DNA, 22 bp, Homo sapiens
aagtttatgttggtaagatatc

SEQ ID NO: 7500671 - DNA, 22 bp, Homo sapiens
aagtttatgttctttgaaggca

SEQ ID NO: 7500672 - DNA, 22 bp, Homo sapiens
aagtttatgttctttgaaggca

SEQ ID NO: 7500673 - DNA, 22 bp, Homo sapiens
aagtttatccctctcacagtta

SEQ ID NO: 7500674 - DNA, 22 bp, Homo sapiens
aagtttatccctctcacagtta

SEQ ID NO: 7500675 - DNA, 22 bp, Homo sapiens
aagtttatctttgctgggtact

SEQ ID NO: 7500676 - DNA, 22 bp, Homo sapiens
aagtttatctttgctgggtact

SEQ ID NO: 7500677 - DNA, 22 bp, Homo sapiens
aagtttatgaagtctaagccaa

SEQ ID NO: 7500678 - DNA, 22 bp, Homo sapiens
aagtttatgaagtctaagccaa

SEQ ID NO: 7500679 - DNA, 22 bp, Homo sapiens
aagtttactggggagatcacct

SEQ ID NO: 7500680 - DNA, 22 bp, Homo sapiens
aagtttaaggtggaagtggtgg

SEQ ID NO: 7500681 - DNA, 22 bp, Homo sapiens
aagtttacataagtgatgatga

SEQ ID NO: 7500682 - DNA, 22 bp, Homo sapiens
aagtttacataagtgatgatga

SEQ ID NO: 7500683 - DNA, 22 bp, Homo sapiens
aagtttactgtccctggaaact

SEQ ID NO: 7500684 - DNA, 22 bp, Homo sapiens
aagtttactggggagatcacct

SEQ ID NO: 7500685 - DNA, 22 bp, Homo sapiens
aagtttactgtccctggaaact

SEQ ID NO: 7500686 - DNA, 22 bp, Homo sapiens
aagtttagggaagtctgagcgc

SEQ ID NO: 7500687 - DNA, 22 bp, Homo sapiens
aagtttaggccaaattagattt

SEQ ID NO: 7500688 - DNA, 22 bp, Homo sapiens
aagtttagggaagtctgagcgc

SEQ ID NO: 7500689 - DNA, 22 bp, Homo sapiens
aagtttagcttgagatggaaag

SEQ ID NO: 7500690 - DNA, 22 bp, Homo sapiens
aagtttaggccaaattagattt

SEQ ID NO: 7500691 - DNA, 22 bp, Homo sapiens
aagtttagcgctctctcaagga

SEQ ID NO: 7500692 - DNA, 22 bp, Homo sapiens
aagtttagcttgagatggaaag

SEQ ID NO: 7500693 - DNA, 22 bp, Homo sapiens
aagtttagatataggtattctg

SEQ ID NO: 7500694 - DNA, 22 bp, Homo sapiens
aagtttagcgctctctcaagga

SEQ ID NO: 7500695 - DNA, 22 bp, Homo sapiens
aagtttagaactataagagtga

SEQ ID NO: 7500696 - DNA, 22 bp, Homo sapiens
aagtttagatataggtattctg

SEQ ID NO: 7500697 - DNA, 22 bp, Homo sapiens
aagtttagaactataagagtga

SEQ ID NO: 7500698 - DNA, 22 bp, Homo sapiens
aagtttagtgaaactctagggg

SEQ ID NO: 7500699 - DNA, 22 bp, Homo sapiens
aagtttagtggtggtgttccat

SEQ ID NO: 7500700 - DNA, 22 bp, Homo sapiens
aagtttagttaagtaaactctt

SEQ ID NO: 7500701 - DNA, 22 bp, Homo sapiens
aagtttagtggtggtgttccat

SEQ ID NO: 7500702 - DNA, 22 bp, Homo sapiens
aagtttagttaagtaaactctt

SEQ ID NO: 7500703 - DNA, 22 bp, Homo sapiens
aagtttatccctctcacagtta

SEQ ID NO: 7500704 - DNA, 22 bp, Homo sapiens
aagtttatccctctcacagtta

SEQ ID NO: 7500705 - DNA, 22 bp, Homo sapiens
aagtttatccctctcacagtta

SEQ ID NO: 7500706 - DNA, 22 bp, Homo sapiens
aagtttagtcttgtcttagtaa

SEQ ID NO: 7500707 - DNA, 22 bp, Homo sapiens
aagtttagtgaaactctagggg

SEQ ID NO: 7500708 - DNA, 22 bp, Homo sapiens
aagtttagtattagggaaaagt

SEQ ID NO: 7500709 - DNA, 22 bp, Homo sapiens
aagtttagtcttgtcttagtaa

SEQ ID NO: 7500710 - DNA, 22 bp, Homo sapiens
aagtttagtattagggaaaagt

SEQ ID NO: 7500711 - DNA, 22 bp, Homo sapiens
aagtttagtattagggaaaagt

SEQ ID NO: 7500712 - DNA, 22 bp, Homo sapiens
aagtttagtagggacagatgga

SEQ ID NO: 7500713 - DNA, 20 bp, Homo sapiens
aagtttaggggaaagtgaca

SEQ ID NO: 7500714 - DNA, 22 bp, Homo sapiens
aagtttagtagggacagatgga

SEQ ID NO: 7500715 - DNA, 20 bp, Homo sapiens
aagtttaggggaaagtgaca

SEQ ID NO: 7500716 - DNA, 22 bp, Homo sapiens
aagttattggtggagagcactg

SEQ ID NO: 7500717 - DNA, 22 bp, Homo sapiens
aagttattggtggagagcactg

SEQ ID NO: 7500718 - DNA, 22 bp, Homo sapiens
aagttatttcctcgtgactgaa

SEQ ID NO: 7500719 - DNA, 22 bp, Homo sapiens
aagttatttttcaagatccttt

SEQ ID NO: 7500720 - DNA, 22 bp, Homo sapiens
aagttatttcctcgtgactgaa

SEQ ID NO: 7500721 - DNA, 22 bp, Homo sapiens
aagttatttcctcgtgactgaa

SEQ ID NO: 7500722 - DNA, 22 bp, Homo sapiens
aagttatttttcaagatccttt

SEQ ID NO: 7500723 - DNA, 22 bp, Homo sapiens
aagttcaagctctgcctaaaat

SEQ ID NO: 7500724 - DNA, 22 bp, Homo sapiens
aagttcaagctctgcctaaaat

SEQ ID NO: 7500725 - DNA, 22 bp, Homo sapiens
aagttcaagatcaaggttccag

SEQ ID NO: 7500726 - DNA, 22 bp, Homo sapiens
aagttcaagagtgacatattag

SEQ ID NO: 7500727 - DNA, 22 bp, Homo sapiens
aagttcaagagtgacatattag

SEQ ID NO: 7500728 - DNA, 22 bp, Homo sapiens
aagttcaagagtgacatattag

SEQ ID NO: 7500729 - DNA, 22 bp, Homo sapiens
actccaggttttctctcaagtt

SEQ ID NO: 7500730 - DNA, 20 bp, Homo sapiens
actccaggtggcatgaggac

SEQ ID NO: 7500731 - DNA, 20 bp, Homo sapiens
actccaggtggcatgaggac

SEQ ID NO: 7500732 - DNA, 20 bp, Homo sapiens
actccaggtggcatgaggac

SEQ ID NO: 7500733 - DNA, 20 bp, Homo sapiens
actccaggtggcatgaggac

SEQ ID NO: 7500734 - DNA, 22 bp, Homo sapiens
aagttcaaggaagcctccagtt

SEQ ID NO: 7500735 - DNA, 22 bp, Homo sapiens
actccaggtaggcacattgaca

SEQ ID NO: 7500736 - DNA, 22 bp, Homo sapiens
actccaggttttttcactgaag

SEQ ID NO: 7500737 - DNA, 22 bp, Homo sapiens
actccagttctcttgtttataa

SEQ ID NO: 7500738 - DNA, 22 bp, Homo sapiens
actccaggttttttcactgaag

SEQ ID NO: 7500739 - DNA, 22 bp, Homo sapiens
actcccagaacatgctcttctt

SEQ ID NO: 7500740 - DNA, 22 bp, Homo sapiens
actcccagaacatgctcttctt

SEQ ID NO: 7500741 - DNA, 22 bp, Homo sapiens
actcccactccagagtagaagc

SEQ ID NO: 7500742 - DNA, 22 bp, Homo sapiens
actccatacaatggcaggctgt

SEQ ID NO: 7500743 - DNA, 22 bp, Homo sapiens
actcccagctcagggctttccc

SEQ ID NO: 7500744 - DNA, 22 bp, Homo sapiens
actcccagctcagggctttccc

SEQ ID NO: 7500745 - DNA, 22 bp, Homo sapiens
actcccagaacatgctcttctt

SEQ ID NO: 7500746 - DNA, 22 bp, Homo sapiens
actcccaggttgcctggcaggc

SEQ ID NO: 7500747 - DNA, 22 bp, Homo sapiens
actcccaggttgcctggcaggc

SEQ ID NO: 7500748 - DNA, 22 bp, Homo sapiens
actcccagctcagggctttccc

SEQ ID NO: 7500749 - DNA, 22 bp, Homo sapiens
actcccaggttgcctggcaggc

SEQ ID NO: 7500750 - DNA, 22 bp, Homo sapiens
aagttctaattttgcattcagg

SEQ ID NO: 7500751 - DNA, 22 bp, Homo sapiens
actccccagactgccatgctgg

SEQ ID NO: 7500752 - DNA, 23 bp, Homo sapiens
actccccagtctcttcttgccaa

SEQ ID NO: 7500753 - DNA, 23 bp, Homo sapiens
actccccagtctcttcttgccaa

SEQ ID NO: 7500754 - DNA, 22 bp, Homo sapiens
actccccagactgccatgctgg

SEQ ID NO: 7500755 - DNA, 22 bp, Homo sapiens
actccccagactgccatgctgg

SEQ ID NO: 7500756 - DNA, 18 bp, Homo sapiens
actccccacaggctctgt

SEQ ID NO: 7500757 - DNA, 18 bp, Homo sapiens
actccccacaggctctgt

SEQ ID NO: 7500758 - DNA, 22 bp, Homo sapiens
actccccagactgccatgctgg

SEQ ID NO: 7500759 - DNA, 22 bp, Homo sapiens
actccccagactgccatgctgg

SEQ ID NO: 7500760 - DNA, 22 bp, Homo sapiens
actccccagactgccatgctgg

SEQ ID NO: 7500761 - DNA, 18 bp, Homo sapiens
actccccacaggctctgt

SEQ ID NO: 7500762 - DNA, 18 bp, Homo sapiens
actccccacaggctctgt

SEQ ID NO: 7500763 - DNA, 22 bp, Homo sapiens
actccccaaaactaaccatgca

SEQ ID NO: 7500764 - DNA, 18 bp, Homo sapiens
actccccacaggctctgt

SEQ ID NO: 7500765 - DNA, 18 bp, Homo sapiens
actccccacaggctctgt

SEQ ID NO: 7500766 - DNA, 22 bp, Homo sapiens
actccccaaaactaaccatgca

SEQ ID NO: 7500767 - DNA, 22 bp, Homo sapiens
actccccaaaactaaccatgca

SEQ ID NO: 7500768 - DNA, 22 bp, Homo sapiens
actccccaaaactaaccatgca

SEQ ID NO: 7500769 - DNA, 22 bp, Homo sapiens
actccccaaaactaaccatgca

SEQ ID NO: 7500770 - DNA, 22 bp, Homo sapiens
actcccaggttgcctggcaggc

SEQ ID NO: 7500771 - DNA, 21 bp, Homo sapiens
actcccatcataactggtggg

SEQ ID NO: 7500772 - DNA, 22 bp, Homo sapiens
actaattgtatagttgatgtaa

SEQ ID NO: 7500773 - DNA, 22 bp, Homo sapiens
actaattggaacactttttgcc

SEQ ID NO: 7500774 - DNA, 22 bp, Homo sapiens
actacaaaagcactgggtatta

SEQ ID NO: 7500775 - DNA, 22 bp, Homo sapiens
actaattgagtgcatgatcttt

SEQ ID NO: 7500776 - DNA, 22 bp, Homo sapiens
actaattgaaatgtcctggcca

SEQ ID NO: 7500777 - DNA, 22 bp, Homo sapiens
actaattgctttcttgtgctga

SEQ ID NO: 7500778 - DNA, 22 bp, Homo sapiens
actacaaaagcactgggtatta

SEQ ID NO: 7500779 - DNA, 22 bp, Homo sapiens
actacaatactcttagtaaaag

SEQ ID NO: 7500780 - DNA, 22 bp, Homo sapiens
actacaatactcttagtaaaag

SEQ ID NO: 7500781 - DNA, 22 bp, Homo sapiens
actacaatactcttagtaaaag

SEQ ID NO: 7500782 - DNA, 22 bp, Homo sapiens
actacaaaagcactgggtatta

SEQ ID NO: 7500783 - DNA, 20 bp, Homo sapiens
aagtgttttgacttctgacc

SEQ ID NO: 7500784 - DNA, 20 bp, Homo sapiens
aagtgttttgacttctgacc

SEQ ID NO: 7500785 - DNA, 22 bp, Homo sapiens
actacaatactcttagtaaaag

SEQ ID NO: 7500786 - DNA, 22 bp, Homo sapiens
actacaatactcttagtaaaag

SEQ ID NO: 7500787 - DNA, 22 bp, Homo sapiens
aagtgttttggcttctgtacac

SEQ ID NO: 7500788 - DNA, 22 bp, Homo sapiens
aagtgttttggcttctgtacac

SEQ ID NO: 7500789 - DNA, 22 bp, Homo sapiens
aagtgttttggcttctgtacac

SEQ ID NO: 7500790 - DNA, 22 bp, Homo sapiens
aagtgttttggcttctgtacac

SEQ ID NO: 7500791 - DNA, 20 bp, Homo sapiens
aagtgttttgacttctgacc

SEQ ID NO: 7500792 - DNA, 22 bp, Homo sapiens
actaatagagacaaacatagat

SEQ ID NO: 7500793 - DNA, 22 bp, Homo sapiens
actaagtagtttgttcctcttt

SEQ ID NO: 7500794 - DNA, 22 bp, Homo sapiens
actaagtagtttcacatataat

SEQ ID NO: 7500795 - DNA, 22 bp, Homo sapiens
actaagtagtttcacatataat

SEQ ID NO: 7500796 - DNA, 22 bp, Homo sapiens
actaagtagtttcacatataat

SEQ ID NO: 7500797 - DNA, 22 bp, Homo sapiens
actaattgaaatgagactggtg

SEQ ID NO: 7500798 - DNA, 22 bp, Homo sapiens
actaatgattattgtcattgtg

SEQ ID NO: 7500799 - DNA, 20 bp, Homo sapiens
actaatcatccagtcacagt

SEQ ID NO: 7500800 - DNA, 20 bp, Homo sapiens
actaatcatccagtcacagt

SEQ ID NO: 7500801 - DNA, 20 bp, Homo sapiens
actaatcatccagtcacagt

SEQ ID NO: 7500802 - DNA, 22 bp, Homo sapiens
actaaggactgtggcgcctgcc

SEQ ID NO: 7500803 - DNA, 22 bp, Homo sapiens
actaaggcagtattacttctgt

SEQ ID NO: 7500804 - DNA, 22 bp, Homo sapiens
actaagatgcaggaaatgctag

SEQ ID NO: 7500805 - DNA, 22 bp, Homo sapiens
actaagagtacataggtaggaa

SEQ ID NO: 7500806 - DNA, 21 bp, Homo sapiens
actaagagatctctgtctcat

SEQ ID NO: 7500807 - DNA, 22 bp, Homo sapiens
actaagacctagatactagggg

SEQ ID NO: 7500808 - DNA, 22 bp, Homo sapiens
actaacttgctgagtgaccatg

SEQ ID NO: 7500809 - DNA, 22 bp, Homo sapiens
actaacttgctgagtgaccatg

SEQ ID NO: 7500810 - DNA, 22 bp, Homo sapiens
aagttaggttgcattggtcatc

SEQ ID NO: 7500811 - DNA, 22 bp, Homo sapiens
aagttaggagagtaaagtggta

SEQ ID NO: 7500812 - DNA, 22 bp, Homo sapiens
aagttatatcatctcattgacg

SEQ ID NO: 7500813 - DNA, 22 bp, Homo sapiens
aagttatatcatctcattgacg

SEQ ID NO: 7500814 - DNA, 22 bp, Homo sapiens
aagttagtggataaacagcaaa

SEQ ID NO: 7500815 - DNA, 23 bp, Homo sapiens
aagttagtttcaataaagcaatt

SEQ ID NO: 7500816 - DNA, 22 bp, Homo sapiens
aagttatgaaatttggacagct

SEQ ID NO: 7500817 - DNA, 22 bp, Homo sapiens
aagttatctgatatctttgagg

SEQ ID NO: 7500818 - DNA, 22 bp, Homo sapiens
aagttattgcagcaatccaagt

SEQ ID NO: 7500819 - DNA, 22 bp, Homo sapiens
aagttattgcagcaatccaagt

SEQ ID NO: 7500820 - DNA, 22 bp, Homo sapiens
aagttatatcatctcattgacg

SEQ ID NO: 7500821 - DNA, 22 bp, Homo sapiens
aagttatatcatctcattgacg

SEQ ID NO: 7500822 - DNA, 22 bp, Homo sapiens
aagttatcagaatgctgctttc

SEQ ID NO: 7500823 - DNA, 22 bp, Homo sapiens
aagttatatcatctcattgacg

SEQ ID NO: 7500824 - DNA, 22 bp, Homo sapiens
aagttagtgcctccttaaattt

SEQ ID NO: 7500825 - DNA, 22 bp, Homo sapiens
aagttatatcatctcattgacg

SEQ ID NO: 7500826 - DNA, 22 bp, Homo sapiens
aagttactaaaaggattttcag

SEQ ID NO: 7500827 - DNA, 22 bp, Homo sapiens
aagttactaaaaggattttcag

SEQ ID NO: 7500828 - DNA, 21 bp, Homo sapiens
aagttactactgtttccaaga

SEQ ID NO: 7500829 - DNA, 21 bp, Homo sapiens
aagttactactgtttccaaga

SEQ ID NO: 7500830 - DNA, 22 bp, Homo sapiens
aagttactatgactcttctttt

SEQ ID NO: 7500831 - DNA, 22 bp, Homo sapiens
aagttactggcaagggctgcag

SEQ ID NO: 7500832 - DNA, 22 bp, Homo sapiens
aagtgttttgtaaacagaaaag

SEQ ID NO: 7500833 - DNA, 22 bp, Homo sapiens
aagtgttttgtaaacagaaaag

SEQ ID NO: 7500834 - DNA, 22 bp, Homo sapiens
aagtgttttgtaaacagaaaag

SEQ ID NO: 7500835 - DNA, 22 bp, Homo sapiens
aagttacattttggtctaattg

SEQ ID NO: 7500836 - DNA, 22 bp, Homo sapiens
aagttacattttggtctaattg

SEQ ID NO: 7500837 - DNA, 22 bp, Homo sapiens
aagttagaaataagggctctcc

SEQ ID NO: 7500838 - DNA, 22 bp, Homo sapiens
aagttagagattccatcatgct

SEQ ID NO: 7500839 - DNA, 22 bp, Homo sapiens
aagttactttacctctttagct

SEQ ID NO: 7500840 - DNA, 22 bp, Homo sapiens
aagttactttacctctttagct

SEQ ID NO: 7500841 - DNA, 22 bp, Homo sapiens
aagttactttatgtagaagaaa

SEQ ID NO: 7500842 - DNA, 22 bp, Homo sapiens
aagttactggcaagggctgcag

SEQ ID NO: 7500843 - DNA, 22 bp, Homo sapiens
aagttactatgactcttctttt

SEQ ID NO: 7500844 - DNA, 22 bp, Homo sapiens
aagttactggcaagggctgcag

SEQ ID NO: 7500845 - DNA, 22 bp, Homo sapiens
aagttactggcaagggctgcag

SEQ ID NO: 7500846 - DNA, 22 bp, Homo sapiens
aagttactggcaagggctgcag

SEQ ID NO: 7500847 - DNA, 22 bp, Homo sapiens
aagttactttacctctttagct

SEQ ID NO: 7500848 - DNA, 22 bp, Homo sapiens
aagttactttacctctttagct

SEQ ID NO: 7500849 - DNA, 23 bp, Homo sapiens
aagtcagagccaagtcaatgaga

SEQ ID NO: 7500850 - DNA, 23 bp, Homo sapiens
aagtcagagccaagtcaatgaga

SEQ ID NO: 7500851 - DNA, 22 bp, Homo sapiens
aagtcagagcaactgagacatt

SEQ ID NO: 7500852 - DNA, 22 bp, Homo sapiens
aagtcagagcaactgagacatt

SEQ ID NO: 7500853 - DNA, 22 bp, Homo sapiens
aagtcagagcaactgagacatt

SEQ ID NO: 7500854 - DNA, 22 bp, Homo sapiens
aagtcagcactccaggaagcca

SEQ ID NO: 7500855 - DNA, 22 bp, Homo sapiens
aagtcagataggtgagtccaaa

SEQ ID NO: 7500856 - DNA, 22 bp, Homo sapiens
aagtcagcactccaggaagcca

SEQ ID NO: 7500857 - DNA, 23 bp, Homo sapiens
aagtcagagccaagtcaatgaga

SEQ ID NO: 7500858 - DNA, 22 bp, Homo sapiens
aagtcagataggtgagtccaaa

SEQ ID NO: 7500859 - DNA, 22 bp, Homo sapiens
aagtcagagatgccaaagatta

SEQ ID NO: 7500860 - DNA, 22 bp, Homo sapiens
aagtcagagatcaaggtgtcta

SEQ ID NO: 7500861 - DNA, 22 bp, Homo sapiens
aagtcagagatcaaggtgtcta

SEQ ID NO: 7500862 - DNA, 22 bp, Homo sapiens
aagtcagagatcaaggtgtcta

SEQ ID NO: 7500863 - DNA, 22 bp, Homo sapiens
aagtcagagcaactgagacatt

SEQ ID NO: 7500864 - DNA, 22 bp, Homo sapiens
aagtcagagatgccaaagatta

SEQ ID NO: 7500865 - DNA, 22 bp, Homo sapiens
aagtcagagcaactgagacatt

SEQ ID NO: 7500866 - DNA, 22 bp, Homo sapiens
aagtcagagcaactgagacatt

SEQ ID NO: 7500867 - DNA, 22 bp, Homo sapiens
aagtcagagcaactgagacatt

SEQ ID NO: 7500868 - DNA, 22 bp, Homo sapiens
aagtcagagcaactgagacatt

SEQ ID NO: 7500869 - DNA, 22 bp, Homo sapiens
aagtcagaccttgttgatagct

SEQ ID NO: 7500870 - DNA, 22 bp, Homo sapiens
aagtcagaccttgttgatagct

SEQ ID NO: 7500871 - DNA, 22 bp, Homo sapiens
aagtcagacagctgagctgcct

SEQ ID NO: 7500872 - DNA, 22 bp, Homo sapiens
aagtcagacagctgagctgcct

SEQ ID NO: 7500873 - DNA, 22 bp, Homo sapiens
aagtcagaataatgtttctttt

SEQ ID NO: 7500874 - DNA, 22 bp, Homo sapiens
aagtcagaataatgtttctttt

SEQ ID NO: 7500875 - DNA, 22 bp, Homo sapiens
aagtcagaaattattcaggaat

SEQ ID NO: 7500876 - DNA, 22 bp, Homo sapiens
aagtcagaaatcatctagtgta

SEQ ID NO: 7500877 - DNA, 22 bp, Homo sapiens
aagtcagaaaacagagcaatta

SEQ ID NO: 7500878 - DNA, 22 bp, Homo sapiens
aagtcactttcccattccttgc

SEQ ID NO: 7500879 - DNA, 22 bp, Homo sapiens
aagtcactttcccattccttgc

SEQ ID NO: 7500880 - DNA, 22 bp, Homo sapiens
aagtcacttgattgttgacaga

SEQ ID NO: 7500881 - DNA, 19 bp, Homo sapiens
aagtcacttgagggcagga

SEQ ID NO: 7500882 - DNA, 22 bp, Homo sapiens
aagtcacttgattgttgacaga

SEQ ID NO: 7500883 - DNA, 22 bp, Homo sapiens
aagtcacttgattgttgacaga

SEQ ID NO: 7500884 - DNA, 22 bp, Homo sapiens
aagtcagaaaacagagcaatta

SEQ ID NO: 7500885 - DNA, 22 bp, Homo sapiens
aagtcagaaaacagagcaatta

SEQ ID NO: 7500886 - DNA, 22 bp, Homo sapiens
aagtcagaaaacagagcaatta

SEQ ID NO: 7500887 - DNA, 22 bp, Homo sapiens
aagtcagaaatcatctagtgta

SEQ ID NO: 7500888 - DNA, 22 bp, Homo sapiens
aagtcagaaatatctgccatca

SEQ ID NO: 7500889 - DNA, 22 bp, Homo sapiens
aagtcagaaatatctgccatca

SEQ ID NO: 7500890 - DNA, 22 bp, Homo sapiens
aagtcactgaaagggcagaaag

SEQ ID NO: 7500891 - DNA, 22 bp, Homo sapiens
aagtcactaagtgaaccactgg

SEQ ID NO: 7500892 - DNA, 22 bp, Homo sapiens
aagtcactgaaagggcagaaag

SEQ ID NO: 7500893 - DNA, 22 bp, Homo sapiens
aagtcactgaaggccatgaaca

SEQ ID NO: 7500894 - DNA, 22 bp, Homo sapiens
aagtcactggaggaactctact

SEQ ID NO: 7500895 - DNA, 22 bp, Homo sapiens
aagtcactggaggaactctact

SEQ ID NO: 7500896 - DNA, 22 bp, Homo sapiens
aagtcactcatattcctcaagc

SEQ ID NO: 7500897 - DNA, 22 bp, Homo sapiens
aagtcactcatattcctcaagc

SEQ ID NO: 7500898 - DNA, 22 bp, Homo sapiens
aagtcactaagtgaaccactgg

SEQ ID NO: 7500899 - DNA, 22 bp, Homo sapiens
aagtcactaagtgaaccactgg

SEQ ID NO: 7500900 - DNA, 18 bp, Homo sapiens
aagtcacccctgctccct

SEQ ID NO: 7500901 - DNA, 22 bp, Homo sapiens
aagtcacttcttaggaaaggag

SEQ ID NO: 7500902 - DNA, 22 bp, Homo sapiens
aagtcacttgattgttgacaga

SEQ ID NO: 7500903 - DNA, 20 bp, Homo sapiens
aagtcacttaagatgggcag

SEQ ID NO: 7500904 - DNA, 17 bp, Homo sapiens
aagtcacttctgggcca

SEQ ID NO: 7500905 - DNA, 22 bp, Homo sapiens
aagtcacttcttaggaaaggag

SEQ ID NO: 7500906 - DNA, 22 bp, Homo sapiens
aagtcactgtgaaaggtgaagc

SEQ ID NO: 7500907 - DNA, 22 bp, Homo sapiens
aagtcactgttttagttttctc

SEQ ID NO: 7500908 - DNA, 22 bp, Homo sapiens
aagtcactgttttagttttctc

SEQ ID NO: 7500909 - DNA, 22 bp, Homo sapiens
aagtcactggcaaaagctgcag

SEQ ID NO: 7500910 - DNA, 22 bp, Homo sapiens
aagtcactgaaggccatgaaca

SEQ ID NO: 7500911 - DNA, 22 bp, Homo sapiens
aagtcactggaggaactctact

SEQ ID NO: 7500912 - DNA, 22 bp, Homo sapiens
aagtcactggcaaaagctgcag

SEQ ID NO: 7500913 - DNA, 22 bp, Homo sapiens
aagtcactggcaaaagctgcag

SEQ ID NO: 7500914 - DNA, 22 bp, Homo sapiens
aagtcactggcaaaagctgcag

SEQ ID NO: 7500915 - DNA, 22 bp, Homo sapiens
aagtcacagagttggaagtcag

SEQ ID NO: 7500916 - DNA, 22 bp, Homo sapiens
aagtcacagctaaatagctaag

SEQ ID NO: 7500917 - DNA, 22 bp, Homo sapiens
aagtcacagctaaatagctaag

SEQ ID NO: 7500918 - DNA, 22 bp, Homo sapiens
aagtcacagagttggaagtcag

SEQ ID NO: 7500919 - DNA, 22 bp, Homo sapiens
aagtcacagagttggaagtcag

SEQ ID NO: 7500920 - DNA, 22 bp, Homo sapiens
aagtcacagctaaatagctaag

SEQ ID NO: 7500921 - DNA, 22 bp, Homo sapiens
aagtcacattctgaggtattgg

SEQ ID NO: 7500922 - DNA, 22 bp, Homo sapiens
aagtcacagctaaatagctaag

SEQ ID NO: 7500923 - DNA, 22 bp, Homo sapiens
aagtcacactgctgggaactct

SEQ ID NO: 7500924 - DNA, 22 bp, Homo sapiens
aagtcacagaacccattgtaac

SEQ ID NO: 7500925 - DNA, 22 bp, Homo sapiens
aagtcacagaacccattgtaac

SEQ ID NO: 7500926 - DNA, 22 bp, Homo sapiens
aagtcacactgctgggaactct

SEQ ID NO: 7500927 - DNA, 22 bp, Homo sapiens
aagtcacactagacaactgagg

SEQ ID NO: 7500928 - DNA, 22 bp, Homo sapiens
aagtcacagagttggaagtcag

SEQ ID NO: 7500929 - DNA, 22 bp, Homo sapiens
aagtcacagaacccattgtaac

SEQ ID NO: 7500930 - DNA, 22 bp, Homo sapiens
aagtcacagagttggaagtcag

SEQ ID NO: 7500931 - DNA, 22 bp, Homo sapiens
aagtcacagaacccattgtaac

SEQ ID NO: 7500932 - DNA, 22 bp, Homo sapiens
aagtgcttggctaatggttatg

SEQ ID NO: 7500933 - DNA, 21 bp, Homo sapiens
aagtcagtcagttctatacta

SEQ ID NO: 7500934 - DNA, 22 bp, Homo sapiens
aagtgcatatttttgttgtaga

SEQ ID NO: 7500935 - DNA, 22 bp, Homo sapiens
aagtgcttggctaatggttatg

SEQ ID NO: 7500936 - DNA, 22 bp, Homo sapiens
aagtgcttggctaatggttatg

SEQ ID NO: 7500937 - DNA, 22 bp, Homo sapiens
aagtgcatatttttgttgtaga

SEQ ID NO: 7500938 - DNA, 22 bp, Homo sapiens
aagtgcatagtaatggagtcaa

SEQ ID NO: 7500939 - DNA, 22 bp, Homo sapiens
aagtgcatacactagttaattg

SEQ ID NO: 7500940 - DNA, 22 bp, Homo sapiens
aagtgcatacactagttaattg

SEQ ID NO: 7500941 - DNA, 22 bp, Homo sapiens
aagtgcataataactcccaagt

SEQ ID NO: 7500942 - DNA, 22 bp, Homo sapiens
aagtgcatacactagttaattg

SEQ ID NO: 7500943 - DNA, 22 bp, Homo sapiens
aagtcaggacttatgctacctg

SEQ ID NO: 7500944 - DNA, 22 bp, Homo sapiens
aagtcaggaagtgcaaaagttg

SEQ ID NO: 7500945 - DNA, 22 bp, Homo sapiens
aagtcaggctggggtctggcag

SEQ ID NO: 7500946 - DNA, 22 bp, Homo sapiens
aagtcaggacttatgctacctg

SEQ ID NO: 7500947 - DNA, 22 bp, Homo sapiens
aagtgcataataactcccaagt

SEQ ID NO: 7500948 - DNA, 22 bp, Homo sapiens
aagtgcataataactcccaagt

SEQ ID NO: 7500949 - DNA, 22 bp, Homo sapiens
aagtgcataagtatgattattt

SEQ ID NO: 7500950 - DNA, 21 bp, Homo sapiens
aagtcagtcagttctatacta

SEQ ID NO: 7500951 - DNA, 22 bp, Homo sapiens
aagtcagtgaaaaggcatcatc

SEQ ID NO: 7500952 - DNA, 22 bp, Homo sapiens
aagtcaggcttctcccagagcc

SEQ ID NO: 7500953 - DNA, 22 bp, Homo sapiens
aagtcaggtgagactctctggg

SEQ ID NO: 7500954 - DNA, 22 bp, Homo sapiens
aagtcaggtgagactctctggg

SEQ ID NO: 7500955 - DNA, 22 bp, Homo sapiens
aagtcaggtgagactctctggg

SEQ ID NO: 7500956 - DNA, 22 bp, Homo sapiens
aagtcaggtgagactctctggg

SEQ ID NO: 7500957 - DNA, 22 bp, Homo sapiens
aagtgctttaaaatttcctgag

SEQ ID NO: 7500958 - DNA, 22 bp, Homo sapiens
aagtgctttaaaatttcctgag

SEQ ID NO: 7500959 - DNA, 22 bp, Homo sapiens
aagtgctttacaaatgtctgtt

SEQ ID NO: 7500960 - DNA, 22 bp, Homo sapiens
aagtgctttacaaatgtctgtt

SEQ ID NO: 7500961 - DNA, 22 bp, Homo sapiens
aagtgctttcatatagtcttaa

SEQ ID NO: 7500962 - DNA, 22 bp, Homo sapiens
aagtgctttcatatagtcttaa

SEQ ID NO: 7500963 - DNA, 22 bp, Homo sapiens
aagtgctttataaacaatgaag

SEQ ID NO: 7500964 - DNA, 22 bp, Homo sapiens
aagtgctttataaacaatgaag

SEQ ID NO: 7500965 - DNA, 22 bp, Homo sapiens
aagtgctttcatatagtcttaa

SEQ ID NO: 7500966 - DNA, 22 bp, Homo sapiens
aagtgctttacaaatgtctgtt

SEQ ID NO: 7500967 - DNA, 22 bp, Homo sapiens
aagtgctttataaacaatgaag

SEQ ID NO: 7500968 - DNA, 22 bp, Homo sapiens
aagtggaaagagtgttgcaagg

SEQ ID NO: 7500969 - DNA, 22 bp, Homo sapiens
aagtgcttttttcttgaggcca

SEQ ID NO: 7500970 - DNA, 22 bp, Homo sapiens
aagtgcttttttcttgaggcca

SEQ ID NO: 7500971 - DNA, 22 bp, Homo sapiens
aagtgctttttcttgagctgct

SEQ ID NO: 7500972 - DNA, 22 bp, Homo sapiens
aagtgctttttcttgagctgct

SEQ ID NO: 7500973 - DNA, 22 bp, Homo sapiens
aagtgctttttcttgagctgct

SEQ ID NO: 7500974 - DNA, 23 bp, Homo sapiens
aagtgctttgggatggagtctgg

SEQ ID NO: 7500975 - DNA, 22 bp, Homo sapiens
aagtgctttttcttgagctgct

SEQ ID NO: 7500976 - DNA, 22 bp, Homo sapiens
aagtggactaatacaaggacta

SEQ ID NO: 7500977 - DNA, 22 bp, Homo sapiens
aagtggaagagaagttatctta

SEQ ID NO: 7500978 - DNA, 22 bp, Homo sapiens
aagtggactaatacaaggacta

SEQ ID NO: 7500979 - DNA, 22 bp, Homo sapiens
aagtggaagagaagttatctta

SEQ ID NO: 7500980 - DNA, 22 bp, Homo sapiens
aagtggactaatacaaggacta

SEQ ID NO: 7500981 - DNA, 22 bp, Homo sapiens
aagtggactaatacaaggacta

SEQ ID NO: 7500982 - DNA, 22 bp, Homo sapiens
aagtggactaatacaaggacta

SEQ ID NO: 7500983 - DNA, 22 bp, Homo sapiens
aagtggactaatacaaggacta

SEQ ID NO: 7500984 - DNA, 20 bp, Homo sapiens
actaacatttgcaaggggct

SEQ ID NO: 7500985 - DNA, 20 bp, Homo sapiens
actaacatttgcaaggggct

SEQ ID NO: 7500986 - DNA, 22 bp, Homo sapiens
actaacatttgtgtatgtcttg

SEQ ID NO: 7500987 - DNA, 22 bp, Homo sapiens
actaacatttgtgtatgtcttg

SEQ ID NO: 7500988 - DNA, 22 bp, Homo sapiens
actaacttctgagaaccaattg

SEQ ID NO: 7500989 - DNA, 22 bp, Homo sapiens
actaaatttgtcaatgacactt

SEQ ID NO: 7500990 - DNA, 22 bp, Homo sapiens
actaaatttgtcaatgacactt

SEQ ID NO: 7500991 - DNA, 22 bp, Homo sapiens
actaacatgttaatcaaaagaa

SEQ ID NO: 7500992 - DNA, 22 bp, Homo sapiens
actaacatgttaatcaaaagaa

SEQ ID NO: 7500993 - DNA, 22 bp, Homo sapiens
actaacatgttaatcaaaagaa

SEQ ID NO: 7500994 - DNA, 22 bp, Homo sapiens
aagtggagccagggaaactgaa

SEQ ID NO: 7500995 - DNA, 22 bp, Homo sapiens
actaaatgaactattaatactt

SEQ ID NO: 7500996 - DNA, 22 bp, Homo sapiens
actaaatgcattggtatctatt

SEQ ID NO: 7500997 - DNA, 22 bp, Homo sapiens
actaaatgctgcataaatgctt

SEQ ID NO: 7500998 - DNA, 22 bp, Homo sapiens
actaaatggaatgattactata

SEQ ID NO: 7500999 - DNA, 23 bp, Homo sapiens
actaaatggggctttgcttaaag

SEQ ID NO: 7501000 - DNA, 22 bp, Homo sapiens
aagtggactaatacaaggacta

SEQ ID NO: 7501001 - DNA, 21 bp, Homo sapiens
aagtggagaagaaaagctgga

SEQ ID NO: 7501002 - DNA, 22 bp, Homo sapiens
aagtggactaatacaaggacta

SEQ ID NO: 7501003 - DNA, 21 bp, Homo sapiens
aagtggagaagaaaagctgga

SEQ ID NO: 7501004 - DNA, 22 bp, Homo sapiens
aagtggagagccctggaggtct

SEQ ID NO: 7501005 - DNA, 21 bp, Homo sapiens
aagtggagaagaaaagctgga

SEQ ID NO: 7501006 - DNA, 21 bp, Homo sapiens
aagtggagaagaaaagctgga

SEQ ID NO: 7501007 - DNA, 21 bp, Homo sapiens
aagtggagaagaaaagctgga

SEQ ID NO: 7501008 - DNA, 22 bp, Homo sapiens
aagtggagagccctggaggtct

SEQ ID NO: 7501009 - DNA, 22 bp, Homo sapiens
aagtggagctataggctcagat

SEQ ID NO: 7501010 - DNA, 22 bp, Homo sapiens
aagtggagccagggaaactgaa

SEQ ID NO: 7501011 - DNA, 22 bp, Homo sapiens
aagtggagccagggaaactgaa

SEQ ID NO: 7501012 - DNA, 22 bp, Homo sapiens
aagtggagagccctggaggtct

SEQ ID NO: 7501013 - DNA, 22 bp, Homo sapiens
aagtggagagccctggaggtct

SEQ ID NO: 7501014 - DNA, 22 bp, Homo sapiens
aagtggagagccctggaggtct

SEQ ID NO: 7501015 - DNA, 22 bp, Homo sapiens
aagtggagagccctggaggtct

SEQ ID NO: 7501016 - DNA, 22 bp, Homo sapiens
aagtggagagccctggaggtct

SEQ ID NO: 7501017 - DNA, 22 bp, Homo sapiens
aagtggagagccctggaggtct

SEQ ID NO: 7501018 - DNA, 22 bp, Homo sapiens
aagtggagagccctggaggtct

SEQ ID NO: 7501019 - DNA, 19 bp, Homo sapiens
acagttctaatttctgtgg

SEQ ID NO: 7501020 - DNA, 22 bp, Homo sapiens
acagttctaaatcttggataat

SEQ ID NO: 7501021 - DNA, 22 bp, Homo sapiens
acagttctaaatcttggataat

SEQ ID NO: 7501022 - DNA, 19 bp, Homo sapiens
acagttctaatttctgtgg

SEQ ID NO: 7501023 - DNA, 19 bp, Homo sapiens
acagttctaatttctgtgg

SEQ ID NO: 7501024 - DNA, 19 bp, Homo sapiens
acagttctaatttctgtgg

SEQ ID NO: 7501025 - DNA, 19 bp, Homo sapiens
acagttctaatttctgtgg

SEQ ID NO: 7501026 - DNA, 22 bp, Homo sapiens
aaggcagagatattcttgatct

SEQ ID NO: 7501027 - DNA, 22 bp, Homo sapiens
aaggcagagatattcttgatct

SEQ ID NO: 7501028 - DNA, 22 bp, Homo sapiens
aaggcagagatattcttgatct

SEQ ID NO: 7501029 - DNA, 22 bp, Homo sapiens
acagttcctgactttaactcca

SEQ ID NO: 7501030 - DNA, 23 bp, Homo sapiens
acagttctctgatgggtttaaca

SEQ ID NO: 7501031 - DNA, 22 bp, Homo sapiens
acagttctccagtgcctttgag

SEQ ID NO: 7501032 - DNA, 22 bp, Homo sapiens
acagttctccagtgcctttgag

SEQ ID NO: 7501033 - DNA, 22 bp, Homo sapiens
acagttctagcttttacatttt

SEQ ID NO: 7501034 - DNA, 22 bp, Homo sapiens
acagttctagcttttacatttt

SEQ ID NO: 7501035 - DNA, 22 bp, Homo sapiens
acagttctccagtgcctttgag

SEQ ID NO: 7501036 - DNA, 22 bp, Homo sapiens
acagttctgaagactagagcct

SEQ ID NO: 7501037 - DNA, 22 bp, Homo sapiens
acagttctgaagactagagcct

SEQ ID NO: 7501038 - DNA, 22 bp, Homo sapiens
acagttctcttgtcacttcctc

SEQ ID NO: 7501039 - DNA, 23 bp, Homo sapiens
acagttctctgatgggtttaaca

SEQ ID NO: 7501040 - DNA, 22 bp, Homo sapiens
acagttctcttgtcacttcctc

SEQ ID NO: 7501041 - DNA, 22 bp, Homo sapiens
acagttctcttgtcacttcctc

SEQ ID NO: 7501042 - DNA, 22 bp, Homo sapiens
acagttctgagctataattgct

SEQ ID NO: 7501043 - DNA, 22 bp, Homo sapiens
acagttctgaagactagagcct

SEQ ID NO: 7501044 - DNA, 22 bp, Homo sapiens
acagttctgcctgtttgagaag

SEQ ID NO: 7501045 - DNA, 22 bp, Homo sapiens
acagttctgcctgtttgagaag

SEQ ID NO: 7501046 - DNA, 22 bp, Homo sapiens
acagttctgtcctagacttcgt

SEQ ID NO: 7501047 - DNA, 22 bp, Homo sapiens
acagttctgcctgtttgagaag

SEQ ID NO: 7501048 - DNA, 21 bp, Homo sapiens
acagttctgccggcatctttc

SEQ ID NO: 7501049 - DNA, 22 bp, Homo sapiens
acagttctgcctgtttgagaag

SEQ ID NO: 7501050 - DNA, 22 bp, Homo sapiens
acagttctgcctgtttgagaag

SEQ ID NO: 7501051 - DNA, 22 bp, Homo sapiens
acagttctgcaagatatttttt

SEQ ID NO: 7501052 - DNA, 22 bp, Homo sapiens
acagttctgcaagatatttttt

SEQ ID NO: 7501053 - DNA, 22 bp, Homo sapiens
acagttctgagctataattgct

SEQ ID NO: 7501054 - DNA, 21 bp, Homo sapiens
acagttctgccggcatctttc

SEQ ID NO: 7501055 - DNA, 21 bp, Homo sapiens
acagttctgccggcatctttc

SEQ ID NO: 7501056 - DNA, 21 bp, Homo sapiens
acagttctgccggcatctttc

SEQ ID NO: 7501057 - DNA, 22 bp, Homo sapiens
acagttctttgtttatagcttg

SEQ ID NO: 7501058 - DNA, 22 bp, Homo sapiens
acagttctttgtttatagcttg

SEQ ID NO: 7501059 - DNA, 22 bp, Homo sapiens
acagttctttggatggaagaat

SEQ ID NO: 7501060 - DNA, 22 bp, Homo sapiens
acagttctttggatggaagaat

SEQ ID NO: 7501061 - DNA, 22 bp, Homo sapiens
acagttctttggatggaagaat

SEQ ID NO: 7501062 - DNA, 22 bp, Homo sapiens
acagttcttaaaacttgaatta

SEQ ID NO: 7501063 - DNA, 22 bp, Homo sapiens
acagttcttaaaacttgaatta

SEQ ID NO: 7501064 - DNA, 22 bp, Homo sapiens
acagttctgtcctagacttcgt

SEQ ID NO: 7501065 - DNA, 22 bp, Homo sapiens
acagttctgtcctagacttcgt

SEQ ID NO: 7501066 - DNA, 22 bp, Homo sapiens
acagttctgtcctagacttcgt

SEQ ID NO: 7501067 - DNA, 22 bp, Homo sapiens
aaggcagccgtgtgactgcatg

SEQ ID NO: 7501068 - DNA, 22 bp, Homo sapiens
aaggcagccgtgtgactgcatg

SEQ ID NO: 7501069 - DNA, 22 bp, Homo sapiens
aaggcagccgtgtgactgcatg

SEQ ID NO: 7501070 - DNA, 22 bp, Homo sapiens
aaggcagcctctgccagccggg

SEQ ID NO: 7501071 - DNA, 22 bp, Homo sapiens
aaggcagcctctgccagccggg

SEQ ID NO: 7501072 - DNA, 22 bp, Homo sapiens
aaggcagcctttgtttgattga

SEQ ID NO: 7501073 - DNA, 22 bp, Homo sapiens
aaggcagccttttgagttgatt

SEQ ID NO: 7501074 - DNA, 22 bp, Homo sapiens
aaggcagccttttgagttgatt

SEQ ID NO: 7501075 - DNA, 22 bp, Homo sapiens
aaggcagccttttgagttgatt

SEQ ID NO: 7501076 - DNA, 22 bp, Homo sapiens
aaggcagctcagctcatggcag

SEQ ID NO: 7501077 - DNA, 22 bp, Homo sapiens
aaggcagctcagctcatggcag

SEQ ID NO: 7501078 - DNA, 22 bp, Homo sapiens
aaggcagctcagctcatggcag

SEQ ID NO: 7501079 - DNA, 22 bp, Homo sapiens
aaggcagctcagctcatggcag

SEQ ID NO: 7501080 - DNA, 22 bp, Homo sapiens
aaggcagctcagctcatggcag

SEQ ID NO: 7501081 - DNA, 22 bp, Homo sapiens
acagttgaggacttaaacaaaa

SEQ ID NO: 7501082 - DNA, 22 bp, Homo sapiens
acagttgaggacttaaacaaaa

SEQ ID NO: 7501083 - DNA, 22 bp, Homo sapiens
acagttgagatgcaactttggg

SEQ ID NO: 7501084 - DNA, 22 bp, Homo sapiens
acagttgggctgtagcatgctt

SEQ ID NO: 7501085 - DNA, 20 bp, Homo sapiens
acagttgacattgctctgtg

SEQ ID NO: 7501086 - DNA, 22 bp, Homo sapiens
acagttgacagggagagggtta

SEQ ID NO: 7501087 - DNA, 22 bp, Homo sapiens
acagttgagtgtctctaggaag

SEQ ID NO: 7501088 - DNA, 22 bp, Homo sapiens
acagttggttaacacaaatatt

SEQ ID NO: 7501089 - DNA, 22 bp, Homo sapiens
acagttggttaacacaaatatt

SEQ ID NO: 7501090 - DNA, 22 bp, Homo sapiens
acagttgatttcattagaatcg

SEQ ID NO: 7501091 - DNA, 22 bp, Homo sapiens
acagttgggctgtagcatgctt

SEQ ID NO: 7501092 - DNA, 22 bp, Homo sapiens
acagttgttttccagatatgtt

SEQ ID NO: 7501093 - DNA, 22 bp, Homo sapiens
acagttgttttccagatatgtt

SEQ ID NO: 7501094 - DNA, 22 bp, Homo sapiens
acagtttacagggatttgagct

SEQ ID NO: 7501095 - DNA, 22 bp, Homo sapiens
acagtttacagggatttgagct

SEQ ID NO: 7501096 - DNA, 22 bp, Homo sapiens
acagttggttaacacaaatatt

SEQ ID NO: 7501097 - DNA, 22 bp, Homo sapiens
acagtttacagggatttgagct

SEQ ID NO: 7501098 - DNA, 22 bp, Homo sapiens
aaggcagatataaagactagag

SEQ ID NO: 7501099 - DNA, 22 bp, Homo sapiens
aaggcagatataaagactagag

SEQ ID NO: 7501100 - DNA, 22 bp, Homo sapiens
aaggcagatataaagactagag

SEQ ID NO: 7501101 - DNA, 22 bp, Homo sapiens
aaggcagatataaagactagag

SEQ ID NO: 7501102 - DNA, 22 bp, Homo sapiens
aaggcagatataaagactagag

SEQ ID NO: 7501103 - DNA, 22 bp, Homo sapiens
aaggcagccgtgtgactgcatg

SEQ ID NO: 7501104 - DNA, 22 bp, Homo sapiens
aaggcagccgtgtgactgcatg

SEQ ID NO: 7501105 - DNA, 22 bp, Homo sapiens
aaggcagccgtgtgactgcatg

SEQ ID NO: 7501106 - DNA, 22 bp, Homo sapiens
aaggcagcttcaccacagcatt

SEQ ID NO: 7501107 - DNA, 22 bp, Homo sapiens
aaggcagcttcaccacagcatt

SEQ ID NO: 7501108 - DNA, 22 bp, Homo sapiens
aaggcagcttcaccacagcatt

SEQ ID NO: 7501109 - DNA, 22 bp, Homo sapiens
aaggcagctttaaaaaagatgc

SEQ ID NO: 7501110 - DNA, 22 bp, Homo sapiens
aaggcagctttaaaaaagatgc

SEQ ID NO: 7501111 - DNA, 22 bp, Homo sapiens
aaggcagctcagctcatggcag

SEQ ID NO: 7501112 - DNA, 22 bp, Homo sapiens
aaggcagcttcaccacagcatt

SEQ ID NO: 7501113 - DNA, 22 bp, Homo sapiens
aaggcagcttcaccacagcatt

SEQ ID NO: 7501114 - DNA, 22 bp, Homo sapiens
aaggcagcttcaccacagcatt

SEQ ID NO: 7501115 - DNA, 22 bp, Homo sapiens
aaggcaggagctgtatcttatt

SEQ ID NO: 7501116 - DNA, 22 bp, Homo sapiens
aaggcaggagctgtatcttatt

SEQ ID NO: 7501117 - DNA, 22 bp, Homo sapiens
aaggcaggagctgtatcttatt

SEQ ID NO: 7501118 - DNA, 22 bp, Homo sapiens
aaggcaggatgcggacccatct

SEQ ID NO: 7501119 - DNA, 22 bp, Homo sapiens
aaggcaggatgcggacccatct

SEQ ID NO: 7501120 - DNA, 22 bp, Homo sapiens
aaggcaggagctgtatcttatt

SEQ ID NO: 7501121 - DNA, 22 bp, Homo sapiens
aaggcaggatgcggacccatct

SEQ ID NO: 7501122 - DNA, 22 bp, Homo sapiens
aaggcaggatgggaaaagattt

SEQ ID NO: 7501123 - DNA, 22 bp, Homo sapiens
aaggcaggatgggaaaagattt

SEQ ID NO: 7501124 - DNA, 22 bp, Homo sapiens
aaggcaggatgggaaaagattt

SEQ ID NO: 7501125 - DNA, 22 bp, Homo sapiens
aaggcaggatgcggacccatct

SEQ ID NO: 7501126 - DNA, 22 bp, Homo sapiens
aaggcaggatgcggacccatct

SEQ ID NO: 7501127 - DNA, 22 bp, Homo sapiens
aaggcaggatgcggacccatct

SEQ ID NO: 7501128 - DNA, 22 bp, Homo sapiens
aaggcaggatgggaaaagattt

SEQ ID NO: 7501129 - DNA, 22 bp, Homo sapiens
aaggcaggatgggaaaagattt

SEQ ID NO: 7501130 - DNA, 22 bp, Homo sapiens
aaggcaggatgggaaaagattt

SEQ ID NO: 7501131 - DNA, 22 bp, Homo sapiens
aaggcaggatgggaaaagattt

SEQ ID NO: 7501132 - DNA, 22 bp, Homo sapiens
aaggcagggaaagtggattagg

SEQ ID NO: 7501133 - DNA, 22 bp, Homo sapiens
aaggcagggaaagtggattagg

SEQ ID NO: 7501134 - DNA, 22 bp, Homo sapiens
aaggcaggatgggaaaagattt

SEQ ID NO: 7501135 - DNA, 22 bp, Homo sapiens
aaggcaggatgggaaaagattt

SEQ ID NO: 7501136 - DNA, 22 bp, Homo sapiens
aaggcagggaaagtggattagg

SEQ ID NO: 7501137 - DNA, 22 bp, Homo sapiens
aaggcagggaaagtggattagg

SEQ ID NO: 7501138 - DNA, 22 bp, Homo sapiens
aaggcagggaaagtggattagg

SEQ ID NO: 7501139 - DNA, 22 bp, Homo sapiens
aaggcagggaaagtggattagg

SEQ ID NO: 7501140 - DNA, 22 bp, Homo sapiens
aaggcagggaaagtggattagg

SEQ ID NO: 7501141 - DNA, 22 bp, Homo sapiens
aaggcagggaaagtggattagg

SEQ ID NO: 7501142 - DNA, 22 bp, Homo sapiens
aaggcagggaaagtggattagg

SEQ ID NO: 7501143 - DNA, 22 bp, Homo sapiens
aaggcagttcactcacgcagcc

SEQ ID NO: 7501144 - DNA, 22 bp, Homo sapiens
aaggcagttaccgcaatggagg

SEQ ID NO: 7501145 - DNA, 22 bp, Homo sapiens
aaggcagttcactcacgcagcc

SEQ ID NO: 7501146 - DNA, 22 bp, Homo sapiens
aaggcatacatattgttatagg

SEQ ID NO: 7501147 - DNA, 22 bp, Homo sapiens
aaggcagtctggtttcaaagca

SEQ ID NO: 7501148 - DNA, 22 bp, Homo sapiens
aaggcagtcagttgttttgaaa

SEQ ID NO: 7501149 - DNA, 22 bp, Homo sapiens
aaggcagtggctggaaaacctg

SEQ ID NO: 7501150 - DNA, 22 bp, Homo sapiens
aaggcagtggttgtgatactgt

SEQ ID NO: 7501151 - DNA, 22 bp, Homo sapiens
aaggcagtaggatcttccacag

SEQ ID NO: 7501152 - DNA, 22 bp, Homo sapiens
aaggcagtatctgtagagtgct

SEQ ID NO: 7501153 - DNA, 22 bp, Homo sapiens
aaggcagtcaaagcagacttct

SEQ ID NO: 7501154 - DNA, 18 bp, Homo sapiens
aaggcagtatgattgcac

SEQ ID NO: 7501155 - DNA, 22 bp, Homo sapiens
aaggcaggtattgatgccacag

SEQ ID NO: 7501156 - DNA, 22 bp, Homo sapiens
aaggcaggtattgatgccacag

SEQ ID NO: 7501157 - DNA, 22 bp, Homo sapiens
aaggcaggtattgatgccacag

SEQ ID NO: 7501158 - DNA, 22 bp, Homo sapiens
aaggcaggtattgatgccacag

SEQ ID NO: 7501159 - DNA, 22 bp, Homo sapiens
aaggcaggtattgatgccacag

SEQ ID NO: 7501160 - DNA, 22 bp, Homo sapiens
aaggcaggtattgatgccacag

SEQ ID NO: 7501161 - DNA, 22 bp, Homo sapiens
aaggcaggtattgatgccacag

SEQ ID NO: 7501162 - DNA, 22 bp, Homo sapiens
aaggcaggtattgatgccacag

SEQ ID NO: 7501163 - DNA, 22 bp, Homo sapiens
aaggcaggtattgatgccacag

SEQ ID NO: 7501164 - DNA, 22 bp, Homo sapiens
aaggcactacgctgctggggcg

SEQ ID NO: 7501165 - DNA, 22 bp, Homo sapiens
aaggcactagcaagctgcctgg

SEQ ID NO: 7501166 - DNA, 22 bp, Homo sapiens
aaggcactacgctgctggggcg

SEQ ID NO: 7501167 - DNA, 22 bp, Homo sapiens
aaggaagaagggaagttactta

SEQ ID NO: 7501168 - DNA, 22 bp, Homo sapiens
aaggaagaagggaagttactta

SEQ ID NO: 7501169 - DNA, 22 bp, Homo sapiens
aaggaagaagactctttactcc

SEQ ID NO: 7501170 - DNA, 22 bp, Homo sapiens
aaggaagaagactctttactcc

SEQ ID NO: 7501171 - DNA, 22 bp, Homo sapiens
aaggaagaagggaagttactta

SEQ ID NO: 7501172 - DNA, 22 bp, Homo sapiens
aaggaagaagggaagttactta

SEQ ID NO: 7501173 - DNA, 22 bp, Homo sapiens
aaggaagaagactctttactcc

SEQ ID NO: 7501174 - DNA, 22 bp, Homo sapiens
aaggaagaagactctttactcc

SEQ ID NO: 7501175 - DNA, 22 bp, Homo sapiens
aaggaagaagggaagttactta

SEQ ID NO: 7501176 - DNA, 22 bp, Homo sapiens
aaggcacttttcctgagatgat

SEQ ID NO: 7501177 - DNA, 22 bp, Homo sapiens
aaggcacttttcctgagatgat

SEQ ID NO: 7501178 - DNA, 22 bp, Homo sapiens
aaggcacttgcccagagctgca

SEQ ID NO: 7501179 - DNA, 22 bp, Homo sapiens
aaggcacttgcccagagctgca

SEQ ID NO: 7501180 - DNA, 22 bp, Homo sapiens
aaggcacttgcccagagctgca

SEQ ID NO: 7501181 - DNA, 22 bp, Homo sapiens
aaggcacttgcccagagctgca

SEQ ID NO: 7501182 - DNA, 22 bp, Homo sapiens
aaggcacttgcccagagctgca

SEQ ID NO: 7501183 - DNA, 22 bp, Homo sapiens
aaggcacttgcccagagctgca

SEQ ID NO: 7501184 - DNA, 22 bp, Homo sapiens
aaggcacttaacgtgggaggat

SEQ ID NO: 7501185 - DNA, 22 bp, Homo sapiens
aaggaactgatgctcaaagaat

SEQ ID NO: 7501186 - DNA, 22 bp, Homo sapiens
aaggaactgatgctcaaagaat

SEQ ID NO: 7501187 - DNA, 22 bp, Homo sapiens
aaggaactgatgctcaaagaat

SEQ ID NO: 7501188 - DNA, 22 bp, Homo sapiens
aaggaactctagagccttgaac

SEQ ID NO: 7501189 - DNA, 22 bp, Homo sapiens
aaggaactctagagccttgaac

SEQ ID NO: 7501190 - DNA, 22 bp, Homo sapiens
aaggaactaactatgtagagat

SEQ ID NO: 7501191 - DNA, 22 bp, Homo sapiens
aaggaactagcatgatgtgtag

SEQ ID NO: 7501192 - DNA, 22 bp, Homo sapiens
aaggaacttgccacagaaaaga

SEQ ID NO: 7501193 - DNA, 22 bp, Homo sapiens
aaggaacttgccacagaaaaga

SEQ ID NO: 7501194 - DNA, 22 bp, Homo sapiens
aaggaactttgcagaggtgatt

SEQ ID NO: 7501195 - DNA, 22 bp, Homo sapiens
aaggaacttgccacagaaaaga

SEQ ID NO: 7501196 - DNA, 22 bp, Homo sapiens
aaggaactgctgatgtggtgac

SEQ ID NO: 7501197 - DNA, 22 bp, Homo sapiens
aaggaactgatgctcaaagaat

SEQ ID NO: 7501198 - DNA, 22 bp, Homo sapiens
aaggaactgatgctcaaagaat

SEQ ID NO: 7501199 - DNA, 22 bp, Homo sapiens
aaggaagaaatgaataggtgga

SEQ ID NO: 7501200 - DNA, 22 bp, Homo sapiens
aaggaagaaatgaataggtgga

SEQ ID NO: 7501201 - DNA, 22 bp, Homo sapiens
aaggaagaaatgaataggtgga

SEQ ID NO: 7501202 - DNA, 22 bp, Homo sapiens
aaggaagaaatgaataggtgga

SEQ ID NO: 7501203 - DNA, 22 bp, Homo sapiens
aaggaagaagactctttactcc

SEQ ID NO: 7501204 - DNA, 22 bp, Homo sapiens
aaggaagaagactctttactcc

SEQ ID NO: 7501205 - DNA, 22 bp, Homo sapiens
aaggaagaaatgaataggtgga

SEQ ID NO: 7501206 - DNA, 22 bp, Homo sapiens
aaggaagaaatgaataggtgga

SEQ ID NO: 7501207 - DNA, 22 bp, Homo sapiens
aaggaagaaatgaataggtgga

SEQ ID NO: 7501208 - DNA, 22 bp, Homo sapiens
aaggaagaaatgaataggtgga

SEQ ID NO: 7501209 - DNA, 22 bp, Homo sapiens
aaggaactttgcagaggtgatt

SEQ ID NO: 7501210 - DNA, 22 bp, Homo sapiens
aaggaagaaatgaataggtgga

SEQ ID NO: 7501211 - DNA, 22 bp, Homo sapiens
aaggaagaaatgaataggtgga

SEQ ID NO: 7501212 - DNA, 22 bp, Homo sapiens
aaggaagaaatgaataggtgga

SEQ ID NO: 7501213 - DNA, 22 bp, Homo sapiens
aaggcacttttctaaagacctt

SEQ ID NO: 7501214 - DNA, 22 bp, Homo sapiens
aaggcacttttctaaagacctt

SEQ ID NO: 7501215 - DNA, 22 bp, Homo sapiens
aaggcacttttctaaagacctt

SEQ ID NO: 7501216 - DNA, 22 bp, Homo sapiens
aaggcacttttcctgagatgat

SEQ ID NO: 7501217 - DNA, 22 bp, Homo sapiens
aaggcacttttctaaagacctt

SEQ ID NO: 7501218 - DNA, 22 bp, Homo sapiens
aaggcagaaagggatgtgagtg

SEQ ID NO: 7501219 - DNA, 22 bp, Homo sapiens
aaggcagaaagggatgtgagtg

SEQ ID NO: 7501220 - DNA, 22 bp, Homo sapiens
aaggcagaaagggatgtgagtg

SEQ ID NO: 7501221 - DNA, 22 bp, Homo sapiens
aaggcagaaagggatgtgagtg

SEQ ID NO: 7501222 - DNA, 22 bp, Homo sapiens
aaggcacttttctaaagacctt

SEQ ID NO: 7501223 - DNA, 22 bp, Homo sapiens
aaggcagaaagggatgtgagtg

SEQ ID NO: 7501224 - DNA, 22 bp, Homo sapiens
aaggcagaaagggatgtgagtg

SEQ ID NO: 7501225 - DNA, 22 bp, Homo sapiens
aaggcagaaagggatgtgagtg

SEQ ID NO: 7501226 - DNA, 22 bp, Homo sapiens
aaggcagaaagggatgtgagtg

SEQ ID NO: 7501227 - DNA, 22 bp, Homo sapiens
aaggcagaaagggatgtgagtg

SEQ ID NO: 7501228 - DNA, 22 bp, Homo sapiens
aaggcagaaagggatgtgagtg

SEQ ID NO: 7501229 - DNA, 22 bp, Homo sapiens
aaggcagaaagggatgtgagtg

SEQ ID NO: 7501230 - DNA, 21 bp, Homo sapiens
aaggcagaagcatggaatgag

SEQ ID NO: 7501231 - DNA, 21 bp, Homo sapiens
aaggcagaagcatggaatgag

SEQ ID NO: 7501232 - DNA, 21 bp, Homo sapiens
aaggcagaagcatggaatgag

SEQ ID NO: 7501233 - DNA, 22 bp, Homo sapiens
aaggcacttttcctgagatgat

SEQ ID NO: 7501234 - DNA, 22 bp, Homo sapiens
aaggcagaaattcaactactgg

SEQ ID NO: 7501235 - DNA, 22 bp, Homo sapiens
aaggcagaaattcaactactgg

SEQ ID NO: 7501236 - DNA, 22 bp, Homo sapiens
aaggcagaaattcaactactgg

SEQ ID NO: 7501237 - DNA, 22 bp, Homo sapiens
aaggcagaaattcaactactgg

SEQ ID NO: 7501238 - DNA, 22 bp, Homo sapiens
aaggcagaaattcaactactgg

SEQ ID NO: 7501239 - DNA, 19 bp, Homo sapiens
aaggcagaagttggatatg

SEQ ID NO: 7501240 - DNA, 19 bp, Homo sapiens
aaggcagaagttggatatg

SEQ ID NO: 7501241 - DNA, 22 bp, Homo sapiens
aaggcagagatattcttgatct

SEQ ID NO: 7501242 - DNA, 19 bp, Homo sapiens
aaggcagaagttggatatg

SEQ ID NO: 7501243 - DNA, 19 bp, Homo sapiens
aaggcagaagttggatatg

SEQ ID NO: 7501244 - DNA, 21 bp, Homo sapiens
aaggcagaagcatggaatgag

SEQ ID NO: 7501245 - DNA, 22 bp, Homo sapiens
acagtagatggctcagagacag

SEQ ID NO: 7501246 - DNA, 22 bp, Homo sapiens
acagtagatggctcagagacag

SEQ ID NO: 7501247 - DNA, 22 bp, Homo sapiens
acagtagagtaaatggttagat

SEQ ID NO: 7501248 - DNA, 22 bp, Homo sapiens
acagtagaccctggataaacat

SEQ ID NO: 7501249 - DNA, 22 bp, Homo sapiens
acagtagaccctggataaacat

SEQ ID NO: 7501250 - DNA, 22 bp, Homo sapiens
acagtagaccctggataaacat

SEQ ID NO: 7501251 - DNA, 22 bp, Homo sapiens
acagtagaccctggataaacat

SEQ ID NO: 7501252 - DNA, 22 bp, Homo sapiens
acagtagaccctggataaacat

SEQ ID NO: 7501253 - DNA, 22 bp, Homo sapiens
acagtagagcatttgttttgat

SEQ ID NO: 7501254 - DNA, 22 bp, Homo sapiens
acagtagaggcttgatcgcagc

SEQ ID NO: 7501255 - DNA, 22 bp, Homo sapiens
acagtactgctgttcttgtcct

SEQ ID NO: 7501256 - DNA, 22 bp, Homo sapiens
acagtactgctgttcttgtcct

SEQ ID NO: 7501257 - DNA, 22 bp, Homo sapiens
acagtactgtgttaactgaacc

SEQ ID NO: 7501258 - DNA, 22 bp, Homo sapiens
acagtagaaacaggcaggcaga

SEQ ID NO: 7501259 - DNA, 21 bp, Homo sapiens
acagtacttgagatcttttga

SEQ ID NO: 7501260 - DNA, 21 bp, Homo sapiens
acagtacttgagatcttttga

SEQ ID NO: 7501261 - DNA, 22 bp, Homo sapiens
acagtagaaacaggcaggcaga

SEQ ID NO: 7501262 - DNA, 20 bp, Homo sapiens
acagtagaagggatttcaaa

SEQ ID NO: 7501263 - DNA, 20 bp, Homo sapiens
acagtagaagggatttcaaa

SEQ ID NO: 7501264 - DNA, 21 bp, Homo sapiens
acagtagctgacacacagttt

SEQ ID NO: 7501265 - DNA, 22 bp, Homo sapiens
acagtagctaatattgcattat

SEQ ID NO: 7501266 - DNA, 22 bp, Homo sapiens
acagtagctaatattgcattat

SEQ ID NO: 7501267 - DNA, 22 bp, Homo sapiens
acagtagattggtatgatgtca

SEQ ID NO: 7501268 - DNA, 22 bp, Homo sapiens
acagtagattggtatgatgtca

SEQ ID NO: 7501269 - DNA, 22 bp, Homo sapiens
acagtagatggctcagagacag

SEQ ID NO: 7501270 - DNA, 22 bp, Homo sapiens
acagtagtcctttattttggtt

SEQ ID NO: 7501271 - DNA, 22 bp, Homo sapiens
acagtagtctcaggaataggca

SEQ ID NO: 7501272 - DNA, 22 bp, Homo sapiens
acagtagtacacatctatgtcc

SEQ ID NO: 7501273 - DNA, 22 bp, Homo sapiens
acagtaggaatagatgtagata

SEQ ID NO: 7501274 - DNA, 22 bp, Homo sapiens
acagtagtgtgtgaaacttgcc

SEQ ID NO: 7501275 - DNA, 22 bp, Homo sapiens
acagtagtgccatgacctacag

SEQ ID NO: 7501276 - DNA, 22 bp, Homo sapiens
acagtagtgctcaatcagtgtt

SEQ ID NO: 7501277 - DNA, 22 bp, Homo sapiens
acagtagtctcaggaataggca

SEQ ID NO: 7501278 - DNA, 22 bp, Homo sapiens
acagtagtcttaatttcatgta

SEQ ID NO: 7501279 - DNA, 22 bp, Homo sapiens
acagtagtttataaaaatgttg

SEQ ID NO: 7501280 - DNA, 22 bp, Homo sapiens
acagtagtttataaaaatgttg

SEQ ID NO: 7501281 - DNA, 22 bp, Homo sapiens
acagtagtttataaaaatgttg

SEQ ID NO: 7501282 - DNA, 22 bp, Homo sapiens
acagtataaactcctaaaagcc

SEQ ID NO: 7501283 - DNA, 22 bp, Homo sapiens
acagtataaactcctaaaagcc

SEQ ID NO: 7501284 - DNA, 22 bp, Homo sapiens
acagtagttggttgttttggga

SEQ ID NO: 7501285 - DNA, 22 bp, Homo sapiens
acagtagttggttgttttggga

SEQ ID NO: 7501286 - DNA, 22 bp, Homo sapiens
acagtagttatctaacttattt

SEQ ID NO: 7501287 - DNA, 22 bp, Homo sapiens
aaggaaatgaggttgatggatg

SEQ ID NO: 7501288 - DNA, 22 bp, Homo sapiens
aaggaaatgaagctgatgttgg

SEQ ID NO: 7501289 - DNA, 22 bp, Homo sapiens
aaggaaatgaagctgatgttgg

SEQ ID NO: 7501290 - DNA, 22 bp, Homo sapiens
aaggaaatgaagctgatgttgg

SEQ ID NO: 7501291 - DNA, 22 bp, Homo sapiens
aaggaaatgaagctgatgttgg

SEQ ID NO: 7501292 - DNA, 22 bp, Homo sapiens
aaggaaatctttgtaacatctt

SEQ ID NO: 7501293 - DNA, 22 bp, Homo sapiens
aaggaaatctttgtaacatctt

SEQ ID NO: 7501294 - DNA, 22 bp, Homo sapiens
aaggaaatctttgtaacatctt

SEQ ID NO: 7501295 - DNA, 22 bp, Homo sapiens
aaggaaatctttgtaacatctt

SEQ ID NO: 7501296 - DNA, 22 bp, Homo sapiens
acagtagtgtgtgaaacttgcc

SEQ ID NO: 7501297 - DNA, 22 bp, Homo sapiens
acagtataactccatgccaccc

SEQ ID NO: 7501298 - DNA, 22 bp, Homo sapiens
acagtataactccatgccaccc

SEQ ID NO: 7501299 - DNA, 22 bp, Homo sapiens
acagtataactccatgccaccc

SEQ ID NO: 7501300 - DNA, 22 bp, Homo sapiens
acagtatagggcttatattgta

SEQ ID NO: 7501301 - DNA, 22 bp, Homo sapiens
acagtataccattgtgactttg

SEQ ID NO: 7501302 - DNA, 22 bp, Homo sapiens
acagtatacattgattaggacc

SEQ ID NO: 7501303 - DNA, 22 bp, Homo sapiens
acagtataccattgtgactttg

SEQ ID NO: 7501304 - DNA, 22 bp, Homo sapiens
aaggaacactacaaggctggga

SEQ ID NO: 7501305 - DNA, 22 bp, Homo sapiens
aaggaacactacaaggctggga

SEQ ID NO: 7501306 - DNA, 22 bp, Homo sapiens
aaggaaattaggttattttgct

SEQ ID NO: 7501307 - DNA, 22 bp, Homo sapiens
aaggaaattaggttattttgct

SEQ ID NO: 7501308 - DNA, 22 bp, Homo sapiens
aaggaacactacaaggctggga

SEQ ID NO: 7501309 - DNA, 22 bp, Homo sapiens
aaggaacctggagtagagggag

SEQ ID NO: 7501310 - DNA, 22 bp, Homo sapiens
aaggaaattaggttattttgct

SEQ ID NO: 7501311 - DNA, 22 bp, Homo sapiens
aaggaaattaggttattttgct

SEQ ID NO: 7501312 - DNA, 22 bp, Homo sapiens
aaggaaatgtgcctgacactgc

SEQ ID NO: 7501313 - DNA, 22 bp, Homo sapiens
aaggaaatgtgcctgacactgc

SEQ ID NO: 7501314 - DNA, 22 bp, Homo sapiens
aaggaaatgtgcctgacactgc

SEQ ID NO: 7501315 - DNA, 22 bp, Homo sapiens
aaggaaatgtgcctgacactgc

SEQ ID NO: 7501316 - DNA, 22 bp, Homo sapiens
aaggaaatgtgcctgacactgc

SEQ ID NO: 7501317 - DNA, 22 bp, Homo sapiens
aaggaaatgtgcctgacactgc

SEQ ID NO: 7501318 - DNA, 22 bp, Homo sapiens
aaggaaatgtgcctgacactgc

SEQ ID NO: 7501319 - DNA, 22 bp, Homo sapiens
aaggaaatgtgcctgacactgc

SEQ ID NO: 7501320 - DNA, 22 bp, Homo sapiens
aaggaaatgaggttgatggatg

SEQ ID NO: 7501321 - DNA, 22 bp, Homo sapiens
aaggaaatgaggttgatggatg

SEQ ID NO: 7501322 - DNA, 22 bp, Homo sapiens
aaggaaatgaggttgatggatg

SEQ ID NO: 7501323 - DNA, 22 bp, Homo sapiens
aagccaggtgttgtggtaagag

SEQ ID NO: 7501324 - DNA, 22 bp, Homo sapiens
aagccaggtgtttaggccagcg

SEQ ID NO: 7501325 - DNA, 22 bp, Homo sapiens
aagccaggtgttgtggtaagag

SEQ ID NO: 7501326 - DNA, 22 bp, Homo sapiens
aagccaggtgtgcccaggatcc

SEQ ID NO: 7501327 - DNA, 22 bp, Homo sapiens
aagccaggtgttgtggtaagag

SEQ ID NO: 7501328 - DNA, 22 bp, Homo sapiens
aagccaggtgttgtggtaagag

SEQ ID NO: 7501329 - DNA, 22 bp, Homo sapiens
aagccaggtgttgtggtaagag

SEQ ID NO: 7501330 - DNA, 22 bp, Homo sapiens
aagccaggtgtgcccaggatcc

SEQ ID NO: 7501331 - DNA, 18 bp, Homo sapiens
aagccaggtcaagataag

SEQ ID NO: 7501332 - DNA, 22 bp, Homo sapiens
aagccaggtgtgcccaggatcc

SEQ ID NO: 7501333 - DNA, 22 bp, Homo sapiens
aagccaggtgtgcccaggatcc

SEQ ID NO: 7501334 - DNA, 22 bp, Homo sapiens
aagccaggtgtgcccaggatcc

SEQ ID NO: 7501335 - DNA, 18 bp, Homo sapiens
aagccaggtcaagataag

SEQ ID NO: 7501336 - DNA, 22 bp, Homo sapiens
aagccaggtgtgcccaggatcc

SEQ ID NO: 7501337 - DNA, 18 bp, Homo sapiens
aagccaggtcaagataag

SEQ ID NO: 7501338 - DNA, 18 bp, Homo sapiens
aagccaggtcaagataag

SEQ ID NO: 7501339 - DNA, 22 bp, Homo sapiens
aagccagggtttgtggatctat

SEQ ID NO: 7501340 - DNA, 22 bp, Homo sapiens
aagccagggtttgtggatctat

SEQ ID NO: 7501341 - DNA, 22 bp, Homo sapiens
aagctcttcttgccaccattca

SEQ ID NO: 7501342 - DNA, 22 bp, Homo sapiens
aagctcttctgtggatttgagt

SEQ ID NO: 7501343 - DNA, 22 bp, Homo sapiens
aagctcttctgtggatttgagt

SEQ ID NO: 7501344 - DNA, 22 bp, Homo sapiens
aagctcttcctggagcgcccac

SEQ ID NO: 7501345 - DNA, 21 bp, Homo sapiens
aagctcttctcagggtcacct

SEQ ID NO: 7501346 - DNA, 22 bp, Homo sapiens
aagctcttctgtggatttgagt

SEQ ID NO: 7501347 - DNA, 22 bp, Homo sapiens
aagctcttgaagaccaccagga

SEQ ID NO: 7501348 - DNA, 22 bp, Homo sapiens
aagctcttcttgccaccattca

SEQ ID NO: 7501349 - DNA, 22 bp, Homo sapiens
aagctcttgaagaccaccagga

SEQ ID NO: 7501350 - DNA, 22 bp, Homo sapiens
aagctgcaaaaaatttctgtct

SEQ ID NO: 7501351 - DNA, 22 bp, Homo sapiens
aagccaggtgtttaggccagcg

SEQ ID NO: 7501352 - DNA, 22 bp, Homo sapiens
aagccaggtgtttaggccagcg

SEQ ID NO: 7501353 - DNA, 22 bp, Homo sapiens
aagccaggtgtttaggccagcg

SEQ ID NO: 7501354 - DNA, 22 bp, Homo sapiens
aagctcttcctgcagggacctt

SEQ ID NO: 7501355 - DNA, 22 bp, Homo sapiens
aagccaggttccatggaggagc

SEQ ID NO: 7501356 - DNA, 22 bp, Homo sapiens
aagccaggtgtttaggccagcg

SEQ ID NO: 7501357 - DNA, 22 bp, Homo sapiens
aagccaggtgtttaggccagcg

SEQ ID NO: 7501358 - DNA, 22 bp, Homo sapiens
aagccaggtgtttaggccagcg

SEQ ID NO: 7501359 - DNA, 22 bp, Homo sapiens
aagccaggtgtttaggccagcg

SEQ ID NO: 7501360 - DNA, 22 bp, Homo sapiens
aagccaggtgtttaggccagcg

SEQ ID NO: 7501361 - DNA, 22 bp, Homo sapiens
aagccaggtgtttaggccagcg

SEQ ID NO: 7501362 - DNA, 22 bp, Homo sapiens
aagccagggatggaatgatagg

SEQ ID NO: 7501363 - DNA, 22 bp, Homo sapiens
aagccagggattcctgagggag

SEQ ID NO: 7501364 - DNA, 22 bp, Homo sapiens
aagccagggattcctgagggag

SEQ ID NO: 7501365 - DNA, 22 bp, Homo sapiens
aagccagggattcctgagggag

SEQ ID NO: 7501366 - DNA, 22 bp, Homo sapiens
aagccagggattcctgagggag

SEQ ID NO: 7501367 - DNA, 22 bp, Homo sapiens
aagccaggctgcacttgctggg

SEQ ID NO: 7501368 - DNA, 22 bp, Homo sapiens
aagccaggctgcacttgctggg

SEQ ID NO: 7501369 - DNA, 22 bp, Homo sapiens
aagccagggatggaatgatagg

SEQ ID NO: 7501370 - DNA, 22 bp, Homo sapiens
aagccaggccattctctggttc

SEQ ID NO: 7501371 - DNA, 22 bp, Homo sapiens
aagccaggcatgcttggacagt

SEQ ID NO: 7501372 - DNA, 22 bp, Homo sapiens
aagccaggccattctctggttc

SEQ ID NO: 7501373 - DNA, 22 bp, Homo sapiens
aagccaggccattctctggttc

SEQ ID NO: 7501374 - DNA, 22 bp, Homo sapiens
aagccaggccattctctggttc

SEQ ID NO: 7501375 - DNA, 22 bp, Homo sapiens
aagccaggccattctctggttc

SEQ ID NO: 7501376 - DNA, 22 bp, Homo sapiens
aagccaggctgcacttgctggg

SEQ ID NO: 7501377 - DNA, 22 bp, Homo sapiens
aagccaggctgcacttgctggg

SEQ ID NO: 7501378 - DNA, 22 bp, Homo sapiens
aagccagggtcagaatttgggc

SEQ ID NO: 7501379 - DNA, 22 bp, Homo sapiens
aagccagggtcagaatttgggc

SEQ ID NO: 7501380 - DNA, 22 bp, Homo sapiens
aagccagggtcaggggcctcct

SEQ ID NO: 7501381 - DNA, 22 bp, Homo sapiens
aagccagggtcaggggcctcct

SEQ ID NO: 7501382 - DNA, 22 bp, Homo sapiens
aagccagggtcaggggcctcct

SEQ ID NO: 7501383 - DNA, 22 bp, Homo sapiens
aagccagggtcaggggcctcct

SEQ ID NO: 7501384 - DNA, 22 bp, Homo sapiens
aagccagggattcctgagggag

SEQ ID NO: 7501385 - DNA, 22 bp, Homo sapiens
aagccagggattcctgagggag

SEQ ID NO: 7501386 - DNA, 22 bp, Homo sapiens
aagccagggattcctgagggag

SEQ ID NO: 7501387 - DNA, 22 bp, Homo sapiens
aagccaggggctgcttaggaga

SEQ ID NO: 7501388 - DNA, 22 bp, Homo sapiens
aagccaggggctgcttaggaga

SEQ ID NO: 7501389 - DNA, 22 bp, Homo sapiens
aagccagggattcctgagggag

SEQ ID NO: 7501390 - DNA, 22 bp, Homo sapiens
aagccaggggttggtatgctat

SEQ ID NO: 7501391 - DNA, 22 bp, Homo sapiens
aagccaggggttggtatgctat

SEQ ID NO: 7501392 - DNA, 22 bp, Homo sapiens
aagccaggggttggtatgctat

SEQ ID NO: 7501393 - DNA, 22 bp, Homo sapiens
aagctgccagattcagtctgct

SEQ ID NO: 7501394 - DNA, 22 bp, Homo sapiens
aagctgccagattcagtctgct

SEQ ID NO: 7501395 - DNA, 22 bp, Homo sapiens
aagctgccagctgagctgaggc

SEQ ID NO: 7501396 - DNA, 22 bp, Homo sapiens
aagctgccagattcagtctgct

SEQ ID NO: 7501397 - DNA, 22 bp, Homo sapiens
aagctgccaccagcccagggca

SEQ ID NO: 7501398 - DNA, 22 bp, Homo sapiens
aagctgccaccagcccagggca

SEQ ID NO: 7501399 - DNA, 22 bp, Homo sapiens
aagctgccagctgagctgaggc

SEQ ID NO: 7501400 - DNA, 22 bp, Homo sapiens
aagctgccagctgagctgaggc

SEQ ID NO: 7501401 - DNA, 23 bp, Homo sapiens
aagctgccagtctgaagcctggg

SEQ ID NO: 7501402 - DNA, 22 bp, Homo sapiens
aagctgccagctgagctgaggc

SEQ ID NO: 7501403 - DNA, 22 bp, Homo sapiens
aagctgccacacggtgagtact

SEQ ID NO: 7501404 - DNA, 22 bp, Homo sapiens
aagctgccacacggtgagtact

SEQ ID NO: 7501405 - DNA, 22 bp, Homo sapiens
aagctgccaccagcccagggca

SEQ ID NO: 7501406 - DNA, 22 bp, Homo sapiens
aagctgccaccagcccagggca

SEQ ID NO: 7501407 - DNA, 22 bp, Homo sapiens
aagctgccaatggtaagctgct

SEQ ID NO: 7501408 - DNA, 22 bp, Homo sapiens
aagctgccaatggtaagctgct

SEQ ID NO: 7501409 - DNA, 22 bp, Homo sapiens
aagctgccacacggtgagtact

SEQ ID NO: 7501410 - DNA, 22 bp, Homo sapiens
aagctgccaatggtaagctgct

SEQ ID NO: 7501411 - DNA, 22 bp, Homo sapiens
aagctgcagatgtgcctgtgga

SEQ ID NO: 7501412 - DNA, 22 bp, Homo sapiens
aagctgcagaccccctgtctca

SEQ ID NO: 7501413 - DNA, 22 bp, Homo sapiens
aagctgcactacttgagggacc

SEQ ID NO: 7501414 - DNA, 22 bp, Homo sapiens
aagctgcactacttgagggacc

SEQ ID NO: 7501415 - DNA, 22 bp, Homo sapiens
aagctgcaaggaagtgtgccag

SEQ ID NO: 7501416 - DNA, 22 bp, Homo sapiens
aagctgcagaccccctgtctca

SEQ ID NO: 7501417 - DNA, 22 bp, Homo sapiens
aagctgcaggttgaatccaggt

SEQ ID NO: 7501418 - DNA, 22 bp, Homo sapiens
aagctgcatgaagttgagtaga

SEQ ID NO: 7501419 - DNA, 22 bp, Homo sapiens
aagctgcagcacagagaggtgg

SEQ ID NO: 7501420 - DNA, 22 bp, Homo sapiens
aagctgcagatgtgcctgtgga

SEQ ID NO: 7501421 - DNA, 22 bp, Homo sapiens
aagctgcagatgtgcctgtgga

SEQ ID NO: 7501422 - DNA, 22 bp, Homo sapiens
aagctgcccaagactgaagcat

SEQ ID NO: 7501423 - DNA, 22 bp, Homo sapiens
aagctgcccaagactgaagcat

SEQ ID NO: 7501424 - DNA, 22 bp, Homo sapiens
aagctgcccaagactgaagcat

SEQ ID NO: 7501425 - DNA, 23 bp, Homo sapiens
aagctgccagtctgaagcctggg

SEQ ID NO: 7501426 - DNA, 22 bp, Homo sapiens
aagctgccatagaacgagaggt

SEQ ID NO: 7501427 - DNA, 22 bp, Homo sapiens
acaggcaggttgagaaacattt

SEQ ID NO: 7501428 - DNA, 22 bp, Homo sapiens
acaggcaggttgagaaacattt

SEQ ID NO: 7501429 - DNA, 22 bp, Homo sapiens
acaggcaggtcctgtcccagct

SEQ ID NO: 7501430 - DNA, 22 bp, Homo sapiens
acaggcaggtcctgtcccagct

SEQ ID NO: 7501431 - DNA, 22 bp, Homo sapiens
acaggcaggtcctgtcccagct

SEQ ID NO: 7501432 - DNA, 18 bp, Homo sapiens
aagctgccctcaggcagg

SEQ ID NO: 7501433 - DNA, 18 bp, Homo sapiens
aagctgccctcaggcagg

SEQ ID NO: 7501434 - DNA, 22 bp, Homo sapiens
acaggcaggtcctgtcccagct

SEQ ID NO: 7501435 - DNA, 22 bp, Homo sapiens
acaggcaggtcctgtcccagct

SEQ ID NO: 7501436 - DNA, 22 bp, Homo sapiens
acaggcaggtcctgtcccagct

SEQ ID NO: 7501437 - DNA, 22 bp, Homo sapiens
acaggcaggtcctgtcccagct

SEQ ID NO: 7501438 - DNA, 22 bp, Homo sapiens
acaggcaggtcctgtcccagct

SEQ ID NO: 7501439 - DNA, 22 bp, Homo sapiens
acaggcagtgatttcctctggt

SEQ ID NO: 7501440 - DNA, 22 bp, Homo sapiens
acaggcaggttgagaaacattt

SEQ ID NO: 7501441 - DNA, 22 bp, Homo sapiens
acaggcagtgatttcctctggt

SEQ ID NO: 7501442 - DNA, 22 bp, Homo sapiens
acaggcagtgatttcctctggt

SEQ ID NO: 7501443 - DNA, 22 bp, Homo sapiens
acaggcaggttgagaaacattt

SEQ ID NO: 7501444 - DNA, 22 bp, Homo sapiens
acaggcaggttgagaaacattt

SEQ ID NO: 7501445 - DNA, 22 bp, Homo sapiens
acaggcaggtcctgtcccagct

SEQ ID NO: 7501446 - DNA, 22 bp, Homo sapiens
acaggcaggttgagaaacattt

SEQ ID NO: 7501447 - DNA, 22 bp, Homo sapiens
acaggcaggttgagaaacattt

SEQ ID NO: 7501448 - DNA, 22 bp, Homo sapiens
acaggcagtgggccagatttgt

SEQ ID NO: 7501449 - DNA, 22 bp, Homo sapiens
acaggcagtgggccagatttgt

SEQ ID NO: 7501450 - DNA, 22 bp, Homo sapiens
acaggcagtgggccagatttgt

SEQ ID NO: 7501451 - DNA, 22 bp, Homo sapiens
acaggcagtgatttcctctggt

SEQ ID NO: 7501452 - DNA, 22 bp, Homo sapiens
acaggcagtgatttcctctggt

SEQ ID NO: 7501453 - DNA, 22 bp, Homo sapiens
acaggcagtgatttcctctggt

SEQ ID NO: 7501454 - DNA, 22 bp, Homo sapiens
acaggcagtgatttcctctggt

SEQ ID NO: 7501455 - DNA, 22 bp, Homo sapiens
acaggcagtgatttcctctggt

SEQ ID NO: 7501456 - DNA, 22 bp, Homo sapiens
acagggctccttgggctgacac

SEQ ID NO: 7501457 - DNA, 22 bp, Homo sapiens
acagggctccttgggctgacac

SEQ ID NO: 7501458 - DNA, 22 bp, Homo sapiens
acagggctcgtcgggccctcgg

SEQ ID NO: 7501459 - DNA, 22 bp, Homo sapiens
acagggctcgtcgggccctcgg

SEQ ID NO: 7501460 - DNA, 22 bp, Homo sapiens
acagggctcgtcgggccctcgg

SEQ ID NO: 7501461 - DNA, 22 bp, Homo sapiens
acagggctctgacaccaaggta

SEQ ID NO: 7501462 - DNA, 19 bp, Homo sapiens
acagggctctggacgccat

SEQ ID NO: 7501463 - DNA, 22 bp, Homo sapiens
acagggctcgtcgggccctcgg

SEQ ID NO: 7501464 - DNA, 22 bp, Homo sapiens
acagggctcccagcaggtctgt

SEQ ID NO: 7501465 - DNA, 22 bp, Homo sapiens
acagggctcctaggtggtgtgc

SEQ ID NO: 7501466 - DNA, 22 bp, Homo sapiens
acagggctcctaggtggtgtgc

SEQ ID NO: 7501467 - DNA, 22 bp, Homo sapiens
acagggctccttgggctgacac

SEQ ID NO: 7501468 - DNA, 22 bp, Homo sapiens
acagggctccttgggctgacac

SEQ ID NO: 7501469 - DNA, 22 bp, Homo sapiens
acagggctccttgggctgacac

SEQ ID NO: 7501470 - DNA, 22 bp, Homo sapiens
acagggctccttgggctgacac

SEQ ID NO: 7501471 - DNA, 22 bp, Homo sapiens
acagggctcccagcaggtctgt

SEQ ID NO: 7501472 - DNA, 22 bp, Homo sapiens
aaggaaatctttgtaacatctt

SEQ ID NO: 7501473 - DNA, 22 bp, Homo sapiens
aaggaaatctttgtaacatctt

SEQ ID NO: 7501474 - DNA, 22 bp, Homo sapiens
aaggaaatctttgtaacatctt

SEQ ID NO: 7501475 - DNA, 22 bp, Homo sapiens
aaggaaatctttgtaacatctt

SEQ ID NO: 7501476 - DNA, 22 bp, Homo sapiens
aaggaaatctttgtaacatctt

SEQ ID NO: 7501477 - DNA, 22 bp, Homo sapiens
acagggctggcgttgggacaga

SEQ ID NO: 7501478 - DNA, 22 bp, Homo sapiens
acagggctggggaaagaggcta

SEQ ID NO: 7501479 - DNA, 22 bp, Homo sapiens
acagggctggcgttgggacaga

SEQ ID NO: 7501480 - DNA, 22 bp, Homo sapiens
acagggctggcgttgggacaga

SEQ ID NO: 7501481 - DNA, 22 bp, Homo sapiens
acagggctggggaaagaggcta

SEQ ID NO: 7501482 - DNA, 22 bp, Homo sapiens
acagggctggggcacttggctg

SEQ ID NO: 7501483 - DNA, 22 bp, Homo sapiens
acagggctggggaaagaggcta

SEQ ID NO: 7501484 - DNA, 22 bp, Homo sapiens
acagggctggggcacttggctg

SEQ ID NO: 7501485 - DNA, 22 bp, Homo sapiens
acagggctgaggctggcttctt

SEQ ID NO: 7501486 - DNA, 22 bp, Homo sapiens
acagggctgaggctggcttctt

SEQ ID NO: 7501487 - DNA, 22 bp, Homo sapiens
acagggctgaggctggcttctt

SEQ ID NO: 7501488 - DNA, 19 bp, Homo sapiens
acagggctctggacgccat

SEQ ID NO: 7501489 - DNA, 23 bp, Homo sapiens
acagggctggcagctgcaagacc

SEQ ID NO: 7501490 - DNA, 23 bp, Homo sapiens
acagggctggcagctgcaagacc

SEQ ID NO: 7501491 - DNA, 23 bp, Homo sapiens
acagggctggcagctgcaagacc

SEQ ID NO: 7501492 - DNA, 22 bp, Homo sapiens
acagtacagctgaaactttagt

SEQ ID NO: 7501493 - DNA, 22 bp, Homo sapiens
acagtacagctgaaactttagt

SEQ ID NO: 7501494 - DNA, 22 bp, Homo sapiens
acagtacagctgaaactttagt

SEQ ID NO: 7501495 - DNA, 22 bp, Homo sapiens
acagtacagctgaaactttagt

SEQ ID NO: 7501496 - DNA, 22 bp, Homo sapiens
acagtacagctgaaactttagt

SEQ ID NO: 7501497 - DNA, 22 bp, Homo sapiens
acagtacagtgcagaggaagat

SEQ ID NO: 7501498 - DNA, 22 bp, Homo sapiens
acagtacagtgcagaggaagat

SEQ ID NO: 7501499 - DNA, 22 bp, Homo sapiens
acagtacaggacgagttttcct

SEQ ID NO: 7501500 - DNA, 22 bp, Homo sapiens
acagtacagtgcagaggaagat

SEQ ID NO: 7501501 - DNA, 22 bp, Homo sapiens
acagtacataatcctgagtctg

SEQ ID NO: 7501502 - DNA, 22 bp, Homo sapiens
acagtacatagatctctaccct

SEQ ID NO: 7501503 - DNA, 22 bp, Homo sapiens
acagtacataatcctgagtctg

SEQ ID NO: 7501504 - DNA, 22 bp, Homo sapiens
acagtacatagatctctaccct

SEQ ID NO: 7501505 - DNA, 22 bp, Homo sapiens
acagtacctgctctcaagcaaa

SEQ ID NO: 7501506 - DNA, 22 bp, Homo sapiens
acagtactaagtgctcacatga

SEQ ID NO: 7501507 - DNA, 22 bp, Homo sapiens
acagtactctaatgaaaagtgc

SEQ ID NO: 7501508 - DNA, 22 bp, Homo sapiens
acagtactctaatgaaaagtgc

SEQ ID NO: 7501509 - DNA, 22 bp, Homo sapiens
acagtactctaatgaaaagtgc

SEQ ID NO: 7501510 - DNA, 22 bp, Homo sapiens
acagggcttagaaatctgttgc

SEQ ID NO: 7501511 - DNA, 22 bp, Homo sapiens
acagggcttagaaatctgttgc

SEQ ID NO: 7501512 - DNA, 22 bp, Homo sapiens
acagggcttagaacttggcctc

SEQ ID NO: 7501513 - DNA, 22 bp, Homo sapiens
acagggcttagaacttggcctc

SEQ ID NO: 7501514 - DNA, 23 bp, Homo sapiens
acagggctgtccagggctaggtc

SEQ ID NO: 7501515 - DNA, 22 bp, Homo sapiens
acagggctggggcacttggctg

SEQ ID NO: 7501516 - DNA, 22 bp, Homo sapiens
acagggctggggcacttggctg

SEQ ID NO: 7501517 - DNA, 23 bp, Homo sapiens
acagggctgtccagggctaggtc

SEQ ID NO: 7501518 - DNA, 23 bp, Homo sapiens
acagggctgtccagggctaggtc

SEQ ID NO: 7501519 - DNA, 23 bp, Homo sapiens
acagggctgtccagggctaggtc

SEQ ID NO: 7501520 - DNA, 22 bp, Homo sapiens
acagtacagctgaaactttagt

SEQ ID NO: 7501521 - DNA, 22 bp, Homo sapiens
acagtacagctgaaactttagt

SEQ ID NO: 7501522 - DNA, 22 bp, Homo sapiens
acagtacagctgaaactttagt

SEQ ID NO: 7501523 - DNA, 22 bp, Homo sapiens
acagtacagctaatgtcattag

SEQ ID NO: 7501524 - DNA, 22 bp, Homo sapiens
acagggcttagaacttggcctc

SEQ ID NO: 7501525 - DNA, 22 bp, Homo sapiens
acagggcttagaacttggcctc

SEQ ID NO: 7501526 - DNA, 22 bp, Homo sapiens
acagggcttagaacttggcctc

SEQ ID NO: 7501527 - DNA, 22 bp, Homo sapiens
acaggtgtggggctgtggtact

SEQ ID NO: 7501528 - DNA, 22 bp, Homo sapiens
acaggcatatttctagattaca

SEQ ID NO: 7501529 - DNA, 22 bp, Homo sapiens
acaggcatatttctagattaca

SEQ ID NO: 7501530 - DNA, 22 bp, Homo sapiens
acaggcatccaggactaggcct

SEQ ID NO: 7501531 - DNA, 22 bp, Homo sapiens
acaggcatatttctagattaca

SEQ ID NO: 7501532 - DNA, 22 bp, Homo sapiens
acaggcatccaggactaggcct

SEQ ID NO: 7501533 - DNA, 22 bp, Homo sapiens
acaggccacagtggagtctctg

SEQ ID NO: 7501534 - DNA, 22 bp, Homo sapiens
acaggccacagtggagtctctg

SEQ ID NO: 7501535 - DNA, 22 bp, Homo sapiens
acaggcattgggatggaggttg

SEQ ID NO: 7501536 - DNA, 22 bp, Homo sapiens
acaggcattgggatggaggttg

SEQ ID NO: 7501537 - DNA, 22 bp, Homo sapiens
acaggccacagtggagtctctg

SEQ ID NO: 7501538 - DNA, 22 bp, Homo sapiens
acaggcatccaggactaggcct

SEQ ID NO: 7501539 - DNA, 22 bp, Homo sapiens
acaggcagtgggccagatttgt

SEQ ID NO: 7501540 - DNA, 22 bp, Homo sapiens
acaggcagtgggccagatttgt

SEQ ID NO: 7501541 - DNA, 22 bp, Homo sapiens
acaggcagtgggccagatttgt

SEQ ID NO: 7501542 - DNA, 22 bp, Homo sapiens
acaggcagttgaggtttgtgtg

SEQ ID NO: 7501543 - DNA, 22 bp, Homo sapiens
acaggcagttgaggtttgtgtg

SEQ ID NO: 7501544 - DNA, 22 bp, Homo sapiens
acaggcagttgaggtttgtgtg

SEQ ID NO: 7501545 - DNA, 22 bp, Homo sapiens
acaggcagttgaggtttgtgtg

SEQ ID NO: 7501546 - DNA, 22 bp, Homo sapiens
acaggcagttgaggtttgtgtg

SEQ ID NO: 7501547 - DNA, 22 bp, Homo sapiens
acaggcagttgaggtttgtgtg

SEQ ID NO: 7501548 - DNA, 22 bp, Homo sapiens
aaggaaagacatataaatgact

SEQ ID NO: 7501549 - DNA, 22 bp, Homo sapiens
aaggaaagagtatgcaccttgt

SEQ ID NO: 7501550 - DNA, 22 bp, Homo sapiens
aaggaaagagtatgcaccttgt

SEQ ID NO: 7501551 - DNA, 22 bp, Homo sapiens
aaggaaagacatataaatgact

SEQ ID NO: 7501552 - DNA, 22 bp, Homo sapiens
aaggaaagacaggacggaattc

SEQ ID NO: 7501553 - DNA, 22 bp, Homo sapiens
aaggaaagacatataaatgact

SEQ ID NO: 7501554 - DNA, 22 bp, Homo sapiens
aaggaaagacatataaatgact

SEQ ID NO: 7501555 - DNA, 22 bp, Homo sapiens
aaggaaagacatataaatgact

SEQ ID NO: 7501556 - DNA, 22 bp, Homo sapiens
aaggaaagacatataaatgact

SEQ ID NO: 7501557 - DNA, 22 bp, Homo sapiens
aagctttaaggaattttatgga

SEQ ID NO: 7501558 - DNA, 22 bp, Homo sapiens
aaggaaagacatataaatgact

SEQ ID NO: 7501559 - DNA, 22 bp, Homo sapiens
aaggaaagacatataaatgact

SEQ ID NO: 7501560 - DNA, 22 bp, Homo sapiens
aagctttaagtgtcagtcagcc

SEQ ID NO: 7501561 - DNA, 22 bp, Homo sapiens
acaggccagaggtggggcagcc

SEQ ID NO: 7501562 - DNA, 22 bp, Homo sapiens
acaggccagaggtggggcagcc

SEQ ID NO: 7501563 - DNA, 22 bp, Homo sapiens
acaggccagaggtggggcagcc

SEQ ID NO: 7501564 - DNA, 22 bp, Homo sapiens
aagctttaaggaattttatgga

SEQ ID NO: 7501565 - DNA, 22 bp, Homo sapiens
aagcttgtcagtgcaattttac

SEQ ID NO: 7501566 - DNA, 22 bp, Homo sapiens
aagcttgtcagtgcaattttac

SEQ ID NO: 7501567 - DNA, 22 bp, Homo sapiens
aaggaaagattctctctctaga

SEQ ID NO: 7501568 - DNA, 22 bp, Homo sapiens
aaggaaagctgtggttctgaga

SEQ ID NO: 7501569 - DNA, 22 bp, Homo sapiens
aaggaaagctgtggttctgaga

SEQ ID NO: 7501570 - DNA, 22 bp, Homo sapiens
aaggaaagctgtggttctgaga

SEQ ID NO: 7501571 - DNA, 22 bp, Homo sapiens
aaggaaagctgtggttctgaga

SEQ ID NO: 7501572 - DNA, 22 bp, Homo sapiens
aaggaaaggatgagcatgcatt

SEQ ID NO: 7501573 - DNA, 22 bp, Homo sapiens
aaggaaaggatgagcatgcatt

SEQ ID NO: 7501574 - DNA, 22 bp, Homo sapiens
aaggaaaggatgagcatgcatt

SEQ ID NO: 7501575 - DNA, 22 bp, Homo sapiens
aaggaaaggatgagcatgcatt

SEQ ID NO: 7501576 - DNA, 22 bp, Homo sapiens
aaggaaagctgtggttctgaga

SEQ ID NO: 7501577 - DNA, 22 bp, Homo sapiens
aaggaaagattctctctctaga

SEQ ID NO: 7501578 - DNA, 22 bp, Homo sapiens
aaggaaagattctctctctaga

SEQ ID NO: 7501579 - DNA, 22 bp, Homo sapiens
aaggaaagattctctctctaga

SEQ ID NO: 7501580 - DNA, 22 bp, Homo sapiens
aaggaaagattctctctctaga

SEQ ID NO: 7501581 - DNA, 22 bp, Homo sapiens
aaggaaagagtatgcaccttgt

SEQ ID NO: 7501582 - DNA, 22 bp, Homo sapiens
aaggaaagattctctctctaga

SEQ ID NO: 7501583 - DNA, 22 bp, Homo sapiens
aaggaaagattctctctctaga

SEQ ID NO: 7501584 - DNA, 22 bp, Homo sapiens
aaggaaagattctctctctaga

SEQ ID NO: 7501585 - DNA, 22 bp, Homo sapiens
aaggaaatacaacatgtattca

SEQ ID NO: 7501586 - DNA, 22 bp, Homo sapiens
aaggaaatacttctgcagagca

SEQ ID NO: 7501587 - DNA, 22 bp, Homo sapiens
aaggaaatacttctgcagagca

SEQ ID NO: 7501588 - DNA, 22 bp, Homo sapiens
aaggaaatacttctgcagagca

SEQ ID NO: 7501589 - DNA, 22 bp, Homo sapiens
aaggaaatacttctgcagagca

SEQ ID NO: 7501590 - DNA, 22 bp, Homo sapiens
aaggaaatacttctgcagagca

SEQ ID NO: 7501591 - DNA, 22 bp, Homo sapiens
aaggaaatctttgtaacatctt

SEQ ID NO: 7501592 - DNA, 22 bp, Homo sapiens
aaggaaatacttctgcagagca

SEQ ID NO: 7501593 - DNA, 22 bp, Homo sapiens
aaggaaatagatgcagatggta

SEQ ID NO: 7501594 - DNA, 22 bp, Homo sapiens
aaggaaatagatgcagatggta

SEQ ID NO: 7501595 - DNA, 22 bp, Homo sapiens
aaggaaatagatgcagatggta

SEQ ID NO: 7501596 - DNA, 22 bp, Homo sapiens
aaggaaatagatgcagatggta

SEQ ID NO: 7501597 - DNA, 22 bp, Homo sapiens
aaggaaatagatgcagatggta

SEQ ID NO: 7501598 - DNA, 22 bp, Homo sapiens
aaggaaaggatgagcatgcatt

SEQ ID NO: 7501599 - DNA, 22 bp, Homo sapiens
aaggaaaggatgagcatgcatt

SEQ ID NO: 7501600 - DNA, 22 bp, Homo sapiens
aaggaaaggatgagcatgcatt

SEQ ID NO: 7501601 - DNA, 22 bp, Homo sapiens
aaggaaaggatgagcatgcatt

SEQ ID NO: 7501602 - DNA, 22 bp, Homo sapiens
aaggaaatacaacatgtattca

SEQ ID NO: 7501603 - DNA, 22 bp, Homo sapiens
aaggaaatacaacatgtattca

SEQ ID NO: 7501604 - DNA, 22 bp, Homo sapiens
aaggaaaggatgagcatgcatt

SEQ ID NO: 7501605 - DNA, 22 bp, Homo sapiens
aaggaaaggatgagcatgcatt

SEQ ID NO: 7501606 - DNA, 22 bp, Homo sapiens
aaggaaatacaacatgtattca

SEQ ID NO: 7501607 - DNA, 22 bp, Homo sapiens
aaggaaatacaacatgtattca

SEQ ID NO: 7501608 - DNA, 22 bp, Homo sapiens
accccagggctgccagcctcct

SEQ ID NO: 7501609 - DNA, 22 bp, Homo sapiens
accccaggtcatctgagagtcc

SEQ ID NO: 7501610 - DNA, 22 bp, Homo sapiens
accccagggctgccagcctcct

SEQ ID NO: 7501611 - DNA, 22 bp, Homo sapiens
accccagggctgccagcctcct

SEQ ID NO: 7501612 - DNA, 22 bp, Homo sapiens
accccagggctgccagcctcct

SEQ ID NO: 7501613 - DNA, 22 bp, Homo sapiens
accccagggctgccagcctcct

SEQ ID NO: 7501614 - DNA, 22 bp, Homo sapiens
accccagggctgccagcctcct

SEQ ID NO: 7501615 - DNA, 22 bp, Homo sapiens
accccagggctgccagcctcct

SEQ ID NO: 7501616 - DNA, 22 bp, Homo sapiens
accccagggctgccagcctcct

SEQ ID NO: 7501617 - DNA, 23 bp, Homo sapiens
accccaggcatcgcattcctctt

SEQ ID NO: 7501618 - DNA, 23 bp, Homo sapiens
accccaggcatcgcattcctctt

SEQ ID NO: 7501619 - DNA, 22 bp, Homo sapiens
accccaggagctgtgcctagtc

SEQ ID NO: 7501620 - DNA, 23 bp, Homo sapiens
accccaggcatcgcattcctctt

SEQ ID NO: 7501621 - DNA, 23 bp, Homo sapiens
accccaggcatcgcattcctctt

SEQ ID NO: 7501622 - DNA, 23 bp, Homo sapiens
accccaggcatcgcattcctctt

SEQ ID NO: 7501623 - DNA, 22 bp, Homo sapiens
accccaggcccagggaagaggc

SEQ ID NO: 7501624 - DNA, 22 bp, Homo sapiens
accccaggcccagggaagaggc

SEQ ID NO: 7501625 - DNA, 22 bp, Homo sapiens
accccaggcccagggaagaggc

SEQ ID NO: 7501626 - DNA, 22 bp, Homo sapiens
accccaggcccagggaagaggc

SEQ ID NO: 7501627 - DNA, 22 bp, Homo sapiens
accccaggtctccaggctctgg

SEQ ID NO: 7501628 - DNA, 22 bp, Homo sapiens
accccaggtctccaggctctgg

SEQ ID NO: 7501629 - DNA, 22 bp, Homo sapiens
accccaggtctccaggctctgg

SEQ ID NO: 7501630 - DNA, 22 bp, Homo sapiens
accccaggtccaggttacagag

SEQ ID NO: 7501631 - DNA, 22 bp, Homo sapiens
accccaggtcatctgagagtcc

SEQ ID NO: 7501632 - DNA, 22 bp, Homo sapiens
accccaggtcatctgagagtcc

SEQ ID NO: 7501633 - DNA, 22 bp, Homo sapiens
accccaggtccaggttacagag

SEQ ID NO: 7501634 - DNA, 22 bp, Homo sapiens
accccaggtccaggttacagag

SEQ ID NO: 7501635 - DNA, 20 bp, Homo sapiens
accccagtgtgtgcctcaag

SEQ ID NO: 7501636 - DNA, 22 bp, Homo sapiens
acccccaaacatcaagggctga

SEQ ID NO: 7501637 - DNA, 22 bp, Homo sapiens
acccccaaacatcaagggctga

SEQ ID NO: 7501638 - DNA, 22 bp, Homo sapiens
accccaggtctccaggctctgg

SEQ ID NO: 7501639 - DNA, 22 bp, Homo sapiens
accccaggtctccaggctctgg

SEQ ID NO: 7501640 - DNA, 21 bp, Homo sapiens
acccccacacctccttagttc

SEQ ID NO: 7501641 - DNA, 22 bp, Homo sapiens
acccccaagaggggccttcagc

SEQ ID NO: 7501642 - DNA, 21 bp, Homo sapiens
acccccacacctccttagttc

SEQ ID NO: 7501643 - DNA, 21 bp, Homo sapiens
acccccacacctccttagttc

SEQ ID NO: 7501644 - DNA, 22 bp, Homo sapiens
acccccaagaggggccttcagc

SEQ ID NO: 7501645 - DNA, 22 bp, Homo sapiens
acccccaaacatgatcatggtg

SEQ ID NO: 7501646 - DNA, 22 bp, Homo sapiens
acccccaaacatgatcatggtg

SEQ ID NO: 7501647 - DNA, 22 bp, Homo sapiens
acccccaaacatgatcatggtg

SEQ ID NO: 7501648 - DNA, 22 bp, Homo sapiens
acccccaaacatcaagggctga

SEQ ID NO: 7501649 - DNA, 22 bp, Homo sapiens
aagtcacaagcatatatgcatt

SEQ ID NO: 7501650 - DNA, 22 bp, Homo sapiens
aagtcacaagcatatatgcatt

SEQ ID NO: 7501651 - DNA, 22 bp, Homo sapiens
aagtcacactagacaactgagg

SEQ ID NO: 7501652 - DNA, 22 bp, Homo sapiens
aagtcacacagttaacatgagg

SEQ ID NO: 7501653 - DNA, 22 bp, Homo sapiens
aagtcacaagcatatatgcatt

SEQ ID NO: 7501654 - DNA, 22 bp, Homo sapiens
aagtcacacagttaacatgagg

SEQ ID NO: 7501655 - DNA, 22 bp, Homo sapiens
aagtcacacagttaacatgagg

SEQ ID NO: 7501656 - DNA, 22 bp, Homo sapiens
aagtcaattagtaaacttggaa

SEQ ID NO: 7501657 - DNA, 22 bp, Homo sapiens
aagtcaattagtaaacttggaa

SEQ ID NO: 7501658 - DNA, 22 bp, Homo sapiens
aagtcaatttatgttctcagac

SEQ ID NO: 7501659 - DNA, 22 bp, Homo sapiens
aagtcaatttatgttctcagac

SEQ ID NO: 7501660 - DNA, 22 bp, Homo sapiens
aagtcacaagcatatatgcatt

SEQ ID NO: 7501661 - DNA, 22 bp, Homo sapiens
aagtcacaaagtgctgtacatg

SEQ ID NO: 7501662 - DNA, 22 bp, Homo sapiens
aagtcacaaagtgctgtacatg

SEQ ID NO: 7501663 - DNA, 22 bp, Homo sapiens
aagtcacaaagtgctgtacatg

SEQ ID NO: 7501664 - DNA, 22 bp, Homo sapiens
aagtatgacatttaagacaatt

SEQ ID NO: 7501665 - DNA, 22 bp, Homo sapiens
aagtatgaatcaaagactatct

SEQ ID NO: 7501666 - DNA, 22 bp, Homo sapiens
aagtcaatcacatgcacactga

SEQ ID NO: 7501667 - DNA, 22 bp, Homo sapiens
aagtcaatcacatgcacactga

SEQ ID NO: 7501668 - DNA, 22 bp, Homo sapiens
aagtatgaatcaaagactatct

SEQ ID NO: 7501669 - DNA, 22 bp, Homo sapiens
aagtatgaatcaaagactatct

SEQ ID NO: 7501670 - DNA, 22 bp, Homo sapiens
aagtatctttctagcaactaaa

SEQ ID NO: 7501671 - DNA, 22 bp, Homo sapiens
aagtatgaatcaaagactatct

SEQ ID NO: 7501672 - DNA, 22 bp, Homo sapiens
accccccagataatcccttgag

SEQ ID NO: 7501673 - DNA, 22 bp, Homo sapiens
accccccagataatcccttgag

SEQ ID NO: 7501674 - DNA, 22 bp, Homo sapiens
acccccttcgcacactctttca

SEQ ID NO: 7501675 - DNA, 22 bp, Homo sapiens
aagtatctgggagatttgcttt

SEQ ID NO: 7501676 - DNA, 22 bp, Homo sapiens
accccctgcctgcagcaggggc

SEQ ID NO: 7501677 - DNA, 22 bp, Homo sapiens
accccctgcctgcagcaggggc

SEQ ID NO: 7501678 - DNA, 22 bp, Homo sapiens
acccccacggaaggccgtacgc

SEQ ID NO: 7501679 - DNA, 22 bp, Homo sapiens
acccccacggaaggccgtacgc

SEQ ID NO: 7501680 - DNA, 22 bp, Homo sapiens
acccccacggaaggccgtacgc

SEQ ID NO: 7501681 - DNA, 22 bp, Homo sapiens
acccccacggaaggccgtacgc

SEQ ID NO: 7501682 - DNA, 21 bp, Homo sapiens
acccccacacctccttagttc

SEQ ID NO: 7501683 - DNA, 22 bp, Homo sapiens
accccaggagctgtgcctagtc

SEQ ID NO: 7501684 - DNA, 22 bp, Homo sapiens
accccaggagctgtgcctagtc

SEQ ID NO: 7501685 - DNA, 22 bp, Homo sapiens
accccaggagctgtgcctagtc

SEQ ID NO: 7501686 - DNA, 22 bp, Homo sapiens
accccaggagctgtgcctagtc

SEQ ID NO: 7501687 - DNA, 22 bp, Homo sapiens
aagtagaatctcaggtaggcta

SEQ ID NO: 7501688 - DNA, 21 bp, Homo sapiens
aagtagaagggagaagggtta

SEQ ID NO: 7501689 - DNA, 21 bp, Homo sapiens
aagtagaagggagaagggtta

SEQ ID NO: 7501690 - DNA, 22 bp, Homo sapiens
accccaggagctgtgcctagtc

SEQ ID NO: 7501691 - DNA, 22 bp, Homo sapiens
accccaggaagtggaggtcatg

SEQ ID NO: 7501692 - DNA, 22 bp, Homo sapiens
aagtagacaataataagacatg

SEQ ID NO: 7501693 - DNA, 21 bp, Homo sapiens
aagtagaagggagaagggtta

SEQ ID NO: 7501694 - DNA, 22 bp, Homo sapiens
aagtagaaaaccgcactggact

SEQ ID NO: 7501695 - DNA, 22 bp, Homo sapiens
aagtagaaaaccgcactggact

SEQ ID NO: 7501696 - DNA, 22 bp, Homo sapiens
aagtagaaaaccgcactggact

SEQ ID NO: 7501697 - DNA, 22 bp, Homo sapiens
aagtactttaggatatgtaact

SEQ ID NO: 7501698 - DNA, 22 bp, Homo sapiens
aagtactttaggatatgtaact

SEQ ID NO: 7501699 - DNA, 22 bp, Homo sapiens
aagtactttaggatatgtaact

SEQ ID NO: 7501700 - DNA, 22 bp, Homo sapiens
aagtactttaggatatgtaact

SEQ ID NO: 7501701 - DNA, 22 bp, Homo sapiens
aagtacttgatagattaactgt

SEQ ID NO: 7501702 - DNA, 22 bp, Homo sapiens
aagtacttgatagattaactgt

SEQ ID NO: 7501703 - DNA, 22 bp, Homo sapiens
aagtacttgatagattaactgt

SEQ ID NO: 7501704 - DNA, 22 bp, Homo sapiens
aagtacttgatagattaactgt

SEQ ID NO: 7501705 - DNA, 22 bp, Homo sapiens
aagtacttctagatggataatc

SEQ ID NO: 7501706 - DNA, 22 bp, Homo sapiens
aagtacattatatgagcagaat

SEQ ID NO: 7501707 - DNA, 22 bp, Homo sapiens
aagtacatttttaacttacagc

SEQ ID NO: 7501708 - DNA, 22 bp, Homo sapiens
aagtacatttttaacttacagc

SEQ ID NO: 7501709 - DNA, 22 bp, Homo sapiens
aagtacatttttaacttacagc

SEQ ID NO: 7501710 - DNA, 22 bp, Homo sapiens
aagtacatttttaacttacagc

SEQ ID NO: 7501711 - DNA, 22 bp, Homo sapiens
aagtacatttttaacttacagc

SEQ ID NO: 7501712 - DNA, 22 bp, Homo sapiens
aagtacatttttaacttacagc

SEQ ID NO: 7501713 - DNA, 22 bp, Homo sapiens
aagtacatttttaacttacagc

SEQ ID NO: 7501714 - DNA, 22 bp, Homo sapiens
aagtaccaagtttgtttgacgc

SEQ ID NO: 7501715 - DNA, 22 bp, Homo sapiens
aagtaccattcaaatgcaaata

SEQ ID NO: 7501716 - DNA, 22 bp, Homo sapiens
aagtaccattcaaatgcaaata

SEQ ID NO: 7501717 - DNA, 23 bp, Homo sapiens
aagtacctacacattatttcaga

SEQ ID NO: 7501718 - DNA, 22 bp, Homo sapiens
aagtactaaggctattatgatg

SEQ ID NO: 7501719 - DNA, 22 bp, Homo sapiens
aagtactaaggctattatgatg

SEQ ID NO: 7501720 - DNA, 22 bp, Homo sapiens
aagtactacagagctaaatgaa

SEQ ID NO: 7501721 - DNA, 22 bp, Homo sapiens
aagtacgtgcctccacttgtgt

SEQ ID NO: 7501722 - DNA, 22 bp, Homo sapiens
aagtacctcatagggttatttt

SEQ ID NO: 7501723 - DNA, 22 bp, Homo sapiens
aagtactaaggctattatgatg

SEQ ID NO: 7501724 - DNA, 22 bp, Homo sapiens
aagtactgtttaaattgcagaa

SEQ ID NO: 7501725 - DNA, 22 bp, Homo sapiens
aagtacttctagatggataatc

SEQ ID NO: 7501726 - DNA, 22 bp, Homo sapiens
aagtactacagagctaaatgaa

SEQ ID NO: 7501727 - DNA, 22 bp, Homo sapiens
aagtactgacagagaagaatga

SEQ ID NO: 7501728 - DNA, 22 bp, Homo sapiens
aagtactgacagagaagaatga

SEQ ID NO: 7501729 - DNA, 22 bp, Homo sapiens
aagtacctagaaatatttttga

SEQ ID NO: 7501730 - DNA, 22 bp, Homo sapiens
aagtactgtatcacttactcct

SEQ ID NO: 7501731 - DNA, 22 bp, Homo sapiens
aagtactgtttaaattgcagaa

SEQ ID NO: 7501732 - DNA, 22 bp, Homo sapiens
aagtacatgttgctcaacagcc

SEQ ID NO: 7501733 - DNA, 22 bp, Homo sapiens
aagtacatgttgctcaacagcc

SEQ ID NO: 7501734 - DNA, 22 bp, Homo sapiens
aagtacatgttgctcaacagcc

SEQ ID NO: 7501735 - DNA, 22 bp, Homo sapiens
aagtacatggaggatagctgct

SEQ ID NO: 7501736 - DNA, 22 bp, Homo sapiens
aagtacatgttgctcaacagcc

SEQ ID NO: 7501737 - DNA, 22 bp, Homo sapiens
aagtacattatatgagcagaat

SEQ ID NO: 7501738 - DNA, 22 bp, Homo sapiens
aagtacatgttgttcaaaagcc

SEQ ID NO: 7501739 - DNA, 22 bp, Homo sapiens
aagtacatgttgttcaaaagcc

SEQ ID NO: 7501740 - DNA, 22 bp, Homo sapiens
aagtacatgctgtaatgattgg

SEQ ID NO: 7501741 - DNA, 22 bp, Homo sapiens
aagtacatgctgtaatgattgg

SEQ ID NO: 7501742 - DNA, 22 bp, Homo sapiens
aagtacatgctgtaatgattgg

SEQ ID NO: 7501743 - DNA, 22 bp, Homo sapiens
aagtacatgctgtaatgattgg

SEQ ID NO: 7501744 - DNA, 22 bp, Homo sapiens
aagtacatgctttattcagagt

SEQ ID NO: 7501745 - DNA, 22 bp, Homo sapiens
aagtacatgctgtaatgattgg

SEQ ID NO: 7501746 - DNA, 22 bp, Homo sapiens
aagtacatggaggatagctgct

SEQ ID NO: 7501747 - DNA, 22 bp, Homo sapiens
aagtacatgctttattcagagt

SEQ ID NO: 7501748 - DNA, 22 bp, Homo sapiens
aagtacatgctttattcagagt

SEQ ID NO: 7501749 - DNA, 22 bp, Homo sapiens
aagtacatgctttattcagagt

SEQ ID NO: 7501750 - DNA, 22 bp, Homo sapiens
aagtacagagcctcagtttgac

SEQ ID NO: 7501751 - DNA, 22 bp, Homo sapiens
aagtacagagcctcagtttgac

SEQ ID NO: 7501752 - DNA, 23 bp, Homo sapiens
aagtaacagggataatagcagtt

SEQ ID NO: 7501753 - DNA, 22 bp, Homo sapiens
aagtacagccagcacccagact

SEQ ID NO: 7501754 - DNA, 22 bp, Homo sapiens
aagtacagattcctagtgagat

SEQ ID NO: 7501755 - DNA, 22 bp, Homo sapiens
aagtacagccttcattctcatg

SEQ ID NO: 7501756 - DNA, 22 bp, Homo sapiens
aagtacagccttcattctcatg

SEQ ID NO: 7501757 - DNA, 22 bp, Homo sapiens
aagtacagccagcacccagact

SEQ ID NO: 7501758 - DNA, 22 bp, Homo sapiens
aagtacagattcctagtgagat

SEQ ID NO: 7501759 - DNA, 23 bp, Homo sapiens
aagtacatatatttagatagtga

SEQ ID NO: 7501760 - DNA, 22 bp, Homo sapiens
aagtacataaaggaattagcca

SEQ ID NO: 7501761 - DNA, 22 bp, Homo sapiens
aagtacataaaggaattagcca

SEQ ID NO: 7501762 - DNA, 22 bp, Homo sapiens
aagtacagccttcattctcatg

SEQ ID NO: 7501763 - DNA, 22 bp, Homo sapiens
aagtacagccttcattctcatg

SEQ ID NO: 7501764 - DNA, 22 bp, Homo sapiens
aagtacagccttcattctcatg

SEQ ID NO: 7501765 - DNA, 22 bp, Homo sapiens
aagtacagccttcattctcatg

SEQ ID NO: 7501766 - DNA, 23 bp, Homo sapiens
aagtacatatatttagatagtga

SEQ ID NO: 7501767 - DNA, 23 bp, Homo sapiens
aagtacatatatttagatagtga

SEQ ID NO: 7501768 - DNA, 22 bp, Homo sapiens
aagtacatatatttatgattct

SEQ ID NO: 7501769 - DNA, 22 bp, Homo sapiens
aagtacatatatttatgattct

SEQ ID NO: 7501770 - DNA, 23 bp, Homo sapiens
aagtacatatatttagatagtga

SEQ ID NO: 7501771 - DNA, 22 bp, Homo sapiens
aagtacatatatttatgattct

SEQ ID NO: 7501772 - DNA, 22 bp, Homo sapiens
aagtacatatatttatgattct

SEQ ID NO: 7501773 - DNA, 22 bp, Homo sapiens
aagtacatatatttatgattct

SEQ ID NO: 7501774 - DNA, 22 bp, Homo sapiens
aagtacatcctagtctctttca

SEQ ID NO: 7501775 - DNA, 22 bp, Homo sapiens
aagtacatcaaatgtttggcta

SEQ ID NO: 7501776 - DNA, 22 bp, Homo sapiens
accatccaaactgctttctgtg

SEQ ID NO: 7501777 - DNA, 22 bp, Homo sapiens
accatcctgaaaccttcatgct

SEQ ID NO: 7501778 - DNA, 22 bp, Homo sapiens
accatctgagtagagagaagta

SEQ ID NO: 7501779 - DNA, 22 bp, Homo sapiens
accatcttaaggggacttctta

SEQ ID NO: 7501780 - DNA, 22 bp, Homo sapiens
accatcttaaggggacttctta

SEQ ID NO: 7501781 - DNA, 22 bp, Homo sapiens
accatcttaaggggacttctta

SEQ ID NO: 7501782 - DNA, 22 bp, Homo sapiens
accatcttttcctctgcctcct

SEQ ID NO: 7501783 - DNA, 22 bp, Homo sapiens
accatcttttcctctgcctcct

SEQ ID NO: 7501784 - DNA, 21 bp, Homo sapiens
accatcttccatgcattatat

SEQ ID NO: 7501785 - DNA, 21 bp, Homo sapiens
accatcttccatgcattatat

SEQ ID NO: 7501786 - DNA, 22 bp, Homo sapiens
accatcttagtggccagctctc

SEQ ID NO: 7501787 - DNA, 21 bp, Homo sapiens
accatcttccatgcattatat

SEQ ID NO: 7501788 - DNA, 21 bp, Homo sapiens
accatcttccatgcattatat

SEQ ID NO: 7501789 - DNA, 22 bp, Homo sapiens
accatcttagcagactgcagtg

SEQ ID NO: 7501790 - DNA, 22 bp, Homo sapiens
accatcttagcagactgcagtg

SEQ ID NO: 7501791 - DNA, 22 bp, Homo sapiens
accatcttagcagactgcagtg

SEQ ID NO: 7501792 - DNA, 22 bp, Homo sapiens
accatcttagtggccagctctc

SEQ ID NO: 7501793 - DNA, 22 bp, Homo sapiens
aaggtggggtcctgtcatctga

SEQ ID NO: 7501794 - DNA, 22 bp, Homo sapiens
aaggtgggtggatcacgaggtc

SEQ ID NO: 7501795 - DNA, 22 bp, Homo sapiens
aaggtggtaatagtgcaggatt

SEQ ID NO: 7501796 - DNA, 22 bp, Homo sapiens
aaggtggggtcctgtcatctga

SEQ ID NO: 7501797 - DNA, 22 bp, Homo sapiens
aaggtgggtggatcacgaggtc

SEQ ID NO: 7501798 - DNA, 22 bp, Homo sapiens
aaggtggcatgtcccctggcca

SEQ ID NO: 7501799 - DNA, 22 bp, Homo sapiens
aaggtggcatgtcccctggcca

SEQ ID NO: 7501800 - DNA, 22 bp, Homo sapiens
aaggtggcgctggagctggtcc

SEQ ID NO: 7501801 - DNA, 22 bp, Homo sapiens
aaggtggccctgagcatgacaa

SEQ ID NO: 7501802 - DNA, 22 bp, Homo sapiens
aaggtggccctgagcatgacaa

SEQ ID NO: 7501803 - DNA, 22 bp, Homo sapiens
aaggtggcgctggagctggtcc

SEQ ID NO: 7501804 - DNA, 22 bp, Homo sapiens
aaggtggcgctggagctggtcc

SEQ ID NO: 7501805 - DNA, 22 bp, Homo sapiens
aaggtggcggctgccaggtcct

SEQ ID NO: 7501806 - DNA, 22 bp, Homo sapiens
aaggtgggcagatcacaaggtc

SEQ ID NO: 7501807 - DNA, 22 bp, Homo sapiens
aaggtgggcagatcacaaggtc

SEQ ID NO: 7501808 - DNA, 22 bp, Homo sapiens
accatgtgatcaaaacaaatcc

SEQ ID NO: 7501809 - DNA, 22 bp, Homo sapiens
accatgtgatcaaaacaaatcc

SEQ ID NO: 7501810 - DNA, 22 bp, Homo sapiens
accatgtcatttattggccaaa

SEQ ID NO: 7501811 - DNA, 22 bp, Homo sapiens
accatgtcatttattggccaaa

SEQ ID NO: 7501812 - DNA, 22 bp, Homo sapiens
accatgtcatttattggccaaa

SEQ ID NO: 7501813 - DNA, 22 bp, Homo sapiens
accatgtcatttattggccaaa

SEQ ID NO: 7501814 - DNA, 22 bp, Homo sapiens
accatgttggccaagctggtct

SEQ ID NO: 7501815 - DNA, 22 bp, Homo sapiens
accatgttggccaagctggtct

SEQ ID NO: 7501816 - DNA, 22 bp, Homo sapiens
accatgttagttactgggaatg

SEQ ID NO: 7501817 - DNA, 22 bp, Homo sapiens
accatgtgatcaaaacaaatcc

SEQ ID NO: 7501818 - DNA, 22 bp, Homo sapiens
accatgtgtttagatgtggcag

SEQ ID NO: 7501819 - DNA, 22 bp, Homo sapiens
accatgtgttttacacatggta

SEQ ID NO: 7501820 - DNA, 22 bp, Homo sapiens
aagtacagaatcattggaagca

SEQ ID NO: 7501821 - DNA, 22 bp, Homo sapiens
aagtacagaatcattggaagca

SEQ ID NO: 7501822 - DNA, 23 bp, Homo sapiens
aagtaacagggataatagcagtt

SEQ ID NO: 7501823 - DNA, 23 bp, Homo sapiens
aagtaacagggataatagcagtt

SEQ ID NO: 7501824 - DNA, 23 bp, Homo sapiens
aagtaacagggataatagcagtt

SEQ ID NO: 7501825 - DNA, 23 bp, Homo sapiens
aagtaacagggataatagcagtt

SEQ ID NO: 7501826 - DNA, 23 bp, Homo sapiens
aagtaacagggataatagcagtt

SEQ ID NO: 7501827 - DNA, 22 bp, Homo sapiens
aagtaacaggcatgtgaatgac

SEQ ID NO: 7501828 - DNA, 22 bp, Homo sapiens
aagtaacaggcatgtgaatgac

SEQ ID NO: 7501829 - DNA, 22 bp, Homo sapiens
aagtaacaggcatgtgaatgac

SEQ ID NO: 7501830 - DNA, 22 bp, Homo sapiens
aagtaacaggcatgtgaatgac

SEQ ID NO: 7501831 - DNA, 22 bp, Homo sapiens
accatgttggccaagctggtct

SEQ ID NO: 7501832 - DNA, 22 bp, Homo sapiens
aagtaacagcatcaagtctcaa

SEQ ID NO: 7501833 - DNA, 22 bp, Homo sapiens
aagtaacaggcatgtgaatgac

SEQ ID NO: 7501834 - DNA, 22 bp, Homo sapiens
accatgctaaaacatgctgcta

SEQ ID NO: 7501835 - DNA, 22 bp, Homo sapiens
accatgctaaaacatgctgcta

SEQ ID NO: 7501836 - DNA, 22 bp, Homo sapiens
accatgcatcagttaaaaggag

SEQ ID NO: 7501837 - DNA, 22 bp, Homo sapiens
accatgccagtggcagccagac

SEQ ID NO: 7501838 - DNA, 22 bp, Homo sapiens
accatgcatcaaagctaatata

SEQ ID NO: 7501839 - DNA, 22 bp, Homo sapiens
accatgggtcagccacctcagc

SEQ ID NO: 7501840 - DNA, 22 bp, Homo sapiens
accatgggtcagccacctcagc

SEQ ID NO: 7501841 - DNA, 22 bp, Homo sapiens
accatggaccatagttcctatt

SEQ ID NO: 7501842 - DNA, 22 bp, Homo sapiens
accatgaggaaatacatttgtg

SEQ ID NO: 7501843 - DNA, 22 bp, Homo sapiens
accatgagttatttgacaggcc

SEQ ID NO: 7501844 - DNA, 22 bp, Homo sapiens
accatgataatgatgtatcatt

SEQ ID NO: 7501845 - DNA, 22 bp, Homo sapiens
accatgatgccactatgcagaa

SEQ ID NO: 7501846 - DNA, 22 bp, Homo sapiens
accatgcacagctgttctatta

SEQ ID NO: 7501847 - DNA, 22 bp, Homo sapiens
accatgcacagctgttctatta

SEQ ID NO: 7501848 - DNA, 22 bp, Homo sapiens
accatgattcacccaccactgt

SEQ ID NO: 7501849 - DNA, 22 bp, Homo sapiens
accatgattcacccaccactgt

SEQ ID NO: 7501850 - DNA, 22 bp, Homo sapiens
accatgatgggaagctcagggc

SEQ ID NO: 7501851 - DNA, 22 bp, Homo sapiens
aaggtgactcacaaagccagtt

SEQ ID NO: 7501852 - DNA, 22 bp, Homo sapiens
aaggtgaagctcccgatgagaa

SEQ ID NO: 7501853 - DNA, 22 bp, Homo sapiens
aaggtgaactggtaatgacaga

SEQ ID NO: 7501854 - DNA, 22 bp, Homo sapiens
aaggtgaactggtaatgacaga

SEQ ID NO: 7501855 - DNA, 22 bp, Homo sapiens
aaggtgaactggtaatgacaga

SEQ ID NO: 7501856 - DNA, 22 bp, Homo sapiens
aaggtgaactggtaatgacaga

SEQ ID NO: 7501857 - DNA, 22 bp, Homo sapiens
aaggtgaactggtaatgacaga

SEQ ID NO: 7501858 - DNA, 22 bp, Homo sapiens
aaggtgaactggtaatgacaga

SEQ ID NO: 7501859 - DNA, 22 bp, Homo sapiens
aaggtgaaactggaagctggcc

SEQ ID NO: 7501860 - DNA, 22 bp, Homo sapiens
aaggtgaaactggaagctggcc

SEQ ID NO: 7501861 - DNA, 22 bp, Homo sapiens
aaggtcttaagaactgctacat

SEQ ID NO: 7501862 - DNA, 22 bp, Homo sapiens
aaggtcttatctccaaatacag

SEQ ID NO: 7501863 - DNA, 18 bp, Homo sapiens
aaggtctgtctggtaggt

SEQ ID NO: 7501864 - DNA, 22 bp, Homo sapiens
aaggtctgttctaggtgagggt

SEQ ID NO: 7501865 - DNA, 22 bp, Homo sapiens
aaggtaggttaacctgcaggag

SEQ ID NO: 7501866 - DNA, 22 bp, Homo sapiens
aaggtctgtgaggctgtttgtc

SEQ ID NO: 7501867 - DNA, 22 bp, Homo sapiens
aaggtgccacttccctcagact

SEQ ID NO: 7501868 - DNA, 17 bp, Homo sapiens
aaggtgagagctgttct

SEQ ID NO: 7501869 - DNA, 22 bp, Homo sapiens
aaggtgccccctcctgaacctt

SEQ ID NO: 7501870 - DNA, 22 bp, Homo sapiens
aaggtgctcacgggctcaggga

SEQ ID NO: 7501871 - DNA, 22 bp, Homo sapiens
aaggtgccagcccctccactga

SEQ ID NO: 7501872 - DNA, 22 bp, Homo sapiens
aaggtggaggttgcagtgagct

SEQ ID NO: 7501873 - DNA, 22 bp, Homo sapiens
aaggtggaggttgcagtgagct

SEQ ID NO: 7501874 - DNA, 22 bp, Homo sapiens
aaggtggaggttgcagtgagct

SEQ ID NO: 7501875 - DNA, 22 bp, Homo sapiens
aaggtggaggttgcagtgagct

SEQ ID NO: 7501876 - DNA, 19 bp, Homo sapiens
aaggtggcagcaggtatta

SEQ ID NO: 7501877 - DNA, 19 bp, Homo sapiens
aaggtggcagcaggtatta

SEQ ID NO: 7501878 - DNA, 22 bp, Homo sapiens
aaggtgctcgttatggccagtg

SEQ ID NO: 7501879 - DNA, 22 bp, Homo sapiens
aaggtgctcacgggctcaggga

SEQ ID NO: 7501880 - DNA, 22 bp, Homo sapiens
aaggtgctcgttatggccagtg

SEQ ID NO: 7501881 - DNA, 22 bp, Homo sapiens
aaggtgctgtggacttgggagc

SEQ ID NO: 7501882 - DNA, 22 bp, Homo sapiens
aaggtaggttaacctgcaggag

SEQ ID NO: 7501883 - DNA, 22 bp, Homo sapiens
aaggtagggatgtattcagctt

SEQ ID NO: 7501884 - DNA, 22 bp, Homo sapiens
aaggtaggctcagggttgttct

SEQ ID NO: 7501885 - DNA, 22 bp, Homo sapiens
aaggtagattctggatcgaagg

SEQ ID NO: 7501886 - DNA, 22 bp, Homo sapiens
aaggtagattctggatcgaagg

SEQ ID NO: 7501887 - DNA, 22 bp, Homo sapiens
aagggctgagcacagtgagcca

SEQ ID NO: 7501888 - DNA, 22 bp, Homo sapiens
aagggctgagcacagtgagcca

SEQ ID NO: 7501889 - DNA, 22 bp, Homo sapiens
aagggctgatctcactttcttt

SEQ ID NO: 7501890 - DNA, 22 bp, Homo sapiens
aagggctgatctcactttcttt

SEQ ID NO: 7501891 - DNA, 22 bp, Homo sapiens
aagggctgatctcactttcttt

SEQ ID NO: 7501892 - DNA, 22 bp, Homo sapiens
aagggctgatctcactttcttt

SEQ ID NO: 7501893 - DNA, 22 bp, Homo sapiens
aagggctgagcacagtgagcca

SEQ ID NO: 7501894 - DNA, 22 bp, Homo sapiens
aagggctgagaagtggggctgg

SEQ ID NO: 7501895 - DNA, 22 bp, Homo sapiens
aagggctgagcacagtgagcca

SEQ ID NO: 7501896 - DNA, 22 bp, Homo sapiens
aagggctgagcacagtgagcca

SEQ ID NO: 7501897 - DNA, 22 bp, Homo sapiens
aagggctgagcacagtgagcca

SEQ ID NO: 7501898 - DNA, 22 bp, Homo sapiens
aagggctgagcacagtgagcca

SEQ ID NO: 7501899 - DNA, 22 bp, Homo sapiens
aagggctgagcacagtgagcca

SEQ ID NO: 7501900 - DNA, 22 bp, Homo sapiens
aagggctgagcacagtgagcca

SEQ ID NO: 7501901 - DNA, 22 bp, Homo sapiens
aagggctgaatgaagggttgaa

SEQ ID NO: 7501902 - DNA, 22 bp, Homo sapiens
aagggctgaatgaagggttgaa

SEQ ID NO: 7501903 - DNA, 22 bp, Homo sapiens
aagggctgaatgaagggttgaa

SEQ ID NO: 7501904 - DNA, 22 bp, Homo sapiens
aagggctgaatgaagggttgaa

SEQ ID NO: 7501905 - DNA, 22 bp, Homo sapiens
aagggctgaaagaccttgggca

SEQ ID NO: 7501906 - DNA, 22 bp, Homo sapiens
aagggctgaaagaccttgggca

SEQ ID NO: 7501907 - DNA, 22 bp, Homo sapiens
aagggctgaaagaccttgggca

SEQ ID NO: 7501908 - DNA, 22 bp, Homo sapiens
aagggctgaaagaccttgggca

SEQ ID NO: 7501909 - DNA, 22 bp, Homo sapiens
aagggctgaaagaccttgggca

SEQ ID NO: 7501910 - DNA, 22 bp, Homo sapiens
aagggctcttctatttatggcc

SEQ ID NO: 7501911 - DNA, 22 bp, Homo sapiens
aagggctgagaagtggggctgg

SEQ ID NO: 7501912 - DNA, 22 bp, Homo sapiens
aagggctgagaagtggggctgg

SEQ ID NO: 7501913 - DNA, 22 bp, Homo sapiens
aagggctgagaagtggggctgg

SEQ ID NO: 7501914 - DNA, 22 bp, Homo sapiens
aagggctgagaagtggggctgg

SEQ ID NO: 7501915 - DNA, 22 bp, Homo sapiens
aagggctgagaagtggggctgg

SEQ ID NO: 7501916 - DNA, 22 bp, Homo sapiens
aagggctgagaagtggggctgg

SEQ ID NO: 7501917 - DNA, 22 bp, Homo sapiens
aagggctgagaagtggggctgg

SEQ ID NO: 7501918 - DNA, 22 bp, Homo sapiens
aagggctgaatgaagggttgaa

SEQ ID NO: 7501919 - DNA, 22 bp, Homo sapiens
aagggctgaatgaagggttgaa

SEQ ID NO: 7501920 - DNA, 22 bp, Homo sapiens
aaggctttaaataaccgtaaag

SEQ ID NO: 7501921 - DNA, 22 bp, Homo sapiens
aaggcttgttgtcacgctcttg

SEQ ID NO: 7501922 - DNA, 22 bp, Homo sapiens
aaggcttgttgtcacgctcttg

SEQ ID NO: 7501923 - DNA, 22 bp, Homo sapiens
aaggcttgttgagtatctactg

SEQ ID NO: 7501924 - DNA, 22 bp, Homo sapiens
aaggcttgttgagtatctactg

SEQ ID NO: 7501925 - DNA, 22 bp, Homo sapiens
aaggcttgtgtgttcagtgagg

SEQ ID NO: 7501926 - DNA, 22 bp, Homo sapiens
aaggcttgtgtgttcagtgagg

SEQ ID NO: 7501927 - DNA, 22 bp, Homo sapiens
aaggcttgttggacggcggggc

SEQ ID NO: 7501928 - DNA, 22 bp, Homo sapiens
aaggcttgttggacggcggggc

SEQ ID NO: 7501929 - DNA, 22 bp, Homo sapiens
aaggcttgtgtgttcagtgagg

SEQ ID NO: 7501930 - DNA, 22 bp, Homo sapiens
aaggcttgtgtgttcagtgagg

SEQ ID NO: 7501931 - DNA, 22 bp, Homo sapiens
aaggctttatgactccagtgga

SEQ ID NO: 7501932 - DNA, 22 bp, Homo sapiens
aaggctttatgactccagtgga

SEQ ID NO: 7501933 - DNA, 22 bp, Homo sapiens
aaggctttatgtgaccaaaaga

SEQ ID NO: 7501934 - DNA, 22 bp, Homo sapiens
aaggcttctttgcaggctttag

SEQ ID NO: 7501935 - DNA, 22 bp, Homo sapiens
aaggcttgatatttacagtctt

SEQ ID NO: 7501936 - DNA, 22 bp, Homo sapiens
aaggcttgatatttacagtctt

SEQ ID NO: 7501937 - DNA, 22 bp, Homo sapiens
aaggcttggagtaagcttggct

SEQ ID NO: 7501938 - DNA, 22 bp, Homo sapiens
aaggcttggagtaagcttggct

SEQ ID NO: 7501939 - DNA, 22 bp, Homo sapiens
aaggcttggagtaagcttggct

SEQ ID NO: 7501940 - DNA, 22 bp, Homo sapiens
aaggcttggaccagctacagtg

SEQ ID NO: 7501941 - DNA, 22 bp, Homo sapiens
aaggcttggaccagctacagtg

SEQ ID NO: 7501942 - DNA, 19 bp, Homo sapiens
aaggcttggctgagctggg

SEQ ID NO: 7501943 - DNA, 19 bp, Homo sapiens
aaggcttggctgagctggg

SEQ ID NO: 7501944 - DNA, 22 bp, Homo sapiens
aaggcttggtctagtcatgcca

SEQ ID NO: 7501945 - DNA, 22 bp, Homo sapiens
aaggcttggtctagtcatgcca

SEQ ID NO: 7501946 - DNA, 19 bp, Homo sapiens
aaggcttggctgagctggg

SEQ ID NO: 7501947 - DNA, 19 bp, Homo sapiens
aaggcttggctgagctggg

SEQ ID NO: 7501948 - DNA, 22 bp, Homo sapiens
aaggcttgtagatttgggcttt

SEQ ID NO: 7501949 - DNA, 22 bp, Homo sapiens
aaggcttgtagatttgggcttt

SEQ ID NO: 7501950 - DNA, 22 bp, Homo sapiens
aaggcttgtagatttgggcttt

SEQ ID NO: 7501951 - DNA, 22 bp, Homo sapiens
aaggcttaaataataatttctg

SEQ ID NO: 7501952 - DNA, 22 bp, Homo sapiens
aaggcttagagacagacagcag

SEQ ID NO: 7501953 - DNA, 18 bp, Homo sapiens
aaggcttcaaagagtaga

SEQ ID NO: 7501954 - DNA, 22 bp, Homo sapiens
aaggcttccactttgttgggtc

SEQ ID NO: 7501955 - DNA, 22 bp, Homo sapiens
aaggcttcctggaggaggtgtc

SEQ ID NO: 7501956 - DNA, 22 bp, Homo sapiens
aaggcttctttagtgtcctaat

SEQ ID NO: 7501957 - DNA, 22 bp, Homo sapiens
aaggctgtgtcagaagctccct

SEQ ID NO: 7501958 - DNA, 22 bp, Homo sapiens
aaggctgtgtcagaagctccct

SEQ ID NO: 7501959 - DNA, 22 bp, Homo sapiens
aaggctgtggttctatacagaa

SEQ ID NO: 7501960 - DNA, 22 bp, Homo sapiens
aaggctgtggttctatacagaa

SEQ ID NO: 7501961 - DNA, 22 bp, Homo sapiens
aaggctgtttattagaaaaagt

SEQ ID NO: 7501962 - DNA, 22 bp, Homo sapiens
aaggctgtgtcagaagctccct

SEQ ID NO: 7501963 - DNA, 22 bp, Homo sapiens
acatgtgtatagcctgtataga

SEQ ID NO: 7501964 - DNA, 22 bp, Homo sapiens
acatgtgtggacatgaatctac

SEQ ID NO: 7501965 - DNA, 22 bp, Homo sapiens
acatgtgtctaagaatgaaaga

SEQ ID NO: 7501966 - DNA, 22 bp, Homo sapiens
acatgtgtgacaacagaggtga

SEQ ID NO: 7501967 - DNA, 22 bp, Homo sapiens
aaggctgggaaacatgcaggcc

SEQ ID NO: 7501968 - DNA, 22 bp, Homo sapiens
aaggctgggaaacatgcaggcc

SEQ ID NO: 7501969 - DNA, 22 bp, Homo sapiens
acatgtgtgtatacgtatttat

SEQ ID NO: 7501970 - DNA, 22 bp, Homo sapiens
acatgtgtggccgctgtagaca

SEQ ID NO: 7501971 - DNA, 22 bp, Homo sapiens
aaggctggggtgcagacggcct

SEQ ID NO: 7501972 - DNA, 22 bp, Homo sapiens
aaggctggggtgcagacggcct

SEQ ID NO: 7501973 - DNA, 22 bp, Homo sapiens
aaggctggtttccttgatgttt

SEQ ID NO: 7501974 - DNA, 22 bp, Homo sapiens
aaggctgggaaacatgcaggcc

SEQ ID NO: 7501975 - DNA, 22 bp, Homo sapiens
aaggctggggtgcagacggcct

SEQ ID NO: 7501976 - DNA, 22 bp, Homo sapiens
aaggctggggtgcagacggcct

SEQ ID NO: 7501977 - DNA, 22 bp, Homo sapiens
aaggctggtttccttgatgttt

SEQ ID NO: 7501978 - DNA, 22 bp, Homo sapiens
aaggctggtttccttgatgttt

SEQ ID NO: 7501979 - DNA, 22 bp, Homo sapiens
aaggctggtttccttgatgttt

SEQ ID NO: 7501980 - DNA, 22 bp, Homo sapiens
aaggctggtttccttgatgttt

SEQ ID NO: 7501981 - DNA, 22 bp, Homo sapiens
aaggctgattagactgatagct

SEQ ID NO: 7501982 - DNA, 22 bp, Homo sapiens
aaggctgagtaaaacagagaac

SEQ ID NO: 7501983 - DNA, 22 bp, Homo sapiens
aaggctgagtaaaacagagaac

SEQ ID NO: 7501984 - DNA, 22 bp, Homo sapiens
aaggctgagtaaaacagagaac

SEQ ID NO: 7501985 - DNA, 22 bp, Homo sapiens
aaggctgaggtagggcctaaaa

SEQ ID NO: 7501986 - DNA, 22 bp, Homo sapiens
aaggctgaggtagggcctaaaa

SEQ ID NO: 7501987 - DNA, 22 bp, Homo sapiens
aaggctgagtaaaacagagaac

SEQ ID NO: 7501988 - DNA, 22 bp, Homo sapiens
aaggctgagtaaaacagagaac

SEQ ID NO: 7501989 - DNA, 22 bp, Homo sapiens
aaggctgagggctgtacctggc

SEQ ID NO: 7501990 - DNA, 22 bp, Homo sapiens
aaggctgagggctgtacctggc

SEQ ID NO: 7501991 - DNA, 22 bp, Homo sapiens
aaggctgagggctgtacctggc

SEQ ID NO: 7501992 - DNA, 22 bp, Homo sapiens
aaggctgaggctggagaattac

SEQ ID NO: 7501993 - DNA, 22 bp, Homo sapiens
aaggctgcttttaacatgcata

SEQ ID NO: 7501994 - DNA, 22 bp, Homo sapiens
acatgtgtacatatatatgtgc

SEQ ID NO: 7501995 - DNA, 22 bp, Homo sapiens
acatgtgtacatatatatgtgc

SEQ ID NO: 7501996 - DNA, 16 bp, Homo sapiens
aaggctgattttccct

SEQ ID NO: 7501997 - DNA, 22 bp, Homo sapiens
aaggctgattagactgatagct

SEQ ID NO: 7501998 - DNA, 16 bp, Homo sapiens
aaggctgattttccct

SEQ ID NO: 7501999 - DNA, 22 bp, Homo sapiens
aaggctgattagactgatagct

SEQ ID NO: 7502000 - DNA, 16 bp, Homo sapiens
aaggctgattttccct

SEQ ID NO: 7502001 - DNA, 22 bp, Homo sapiens
aaggctgcctctgccagaggag

SEQ ID NO: 7502002 - DNA, 22 bp, Homo sapiens
aaggctgcctctgccagaggag

SEQ ID NO: 7502003 - DNA, 22 bp, Homo sapiens
aaggctgcctctgccagaggag

SEQ ID NO: 7502004 - DNA, 22 bp, Homo sapiens
aaggctgcctctgccagaggag

SEQ ID NO: 7502005 - DNA, 22 bp, Homo sapiens
aaggcatatgctgtgtacagtt

SEQ ID NO: 7502006 - DNA, 22 bp, Homo sapiens
aaggcatatgctgtgtacagtt

SEQ ID NO: 7502007 - DNA, 22 bp, Homo sapiens
aaggcatatgcatagaagacag

SEQ ID NO: 7502008 - DNA, 22 bp, Homo sapiens
aaggcatcatggctggctattt

SEQ ID NO: 7502009 - DNA, 22 bp, Homo sapiens
aaggcatcatggctggctattt

SEQ ID NO: 7502010 - DNA, 22 bp, Homo sapiens
aaggcatatgcatagaagacag

SEQ ID NO: 7502011 - DNA, 22 bp, Homo sapiens
aaggcatatattctaaacagga

SEQ ID NO: 7502012 - DNA, 22 bp, Homo sapiens
aaggcatatattctaaacagga

SEQ ID NO: 7502013 - DNA, 22 bp, Homo sapiens
aaggcatagtctttaagttctg

SEQ ID NO: 7502014 - DNA, 22 bp, Homo sapiens
aaggcatatattctaaacagga

SEQ ID NO: 7502015 - DNA, 22 bp, Homo sapiens
aaggcataggacaaatcagtga

SEQ ID NO: 7502016 - DNA, 22 bp, Homo sapiens
aaggcatagtctttaagttctg

SEQ ID NO: 7502017 - DNA, 22 bp, Homo sapiens
aaggcatacatattgttatagg

SEQ ID NO: 7502018 - DNA, 22 bp, Homo sapiens
aaggcatctggatggaggagga

SEQ ID NO: 7502019 - DNA, 22 bp, Homo sapiens
aaggcatctggatggaggagga

SEQ ID NO: 7502020 - DNA, 22 bp, Homo sapiens
aaggcatatgctgtgtacagtt

SEQ ID NO: 7502021 - DNA, 22 bp, Homo sapiens
aaggcatgatgtaatcaatgat

SEQ ID NO: 7502022 - DNA, 22 bp, Homo sapiens
aaggcatgaaagcgaaatgaga

SEQ ID NO: 7502023 - DNA, 22 bp, Homo sapiens
aaggcatgaaagcgaaatgaga

SEQ ID NO: 7502024 - DNA, 22 bp, Homo sapiens
aaggcatgctgagtcctaaaag

SEQ ID NO: 7502025 - DNA, 22 bp, Homo sapiens
aaggcatggcagggtttacaca

SEQ ID NO: 7502026 - DNA, 22 bp, Homo sapiens
aaggctcttgagtggtgatagt

SEQ ID NO: 7502027 - DNA, 22 bp, Homo sapiens
aaggctgaggctggagaattac

SEQ ID NO: 7502028 - DNA, 22 bp, Homo sapiens
aaggctgaggcagtgaggcaga

SEQ ID NO: 7502029 - DNA, 22 bp, Homo sapiens
aaggctgaggctggagaattac

SEQ ID NO: 7502030 - DNA, 22 bp, Homo sapiens
aaggctgaggctggagaattac

SEQ ID NO: 7502031 - DNA, 22 bp, Homo sapiens
aaggctgaggcagtgaggcaga

SEQ ID NO: 7502032 - DNA, 22 bp, Homo sapiens
aaggctgaggcagtgaggcaga

SEQ ID NO: 7502033 - DNA, 22 bp, Homo sapiens
aaggctgaggcagtgaggcaga

SEQ ID NO: 7502034 - DNA, 22 bp, Homo sapiens
aaggctgaggagggcctgcagg

SEQ ID NO: 7502035 - DNA, 22 bp, Homo sapiens
aaggctgaggagggcctgcagg

SEQ ID NO: 7502036 - DNA, 22 bp, Homo sapiens
aaggctgaggagggcctgcagg

SEQ ID NO: 7502037 - DNA, 22 bp, Homo sapiens
aaggctcttggagtgaatgcag

SEQ ID NO: 7502038 - DNA, 22 bp, Homo sapiens
aaggctcttggagtgaatgcag

SEQ ID NO: 7502039 - DNA, 22 bp, Homo sapiens
aaggctcttggagtgaatgcag

SEQ ID NO: 7502040 - DNA, 22 bp, Homo sapiens
aaggctcttggagtgaatgcag

SEQ ID NO: 7502041 - DNA, 22 bp, Homo sapiens
aagggaagtttgcatcctcact

SEQ ID NO: 7502042 - DNA, 22 bp, Homo sapiens
aagggaagtttgcatcctcact

SEQ ID NO: 7502043 - DNA, 22 bp, Homo sapiens
aagggaagtttgcatcctcact

SEQ ID NO: 7502044 - DNA, 22 bp, Homo sapiens
aagggaagtttgcatcctcact

SEQ ID NO: 7502045 - DNA, 22 bp, Homo sapiens
aagggaagtttgcatcctcact

SEQ ID NO: 7502046 - DNA, 22 bp, Homo sapiens
aagggacatagactgtacatct

SEQ ID NO: 7502047 - DNA, 22 bp, Homo sapiens
aagggacatagactgtacatct

SEQ ID NO: 7502048 - DNA, 22 bp, Homo sapiens
aagggaagtttgcatcctcact

SEQ ID NO: 7502049 - DNA, 22 bp, Homo sapiens
aagggaatgttgtggctggttt

SEQ ID NO: 7502050 - DNA, 22 bp, Homo sapiens
aagggactttgtcagctttcca

SEQ ID NO: 7502051 - DNA, 22 bp, Homo sapiens
aagggactttgtcagctttcca

SEQ ID NO: 7502052 - DNA, 22 bp, Homo sapiens
aagggacatagactgtacatct

SEQ ID NO: 7502053 - DNA, 22 bp, Homo sapiens
aagggacatagactgtacatct

SEQ ID NO: 7502054 - DNA, 22 bp, Homo sapiens
aagggaccctggatcaaatgga

SEQ ID NO: 7502055 - DNA, 22 bp, Homo sapiens
aagggagaaaacttgtggctta

SEQ ID NO: 7502056 - DNA, 22 bp, Homo sapiens
aagggagaaaacttgtggctta

SEQ ID NO: 7502057 - DNA, 22 bp, Homo sapiens
aagggagaaaacttgtggctta

SEQ ID NO: 7502058 - DNA, 22 bp, Homo sapiens
aagggagaaaacttgtggctta

SEQ ID NO: 7502059 - DNA, 22 bp, Homo sapiens
aagggagaaaacttgtggctta

SEQ ID NO: 7502060 - DNA, 22 bp, Homo sapiens
aagggagaaagaatgagtttag

SEQ ID NO: 7502061 - DNA, 22 bp, Homo sapiens
aagggagaaagaatgagtttag

SEQ ID NO: 7502062 - DNA, 22 bp, Homo sapiens
aagggagaaagaatgagtttag

SEQ ID NO: 7502063 - DNA, 22 bp, Homo sapiens
aagggagaaaacttgtggctta

SEQ ID NO: 7502064 - DNA, 22 bp, Homo sapiens
aagggagaaaacttgtggctta

SEQ ID NO: 7502065 - DNA, 22 bp, Homo sapiens
aagggaaatggccaggcagaga

SEQ ID NO: 7502066 - DNA, 22 bp, Homo sapiens
aagggaaatggccaggcagaga

SEQ ID NO: 7502067 - DNA, 22 bp, Homo sapiens
aagggaaatggccaggcagaga

SEQ ID NO: 7502068 - DNA, 22 bp, Homo sapiens
aagggaaggttccattatactt

SEQ ID NO: 7502069 - DNA, 22 bp, Homo sapiens
aagggaaggttccattatactt

SEQ ID NO: 7502070 - DNA, 22 bp, Homo sapiens
aagggaaatggccaggcagaga

SEQ ID NO: 7502071 - DNA, 22 bp, Homo sapiens
aagggaaatggccaggcagaga

SEQ ID NO: 7502072 - DNA, 22 bp, Homo sapiens
aagggaaatcctcagcccagga

SEQ ID NO: 7502073 - DNA, 22 bp, Homo sapiens
aagggaaatcctcagcccagga

SEQ ID NO: 7502074 - DNA, 22 bp, Homo sapiens
aagggaaatcctcagcccagga

SEQ ID NO: 7502075 - DNA, 22 bp, Homo sapiens
aagggaaatcctcagcccagga

SEQ ID NO: 7502076 - DNA, 22 bp, Homo sapiens
aagggaaatcctcagcccagga

SEQ ID NO: 7502077 - DNA, 22 bp, Homo sapiens
aagggaaactttcacaatgtcc

SEQ ID NO: 7502078 - DNA, 22 bp, Homo sapiens
aagggaaactttcacaatgtcc

SEQ ID NO: 7502079 - DNA, 22 bp, Homo sapiens
aagggaaaatagttgatgacca

SEQ ID NO: 7502080 - DNA, 22 bp, Homo sapiens
aagggaaaatagttgatgacca

SEQ ID NO: 7502081 - DNA, 22 bp, Homo sapiens
aagggaaaatagttgatgacca

SEQ ID NO: 7502082 - DNA, 22 bp, Homo sapiens
aagggaaactttcacaatgtcc

SEQ ID NO: 7502083 - DNA, 22 bp, Homo sapiens
aagggaaactttcacaatgtcc

SEQ ID NO: 7502084 - DNA, 22 bp, Homo sapiens
aagggaaatcatatggtgcagt

SEQ ID NO: 7502085 - DNA, 22 bp, Homo sapiens
aagggaaatcatatggtgcagt

SEQ ID NO: 7502086 - DNA, 22 bp, Homo sapiens
aagggaaactttcacaatgtcc

SEQ ID NO: 7502087 - DNA, 22 bp, Homo sapiens
aagggaaactttcacaatgtcc

SEQ ID NO: 7502088 - DNA, 22 bp, Homo sapiens
aagggaaatcatatggtgcagt

SEQ ID NO: 7502089 - DNA, 22 bp, Homo sapiens
aagggaaatcatatggtgcagt

SEQ ID NO: 7502090 - DNA, 22 bp, Homo sapiens
aagggaaatcatatggtgcagt

SEQ ID NO: 7502091 - DNA, 22 bp, Homo sapiens
aaggctttccagaaagtcttga

SEQ ID NO: 7502092 - DNA, 22 bp, Homo sapiens
aaggctttccagaaagtcttga

SEQ ID NO: 7502093 - DNA, 22 bp, Homo sapiens
aaggctttatgtgaccaaaaga

SEQ ID NO: 7502094 - DNA, 22 bp, Homo sapiens
aaggctttcagctaacttgatt

SEQ ID NO: 7502095 - DNA, 22 bp, Homo sapiens
aaggctttcagctaacttgatt

SEQ ID NO: 7502096 - DNA, 22 bp, Homo sapiens
aaggctttctcaggccctggaa

SEQ ID NO: 7502097 - DNA, 22 bp, Homo sapiens
aaggctttccttgggcggttac

SEQ ID NO: 7502098 - DNA, 22 bp, Homo sapiens
aaggctttccttgggcggttac

SEQ ID NO: 7502099 - DNA, 22 bp, Homo sapiens
aaggctttcctgtaggaagaca

SEQ ID NO: 7502100 - DNA, 22 bp, Homo sapiens
aaggctttgtgctgagttgtcg

SEQ ID NO: 7502101 - DNA, 22 bp, Homo sapiens
aaggctttgtgctgagttgtcg

SEQ ID NO: 7502102 - DNA, 22 bp, Homo sapiens
aaggctttggcccgagggaaga

SEQ ID NO: 7502103 - DNA, 22 bp, Homo sapiens
aaggctttgattccattgccct

SEQ ID NO: 7502104 - DNA, 22 bp, Homo sapiens
aaggctttgaaaaccaaaaggt

SEQ ID NO: 7502105 - DNA, 22 bp, Homo sapiens
aaggctttgattccattgccct

SEQ ID NO: 7502106 - DNA, 19 bp, Homo sapiens
aaggctttctgagtgaaaa

SEQ ID NO: 7502107 - DNA, 22 bp, Homo sapiens
aaggcttttaaactgtcaagga

SEQ ID NO: 7502108 - DNA, 22 bp, Homo sapiens
aaggcttttaaactgtcaagga

SEQ ID NO: 7502109 - DNA, 22 bp, Homo sapiens
aaggctttgtgggctgcaggca

SEQ ID NO: 7502110 - DNA, 22 bp, Homo sapiens
aaggctttgtgggctgcaggca

SEQ ID NO: 7502111 - DNA, 22 bp, Homo sapiens
aaggctttgtgggctgcaggca

SEQ ID NO: 7502112 - DNA, 22 bp, Homo sapiens
aaggcttttgacggttgcctct

SEQ ID NO: 7502113 - DNA, 22 bp, Homo sapiens
aaggcttttgacggttgcctct

SEQ ID NO: 7502114 - DNA, 22 bp, Homo sapiens
aaggcttttaatgagttagaga

SEQ ID NO: 7502115 - DNA, 22 bp, Homo sapiens
aaggcttttaactactgtttta

SEQ ID NO: 7502116 - DNA, 22 bp, Homo sapiens
aaggcttttaatgagttagaga

SEQ ID NO: 7502117 - DNA, 22 bp, Homo sapiens
aaggcttttaactactgtttta

SEQ ID NO: 7502118 - DNA, 22 bp, Homo sapiens
aaggcttttaatgagttagaga

SEQ ID NO: 7502119 - DNA, 22 bp, Homo sapiens
aaggcttttgggaattttcaac

SEQ ID NO: 7502120 - DNA, 22 bp, Homo sapiens
aaggcttttgggaattttcaac

SEQ ID NO: 7502121 - DNA, 22 bp, Homo sapiens
aaggcttttgttcctatttagt

SEQ ID NO: 7502122 - DNA, 22 bp, Homo sapiens
aaggcttttgttcctatttagt

SEQ ID NO: 7502123 - DNA, 22 bp, Homo sapiens
aaggctttttcactggtgactc

SEQ ID NO: 7502124 - DNA, 22 bp, Homo sapiens
aaggctttttcactggtgactc

SEQ ID NO: 7502125 - DNA, 22 bp, Homo sapiens
aagggaaaatagttgatgacca

SEQ ID NO: 7502126 - DNA, 22 bp, Homo sapiens
aagggaaaatagttgatgacca

SEQ ID NO: 7502127 - DNA, 22 bp, Homo sapiens
aagggaaaatagttgatgacca

SEQ ID NO: 7502128 - DNA, 22 bp, Homo sapiens
aagggccattgctgagagcagt

SEQ ID NO: 7502129 - DNA, 22 bp, Homo sapiens
aagggcccagccaagctatgct

SEQ ID NO: 7502130 - DNA, 22 bp, Homo sapiens
aagggccattgctgagagcagt

SEQ ID NO: 7502131 - DNA, 22 bp, Homo sapiens
aagggccatgcctctactttct

SEQ ID NO: 7502132 - DNA, 22 bp, Homo sapiens
aagggccatgcctctactttct

SEQ ID NO: 7502133 - DNA, 22 bp, Homo sapiens
aagggccatcttggactcccca

SEQ ID NO: 7502134 - DNA, 22 bp, Homo sapiens
aagggccatcttggactcccca

SEQ ID NO: 7502135 - DNA, 22 bp, Homo sapiens
aagggccattgctgagagcagt

SEQ ID NO: 7502136 - DNA, 22 bp, Homo sapiens
aagggccattgctgagagcagt

SEQ ID NO: 7502137 - DNA, 22 bp, Homo sapiens
aagggccattgctgagagcagt

SEQ ID NO: 7502138 - DNA, 22 bp, Homo sapiens
aagggccataacttgcagtgtt

SEQ ID NO: 7502139 - DNA, 22 bp, Homo sapiens
aagggccataacttgcagtgtt

SEQ ID NO: 7502140 - DNA, 22 bp, Homo sapiens
aagggccataacttgcagtgtt

SEQ ID NO: 7502141 - DNA, 22 bp, Homo sapiens
aagggccagtagaattttagtg

SEQ ID NO: 7502142 - DNA, 22 bp, Homo sapiens
aagggccataacttgcagtgtt

SEQ ID NO: 7502143 - DNA, 22 bp, Homo sapiens
aagggccatcccagaacagaaa

SEQ ID NO: 7502144 - DNA, 22 bp, Homo sapiens
aagggccataacttgcagtgtt

SEQ ID NO: 7502145 - DNA, 22 bp, Homo sapiens
aagggccatcccagaacagaaa

SEQ ID NO: 7502146 - DNA, 22 bp, Homo sapiens
aagggccatcttggactcccca

SEQ ID NO: 7502147 - DNA, 22 bp, Homo sapiens
aagggccatcccagaacagaaa

SEQ ID NO: 7502148 - DNA, 22 bp, Homo sapiens
aagggccatcccagaacagaaa

SEQ ID NO: 7502149 - DNA, 22 bp, Homo sapiens
aagggccagggctctagagata

SEQ ID NO: 7502150 - DNA, 22 bp, Homo sapiens
aagggccagggcagggttgtga

SEQ ID NO: 7502151 - DNA, 22 bp, Homo sapiens
aagggccacttactcctgctgt

SEQ ID NO: 7502152 - DNA, 22 bp, Homo sapiens
aagggccacatttgggtccctg

SEQ ID NO: 7502153 - DNA, 22 bp, Homo sapiens
aagggccagggcagggttgtga

SEQ ID NO: 7502154 - DNA, 22 bp, Homo sapiens
aagggccagtagaattttagtg

SEQ ID NO: 7502155 - DNA, 22 bp, Homo sapiens
aagggccagggctctagagata

SEQ ID NO: 7502156 - DNA, 22 bp, Homo sapiens
aagggccagggctctagagata

SEQ ID NO: 7502157 - DNA, 22 bp, Homo sapiens
aagggccagggcagggttgtga

SEQ ID NO: 7502158 - DNA, 22 bp, Homo sapiens
aagggccacatttgggtccctg

SEQ ID NO: 7502159 - DNA, 22 bp, Homo sapiens
aagggccacatttgggtccctg

SEQ ID NO: 7502160 - DNA, 22 bp, Homo sapiens
aagggccacatgccatttaaaa

SEQ ID NO: 7502161 - DNA, 22 bp, Homo sapiens
aagggccacatttgggtccctg

SEQ ID NO: 7502162 - DNA, 22 bp, Homo sapiens
aagggccacttactcctgctgt

SEQ ID NO: 7502163 - DNA, 22 bp, Homo sapiens
aagggccaagctcttctcccat

SEQ ID NO: 7502164 - DNA, 22 bp, Homo sapiens
aagggccacatgccatttaaaa

SEQ ID NO: 7502165 - DNA, 22 bp, Homo sapiens
aagggccaagctcttctcccat

SEQ ID NO: 7502166 - DNA, 22 bp, Homo sapiens
aagggcatgggatgaaaagtag

SEQ ID NO: 7502167 - DNA, 22 bp, Homo sapiens
aagggcattgaggctgagagac

SEQ ID NO: 7502168 - DNA, 22 bp, Homo sapiens
aagggcatttgtattccctgca

SEQ ID NO: 7502169 - DNA, 22 bp, Homo sapiens
aagggcattgaggctgagagac

SEQ ID NO: 7502170 - DNA, 22 bp, Homo sapiens
aagggcatgggatgaaaagtag

SEQ ID NO: 7502171 - DNA, 22 bp, Homo sapiens
aagggcatgagaagcttgaaag

SEQ ID NO: 7502172 - DNA, 22 bp, Homo sapiens
aagggcatgagaagcttgaaag

SEQ ID NO: 7502173 - DNA, 22 bp, Homo sapiens
aagggcaggtgggcatttctgg

SEQ ID NO: 7502174 - DNA, 22 bp, Homo sapiens
aagggcaggtgggcatttctgg

SEQ ID NO: 7502175 - DNA, 22 bp, Homo sapiens
aagggcaggaaaagatggatgt

SEQ ID NO: 7502176 - DNA, 22 bp, Homo sapiens
aagggcaggaaaagatggatgt

SEQ ID NO: 7502177 - DNA, 20 bp, Homo sapiens
aagggagaataatgattgta

SEQ ID NO: 7502178 - DNA, 20 bp, Homo sapiens
aagggagaataatgattgta

SEQ ID NO: 7502179 - DNA, 22 bp, Homo sapiens
aagggcccattctctcagaaaa

SEQ ID NO: 7502180 - DNA, 22 bp, Homo sapiens
aagggcccattctctcagaaaa

SEQ ID NO: 7502181 - DNA, 22 bp, Homo sapiens
aagggcccattctctcagaaaa

SEQ ID NO: 7502182 - DNA, 22 bp, Homo sapiens
aagggcccttctgttagtggca

SEQ ID NO: 7502183 - DNA, 22 bp, Homo sapiens
aagggcccggctgtgggcagag

SEQ ID NO: 7502184 - DNA, 22 bp, Homo sapiens
aagggcctcctggggagcctgg

SEQ ID NO: 7502185 - DNA, 19 bp, Homo sapiens
aagggcctctgctgtcttc

SEQ ID NO: 7502186 - DNA, 22 bp, Homo sapiens
aagggcctcctggggagcctgg

SEQ ID NO: 7502187 - DNA, 19 bp, Homo sapiens
aagggcctctgctgtcttc

SEQ ID NO: 7502188 - DNA, 19 bp, Homo sapiens
aagggcctctgctgtcttc

SEQ ID NO: 7502189 - DNA, 22 bp, Homo sapiens
aagggcctgccagctcttcatg

SEQ ID NO: 7502190 - DNA, 22 bp, Homo sapiens
aagggcggacagggcacatttc

SEQ ID NO: 7502191 - DNA, 22 bp, Homo sapiens
aagggcggacagggcacatttc

SEQ ID NO: 7502192 - DNA, 22 bp, Homo sapiens
aagggctcacccaactcacttc

SEQ ID NO: 7502193 - DNA, 22 bp, Homo sapiens
aagggctccaagaggtagctgg

SEQ ID NO: 7502194 - DNA, 22 bp, Homo sapiens
aagggctcacccaactcacttc

SEQ ID NO: 7502195 - DNA, 22 bp, Homo sapiens
aagggcctttcaaaggtgatta

SEQ ID NO: 7502196 - DNA, 22 bp, Homo sapiens
aagggctcacccaactcacttc

SEQ ID NO: 7502197 - DNA, 22 bp, Homo sapiens
aagggcctttcaaaggtgatta

SEQ ID NO: 7502198 - DNA, 22 bp, Homo sapiens
aagggccttgccaggtgaagag

SEQ ID NO: 7502199 - DNA, 22 bp, Homo sapiens
aagggccttgccaggtgaagag

SEQ ID NO: 7502200 - DNA, 22 bp, Homo sapiens
aagggccttcactgtctaagca

SEQ ID NO: 7502201 - DNA, 22 bp, Homo sapiens
aagggctcggtagcagtcctga

SEQ ID NO: 7502202 - DNA, 22 bp, Homo sapiens
aagggctcggtagcagtcctga

SEQ ID NO: 7502203 - DNA, 22 bp, Homo sapiens
aagggctccctgcctgaggtgg

SEQ ID NO: 7502204 - DNA, 22 bp, Homo sapiens
aagggctctgctgtctctcccc

SEQ ID NO: 7502205 - DNA, 22 bp, Homo sapiens
aagggctctctgcattgaaatt

SEQ ID NO: 7502206 - DNA, 22 bp, Homo sapiens
aagggctcggtagcagtcctga

SEQ ID NO: 7502207 - DNA, 22 bp, Homo sapiens
aagggctcccaactcatctttt

SEQ ID NO: 7502208 - DNA, 22 bp, Homo sapiens
aagggctccatccttataaatg

SEQ ID NO: 7502209 - DNA, 22 bp, Homo sapiens
aagggctccacttgaatcacac

SEQ ID NO: 7502210 - DNA, 22 bp, Homo sapiens
aagggctccaagaggtagctgg

SEQ ID NO: 7502211 - DNA, 22 bp, Homo sapiens
aagggctctgttgccatttcag

SEQ ID NO: 7502212 - DNA, 22 bp, Homo sapiens
aagggctgaaagaccttgggca

SEQ ID NO: 7502213 - DNA, 22 bp, Homo sapiens
aagggctctgtgtgcctcccca

SEQ ID NO: 7502214 - DNA, 22 bp, Homo sapiens
aagggctctgtgtgcctcccca

SEQ ID NO: 7502215 - DNA, 22 bp, Homo sapiens
aagggctctgggctacgcactg

SEQ ID NO: 7502216 - DNA, 22 bp, Homo sapiens
aagggctctgggctacgcactg

SEQ ID NO: 7502217 - DNA, 22 bp, Homo sapiens
aagggctctgggctacgcactg

SEQ ID NO: 7502218 - DNA, 22 bp, Homo sapiens
aagggctctgggctacgcactg

SEQ ID NO: 7502219 - DNA, 22 bp, Homo sapiens
aagggctctgtgcttgtcccat

SEQ ID NO: 7502220 - DNA, 22 bp, Homo sapiens
aagggctctgtgcttgtcccat

SEQ ID NO: 7502221 - DNA, 22 bp, Homo sapiens
aagggctctgtgcttgtcccat

SEQ ID NO: 7502222 - DNA, 22 bp, Homo sapiens
aatgttatttctgcatagtagt

SEQ ID NO: 7502223 - DNA, 22 bp, Homo sapiens
aatgttatttctgcatagtagt

SEQ ID NO: 7502224 - DNA, 22 bp, Homo sapiens
aatgttatttctgcatagtagt

SEQ ID NO: 7502225 - DNA, 22 bp, Homo sapiens
aatgttattgtcctttccaaaa

SEQ ID NO: 7502226 - DNA, 22 bp, Homo sapiens
aatgttattgtcctttccaaaa

SEQ ID NO: 7502227 - DNA, 22 bp, Homo sapiens
aatgtgtttagttaatgagttg

SEQ ID NO: 7502228 - DNA, 22 bp, Homo sapiens
aatgtgtttatttagtgattta

SEQ ID NO: 7502229 - DNA, 22 bp, Homo sapiens
aatgttattgtcctttccaaaa

SEQ ID NO: 7502230 - DNA, 22 bp, Homo sapiens
aatgttcaaaagcatcagtgaa

SEQ ID NO: 7502231 - DNA, 22 bp, Homo sapiens
aatgttcaaaagcatcagtgaa

SEQ ID NO: 7502232 - DNA, 22 bp, Homo sapiens
aatgttcaaaagcatcagtgaa

SEQ ID NO: 7502233 - DNA, 22 bp, Homo sapiens
aatgttatttctgcatagtagt

SEQ ID NO: 7502234 - DNA, 22 bp, Homo sapiens
aatgttcaaacagatcacttag

SEQ ID NO: 7502235 - DNA, 22 bp, Homo sapiens
aatgttcaaacagatcacttag

SEQ ID NO: 7502236 - DNA, 22 bp, Homo sapiens
aatgttcagggcagccctgcta

SEQ ID NO: 7502237 - DNA, 22 bp, Homo sapiens
aatgttcagggcagccctgcta

SEQ ID NO: 7502238 - DNA, 22 bp, Homo sapiens
aatgttcagctttcttacttaa

SEQ ID NO: 7502239 - DNA, 22 bp, Homo sapiens
aatgttcagcgagggatgctag

SEQ ID NO: 7502240 - DNA, 22 bp, Homo sapiens
aatgttcagcgagggatgctag

SEQ ID NO: 7502241 - DNA, 22 bp, Homo sapiens
aatgttcagcgagggatgctag

SEQ ID NO: 7502242 - DNA, 22 bp, Homo sapiens
aatgttcagcgagggatgctag

SEQ ID NO: 7502243 - DNA, 22 bp, Homo sapiens
aatgttcagctttcttacttaa

SEQ ID NO: 7502244 - DNA, 22 bp, Homo sapiens
aatgttcagctttcttacttaa

SEQ ID NO: 7502245 - DNA, 22 bp, Homo sapiens
aatgttcagtagaataggaatg

SEQ ID NO: 7502246 - DNA, 22 bp, Homo sapiens
aatgttcagtagaataggaatg

SEQ ID NO: 7502247 - DNA, 20 bp, Homo sapiens
aatgttcagtaattgtttta

SEQ ID NO: 7502248 - DNA, 20 bp, Homo sapiens
aatgttcagtaattgtttta

SEQ ID NO: 7502249 - DNA, 20 bp, Homo sapiens
aatgttcagtaattgtttta

SEQ ID NO: 7502250 - DNA, 20 bp, Homo sapiens
aatgttcagtaattgtttta

SEQ ID NO: 7502251 - DNA, 20 bp, Homo sapiens
aatgttcagtaattgtttta

SEQ ID NO: 7502252 - DNA, 22 bp, Homo sapiens
aatgttcagaggacaatataaa

SEQ ID NO: 7502253 - DNA, 22 bp, Homo sapiens
aatgttcagaggacaatataaa

SEQ ID NO: 7502254 - DNA, 22 bp, Homo sapiens
aatgttcagaggacaatataaa

SEQ ID NO: 7502255 - DNA, 22 bp, Homo sapiens
aatgttcaacagatggatattt

SEQ ID NO: 7502256 - DNA, 20 bp, Homo sapiens
aatgttcaaaggtgatggca

SEQ ID NO: 7502257 - DNA, 22 bp, Homo sapiens
aatgttcaacagatggatattt

SEQ ID NO: 7502258 - DNA, 22 bp, Homo sapiens
aatgttcaacagatggatattt

SEQ ID NO: 7502259 - DNA, 22 bp, Homo sapiens
aatgttcaacagatggatattt

SEQ ID NO: 7502260 - DNA, 22 bp, Homo sapiens
aatgttcaaacagatcacttag

SEQ ID NO: 7502261 - DNA, 22 bp, Homo sapiens
aatgttcagaggacaatataaa

SEQ ID NO: 7502262 - DNA, 22 bp, Homo sapiens
aatgttcagaggacaatataaa

SEQ ID NO: 7502263 - DNA, 22 bp, Homo sapiens
aatgttcagaggacaatataaa

SEQ ID NO: 7502264 - DNA, 22 bp, Homo sapiens
aatgttcagaggacaatataaa

SEQ ID NO: 7502265 - DNA, 22 bp, Homo sapiens
aatgttcagaggacaatataaa

SEQ ID NO: 7502266 - DNA, 22 bp, Homo sapiens
aatgttcagaggacaatataaa

SEQ ID NO: 7502267 - DNA, 22 bp, Homo sapiens
aatgttcagaggacaatataaa

SEQ ID NO: 7502268 - DNA, 22 bp, Homo sapiens
aatgttgaggatatcagaaaat

SEQ ID NO: 7502269 - DNA, 22 bp, Homo sapiens
aatgttgaggatatcagaaaat

SEQ ID NO: 7502270 - DNA, 22 bp, Homo sapiens
aatgttgagcttgaaagtaggt

SEQ ID NO: 7502271 - DNA, 22 bp, Homo sapiens
aatgttgacctcctgaatgttt

SEQ ID NO: 7502272 - DNA, 22 bp, Homo sapiens
aatgttctgtgctggttctggg

SEQ ID NO: 7502273 - DNA, 22 bp, Homo sapiens
aatgttgagaaatgactactct

SEQ ID NO: 7502274 - DNA, 22 bp, Homo sapiens
aatgttctgatgtagggtttag

SEQ ID NO: 7502275 - DNA, 22 bp, Homo sapiens
aatgttctgcaactgttttcat

SEQ ID NO: 7502276 - DNA, 22 bp, Homo sapiens
aatgttctgcaactgttttcat

SEQ ID NO: 7502277 - DNA, 22 bp, Homo sapiens
aatgttctgcaactgttttcat

SEQ ID NO: 7502278 - DNA, 22 bp, Homo sapiens
aatgttgacagtggtgatctca

SEQ ID NO: 7502279 - DNA, 22 bp, Homo sapiens
aatgttgcagagtgattgtcca

SEQ ID NO: 7502280 - DNA, 22 bp, Homo sapiens
aatgttgcagagtgattgtcca

SEQ ID NO: 7502281 - DNA, 22 bp, Homo sapiens
aatgttgatgttttcagtgagc

SEQ ID NO: 7502282 - DNA, 22 bp, Homo sapiens
aatgttgatgttttcagtgagc

SEQ ID NO: 7502283 - DNA, 22 bp, Homo sapiens
aatgttgcagagtgattgtcca

SEQ ID NO: 7502284 - DNA, 22 bp, Homo sapiens
aatgttgcagagtgattgtcca

SEQ ID NO: 7502285 - DNA, 22 bp, Homo sapiens
aatgttgtaaatattctttgag

SEQ ID NO: 7502286 - DNA, 22 bp, Homo sapiens
aatgttgtaaatattctttgag

SEQ ID NO: 7502287 - DNA, 22 bp, Homo sapiens
aatgttgtaaatattctttgag

SEQ ID NO: 7502288 - DNA, 22 bp, Homo sapiens
aatgttctcaacaaaaggaagc

SEQ ID NO: 7502289 - DNA, 22 bp, Homo sapiens
aatgttccacagatatagcatg

SEQ ID NO: 7502290 - DNA, 22 bp, Homo sapiens
aatgttcattgttttccatatg

SEQ ID NO: 7502291 - DNA, 22 bp, Homo sapiens
aatgttcattgttttccatatg

SEQ ID NO: 7502292 - DNA, 22 bp, Homo sapiens
aatgttcattgattaaatgaat

SEQ ID NO: 7502293 - DNA, 22 bp, Homo sapiens
aatgttcattgattaaatgaat

SEQ ID NO: 7502294 - DNA, 22 bp, Homo sapiens
aatgttcattgattaaatgaat

SEQ ID NO: 7502295 - DNA, 22 bp, Homo sapiens
aatgttcattgattaaatgaat

SEQ ID NO: 7502296 - DNA, 22 bp, Homo sapiens
aatgttcattgttttccatatg

SEQ ID NO: 7502297 - DNA, 22 bp, Homo sapiens
aatgttcagtctcaagagtgat

SEQ ID NO: 7502298 - DNA, 22 bp, Homo sapiens
aatgttcagtctcaagagtgat

SEQ ID NO: 7502299 - DNA, 22 bp, Homo sapiens
aatgttcagtatctggtccacc

SEQ ID NO: 7502300 - DNA, 22 bp, Homo sapiens
aatgttcagtctcaagagtgat

SEQ ID NO: 7502301 - DNA, 22 bp, Homo sapiens
aatgttcagtgcctttaaacat

SEQ ID NO: 7502302 - DNA, 22 bp, Homo sapiens
aatgttcagtgcctttaaacat

SEQ ID NO: 7502303 - DNA, 22 bp, Homo sapiens
aatgttcagtatctggtccacc

SEQ ID NO: 7502304 - DNA, 22 bp, Homo sapiens
aatgttcagtagaataggaatg

SEQ ID NO: 7502305 - DNA, 22 bp, Homo sapiens
aatgttcagtagaataggaatg

SEQ ID NO: 7502306 - DNA, 22 bp, Homo sapiens
aatgttcagtgcctttaaacat

SEQ ID NO: 7502307 - DNA, 22 bp, Homo sapiens
aatgttcagtgcctttaaacat

SEQ ID NO: 7502308 - DNA, 22 bp, Homo sapiens
aatgttcattagcattgttgac

SEQ ID NO: 7502309 - DNA, 22 bp, Homo sapiens
aatgttcattagcattgttgac

SEQ ID NO: 7502310 - DNA, 22 bp, Homo sapiens
aatgttgtgtttcagttcaaga

SEQ ID NO: 7502311 - DNA, 22 bp, Homo sapiens
aatgttgtatggtgccttcaga

SEQ ID NO: 7502312 - DNA, 22 bp, Homo sapiens
aatgttgtgcatgtattttgta

SEQ ID NO: 7502313 - DNA, 22 bp, Homo sapiens
aatgttgttggctcttcatgat

SEQ ID NO: 7502314 - DNA, 22 bp, Homo sapiens
aatgttgttggctcttcatgat

SEQ ID NO: 7502315 - DNA, 22 bp, Homo sapiens
aatgttgttctctgcaaacaca

SEQ ID NO: 7502316 - DNA, 22 bp, Homo sapiens
aatgttgtttttctgcatgtct

SEQ ID NO: 7502317 - DNA, 22 bp, Homo sapiens
aatgtttaatgttagtggtaat

SEQ ID NO: 7502318 - DNA, 22 bp, Homo sapiens
aatgtttaatgttagtggtaat

SEQ ID NO: 7502319 - DNA, 19 bp, Homo sapiens
aatgtttaagagaaaaagg

SEQ ID NO: 7502320 - DNA, 19 bp, Homo sapiens
aatgtttaagagaaaaagg

SEQ ID NO: 7502321 - DNA, 19 bp, Homo sapiens
aatgtttaagagaaaaagg

SEQ ID NO: 7502322 - DNA, 19 bp, Homo sapiens
aatgtttaagagaaaaagg

SEQ ID NO: 7502323 - DNA, 19 bp, Homo sapiens
aatgtttaagagaaaaagg

SEQ ID NO: 7502324 - DNA, 22 bp, Homo sapiens
aatgttgtttttctgcatgtct

SEQ ID NO: 7502325 - DNA, 19 bp, Homo sapiens
aatgtttaagagaaaaagg

SEQ ID NO: 7502326 - DNA, 19 bp, Homo sapiens
aatgtttaagagaaaaagg

SEQ ID NO: 7502327 - DNA, 22 bp, Homo sapiens
aatgtttcatttagttgtctcc

SEQ ID NO: 7502328 - DNA, 22 bp, Homo sapiens
aatgtttcgtaaattgtctatg

SEQ ID NO: 7502329 - DNA, 22 bp, Homo sapiens
aatgtttcgtaaattgtctatg

SEQ ID NO: 7502330 - DNA, 22 bp, Homo sapiens
aatgtttaatgttagtggtaat

SEQ ID NO: 7502331 - DNA, 22 bp, Homo sapiens
aatgtttcaattaagtctttta

SEQ ID NO: 7502332 - DNA, 22 bp, Homo sapiens
aatgtttcaattaagtctttta

SEQ ID NO: 7502333 - DNA, 22 bp, Homo sapiens
aatgtttgagcatctacatgct

SEQ ID NO: 7502334 - DNA, 22 bp, Homo sapiens
aatgtttgaactttgcatattt

SEQ ID NO: 7502335 - DNA, 22 bp, Homo sapiens
aatgtttgaactttgcatattt

SEQ ID NO: 7502336 - DNA, 22 bp, Homo sapiens
aattaccttttccacttaggcc

SEQ ID NO: 7502337 - DNA, 22 bp, Homo sapiens
aattacctgtcatacatcaagc

SEQ ID NO: 7502338 - DNA, 22 bp, Homo sapiens
aatgtttgcatctattcacatg

SEQ ID NO: 7502339 - DNA, 22 bp, Homo sapiens
aattaccatcgtcaaatcatat

SEQ ID NO: 7502340 - DNA, 22 bp, Homo sapiens
aattaccatcgtcaaatcatat

SEQ ID NO: 7502341 - DNA, 22 bp, Homo sapiens
aattaccaggatttttcagtat

SEQ ID NO: 7502342 - DNA, 22 bp, Homo sapiens
aattaccaggatttttcagtat

SEQ ID NO: 7502343 - DNA, 20 bp, Homo sapiens
aatgtttctgaacaggtagt

SEQ ID NO: 7502344 - DNA, 22 bp, Homo sapiens
aattactgatgcctgtgttcca

SEQ ID NO: 7502345 - DNA, 22 bp, Homo sapiens
aattactgggtctgagattaat

SEQ ID NO: 7502346 - DNA, 20 bp, Homo sapiens
aattagcttaagtcaatcag

SEQ ID NO: 7502347 - DNA, 22 bp, Homo sapiens
aattaggaataaatgagtactt

SEQ ID NO: 7502348 - DNA, 22 bp, Homo sapiens
aattagggaaaatttacttgta

SEQ ID NO: 7502349 - DNA, 22 bp, Homo sapiens
aattagggaagtatttagtagt

SEQ ID NO: 7502350 - DNA, 22 bp, Homo sapiens
aattaggaaattcagccatttt

SEQ ID NO: 7502351 - DNA, 22 bp, Homo sapiens
aattagtattgcgattcattag

SEQ ID NO: 7502352 - DNA, 22 bp, Homo sapiens
aattagtaacctaattccatct

SEQ ID NO: 7502353 - DNA, 22 bp, Homo sapiens
aattagtattgcgattcattag

SEQ ID NO: 7502354 - DNA, 22 bp, Homo sapiens
aattagtattgcgattcattag

SEQ ID NO: 7502355 - DNA, 22 bp, Homo sapiens
aattagtaacctaattccatct

SEQ ID NO: 7502356 - DNA, 21 bp, Homo sapiens
aattagggtgcctcttataat

SEQ ID NO: 7502357 - DNA, 22 bp, Homo sapiens
aatttagattgataaacatgga

SEQ ID NO: 7502358 - DNA, 22 bp, Homo sapiens
aatttagattgataaacatgga

SEQ ID NO: 7502359 - DNA, 22 bp, Homo sapiens
aatttagattgataaacatgga

SEQ ID NO: 7502360 - DNA, 22 bp, Homo sapiens
aatttagaattcgctagctaat

SEQ ID NO: 7502361 - DNA, 22 bp, Homo sapiens
aatttagaattcgctagctaat

SEQ ID NO: 7502362 - DNA, 20 bp, Homo sapiens
aatttactcacagaatgaat

SEQ ID NO: 7502363 - DNA, 20 bp, Homo sapiens
aatttactcacagaatgaat

SEQ ID NO: 7502364 - DNA, 20 bp, Homo sapiens
aatttactcacagaatgaat

SEQ ID NO: 7502365 - DNA, 22 bp, Homo sapiens
aatttacagttgctgatggtac

SEQ ID NO: 7502366 - DNA, 20 bp, Homo sapiens
aatttactcacagaatgaat

SEQ ID NO: 7502367 - DNA, 20 bp, Homo sapiens
aatttactcacagaatgaat

SEQ ID NO: 7502368 - DNA, 20 bp, Homo sapiens
aatttactcacagaatgaat

SEQ ID NO: 7502369 - DNA, 22 bp, Homo sapiens
aatttacagttgctgatggtac

SEQ ID NO: 7502370 - DNA, 22 bp, Homo sapiens
aatttacagttgctgatggtac

SEQ ID NO: 7502371 - DNA, 22 bp, Homo sapiens
aatttacagttgctgatggtac

SEQ ID NO: 7502372 - DNA, 22 bp, Homo sapiens
aatttacagttgctgatggtac

SEQ ID NO: 7502373 - DNA, 22 bp, Homo sapiens
aatttacagttgctgatggtac

SEQ ID NO: 7502374 - DNA, 22 bp, Homo sapiens
aatttacagttgctgatggtac

SEQ ID NO: 7502375 - DNA, 22 bp, Homo sapiens
aatttacagttgctgatggtac

SEQ ID NO: 7502376 - DNA, 22 bp, Homo sapiens
aatttacagttgctgatggtac

SEQ ID NO: 7502377 - DNA, 22 bp, Homo sapiens
aatttacagttgctgatggtac

SEQ ID NO: 7502378 - DNA, 22 bp, Homo sapiens
aatttacagttgctgatggtac

SEQ ID NO: 7502379 - DNA, 22 bp, Homo sapiens
aatttacagttgctgatggtac

SEQ ID NO: 7502380 - DNA, 22 bp, Homo sapiens
aatttacagttgctgatggtac

SEQ ID NO: 7502381 - DNA, 22 bp, Homo sapiens
aatttacagttgctgatggtac

SEQ ID NO: 7502382 - DNA, 22 bp, Homo sapiens
aatttacagttgctgatggtac

SEQ ID NO: 7502383 - DNA, 22 bp, Homo sapiens
aatttacaggtgcactcgccat

SEQ ID NO: 7502384 - DNA, 22 bp, Homo sapiens
aatttacaggtgcactcgccat

SEQ ID NO: 7502385 - DNA, 22 bp, Homo sapiens
aatttacaggtgcactcgccat

SEQ ID NO: 7502386 - DNA, 22 bp, Homo sapiens
aatttacaggtgcactcgccat

SEQ ID NO: 7502387 - DNA, 22 bp, Homo sapiens
aatttacaggtgcactcgccat

SEQ ID NO: 7502388 - DNA, 22 bp, Homo sapiens
aatttacaggtgcactcgccat

SEQ ID NO: 7502389 - DNA, 22 bp, Homo sapiens
aatttacaggtgcactcgccat

SEQ ID NO: 7502390 - DNA, 22 bp, Homo sapiens
aatttacaggtgcactcgccat

SEQ ID NO: 7502391 - DNA, 22 bp, Homo sapiens
aatttacaggtgcactcgccat

SEQ ID NO: 7502392 - DNA, 22 bp, Homo sapiens
aatttacacttcatttggaggg

SEQ ID NO: 7502393 - DNA, 22 bp, Homo sapiens
aatttacacttcatttggaggg

SEQ ID NO: 7502394 - DNA, 22 bp, Homo sapiens
aatttacaggtgcactcgccat

SEQ ID NO: 7502395 - DNA, 22 bp, Homo sapiens
aatttacacttcatttggaggg

SEQ ID NO: 7502396 - DNA, 22 bp, Homo sapiens
aatttacacttcatttggaggg

SEQ ID NO: 7502397 - DNA, 22 bp, Homo sapiens
aatttacacttcatttggaggg

SEQ ID NO: 7502398 - DNA, 22 bp, Homo sapiens
aatttacacttcatttggaggg

SEQ ID NO: 7502399 - DNA, 22 bp, Homo sapiens
aatttacacttcatttggaggg

SEQ ID NO: 7502400 - DNA, 22 bp, Homo sapiens
aatttacacttcatttggaggg

SEQ ID NO: 7502401 - DNA, 22 bp, Homo sapiens
aatttacacttcatttggaggg

SEQ ID NO: 7502402 - DNA, 22 bp, Homo sapiens
aatttataataaatagggcttt

SEQ ID NO: 7502403 - DNA, 22 bp, Homo sapiens
aatttataataaatagggcttt

SEQ ID NO: 7502404 - DNA, 22 bp, Homo sapiens
aatttataataaatagggcttt

SEQ ID NO: 7502405 - DNA, 22 bp, Homo sapiens
aatttagattgataaacatgga

SEQ ID NO: 7502406 - DNA, 21 bp, Homo sapiens
aatttagtcaacagactgtgg

SEQ ID NO: 7502407 - DNA, 21 bp, Homo sapiens
aatttagtcaacagactgtgg

SEQ ID NO: 7502408 - DNA, 22 bp, Homo sapiens
aatttagattgataaacatgga

SEQ ID NO: 7502409 - DNA, 19 bp, Homo sapiens
aatttagttcttgtttaga

SEQ ID NO: 7502410 - DNA, 22 bp, Homo sapiens
aatttatatgtaattaggcaca

SEQ ID NO: 7502411 - DNA, 22 bp, Homo sapiens
aatttatatgtaattaggcaca

SEQ ID NO: 7502412 - DNA, 22 bp, Homo sapiens
agagctgggacttggactcaat

SEQ ID NO: 7502413 - DNA, 22 bp, Homo sapiens
agagctggggcataaatgccac

SEQ ID NO: 7502414 - DNA, 22 bp, Homo sapiens
agagctggggcataaatgccac

SEQ ID NO: 7502415 - DNA, 22 bp, Homo sapiens
agagctggggcataaatgccac

SEQ ID NO: 7502416 - DNA, 22 bp, Homo sapiens
agagctgggacttggactcaat

SEQ ID NO: 7502417 - DNA, 22 bp, Homo sapiens
agagctgggacttggactcaat

SEQ ID NO: 7502418 - DNA, 22 bp, Homo sapiens
agagctggggcataaatgccac

SEQ ID NO: 7502419 - DNA, 22 bp, Homo sapiens
agagctggggccagagtcaagg

SEQ ID NO: 7502420 - DNA, 22 bp, Homo sapiens
agagctggggccagagtcaagg

SEQ ID NO: 7502421 - DNA, 22 bp, Homo sapiens
agagctggggccagagtcaagg

SEQ ID NO: 7502422 - DNA, 22 bp, Homo sapiens
aattatattgtggtgtgaatgt

SEQ ID NO: 7502423 - DNA, 22 bp, Homo sapiens
aattatcagatataaaactgca

SEQ ID NO: 7502424 - DNA, 22 bp, Homo sapiens
aattatattgtggtgtgaatgt

SEQ ID NO: 7502425 - DNA, 22 bp, Homo sapiens
aattatattgtggtgtgaatgt

SEQ ID NO: 7502426 - DNA, 22 bp, Homo sapiens
aattatattgtggtgtgaatgt

SEQ ID NO: 7502427 - DNA, 22 bp, Homo sapiens
aattatattgtggtgtgaatgt

SEQ ID NO: 7502428 - DNA, 22 bp, Homo sapiens
aattatattgtggtgtgaatgt

SEQ ID NO: 7502429 - DNA, 22 bp, Homo sapiens
aattatattgtggtgtgaatgt

SEQ ID NO: 7502430 - DNA, 23 bp, Homo sapiens
aattatctatttcaaatttagca

SEQ ID NO: 7502431 - DNA, 23 bp, Homo sapiens
aattatctatttcaaatttagca

SEQ ID NO: 7502432 - DNA, 22 bp, Homo sapiens
aattatccttaatgcagtaagc

SEQ ID NO: 7502433 - DNA, 22 bp, Homo sapiens
aattatcagatataaaactgca

SEQ ID NO: 7502434 - DNA, 22 bp, Homo sapiens
aattatcagatataaaactgca

SEQ ID NO: 7502435 - DNA, 22 bp, Homo sapiens
aattatcagatataaaactgca

SEQ ID NO: 7502436 - DNA, 22 bp, Homo sapiens
aattatcagatataaaactgca

SEQ ID NO: 7502437 - DNA, 22 bp, Homo sapiens
aattatccacctttgcatgatt

SEQ ID NO: 7502438 - DNA, 22 bp, Homo sapiens
aattatccacctttgcatgatt

SEQ ID NO: 7502439 - DNA, 22 bp, Homo sapiens
aattatgcaaccaatgaccacg

SEQ ID NO: 7502440 - DNA, 22 bp, Homo sapiens
aattatgcaaccaatgaccacg

SEQ ID NO: 7502441 - DNA, 22 bp, Homo sapiens
aattatggaatttttagagaag

SEQ ID NO: 7502442 - DNA, 22 bp, Homo sapiens
aattatgaggtagatatcacat

SEQ ID NO: 7502443 - DNA, 22 bp, Homo sapiens
aattatgaggtagatatcacat

SEQ ID NO: 7502444 - DNA, 22 bp, Homo sapiens
aattatgattggtctaaaccag

SEQ ID NO: 7502445 - DNA, 22 bp, Homo sapiens
aattatggtatgttcaacaact

SEQ ID NO: 7502446 - DNA, 22 bp, Homo sapiens
aattatggtcactgttcctggg

SEQ ID NO: 7502447 - DNA, 22 bp, Homo sapiens
aattatggtatgttcaacaact

SEQ ID NO: 7502448 - DNA, 22 bp, Homo sapiens
aattatgcaaccaatgaccacg

SEQ ID NO: 7502449 - DNA, 22 bp, Homo sapiens
aattatggtatgttcaacaact

SEQ ID NO: 7502450 - DNA, 22 bp, Homo sapiens
aattatgtagccatatgaaaca

SEQ ID NO: 7502451 - DNA, 22 bp, Homo sapiens
aattatggtgtgtggttaaggg

SEQ ID NO: 7502452 - DNA, 22 bp, Homo sapiens
aattatggtggatcccagtggg

SEQ ID NO: 7502453 - DNA, 22 bp, Homo sapiens
aattggaaaaagacttaattgc

SEQ ID NO: 7502454 - DNA, 22 bp, Homo sapiens
aattggaaaaagacttaattgc

SEQ ID NO: 7502455 - DNA, 22 bp, Homo sapiens
aattatattgaagttgaatgtc

SEQ ID NO: 7502456 - DNA, 22 bp, Homo sapiens
aattatattgaagttgaatgtc

SEQ ID NO: 7502457 - DNA, 22 bp, Homo sapiens
aattatattgaagttgaatgtc

SEQ ID NO: 7502458 - DNA, 22 bp, Homo sapiens
aattatatgttaatcttcaatt

SEQ ID NO: 7502459 - DNA, 22 bp, Homo sapiens
aattatatgttaatcttcaatt

SEQ ID NO: 7502460 - DNA, 22 bp, Homo sapiens
aattatatgttaatcttcaatt

SEQ ID NO: 7502461 - DNA, 22 bp, Homo sapiens
aattatatgttaatcttcaatt

SEQ ID NO: 7502462 - DNA, 22 bp, Homo sapiens
aattatatgttaatcttcaatt

SEQ ID NO: 7502463 - DNA, 22 bp, Homo sapiens
aattatatgttaatcttcaatt

SEQ ID NO: 7502464 - DNA, 22 bp, Homo sapiens
aattatatgttaatcttcaatt

SEQ ID NO: 7502465 - DNA, 22 bp, Homo sapiens
aattatatgttaatcttcaatt

SEQ ID NO: 7502466 - DNA, 22 bp, Homo sapiens
aattatatgttaatcttcaatt

SEQ ID NO: 7502467 - DNA, 22 bp, Homo sapiens
aattatatgttaatcttcaatt

SEQ ID NO: 7502468 - DNA, 20 bp, Homo sapiens
aattatataactccaacatt

SEQ ID NO: 7502469 - DNA, 22 bp, Homo sapiens
aattagtattgcgattcattag

SEQ ID NO: 7502470 - DNA, 22 bp, Homo sapiens
aattatacaattgtcaagttct

SEQ ID NO: 7502471 - DNA, 22 bp, Homo sapiens
aattatacaattgtcaagttct

SEQ ID NO: 7502472 - DNA, 22 bp, Homo sapiens
aattatacaattgtcaagttct

SEQ ID NO: 7502473 - DNA, 22 bp, Homo sapiens
aattatacatgaaggcattata

SEQ ID NO: 7502474 - DNA, 22 bp, Homo sapiens
aattatacaattgtcaagttct

SEQ ID NO: 7502475 - DNA, 22 bp, Homo sapiens
aattatacaattgtcaagttct

SEQ ID NO: 7502476 - DNA, 22 bp, Homo sapiens
aattatacaattgtcaagttct

SEQ ID NO: 7502477 - DNA, 20 bp, Homo sapiens
aattatataactccaacatt

SEQ ID NO: 7502478 - DNA, 20 bp, Homo sapiens
aattatataactccaacatt

SEQ ID NO: 7502479 - DNA, 20 bp, Homo sapiens
aattatataactccaacatt

SEQ ID NO: 7502480 - DNA, 20 bp, Homo sapiens
aattatataactccaacatt

SEQ ID NO: 7502481 - DNA, 22 bp, Homo sapiens
aattatacattgaacaatctag

SEQ ID NO: 7502482 - DNA, 22 bp, Homo sapiens
aattatacattgaacaatctag

SEQ ID NO: 7502483 - DNA, 22 bp, Homo sapiens
aattatacattgaacaatctag

SEQ ID NO: 7502484 - DNA, 22 bp, Homo sapiens
aattatacattgaacaatctag

SEQ ID NO: 7502485 - DNA, 22 bp, Homo sapiens
aattatacattgaacaatctag

SEQ ID NO: 7502486 - DNA, 22 bp, Homo sapiens
aattatacatgaaggcattata

SEQ ID NO: 7502487 - DNA, 23 bp, Homo sapiens
agacagaggctgaggctggccgc

SEQ ID NO: 7502488 - DNA, 23 bp, Homo sapiens
agacagaggctgaggctggccgc

SEQ ID NO: 7502489 - DNA, 23 bp, Homo sapiens
agacagaggctgaggctggccgc

SEQ ID NO: 7502490 - DNA, 23 bp, Homo sapiens
agacagaggctgaggctggccgc

SEQ ID NO: 7502491 - DNA, 23 bp, Homo sapiens
agacagaggctgaggctggccgc

SEQ ID NO: 7502492 - DNA, 19 bp, Homo sapiens
agacagagctcagtgggtt

SEQ ID NO: 7502493 - DNA, 23 bp, Homo sapiens
agacagaggctgaggctggccgc

SEQ ID NO: 7502494 - DNA, 23 bp, Homo sapiens
agacagaggctgaggctggccgc

SEQ ID NO: 7502495 - DNA, 21 bp, Homo sapiens
agacagagtgcagtctacata

SEQ ID NO: 7502496 - DNA, 22 bp, Homo sapiens
agacagcaatatgggagacgga

SEQ ID NO: 7502497 - DNA, 22 bp, Homo sapiens
agacagcaatatgggagacgga

SEQ ID NO: 7502498 - DNA, 21 bp, Homo sapiens
agacagagtgcagtctacata

SEQ ID NO: 7502499 - DNA, 21 bp, Homo sapiens
agacagagtgcagtctacata

SEQ ID NO: 7502500 - DNA, 21 bp, Homo sapiens
agacagagtgcagtctacata

SEQ ID NO: 7502501 - DNA, 22 bp, Homo sapiens
agacaggctgctgtctgctagg

SEQ ID NO: 7502502 - DNA, 22 bp, Homo sapiens
agacaggctgctgtctgctagg

SEQ ID NO: 7502503 - DNA, 22 bp, Homo sapiens
agacaggctgctgtctgctagg

SEQ ID NO: 7502504 - DNA, 22 bp, Homo sapiens
agacaggcttggaaaaaacctc

SEQ ID NO: 7502505 - DNA, 22 bp, Homo sapiens
agacaggccactctggtctggt

SEQ ID NO: 7502506 - DNA, 22 bp, Homo sapiens
agacaggccactctggtctggt

SEQ ID NO: 7502507 - DNA, 22 bp, Homo sapiens
agacaggccactctggtctggt

SEQ ID NO: 7502508 - DNA, 22 bp, Homo sapiens
agacaggccactctggtctggt

SEQ ID NO: 7502509 - DNA, 22 bp, Homo sapiens
agacaggccactctggtctggt

SEQ ID NO: 7502510 - DNA, 22 bp, Homo sapiens
agacagcagaaactagagcact

SEQ ID NO: 7502511 - DNA, 22 bp, Homo sapiens
agacagcagaaactagagcact

SEQ ID NO: 7502512 - DNA, 22 bp, Homo sapiens
agacagcagaaactagagcact

SEQ ID NO: 7502513 - DNA, 22 bp, Homo sapiens
agacagcagaaactagagcact

SEQ ID NO: 7502514 - DNA, 22 bp, Homo sapiens
agacagcacttttgtatggggg

SEQ ID NO: 7502515 - DNA, 22 bp, Homo sapiens
agacagcacttttgtatggggg

SEQ ID NO: 7502516 - DNA, 22 bp, Homo sapiens
agacagcacttttgtatggggg

SEQ ID NO: 7502517 - DNA, 22 bp, Homo sapiens
agacagcaatatgggagacgga

SEQ ID NO: 7502518 - DNA, 22 bp, Homo sapiens
agacagcaatatgggagacgga

SEQ ID NO: 7502519 - DNA, 22 bp, Homo sapiens
aatgcaaggcctgtatctgatt

SEQ ID NO: 7502520 - DNA, 22 bp, Homo sapiens
aatgcaagatcaaatctaacac

SEQ ID NO: 7502521 - DNA, 22 bp, Homo sapiens
aatgcaaggcctgtatctgatt

SEQ ID NO: 7502522 - DNA, 22 bp, Homo sapiens
aatgcaagtcaatgctataccc

SEQ ID NO: 7502523 - DNA, 22 bp, Homo sapiens
aatgcaatacctttttatgctg

SEQ ID NO: 7502524 - DNA, 22 bp, Homo sapiens
aatgcaaggcctgtatctgatt

SEQ ID NO: 7502525 - DNA, 22 bp, Homo sapiens
aatgcaatgcagcacctccttg

SEQ ID NO: 7502526 - DNA, 22 bp, Homo sapiens
aatgcaatgcagcacctccttg

SEQ ID NO: 7502527 - DNA, 22 bp, Homo sapiens
aatgcaatgcagcacctccttg

SEQ ID NO: 7502528 - DNA, 22 bp, Homo sapiens
aatgcaatgcagcacctccttg

SEQ ID NO: 7502529 - DNA, 22 bp, Homo sapiens
aatgcaatgcagcacctccttg

SEQ ID NO: 7502530 - DNA, 22 bp, Homo sapiens
aatgcaatgcagcacctccttg

SEQ ID NO: 7502531 - DNA, 23 bp, Homo sapiens
agacactgtaaagaattgcagtt

SEQ ID NO: 7502532 - DNA, 23 bp, Homo sapiens
agacactgtaaagaattgcagtt

SEQ ID NO: 7502533 - DNA, 22 bp, Homo sapiens
agacagactttgatctggatgt

SEQ ID NO: 7502534 - DNA, 18 bp, Homo sapiens
aatgcaatgtatttgcag

SEQ ID NO: 7502535 - DNA, 21 bp, Homo sapiens
agacactggtttagcattcat

SEQ ID NO: 7502536 - DNA, 19 bp, Homo sapiens
agacagagactgaaataga

SEQ ID NO: 7502537 - DNA, 22 bp, Homo sapiens
agacagactttgatctggatgt

SEQ ID NO: 7502538 - DNA, 22 bp, Homo sapiens
agacagactttgatctggatgt

SEQ ID NO: 7502539 - DNA, 19 bp, Homo sapiens
agacagagactgaaataga

SEQ ID NO: 7502540 - DNA, 19 bp, Homo sapiens
agacagagactgaaataga

SEQ ID NO: 7502541 - DNA, 19 bp, Homo sapiens
agacagagactgaaataga

SEQ ID NO: 7502542 - DNA, 22 bp, Homo sapiens
agacagagatactatgttgtca

SEQ ID NO: 7502543 - DNA, 22 bp, Homo sapiens
agacagagatactatgttgtca

SEQ ID NO: 7502544 - DNA, 22 bp, Homo sapiens
agacagagatactatgttgtca

SEQ ID NO: 7502545 - DNA, 22 bp, Homo sapiens
agacagagatactatgttgtca

SEQ ID NO: 7502546 - DNA, 22 bp, Homo sapiens
agacagagatactatgttgtca

SEQ ID NO: 7502547 - DNA, 19 bp, Homo sapiens
agacagagactgaaataga

SEQ ID NO: 7502548 - DNA, 19 bp, Homo sapiens
agacagagctcagtgggtt

SEQ ID NO: 7502549 - DNA, 19 bp, Homo sapiens
agacagagctcagtgggtt

SEQ ID NO: 7502550 - DNA, 19 bp, Homo sapiens
agacagagctcagtgggtt

SEQ ID NO: 7502551 - DNA, 19 bp, Homo sapiens
agacagagctcagtgggtt

SEQ ID NO: 7502552 - DNA, 19 bp, Homo sapiens
agacagagctcagtgggtt

SEQ ID NO: 7502553 - DNA, 19 bp, Homo sapiens
agacagagctcagtgggtt

SEQ ID NO: 7502554 - DNA, 19 bp, Homo sapiens
agacagagctcagtgggtt

SEQ ID NO: 7502555 - DNA, 22 bp, Homo sapiens
agaaggggcccaaggatgtcag

SEQ ID NO: 7502556 - DNA, 22 bp, Homo sapiens
agaaggggcccaaggatgtcag

SEQ ID NO: 7502557 - DNA, 22 bp, Homo sapiens
agaaggggagaagctaccagga

SEQ ID NO: 7502558 - DNA, 22 bp, Homo sapiens
agaaggggagaagctaccagga

SEQ ID NO: 7502559 - DNA, 22 bp, Homo sapiens
agaaggggagaagctaccagga

SEQ ID NO: 7502560 - DNA, 22 bp, Homo sapiens
agaaggggagaagctaccagga

SEQ ID NO: 7502561 - DNA, 22 bp, Homo sapiens
agaagggtagggacttatccaa

SEQ ID NO: 7502562 - DNA, 22 bp, Homo sapiens
agaagggtagttgtaagagtga

SEQ ID NO: 7502563 - DNA, 22 bp, Homo sapiens
agaagggtagttgtaagagtga

SEQ ID NO: 7502564 - DNA, 22 bp, Homo sapiens
agaaggggcccaaggatgtcag

SEQ ID NO: 7502565 - DNA, 22 bp, Homo sapiens
agaaggggcccaaggatgtcag

SEQ ID NO: 7502566 - DNA, 22 bp, Homo sapiens
agaagggctacacgggctctcc

SEQ ID NO: 7502567 - DNA, 22 bp, Homo sapiens
agaagggctacacgggctctcc

SEQ ID NO: 7502568 - DNA, 22 bp, Homo sapiens
agaagggccagctggacacctg

SEQ ID NO: 7502569 - DNA, 22 bp, Homo sapiens
agaagggagagaaagttggtta

SEQ ID NO: 7502570 - DNA, 21 bp, Homo sapiens
agaagggattgtggtaaagat

SEQ ID NO: 7502571 - DNA, 22 bp, Homo sapiens
agaagtattctgcatgtactga

SEQ ID NO: 7502572 - DNA, 22 bp, Homo sapiens
agaagtatgtgagaaattatcc

SEQ ID NO: 7502573 - DNA, 22 bp, Homo sapiens
agaagtatgtgagaaattatcc

SEQ ID NO: 7502574 - DNA, 22 bp, Homo sapiens
agaagtatgtgagaaattatcc

SEQ ID NO: 7502575 - DNA, 22 bp, Homo sapiens
agaagtatcaggaagattctca

SEQ ID NO: 7502576 - DNA, 22 bp, Homo sapiens
agaagtataactatttgctttc

SEQ ID NO: 7502577 - DNA, 22 bp, Homo sapiens
agaagtatgtgagaaattatcc

SEQ ID NO: 7502578 - DNA, 22 bp, Homo sapiens
agaagtataaagaatgtttatg

SEQ ID NO: 7502579 - DNA, 22 bp, Homo sapiens
agaagtagtccagtggaaagta

SEQ ID NO: 7502580 - DNA, 22 bp, Homo sapiens
agaagtataaagaatgtttatg

SEQ ID NO: 7502581 - DNA, 22 bp, Homo sapiens
agaagtataaagaatgtttatg

SEQ ID NO: 7502582 - DNA, 22 bp, Homo sapiens
agaagtagtccagtggaaagta

SEQ ID NO: 7502583 - DNA, 22 bp, Homo sapiens
agaagggtgtatacatttcctg

SEQ ID NO: 7502584 - DNA, 22 bp, Homo sapiens
agaagggttcaggaatatgtta

SEQ ID NO: 7502585 - DNA, 23 bp, Homo sapiens
agaagggtccttggcagcgacag

SEQ ID NO: 7502586 - DNA, 23 bp, Homo sapiens
agaagggtccttggcagcgacag

SEQ ID NO: 7502587 - DNA, 23 bp, Homo sapiens
agaagggtccttggcagcgacag

SEQ ID NO: 7502588 - DNA, 22 bp, Homo sapiens
agaagtaggcagggctgtatca

SEQ ID NO: 7502589 - DNA, 22 bp, Homo sapiens
agaagtactggcagaagattgg

SEQ ID NO: 7502590 - DNA, 23 bp, Homo sapiens
agaaggtgggcctgctgagttat

SEQ ID NO: 7502591 - DNA, 22 bp, Homo sapiens
agaaggtggctactcagtcatc

SEQ ID NO: 7502592 - DNA, 22 bp, Homo sapiens
aatgcaagatcaaatctaacac

SEQ ID NO: 7502593 - DNA, 22 bp, Homo sapiens
aatgcaacctgctgatctgaca

SEQ ID NO: 7502594 - DNA, 22 bp, Homo sapiens
aatgcaacctgctgatctgaca

SEQ ID NO: 7502595 - DNA, 22 bp, Homo sapiens
aatgcaacctgctgatctgaca

SEQ ID NO: 7502596 - DNA, 22 bp, Homo sapiens
aatgcaaattctagggccctat

SEQ ID NO: 7502597 - DNA, 22 bp, Homo sapiens
aatgcaaattatcaggcttctc

SEQ ID NO: 7502598 - DNA, 22 bp, Homo sapiens
aatgcaaatgtaagggtgggat

SEQ ID NO: 7502599 - DNA, 22 bp, Homo sapiens
aatgcaaattatcaggcttctc

SEQ ID NO: 7502600 - DNA, 22 bp, Homo sapiens
aatgcaaattatcaggcttctc

SEQ ID NO: 7502601 - DNA, 22 bp, Homo sapiens
aatgcaaatgtaagggtgggat

SEQ ID NO: 7502602 - DNA, 22 bp, Homo sapiens
aatgcaaattatcaggcttctc

SEQ ID NO: 7502603 - DNA, 22 bp, Homo sapiens
aatgcaaattctagggccctat

SEQ ID NO: 7502604 - DNA, 22 bp, Homo sapiens
aatgcaaattctagggccctat

SEQ ID NO: 7502605 - DNA, 22 bp, Homo sapiens
aatgcaaagtgaggtgagtggc

SEQ ID NO: 7502606 - DNA, 22 bp, Homo sapiens
aatgcaaagtgaggtgagtggc

SEQ ID NO: 7502607 - DNA, 22 bp, Homo sapiens
aatgcaaagtgaggtgagtggc

SEQ ID NO: 7502608 - DNA, 22 bp, Homo sapiens
aatgcaaagctctttaatcctt

SEQ ID NO: 7502609 - DNA, 22 bp, Homo sapiens
aatgcaaagtgaggtgagtggc

SEQ ID NO: 7502610 - DNA, 22 bp, Homo sapiens
aatgcaaagtgaggtgagtggc

SEQ ID NO: 7502611 - DNA, 22 bp, Homo sapiens
aatgcaaagctctttaatcctt

SEQ ID NO: 7502612 - DNA, 22 bp, Homo sapiens
aatgcaaagcaagcagagattt

SEQ ID NO: 7502613 - DNA, 22 bp, Homo sapiens
aatgcaaagctctttaatcctt

SEQ ID NO: 7502614 - DNA, 22 bp, Homo sapiens
aatgcaaagctctttaatcctt

SEQ ID NO: 7502615 - DNA, 22 bp, Homo sapiens
aatgcaaagctctttaatcctt

SEQ ID NO: 7502616 - DNA, 22 bp, Homo sapiens
aatgcaaactccactggagcag

SEQ ID NO: 7502617 - DNA, 22 bp, Homo sapiens
aatgcaaacttcttgttacttg

SEQ ID NO: 7502618 - DNA, 22 bp, Homo sapiens
aatgcaaacttcttgttacttg

SEQ ID NO: 7502619 - DNA, 22 bp, Homo sapiens
aatgcaaactccactggagcag

SEQ ID NO: 7502620 - DNA, 22 bp, Homo sapiens
aatgcaaacttcttgttacttg

SEQ ID NO: 7502621 - DNA, 22 bp, Homo sapiens
aatgcaaacttcttgttacttg

SEQ ID NO: 7502622 - DNA, 22 bp, Homo sapiens
aatgcaaacttcttgttacttg

SEQ ID NO: 7502623 - DNA, 22 bp, Homo sapiens
aatgcaaactccactggagcag

SEQ ID NO: 7502624 - DNA, 22 bp, Homo sapiens
aatgcaaactccactggagcag

SEQ ID NO: 7502625 - DNA, 22 bp, Homo sapiens
aatgcaaactccactggagcag

SEQ ID NO: 7502626 - DNA, 22 bp, Homo sapiens
agaagtattctgcatgtactga

SEQ ID NO: 7502627 - DNA, 22 bp, Homo sapiens
aatgcaaacagcccagaatcca

SEQ ID NO: 7502628 - DNA, 22 bp, Homo sapiens
aatgcaaacagcccagaatcca

SEQ ID NO: 7502629 - DNA, 22 bp, Homo sapiens
aatgcaaacagcccagaatcca

SEQ ID NO: 7502630 - DNA, 22 bp, Homo sapiens
aatgcaaagcaagcagagattt

SEQ ID NO: 7502631 - DNA, 22 bp, Homo sapiens
aatgcaaagcaagcagagattt

SEQ ID NO: 7502632 - DNA, 22 bp, Homo sapiens
aatgcaaagagttgcttatcaa

SEQ ID NO: 7502633 - DNA, 22 bp, Homo sapiens
aatgcaaagagttgcttatcaa

SEQ ID NO: 7502634 - DNA, 22 bp, Homo sapiens
aatgcaaagagttgcttatcaa

SEQ ID NO: 7502635 - DNA, 22 bp, Homo sapiens
aatgcaaagcaagcagagattt

SEQ ID NO: 7502636 - DNA, 22 bp, Homo sapiens
aatgcaaagcaagcagagattt

SEQ ID NO: 7502637 - DNA, 22 bp, Homo sapiens
aatgcaaagcaagcagagattt

SEQ ID NO: 7502638 - DNA, 22 bp, Homo sapiens
aatgcaaacttcttgttacttg

SEQ ID NO: 7502639 - DNA, 22 bp, Homo sapiens
aatgcaaacttcttgttacttg

SEQ ID NO: 7502640 - DNA, 22 bp, Homo sapiens
aatgcaaacttcttgttacttg

SEQ ID NO: 7502641 - DNA, 22 bp, Homo sapiens
aatgcaaacttcttgttacttg

SEQ ID NO: 7502642 - DNA, 22 bp, Homo sapiens
aatgtgttcacaggaaatacag

SEQ ID NO: 7502643 - DNA, 22 bp, Homo sapiens
aatgtgttcagttaaatgaact

SEQ ID NO: 7502644 - DNA, 22 bp, Homo sapiens
aatgtgttcagttaaatgaact

SEQ ID NO: 7502645 - DNA, 22 bp, Homo sapiens
aatgtgttactgtgtaagagca

SEQ ID NO: 7502646 - DNA, 22 bp, Homo sapiens
aatgtgttagtattgatttgtc

SEQ ID NO: 7502647 - DNA, 22 bp, Homo sapiens
aatgtgttatttcagaatccag

SEQ ID NO: 7502648 - DNA, 22 bp, Homo sapiens
aatgtcttcagtgtatacatgg

SEQ ID NO: 7502649 - DNA, 22 bp, Homo sapiens
aatgtcttcagtgtatacatgg

SEQ ID NO: 7502650 - DNA, 22 bp, Homo sapiens
aatgtcttcagtgtatacatgg

SEQ ID NO: 7502651 - DNA, 22 bp, Homo sapiens
aatgtcttcagtgtatacatgg

SEQ ID NO: 7502652 - DNA, 22 bp, Homo sapiens
aatgtcttacatttactgagca

SEQ ID NO: 7502653 - DNA, 22 bp, Homo sapiens
aatgtcttcagtgtatacatgg

SEQ ID NO: 7502654 - DNA, 22 bp, Homo sapiens
aatgtcttcagtgtatacatgg

SEQ ID NO: 7502655 - DNA, 22 bp, Homo sapiens
aatgtcttaaagtcgtgttaca

SEQ ID NO: 7502656 - DNA, 22 bp, Homo sapiens
aatgtctgtgccttaaaacttc

SEQ ID NO: 7502657 - DNA, 22 bp, Homo sapiens
aatgtctgtgccttaaaacttc

SEQ ID NO: 7502658 - DNA, 22 bp, Homo sapiens
aatgtctgctctactcaggagg

SEQ ID NO: 7502659 - DNA, 22 bp, Homo sapiens
aatgtctgcctgaactttatat

SEQ ID NO: 7502660 - DNA, 22 bp, Homo sapiens
aatgtctgcctgaactttatat

SEQ ID NO: 7502661 - DNA, 22 bp, Homo sapiens
aatgtctgagtctctgtatccc

SEQ ID NO: 7502662 - DNA, 22 bp, Homo sapiens
aatgtctgagtctctgtatccc

SEQ ID NO: 7502663 - DNA, 22 bp, Homo sapiens
aatgtctgagtctctgtatccc

SEQ ID NO: 7502664 - DNA, 22 bp, Homo sapiens
aatgtctgccagaactgatcat

SEQ ID NO: 7502665 - DNA, 22 bp, Homo sapiens
aatgtctgcctgaactttatat

SEQ ID NO: 7502666 - DNA, 22 bp, Homo sapiens
aatgtctgaaaatcagactgca

SEQ ID NO: 7502667 - DNA, 22 bp, Homo sapiens
aatgtctgaaaatcagactgca

SEQ ID NO: 7502668 - DNA, 22 bp, Homo sapiens
aatgtctcttgagaggcgaaac

SEQ ID NO: 7502669 - DNA, 22 bp, Homo sapiens
aatgtctctggtttaggatcgc

SEQ ID NO: 7502670 - DNA, 22 bp, Homo sapiens
aatgtctctggtttaggatcgc

SEQ ID NO: 7502671 - DNA, 22 bp, Homo sapiens
aatgtctgaggctcatctgagg

SEQ ID NO: 7502672 - DNA, 22 bp, Homo sapiens
aatgtctgaggctcatctgagg

SEQ ID NO: 7502673 - DNA, 22 bp, Homo sapiens
aatgtctgaggctcatctgagg

SEQ ID NO: 7502674 - DNA, 22 bp, Homo sapiens
aatgtctgaggctcatctgagg

SEQ ID NO: 7502675 - DNA, 22 bp, Homo sapiens
aatgtctcaccgtaaatgtaac

SEQ ID NO: 7502676 - DNA, 22 bp, Homo sapiens
aatgtctcaccgtaaatgtaac

SEQ ID NO: 7502677 - DNA, 20 bp, Homo sapiens
aatgtctcctaaaaggtcag

SEQ ID NO: 7502678 - DNA, 20 bp, Homo sapiens
aatgtctcctaaaaggtcag

SEQ ID NO: 7502679 - DNA, 22 bp, Homo sapiens
aatgtctctatatctcataaga

SEQ ID NO: 7502680 - DNA, 19 bp, Homo sapiens
aatgtctctatctgttctc

SEQ ID NO: 7502681 - DNA, 22 bp, Homo sapiens
aatgtctctctaaataaacttt

SEQ ID NO: 7502682 - DNA, 22 bp, Homo sapiens
aatgtctctctaaataaacttt

SEQ ID NO: 7502683 - DNA, 22 bp, Homo sapiens
aatgtcatttaaaataattctg

SEQ ID NO: 7502684 - DNA, 22 bp, Homo sapiens
aatgtcatttaaaataattctg

SEQ ID NO: 7502685 - DNA, 22 bp, Homo sapiens
aatgtcatttaaaataattctg

SEQ ID NO: 7502686 - DNA, 22 bp, Homo sapiens
aatgtcattgtgagttaggctt

SEQ ID NO: 7502687 - DNA, 22 bp, Homo sapiens
aatgtcattgtgagttaggctt

SEQ ID NO: 7502688 - DNA, 22 bp, Homo sapiens
aatgtcatgagcctgctcttgt

SEQ ID NO: 7502689 - DNA, 22 bp, Homo sapiens
aatgtcattggtaaagattagg

SEQ ID NO: 7502690 - DNA, 22 bp, Homo sapiens
aatgtcattggtaaagattagg

SEQ ID NO: 7502691 - DNA, 22 bp, Homo sapiens
aatgtcatttaggattatgttt

SEQ ID NO: 7502692 - DNA, 22 bp, Homo sapiens
aatgtcatttaggattatgttt

SEQ ID NO: 7502693 - DNA, 22 bp, Homo sapiens
aatgtcatttaggattatgttt

SEQ ID NO: 7502694 - DNA, 22 bp, Homo sapiens
aatgtcatttaaagacaaagaa

SEQ ID NO: 7502695 - DNA, 22 bp, Homo sapiens
aatgtcatttaaaataattctg

SEQ ID NO: 7502696 - DNA, 22 bp, Homo sapiens
aatgtcatttaaaataattctg

SEQ ID NO: 7502697 - DNA, 22 bp, Homo sapiens
aatgtcatttaaagacaaagaa

SEQ ID NO: 7502698 - DNA, 22 bp, Homo sapiens
aatgtcatttttaaatgtgaga

SEQ ID NO: 7502699 - DNA, 22 bp, Homo sapiens
aatgtcatttttaaatgtgaga

SEQ ID NO: 7502700 - DNA, 22 bp, Homo sapiens
aatgtcatttttaaatgtgaga

SEQ ID NO: 7502701 - DNA, 22 bp, Homo sapiens
aatgtcatttttaaatgtgaga

SEQ ID NO: 7502702 - DNA, 22 bp, Homo sapiens
aatgtcctaggcatgattttgt

SEQ ID NO: 7502703 - DNA, 22 bp, Homo sapiens
aatgtcctgttaaattttccca

SEQ ID NO: 7502704 - DNA, 22 bp, Homo sapiens
aatgtctacaccgtatgttgtt

SEQ ID NO: 7502705 - DNA, 22 bp, Homo sapiens
aatgtctacaccgtatgttgtt

SEQ ID NO: 7502706 - DNA, 22 bp, Homo sapiens
aatgtctacaccgtatgttgtt

SEQ ID NO: 7502707 - DNA, 17 bp, Homo sapiens
aatgtccttggaccaca

SEQ ID NO: 7502708 - DNA, 22 bp, Homo sapiens
aatgtcctgttaaattttccca

SEQ ID NO: 7502709 - DNA, 17 bp, Homo sapiens
aatgtccttggaccaca

SEQ ID NO: 7502710 - DNA, 22 bp, Homo sapiens
aatgtctattaaactgtcataa

SEQ ID NO: 7502711 - DNA, 22 bp, Homo sapiens
aatgtctatgatcctttaagtt

SEQ ID NO: 7502712 - DNA, 22 bp, Homo sapiens
aatgtctatttgctacaaagcc

SEQ ID NO: 7502713 - DNA, 22 bp, Homo sapiens
aatgtctatgatcctttaagtt

SEQ ID NO: 7502714 - DNA, 22 bp, Homo sapiens
aatgtctatgaaatgaaaggga

SEQ ID NO: 7502715 - DNA, 22 bp, Homo sapiens
aatgtctatgaaatgaaaggga

SEQ ID NO: 7502716 - DNA, 22 bp, Homo sapiens
aatgtctagagttttaagctta

SEQ ID NO: 7502717 - DNA, 22 bp, Homo sapiens
aatgtctagacatgttaatgca

SEQ ID NO: 7502718 - DNA, 22 bp, Homo sapiens
aatgtctagacatgttaatgca

SEQ ID NO: 7502719 - DNA, 22 bp, Homo sapiens
aatgtctacagcaaaccccaca

SEQ ID NO: 7502720 - DNA, 22 bp, Homo sapiens
aatgtctacattctgaattcgt

SEQ ID NO: 7502721 - DNA, 22 bp, Homo sapiens
aatgtctacattctgaattcgt

SEQ ID NO: 7502722 - DNA, 22 bp, Homo sapiens
agacagggtcttgatcagagct

SEQ ID NO: 7502723 - DNA, 22 bp, Homo sapiens
agacagggtcttgatcagagct

SEQ ID NO: 7502724 - DNA, 22 bp, Homo sapiens
agacagggtcttgatcagagct

SEQ ID NO: 7502725 - DNA, 22 bp, Homo sapiens
agacagggtcttgatcagagct

SEQ ID NO: 7502726 - DNA, 22 bp, Homo sapiens
agacagggtcttgatcagagct

SEQ ID NO: 7502727 - DNA, 22 bp, Homo sapiens
agacagggccactcatcctcac

SEQ ID NO: 7502728 - DNA, 22 bp, Homo sapiens
agacagggtcttgatcagagct

SEQ ID NO: 7502729 - DNA, 22 bp, Homo sapiens
agacagggtcttgatcagagct

SEQ ID NO: 7502730 - DNA, 22 bp, Homo sapiens
agacagggagggagcgcggctg

SEQ ID NO: 7502731 - DNA, 22 bp, Homo sapiens
agacagggccactcatcctcac

SEQ ID NO: 7502732 - DNA, 22 bp, Homo sapiens
agacagggccactcatcctcac

SEQ ID NO: 7502733 - DNA, 22 bp, Homo sapiens
agacagggccactcatcctcac

SEQ ID NO: 7502734 - DNA, 22 bp, Homo sapiens
agacagggccactcatcctcac

SEQ ID NO: 7502735 - DNA, 22 bp, Homo sapiens
agacagggagggagcgcggctg

SEQ ID NO: 7502736 - DNA, 22 bp, Homo sapiens
agacagggagggagcgcggctg

SEQ ID NO: 7502737 - DNA, 22 bp, Homo sapiens
agacagggagggagcgcggctg

SEQ ID NO: 7502738 - DNA, 22 bp, Homo sapiens
agacagggagggagcgcggctg

SEQ ID NO: 7502739 - DNA, 22 bp, Homo sapiens
agacagggagggagcgcggctg

SEQ ID NO: 7502740 - DNA, 22 bp, Homo sapiens
aatgtattctctttataagata

SEQ ID NO: 7502741 - DNA, 22 bp, Homo sapiens
aatgtattctctttataagata

SEQ ID NO: 7502742 - DNA, 22 bp, Homo sapiens
aatgtattctctttataagata

SEQ ID NO: 7502743 - DNA, 22 bp, Homo sapiens
aatgtattctctttataagata

SEQ ID NO: 7502744 - DNA, 22 bp, Homo sapiens
aatgtattctctttataagata

SEQ ID NO: 7502745 - DNA, 22 bp, Homo sapiens
aatgtattctctttataagata

SEQ ID NO: 7502746 - DNA, 22 bp, Homo sapiens
aatgtattcctcatgcaagagt

SEQ ID NO: 7502747 - DNA, 22 bp, Homo sapiens
agacagggtgatcgcttgagcc

SEQ ID NO: 7502748 - DNA, 22 bp, Homo sapiens
agacagggtgatcgcttgagcc

SEQ ID NO: 7502749 - DNA, 22 bp, Homo sapiens
agacagggtgatcgcttgagcc

SEQ ID NO: 7502750 - DNA, 22 bp, Homo sapiens
agacagggtgatcgcttgagcc

SEQ ID NO: 7502751 - DNA, 22 bp, Homo sapiens
agacagggtgatcgcttgagcc

SEQ ID NO: 7502752 - DNA, 22 bp, Homo sapiens
agacagggtgatcgcttgagcc

SEQ ID NO: 7502753 - DNA, 22 bp, Homo sapiens
agacagggtgatcgcttgagcc

SEQ ID NO: 7502754 - DNA, 22 bp, Homo sapiens
agacagggtgatcgcttgagcc

SEQ ID NO: 7502755 - DNA, 22 bp, Homo sapiens
agacagggtgatcgcttgagcc

SEQ ID NO: 7502756 - DNA, 22 bp, Homo sapiens
agacagggtcttgatcagagct

SEQ ID NO: 7502757 - DNA, 22 bp, Homo sapiens
agacagggtcttgatcagagct

SEQ ID NO: 7502758 - DNA, 22 bp, Homo sapiens
aatgtcattgagctccaatcct

SEQ ID NO: 7502759 - DNA, 22 bp, Homo sapiens
aatgtcattgagctccaatcct

SEQ ID NO: 7502760 - DNA, 22 bp, Homo sapiens
aatgtcattggtaaagattagg

SEQ ID NO: 7502761 - DNA, 22 bp, Homo sapiens
aatgtcattggtaaagattagg

SEQ ID NO: 7502762 - DNA, 22 bp, Homo sapiens
aatgtcatgggaatttattcat

SEQ ID NO: 7502763 - DNA, 22 bp, Homo sapiens
aatgtcatgggaatttattcat

SEQ ID NO: 7502764 - DNA, 21 bp, Homo sapiens
aatgtcattgaatggtgagac

SEQ ID NO: 7502765 - DNA, 22 bp, Homo sapiens
aatgtcatattagtttgtgcct

SEQ ID NO: 7502766 - DNA, 22 bp, Homo sapiens
aatgtcatagcatttcttcaat

SEQ ID NO: 7502767 - DNA, 22 bp, Homo sapiens
aatgtcatagcatttcttcaat

SEQ ID NO: 7502768 - DNA, 22 bp, Homo sapiens
aatgtcatgggaatttattcat

SEQ ID NO: 7502769 - DNA, 22 bp, Homo sapiens
aatgtcatgggaatttattcat

SEQ ID NO: 7502770 - DNA, 22 bp, Homo sapiens
aatgtcatgagcctgctcttgt

SEQ ID NO: 7502771 - DNA, 22 bp, Homo sapiens
aatgtcatagcatttcttcaat

SEQ ID NO: 7502772 - DNA, 22 bp, Homo sapiens
aatgtcatagcatttcttcaat

SEQ ID NO: 7502773 - DNA, 22 bp, Homo sapiens
aatgtcatagcaaagagagtga

SEQ ID NO: 7502774 - DNA, 19 bp, Homo sapiens
aatgtcagcatgttaattt

SEQ ID NO: 7502775 - DNA, 22 bp, Homo sapiens
aatgtcatagcaaagagagtga

SEQ ID NO: 7502776 - DNA, 22 bp, Homo sapiens
aatgtcactctgtttcctctgc

SEQ ID NO: 7502777 - DNA, 22 bp, Homo sapiens
aatgtcagcctgaaagctattc

SEQ ID NO: 7502778 - DNA, 22 bp, Homo sapiens
aatgtcagtgttactgctattg

SEQ ID NO: 7502779 - DNA, 22 bp, Homo sapiens
aatgtcaattaccagaacagaa

SEQ ID NO: 7502780 - DNA, 22 bp, Homo sapiens
aatgtcaattaccagaacagaa

SEQ ID NO: 7502781 - DNA, 22 bp, Homo sapiens
aatgtcaattaccagaacagaa

SEQ ID NO: 7502782 - DNA, 22 bp, Homo sapiens
aatgtcaattaccagaacagaa

SEQ ID NO: 7502783 - DNA, 22 bp, Homo sapiens
aatgtcaatctcagagaacaca

SEQ ID NO: 7502784 - DNA, 22 bp, Homo sapiens
aattttatgccttgcacgttgg

SEQ ID NO: 7502785 - DNA, 22 bp, Homo sapiens
aattttatgccttgcacgttgg

SEQ ID NO: 7502786 - DNA, 22 bp, Homo sapiens
aattttatgccttgcacgttgg

SEQ ID NO: 7502787 - DNA, 22 bp, Homo sapiens
aattttatgccttgcacgttgg

SEQ ID NO: 7502788 - DNA, 22 bp, Homo sapiens
aattttatgccttgcacgttgg

SEQ ID NO: 7502789 - DNA, 22 bp, Homo sapiens
aattttatgccttgcacgttgg

SEQ ID NO: 7502790 - DNA, 22 bp, Homo sapiens
aatttgttacacagcaatataa

SEQ ID NO: 7502791 - DNA, 22 bp, Homo sapiens
aatttgttacacagcaatataa

SEQ ID NO: 7502792 - DNA, 22 bp, Homo sapiens
aattttatgccttgcacgttgg

SEQ ID NO: 7502793 - DNA, 22 bp, Homo sapiens
aattttattaactggatgtagc

SEQ ID NO: 7502794 - DNA, 22 bp, Homo sapiens
aattttattaactggatgtagc

SEQ ID NO: 7502795 - DNA, 22 bp, Homo sapiens
aattttatgccttgcacgttgg

SEQ ID NO: 7502796 - DNA, 22 bp, Homo sapiens
aattttattaactggatgtagc

SEQ ID NO: 7502797 - DNA, 22 bp, Homo sapiens
aattttattaactggatgtagc

SEQ ID NO: 7502798 - DNA, 22 bp, Homo sapiens
aattttattaactggatgtagc

SEQ ID NO: 7502799 - DNA, 22 bp, Homo sapiens
aattttattagaaggcaagggg

SEQ ID NO: 7502800 - DNA, 22 bp, Homo sapiens
aattttattaactggatgtagc

SEQ ID NO: 7502801 - DNA, 22 bp, Homo sapiens
aattttattaactggatgtagc

SEQ ID NO: 7502802 - DNA, 22 bp, Homo sapiens
aattttattagaaggcaagggg

SEQ ID NO: 7502803 - DNA, 22 bp, Homo sapiens
aattttcacagtgctgtgagat

SEQ ID NO: 7502804 - DNA, 22 bp, Homo sapiens
aattttcacagtgctgtgagat

SEQ ID NO: 7502805 - DNA, 22 bp, Homo sapiens
aattttccatccaaagtaacat

SEQ ID NO: 7502806 - DNA, 22 bp, Homo sapiens
aattttccatccaaagtaacat

SEQ ID NO: 7502807 - DNA, 22 bp, Homo sapiens
aattttctaaggtgatgatctg

SEQ ID NO: 7502808 - DNA, 22 bp, Homo sapiens
aattttctaaggtgatgatctg

SEQ ID NO: 7502809 - DNA, 22 bp, Homo sapiens
aattttattagaaggcaagggg

SEQ ID NO: 7502810 - DNA, 22 bp, Homo sapiens
aattttcacagtgctgtgagat

SEQ ID NO: 7502811 - DNA, 22 bp, Homo sapiens
aattttcacagtgctgtgagat

SEQ ID NO: 7502812 - DNA, 22 bp, Homo sapiens
aatttgtatacatgttacattt

SEQ ID NO: 7502813 - DNA, 22 bp, Homo sapiens
aatttgtgaatctgtctcttga

SEQ ID NO: 7502814 - DNA, 22 bp, Homo sapiens
agagctgggtggtggtgactca

SEQ ID NO: 7502815 - DNA, 22 bp, Homo sapiens
agagctgggtggtggtgactca

SEQ ID NO: 7502816 - DNA, 22 bp, Homo sapiens
aatttgttaaaagtgagtgaca

SEQ ID NO: 7502817 - DNA, 22 bp, Homo sapiens
aatttgttaaaagtgagtgaca

SEQ ID NO: 7502818 - DNA, 22 bp, Homo sapiens
agagctgggtggtggtgactca

SEQ ID NO: 7502819 - DNA, 22 bp, Homo sapiens
agagctgggtggtggtgactca

SEQ ID NO: 7502820 - DNA, 22 bp, Homo sapiens
agagctgggtggtggtgactca

SEQ ID NO: 7502821 - DNA, 22 bp, Homo sapiens
agagctgggtggtggtgactca

SEQ ID NO: 7502822 - DNA, 22 bp, Homo sapiens
agagctgggtggtggtgactca

SEQ ID NO: 7502823 - DNA, 22 bp, Homo sapiens
agagctgggtggacttgtagtt

SEQ ID NO: 7502824 - DNA, 22 bp, Homo sapiens
agagctgggtggacttgtagtt

SEQ ID NO: 7502825 - DNA, 22 bp, Homo sapiens
agagctgggtggacttgtagtt

SEQ ID NO: 7502826 - DNA, 22 bp, Homo sapiens
agagctgggtggacttgtagtt

SEQ ID NO: 7502827 - DNA, 22 bp, Homo sapiens
agagctgggtgaagtgccatca

SEQ ID NO: 7502828 - DNA, 22 bp, Homo sapiens
agagctgggtgaagtgccatca

SEQ ID NO: 7502829 - DNA, 22 bp, Homo sapiens
agagctgggtgaagtgccatca

SEQ ID NO: 7502830 - DNA, 22 bp, Homo sapiens
agagctggggctctgggtttaa

SEQ ID NO: 7502831 - DNA, 22 bp, Homo sapiens
agagctggggcccgtaaagcca

SEQ ID NO: 7502832 - DNA, 22 bp, Homo sapiens
agagctggggctctgggtttaa

SEQ ID NO: 7502833 - DNA, 22 bp, Homo sapiens
agagctggggctctgggtttaa

SEQ ID NO: 7502834 - DNA, 22 bp, Homo sapiens
agagctgggtgaagtgccatca

SEQ ID NO: 7502835 - DNA, 22 bp, Homo sapiens
agagctgggtgaagtgccatca

SEQ ID NO: 7502836 - DNA, 22 bp, Homo sapiens
agagctgggtgaagtgccatca

SEQ ID NO: 7502837 - DNA, 22 bp, Homo sapiens
agagctggggccagagtcaagg

SEQ ID NO: 7502838 - DNA, 22 bp, Homo sapiens
agagctggggccagagtcaagg

SEQ ID NO: 7502839 - DNA, 22 bp, Homo sapiens
agagctggggccagagtcaagg

SEQ ID NO: 7502840 - DNA, 22 bp, Homo sapiens
agagctggggcccgtaaagcca

SEQ ID NO: 7502841 - DNA, 22 bp, Homo sapiens
agagctggggcccgtaaagcca

SEQ ID NO: 7502842 - DNA, 22 bp, Homo sapiens
agagctggggcccgtaaagcca

SEQ ID NO: 7502843 - DNA, 22 bp, Homo sapiens
agagctggggccagagtcaagg

SEQ ID NO: 7502844 - DNA, 22 bp, Homo sapiens
agagctggggccagagtcaagg

SEQ ID NO: 7502845 - DNA, 22 bp, Homo sapiens
agagctggggccagagtcaagg

SEQ ID NO: 7502846 - DNA, 22 bp, Homo sapiens
agaggccccatgggatggcggt

SEQ ID NO: 7502847 - DNA, 22 bp, Homo sapiens
agaggccccaggtgagcatgcc

SEQ ID NO: 7502848 - DNA, 22 bp, Homo sapiens
agaggccccaggtgagcatgcc

SEQ ID NO: 7502849 - DNA, 21 bp, Homo sapiens
agaggccctcggactgggcgt

SEQ ID NO: 7502850 - DNA, 21 bp, Homo sapiens
agaggccctcggactgggcgt

SEQ ID NO: 7502851 - DNA, 22 bp, Homo sapiens
agaggccccatgggatggcggt

SEQ ID NO: 7502852 - DNA, 22 bp, Homo sapiens
agaggccccatgggatggcggt

SEQ ID NO: 7502853 - DNA, 22 bp, Homo sapiens
agaggccatggggcatttttca

SEQ ID NO: 7502854 - DNA, 22 bp, Homo sapiens
agaggccccaggtgagcatgcc

SEQ ID NO: 7502855 - DNA, 22 bp, Homo sapiens
agaggccccaggtgagcatgcc

SEQ ID NO: 7502856 - DNA, 22 bp, Homo sapiens
agaggccatggggcatttttca

SEQ ID NO: 7502857 - DNA, 22 bp, Homo sapiens
agaggccatggggcatttttca

SEQ ID NO: 7502858 - DNA, 22 bp, Homo sapiens
agaggccatgctagaggcctgg

SEQ ID NO: 7502859 - DNA, 22 bp, Homo sapiens
agaggccatgctagaggcctgg

SEQ ID NO: 7502860 - DNA, 22 bp, Homo sapiens
agaggccatgctagaggcctgg

SEQ ID NO: 7502861 - DNA, 22 bp, Homo sapiens
agaggccatgctagaggcctgg

SEQ ID NO: 7502862 - DNA, 22 bp, Homo sapiens
agaggccatgctagaggcctgg

SEQ ID NO: 7502863 - DNA, 20 bp, Homo sapiens
acaaaataggtactgggtag

SEQ ID NO: 7502864 - DNA, 20 bp, Homo sapiens
acaaaataggtactgggtag

SEQ ID NO: 7502865 - DNA, 20 bp, Homo sapiens
acaaaataggtactgggtag

SEQ ID NO: 7502866 - DNA, 20 bp, Homo sapiens
acaaaataggtactgggtag

SEQ ID NO: 7502867 - DNA, 20 bp, Homo sapiens
acaaaataggtactgggtag

SEQ ID NO: 7502868 - DNA, 20 bp, Homo sapiens
acaaaataggtactgggtag

SEQ ID NO: 7502869 - DNA, 20 bp, Homo sapiens
acaaaataggtactgggtag

SEQ ID NO: 7502870 - DNA, 20 bp, Homo sapiens
acaaaataggtactgggtag

SEQ ID NO: 7502871 - DNA, 22 bp, Homo sapiens
acaaaaagctccattactgtcc

SEQ ID NO: 7502872 - DNA, 21 bp, Homo sapiens
agaggccctcggactgggcgt

SEQ ID NO: 7502873 - DNA, 22 bp, Homo sapiens
acaaaaagggagatgaggtaga

SEQ ID NO: 7502874 - DNA, 22 bp, Homo sapiens
acaaaaagggagatgaggtaga

SEQ ID NO: 7502875 - DNA, 22 bp, Homo sapiens
acaaaaagggagatgaggtaga

SEQ ID NO: 7502876 - DNA, 21 bp, Homo sapiens
agaggccctcggactgggcgt

SEQ ID NO: 7502877 - DNA, 22 bp, Homo sapiens
acaaaaagctccattactgtcc

SEQ ID NO: 7502878 - DNA, 22 bp, Homo sapiens
acaaaatagagttctcccctgg

SEQ ID NO: 7502879 - DNA, 22 bp, Homo sapiens
acaaaaagggagatgaggtaga

SEQ ID NO: 7502880 - DNA, 22 bp, Homo sapiens
acaaaaagggagatgaggtaga

SEQ ID NO: 7502881 - DNA, 22 bp, Homo sapiens
acaaaaagggagatgaggtaga

SEQ ID NO: 7502882 - DNA, 22 bp, Homo sapiens
agaggccatctgctctgtgggg

SEQ ID NO: 7502883 - DNA, 22 bp, Homo sapiens
agaggccatctgctctgtgggg

SEQ ID NO: 7502884 - DNA, 22 bp, Homo sapiens
agaggccatctgctctgtgggg

SEQ ID NO: 7502885 - DNA, 22 bp, Homo sapiens
agaggccatctgctctgtgggg

SEQ ID NO: 7502886 - DNA, 22 bp, Homo sapiens
agaggccatctgctctgtgggg

SEQ ID NO: 7502887 - DNA, 22 bp, Homo sapiens
agaggccatgctagaggcctgg

SEQ ID NO: 7502888 - DNA, 22 bp, Homo sapiens
agaggccatgctagaggcctgg

SEQ ID NO: 7502889 - DNA, 22 bp, Homo sapiens
agaggccatgctagaggcctgg

SEQ ID NO: 7502890 - DNA, 22 bp, Homo sapiens
agaggccatctgctctgtgggg

SEQ ID NO: 7502891 - DNA, 22 bp, Homo sapiens
agaggccatctgctctgtgggg

SEQ ID NO: 7502892 - DNA, 20 bp, Homo sapiens
agaggccagttaggagtcta

SEQ ID NO: 7502893 - DNA, 20 bp, Homo sapiens
agaggccagttaggagtcta

SEQ ID NO: 7502894 - DNA, 20 bp, Homo sapiens
agaggccagttaggagtcta

SEQ ID NO: 7502895 - DNA, 22 bp, Homo sapiens
agaggccatctgctctgtgggg

SEQ ID NO: 7502896 - DNA, 22 bp, Homo sapiens
agaggccatctgctctgtgggg

SEQ ID NO: 7502897 - DNA, 20 bp, Homo sapiens
agaggccagttaggagtcta

SEQ ID NO: 7502898 - DNA, 20 bp, Homo sapiens
agaggccagttaggagtcta

SEQ ID NO: 7502899 - DNA, 22 bp, Homo sapiens
agaggccagtggctgtgctgtc

SEQ ID NO: 7502900 - DNA, 22 bp, Homo sapiens
agaggccagtggctgtgctgtc

SEQ ID NO: 7502901 - DNA, 20 bp, Homo sapiens
agaggccagttaggagtcta

SEQ ID NO: 7502902 - DNA, 20 bp, Homo sapiens
agaggccagttaggagtcta

SEQ ID NO: 7502903 - DNA, 22 bp, Homo sapiens
aattttctaaggtgatgatctg

SEQ ID NO: 7502904 - DNA, 22 bp, Homo sapiens
aattttctaaggtgatgatctg

SEQ ID NO: 7502905 - DNA, 22 bp, Homo sapiens
aattttctaaggtgatgatctg

SEQ ID NO: 7502906 - DNA, 22 bp, Homo sapiens
aattttctgatgatgaagcacg

SEQ ID NO: 7502907 - DNA, 22 bp, Homo sapiens
aattttctgatgatgaagcacg

SEQ ID NO: 7502908 - DNA, 22 bp, Homo sapiens
aattttctgatgatgaagcacg

SEQ ID NO: 7502909 - DNA, 22 bp, Homo sapiens
aattttctgcctagcaaaaact

SEQ ID NO: 7502910 - DNA, 22 bp, Homo sapiens
aattttctgatgatgaagcacg

SEQ ID NO: 7502911 - DNA, 22 bp, Homo sapiens
aattttctgatgatgaagcacg

SEQ ID NO: 7502912 - DNA, 22 bp, Homo sapiens
aattttctgatgatgaagcacg

SEQ ID NO: 7502913 - DNA, 22 bp, Homo sapiens
aattttctgatgatgaagcacg

SEQ ID NO: 7502914 - DNA, 22 bp, Homo sapiens
aattttctgcctagcaaaaact

SEQ ID NO: 7502915 - DNA, 22 bp, Homo sapiens
aattttctgcctagcaaaaact

SEQ ID NO: 7502916 - DNA, 22 bp, Homo sapiens
aattttctgcctagcaaaaact

SEQ ID NO: 7502917 - DNA, 22 bp, Homo sapiens
aattttctggtgtgtaatgaag

SEQ ID NO: 7502918 - DNA, 22 bp, Homo sapiens
agaggccagtggctgtgctgtc

SEQ ID NO: 7502919 - DNA, 22 bp, Homo sapiens
agaggccagtggctgtgctgtc

SEQ ID NO: 7502920 - DNA, 22 bp, Homo sapiens
aattttctggtgtgtaatgaag

SEQ ID NO: 7502921 - DNA, 22 bp, Homo sapiens
agaggccaggtccagagtttgt

SEQ ID NO: 7502922 - DNA, 22 bp, Homo sapiens
acaaatgattttccaagccagt

SEQ ID NO: 7502923 - DNA, 22 bp, Homo sapiens
acaaatgattttccaagccagt

SEQ ID NO: 7502924 - DNA, 22 bp, Homo sapiens
acaaatgattttccaagccagt

SEQ ID NO: 7502925 - DNA, 22 bp, Homo sapiens
acaaatgattttccaagccagt

SEQ ID NO: 7502926 - DNA, 22 bp, Homo sapiens
acaaatgattttccaagccagt

SEQ ID NO: 7502927 - DNA, 22 bp, Homo sapiens
acaaatgcaagttttatgtcaa

SEQ ID NO: 7502928 - DNA, 22 bp, Homo sapiens
acaaatgcagcataaagtgaac

SEQ ID NO: 7502929 - DNA, 22 bp, Homo sapiens
acaaatgcaagttttatgtcaa

SEQ ID NO: 7502930 - DNA, 22 bp, Homo sapiens
acaaatgcagcataaagtgaac

SEQ ID NO: 7502931 - DNA, 22 bp, Homo sapiens
acaaatgcagcataaagtgaac

SEQ ID NO: 7502932 - DNA, 22 bp, Homo sapiens
acaaatgcagcataaagtgaac

SEQ ID NO: 7502933 - DNA, 20 bp, Homo sapiens
acaaatgcattctgtgacat

SEQ ID NO: 7502934 - DNA, 22 bp, Homo sapiens
acaaatgcagcataaagtgaac

SEQ ID NO: 7502935 - DNA, 20 bp, Homo sapiens
acaaatgcattctgtgacat

SEQ ID NO: 7502936 - DNA, 22 bp, Homo sapiens
acaaatgcttagttcaccaaaa

SEQ ID NO: 7502937 - DNA, 22 bp, Homo sapiens
acaaatgcttagttcaccaaaa

SEQ ID NO: 7502938 - DNA, 22 bp, Homo sapiens
acaaatgcttagttcaccaaaa

SEQ ID NO: 7502939 - DNA, 23 bp, Homo sapiens
acaaatgcccatacatctagttc

SEQ ID NO: 7502940 - DNA, 23 bp, Homo sapiens
acaaatgcccatacatctagttc

SEQ ID NO: 7502941 - DNA, 22 bp, Homo sapiens
acaaatgattttccaagccagt

SEQ ID NO: 7502942 - DNA, 22 bp, Homo sapiens
acaaatgccatatataaattct

SEQ ID NO: 7502943 - DNA, 22 bp, Homo sapiens
acaaatgccatatataaattct

SEQ ID NO: 7502944 - DNA, 22 bp, Homo sapiens
acaaatgccatatataaattct

SEQ ID NO: 7502945 - DNA, 19 bp, Homo sapiens
acaaatgatgttgcactga

SEQ ID NO: 7502946 - DNA, 22 bp, Homo sapiens
acaaatgattatcacagaggag

SEQ ID NO: 7502947 - DNA, 22 bp, Homo sapiens
acaaatgattatcacagaggag

SEQ ID NO: 7502948 - DNA, 19 bp, Homo sapiens
acaaatgatgttgcactga

SEQ ID NO: 7502949 - DNA, 22 bp, Homo sapiens
acaaatgattatcacagaggag

SEQ ID NO: 7502950 - DNA, 22 bp, Homo sapiens
acaaatgattatcacagaggag

SEQ ID NO: 7502951 - DNA, 22 bp, Homo sapiens
acaaatgattttccaagccagt

SEQ ID NO: 7502952 - DNA, 22 bp, Homo sapiens
acaaatgattttccaagccagt

SEQ ID NO: 7502953 - DNA, 22 bp, Homo sapiens
acaaatgagaatgtagacagag

SEQ ID NO: 7502954 - DNA, 19 bp, Homo sapiens
acaaatgatgttgcactga

SEQ ID NO: 7502955 - DNA, 19 bp, Homo sapiens
acaaatgatgttgcactga

SEQ ID NO: 7502956 - DNA, 19 bp, Homo sapiens
acaaatgatgttgcactga

SEQ ID NO: 7502957 - DNA, 22 bp, Homo sapiens
acaaatgagaatgtagacagag

SEQ ID NO: 7502958 - DNA, 22 bp, Homo sapiens
acaaatgactcaaacaccactt

SEQ ID NO: 7502959 - DNA, 22 bp, Homo sapiens
acaaatgagaatgtagacagag

SEQ ID NO: 7502960 - DNA, 22 bp, Homo sapiens
acaaatgagaatgtagacagag

SEQ ID NO: 7502961 - DNA, 22 bp, Homo sapiens
acaaatgagaatgtagacagag

SEQ ID NO: 7502962 - DNA, 22 bp, Homo sapiens
acaaatgagaatgtagacagag

SEQ ID NO: 7502963 - DNA, 22 bp, Homo sapiens
acaaatgagaatgtagacagag

SEQ ID NO: 7502964 - DNA, 22 bp, Homo sapiens
acaaacttatgtttcatatgta

SEQ ID NO: 7502965 - DNA, 22 bp, Homo sapiens
acaaacttatgtttcatatgta

SEQ ID NO: 7502966 - DNA, 22 bp, Homo sapiens
acaaacttatgtttcatatgta

SEQ ID NO: 7502967 - DNA, 22 bp, Homo sapiens
acaaacttatgtttcatatgta

SEQ ID NO: 7502968 - DNA, 22 bp, Homo sapiens
acaaacttccatcatgaatttt

SEQ ID NO: 7502969 - DNA, 22 bp, Homo sapiens
acaaacttccatcatgaatttt

SEQ ID NO: 7502970 - DNA, 22 bp, Homo sapiens
acaaacttccatcatgaatttt

SEQ ID NO: 7502971 - DNA, 22 bp, Homo sapiens
acaaacttccatcatgaatttt

SEQ ID NO: 7502972 - DNA, 22 bp, Homo sapiens
acaaacttcccagacaagctcc

SEQ ID NO: 7502973 - DNA, 22 bp, Homo sapiens
acaaactgggataggatcctgt

SEQ ID NO: 7502974 - DNA, 22 bp, Homo sapiens
acaaactgaatgggttttctgt

SEQ ID NO: 7502975 - DNA, 19 bp, Homo sapiens
acaaactgagtacacttgt

SEQ ID NO: 7502976 - DNA, 22 bp, Homo sapiens
acaaactacctacagatgttca

SEQ ID NO: 7502977 - DNA, 22 bp, Homo sapiens
acaaactacctacagatgttca

SEQ ID NO: 7502978 - DNA, 22 bp, Homo sapiens
acaaactacctacagatgttca

SEQ ID NO: 7502979 - DNA, 22 bp, Homo sapiens
acaaactacctacagatgttca

SEQ ID NO: 7502980 - DNA, 21 bp, Homo sapiens
acaaactgaaatgagtttcct

SEQ ID NO: 7502981 - DNA, 21 bp, Homo sapiens
acaaactgaaatgagtttcct

SEQ ID NO: 7502982 - DNA, 19 bp, Homo sapiens
acaaatagttacatatcct

SEQ ID NO: 7502983 - DNA, 22 bp, Homo sapiens
acaaatatggtactcggagaaa

SEQ ID NO: 7502984 - DNA, 22 bp, Homo sapiens
acaaatatggtactcggagaaa

SEQ ID NO: 7502985 - DNA, 22 bp, Homo sapiens
acaaacttcccagacaagctcc

SEQ ID NO: 7502986 - DNA, 19 bp, Homo sapiens
acaaatagttacatatcct

SEQ ID NO: 7502987 - DNA, 19 bp, Homo sapiens
acaaatagttacatatcct

SEQ ID NO: 7502988 - DNA, 19 bp, Homo sapiens
acaaatagttacatatcct

SEQ ID NO: 7502989 - DNA, 22 bp, Homo sapiens
acaaacttcccagacaagctcc

SEQ ID NO: 7502990 - DNA, 22 bp, Homo sapiens
acaaatgactatttggtacagg

SEQ ID NO: 7502991 - DNA, 22 bp, Homo sapiens
acaaatatggtactcggagaaa

SEQ ID NO: 7502992 - DNA, 22 bp, Homo sapiens
acaaatgactatttggtacagg

SEQ ID NO: 7502993 - DNA, 22 bp, Homo sapiens
acaaatgactatttggtacagg

SEQ ID NO: 7502994 - DNA, 22 bp, Homo sapiens
acaaatgagaatgtagacagag

SEQ ID NO: 7502995 - DNA, 22 bp, Homo sapiens
acaaatgactcaaacaccactt

SEQ ID NO: 7502996 - DNA, 22 bp, Homo sapiens
acaaatgactcaaacaccactt

SEQ ID NO: 7502997 - DNA, 22 bp, Homo sapiens
acaaatgactcaaacaccactt

SEQ ID NO: 7502998 - DNA, 22 bp, Homo sapiens
acaaatgactcaaacaccactt

SEQ ID NO: 7502999 - DNA, 22 bp, Homo sapiens
acaaaatttttagacaaggctt

SEQ ID NO: 7503000 - DNA, 22 bp, Homo sapiens
acaaaatttttagacaaggctt

SEQ ID NO: 7503001 - DNA, 22 bp, Homo sapiens
acaaaatttttagacaaggctt

SEQ ID NO: 7503002 - DNA, 22 bp, Homo sapiens
acaaacacgagacgccactgtg

SEQ ID NO: 7503003 - DNA, 22 bp, Homo sapiens
acaaacacgagacgccactgtg

SEQ ID NO: 7503004 - DNA, 22 bp, Homo sapiens
acaaacacgagacgccactgtg

SEQ ID NO: 7503005 - DNA, 22 bp, Homo sapiens
acaaacacgagacgccactgtg

SEQ ID NO: 7503006 - DNA, 22 bp, Homo sapiens
acaaacacgagacgccactgtg

SEQ ID NO: 7503007 - DNA, 22 bp, Homo sapiens
acaaaatttttagacaaggctt

SEQ ID NO: 7503008 - DNA, 22 bp, Homo sapiens
acaaaatttttagacaaggctt

SEQ ID NO: 7503009 - DNA, 22 bp, Homo sapiens
acaaaattgtgttaaactttat

SEQ ID NO: 7503010 - DNA, 22 bp, Homo sapiens
acaaaatttttagacaaggctt

SEQ ID NO: 7503011 - DNA, 22 bp, Homo sapiens
acaaaatttttagacaaggctt

SEQ ID NO: 7503012 - DNA, 22 bp, Homo sapiens
acaaaattgtgttaaactttat

SEQ ID NO: 7503013 - DNA, 22 bp, Homo sapiens
acaaaattgtgttaaactttat

SEQ ID NO: 7503014 - DNA, 22 bp, Homo sapiens
acaaaattgtgttaaactttat

SEQ ID NO: 7503015 - DNA, 22 bp, Homo sapiens
acaaaattgtgttaaactttat

SEQ ID NO: 7503016 - DNA, 22 bp, Homo sapiens
acaaaattgtgttaaactttat

SEQ ID NO: 7503017 - DNA, 22 bp, Homo sapiens
acaaaattgtgttaaactttat

SEQ ID NO: 7503018 - DNA, 22 bp, Homo sapiens
acaaaattgtgttaaactttat

SEQ ID NO: 7503019 - DNA, 22 bp, Homo sapiens
acaaaattgtgttaaactttat

SEQ ID NO: 7503020 - DNA, 22 bp, Homo sapiens
acaaaattacctagttattttc

SEQ ID NO: 7503021 - DNA, 22 bp, Homo sapiens
acaaaattacctagttattttc

SEQ ID NO: 7503022 - DNA, 22 bp, Homo sapiens
acaaaattatgaagaggccttg

SEQ ID NO: 7503023 - DNA, 22 bp, Homo sapiens
acaaaattatgaagaggccttg

SEQ ID NO: 7503024 - DNA, 22 bp, Homo sapiens
acaaaattacctagttattttc

SEQ ID NO: 7503025 - DNA, 22 bp, Homo sapiens
acaaaattacctagttattttc

SEQ ID NO: 7503026 - DNA, 22 bp, Homo sapiens
acaaaattacctagttattttc

SEQ ID NO: 7503027 - DNA, 22 bp, Homo sapiens
acaaaatcaaaggagtgattca

SEQ ID NO: 7503028 - DNA, 22 bp, Homo sapiens
acaaaatcaaaggagtgattca

SEQ ID NO: 7503029 - DNA, 22 bp, Homo sapiens
acaaaatcaaaggagtgattca

SEQ ID NO: 7503030 - DNA, 22 bp, Homo sapiens
acaaaatcaaaggagtgattca

SEQ ID NO: 7503031 - DNA, 22 bp, Homo sapiens
acaaaattacctagttattttc

SEQ ID NO: 7503032 - DNA, 22 bp, Homo sapiens
acaaaattacctagttattttc

SEQ ID NO: 7503033 - DNA, 22 bp, Homo sapiens
acaaaattacctagttattttc

SEQ ID NO: 7503034 - DNA, 22 bp, Homo sapiens
acaaaattacctagttattttc

SEQ ID NO: 7503035 - DNA, 22 bp, Homo sapiens
acaaaattacctagttattttc

SEQ ID NO: 7503036 - DNA, 23 bp, Homo sapiens
acaaaatgttctgctgggaggtg

SEQ ID NO: 7503037 - DNA, 23 bp, Homo sapiens
acaaaatgttctgctgggaggtg

SEQ ID NO: 7503038 - DNA, 22 bp, Homo sapiens
acaaacagctaacatatgttaa

SEQ ID NO: 7503039 - DNA, 22 bp, Homo sapiens
acaaacagctaacatatgttaa

SEQ ID NO: 7503040 - DNA, 22 bp, Homo sapiens
acaaacagctaacatatgttaa

SEQ ID NO: 7503041 - DNA, 22 bp, Homo sapiens
acaaacagctaacatatgttaa

SEQ ID NO: 7503042 - DNA, 22 bp, Homo sapiens
acaaacagctaacatatgttaa

SEQ ID NO: 7503043 - DNA, 22 bp, Homo sapiens
acaaacagctaacatatgttaa

SEQ ID NO: 7503044 - DNA, 22 bp, Homo sapiens
acaaacagagttgaaaaatagg

SEQ ID NO: 7503045 - DNA, 22 bp, Homo sapiens
acaaacagagttgaaaaatagg

SEQ ID NO: 7503046 - DNA, 22 bp, Homo sapiens
acaaacagctaacatatgttaa

SEQ ID NO: 7503047 - DNA, 22 bp, Homo sapiens
acaaacagctaacatatgttaa

SEQ ID NO: 7503048 - DNA, 22 bp, Homo sapiens
acaaacagagttgaaaaatagg

SEQ ID NO: 7503049 - DNA, 22 bp, Homo sapiens
acaaacagagttgaaaaatagg

SEQ ID NO: 7503050 - DNA, 22 bp, Homo sapiens
acaaacagagttgaaaaatagg

SEQ ID NO: 7503051 - DNA, 22 bp, Homo sapiens
acaaacagagttgaaaaatagg

SEQ ID NO: 7503052 - DNA, 22 bp, Homo sapiens
acaaacagagttgaaaaatagg

SEQ ID NO: 7503053 - DNA, 22 bp, Homo sapiens
acaaacagagttgaaaaatagg

SEQ ID NO: 7503054 - DNA, 22 bp, Homo sapiens
acaaacagagttgaaaaatagg

SEQ ID NO: 7503055 - DNA, 22 bp, Homo sapiens
acaaacagagttgaaaaatagg

SEQ ID NO: 7503056 - DNA, 22 bp, Homo sapiens
acaaacagagttgaaaaatagg

SEQ ID NO: 7503057 - DNA, 22 bp, Homo sapiens
acaaacagagttgaaaaatagg

SEQ ID NO: 7503058 - DNA, 22 bp, Homo sapiens
acaaacagagttgaaaaatagg

SEQ ID NO: 7503059 - DNA, 22 bp, Homo sapiens
acaaacagagttgaaaaatagg

SEQ ID NO: 7503060 - DNA, 22 bp, Homo sapiens
acaaacagagttgaaaaatagg

SEQ ID NO: 7503061 - DNA, 22 bp, Homo sapiens
acaaactaaaattctttattga

SEQ ID NO: 7503062 - DNA, 22 bp, Homo sapiens
acaaactaaaattctttattga

SEQ ID NO: 7503063 - DNA, 22 bp, Homo sapiens
acaaactaaaattctttattga

SEQ ID NO: 7503064 - DNA, 22 bp, Homo sapiens
acaaactaaaattctttattga

SEQ ID NO: 7503065 - DNA, 22 bp, Homo sapiens
acaaactaaaattctttattga

SEQ ID NO: 7503066 - DNA, 22 bp, Homo sapiens
acaaaccagcttaagcaagatg

SEQ ID NO: 7503067 - DNA, 22 bp, Homo sapiens
acaaaccagcttaagcaagatg

SEQ ID NO: 7503068 - DNA, 22 bp, Homo sapiens
acaaacatcttgacctcagatt

SEQ ID NO: 7503069 - DNA, 22 bp, Homo sapiens
acaaacatcttgacctcagatt

SEQ ID NO: 7503070 - DNA, 22 bp, Homo sapiens
acaaacatcttgacctcagatt

SEQ ID NO: 7503071 - DNA, 22 bp, Homo sapiens
acaaacatcttgacctcagatt

SEQ ID NO: 7503072 - DNA, 22 bp, Homo sapiens
acaaacatcttgacctcagatt

SEQ ID NO: 7503073 - DNA, 22 bp, Homo sapiens
acaaacatcttgacctcagatt

SEQ ID NO: 7503074 - DNA, 22 bp, Homo sapiens
acaaacagctaacatatgttaa

SEQ ID NO: 7503075 - DNA, 22 bp, Homo sapiens
acaaacagctaacatatgttaa

SEQ ID NO: 7503076 - DNA, 22 bp, Homo sapiens
acaaaccagcttaagcaagatg

SEQ ID NO: 7503077 - DNA, 22 bp, Homo sapiens
acaaaccagcttaagcaagatg

SEQ ID NO: 7503078 - DNA, 22 bp, Homo sapiens
acaaacatcttgacctcagatt

SEQ ID NO: 7503079 - DNA, 22 bp, Homo sapiens
acaaaccagcttaagcaagatg

SEQ ID NO: 7503080 - DNA, 22 bp, Homo sapiens
acaaattatagaaaattgagct

SEQ ID NO: 7503081 - DNA, 22 bp, Homo sapiens
acaaattatagaaaattgagct

SEQ ID NO: 7503082 - DNA, 22 bp, Homo sapiens
acaaattatagaaaattgagct

SEQ ID NO: 7503083 - DNA, 22 bp, Homo sapiens
acaaattatagaaaattgagct

SEQ ID NO: 7503084 - DNA, 22 bp, Homo sapiens
acaaattatagaaaattgagct

SEQ ID NO: 7503085 - DNA, 22 bp, Homo sapiens
acaaattaccatggaatttggg

SEQ ID NO: 7503086 - DNA, 22 bp, Homo sapiens
acaaattaccatggaatttggg

SEQ ID NO: 7503087 - DNA, 22 bp, Homo sapiens
acaaattaccatggaatttggg

SEQ ID NO: 7503088 - DNA, 22 bp, Homo sapiens
acaaattatagaaaattgagct

SEQ ID NO: 7503089 - DNA, 22 bp, Homo sapiens
acaaattatagaaaattgagct

SEQ ID NO: 7503090 - DNA, 22 bp, Homo sapiens
acaaattatagaaaattgagct

SEQ ID NO: 7503091 - DNA, 22 bp, Homo sapiens
acaaattatagaaaattgagct

SEQ ID NO: 7503092 - DNA, 22 bp, Homo sapiens
acaaatgttggatttgtcttcc

SEQ ID NO: 7503093 - DNA, 22 bp, Homo sapiens
acaaatgttggatttgtcttcc

SEQ ID NO: 7503094 - DNA, 22 bp, Homo sapiens
acaaatgttggatttgtcttcc

SEQ ID NO: 7503095 - DNA, 22 bp, Homo sapiens
acaaatgttggatttgtcttcc

SEQ ID NO: 7503096 - DNA, 22 bp, Homo sapiens
acaaatgttacataagtttgga

SEQ ID NO: 7503097 - DNA, 22 bp, Homo sapiens
acaaatgttacataagtttgga

SEQ ID NO: 7503098 - DNA, 22 bp, Homo sapiens
acaaatgttacataagtttgga

SEQ ID NO: 7503099 - DNA, 22 bp, Homo sapiens
acaaatgttacataagtttgga

SEQ ID NO: 7503100 - DNA, 22 bp, Homo sapiens
acaagggattgttgagtagtct

SEQ ID NO: 7503101 - DNA, 22 bp, Homo sapiens
acaagggattgttgagtagtct

SEQ ID NO: 7503102 - DNA, 20 bp, Homo sapiens
acaaggaaccaggaggtggc

SEQ ID NO: 7503103 - DNA, 20 bp, Homo sapiens
acaaggaaccaggaggtggc

SEQ ID NO: 7503104 - DNA, 22 bp, Homo sapiens
acaaggctttggagggttctta

SEQ ID NO: 7503105 - DNA, 20 bp, Homo sapiens
acaaggaaccaggaggtggc

SEQ ID NO: 7503106 - DNA, 22 bp, Homo sapiens
acaaggaacaagcatgtagttt

SEQ ID NO: 7503107 - DNA, 22 bp, Homo sapiens
acaaggaacaagcatgtagttt

SEQ ID NO: 7503108 - DNA, 22 bp, Homo sapiens
acaaattgaccgcaagattcat

SEQ ID NO: 7503109 - DNA, 22 bp, Homo sapiens
acaaattgaccgcaagattcat

SEQ ID NO: 7503110 - DNA, 22 bp, Homo sapiens
acaaattctttctgcctattgg

SEQ ID NO: 7503111 - DNA, 22 bp, Homo sapiens
acaagctttgtgatagtagaga

SEQ ID NO: 7503112 - DNA, 22 bp, Homo sapiens
acaaattgaccgcaagattcat

SEQ ID NO: 7503113 - DNA, 22 bp, Homo sapiens
acaaattctacaatcatatgat

SEQ ID NO: 7503114 - DNA, 22 bp, Homo sapiens
acaaattctacaatcatatgat

SEQ ID NO: 7503115 - DNA, 22 bp, Homo sapiens
acaaattctacaatcatatgat

SEQ ID NO: 7503116 - DNA, 22 bp, Homo sapiens
acaaattctacaatcatatgat

SEQ ID NO: 7503117 - DNA, 22 bp, Homo sapiens
acaaattctacaatcatatgat

SEQ ID NO: 7503118 - DNA, 22 bp, Homo sapiens
acaaattctctaggcaaggaag

SEQ ID NO: 7503119 - DNA, 22 bp, Homo sapiens
acaaattctctaggcaaggaag

SEQ ID NO: 7503120 - DNA, 22 bp, Homo sapiens
acaaattctctaggcaaggaag

SEQ ID NO: 7503121 - DNA, 22 bp, Homo sapiens
acaaattctttctgcctattgg

SEQ ID NO: 7503122 - DNA, 22 bp, Homo sapiens
acaaattctttctgcctattgg

SEQ ID NO: 7503123 - DNA, 22 bp, Homo sapiens
acaaatgtgattgtttctgaaa

SEQ ID NO: 7503124 - DNA, 22 bp, Homo sapiens
acaaatgtgattgtttctgaaa

SEQ ID NO: 7503125 - DNA, 22 bp, Homo sapiens
acaaatgtggacatggataatg

SEQ ID NO: 7503126 - DNA, 22 bp, Homo sapiens
acaaatgtgattgtttctgaaa

SEQ ID NO: 7503127 - DNA, 22 bp, Homo sapiens
acaaatgtgattgtttctgaaa

SEQ ID NO: 7503128 - DNA, 22 bp, Homo sapiens
acaaatgtctcctcttttgtta

SEQ ID NO: 7503129 - DNA, 22 bp, Homo sapiens
acaaatgtctcctcttttgtta

SEQ ID NO: 7503130 - DNA, 23 bp, Homo sapiens
acaaatgtctagagagggtgtga

SEQ ID NO: 7503131 - DNA, 22 bp, Homo sapiens
acaaatgtggacatggataatg

SEQ ID NO: 7503132 - DNA, 22 bp, Homo sapiens
acaaatgtgattgtttctgaaa

SEQ ID NO: 7503133 - DNA, 22 bp, Homo sapiens
acaaatgtggacatggataatg

SEQ ID NO: 7503134 - DNA, 22 bp, Homo sapiens
acaaatgtgtctaattgtgcct

SEQ ID NO: 7503135 - DNA, 22 bp, Homo sapiens
acaaatgtggacatggataatg

SEQ ID NO: 7503136 - DNA, 22 bp, Homo sapiens
acaaatgtctacattgagaata

SEQ ID NO: 7503137 - DNA, 22 bp, Homo sapiens
acaaatgtctacattgagaata

SEQ ID NO: 7503138 - DNA, 18 bp, Homo sapiens
acaaatgtagtgtcttaa

SEQ ID NO: 7503139 - DNA, 22 bp, Homo sapiens
acaaatgtctacattgagaata

SEQ ID NO: 7503140 - DNA, 22 bp, Homo sapiens
acaaatgtctacattgagaata

SEQ ID NO: 7503141 - DNA, 22 bp, Homo sapiens
acaaatgtctacattgagaata

SEQ ID NO: 7503142 - DNA, 22 bp, Homo sapiens
acaaatgtctacattgagaata

SEQ ID NO: 7503143 - DNA, 22 bp, Homo sapiens
acaaatgtctcctcttttgtta

SEQ ID NO: 7503144 - DNA, 22 bp, Homo sapiens
acaaatgtctacattgagaata

SEQ ID NO: 7503145 - DNA, 18 bp, Homo sapiens
acaaatgtagtgtcttaa

SEQ ID NO: 7503146 - DNA, 22 bp, Homo sapiens
acaaatggagaaactgaggccc

SEQ ID NO: 7503147 - DNA, 18 bp, Homo sapiens
acaaatgtagtgtcttaa

SEQ ID NO: 7503148 - DNA, 22 bp, Homo sapiens
acaaatggagaaactgaggccc

SEQ ID NO: 7503149 - DNA, 22 bp, Homo sapiens
acaaatggactctcatcttttg

SEQ ID NO: 7503150 - DNA, 22 bp, Homo sapiens
acaaatggactctcatcttttg

SEQ ID NO: 7503151 - DNA, 22 bp, Homo sapiens
acaaatggaacaatgaagactg

SEQ ID NO: 7503152 - DNA, 22 bp, Homo sapiens
acaaatggaacaatgaagactg

SEQ ID NO: 7503153 - DNA, 22 bp, Homo sapiens
acaaatggaacaatgaagactg

SEQ ID NO: 7503154 - DNA, 22 bp, Homo sapiens
acaaatggaaggtgttctcttc

SEQ ID NO: 7503155 - DNA, 22 bp, Homo sapiens
agatggggcagaatggagccat

SEQ ID NO: 7503156 - DNA, 22 bp, Homo sapiens
agatggggcagaatggagccat

SEQ ID NO: 7503157 - DNA, 22 bp, Homo sapiens
agatggggctcagtgtggaggc

SEQ ID NO: 7503158 - DNA, 22 bp, Homo sapiens
agatggggctcagtgtggaggc

SEQ ID NO: 7503159 - DNA, 22 bp, Homo sapiens
agatggggctcagtgtggaggc

SEQ ID NO: 7503160 - DNA, 22 bp, Homo sapiens
agatggggctcagtgtggaggc

SEQ ID NO: 7503161 - DNA, 22 bp, Homo sapiens
agatggggctcagtgtggaggc

SEQ ID NO: 7503162 - DNA, 22 bp, Homo sapiens
agatggggcagaatggagccat

SEQ ID NO: 7503163 - DNA, 22 bp, Homo sapiens
agatggggcagaatggagccat

SEQ ID NO: 7503164 - DNA, 22 bp, Homo sapiens
agatggggcagaatggagccat

SEQ ID NO: 7503165 - DNA, 22 bp, Homo sapiens
agatggggcagaatggagccat

SEQ ID NO: 7503166 - DNA, 19 bp, Homo sapiens
agatggggaagagtgtgag

SEQ ID NO: 7503167 - DNA, 19 bp, Homo sapiens
agatggggaagagtgtgag

SEQ ID NO: 7503168 - DNA, 19 bp, Homo sapiens
agatggggaagagtgtgag

SEQ ID NO: 7503169 - DNA, 22 bp, Homo sapiens
acaagttctgggaattaggaca

SEQ ID NO: 7503170 - DNA, 22 bp, Homo sapiens
acaagtttatttgattagaaca

SEQ ID NO: 7503171 - DNA, 22 bp, Homo sapiens
acaagtttatttgattagaaca

SEQ ID NO: 7503172 - DNA, 22 bp, Homo sapiens
acaagttaggttttaatccaaa

SEQ ID NO: 7503173 - DNA, 22 bp, Homo sapiens
acaagttaggttttaatccaaa

SEQ ID NO: 7503174 - DNA, 22 bp, Homo sapiens
acaagttaccaaaaaagattca

SEQ ID NO: 7503175 - DNA, 22 bp, Homo sapiens
acaagttaccaaaaaagattca

SEQ ID NO: 7503176 - DNA, 22 bp, Homo sapiens
acaagtttatttgattagaaca

SEQ ID NO: 7503177 - DNA, 22 bp, Homo sapiens
acaagtttatttgattagaaca

SEQ ID NO: 7503178 - DNA, 22 bp, Homo sapiens
acaagtttcattgtttagaacc

SEQ ID NO: 7503179 - DNA, 22 bp, Homo sapiens
acaagtttatttgattagaaca

SEQ ID NO: 7503180 - DNA, 22 bp, Homo sapiens
acaagtttcattgtttagaacc

SEQ ID NO: 7503181 - DNA, 22 bp, Homo sapiens
acaagtttcattgtttagaacc

SEQ ID NO: 7503182 - DNA, 19 bp, Homo sapiens
agatggggaagagtgtgag

SEQ ID NO: 7503183 - DNA, 19 bp, Homo sapiens
agatggggaagagtgtgag

SEQ ID NO: 7503184 - DNA, 19 bp, Homo sapiens
agatggggaagagtgtgag

SEQ ID NO: 7503185 - DNA, 22 bp, Homo sapiens
acaaggtttaaatagccatcag

SEQ ID NO: 7503186 - DNA, 22 bp, Homo sapiens
acaaggtttggtaccacatcca

SEQ ID NO: 7503187 - DNA, 22 bp, Homo sapiens
acaagtagtaaattattaggtg

SEQ ID NO: 7503188 - DNA, 22 bp, Homo sapiens
acaagtatttaaggttagtata

SEQ ID NO: 7503189 - DNA, 22 bp, Homo sapiens
acaagtcactctatcattttca

SEQ ID NO: 7503190 - DNA, 19 bp, Homo sapiens
acaagtcacttacttagta

SEQ ID NO: 7503191 - DNA, 22 bp, Homo sapiens
acaaggttctatggcgtctgtg

SEQ ID NO: 7503192 - DNA, 22 bp, Homo sapiens
acaaggtatccacattaaatgt

SEQ ID NO: 7503193 - DNA, 22 bp, Homo sapiens
acaaggtatccacattaaatgt

SEQ ID NO: 7503194 - DNA, 22 bp, Homo sapiens
acaaggttcttagagctgggat

SEQ ID NO: 7503195 - DNA, 22 bp, Homo sapiens
acaaggttgattctggcatctg

SEQ ID NO: 7503196 - DNA, 22 bp, Homo sapiens
acaaggttggctctttctttgt

SEQ ID NO: 7503197 - DNA, 22 bp, Homo sapiens
acaagtgggtcctacataaagc

SEQ ID NO: 7503198 - DNA, 22 bp, Homo sapiens
acaagtgtgtgcagtttgtaaa

SEQ ID NO: 7503199 - DNA, 22 bp, Homo sapiens
acaagtgtgtgcagtttgtaaa

SEQ ID NO: 7503200 - DNA, 22 bp, Homo sapiens
acaagtgtgtgcagtttgtaaa

SEQ ID NO: 7503201 - DNA, 22 bp, Homo sapiens
acaagttaccaaaaaagattca

SEQ ID NO: 7503202 - DNA, 22 bp, Homo sapiens
acaagttaccaaaaaagattca

SEQ ID NO: 7503203 - DNA, 22 bp, Homo sapiens
acaagtgttgcattttgccatt

SEQ ID NO: 7503204 - DNA, 22 bp, Homo sapiens
acaagtgttgcattttgccatt

SEQ ID NO: 7503205 - DNA, 19 bp, Homo sapiens
acaagtcacttacttagta

SEQ ID NO: 7503206 - DNA, 19 bp, Homo sapiens
acaagtcacttacttagta

SEQ ID NO: 7503207 - DNA, 22 bp, Homo sapiens
acaagtctttttcatgtcttct

SEQ ID NO: 7503208 - DNA, 22 bp, Homo sapiens
acaagtgcatggaatcagctgt

SEQ ID NO: 7503209 - DNA, 22 bp, Homo sapiens
acaagtgcatggaatcagctgt

SEQ ID NO: 7503210 - DNA, 22 bp, Homo sapiens
acaagtggctacctagattata

SEQ ID NO: 7503211 - DNA, 22 bp, Homo sapiens
acaagtctttttcatgtcttct

SEQ ID NO: 7503212 - DNA, 22 bp, Homo sapiens
acaagtctttttcatgtcttct

SEQ ID NO: 7503213 - DNA, 22 bp, Homo sapiens
agcacaggtacggagatgctac

SEQ ID NO: 7503214 - DNA, 22 bp, Homo sapiens
agcaaggcagtcagctggctgg

SEQ ID NO: 7503215 - DNA, 22 bp, Homo sapiens
agcaaggcagtcagctggctgg

SEQ ID NO: 7503216 - DNA, 22 bp, Homo sapiens
agcacaggtacggagatgctac

SEQ ID NO: 7503217 - DNA, 22 bp, Homo sapiens
agcacaggtacggagatgctac

SEQ ID NO: 7503218 - DNA, 20 bp, Homo sapiens
agcaccagtgggggcagccc

SEQ ID NO: 7503219 - DNA, 20 bp, Homo sapiens
agcaccagtgggggcagccc

SEQ ID NO: 7503220 - DNA, 20 bp, Homo sapiens
agcaccagtgggggcagccc

SEQ ID NO: 7503221 - DNA, 20 bp, Homo sapiens
agcaccagtgggggcagccc

SEQ ID NO: 7503222 - DNA, 22 bp, Homo sapiens
agcacaggtacggagatgctac

SEQ ID NO: 7503223 - DNA, 20 bp, Homo sapiens
agcaccagtgggggcagccc

SEQ ID NO: 7503224 - DNA, 20 bp, Homo sapiens
agcaccagtgggggcagccc

SEQ ID NO: 7503225 - DNA, 20 bp, Homo sapiens
agcaccagtgggggcagccc

SEQ ID NO: 7503226 - DNA, 19 bp, Homo sapiens
agcaccatagccctgaaag

SEQ ID NO: 7503227 - DNA, 21 bp, Homo sapiens
agcaccagttttatgccaggc

SEQ ID NO: 7503228 - DNA, 22 bp, Homo sapiens
agcaccatcgggttcttgcttt

SEQ ID NO: 7503229 - DNA, 21 bp, Homo sapiens
agcaccagttttatgccaggc

SEQ ID NO: 7503230 - DNA, 21 bp, Homo sapiens
agcaccagttttatgccaggc

SEQ ID NO: 7503231 - DNA, 21 bp, Homo sapiens
agcaccagttttatgccaggc

SEQ ID NO: 7503232 - DNA, 22 bp, Homo sapiens
agcaccagtttcgtcgtgacaa

SEQ ID NO: 7503233 - DNA, 20 bp, Homo sapiens
agcaccagtgggggcagccc

SEQ ID NO: 7503234 - DNA, 22 bp, Homo sapiens
agcaccagtttcgtcgtgacaa

SEQ ID NO: 7503235 - DNA, 22 bp, Homo sapiens
agcaccagtttcgtcgtgacaa

SEQ ID NO: 7503236 - DNA, 22 bp, Homo sapiens
agcaaggcagtcagctggctgg

SEQ ID NO: 7503237 - DNA, 22 bp, Homo sapiens
agcaaggcagtcagctggctgg

SEQ ID NO: 7503238 - DNA, 22 bp, Homo sapiens
agcacaggtacggagatgctac

SEQ ID NO: 7503239 - DNA, 22 bp, Homo sapiens
agcacaggtacggagatgctac

SEQ ID NO: 7503240 - DNA, 22 bp, Homo sapiens
agcacaggtacggagatgctac

SEQ ID NO: 7503241 - DNA, 22 bp, Homo sapiens
agcacaggtacggagatgctac

SEQ ID NO: 7503242 - DNA, 22 bp, Homo sapiens
agcaaggcagctttcactgctt

SEQ ID NO: 7503243 - DNA, 22 bp, Homo sapiens
agcaaggcagctttcactgctt

SEQ ID NO: 7503244 - DNA, 22 bp, Homo sapiens
agcaaggcagctttcactgctt

SEQ ID NO: 7503245 - DNA, 22 bp, Homo sapiens
agcaaggcagctttcactgctt

SEQ ID NO: 7503246 - DNA, 21 bp, Homo sapiens
agcaaggcagcctctcagcct

SEQ ID NO: 7503247 - DNA, 21 bp, Homo sapiens
agcaaggcagcctctcagcct

SEQ ID NO: 7503248 - DNA, 22 bp, Homo sapiens
agcaaggagtagaacaagagtg

SEQ ID NO: 7503249 - DNA, 22 bp, Homo sapiens
agcaaggagtagaacaagagtg

SEQ ID NO: 7503250 - DNA, 22 bp, Homo sapiens
agcaaggaaagtaggcacggaa

SEQ ID NO: 7503251 - DNA, 22 bp, Homo sapiens
agcaaggaaagtaggcacggaa

SEQ ID NO: 7503252 - DNA, 22 bp, Homo sapiens
agcaaggaaagtaggcacggaa

SEQ ID NO: 7503253 - DNA, 22 bp, Homo sapiens
agcaaggaaactatggagagat

SEQ ID NO: 7503254 - DNA, 22 bp, Homo sapiens
agcaagctgtcaagagagctga

SEQ ID NO: 7503255 - DNA, 22 bp, Homo sapiens
agcaagctgtcaagagagctga

SEQ ID NO: 7503256 - DNA, 22 bp, Homo sapiens
agcaagctggaggggctcatga

SEQ ID NO: 7503257 - DNA, 22 bp, Homo sapiens
agcaagctcttggaaatgagct

SEQ ID NO: 7503258 - DNA, 22 bp, Homo sapiens
agcaaggaaactatggagagat

SEQ ID NO: 7503259 - DNA, 22 bp, Homo sapiens
agcaaggaaactatggagagat

SEQ ID NO: 7503260 - DNA, 22 bp, Homo sapiens
agcaaggaaactatggagagat

SEQ ID NO: 7503261 - DNA, 22 bp, Homo sapiens
agcaaggaaactatggagagat

SEQ ID NO: 7503262 - DNA, 18 bp, Homo sapiens
agcaagcagttttcatgt

SEQ ID NO: 7503263 - DNA, 18 bp, Homo sapiens
agcaagcagttttcatgt

SEQ ID NO: 7503264 - DNA, 18 bp, Homo sapiens
agcaagcagttttcatgt

SEQ ID NO: 7503265 - DNA, 22 bp, Homo sapiens
agcaagcagtgaagttgaatgt

SEQ ID NO: 7503266 - DNA, 22 bp, Homo sapiens
agcaagcagtgaagttgaatgt

SEQ ID NO: 7503267 - DNA, 18 bp, Homo sapiens
agcaagcagttttcatgt

SEQ ID NO: 7503268 - DNA, 22 bp, Homo sapiens
agcaagctaacataggagattg

SEQ ID NO: 7503269 - DNA, 18 bp, Homo sapiens
agcaagcagttttcatgt

SEQ ID NO: 7503270 - DNA, 22 bp, Homo sapiens
agcaagcattgctggttaggtc

SEQ ID NO: 7503271 - DNA, 22 bp, Homo sapiens
agcaagcacacttcatgtgaac

SEQ ID NO: 7503272 - DNA, 22 bp, Homo sapiens
agcaagatttttcaggttagta

SEQ ID NO: 7503273 - DNA, 22 bp, Homo sapiens
agcaagcacacttcatgtgaac

SEQ ID NO: 7503274 - DNA, 22 bp, Homo sapiens
agcaagcacacttcatgtgaac

SEQ ID NO: 7503275 - DNA, 22 bp, Homo sapiens
agcaagcagaaatgccatggca

SEQ ID NO: 7503276 - DNA, 22 bp, Homo sapiens
agcaagcagaaatgccatggca

SEQ ID NO: 7503277 - DNA, 22 bp, Homo sapiens
agcaagcagaattctgtcctct

SEQ ID NO: 7503278 - DNA, 22 bp, Homo sapiens
agcaagcagaattctgtcctct

SEQ ID NO: 7503279 - DNA, 22 bp, Homo sapiens
agcaagcagaattctgtcctct

SEQ ID NO: 7503280 - DNA, 21 bp, Homo sapiens
agcaagcagaatccatctaga

SEQ ID NO: 7503281 - DNA, 21 bp, Homo sapiens
agcaagcagaatccatctaga

SEQ ID NO: 7503282 - DNA, 22 bp, Homo sapiens
agcaagatttaaacccaggtca

SEQ ID NO: 7503283 - DNA, 22 bp, Homo sapiens
agcaagatttaaacccaggtca

SEQ ID NO: 7503284 - DNA, 22 bp, Homo sapiens
agcaagattgaggcttcctcag

SEQ ID NO: 7503285 - DNA, 22 bp, Homo sapiens
agcaagattgaggcttcctcag

SEQ ID NO: 7503286 - DNA, 22 bp, Homo sapiens
agcaagatttttcaggttagta

SEQ ID NO: 7503287 - DNA, 22 bp, Homo sapiens
agcaagattttccttgaatgtt

SEQ ID NO: 7503288 - DNA, 22 bp, Homo sapiens
agcaagattttccttgaatgtt

SEQ ID NO: 7503289 - DNA, 22 bp, Homo sapiens
agcaagattgaggcttcctcag

SEQ ID NO: 7503290 - DNA, 22 bp, Homo sapiens
acaatggcatgctagcaaatgg

SEQ ID NO: 7503291 - DNA, 22 bp, Homo sapiens
acaatgtagaggctgaaagcaa

SEQ ID NO: 7503292 - DNA, 22 bp, Homo sapiens
acaatgcttggtttttctagaa

SEQ ID NO: 7503293 - DNA, 22 bp, Homo sapiens
acaatgtagaggctgaaagcaa

SEQ ID NO: 7503294 - DNA, 22 bp, Homo sapiens
acaatgtagaggctgaaagcaa

SEQ ID NO: 7503295 - DNA, 22 bp, Homo sapiens
acaatggcatgctagcaaatgg

SEQ ID NO: 7503296 - DNA, 22 bp, Homo sapiens
acaatgctgttgagacattctt

SEQ ID NO: 7503297 - DNA, 22 bp, Homo sapiens
acaatgcttggtttttctagaa

SEQ ID NO: 7503298 - DNA, 22 bp, Homo sapiens
acaatgctgttgagacattctt

SEQ ID NO: 7503299 - DNA, 22 bp, Homo sapiens
agatgggtaattgatggcagta

SEQ ID NO: 7503300 - DNA, 22 bp, Homo sapiens
agatgggtaactggagtctgct

SEQ ID NO: 7503301 - DNA, 22 bp, Homo sapiens
acaatgtttttgttcaaagagt

SEQ ID NO: 7503302 - DNA, 22 bp, Homo sapiens
acaatgtttttgttcaaagagt

SEQ ID NO: 7503303 - DNA, 22 bp, Homo sapiens
acaatgtttttgttcaaagagt

SEQ ID NO: 7503304 - DNA, 22 bp, Homo sapiens
acaatgtttttgttcaaagagt

SEQ ID NO: 7503305 - DNA, 22 bp, Homo sapiens
agatgggtaactggagtctgct

SEQ ID NO: 7503306 - DNA, 22 bp, Homo sapiens
agatggggtttcatcatgttgg

SEQ ID NO: 7503307 - DNA, 22 bp, Homo sapiens
agatggggtttcatcatgttgg

SEQ ID NO: 7503308 - DNA, 22 bp, Homo sapiens
agatggggctgaaagttccaat

SEQ ID NO: 7503309 - DNA, 22 bp, Homo sapiens
agatggggctgaaagttccaat

SEQ ID NO: 7503310 - DNA, 22 bp, Homo sapiens
agatggggctgaaagttccaat

SEQ ID NO: 7503311 - DNA, 22 bp, Homo sapiens
agatggggctgaaagttccaat

SEQ ID NO: 7503312 - DNA, 22 bp, Homo sapiens
agatggggctcagtgtggaggc

SEQ ID NO: 7503313 - DNA, 22 bp, Homo sapiens
agatggggctgaaagttccaat

SEQ ID NO: 7503314 - DNA, 22 bp, Homo sapiens
agatggggctcagtgtggaggc

SEQ ID NO: 7503315 - DNA, 22 bp, Homo sapiens
agatggggctcagtgtggaggc

SEQ ID NO: 7503316 - DNA, 22 bp, Homo sapiens
agatggggctcagtgtggaggc

SEQ ID NO: 7503317 - DNA, 22 bp, Homo sapiens
agatggggctcagtgtggaggc

SEQ ID NO: 7503318 - DNA, 22 bp, Homo sapiens
agatggggctgaaagttccaat

SEQ ID NO: 7503319 - DNA, 22 bp, Homo sapiens
agatggggctcagtgtggaggc

SEQ ID NO: 7503320 - DNA, 22 bp, Homo sapiens
agatggggctcagtgtggaggc

SEQ ID NO: 7503321 - DNA, 22 bp, Homo sapiens
agatggggctcagtgtggaggc

SEQ ID NO: 7503322 - DNA, 22 bp, Homo sapiens
acaattagctgtgtgtctatct

SEQ ID NO: 7503323 - DNA, 22 bp, Homo sapiens
acaattagcaaggggaagattt

SEQ ID NO: 7503324 - DNA, 22 bp, Homo sapiens
acaattagcaaggggaagattt

SEQ ID NO: 7503325 - DNA, 22 bp, Homo sapiens
acaattagctgtgtgtctatct

SEQ ID NO: 7503326 - DNA, 22 bp, Homo sapiens
acaattagctgtgtgtctatct

SEQ ID NO: 7503327 - DNA, 22 bp, Homo sapiens
acaattactcaactttgctgct

SEQ ID NO: 7503328 - DNA, 22 bp, Homo sapiens
acaattactcaactttgctgct

SEQ ID NO: 7503329 - DNA, 22 bp, Homo sapiens
acaattaccctggcttgataaa

SEQ ID NO: 7503330 - DNA, 22 bp, Homo sapiens
acaattaccctggcttgataaa

SEQ ID NO: 7503331 - DNA, 22 bp, Homo sapiens
acaattaccctggcttgataaa

SEQ ID NO: 7503332 - DNA, 22 bp, Homo sapiens
acaattagtgatcagtgatgcc

SEQ ID NO: 7503333 - DNA, 22 bp, Homo sapiens
acaattcaagaagagagatgaa

SEQ ID NO: 7503334 - DNA, 22 bp, Homo sapiens
acaattcaagaagagagatgaa

SEQ ID NO: 7503335 - DNA, 22 bp, Homo sapiens
acaattcaagaagagagatgaa

SEQ ID NO: 7503336 - DNA, 22 bp, Homo sapiens
acaattcaagatgagattcagg

SEQ ID NO: 7503337 - DNA, 22 bp, Homo sapiens
acaattcaagaagagagatgaa

SEQ ID NO: 7503338 - DNA, 22 bp, Homo sapiens
acaattcaagatgagattcagg

SEQ ID NO: 7503339 - DNA, 22 bp, Homo sapiens
acaattcaagatgagattcagg

SEQ ID NO: 7503340 - DNA, 22 bp, Homo sapiens
acaattcaagatgagattcagg

SEQ ID NO: 7503341 - DNA, 22 bp, Homo sapiens
acaattcaagatgagattcagg

SEQ ID NO: 7503342 - DNA, 22 bp, Homo sapiens
acaattctgatggtttcccagt

SEQ ID NO: 7503343 - DNA, 22 bp, Homo sapiens
acaattctgatggtttcccagt

SEQ ID NO: 7503344 - DNA, 22 bp, Homo sapiens
acaattctctcatatcttatta

SEQ ID NO: 7503345 - DNA, 22 bp, Homo sapiens
acaattccacatggcatgcagg

SEQ ID NO: 7503346 - DNA, 22 bp, Homo sapiens
acaattctctcatatcttatta

SEQ ID NO: 7503347 - DNA, 22 bp, Homo sapiens
agcaagattgaggcttcctcag

SEQ ID NO: 7503348 - DNA, 22 bp, Homo sapiens
agcaagattgaggcttcctcag

SEQ ID NO: 7503349 - DNA, 22 bp, Homo sapiens
agcaagattgaggcttcctcag

SEQ ID NO: 7503350 - DNA, 22 bp, Homo sapiens
acaattctgatggtttcccagt

SEQ ID NO: 7503351 - DNA, 22 bp, Homo sapiens
acaattctgatggtttcccagt

SEQ ID NO: 7503352 - DNA, 22 bp, Homo sapiens
acaattctctcatatcttatta

SEQ ID NO: 7503353 - DNA, 22 bp, Homo sapiens
acaattcctgagaatacttgtt

SEQ ID NO: 7503354 - DNA, 22 bp, Homo sapiens
acaattctctcatatcttatta

SEQ ID NO: 7503355 - DNA, 22 bp, Homo sapiens
acaattcattaatgtgaggtag

SEQ ID NO: 7503356 - DNA, 22 bp, Homo sapiens
acaattcaagcaagagagacaa

SEQ ID NO: 7503357 - DNA, 22 bp, Homo sapiens
acaattccacatggcatgcagg

SEQ ID NO: 7503358 - DNA, 22 bp, Homo sapiens
acaattcattaatgtgaggtag

SEQ ID NO: 7503359 - DNA, 22 bp, Homo sapiens
acaattcaagcaagagagacaa

SEQ ID NO: 7503360 - DNA, 22 bp, Homo sapiens
acactgtgtctagcattttaca

SEQ ID NO: 7503361 - DNA, 22 bp, Homo sapiens
agcagtggctggatggtgtgct

SEQ ID NO: 7503362 - DNA, 22 bp, Homo sapiens
agcagtggctggatggtgtgct

SEQ ID NO: 7503363 - DNA, 22 bp, Homo sapiens
agcagtgggtgacagagctgag

SEQ ID NO: 7503364 - DNA, 22 bp, Homo sapiens
agcagtgggggagtgttagttt

SEQ ID NO: 7503365 - DNA, 22 bp, Homo sapiens
agcagtgggggagtgttagttt

SEQ ID NO: 7503366 - DNA, 22 bp, Homo sapiens
agcagtggtccccaacctttct

SEQ ID NO: 7503367 - DNA, 22 bp, Homo sapiens
agcagtggtgtgaggagggctc

SEQ ID NO: 7503368 - DNA, 22 bp, Homo sapiens
agcagtgggtgacagagctgag

SEQ ID NO: 7503369 - DNA, 22 bp, Homo sapiens
agcagtgggtgacagagctgag

SEQ ID NO: 7503370 - DNA, 22 bp, Homo sapiens
agcagtgggtgacagagctgag

SEQ ID NO: 7503371 - DNA, 22 bp, Homo sapiens
agcagtgggtgacagagctgag

SEQ ID NO: 7503372 - DNA, 22 bp, Homo sapiens
agcagtgggtgacagagctgag

SEQ ID NO: 7503373 - DNA, 22 bp, Homo sapiens
acactgtgcagattccctgtga

SEQ ID NO: 7503374 - DNA, 22 bp, Homo sapiens
acactgtgcagattccctgtga

SEQ ID NO: 7503375 - DNA, 22 bp, Homo sapiens
acactgtgatcttgagaaaggt

SEQ ID NO: 7503376 - DNA, 22 bp, Homo sapiens
acactgtgatttctgggttcca

SEQ ID NO: 7503377 - DNA, 22 bp, Homo sapiens
acactgtgcatgcatatacaca

SEQ ID NO: 7503378 - DNA, 22 bp, Homo sapiens
acactgtgcatgcatatacaca

SEQ ID NO: 7503379 - DNA, 22 bp, Homo sapiens
acactgtgcatgcatatacaca

SEQ ID NO: 7503380 - DNA, 20 bp, Homo sapiens
acactgtgctaaggattttc

SEQ ID NO: 7503381 - DNA, 22 bp, Homo sapiens
acactgtgcatgcatatacaca

SEQ ID NO: 7503382 - DNA, 22 bp, Homo sapiens
acactgtgcagattccctgtga

SEQ ID NO: 7503383 - DNA, 22 bp, Homo sapiens
acactgtgcagattccctgtga

SEQ ID NO: 7503384 - DNA, 22 bp, Homo sapiens
acactgtgtctagcattttaca

SEQ ID NO: 7503385 - DNA, 22 bp, Homo sapiens
acactgtgtctagcattttaca

SEQ ID NO: 7503386 - DNA, 21 bp, Homo sapiens
acactgtgtcataatgcttaa

SEQ ID NO: 7503387 - DNA, 21 bp, Homo sapiens
acactgtgtcataatgcttaa

SEQ ID NO: 7503388 - DNA, 21 bp, Homo sapiens
acactgtgtcataatgcttaa

SEQ ID NO: 7503389 - DNA, 22 bp, Homo sapiens
acactgtgcttagatgctgaac

SEQ ID NO: 7503390 - DNA, 20 bp, Homo sapiens
acactgtgctaaggattttc

SEQ ID NO: 7503391 - DNA, 22 bp, Homo sapiens
acactgtgcttagatgctgaac

SEQ ID NO: 7503392 - DNA, 22 bp, Homo sapiens
acactgtgcttagatgctgaac

SEQ ID NO: 7503393 - DNA, 22 bp, Homo sapiens
acactgtgcttagatgctgaac

SEQ ID NO: 7503394 - DNA, 22 bp, Homo sapiens
agcagttacgggcctatctagg

SEQ ID NO: 7503395 - DNA, 22 bp, Homo sapiens
agcagttaccaaggaacctggt

SEQ ID NO: 7503396 - DNA, 22 bp, Homo sapiens
agcagtgtttgtgactttagat

SEQ ID NO: 7503397 - DNA, 22 bp, Homo sapiens
agcagtgttctaatctggctag

SEQ ID NO: 7503398 - DNA, 22 bp, Homo sapiens
agcagtgttcaatgatacactg

SEQ ID NO: 7503399 - DNA, 22 bp, Homo sapiens
agcagtgttctaatctggctag

SEQ ID NO: 7503400 - DNA, 22 bp, Homo sapiens
agcagttactagttaaatgcat

SEQ ID NO: 7503401 - DNA, 22 bp, Homo sapiens
agcagttactagttaaatgcat

SEQ ID NO: 7503402 - DNA, 22 bp, Homo sapiens
agcagttactagttaaatgcat

SEQ ID NO: 7503403 - DNA, 22 bp, Homo sapiens
acagaaagataggcacaaggtc

SEQ ID NO: 7503404 - DNA, 22 bp, Homo sapiens
acagaaagataggcacaaggtc

SEQ ID NO: 7503405 - DNA, 22 bp, Homo sapiens
acagaaagatgatttgaaatgg

SEQ ID NO: 7503406 - DNA, 22 bp, Homo sapiens
acagaaagatgatttgaaatgg

SEQ ID NO: 7503407 - DNA, 22 bp, Homo sapiens
acagaaagatgatttgaaatgg

SEQ ID NO: 7503408 - DNA, 19 bp, Homo sapiens
acagaaatgtaagtgagac

SEQ ID NO: 7503409 - DNA, 22 bp, Homo sapiens
acagaaagataggcacaaggtc

SEQ ID NO: 7503410 - DNA, 22 bp, Homo sapiens
acagaaagataggcacaaggtc

SEQ ID NO: 7503411 - DNA, 22 bp, Homo sapiens
acagaaagataggcacaaggtc

SEQ ID NO: 7503412 - DNA, 22 bp, Homo sapiens
agcagtggtgtgaggagggctc

SEQ ID NO: 7503413 - DNA, 22 bp, Homo sapiens
agcagtggtgtgaggagggctc

SEQ ID NO: 7503414 - DNA, 22 bp, Homo sapiens
agcagtggtgtgaggagggctc

SEQ ID NO: 7503415 - DNA, 22 bp, Homo sapiens
agcagtgttcaatgatacactg

SEQ ID NO: 7503416 - DNA, 22 bp, Homo sapiens
agcagtgttcaatgatacactg

SEQ ID NO: 7503417 - DNA, 22 bp, Homo sapiens
agcagtgtgcttcgtttcatga

SEQ ID NO: 7503418 - DNA, 18 bp, Homo sapiens
agcagtgtggcaagcaga

SEQ ID NO: 7503419 - DNA, 22 bp, Homo sapiens
agcagtgtggccttagacccgg

SEQ ID NO: 7503420 - DNA, 18 bp, Homo sapiens
agcagtgtggcaagcaga

SEQ ID NO: 7503421 - DNA, 22 bp, Homo sapiens
agcagtgtgggctgcacgctgg

SEQ ID NO: 7503422 - DNA, 22 bp, Homo sapiens
acagaaattgggcaaatggaag

SEQ ID NO: 7503423 - DNA, 22 bp, Homo sapiens
acagaaattgggcaaatggaag

SEQ ID NO: 7503424 - DNA, 22 bp, Homo sapiens
acagaaattgggcaaatggaag

SEQ ID NO: 7503425 - DNA, 22 bp, Homo sapiens
acagaaattgggcaaatggaag

SEQ ID NO: 7503426 - DNA, 22 bp, Homo sapiens
acagaaattgggcaaatggaag

SEQ ID NO: 7503427 - DNA, 22 bp, Homo sapiens
acagaaattgggcaaatggaag

SEQ ID NO: 7503428 - DNA, 22 bp, Homo sapiens
acagaaattgggcaaatggaag

SEQ ID NO: 7503429 - DNA, 22 bp, Homo sapiens
acagaacaacaaggtggaccag

SEQ ID NO: 7503430 - DNA, 22 bp, Homo sapiens
acagaaattgggcaaatggaag

SEQ ID NO: 7503431 - DNA, 22 bp, Homo sapiens
acagaacaacaaggtggaccag

SEQ ID NO: 7503432 - DNA, 22 bp, Homo sapiens
acagaacaagacctgcttattg

SEQ ID NO: 7503433 - DNA, 22 bp, Homo sapiens
acagaacaagacctgcttattg

SEQ ID NO: 7503434 - DNA, 22 bp, Homo sapiens
acagaacaagacctgcttattg

SEQ ID NO: 7503435 - DNA, 22 bp, Homo sapiens
acagaacaagacctgcttattg

SEQ ID NO: 7503436 - DNA, 22 bp, Homo sapiens
agccacaggaaacagagacagc

SEQ ID NO: 7503437 - DNA, 22 bp, Homo sapiens
acagaacaagacctgcttattg

SEQ ID NO: 7503438 - DNA, 22 bp, Homo sapiens
acagaacaagacctgcttattg

SEQ ID NO: 7503439 - DNA, 22 bp, Homo sapiens
acagaacaacaaggtggaccag

SEQ ID NO: 7503440 - DNA, 22 bp, Homo sapiens
acagaacaacaaggtggaccag

SEQ ID NO: 7503441 - DNA, 22 bp, Homo sapiens
acagaacaacaaggtggaccag

SEQ ID NO: 7503442 - DNA, 22 bp, Homo sapiens
agccacaggtgttggccagtgt

SEQ ID NO: 7503443 - DNA, 22 bp, Homo sapiens
agccacagggggtgagggacaa

SEQ ID NO: 7503444 - DNA, 22 bp, Homo sapiens
agccacaggtgttggccagtgt

SEQ ID NO: 7503445 - DNA, 22 bp, Homo sapiens
agccacagggggtgagggacaa

SEQ ID NO: 7503446 - DNA, 22 bp, Homo sapiens
agccacagggggtgagggacaa

SEQ ID NO: 7503447 - DNA, 22 bp, Homo sapiens
agccacagggggtgagggacaa

SEQ ID NO: 7503448 - DNA, 22 bp, Homo sapiens
agccacaggccatgagatacca

SEQ ID NO: 7503449 - DNA, 22 bp, Homo sapiens
agccacagggggtgagggacaa

SEQ ID NO: 7503450 - DNA, 22 bp, Homo sapiens
agccacagggggtgagggacaa

SEQ ID NO: 7503451 - DNA, 22 bp, Homo sapiens
agccacagggggtgagggacaa

SEQ ID NO: 7503452 - DNA, 22 bp, Homo sapiens
agccacagggggtgagggacaa

SEQ ID NO: 7503453 - DNA, 22 bp, Homo sapiens
agccacaggccatgagatacca

SEQ ID NO: 7503454 - DNA, 22 bp, Homo sapiens
agccacaggccatgagatacca

SEQ ID NO: 7503455 - DNA, 22 bp, Homo sapiens
agccacaggccatgagatacca

SEQ ID NO: 7503456 - DNA, 22 bp, Homo sapiens
agccacaggccatgagatacca

SEQ ID NO: 7503457 - DNA, 22 bp, Homo sapiens
agccacaggccatgagatacca

SEQ ID NO: 7503458 - DNA, 22 bp, Homo sapiens
agccacaggccatgagatacca

SEQ ID NO: 7503459 - DNA, 22 bp, Homo sapiens
agccacaggaaacagagacagc

SEQ ID NO: 7503460 - DNA, 22 bp, Homo sapiens
agccacaggaaacagagacagc

SEQ ID NO: 7503461 - DNA, 22 bp, Homo sapiens
agccacaggaaacagagacagc

SEQ ID NO: 7503462 - DNA, 22 bp, Homo sapiens
agccacaggaaacagagacagc

SEQ ID NO: 7503463 - DNA, 22 bp, Homo sapiens
agccacaggaaacagagacagc

SEQ ID NO: 7503464 - DNA, 19 bp, Homo sapiens
acagaaattagttattttc

SEQ ID NO: 7503465 - DNA, 19 bp, Homo sapiens
acagaaattagttattttc

SEQ ID NO: 7503466 - DNA, 19 bp, Homo sapiens
acagaaattagttattttc

SEQ ID NO: 7503467 - DNA, 19 bp, Homo sapiens
acagaaattagttattttc

SEQ ID NO: 7503468 - DNA, 22 bp, Homo sapiens
acagaaattagcagtgagttta

SEQ ID NO: 7503469 - DNA, 22 bp, Homo sapiens
acagaaattagcagtgagttta

SEQ ID NO: 7503470 - DNA, 22 bp, Homo sapiens
acagaaattagcagtgagttta

SEQ ID NO: 7503471 - DNA, 22 bp, Homo sapiens
acagaaattagcagtgagttta

SEQ ID NO: 7503472 - DNA, 22 bp, Homo sapiens
acagaaattagcagtgagttta

SEQ ID NO: 7503473 - DNA, 22 bp, Homo sapiens
acagaaattcaaactggaattt

SEQ ID NO: 7503474 - DNA, 22 bp, Homo sapiens
acagaaattcaaactggaattt

SEQ ID NO: 7503475 - DNA, 19 bp, Homo sapiens
acagaaattagttattttc

SEQ ID NO: 7503476 - DNA, 22 bp, Homo sapiens
acagaaattcaaactggaattt

SEQ ID NO: 7503477 - DNA, 22 bp, Homo sapiens
acagaaattcaaactggaattt

SEQ ID NO: 7503478 - DNA, 19 bp, Homo sapiens
acagaaattagttattttc

SEQ ID NO: 7503479 - DNA, 19 bp, Homo sapiens
acagaaattagttattttc

SEQ ID NO: 7503480 - DNA, 22 bp, Homo sapiens
acagaaattcaaactggaattt

SEQ ID NO: 7503481 - DNA, 22 bp, Homo sapiens
acagaaattcaaactggaattt

SEQ ID NO: 7503482 - DNA, 22 bp, Homo sapiens
acagaaattcaaactggaattt

SEQ ID NO: 7503483 - DNA, 22 bp, Homo sapiens
acagaaattcaaactggaattt

SEQ ID NO: 7503484 - DNA, 22 bp, Homo sapiens
acagaaattctgggacagaaaa

SEQ ID NO: 7503485 - DNA, 22 bp, Homo sapiens
acagaaattctgggacagaaaa

SEQ ID NO: 7503486 - DNA, 22 bp, Homo sapiens
acagaaattctgggacagaaaa

SEQ ID NO: 7503487 - DNA, 22 bp, Homo sapiens
acagaaattctgggacagaaaa

SEQ ID NO: 7503488 - DNA, 22 bp, Homo sapiens
acagaaattctgggacagaaaa

SEQ ID NO: 7503489 - DNA, 22 bp, Homo sapiens
acagaaattctgggacagaaaa

SEQ ID NO: 7503490 - DNA, 22 bp, Homo sapiens
acagaaattctgggacagaaaa

SEQ ID NO: 7503491 - DNA, 22 bp, Homo sapiens
acagaaattctgggacagaaaa

SEQ ID NO: 7503492 - DNA, 22 bp, Homo sapiens
acagaaattgctaatagctcat

SEQ ID NO: 7503493 - DNA, 22 bp, Homo sapiens
acagaaattgctaatagctcat

SEQ ID NO: 7503494 - DNA, 22 bp, Homo sapiens
acagaaattgctaatagctcat

SEQ ID NO: 7503495 - DNA, 22 bp, Homo sapiens
acagaaattgctaatagctcat

SEQ ID NO: 7503496 - DNA, 22 bp, Homo sapiens
acagaaattctgggacagaaaa

SEQ ID NO: 7503497 - DNA, 22 bp, Homo sapiens
acagaaattctgggacagaaaa

SEQ ID NO: 7503498 - DNA, 22 bp, Homo sapiens
acagaaattctgggacagaaaa

SEQ ID NO: 7503499 - DNA, 22 bp, Homo sapiens
acagaaattgctaatagctcat

SEQ ID NO: 7503500 - DNA, 22 bp, Homo sapiens
acagaaattgggcaaatggaag

SEQ ID NO: 7503501 - DNA, 22 bp, Homo sapiens
acagaaattgggcaaatggaag

SEQ ID NO: 7503502 - DNA, 22 bp, Homo sapiens
acagaaattgggcaaatggaag

SEQ ID NO: 7503503 - DNA, 22 bp, Homo sapiens
acagaaattgctaatagctcat

SEQ ID NO: 7503504 - DNA, 22 bp, Homo sapiens
acagaaattgctaatagctcat

SEQ ID NO: 7503505 - DNA, 22 bp, Homo sapiens
acagaaattgctaatagctcat

SEQ ID NO: 7503506 - DNA, 22 bp, Homo sapiens
acagaaattgctaatagctcat

SEQ ID NO: 7503507 - DNA, 22 bp, Homo sapiens
acacattttcaacactgtcaag

SEQ ID NO: 7503508 - DNA, 22 bp, Homo sapiens
acacattttcaacactgtcaag

SEQ ID NO: 7503509 - DNA, 22 bp, Homo sapiens
acacattttcaacactgtcaag

SEQ ID NO: 7503510 - DNA, 22 bp, Homo sapiens
acacattttcaacactgtcaag

SEQ ID NO: 7503511 - DNA, 22 bp, Homo sapiens
acacattttcaacactgtcaag

SEQ ID NO: 7503512 - DNA, 22 bp, Homo sapiens
acacattttcaacactgtcaag

SEQ ID NO: 7503513 - DNA, 22 bp, Homo sapiens
acacattttcaacactgtcaag

SEQ ID NO: 7503514 - DNA, 22 bp, Homo sapiens
acacattttcaacactgtcaag

SEQ ID NO: 7503515 - DNA, 22 bp, Homo sapiens
acacattttcaacactgtcaag

SEQ ID NO: 7503516 - DNA, 22 bp, Homo sapiens
acacattttcaacactgtcaag

SEQ ID NO: 7503517 - DNA, 22 bp, Homo sapiens
acacattttggctaggtggaga

SEQ ID NO: 7503518 - DNA, 22 bp, Homo sapiens
acacattttgttaaaccctgtg

SEQ ID NO: 7503519 - DNA, 22 bp, Homo sapiens
acacattttggctaggtggaga

SEQ ID NO: 7503520 - DNA, 23 bp, Homo sapiens
acacatttttcccgttctgaggt

SEQ ID NO: 7503521 - DNA, 23 bp, Homo sapiens
acacatttttcccgttctgaggt

SEQ ID NO: 7503522 - DNA, 22 bp, Homo sapiens
acacattttgttaaaccctgtg

SEQ ID NO: 7503523 - DNA, 22 bp, Homo sapiens
acacattttctaacagggatca

SEQ ID NO: 7503524 - DNA, 22 bp, Homo sapiens
acacattttctaacagggatca

SEQ ID NO: 7503525 - DNA, 22 bp, Homo sapiens
acacattttctaacagggatca

SEQ ID NO: 7503526 - DNA, 23 bp, Homo sapiens
acacatttttcccgttctgaggt

SEQ ID NO: 7503527 - DNA, 23 bp, Homo sapiens
acacatttttcccgttctgaggt

SEQ ID NO: 7503528 - DNA, 23 bp, Homo sapiens
acacatttttcccgttctgaggt

SEQ ID NO: 7503529 - DNA, 23 bp, Homo sapiens
acacatttttcccgttctgaggt

SEQ ID NO: 7503530 - DNA, 23 bp, Homo sapiens
acacatttttcccgttctgaggt

SEQ ID NO: 7503531 - DNA, 23 bp, Homo sapiens
acacatttttcccgttctgaggt

SEQ ID NO: 7503532 - DNA, 22 bp, Homo sapiens
acaccaaagtagaattaatgta

SEQ ID NO: 7503533 - DNA, 23 bp, Homo sapiens
acacatttttcccgttctgaggt

SEQ ID NO: 7503534 - DNA, 22 bp, Homo sapiens
acaccaaagtagaattaatgta

SEQ ID NO: 7503535 - DNA, 22 bp, Homo sapiens
acaccaaagtagaattaatgta

SEQ ID NO: 7503536 - DNA, 22 bp, Homo sapiens
acaccaaagtagaattaatgta

SEQ ID NO: 7503537 - DNA, 22 bp, Homo sapiens
acaccagggatatgaggaagga

SEQ ID NO: 7503538 - DNA, 22 bp, Homo sapiens
agcagggcagtgcttcagctct

SEQ ID NO: 7503539 - DNA, 22 bp, Homo sapiens
acaccacaagtaactcttttcc

SEQ ID NO: 7503540 - DNA, 22 bp, Homo sapiens
acaccaaagtagaattaatgta

SEQ ID NO: 7503541 - DNA, 22 bp, Homo sapiens
acaccaccgtcccagcctcctg

SEQ ID NO: 7503542 - DNA, 22 bp, Homo sapiens
acaccagcctcgcccgtgtgtt

SEQ ID NO: 7503543 - DNA, 22 bp, Homo sapiens
acaccagggatatgaggaagga

SEQ ID NO: 7503544 - DNA, 22 bp, Homo sapiens
acacatttgctaaaatgagctc

SEQ ID NO: 7503545 - DNA, 22 bp, Homo sapiens
acacatttgcataatacctcat

SEQ ID NO: 7503546 - DNA, 22 bp, Homo sapiens
acacatttgctaaaatgagctc

SEQ ID NO: 7503547 - DNA, 22 bp, Homo sapiens
acacatttgctaaaatgagctc

SEQ ID NO: 7503548 - DNA, 22 bp, Homo sapiens
acacatttgcataatacctcat

SEQ ID NO: 7503549 - DNA, 22 bp, Homo sapiens
acacatttgctaaaatgagctc

SEQ ID NO: 7503550 - DNA, 22 bp, Homo sapiens
acacatttgctaaaatgagctc

SEQ ID NO: 7503551 - DNA, 22 bp, Homo sapiens
acacatttgctaaaatgagctc

SEQ ID NO: 7503552 - DNA, 22 bp, Homo sapiens
acacatttgggctcctacataa

SEQ ID NO: 7503553 - DNA, 22 bp, Homo sapiens
acacatttgggctcctacataa

SEQ ID NO: 7503554 - DNA, 22 bp, Homo sapiens
acacatttgggctcctacataa

SEQ ID NO: 7503555 - DNA, 22 bp, Homo sapiens
acacatttgctaaaatgagctc

SEQ ID NO: 7503556 - DNA, 22 bp, Homo sapiens
acacatttgggctcctacataa

SEQ ID NO: 7503557 - DNA, 22 bp, Homo sapiens
acacatttgggctcctacataa

SEQ ID NO: 7503558 - DNA, 19 bp, Homo sapiens
acacatttgcacaatccac

SEQ ID NO: 7503559 - DNA, 22 bp, Homo sapiens
acacatttctctttttgtaagt

SEQ ID NO: 7503560 - DNA, 19 bp, Homo sapiens
acacatttgcacaatccac

SEQ ID NO: 7503561 - DNA, 19 bp, Homo sapiens
acacatttgcacaatccac

SEQ ID NO: 7503562 - DNA, 22 bp, Homo sapiens
acacatttgcataatacctcat

SEQ ID NO: 7503563 - DNA, 19 bp, Homo sapiens
acacatttgcacaatccac

SEQ ID NO: 7503564 - DNA, 22 bp, Homo sapiens
acacatttgcataatacctcat

SEQ ID NO: 7503565 - DNA, 22 bp, Homo sapiens
acacattatctcattaaatact

SEQ ID NO: 7503566 - DNA, 22 bp, Homo sapiens
acacattatctcattaaatact

SEQ ID NO: 7503567 - DNA, 22 bp, Homo sapiens
acacattatctcattaaatact

SEQ ID NO: 7503568 - DNA, 22 bp, Homo sapiens
acacattatctcattaaatact

SEQ ID NO: 7503569 - DNA, 22 bp, Homo sapiens
acacattatctcattaaatact

SEQ ID NO: 7503570 - DNA, 22 bp, Homo sapiens
acacatttctctttttgtaagt

SEQ ID NO: 7503571 - DNA, 22 bp, Homo sapiens
acacatttctctttttgtaagt

SEQ ID NO: 7503572 - DNA, 22 bp, Homo sapiens
acacatttctctttttgtaagt

SEQ ID NO: 7503573 - DNA, 22 bp, Homo sapiens
acacattatctcattaaatact

SEQ ID NO: 7503574 - DNA, 22 bp, Homo sapiens
acacatttctctttttgtaagt

SEQ ID NO: 7503575 - DNA, 23 bp, Homo sapiens
agcaggaaaccgagggtgatgtt

SEQ ID NO: 7503576 - DNA, 23 bp, Homo sapiens
agcaggaaaccgagggtgatgtt

SEQ ID NO: 7503577 - DNA, 23 bp, Homo sapiens
agcaggaaaccgagggtgatgtt

SEQ ID NO: 7503578 - DNA, 23 bp, Homo sapiens
agcaggaaaccgagggtgatgtt

SEQ ID NO: 7503579 - DNA, 23 bp, Homo sapiens
agcaggaaaccgagggtgatgtt

SEQ ID NO: 7503580 - DNA, 23 bp, Homo sapiens
agcaggaaaccgagggtgatgtt

SEQ ID NO: 7503581 - DNA, 22 bp, Homo sapiens
agcaggaaagaaaaatctgtgt

SEQ ID NO: 7503582 - DNA, 22 bp, Homo sapiens
agcaggaaagaaaaatctgtgt

SEQ ID NO: 7503583 - DNA, 23 bp, Homo sapiens
agcaggaaaccgagggtgatgtt

SEQ ID NO: 7503584 - DNA, 19 bp, Homo sapiens
acactgtagatatagctat

SEQ ID NO: 7503585 - DNA, 22 bp, Homo sapiens
acactgtagatatagagttagt

SEQ ID NO: 7503586 - DNA, 19 bp, Homo sapiens
acactgtagatatagctat

SEQ ID NO: 7503587 - DNA, 22 bp, Homo sapiens
acactgtagactgttgaagtac

SEQ ID NO: 7503588 - DNA, 22 bp, Homo sapiens
acactgtagatatagagttagt

SEQ ID NO: 7503589 - DNA, 22 bp, Homo sapiens
acactgtagatatagagttagt

SEQ ID NO: 7503590 - DNA, 22 bp, Homo sapiens
acactgtagctgagggcatgcg

SEQ ID NO: 7503591 - DNA, 22 bp, Homo sapiens
acactgtagctgagggcatgcg

SEQ ID NO: 7503592 - DNA, 22 bp, Homo sapiens
acactgtaggagaaaggagttt

SEQ ID NO: 7503593 - DNA, 22 bp, Homo sapiens
acactgtaggagaaaggagttt

SEQ ID NO: 7503594 - DNA, 22 bp, Homo sapiens
acactgtaggagaaaggagttt

SEQ ID NO: 7503595 - DNA, 22 bp, Homo sapiens
acactgtatgaaaacaggaaat

SEQ ID NO: 7503596 - DNA, 22 bp, Homo sapiens
acactgtagactgttgaagtac

SEQ ID NO: 7503597 - DNA, 22 bp, Homo sapiens
acactgtaaattgagtgcgtga

SEQ ID NO: 7503598 - DNA, 22 bp, Homo sapiens
acactgtaaattgagtgcgtga

SEQ ID NO: 7503599 - DNA, 22 bp, Homo sapiens
acactgtaaagtgatgcttaaa

SEQ ID NO: 7503600 - DNA, 22 bp, Homo sapiens
acactgtaaagtgatgcttaaa

SEQ ID NO: 7503601 - DNA, 18 bp, Homo sapiens
acactgcagcagtctgct

SEQ ID NO: 7503602 - DNA, 18 bp, Homo sapiens
acactgcagcagtctgct

SEQ ID NO: 7503603 - DNA, 18 bp, Homo sapiens
acactgcagcagtctgct

SEQ ID NO: 7503604 - DNA, 18 bp, Homo sapiens
acactgcagcagtctgct

SEQ ID NO: 7503605 - DNA, 22 bp, Homo sapiens
acactgtaaacatctcaagcac

SEQ ID NO: 7503606 - DNA, 18 bp, Homo sapiens
acactgcagcagtctgct

SEQ ID NO: 7503607 - DNA, 22 bp, Homo sapiens
acactgtgacaaaggctgttct

SEQ ID NO: 7503608 - DNA, 22 bp, Homo sapiens
acactgtctgggactcaggagt

SEQ ID NO: 7503609 - DNA, 22 bp, Homo sapiens
acactgtctgggactcaggagt

SEQ ID NO: 7503610 - DNA, 22 bp, Homo sapiens
acactgtgacaaaggctgttct

SEQ ID NO: 7503611 - DNA, 22 bp, Homo sapiens
acactgtgacaagaaagagctg

SEQ ID NO: 7503612 - DNA, 22 bp, Homo sapiens
acactgtgacaagaaagagctg

SEQ ID NO: 7503613 - DNA, 22 bp, Homo sapiens
acactgtgacggaaataaagaa

SEQ ID NO: 7503614 - DNA, 22 bp, Homo sapiens
acactgtgacggaaataaagaa

SEQ ID NO: 7503615 - DNA, 22 bp, Homo sapiens
acactgtgagctgaagggctgc

SEQ ID NO: 7503616 - DNA, 22 bp, Homo sapiens
acactgtgagctgaagggctgc

SEQ ID NO: 7503617 - DNA, 22 bp, Homo sapiens
acactgtgacggaaataaagaa

SEQ ID NO: 7503618 - DNA, 22 bp, Homo sapiens
acactgtgagctgaagggctgc

SEQ ID NO: 7503619 - DNA, 22 bp, Homo sapiens
acactgtgagctgaagggctgc

SEQ ID NO: 7503620 - DNA, 22 bp, Homo sapiens
acactgtgagctgaagggctgc

SEQ ID NO: 7503621 - DNA, 22 bp, Homo sapiens
acactgtatgaaaacaggaaat

SEQ ID NO: 7503622 - DNA, 22 bp, Homo sapiens
acactgtatgaaaacaggaaat

SEQ ID NO: 7503623 - DNA, 22 bp, Homo sapiens
acactgtctcatatgaggggac

SEQ ID NO: 7503624 - DNA, 23 bp, Homo sapiens
acactgtctcatggatagactgc

SEQ ID NO: 7503625 - DNA, 22 bp, Homo sapiens
acactgtctcatatgaggggac

SEQ ID NO: 7503626 - DNA, 23 bp, Homo sapiens
acactgtctcatggatagactgc

SEQ ID NO: 7503627 - DNA, 23 bp, Homo sapiens
acactgtctcatggatagactgc

SEQ ID NO: 7503628 - DNA, 22 bp, Homo sapiens
acactgtctgggactcaggagt

SEQ ID NO: 7503629 - DNA, 22 bp, Homo sapiens
acactgtctgggactcaggagt

SEQ ID NO: 7503630 - DNA, 22 bp, Homo sapiens
acactgtctgggactcaggagt

SEQ ID NO: 7503631 - DNA, 22 bp, Homo sapiens
agcagggccaacagtaaacacc

SEQ ID NO: 7503632 - DNA, 18 bp, Homo sapiens
agcagggcattttgccat

SEQ ID NO: 7503633 - DNA, 22 bp, Homo sapiens
agcagggcatgaataagggttt

SEQ ID NO: 7503634 - DNA, 22 bp, Homo sapiens
agcagggcatgaataagggttt

SEQ ID NO: 7503635 - DNA, 22 bp, Homo sapiens
agcagggcatgaataagggttt

SEQ ID NO: 7503636 - DNA, 22 bp, Homo sapiens
agcagggcatgaataagggttt

SEQ ID NO: 7503637 - DNA, 22 bp, Homo sapiens
agcagggcagttaaagggtcct

SEQ ID NO: 7503638 - DNA, 22 bp, Homo sapiens
agcagggcagttaaagggtcct

SEQ ID NO: 7503639 - DNA, 22 bp, Homo sapiens
agcagggcagttaaagggtcct

SEQ ID NO: 7503640 - DNA, 23 bp, Homo sapiens
agcagggccagaatacttgctgt

SEQ ID NO: 7503641 - DNA, 23 bp, Homo sapiens
agcagggccagaatacttgctgt

SEQ ID NO: 7503642 - DNA, 22 bp, Homo sapiens
agcagggcccactaggggagat

SEQ ID NO: 7503643 - DNA, 22 bp, Homo sapiens
agcagggcccactaggggagat

SEQ ID NO: 7503644 - DNA, 22 bp, Homo sapiens
agcagggcccactaggggagat

SEQ ID NO: 7503645 - DNA, 22 bp, Homo sapiens
agcagggcccactaggggagat

SEQ ID NO: 7503646 - DNA, 22 bp, Homo sapiens
agcagggcccactaggggagat

SEQ ID NO: 7503647 - DNA, 22 bp, Homo sapiens
agcagggcccactaggggagat

SEQ ID NO: 7503648 - DNA, 22 bp, Homo sapiens
acactgcagatgaaagcataag

SEQ ID NO: 7503649 - DNA, 22 bp, Homo sapiens
acactgcagatgaaagcataag

SEQ ID NO: 7503650 - DNA, 22 bp, Homo sapiens
acactgcagatgaaagcataag

SEQ ID NO: 7503651 - DNA, 22 bp, Homo sapiens
agcagggcccactaggggagat

SEQ ID NO: 7503652 - DNA, 22 bp, Homo sapiens
agcagggcccactaggggagat

SEQ ID NO: 7503653 - DNA, 22 bp, Homo sapiens
agcagggcccactaggggagat

SEQ ID NO: 7503654 - DNA, 22 bp, Homo sapiens
agcagggcccactaggggagat

SEQ ID NO: 7503655 - DNA, 22 bp, Homo sapiens
acaattttccccataggttatc

SEQ ID NO: 7503656 - DNA, 22 bp, Homo sapiens
acaattttccccataggttatc

SEQ ID NO: 7503657 - DNA, 22 bp, Homo sapiens
acaattttccccataggttatc

SEQ ID NO: 7503658 - DNA, 22 bp, Homo sapiens
acacagatgggtagaaaacaga

SEQ ID NO: 7503659 - DNA, 22 bp, Homo sapiens
acaattttccccataggttatc

SEQ ID NO: 7503660 - DNA, 22 bp, Homo sapiens
acacagatgggtagaaaacaga

SEQ ID NO: 7503661 - DNA, 22 bp, Homo sapiens
acaattttaagccagagtgggt

SEQ ID NO: 7503662 - DNA, 22 bp, Homo sapiens
acaattttaagccagagtgggt

SEQ ID NO: 7503663 - DNA, 22 bp, Homo sapiens
acaatttggacatgtgcaggat

SEQ ID NO: 7503664 - DNA, 22 bp, Homo sapiens
acaatttctaatatagatctta

SEQ ID NO: 7503665 - DNA, 20 bp, Homo sapiens
acaatttcctcactatatgc

SEQ ID NO: 7503666 - DNA, 22 bp, Homo sapiens
acaatttctaatatagatctta

SEQ ID NO: 7503667 - DNA, 22 bp, Homo sapiens
acaatttctgatcagtgaattt

SEQ ID NO: 7503668 - DNA, 22 bp, Homo sapiens
acaatttctgatcagtgaattt

SEQ ID NO: 7503669 - DNA, 22 bp, Homo sapiens
acaatttcttatagttcaattc

SEQ ID NO: 7503670 - DNA, 22 bp, Homo sapiens
acaatttgaggctactcaattg

SEQ ID NO: 7503671 - DNA, 22 bp, Homo sapiens
acaatttgaggctactcaattg

SEQ ID NO: 7503672 - DNA, 22 bp, Homo sapiens
acaatttgaggctactcaattg

SEQ ID NO: 7503673 - DNA, 22 bp, Homo sapiens
acacaggaactctgagaggtgg

SEQ ID NO: 7503674 - DNA, 22 bp, Homo sapiens
acacaggaactctgagaggtgg

SEQ ID NO: 7503675 - DNA, 22 bp, Homo sapiens
acacaggaagagagataataat

SEQ ID NO: 7503676 - DNA, 22 bp, Homo sapiens
acacaggaagagagataataat

SEQ ID NO: 7503677 - DNA, 22 bp, Homo sapiens
acacaggaagcaatttcagagc

SEQ ID NO: 7503678 - DNA, 22 bp, Homo sapiens
acacaggaagcaatttcagagc

SEQ ID NO: 7503679 - DNA, 22 bp, Homo sapiens
acacaggaagcaatttcagagc

SEQ ID NO: 7503680 - DNA, 22 bp, Homo sapiens
acacaggaagagagataataat

SEQ ID NO: 7503681 - DNA, 22 bp, Homo sapiens
acacaggaagagagataataat

SEQ ID NO: 7503682 - DNA, 22 bp, Homo sapiens
acacaggaagagagataataat

SEQ ID NO: 7503683 - DNA, 22 bp, Homo sapiens
acacagattttacatgttatgc

SEQ ID NO: 7503684 - DNA, 22 bp, Homo sapiens
acacagattttacatgttatgc

SEQ ID NO: 7503685 - DNA, 22 bp, Homo sapiens
acacagatttcactggaataga

SEQ ID NO: 7503686 - DNA, 22 bp, Homo sapiens
acacagatttcactggaataga

SEQ ID NO: 7503687 - DNA, 22 bp, Homo sapiens
acacaggaactctgagaggtgg

SEQ ID NO: 7503688 - DNA, 22 bp, Homo sapiens
acacaggaactctgagaggtgg

SEQ ID NO: 7503689 - DNA, 22 bp, Homo sapiens
acacaggaactctgagaggtgg

SEQ ID NO: 7503690 - DNA, 22 bp, Homo sapiens
acacaggaactctgagaggtgg

SEQ ID NO: 7503691 - DNA, 22 bp, Homo sapiens
acacagattttacatgttatgc

SEQ ID NO: 7503692 - DNA, 22 bp, Homo sapiens
acacaggcaagagtgcaggtct

SEQ ID NO: 7503693 - DNA, 23 bp, Homo sapiens
acacaggatacatacggaagcaa

SEQ ID NO: 7503694 - DNA, 22 bp, Homo sapiens
acacaggcaagagtgcaggtct

SEQ ID NO: 7503695 - DNA, 23 bp, Homo sapiens
acacaggatacatacggaagcaa

SEQ ID NO: 7503696 - DNA, 23 bp, Homo sapiens
acacaggatacatacggaagcaa

SEQ ID NO: 7503697 - DNA, 23 bp, Homo sapiens
acacaggatacatacggaagcaa

SEQ ID NO: 7503698 - DNA, 23 bp, Homo sapiens
acacaggatacatacggaagcaa

SEQ ID NO: 7503699 - DNA, 22 bp, Homo sapiens
acacaggagagagttgggaagg

SEQ ID NO: 7503700 - DNA, 21 bp, Homo sapiens
acacaggagtttcttctttct

SEQ ID NO: 7503701 - DNA, 21 bp, Homo sapiens
acacaggagtttcttctttct

SEQ ID NO: 7503702 - DNA, 22 bp, Homo sapiens
acacaggaggaggatggtggtc

SEQ ID NO: 7503703 - DNA, 22 bp, Homo sapiens
acacaggaggaggatggtggtc

SEQ ID NO: 7503704 - DNA, 22 bp, Homo sapiens
acacaggaggaggatggtggtc

SEQ ID NO: 7503705 - DNA, 22 bp, Homo sapiens
acacaggaggaggatggtggtc

SEQ ID NO: 7503706 - DNA, 22 bp, Homo sapiens
acacaggaggaggatggtggtc

SEQ ID NO: 7503707 - DNA, 22 bp, Homo sapiens
acacaggaggaggatggtggtc

SEQ ID NO: 7503708 - DNA, 22 bp, Homo sapiens
acacaggagatatgtaatggct

SEQ ID NO: 7503709 - DNA, 22 bp, Homo sapiens
acacaggagatatgtaatggct

SEQ ID NO: 7503710 - DNA, 22 bp, Homo sapiens
acacaggagatatgtaatggct

SEQ ID NO: 7503711 - DNA, 22 bp, Homo sapiens
acacaggagatatgtaatggct

SEQ ID NO: 7503712 - DNA, 22 bp, Homo sapiens
acacaggagatatgtaatggct

SEQ ID NO: 7503713 - DNA, 22 bp, Homo sapiens
acacaggagatatgtaatggct

SEQ ID NO: 7503714 - DNA, 22 bp, Homo sapiens
acacaggagagagttgggaagg

SEQ ID NO: 7503715 - DNA, 22 bp, Homo sapiens
acacaggagagagttgggaagg

SEQ ID NO: 7503716 - DNA, 22 bp, Homo sapiens
acacaggagaaaagatctccca

SEQ ID NO: 7503717 - DNA, 22 bp, Homo sapiens
acacaggagaaaagatctccca

SEQ ID NO: 7503718 - DNA, 22 bp, Homo sapiens
acacaggacagggatgtgtttt

SEQ ID NO: 7503719 - DNA, 22 bp, Homo sapiens
acacaggaagtcagcactgatg

SEQ ID NO: 7503720 - DNA, 22 bp, Homo sapiens
acacaggaagtcagcactgatg

SEQ ID NO: 7503721 - DNA, 22 bp, Homo sapiens
acacaggaagtcagcactgatg

SEQ ID NO: 7503722 - DNA, 22 bp, Homo sapiens
acacaggaagtcagcactgatg

SEQ ID NO: 7503723 - DNA, 22 bp, Homo sapiens
acacaggaagtcagcactgatg

SEQ ID NO: 7503724 - DNA, 22 bp, Homo sapiens
acacaggaagcaatttcagagc

SEQ ID NO: 7503725 - DNA, 22 bp, Homo sapiens
acacaggaagtcagcactgatg

SEQ ID NO: 7503726 - DNA, 22 bp, Homo sapiens
acacaggaagtcagcactgatg

SEQ ID NO: 7503727 - DNA, 22 bp, Homo sapiens
acacaggaagtcagcactgatg

SEQ ID NO: 7503728 - DNA, 22 bp, Homo sapiens
acacaggaagtcagcactgatg

SEQ ID NO: 7503729 - DNA, 22 bp, Homo sapiens
acacaggaagtcagcactgatg

SEQ ID NO: 7503730 - DNA, 22 bp, Homo sapiens
acacaggacggccctgtggctt

SEQ ID NO: 7503731 - DNA, 22 bp, Homo sapiens
acacaggacggccctgtggctt

SEQ ID NO: 7503732 - DNA, 22 bp, Homo sapiens
acacaggacggccctgtggctt

SEQ ID NO: 7503733 - DNA, 22 bp, Homo sapiens
acacaggagaaaagatctccca

SEQ ID NO: 7503734 - DNA, 22 bp, Homo sapiens
acacaggagaaaagatctccca

SEQ ID NO: 7503735 - DNA, 22 bp, Homo sapiens
acacaggacagggatgtgtttt

SEQ ID NO: 7503736 - DNA, 22 bp, Homo sapiens
acacaggacggccctgtggctt

SEQ ID NO: 7503737 - DNA, 22 bp, Homo sapiens
acacaggacagggatgtgtttt

SEQ ID NO: 7503738 - DNA, 22 bp, Homo sapiens
acacaggacagggatgtgtttt

SEQ ID NO: 7503739 - DNA, 22 bp, Homo sapiens
acacaggacagggatgtgtttt

SEQ ID NO: 7503740 - DNA, 22 bp, Homo sapiens
acacaggacagggatgtgtttt

SEQ ID NO: 7503741 - DNA, 22 bp, Homo sapiens
agcaccctcagccttatccaga

SEQ ID NO: 7503742 - DNA, 22 bp, Homo sapiens
agcaccccatagtcagtcacgt

SEQ ID NO: 7503743 - DNA, 21 bp, Homo sapiens
agcaccagttttatgccaggc

SEQ ID NO: 7503744 - DNA, 23 bp, Homo sapiens
agcaccattacagtttgattggg

SEQ ID NO: 7503745 - DNA, 23 bp, Homo sapiens
agcaccattacagtttgattggg

SEQ ID NO: 7503746 - DNA, 22 bp, Homo sapiens
agcaccatgaccttgccattga

SEQ ID NO: 7503747 - DNA, 23 bp, Homo sapiens
agcaccattacagtttgattggg

SEQ ID NO: 7503748 - DNA, 22 bp, Homo sapiens
agcacccttcagcccagcctgg

SEQ ID NO: 7503749 - DNA, 22 bp, Homo sapiens
agcaccctggggaagcacaaag

SEQ ID NO: 7503750 - DNA, 22 bp, Homo sapiens
agcacccttcagcccagcctgg

SEQ ID NO: 7503751 - DNA, 22 bp, Homo sapiens
agcacccttcagcccagcctgg

SEQ ID NO: 7503752 - DNA, 22 bp, Homo sapiens
agcacccttcagcccagcctgg

SEQ ID NO: 7503753 - DNA, 22 bp, Homo sapiens
agcaccctggggaagcacaaag

SEQ ID NO: 7503754 - DNA, 21 bp, Homo sapiens
agcaccctcccttctggaggg

SEQ ID NO: 7503755 - DNA, 22 bp, Homo sapiens
agcaccctcccaccctctcaga

SEQ ID NO: 7503756 - DNA, 22 bp, Homo sapiens
agcaccctccaacttccctgta

SEQ ID NO: 7503757 - DNA, 22 bp, Homo sapiens
agcaccctccaacttccctgta

SEQ ID NO: 7503758 - DNA, 22 bp, Homo sapiens
agcaccatttatcatctaggta

SEQ ID NO: 7503759 - DNA, 22 bp, Homo sapiens
agcaccctcagccttatccaga

SEQ ID NO: 7503760 - DNA, 22 bp, Homo sapiens
agcaccctcccaccctctcaga

SEQ ID NO: 7503761 - DNA, 22 bp, Homo sapiens
agcaccctcccaccctctcaga

SEQ ID NO: 7503762 - DNA, 22 bp, Homo sapiens
agcaccctcccaccctctcaga

SEQ ID NO: 7503763 - DNA, 22 bp, Homo sapiens
agcaccctcccaccctctcaga

SEQ ID NO: 7503764 - DNA, 22 bp, Homo sapiens
agcacctccttagctatgacca

SEQ ID NO: 7503765 - DNA, 22 bp, Homo sapiens
agcacctccttagctatgacca

SEQ ID NO: 7503766 - DNA, 22 bp, Homo sapiens
agcacctgcacagtggaggaaa

SEQ ID NO: 7503767 - DNA, 22 bp, Homo sapiens
agcacctgcacagtggaggaaa

SEQ ID NO: 7503768 - DNA, 22 bp, Homo sapiens
agcacctccttagctatgacca

SEQ ID NO: 7503769 - DNA, 22 bp, Homo sapiens
agcacctccgtgcagcgtggcc

SEQ ID NO: 7503770 - DNA, 22 bp, Homo sapiens
agcacctccgtgcagcgtggcc

SEQ ID NO: 7503771 - DNA, 22 bp, Homo sapiens
agcacctccgtgcagcgtggcc

SEQ ID NO: 7503772 - DNA, 23 bp, Homo sapiens
agcacctactccataccaggcac

SEQ ID NO: 7503773 - DNA, 22 bp, Homo sapiens
agcacctccttagctatgacca

SEQ ID NO: 7503774 - DNA, 22 bp, Homo sapiens
agcacctccttagctatgacca

SEQ ID NO: 7503775 - DNA, 22 bp, Homo sapiens
agcaccctttgtgagcataagt

SEQ ID NO: 7503776 - DNA, 22 bp, Homo sapiens
agcacccttcagcccagcctgg

SEQ ID NO: 7503777 - DNA, 22 bp, Homo sapiens
agcacccttcagcccagcctgg

SEQ ID NO: 7503778 - DNA, 22 bp, Homo sapiens
agcaccctttgtgagcataagt

SEQ ID NO: 7503779 - DNA, 22 bp, Homo sapiens
agcaccgttcaaacccaggtta

SEQ ID NO: 7503780 - DNA, 22 bp, Homo sapiens
agcaccgtcatagccaggtaag

SEQ ID NO: 7503781 - DNA, 22 bp, Homo sapiens
agcacctccagagcttgaagct

SEQ ID NO: 7503782 - DNA, 20 bp, Homo sapiens
agcacctcccatatgctaga

SEQ ID NO: 7503783 - DNA, 20 bp, Homo sapiens
agcacctcccatatgctaga

SEQ ID NO: 7503784 - DNA, 20 bp, Homo sapiens
agcacctcccatatgctaga

SEQ ID NO: 7503785 - DNA, 22 bp, Homo sapiens
acaattctgggtatttatatag

SEQ ID NO: 7503786 - DNA, 22 bp, Homo sapiens
acaattctgggtatttatatag

SEQ ID NO: 7503787 - DNA, 22 bp, Homo sapiens
acaattctgggtatttatatag

SEQ ID NO: 7503788 - DNA, 22 bp, Homo sapiens
acaattgactgtatttttagct

SEQ ID NO: 7503789 - DNA, 22 bp, Homo sapiens
acaattctgtggttgtctgtgg

SEQ ID NO: 7503790 - DNA, 22 bp, Homo sapiens
acaattctgtggttgtctgtgg

SEQ ID NO: 7503791 - DNA, 22 bp, Homo sapiens
acaattctgggtatttatatag

SEQ ID NO: 7503792 - DNA, 22 bp, Homo sapiens
acaattctgtggttgtctgtgg

SEQ ID NO: 7503793 - DNA, 22 bp, Homo sapiens
agcacctgcacagtggaggaaa

SEQ ID NO: 7503794 - DNA, 22 bp, Homo sapiens
agcacctgcctgcattggctat

SEQ ID NO: 7503795 - DNA, 22 bp, Homo sapiens
agcacctgctatgtgtcaggga

SEQ ID NO: 7503796 - DNA, 22 bp, Homo sapiens
agcacctgctatgtgtcaggga

SEQ ID NO: 7503797 - DNA, 22 bp, Homo sapiens
agcacctgctatgtgtcaggga

SEQ ID NO: 7503798 - DNA, 22 bp, Homo sapiens
acaattctgatggtttcccagt

SEQ ID NO: 7503799 - DNA, 22 bp, Homo sapiens
agcacctgcttaatgtgcagtg

SEQ ID NO: 7503800 - DNA, 22 bp, Homo sapiens
agcacctgcttaatgtgcagtg

SEQ ID NO: 7503801 - DNA, 22 bp, Homo sapiens
acaattctgatggtttcccagt

SEQ ID NO: 7503802 - DNA, 22 bp, Homo sapiens
agcacctgctatgtgtcaggga

SEQ ID NO: 7503803 - DNA, 22 bp, Homo sapiens
acaattgtggcaatttgtatgt

SEQ ID NO: 7503804 - DNA, 22 bp, Homo sapiens
acaattgtgagtatgaagtgat

SEQ ID NO: 7503805 - DNA, 22 bp, Homo sapiens
acaattgtgagtatgaagtgat

SEQ ID NO: 7503806 - DNA, 20 bp, Homo sapiens
acaattgtccctgtctgtca

SEQ ID NO: 7503807 - DNA, 22 bp, Homo sapiens
acaattgcattgtcacaaataa

SEQ ID NO: 7503808 - DNA, 22 bp, Homo sapiens
acaattgagtttctgagggttt

SEQ ID NO: 7503809 - DNA, 21 bp, Homo sapiens
acaattgatggcttaagttgc

SEQ ID NO: 7503810 - DNA, 22 bp, Homo sapiens
acaattgcattgtcacaaataa

SEQ ID NO: 7503811 - DNA, 22 bp, Homo sapiens
acaattgctaatgcttctgttg

SEQ ID NO: 7503812 - DNA, 22 bp, Homo sapiens
acaatttatccattgtatagtt

SEQ ID NO: 7503813 - DNA, 22 bp, Homo sapiens
acaattgactgtatttttagct

SEQ ID NO: 7503814 - DNA, 22 bp, Homo sapiens
acaatttatccattgtatagtt

SEQ ID NO: 7503815 - DNA, 22 bp, Homo sapiens
acaatttatccattgtatagtt

SEQ ID NO: 7503816 - DNA, 22 bp, Homo sapiens
acaattgtggcaatttgtatgt

SEQ ID NO: 7503817 - DNA, 22 bp, Homo sapiens
acaatttatccattgtatagtt

SEQ ID NO: 7503818 - DNA, 22 bp, Homo sapiens
acaatttatccattgtatagtt

SEQ ID NO: 7503819 - DNA, 20 bp, Homo sapiens
acaatttcctcactatatgc

SEQ ID NO: 7503820 - DNA, 22 bp, Homo sapiens
acaatttcaccttttggttcaa

SEQ ID NO: 7503821 - DNA, 22 bp, Homo sapiens
acaatttatccattgtatagtt

SEQ ID NO: 7503822 - DNA, 22 bp, Homo sapiens
acaatttatccattgtatagtt

SEQ ID NO: 7503823 - DNA, 20 bp, Homo sapiens
acaatttcctcactatatgc

SEQ ID NO: 7503824 - DNA, 22 bp, Homo sapiens
acaatttatccattgtatagtt

SEQ ID NO: 7503825 - DNA, 22 bp, Homo sapiens
acaatttatccattgtatagtt

SEQ ID NO: 7503826 - DNA, 22 bp, Homo sapiens
acacatatgtatgcatcatgtg

SEQ ID NO: 7503827 - DNA, 22 bp, Homo sapiens
acacatatggttgctgcagtga

SEQ ID NO: 7503828 - DNA, 22 bp, Homo sapiens
acacatatgtatgcatcatgtg

SEQ ID NO: 7503829 - DNA, 22 bp, Homo sapiens
acacatatgtatgcatcatgtg

SEQ ID NO: 7503830 - DNA, 22 bp, Homo sapiens
acacatatggttggtaggagtt

SEQ ID NO: 7503831 - DNA, 22 bp, Homo sapiens
acacatatgtatgcatcatgtg

SEQ ID NO: 7503832 - DNA, 22 bp, Homo sapiens
acacatatgtatgcatcatgtg

SEQ ID NO: 7503833 - DNA, 22 bp, Homo sapiens
acacatatgtcattgaaaaatc

SEQ ID NO: 7503834 - DNA, 22 bp, Homo sapiens
acacatatgtatgcatcatgtg

SEQ ID NO: 7503835 - DNA, 22 bp, Homo sapiens
agcagcttggggccgagataga

SEQ ID NO: 7503836 - DNA, 21 bp, Homo sapiens
agcagcttgagtctggagctc

SEQ ID NO: 7503837 - DNA, 22 bp, Homo sapiens
agcagcttgggtctctcctgct

SEQ ID NO: 7503838 - DNA, 22 bp, Homo sapiens
agcagcttgggtctctcctgct

SEQ ID NO: 7503839 - DNA, 22 bp, Homo sapiens
agcagcttggggccgagataga

SEQ ID NO: 7503840 - DNA, 23 bp, Homo sapiens
agcaggaaaccgagggtgatgtt

SEQ ID NO: 7503841 - DNA, 20 bp, Homo sapiens
agcaggaaaagtgccagtct

SEQ ID NO: 7503842 - DNA, 20 bp, Homo sapiens
agcaggaaaagtgccagtct

SEQ ID NO: 7503843 - DNA, 20 bp, Homo sapiens
agcaggaaaagtgccagtct

SEQ ID NO: 7503844 - DNA, 20 bp, Homo sapiens
agcaggaaaagtgccagtct

SEQ ID NO: 7503845 - DNA, 18 bp, Homo sapiens
agcagctttgtgcttgat

SEQ ID NO: 7503846 - DNA, 22 bp, Homo sapiens
agcagctttcctctggggtcag

SEQ ID NO: 7503847 - DNA, 22 bp, Homo sapiens
agcagctttaagtcactggtta

SEQ ID NO: 7503848 - DNA, 22 bp, Homo sapiens
agcagctttaagtcactggtta

SEQ ID NO: 7503849 - DNA, 22 bp, Homo sapiens
agcagctttcacctccccgcct

SEQ ID NO: 7503850 - DNA, 22 bp, Homo sapiens
agcagcttgttaaaaagttcca

SEQ ID NO: 7503851 - DNA, 22 bp, Homo sapiens
agcagcttgggtctctcctgct

SEQ ID NO: 7503852 - DNA, 22 bp, Homo sapiens
acacatatatttgcatatacac

SEQ ID NO: 7503853 - DNA, 22 bp, Homo sapiens
acacatatatttgcatatacac

SEQ ID NO: 7503854 - DNA, 23 bp, Homo sapiens
acacatatattcagatacagatg

SEQ ID NO: 7503855 - DNA, 23 bp, Homo sapiens
acacatatattcagatacagatg

SEQ ID NO: 7503856 - DNA, 23 bp, Homo sapiens
acacatatattcagatacagatg

SEQ ID NO: 7503857 - DNA, 23 bp, Homo sapiens
acacatatattcagatacagatg

SEQ ID NO: 7503858 - DNA, 23 bp, Homo sapiens
acacatatattcagatacagatg

SEQ ID NO: 7503859 - DNA, 23 bp, Homo sapiens
acacatatattcagatacagatg

SEQ ID NO: 7503860 - DNA, 23 bp, Homo sapiens
acacatatattcagatacagatg

SEQ ID NO: 7503861 - DNA, 23 bp, Homo sapiens
acacatatattcagatacagatg

SEQ ID NO: 7503862 - DNA, 23 bp, Homo sapiens
acacatatattcagatacagatg

SEQ ID NO: 7503863 - DNA, 23 bp, Homo sapiens
acacatatattcagatacagatg

SEQ ID NO: 7503864 - DNA, 22 bp, Homo sapiens
acacatatatttgcatatacac

SEQ ID NO: 7503865 - DNA, 22 bp, Homo sapiens
acacatatatttgcatatacac

SEQ ID NO: 7503866 - DNA, 22 bp, Homo sapiens
acacatatatttgcatatacac

SEQ ID NO: 7503867 - DNA, 22 bp, Homo sapiens
acacatatatttgcatatacac

SEQ ID NO: 7503868 - DNA, 22 bp, Homo sapiens
acacatatatttgcatatacac

SEQ ID NO: 7503869 - DNA, 22 bp, Homo sapiens
acacatatatttgcatatacac

SEQ ID NO: 7503870 - DNA, 22 bp, Homo sapiens
acacatatatttgcatatacac

SEQ ID NO: 7503871 - DNA, 22 bp, Homo sapiens
acacatatatttgcatatacac

SEQ ID NO: 7503872 - DNA, 22 bp, Homo sapiens
acacatatatttgcatatacac

SEQ ID NO: 7503873 - DNA, 22 bp, Homo sapiens
acacatatctaagatagatgac

SEQ ID NO: 7503874 - DNA, 22 bp, Homo sapiens
acacatatatttgcatatacac

SEQ ID NO: 7503875 - DNA, 22 bp, Homo sapiens
acacatatctaagatagatgac

SEQ ID NO: 7503876 - DNA, 22 bp, Homo sapiens
acacatatctaagatagatgac

SEQ ID NO: 7503877 - DNA, 22 bp, Homo sapiens
acacatatctaagatagatgac

SEQ ID NO: 7503878 - DNA, 22 bp, Homo sapiens
acacatatctaagatagatgac

SEQ ID NO: 7503879 - DNA, 22 bp, Homo sapiens
acacatatctaagatagatgac

SEQ ID NO: 7503880 - DNA, 22 bp, Homo sapiens
acacatatgcagatcccccaca

SEQ ID NO: 7503881 - DNA, 22 bp, Homo sapiens
acacatatctaagatagatgac

SEQ ID NO: 7503882 - DNA, 22 bp, Homo sapiens
acacatatctaagatagatgac

SEQ ID NO: 7503883 - DNA, 22 bp, Homo sapiens
acacatatgccattacagcaaa

SEQ ID NO: 7503884 - DNA, 22 bp, Homo sapiens
acacatatgccattacagcaaa

SEQ ID NO: 7503885 - DNA, 22 bp, Homo sapiens
acacatatgccattacagcaaa

SEQ ID NO: 7503886 - DNA, 22 bp, Homo sapiens
acacatatgccattacagcaaa

SEQ ID NO: 7503887 - DNA, 22 bp, Homo sapiens
acacatatgccattacagcaaa

SEQ ID NO: 7503888 - DNA, 22 bp, Homo sapiens
acacatatggttgctgcagtga

SEQ ID NO: 7503889 - DNA, 22 bp, Homo sapiens
acacatatggttgctgcagtga

SEQ ID NO: 7503890 - DNA, 22 bp, Homo sapiens
acacatatggttgctgcagtga

SEQ ID NO: 7503891 - DNA, 22 bp, Homo sapiens
acacatatggttgctgcagtga

SEQ ID NO: 7503892 - DNA, 22 bp, Homo sapiens
acacatatgccattacagcaaa

SEQ ID NO: 7503893 - DNA, 22 bp, Homo sapiens
agcagcagtgttctggaattct

SEQ ID NO: 7503894 - DNA, 22 bp, Homo sapiens
agcagcagttgctgacgttcta

SEQ ID NO: 7503895 - DNA, 22 bp, Homo sapiens
acacataagaaactacaaagag

SEQ ID NO: 7503896 - DNA, 22 bp, Homo sapiens
agcagcagtgtgtggtcatgtt

SEQ ID NO: 7503897 - DNA, 22 bp, Homo sapiens
acacataagaaactacaaagag

SEQ ID NO: 7503898 - DNA, 22 bp, Homo sapiens
acacataagaaactacaaagag

SEQ ID NO: 7503899 - DNA, 22 bp, Homo sapiens
acacatatattatttgtggctc

SEQ ID NO: 7503900 - DNA, 22 bp, Homo sapiens
acacatatatgtgcgtgtatat

SEQ ID NO: 7503901 - DNA, 22 bp, Homo sapiens
acacatatatgtgcgtgtatat

SEQ ID NO: 7503902 - DNA, 22 bp, Homo sapiens
acacatatatgtgcgtgtatat

SEQ ID NO: 7503903 - DNA, 23 bp, Homo sapiens
agcagcagtgagaggtgtcttac

SEQ ID NO: 7503904 - DNA, 22 bp, Homo sapiens
agcagcagtgtggtttggggaa

SEQ ID NO: 7503905 - DNA, 22 bp, Homo sapiens
agcagcagtgtgtggtcatgtt

SEQ ID NO: 7503906 - DNA, 22 bp, Homo sapiens
agcagcagtgtgtggtcatgtt

SEQ ID NO: 7503907 - DNA, 22 bp, Homo sapiens
agcagcagtgtgtggtcatgtt

SEQ ID NO: 7503908 - DNA, 22 bp, Homo sapiens
agcagcagtgtgtggtcatgtt

SEQ ID NO: 7503909 - DNA, 22 bp, Homo sapiens
agcagcagtgtgtggtcatgtt

SEQ ID NO: 7503910 - DNA, 23 bp, Homo sapiens
agcagcagtgagaggtgtcttac

SEQ ID NO: 7503911 - DNA, 23 bp, Homo sapiens
agcagcagtgagaggtgtcttac

SEQ ID NO: 7503912 - DNA, 23 bp, Homo sapiens
agcagcagtgagaggtgtcttac

SEQ ID NO: 7503913 - DNA, 23 bp, Homo sapiens
agcagcagtgagaggtgtcttac

SEQ ID NO: 7503914 - DNA, 22 bp, Homo sapiens
agcagcagtgacagccgaaagc

SEQ ID NO: 7503915 - DNA, 22 bp, Homo sapiens
agcagcagtcctttgtgtaatt

SEQ ID NO: 7503916 - DNA, 22 bp, Homo sapiens
agcagcagtgacagccgaaagc

SEQ ID NO: 7503917 - DNA, 22 bp, Homo sapiens
agcagcagtgacagccgaaagc

SEQ ID NO: 7503918 - DNA, 22 bp, Homo sapiens
agcagcagtcctttgtgtaatt

SEQ ID NO: 7503919 - DNA, 22 bp, Homo sapiens
agcagcagtcctttgtgtaatt

SEQ ID NO: 7503920 - DNA, 22 bp, Homo sapiens
agcagcagtcatgcctatgctc

SEQ ID NO: 7503921 - DNA, 22 bp, Homo sapiens
agcagcagtcatgcctatgctc

SEQ ID NO: 7503922 - DNA, 22 bp, Homo sapiens
agcagcagtcatgcctatgctc

SEQ ID NO: 7503923 - DNA, 22 bp, Homo sapiens
agcagcagtatccttccccggc

SEQ ID NO: 7503924 - DNA, 22 bp, Homo sapiens
agcagcagtacatataagacta

SEQ ID NO: 7503925 - DNA, 22 bp, Homo sapiens
agcagcagtatccttccccggc

SEQ ID NO: 7503926 - DNA, 22 bp, Homo sapiens
agcagcagtacatataagacta

SEQ ID NO: 7503927 - DNA, 22 bp, Homo sapiens
agcagcagtacatataagacta

SEQ ID NO: 7503928 - DNA, 22 bp, Homo sapiens
agcagcagtacatataagacta

SEQ ID NO: 7503929 - DNA, 22 bp, Homo sapiens
agcagcagtacatataagacta

SEQ ID NO: 7503930 - DNA, 22 bp, Homo sapiens
agcagcaggtgcttctggatct

SEQ ID NO: 7503931 - DNA, 22 bp, Homo sapiens
agcagcaggtgacctcgatgcc

SEQ ID NO: 7503932 - DNA, 22 bp, Homo sapiens
agcagcaggtgacctcgatgcc

SEQ ID NO: 7503933 - DNA, 22 bp, Homo sapiens
acacaggcatagccatacatgt

SEQ ID NO: 7503934 - DNA, 22 bp, Homo sapiens
agcagcaggtgacctcgatgcc

SEQ ID NO: 7503935 - DNA, 22 bp, Homo sapiens
agcagcaggtgcttctggatct

SEQ ID NO: 7503936 - DNA, 22 bp, Homo sapiens
agcagcaggtgcttctggatct

SEQ ID NO: 7503937 - DNA, 22 bp, Homo sapiens
agcagcaggtgcttctggatct

SEQ ID NO: 7503938 - DNA, 22 bp, Homo sapiens
acacaggcatagccatacatgt

SEQ ID NO: 7503939 - DNA, 22 bp, Homo sapiens
acacaggcaatgtgagtgggag

SEQ ID NO: 7503940 - DNA, 22 bp, Homo sapiens
acacaggcaatgtgagtgggag

SEQ ID NO: 7503941 - DNA, 22 bp, Homo sapiens
acacaggcaatgtgagtgggag

SEQ ID NO: 7503942 - DNA, 21 bp, Homo sapiens
acacaggcagtgtcccgaggt

SEQ ID NO: 7503943 - DNA, 21 bp, Homo sapiens
acacaggcagtgtcccgaggt

SEQ ID NO: 7503944 - DNA, 22 bp, Homo sapiens
acacaggcaatgtgagtgggag

SEQ ID NO: 7503945 - DNA, 22 bp, Homo sapiens
acacaggcaatgtgagtgggag

SEQ ID NO: 7503946 - DNA, 22 bp, Homo sapiens
acacaggcaatgtgagtgggag

SEQ ID NO: 7503947 - DNA, 22 bp, Homo sapiens
agccatggcgccactagaggga

SEQ ID NO: 7503948 - DNA, 22 bp, Homo sapiens
agccatggcgccactagaggga

SEQ ID NO: 7503949 - DNA, 22 bp, Homo sapiens
agccatggcgccactagaggga

SEQ ID NO: 7503950 - DNA, 22 bp, Homo sapiens
agccatggcgccactagaggga

SEQ ID NO: 7503951 - DNA, 22 bp, Homo sapiens
agccatggcgccactagaggga

SEQ ID NO: 7503952 - DNA, 22 bp, Homo sapiens
agccatggcgccactagaggga

SEQ ID NO: 7503953 - DNA, 22 bp, Homo sapiens
agccatggcgccactagaggga

SEQ ID NO: 7503954 - DNA, 22 bp, Homo sapiens
agccatgggctcccagtccttt

SEQ ID NO: 7503955 - DNA, 22 bp, Homo sapiens
agccatgggctcccagtccttt

SEQ ID NO: 7503956 - DNA, 22 bp, Homo sapiens
agccatgggagactgtgggaga

SEQ ID NO: 7503957 - DNA, 22 bp, Homo sapiens
agccatgctccttcccctctgg

SEQ ID NO: 7503958 - DNA, 22 bp, Homo sapiens
agccatgctcagttcctggagc

SEQ ID NO: 7503959 - DNA, 22 bp, Homo sapiens
agccatgcaccttactcttgct

SEQ ID NO: 7503960 - DNA, 22 bp, Homo sapiens
agccatgcaccttactcttgct

SEQ ID NO: 7503961 - DNA, 22 bp, Homo sapiens
agccatgaccttgcagacctgc

SEQ ID NO: 7503962 - DNA, 22 bp, Homo sapiens
agccatctaagaaatacaaaat

SEQ ID NO: 7503963 - DNA, 22 bp, Homo sapiens
agccatgtcacatatggtcatc

SEQ ID NO: 7503964 - DNA, 18 bp, Homo sapiens
agccattacagacttgaa

SEQ ID NO: 7503965 - DNA, 22 bp, Homo sapiens
agccattcattgtgctctcaga

SEQ ID NO: 7503966 - DNA, 22 bp, Homo sapiens
agccattcattgtgctctcaga

SEQ ID NO: 7503967 - DNA, 22 bp, Homo sapiens
agccatttcatacacctgcagc

SEQ ID NO: 7503968 - DNA, 22 bp, Homo sapiens
agccattggctgcctggtgcgt

SEQ ID NO: 7503969 - DNA, 22 bp, Homo sapiens
agccattgaatttagtgccttt

SEQ ID NO: 7503970 - DNA, 22 bp, Homo sapiens
agccatgtcacatatggtcatc

SEQ ID NO: 7503971 - DNA, 22 bp, Homo sapiens
agccatgggctcccagtccttt

SEQ ID NO: 7503972 - DNA, 22 bp, Homo sapiens
agccatggtctcagggccataa

SEQ ID NO: 7503973 - DNA, 22 bp, Homo sapiens
agccatggtctcagggccataa

SEQ ID NO: 7503974 - DNA, 22 bp, Homo sapiens
agccatgggctcccagtccttt

SEQ ID NO: 7503975 - DNA, 22 bp, Homo sapiens
agccatgggctcccagtccttt

SEQ ID NO: 7503976 - DNA, 22 bp, Homo sapiens
agccagggtgggtgaatgctat

SEQ ID NO: 7503977 - DNA, 22 bp, Homo sapiens
agccagggtgggtgaatgctat

SEQ ID NO: 7503978 - DNA, 22 bp, Homo sapiens
agccagggtgggtgaatgctat

SEQ ID NO: 7503979 - DNA, 22 bp, Homo sapiens
agccatcctccacagccttgat

SEQ ID NO: 7503980 - DNA, 22 bp, Homo sapiens
agccatcgccgcaggcatctgc

SEQ ID NO: 7503981 - DNA, 22 bp, Homo sapiens
agccatcctcccacctcagcct

SEQ ID NO: 7503982 - DNA, 22 bp, Homo sapiens
agccatcctcccacctcagcct

SEQ ID NO: 7503983 - DNA, 22 bp, Homo sapiens
agccatcctccacagccttgat

SEQ ID NO: 7503984 - DNA, 21 bp, Homo sapiens
agccagggtggacactgtatg

SEQ ID NO: 7503985 - DNA, 21 bp, Homo sapiens
agccagggtggacactgtatg

SEQ ID NO: 7503986 - DNA, 21 bp, Homo sapiens
agccagggtggacactgtatg

SEQ ID NO: 7503987 - DNA, 22 bp, Homo sapiens
agccacagtctgatgcctgaga

SEQ ID NO: 7503988 - DNA, 22 bp, Homo sapiens
agccacagtctgatgcctgaga

SEQ ID NO: 7503989 - DNA, 22 bp, Homo sapiens
agccacagtctgatgcctgaga

SEQ ID NO: 7503990 - DNA, 22 bp, Homo sapiens
agccacagtctgatgcctgaga

SEQ ID NO: 7503991 - DNA, 22 bp, Homo sapiens
agccacagtctgatgcctgaga

SEQ ID NO: 7503992 - DNA, 22 bp, Homo sapiens
agccacagtctgatgcctgaga

SEQ ID NO: 7503993 - DNA, 22 bp, Homo sapiens
agccacagtctgatgcctgaga

SEQ ID NO: 7503994 - DNA, 22 bp, Homo sapiens
agccacagtctgatgcctgaga

SEQ ID NO: 7503995 - DNA, 22 bp, Homo sapiens
agccacagtctgatgcctgaga

SEQ ID NO: 7503996 - DNA, 22 bp, Homo sapiens
agccacagtcaacctgtccata

SEQ ID NO: 7503997 - DNA, 22 bp, Homo sapiens
agccacagtcaacctgtccata

SEQ ID NO: 7503998 - DNA, 22 bp, Homo sapiens
agccacagtcaacctgtccata

SEQ ID NO: 7503999 - DNA, 22 bp, Homo sapiens
agccacagtcaacctgtccata

SEQ ID NO: 7504000 - DNA, 22 bp, Homo sapiens
agccacagtcaacctgtccata

SEQ ID NO: 7504001 - DNA, 22 bp, Homo sapiens
agccacagtcaacctgtccata

SEQ ID NO: 7504002 - DNA, 22 bp, Homo sapiens
agccacagtcaacctgtccata

SEQ ID NO: 7504003 - DNA, 22 bp, Homo sapiens
agccacagtcaacctgtccata

SEQ ID NO: 7504004 - DNA, 22 bp, Homo sapiens
agccacagtcaacctgtccata

SEQ ID NO: 7504005 - DNA, 22 bp, Homo sapiens
agccacaggtgttggccagtgt

SEQ ID NO: 7504006 - DNA, 22 bp, Homo sapiens
agccacagtcaacctgtccata

SEQ ID NO: 7504007 - DNA, 22 bp, Homo sapiens
agccacaggtgttggccagtgt

SEQ ID NO: 7504008 - DNA, 22 bp, Homo sapiens
agccacagtcaacctgtccata

SEQ ID NO: 7504009 - DNA, 22 bp, Homo sapiens
acagagcactgccctgtgccgc

SEQ ID NO: 7504010 - DNA, 22 bp, Homo sapiens
acagagcactgccctgtgccgc

SEQ ID NO: 7504011 - DNA, 22 bp, Homo sapiens
acagagcactgccctgtgccgc

SEQ ID NO: 7504012 - DNA, 22 bp, Homo sapiens
acagagcactgccctgtgccgc

SEQ ID NO: 7504013 - DNA, 22 bp, Homo sapiens
acagagcactgccctgtgccgc

SEQ ID NO: 7504014 - DNA, 22 bp, Homo sapiens
acagagcactgccctgtgccgc

SEQ ID NO: 7504015 - DNA, 22 bp, Homo sapiens
acagagatcagaggcataagca

SEQ ID NO: 7504016 - DNA, 22 bp, Homo sapiens
acagagatcagaggcataagca

SEQ ID NO: 7504017 - DNA, 17 bp, Homo sapiens
acagagcacatcaagat

SEQ ID NO: 7504018 - DNA, 17 bp, Homo sapiens
acagagcacatcaagat

SEQ ID NO: 7504019 - DNA, 17 bp, Homo sapiens
acagagcacatcaagat

SEQ ID NO: 7504020 - DNA, 17 bp, Homo sapiens
acagagcacatcaagat

SEQ ID NO: 7504021 - DNA, 22 bp, Homo sapiens
acagagcagtaagaacacagct

SEQ ID NO: 7504022 - DNA, 22 bp, Homo sapiens
acagagcagtaagaacacagct

SEQ ID NO: 7504023 - DNA, 22 bp, Homo sapiens
acagagcaggtccagaagtgcc

SEQ ID NO: 7504024 - DNA, 22 bp, Homo sapiens
acagagcaggtccagaagtgcc

SEQ ID NO: 7504025 - DNA, 22 bp, Homo sapiens
acagagcagtaagaacacagct

SEQ ID NO: 7504026 - DNA, 22 bp, Homo sapiens
acagagcagtaagaacacagct

SEQ ID NO: 7504027 - DNA, 22 bp, Homo sapiens
acagagcagtaagaacacagct

SEQ ID NO: 7504028 - DNA, 22 bp, Homo sapiens
acagagcaggtccagaagtgcc

SEQ ID NO: 7504029 - DNA, 22 bp, Homo sapiens
acagagcaggtccagaagtgcc

SEQ ID NO: 7504030 - DNA, 22 bp, Homo sapiens
acagagcactgccctgtgccgc

SEQ ID NO: 7504031 - DNA, 22 bp, Homo sapiens
acagagcaggtccagaagtgcc

SEQ ID NO: 7504032 - DNA, 22 bp, Homo sapiens
acagagcaggtccagaagtgcc

SEQ ID NO: 7504033 - DNA, 22 bp, Homo sapiens
acagagcaggtccagaagtgcc

SEQ ID NO: 7504034 - DNA, 22 bp, Homo sapiens
agcccagcttccttctgtctct

SEQ ID NO: 7504035 - DNA, 22 bp, Homo sapiens
agcccagcttccttctgtctct

SEQ ID NO: 7504036 - DNA, 22 bp, Homo sapiens
agcccagcttccttctgtctct

SEQ ID NO: 7504037 - DNA, 22 bp, Homo sapiens
agcccagcttccttctgtctct

SEQ ID NO: 7504038 - DNA, 19 bp, Homo sapiens
agcccagcttatttgtcag

SEQ ID NO: 7504039 - DNA, 22 bp, Homo sapiens
agcccagctgctatgtacctgg

SEQ ID NO: 7504040 - DNA, 19 bp, Homo sapiens
agcccagcttatttgtcag

SEQ ID NO: 7504041 - DNA, 19 bp, Homo sapiens
agcccagcttatttgtcag

SEQ ID NO: 7504042 - DNA, 22 bp, Homo sapiens
agcccagcttccttctgtctct

SEQ ID NO: 7504043 - DNA, 22 bp, Homo sapiens
agcccagcttccttctgtctct

SEQ ID NO: 7504044 - DNA, 22 bp, Homo sapiens
agcccagctttcacccctctgg

SEQ ID NO: 7504045 - DNA, 22 bp, Homo sapiens
acagagagggagtgataaatcc

SEQ ID NO: 7504046 - DNA, 22 bp, Homo sapiens
acagagagggagtgataaatcc

SEQ ID NO: 7504047 - DNA, 22 bp, Homo sapiens
acagagagggagtgataaatcc

SEQ ID NO: 7504048 - DNA, 22 bp, Homo sapiens
agcccagctttcacccctctgg

SEQ ID NO: 7504049 - DNA, 22 bp, Homo sapiens
agcccagctttcacccctctgg

SEQ ID NO: 7504050 - DNA, 22 bp, Homo sapiens
agcccagcttccttctgtctct

SEQ ID NO: 7504051 - DNA, 22 bp, Homo sapiens
agcccagctttcacccctctgg

SEQ ID NO: 7504052 - DNA, 22 bp, Homo sapiens
agcccagctttcacccctctgg

SEQ ID NO: 7504053 - DNA, 22 bp, Homo sapiens
acagagagggagtgataaatcc

SEQ ID NO: 7504054 - DNA, 22 bp, Homo sapiens
acagagaggtaaaatatatagt

SEQ ID NO: 7504055 - DNA, 22 bp, Homo sapiens
acagagagggagtgataaatcc

SEQ ID NO: 7504056 - DNA, 22 bp, Homo sapiens
agcccagctcctccacagaata

SEQ ID NO: 7504057 - DNA, 22 bp, Homo sapiens
agcccagctcctccacagaata

SEQ ID NO: 7504058 - DNA, 22 bp, Homo sapiens
agcccagctcctccacagaata

SEQ ID NO: 7504059 - DNA, 22 bp, Homo sapiens
agcccagctgcctgcctgctgt

SEQ ID NO: 7504060 - DNA, 22 bp, Homo sapiens
agcccagctcctccacagaata

SEQ ID NO: 7504061 - DNA, 22 bp, Homo sapiens
agcccagctcctccacagaata

SEQ ID NO: 7504062 - DNA, 22 bp, Homo sapiens
agcccagctcctccacagaata

SEQ ID NO: 7504063 - DNA, 18 bp, Homo sapiens
agcccagcggagtgaatc

SEQ ID NO: 7504064 - DNA, 18 bp, Homo sapiens
agcccagcggagtgaatc

SEQ ID NO: 7504065 - DNA, 18 bp, Homo sapiens
agcccagcggagtgaatc

SEQ ID NO: 7504066 - DNA, 18 bp, Homo sapiens
agcccagcggagtgaatc

SEQ ID NO: 7504067 - DNA, 18 bp, Homo sapiens
agcccagcggagtgaatc

SEQ ID NO: 7504068 - DNA, 22 bp, Homo sapiens
agcccagctgctatgtacctgg

SEQ ID NO: 7504069 - DNA, 22 bp, Homo sapiens
agcccagctgctatgtacctgg

SEQ ID NO: 7504070 - DNA, 22 bp, Homo sapiens
agcccagctgctatgtacctgg

SEQ ID NO: 7504071 - DNA, 22 bp, Homo sapiens
agcccagctgcctgcctgctgt

SEQ ID NO: 7504072 - DNA, 22 bp, Homo sapiens
agcccagctgcctgcctgctgt

SEQ ID NO: 7504073 - DNA, 22 bp, Homo sapiens
agcccagctgcctgcctgctgt

SEQ ID NO: 7504074 - DNA, 22 bp, Homo sapiens
agcccagctgcctgcctgctgt

SEQ ID NO: 7504075 - DNA, 22 bp, Homo sapiens
agcccagctgcctgcctgctgt

SEQ ID NO: 7504076 - DNA, 22 bp, Homo sapiens
agcccagctgcctgcctgctgt

SEQ ID NO: 7504077 - DNA, 22 bp, Homo sapiens
agcccagcggagcgggcccggg

SEQ ID NO: 7504078 - DNA, 22 bp, Homo sapiens
agcccagcggagcgggcccggg

SEQ ID NO: 7504079 - DNA, 22 bp, Homo sapiens
agcccagcggagcgggcccggg

SEQ ID NO: 7504080 - DNA, 22 bp, Homo sapiens
agcccagcggagcgggcccggg

SEQ ID NO: 7504081 - DNA, 22 bp, Homo sapiens
agcccagcctgattctacaccc

SEQ ID NO: 7504082 - DNA, 22 bp, Homo sapiens
agcccaaacctgcgagcagagc

SEQ ID NO: 7504083 - DNA, 22 bp, Homo sapiens
agccattttggtaatgataaca

SEQ ID NO: 7504084 - DNA, 22 bp, Homo sapiens
agcccaaactcatggtcctttg

SEQ ID NO: 7504085 - DNA, 22 bp, Homo sapiens
agcccaaacctgcgagcagagc

SEQ ID NO: 7504086 - DNA, 22 bp, Homo sapiens
agcccaaacctgcgagcagagc

SEQ ID NO: 7504087 - DNA, 22 bp, Homo sapiens
agccatttcctgaactctggac

SEQ ID NO: 7504088 - DNA, 22 bp, Homo sapiens
agccatttggacttctggtagg

SEQ ID NO: 7504089 - DNA, 22 bp, Homo sapiens
agccattttcctgaaatataac

SEQ ID NO: 7504090 - DNA, 22 bp, Homo sapiens
agccattttcctgaaatataac

SEQ ID NO: 7504091 - DNA, 22 bp, Homo sapiens
agccattttcctgaaatataac

SEQ ID NO: 7504092 - DNA, 22 bp, Homo sapiens
agccattttcctgaaatataac

SEQ ID NO: 7504093 - DNA, 22 bp, Homo sapiens
agccattttcctgaaatataac

SEQ ID NO: 7504094 - DNA, 22 bp, Homo sapiens
agccattttggtaatgataaca

SEQ ID NO: 7504095 - DNA, 22 bp, Homo sapiens
agccattttggtaatgataaca

SEQ ID NO: 7504096 - DNA, 22 bp, Homo sapiens
acagagcagttctggagctggc

SEQ ID NO: 7504097 - DNA, 22 bp, Homo sapiens
acagagcagttctggagctggc

SEQ ID NO: 7504098 - DNA, 22 bp, Homo sapiens
acagagcagttctggagctggc

SEQ ID NO: 7504099 - DNA, 22 bp, Homo sapiens
acagagcagttctggagctggc

SEQ ID NO: 7504100 - DNA, 22 bp, Homo sapiens
acagagcagttctggagctggc

SEQ ID NO: 7504101 - DNA, 22 bp, Homo sapiens
acagagcagtaagaacacagct

SEQ ID NO: 7504102 - DNA, 22 bp, Homo sapiens
acagagcagtaagaacacagct

SEQ ID NO: 7504103 - DNA, 22 bp, Homo sapiens
acagagcagtaagaacacagct

SEQ ID NO: 7504104 - DNA, 22 bp, Homo sapiens
acagagcataatgtctagcaca

SEQ ID NO: 7504105 - DNA, 22 bp, Homo sapiens
acagagcataatgtctagcaca

SEQ ID NO: 7504106 - DNA, 22 bp, Homo sapiens
acagagcataatgtctagcaca

SEQ ID NO: 7504107 - DNA, 22 bp, Homo sapiens
acagagcataatgtctagcaca

SEQ ID NO: 7504108 - DNA, 22 bp, Homo sapiens
acagagcataatgtctagcaca

SEQ ID NO: 7504109 - DNA, 22 bp, Homo sapiens
acagagcataatgtctagcaca

SEQ ID NO: 7504110 - DNA, 22 bp, Homo sapiens
acagagcataatgtctagcaca

SEQ ID NO: 7504111 - DNA, 22 bp, Homo sapiens
acagagcataatgtctagcaca

SEQ ID NO: 7504112 - DNA, 22 bp, Homo sapiens
acagagcataatgtctagcaca

SEQ ID NO: 7504113 - DNA, 21 bp, Homo sapiens
acagagcataatggtgtggca

SEQ ID NO: 7504114 - DNA, 21 bp, Homo sapiens
acagagcataatggtgtggca

SEQ ID NO: 7504115 - DNA, 21 bp, Homo sapiens
acagagcataatggtgtggca

SEQ ID NO: 7504116 - DNA, 21 bp, Homo sapiens
acagagcataatggtgtggca

SEQ ID NO: 7504117 - DNA, 21 bp, Homo sapiens
acagagcataatggtgtggca

SEQ ID NO: 7504118 - DNA, 22 bp, Homo sapiens
acagagcatgctcagtgtgtga

SEQ ID NO: 7504119 - DNA, 22 bp, Homo sapiens
acagagcatgctcagtgtgtga

SEQ ID NO: 7504120 - DNA, 22 bp, Homo sapiens
acagagcatgatggaagatcga

SEQ ID NO: 7504121 - DNA, 22 bp, Homo sapiens
acagagcatgatggaagatcga

SEQ ID NO: 7504122 - DNA, 22 bp, Homo sapiens
acagagcatgatggaagatcga

SEQ ID NO: 7504123 - DNA, 22 bp, Homo sapiens
acagagcatgatggaagatcga

SEQ ID NO: 7504124 - DNA, 22 bp, Homo sapiens
acagagcatgatggaagatcga

SEQ ID NO: 7504125 - DNA, 22 bp, Homo sapiens
acagagcatgatggaagatcga

SEQ ID NO: 7504126 - DNA, 22 bp, Homo sapiens
acagagcatttgggacagagag

SEQ ID NO: 7504127 - DNA, 22 bp, Homo sapiens
acagagcatttgggacagagag

SEQ ID NO: 7504128 - DNA, 22 bp, Homo sapiens
acagagcatttgggacagagag

SEQ ID NO: 7504129 - DNA, 22 bp, Homo sapiens
acagagcatttgggacagagag

SEQ ID NO: 7504130 - DNA, 22 bp, Homo sapiens
acagagcatttgggacagagag

SEQ ID NO: 7504131 - DNA, 22 bp, Homo sapiens
acagagcatgctcagtgtgtga

SEQ ID NO: 7504132 - DNA, 22 bp, Homo sapiens
acagagcatataaagtgctttg

SEQ ID NO: 7504133 - DNA, 22 bp, Homo sapiens
acagagcataatgtctagcaca

SEQ ID NO: 7504134 - DNA, 22 bp, Homo sapiens
acagagcatataaagtgctttg

SEQ ID NO: 7504135 - DNA, 22 bp, Homo sapiens
acagagcatataaagtgctttg

SEQ ID NO: 7504136 - DNA, 22 bp, Homo sapiens
acagagcatataaagtgctttg

SEQ ID NO: 7504137 - DNA, 22 bp, Homo sapiens
acagagcatataaagtgctttg

SEQ ID NO: 7504138 - DNA, 22 bp, Homo sapiens
acagagcatataaagtgctttg

SEQ ID NO: 7504139 - DNA, 22 bp, Homo sapiens
acagagcatcagatgaaatcaa

SEQ ID NO: 7504140 - DNA, 22 bp, Homo sapiens
acagagcatcagatgaaatcaa

SEQ ID NO: 7504141 - DNA, 22 bp, Homo sapiens
acagagcatcagatgaaatcaa

SEQ ID NO: 7504142 - DNA, 22 bp, Homo sapiens
acagagcatcagatgaaatcaa

SEQ ID NO: 7504143 - DNA, 23 bp, Homo sapiens
agcccctcatggtgtctagacag

SEQ ID NO: 7504144 - DNA, 23 bp, Homo sapiens
agcccctcatggtgtctagacag

SEQ ID NO: 7504145 - DNA, 23 bp, Homo sapiens
agcccctcatggtgtctagacag

SEQ ID NO: 7504146 - DNA, 23 bp, Homo sapiens
agcccctcatatctgctttctct

SEQ ID NO: 7504147 - DNA, 23 bp, Homo sapiens
agcccctcatatctgctttctct

SEQ ID NO: 7504148 - DNA, 23 bp, Homo sapiens
agcccctcatggtgtctagacag

SEQ ID NO: 7504149 - DNA, 23 bp, Homo sapiens
agcccctcatggtgtctagacag

SEQ ID NO: 7504150 - DNA, 17 bp, Homo sapiens
agcccctcagcgtcacc

SEQ ID NO: 7504151 - DNA, 17 bp, Homo sapiens
agcccctcagcgtcacc

SEQ ID NO: 7504152 - DNA, 23 bp, Homo sapiens
agcccctcatatctgctttctct

SEQ ID NO: 7504153 - DNA, 23 bp, Homo sapiens
agcccctcatatctgctttctct

SEQ ID NO: 7504154 - DNA, 17 bp, Homo sapiens
agcccctcagcgtcacc

SEQ ID NO: 7504155 - DNA, 22 bp, Homo sapiens
agcccctctgtagctaatagta

SEQ ID NO: 7504156 - DNA, 22 bp, Homo sapiens
agcccctctgtagctaatagta

SEQ ID NO: 7504157 - DNA, 22 bp, Homo sapiens
agcccctctgtggctctgcctc

SEQ ID NO: 7504158 - DNA, 22 bp, Homo sapiens
agcccctctgtggctctgcctc

SEQ ID NO: 7504159 - DNA, 22 bp, Homo sapiens
agcccctctgtagctaatagta

SEQ ID NO: 7504160 - DNA, 22 bp, Homo sapiens
agcccctctgtagctaatagta

SEQ ID NO: 7504161 - DNA, 22 bp, Homo sapiens
agcccctctgtagctaatagta

SEQ ID NO: 7504162 - DNA, 22 bp, Homo sapiens
agcccctctccgccctgagtcg

SEQ ID NO: 7504163 - DNA, 22 bp, Homo sapiens
agcccctccagtggcataaaat

SEQ ID NO: 7504164 - DNA, 22 bp, Homo sapiens
agcccctccagtggcataaaat

SEQ ID NO: 7504165 - DNA, 22 bp, Homo sapiens
agcccctccagtggcataaaat

SEQ ID NO: 7504166 - DNA, 22 bp, Homo sapiens
agcccctccagtggcataaaat

SEQ ID NO: 7504167 - DNA, 22 bp, Homo sapiens
agcccctccagtggcataaaat

SEQ ID NO: 7504168 - DNA, 22 bp, Homo sapiens
agcccctctccgccctgagtcg

SEQ ID NO: 7504169 - DNA, 22 bp, Homo sapiens
agcccctctccgccctgagtcg

SEQ ID NO: 7504170 - DNA, 22 bp, Homo sapiens
agcccctctccgccctgagtcg

SEQ ID NO: 7504171 - DNA, 22 bp, Homo sapiens
agcccctctccgccctgagtcg

SEQ ID NO: 7504172 - DNA, 19 bp, Homo sapiens
agcccccagacagcaggcc

SEQ ID NO: 7504173 - DNA, 22 bp, Homo sapiens
agcccccaggagtctccacgcc

SEQ ID NO: 7504174 - DNA, 22 bp, Homo sapiens
agcccccaggagtctccacgcc

SEQ ID NO: 7504175 - DNA, 22 bp, Homo sapiens
agcccccaggagtctccacgcc

SEQ ID NO: 7504176 - DNA, 22 bp, Homo sapiens
agcccccaggagtctccacgcc

SEQ ID NO: 7504177 - DNA, 22 bp, Homo sapiens
acagagcatttgggacagagag

SEQ ID NO: 7504178 - DNA, 22 bp, Homo sapiens
acagagcatttgggacagagag

SEQ ID NO: 7504179 - DNA, 22 bp, Homo sapiens
agcccccaggatgcaaaatgac

SEQ ID NO: 7504180 - DNA, 22 bp, Homo sapiens
agcccccaggagtctccacgcc

SEQ ID NO: 7504181 - DNA, 22 bp, Homo sapiens
agcccccaggagtctccacgcc

SEQ ID NO: 7504182 - DNA, 22 bp, Homo sapiens
agccccctccctagtgactgga

SEQ ID NO: 7504183 - DNA, 22 bp, Homo sapiens
agccccccaagggccttctctt

SEQ ID NO: 7504184 - DNA, 22 bp, Homo sapiens
agcccctgctgggtgtagctca

SEQ ID NO: 7504185 - DNA, 22 bp, Homo sapiens
agcccctgctgggtgtagctca

SEQ ID NO: 7504186 - DNA, 22 bp, Homo sapiens
agcccctgctgggtgtagctca

SEQ ID NO: 7504187 - DNA, 22 bp, Homo sapiens
agcccctgctgggtgtagctca

SEQ ID NO: 7504188 - DNA, 22 bp, Homo sapiens
agcccctgctgggtgtagctca

SEQ ID NO: 7504189 - DNA, 22 bp, Homo sapiens
agcccctgggagtagctgctgc

SEQ ID NO: 7504190 - DNA, 22 bp, Homo sapiens
agcccctctgtggctctgcctc

SEQ ID NO: 7504191 - DNA, 22 bp, Homo sapiens
agcccctctgtggctctgcctc

SEQ ID NO: 7504192 - DNA, 22 bp, Homo sapiens
agcccctctgtggctctgcctc

SEQ ID NO: 7504193 - DNA, 22 bp, Homo sapiens
agcccctctgtggctctgcctc

SEQ ID NO: 7504194 - DNA, 22 bp, Homo sapiens
agcccctctgtggctctgcctc

SEQ ID NO: 7504195 - DNA, 22 bp, Homo sapiens
agcccctgtaccctgagtgctt

SEQ ID NO: 7504196 - DNA, 22 bp, Homo sapiens
agcccctgtaccctgagtgctt

SEQ ID NO: 7504197 - DNA, 22 bp, Homo sapiens
agcccctgtaccctgagtgctt

SEQ ID NO: 7504198 - DNA, 22 bp, Homo sapiens
agcccctgtaccctgagtgctt

SEQ ID NO: 7504199 - DNA, 23 bp, Homo sapiens
acagaggtccaaacagtataagc

SEQ ID NO: 7504200 - DNA, 22 bp, Homo sapiens
agcccctgtaccctgagtgctt

SEQ ID NO: 7504201 - DNA, 22 bp, Homo sapiens
agcccctgtaccctgagtgctt

SEQ ID NO: 7504202 - DNA, 22 bp, Homo sapiens
agcccctgggagtagctgctgc

SEQ ID NO: 7504203 - DNA, 22 bp, Homo sapiens
agcccctgggagtagctgctgc

SEQ ID NO: 7504204 - DNA, 22 bp, Homo sapiens
agcccctgggagtagctgctgc

SEQ ID NO: 7504205 - DNA, 19 bp, Homo sapiens
acagagtccagaggaaagg

SEQ ID NO: 7504206 - DNA, 22 bp, Homo sapiens
acagagtcattcattgtccagt

SEQ ID NO: 7504207 - DNA, 19 bp, Homo sapiens
acagagtccagaggaaagg

SEQ ID NO: 7504208 - DNA, 22 bp, Homo sapiens
acagagtcattcattgtccagt

SEQ ID NO: 7504209 - DNA, 22 bp, Homo sapiens
acagagtcctagctgcaaagaa

SEQ ID NO: 7504210 - DNA, 22 bp, Homo sapiens
acagagtcctagctgcaaagaa

SEQ ID NO: 7504211 - DNA, 23 bp, Homo sapiens
acagaggtccaaacagtataagc

SEQ ID NO: 7504212 - DNA, 22 bp, Homo sapiens
acagaggtggacctcagcaggc

SEQ ID NO: 7504213 - DNA, 22 bp, Homo sapiens
acagaggtggacctcagcaggc

SEQ ID NO: 7504214 - DNA, 22 bp, Homo sapiens
acagaggtggacctcagcaggc

SEQ ID NO: 7504215 - DNA, 22 bp, Homo sapiens
acagagtcgccttgtagctggc

SEQ ID NO: 7504216 - DNA, 22 bp, Homo sapiens
acagagtctcaaacctacaaag

SEQ ID NO: 7504217 - DNA, 22 bp, Homo sapiens
acagagtctcagggatgaaagc

SEQ ID NO: 7504218 - DNA, 22 bp, Homo sapiens
acagagtctgacaggtaggcgc

SEQ ID NO: 7504219 - DNA, 22 bp, Homo sapiens
acagagtctgacaggtaggcgc

SEQ ID NO: 7504220 - DNA, 22 bp, Homo sapiens
acagagtctcagggatgaaagc

SEQ ID NO: 7504221 - DNA, 22 bp, Homo sapiens
acagagtggagttcagtaaata

SEQ ID NO: 7504222 - DNA, 22 bp, Homo sapiens
acagagtggagttcagtaaata

SEQ ID NO: 7504223 - DNA, 19 bp, Homo sapiens
acagagtgatgaggataga

SEQ ID NO: 7504224 - DNA, 22 bp, Homo sapiens
acagagtcttacgtggtgataa

SEQ ID NO: 7504225 - DNA, 22 bp, Homo sapiens
acagataaagaaacaatcacag

SEQ ID NO: 7504226 - DNA, 22 bp, Homo sapiens
acagataaagaaacaatcacag

SEQ ID NO: 7504227 - DNA, 22 bp, Homo sapiens
acagagtttatgtgtgtacaaa

SEQ ID NO: 7504228 - DNA, 22 bp, Homo sapiens
acagataaagaaacaatcacag

SEQ ID NO: 7504229 - DNA, 22 bp, Homo sapiens
acagataaaagttgtttaaaat

SEQ ID NO: 7504230 - DNA, 22 bp, Homo sapiens
acagagttgtgtttgtacaacg

SEQ ID NO: 7504231 - DNA, 22 bp, Homo sapiens
acagataaaagttgtttaaaat

SEQ ID NO: 7504232 - DNA, 22 bp, Homo sapiens
acagagtttatgtgtgtacaaa

SEQ ID NO: 7504233 - DNA, 22 bp, Homo sapiens
acagataaggcagttaagagtt

SEQ ID NO: 7504234 - DNA, 22 bp, Homo sapiens
acagataaggcagttaagagtt

SEQ ID NO: 7504235 - DNA, 22 bp, Homo sapiens
acagataaatttataggagtgt

SEQ ID NO: 7504236 - DNA, 22 bp, Homo sapiens
acagataaatttataggagtgt

SEQ ID NO: 7504237 - DNA, 22 bp, Homo sapiens
agcctgagtgcttaggactgtt

SEQ ID NO: 7504238 - DNA, 22 bp, Homo sapiens
acagataatacattgtgctaca

SEQ ID NO: 7504239 - DNA, 22 bp, Homo sapiens
acagataatacattgtgctaca

SEQ ID NO: 7504240 - DNA, 22 bp, Homo sapiens
acagataatacattgtgctaca

SEQ ID NO: 7504241 - DNA, 22 bp, Homo sapiens
acagataatacattgtgctaca

SEQ ID NO: 7504242 - DNA, 22 bp, Homo sapiens
acagataatacattgtgctaca

SEQ ID NO: 7504243 - DNA, 19 bp, Homo sapiens
acagagtgatgaggataga

SEQ ID NO: 7504244 - DNA, 17 bp, Homo sapiens
acagagtgtcccgcagt

SEQ ID NO: 7504245 - DNA, 17 bp, Homo sapiens
acagagtgtcccgcagt

SEQ ID NO: 7504246 - DNA, 22 bp, Homo sapiens
acagagtggagttcagtaaata

SEQ ID NO: 7504247 - DNA, 22 bp, Homo sapiens
acagagtgtttttaagtatatt

SEQ ID NO: 7504248 - DNA, 22 bp, Homo sapiens
acagagtgtttttaagtatatt

SEQ ID NO: 7504249 - DNA, 22 bp, Homo sapiens
acagagtgtttttaagtatatt

SEQ ID NO: 7504250 - DNA, 22 bp, Homo sapiens
acagagttaatggataggcagg

SEQ ID NO: 7504251 - DNA, 22 bp, Homo sapiens
acagagttacataacttgtcca

SEQ ID NO: 7504252 - DNA, 22 bp, Homo sapiens
acagagttaatggataggcagg

SEQ ID NO: 7504253 - DNA, 22 bp, Homo sapiens
acagagttaatggataggcagg

SEQ ID NO: 7504254 - DNA, 22 bp, Homo sapiens
acagagttagcagaaagttgga

SEQ ID NO: 7504255 - DNA, 22 bp, Homo sapiens
acagagttagcagaaagttgga

SEQ ID NO: 7504256 - DNA, 22 bp, Homo sapiens
acagagttcccactccagaagc

SEQ ID NO: 7504257 - DNA, 22 bp, Homo sapiens
acagagttcccactccagaagc

SEQ ID NO: 7504258 - DNA, 22 bp, Homo sapiens
acagagttcccactccagaagc

SEQ ID NO: 7504259 - DNA, 22 bp, Homo sapiens
acagagttgtgtttgtacaacg

SEQ ID NO: 7504260 - DNA, 22 bp, Homo sapiens
acagagttgtgtttgtacaacg

SEQ ID NO: 7504261 - DNA, 22 bp, Homo sapiens
acagagttgtgtttgtacaacg

SEQ ID NO: 7504262 - DNA, 22 bp, Homo sapiens
acagagttgtgtttgtacaacg

SEQ ID NO: 7504263 - DNA, 22 bp, Homo sapiens
acagagttgtgtttgtacaacg

SEQ ID NO: 7504264 - DNA, 22 bp, Homo sapiens
agctccttgaagggctctggga

SEQ ID NO: 7504265 - DNA, 22 bp, Homo sapiens
agctccttgaagggctctggga

SEQ ID NO: 7504266 - DNA, 22 bp, Homo sapiens
agctcgcccctccctcttattt

SEQ ID NO: 7504267 - DNA, 22 bp, Homo sapiens
agctctatcacctgtcagttgc

SEQ ID NO: 7504268 - DNA, 22 bp, Homo sapiens
agctctaaatggaattttgcct

SEQ ID NO: 7504269 - DNA, 22 bp, Homo sapiens
agctctccacacataggactag

SEQ ID NO: 7504270 - DNA, 22 bp, Homo sapiens
agctctcattactttacagatg

SEQ ID NO: 7504271 - DNA, 22 bp, Homo sapiens
agctctcaagataagaaagaac

SEQ ID NO: 7504272 - DNA, 20 bp, Homo sapiens
agctctcagcatgctgcctg

SEQ ID NO: 7504273 - DNA, 21 bp, Homo sapiens
agctctatgacttggccaggt

SEQ ID NO: 7504274 - DNA, 22 bp, Homo sapiens
agctctcaagataagaaagaac

SEQ ID NO: 7504275 - DNA, 22 bp, Homo sapiens
agctcctgttctgagagcagga

SEQ ID NO: 7504276 - DNA, 22 bp, Homo sapiens
agctccttgaagggctctggga

SEQ ID NO: 7504277 - DNA, 22 bp, Homo sapiens
agctccttgaagggctctggga

SEQ ID NO: 7504278 - DNA, 22 bp, Homo sapiens
agctcctgttctgagagcagga

SEQ ID NO: 7504279 - DNA, 22 bp, Homo sapiens
agctcctgttctgagagcagga

SEQ ID NO: 7504280 - DNA, 22 bp, Homo sapiens
agctcctgttctgagagcagga

SEQ ID NO: 7504281 - DNA, 22 bp, Homo sapiens
agctcctgttctgagagcagga

SEQ ID NO: 7504282 - DNA, 22 bp, Homo sapiens
agctcctgttctgagagcagga

SEQ ID NO: 7504283 - DNA, 22 bp, Homo sapiens
agctcctgttctgagagcagga

SEQ ID NO: 7504284 - DNA, 22 bp, Homo sapiens
agctcctgttctgagagcagga

SEQ ID NO: 7504285 - DNA, 19 bp, Homo sapiens
agctcctgttcagcagctc

SEQ ID NO: 7504286 - DNA, 19 bp, Homo sapiens
agctcctgttcagcagctc

SEQ ID NO: 7504287 - DNA, 19 bp, Homo sapiens
agctcctgttcagcagctc

SEQ ID NO: 7504288 - DNA, 19 bp, Homo sapiens
agctcctgttcagcagctc

SEQ ID NO: 7504289 - DNA, 19 bp, Homo sapiens
agctcctgttcagcagctc

SEQ ID NO: 7504290 - DNA, 19 bp, Homo sapiens
agctcctgttcagcagctc

SEQ ID NO: 7504291 - DNA, 19 bp, Homo sapiens
agctcctgttcagcagctc

SEQ ID NO: 7504292 - DNA, 22 bp, Homo sapiens
agctctgggctgacatgctccc

SEQ ID NO: 7504293 - DNA, 22 bp, Homo sapiens
agctctgggccaggaaccctaa

SEQ ID NO: 7504294 - DNA, 22 bp, Homo sapiens
agctctgggctgacatgctccc

SEQ ID NO: 7504295 - DNA, 22 bp, Homo sapiens
agctctgggccaggaaccctaa

SEQ ID NO: 7504296 - DNA, 22 bp, Homo sapiens
agctctcccaccttcttcttac

SEQ ID NO: 7504297 - DNA, 22 bp, Homo sapiens
agctctccatctatctgtgatg

SEQ ID NO: 7504298 - DNA, 22 bp, Homo sapiens
agctctccatctatctgtgatg

SEQ ID NO: 7504299 - DNA, 22 bp, Homo sapiens
agctctccacacataggactag

SEQ ID NO: 7504300 - DNA, 18 bp, Homo sapiens
agctctggggagatgggc

SEQ ID NO: 7504301 - DNA, 18 bp, Homo sapiens
agctctggggagatgggc

SEQ ID NO: 7504302 - DNA, 18 bp, Homo sapiens
agctctggggagatgggc

SEQ ID NO: 7504303 - DNA, 18 bp, Homo sapiens
agctctggggagatgggc

SEQ ID NO: 7504304 - DNA, 22 bp, Homo sapiens
agctctgggctgacatgctccc

SEQ ID NO: 7504305 - DNA, 22 bp, Homo sapiens
agctctgggctgacatgctccc

SEQ ID NO: 7504306 - DNA, 22 bp, Homo sapiens
agctctgggctgacatgctccc

SEQ ID NO: 7504307 - DNA, 22 bp, Homo sapiens
agctctgggctgacatgctccc

SEQ ID NO: 7504308 - DNA, 22 bp, Homo sapiens
agctctgggctgacatgctccc

SEQ ID NO: 7504309 - DNA, 22 bp, Homo sapiens
agctctgggctgacatgctccc

SEQ ID NO: 7504310 - DNA, 22 bp, Homo sapiens
agctctgggggaaagtctgctc

SEQ ID NO: 7504311 - DNA, 22 bp, Homo sapiens
agctctgggggaaagtctgctc

SEQ ID NO: 7504312 - DNA, 22 bp, Homo sapiens
agctctgggggaaagtctgctc

SEQ ID NO: 7504313 - DNA, 22 bp, Homo sapiens
agctctggggtggagcccagga

SEQ ID NO: 7504314 - DNA, 22 bp, Homo sapiens
agctctggggtagggcccaaca

SEQ ID NO: 7504315 - DNA, 22 bp, Homo sapiens
agctctggggtagggcccaaca

SEQ ID NO: 7504316 - DNA, 22 bp, Homo sapiens
agctctgggggaaagtctgctc

SEQ ID NO: 7504317 - DNA, 22 bp, Homo sapiens
agctctggggtagggcccaaca

SEQ ID NO: 7504318 - DNA, 22 bp, Homo sapiens
agctctgggggaaagtctgctc

SEQ ID NO: 7504319 - DNA, 18 bp, Homo sapiens
agctctggggagatgggc

SEQ ID NO: 7504320 - DNA, 18 bp, Homo sapiens
agctctggggagatgggc

SEQ ID NO: 7504321 - DNA, 22 bp, Homo sapiens
agctctggggcctgtcccacat

SEQ ID NO: 7504322 - DNA, 22 bp, Homo sapiens
agctctggggcctgtcccacat

SEQ ID NO: 7504323 - DNA, 22 bp, Homo sapiens
agctctggggcctgtcccacat

SEQ ID NO: 7504324 - DNA, 22 bp, Homo sapiens
agctctggggcctgtcccacat

SEQ ID NO: 7504325 - DNA, 22 bp, Homo sapiens
agctctggggcctgtcccacat

SEQ ID NO: 7504326 - DNA, 22 bp, Homo sapiens
agctctgggggaaagtctgctc

SEQ ID NO: 7504327 - DNA, 22 bp, Homo sapiens
agctctgggggaaagtctgctc

SEQ ID NO: 7504328 - DNA, 22 bp, Homo sapiens
agctctgggggaaagtctgctc

SEQ ID NO: 7504329 - DNA, 22 bp, Homo sapiens
acagcaggcatgaagaaatgtt

SEQ ID NO: 7504330 - DNA, 22 bp, Homo sapiens
acagcaggcatgaagaaatgtt

SEQ ID NO: 7504331 - DNA, 22 bp, Homo sapiens
acagcaggcatgaagaaatgtt

SEQ ID NO: 7504332 - DNA, 22 bp, Homo sapiens
acagcaggcacacaaggataga

SEQ ID NO: 7504333 - DNA, 22 bp, Homo sapiens
acagcaggcacacaaggataga

SEQ ID NO: 7504334 - DNA, 22 bp, Homo sapiens
acagcaggcacacaaggataga

SEQ ID NO: 7504335 - DNA, 22 bp, Homo sapiens
acagcaggcacacaaggataga

SEQ ID NO: 7504336 - DNA, 22 bp, Homo sapiens
acagcaggcacacaaggataga

SEQ ID NO: 7504337 - DNA, 22 bp, Homo sapiens
acagcaggcacacaaggataga

SEQ ID NO: 7504338 - DNA, 22 bp, Homo sapiens
acagcaggatttggcgatgttg

SEQ ID NO: 7504339 - DNA, 22 bp, Homo sapiens
acagcaggatttggcgatgttg

SEQ ID NO: 7504340 - DNA, 22 bp, Homo sapiens
acagcaggcacacaaggataga

SEQ ID NO: 7504341 - DNA, 22 bp, Homo sapiens
acagcaggatttggcgatgttg

SEQ ID NO: 7504342 - DNA, 22 bp, Homo sapiens
acagcaggatttggcgatgttg

SEQ ID NO: 7504343 - DNA, 22 bp, Homo sapiens
acagcaggcatgaatgacactg

SEQ ID NO: 7504344 - DNA, 22 bp, Homo sapiens
acagcaggcatgaatgacactg

SEQ ID NO: 7504345 - DNA, 22 bp, Homo sapiens
acagcaggcatgaatgacactg

SEQ ID NO: 7504346 - DNA, 22 bp, Homo sapiens
acagcaggcatgaatgacactg

SEQ ID NO: 7504347 - DNA, 22 bp, Homo sapiens
agctcctgtgtgcccacctgct

SEQ ID NO: 7504348 - DNA, 22 bp, Homo sapiens
agctcctgtgtgcccacctgct

SEQ ID NO: 7504349 - DNA, 22 bp, Homo sapiens
agctcctgtgtgcccacctgct

SEQ ID NO: 7504350 - DNA, 22 bp, Homo sapiens
agctcctgtgtgcccacctgct

SEQ ID NO: 7504351 - DNA, 22 bp, Homo sapiens
agctcctgtgtgcccacctgct

SEQ ID NO: 7504352 - DNA, 22 bp, Homo sapiens
agctcctgtgtgcccacctgct

SEQ ID NO: 7504353 - DNA, 22 bp, Homo sapiens
acagcaggcatgaatgacactg

SEQ ID NO: 7504354 - DNA, 22 bp, Homo sapiens
acagcaggcatgaatgacactg

SEQ ID NO: 7504355 - DNA, 22 bp, Homo sapiens
acagcaggcatgaagaaatgtt

SEQ ID NO: 7504356 - DNA, 22 bp, Homo sapiens
acagcaggcatgaatgacactg

SEQ ID NO: 7504357 - DNA, 22 bp, Homo sapiens
acagcaggcatgaagaaatgtt

SEQ ID NO: 7504358 - DNA, 22 bp, Homo sapiens
acagcaggcatgaagaaatgtt

SEQ ID NO: 7504359 - DNA, 22 bp, Homo sapiens
acagcaggcatgaagaaatgtt

SEQ ID NO: 7504360 - DNA, 22 bp, Homo sapiens
agctatttcaggaaatttgtga

SEQ ID NO: 7504361 - DNA, 22 bp, Homo sapiens
agctatttcaggaaatttgtga

SEQ ID NO: 7504362 - DNA, 22 bp, Homo sapiens
agctatttcaggaaatttgtga

SEQ ID NO: 7504363 - DNA, 22 bp, Homo sapiens
agctatttcaggaaatttgtga

SEQ ID NO: 7504364 - DNA, 22 bp, Homo sapiens
agctatttctcttattatatcc

SEQ ID NO: 7504365 - DNA, 22 bp, Homo sapiens
agctatttctcttattatatcc

SEQ ID NO: 7504366 - DNA, 22 bp, Homo sapiens
agctatttctcttattatatcc

SEQ ID NO: 7504367 - DNA, 22 bp, Homo sapiens
agctattgtgtgcccagcagga

SEQ ID NO: 7504368 - DNA, 22 bp, Homo sapiens
agctatttcaaagtttgagaca

SEQ ID NO: 7504369 - DNA, 22 bp, Homo sapiens
agctatttcaaagtttgagaca

SEQ ID NO: 7504370 - DNA, 21 bp, Homo sapiens
agctatttcagatttgagagc

SEQ ID NO: 7504371 - DNA, 21 bp, Homo sapiens
agctatttcagatttgagagc

SEQ ID NO: 7504372 - DNA, 22 bp, Homo sapiens
agctcaagcgtgggctgggcgc

SEQ ID NO: 7504373 - DNA, 22 bp, Homo sapiens
agctcaaagctgttacattgta

SEQ ID NO: 7504374 - DNA, 22 bp, Homo sapiens
agctcaagagtagttcgagggg

SEQ ID NO: 7504375 - DNA, 22 bp, Homo sapiens
agctcaagagtagttcgagggg

SEQ ID NO: 7504376 - DNA, 22 bp, Homo sapiens
acagcagctaaaggtgtctcct

SEQ ID NO: 7504377 - DNA, 22 bp, Homo sapiens
acagcagctaaaggtgtctcct

SEQ ID NO: 7504378 - DNA, 22 bp, Homo sapiens
acagcagcgtgaagtgtgttat

SEQ ID NO: 7504379 - DNA, 22 bp, Homo sapiens
acagcagcgtgaagtgtgttat

SEQ ID NO: 7504380 - DNA, 22 bp, Homo sapiens
acagcagcgtgaagtgtgttat

SEQ ID NO: 7504381 - DNA, 22 bp, Homo sapiens
acagcaggaattaacatataag

SEQ ID NO: 7504382 - DNA, 22 bp, Homo sapiens
acagcaggaattaacatataag

SEQ ID NO: 7504383 - DNA, 22 bp, Homo sapiens
acagcaggaattaacatataag

SEQ ID NO: 7504384 - DNA, 22 bp, Homo sapiens
acagcaggaattaacatataag

SEQ ID NO: 7504385 - DNA, 22 bp, Homo sapiens
acagcaggaagctggagggaaa

SEQ ID NO: 7504386 - DNA, 22 bp, Homo sapiens
acagcaggaattaacatataag

SEQ ID NO: 7504387 - DNA, 22 bp, Homo sapiens
acagcagctaaaggtgtctcct

SEQ ID NO: 7504388 - DNA, 22 bp, Homo sapiens
acagcagctaaaggtgtctcct

SEQ ID NO: 7504389 - DNA, 22 bp, Homo sapiens
acagcagctaaaggtgtctcct

SEQ ID NO: 7504390 - DNA, 22 bp, Homo sapiens
acagcagctaaaggtgtctcct

SEQ ID NO: 7504391 - DNA, 22 bp, Homo sapiens
acagcaggatttggcgatgttg

SEQ ID NO: 7504392 - DNA, 22 bp, Homo sapiens
acagcaggagccttcatatgct

SEQ ID NO: 7504393 - DNA, 22 bp, Homo sapiens
acagcaggatttggcgatgttg

SEQ ID NO: 7504394 - DNA, 22 bp, Homo sapiens
acagcaggagccttcatatgct

SEQ ID NO: 7504395 - DNA, 22 bp, Homo sapiens
acagcaggagccttcatatgct

SEQ ID NO: 7504396 - DNA, 22 bp, Homo sapiens
acagcaggagccttcatatgct

SEQ ID NO: 7504397 - DNA, 22 bp, Homo sapiens
acagcaggagccttcatatgct

SEQ ID NO: 7504398 - DNA, 22 bp, Homo sapiens
acagcaggagccttcatatgct

SEQ ID NO: 7504399 - DNA, 22 bp, Homo sapiens
agcctgcgatcccacctggcct

SEQ ID NO: 7504400 - DNA, 22 bp, Homo sapiens
agcctgcgatcccacctggcct

SEQ ID NO: 7504401 - DNA, 17 bp, Homo sapiens
agcctgctgatctcaca

SEQ ID NO: 7504402 - DNA, 17 bp, Homo sapiens
agcctgctgatctcaca

SEQ ID NO: 7504403 - DNA, 17 bp, Homo sapiens
agcctgctgatctcaca

SEQ ID NO: 7504404 - DNA, 22 bp, Homo sapiens
agcctgcgcggcctggggcgaa

SEQ ID NO: 7504405 - DNA, 22 bp, Homo sapiens
agcctgccttgggctgcttgag

SEQ ID NO: 7504406 - DNA, 22 bp, Homo sapiens
agcctgccttgggctgcttgag

SEQ ID NO: 7504407 - DNA, 22 bp, Homo sapiens
agcctgccttgggctgcttgag

SEQ ID NO: 7504408 - DNA, 17 bp, Homo sapiens
agcctgctgatctcaca

SEQ ID NO: 7504409 - DNA, 22 bp, Homo sapiens
agcctgctggaccaagctcatg

SEQ ID NO: 7504410 - DNA, 22 bp, Homo sapiens
acagatttaggactgtagcgat

SEQ ID NO: 7504411 - DNA, 22 bp, Homo sapiens
acagatttaggactgtagcgat

SEQ ID NO: 7504412 - DNA, 21 bp, Homo sapiens
acagattgctgagctctacct

SEQ ID NO: 7504413 - DNA, 23 bp, Homo sapiens
acagattggccatgagtcaccaa

SEQ ID NO: 7504414 - DNA, 23 bp, Homo sapiens
acagattggccatgagtcaccaa

SEQ ID NO: 7504415 - DNA, 22 bp, Homo sapiens
acagattgatcttgagaattat

SEQ ID NO: 7504416 - DNA, 22 bp, Homo sapiens
acagcaagacccctagcatggt

SEQ ID NO: 7504417 - DNA, 22 bp, Homo sapiens
acagcaagacccctagcatggt

SEQ ID NO: 7504418 - DNA, 22 bp, Homo sapiens
acagcaactcctgcttctgagt

SEQ ID NO: 7504419 - DNA, 22 bp, Homo sapiens
acagcaaatggttttctgtctg

SEQ ID NO: 7504420 - DNA, 22 bp, Homo sapiens
acagcaaatggttttctgtctg

SEQ ID NO: 7504421 - DNA, 22 bp, Homo sapiens
acagattgggaactgtctcctt

SEQ ID NO: 7504422 - DNA, 22 bp, Homo sapiens
acagcaaatggttttctgtctg

SEQ ID NO: 7504423 - DNA, 22 bp, Homo sapiens
acagcaaaggacgaacactctg

SEQ ID NO: 7504424 - DNA, 22 bp, Homo sapiens
acagcaaaggacgaacactctg

SEQ ID NO: 7504425 - DNA, 22 bp, Homo sapiens
acagcaaaggacgaacactctg

SEQ ID NO: 7504426 - DNA, 22 bp, Homo sapiens
acagcaaatggttttctgtctg

SEQ ID NO: 7504427 - DNA, 22 bp, Homo sapiens
acagcaaatggttttctgtctg

SEQ ID NO: 7504428 - DNA, 22 bp, Homo sapiens
acagcaaaagacaagaacttaa

SEQ ID NO: 7504429 - DNA, 22 bp, Homo sapiens
acagcaaaagacaagaacttaa

SEQ ID NO: 7504430 - DNA, 22 bp, Homo sapiens
acagcaaaagacaagaacttaa

SEQ ID NO: 7504431 - DNA, 22 bp, Homo sapiens
acagcaaaggacgaacactctg

SEQ ID NO: 7504432 - DNA, 22 bp, Homo sapiens
acagcaaaggacgaacactctg

SEQ ID NO: 7504433 - DNA, 22 bp, Homo sapiens
acagcaaaggacgaacactctg

SEQ ID NO: 7504434 - DNA, 22 bp, Homo sapiens
acagcaaaggacgaacactctg

SEQ ID NO: 7504435 - DNA, 22 bp, Homo sapiens
acagcaaaggacgaacactctg

SEQ ID NO: 7504436 - DNA, 22 bp, Homo sapiens
acagcaaaggacgaacactctg

SEQ ID NO: 7504437 - DNA, 17 bp, Homo sapiens
agcctgccccatgctgc

SEQ ID NO: 7504438 - DNA, 17 bp, Homo sapiens
agcctgccccatgctgc

SEQ ID NO: 7504439 - DNA, 17 bp, Homo sapiens
agcctgccccatgctgc

SEQ ID NO: 7504440 - DNA, 17 bp, Homo sapiens
agcctgccccatgctgc

SEQ ID NO: 7504441 - DNA, 22 bp, Homo sapiens
agcctgccaggcgctgcctgga

SEQ ID NO: 7504442 - DNA, 22 bp, Homo sapiens
agcctgcctcagactcaggata

SEQ ID NO: 7504443 - DNA, 17 bp, Homo sapiens
agcctgccccatgctgc

SEQ ID NO: 7504444 - DNA, 22 bp, Homo sapiens
agcctgcctcagactcaggata

SEQ ID NO: 7504445 - DNA, 22 bp, Homo sapiens
agcctgcctcagactcaggata

SEQ ID NO: 7504446 - DNA, 17 bp, Homo sapiens
agcctgccccatgctgc

SEQ ID NO: 7504447 - DNA, 22 bp, Homo sapiens
agcctgcctcagactcaggata

SEQ ID NO: 7504448 - DNA, 22 bp, Homo sapiens
agcctgcctcagactcaggata

SEQ ID NO: 7504449 - DNA, 22 bp, Homo sapiens
agcctgcctcagactcaggata

SEQ ID NO: 7504450 - DNA, 22 bp, Homo sapiens
agcctgcctgtgaggctttgag

SEQ ID NO: 7504451 - DNA, 21 bp, Homo sapiens
agcctgcctgaactctgtggc

SEQ ID NO: 7504452 - DNA, 22 bp, Homo sapiens
agcctgcctgtgaggctttgag

SEQ ID NO: 7504453 - DNA, 22 bp, Homo sapiens
agcctgccaggcgctgcctgga

SEQ ID NO: 7504454 - DNA, 22 bp, Homo sapiens
agcctgccaggcgctgcctgga

SEQ ID NO: 7504455 - DNA, 22 bp, Homo sapiens
agcctgccaggcgctgcctgga

SEQ ID NO: 7504456 - DNA, 20 bp, Homo sapiens
agcctgccagctggcccaga

SEQ ID NO: 7504457 - DNA, 20 bp, Homo sapiens
agcctgccagctggcccaga

SEQ ID NO: 7504458 - DNA, 22 bp, Homo sapiens
agcctgccaggcgctgcctgga

SEQ ID NO: 7504459 - DNA, 22 bp, Homo sapiens
agcctgccaggcgctgcctgga

SEQ ID NO: 7504460 - DNA, 22 bp, Homo sapiens
agcctgccaggcgctgcctgga

SEQ ID NO: 7504461 - DNA, 22 bp, Homo sapiens
agcctgccaggcgctgcctgga

SEQ ID NO: 7504462 - DNA, 22 bp, Homo sapiens
agcctgccaggcgctgcctgga

SEQ ID NO: 7504463 - DNA, 20 bp, Homo sapiens
agcctgccagctggcccaga

SEQ ID NO: 7504464 - DNA, 20 bp, Homo sapiens
agcctgccagctggcccaga

SEQ ID NO: 7504465 - DNA, 20 bp, Homo sapiens
agcctgccagctggcccaga

SEQ ID NO: 7504466 - DNA, 20 bp, Homo sapiens
agcctgccagctggcccaga

SEQ ID NO: 7504467 - DNA, 22 bp, Homo sapiens
agcctgcaggatgggcagcacc

SEQ ID NO: 7504468 - DNA, 22 bp, Homo sapiens
agcctgcaggatgggcagcacc

SEQ ID NO: 7504469 - DNA, 22 bp, Homo sapiens
agcctgcacctgaccaacctgc

SEQ ID NO: 7504470 - DNA, 22 bp, Homo sapiens
agcctgcacctgaccaacctgc

SEQ ID NO: 7504471 - DNA, 22 bp, Homo sapiens
acagcaatctgagagacatagt

SEQ ID NO: 7504472 - DNA, 22 bp, Homo sapiens
acagcaatcaatatggcattct

SEQ ID NO: 7504473 - DNA, 22 bp, Homo sapiens
acagcaatctgagagacatagt

SEQ ID NO: 7504474 - DNA, 22 bp, Homo sapiens
acagcaatcaatatggcattct

SEQ ID NO: 7504475 - DNA, 22 bp, Homo sapiens
acagcaataggaaatacttgca

SEQ ID NO: 7504476 - DNA, 22 bp, Homo sapiens
acagcaataggaaatacttgca

SEQ ID NO: 7504477 - DNA, 21 bp, Homo sapiens
acagcaagccttcacatgagt

SEQ ID NO: 7504478 - DNA, 21 bp, Homo sapiens
acagcaagccttcacatgagt

SEQ ID NO: 7504479 - DNA, 21 bp, Homo sapiens
acagcaagccttcacatgagt

SEQ ID NO: 7504480 - DNA, 21 bp, Homo sapiens
acagcaagccttcctttcagg

SEQ ID NO: 7504481 - DNA, 21 bp, Homo sapiens
acagcaagccttcctttcagg

SEQ ID NO: 7504482 - DNA, 21 bp, Homo sapiens
acagcaagccttcacatgagt

SEQ ID NO: 7504483 - DNA, 21 bp, Homo sapiens
acagcaagccttcctttcagg

SEQ ID NO: 7504484 - DNA, 23 bp, Homo sapiens
acagcaagaggaccagatgtgag

SEQ ID NO: 7504485 - DNA, 22 bp, Homo sapiens
acagcaagacccctagcatggt

SEQ ID NO: 7504486 - DNA, 22 bp, Homo sapiens
acagcaagacccctagcatggt

SEQ ID NO: 7504487 - DNA, 22 bp, Homo sapiens
acagcaagacccctagcatggt

SEQ ID NO: 7504488 - DNA, 22 bp, Homo sapiens
acagcaagacccctagcatggt

SEQ ID NO: 7504489 - DNA, 23 bp, Homo sapiens
acagcaagaggaccagatgtgag

SEQ ID NO: 7504490 - DNA, 23 bp, Homo sapiens
acagcaagaggaccagatgtgag

SEQ ID NO: 7504491 - DNA, 23 bp, Homo sapiens
acagcaagaggaccagatgtgag

SEQ ID NO: 7504492 - DNA, 23 bp, Homo sapiens
acagcaagaggaccagatgtgag

SEQ ID NO: 7504493 - DNA, 23 bp, Homo sapiens
acagcaagaggaccagatgtgag

SEQ ID NO: 7504494 - DNA, 21 bp, Homo sapiens
acagcaagccttcacatgagt

SEQ ID NO: 7504495 - DNA, 21 bp, Homo sapiens
acagcaagccttcacatgagt

SEQ ID NO: 7504496 - DNA, 21 bp, Homo sapiens
acagcaagccttcacatgagt

SEQ ID NO: 7504497 - DNA, 21 bp, Homo sapiens
acagcaagccttcacatgagt

SEQ ID NO: 7504498 - DNA, 22 bp, Homo sapiens
acagcaagccagcttgtcactg

SEQ ID NO: 7504499 - DNA, 23 bp, Homo sapiens
acagcaagaggaccagatgtgag

SEQ ID NO: 7504500 - DNA, 22 bp, Homo sapiens
acagcaagccagcttgtcactg

SEQ ID NO: 7504501 - DNA, 22 bp, Homo sapiens
acagcaagccagcttgtcactg

SEQ ID NO: 7504502 - DNA, 23 bp, Homo sapiens
acagcaagaggaccagatgtgag

SEQ ID NO: 7504503 - DNA, 22 bp, Homo sapiens
agctaggggaccaaggtggccc

SEQ ID NO: 7504504 - DNA, 22 bp, Homo sapiens
agctagggctttcgtagacagt

SEQ ID NO: 7504505 - DNA, 22 bp, Homo sapiens
agctaggggaccaaggtggccc

SEQ ID NO: 7504506 - DNA, 17 bp, Homo sapiens
agctagggcctagaatc

SEQ ID NO: 7504507 - DNA, 17 bp, Homo sapiens
agctagggcctagaatc

SEQ ID NO: 7504508 - DNA, 22 bp, Homo sapiens
agctagggacagataccagcca

SEQ ID NO: 7504509 - DNA, 22 bp, Homo sapiens
agctaggataagcagagactgg

SEQ ID NO: 7504510 - DNA, 22 bp, Homo sapiens
agctagggacagataccagcca

SEQ ID NO: 7504511 - DNA, 22 bp, Homo sapiens
agctagggcaaatatgagatac

SEQ ID NO: 7504512 - DNA, 22 bp, Homo sapiens
agctagtatttcattgaggatt

SEQ ID NO: 7504513 - DNA, 22 bp, Homo sapiens
agctaggggaccaaggtggccc

SEQ ID NO: 7504514 - DNA, 22 bp, Homo sapiens
agctagtatttcattgaggatt

SEQ ID NO: 7504515 - DNA, 19 bp, Homo sapiens
agctagtgctcagctgtca

SEQ ID NO: 7504516 - DNA, 19 bp, Homo sapiens
agctagtgctcagctgtca

SEQ ID NO: 7504517 - DNA, 22 bp, Homo sapiens
agctaggggaccaaggtggccc

SEQ ID NO: 7504518 - DNA, 22 bp, Homo sapiens
agctaggggaccaaggtggccc

SEQ ID NO: 7504519 - DNA, 22 bp, Homo sapiens
agctaggggaccaaggtggccc

SEQ ID NO: 7504520 - DNA, 22 bp, Homo sapiens
agctaggggaccaaggtggccc

SEQ ID NO: 7504521 - DNA, 22 bp, Homo sapiens
agctaggggaccaaggtggccc

SEQ ID NO: 7504522 - DNA, 23 bp, Homo sapiens
agctataaaatctgtgacagcag

SEQ ID NO: 7504523 - DNA, 22 bp, Homo sapiens
agctatagctggatcttaagtg

SEQ ID NO: 7504524 - DNA, 22 bp, Homo sapiens
agctatagtacttggcttttct

SEQ ID NO: 7504525 - DNA, 22 bp, Homo sapiens
agctagttaaactatgaataca

SEQ ID NO: 7504526 - DNA, 22 bp, Homo sapiens
agctagtgggctgggagaggaa

SEQ ID NO: 7504527 - DNA, 22 bp, Homo sapiens
agctagttcactgaagcctatg

SEQ ID NO: 7504528 - DNA, 22 bp, Homo sapiens
agctatagctggatcttaagtg

SEQ ID NO: 7504529 - DNA, 22 bp, Homo sapiens
agctatctcaggcactcacatt

SEQ ID NO: 7504530 - DNA, 22 bp, Homo sapiens
agctatgtgtgcagggacagga

SEQ ID NO: 7504531 - DNA, 22 bp, Homo sapiens
agctatgtgttgtgagaaggaa

SEQ ID NO: 7504532 - DNA, 22 bp, Homo sapiens
agctatgtgatttaaacaaggt

SEQ ID NO: 7504533 - DNA, 22 bp, Homo sapiens
agctatgtgccaagaaatgggg

SEQ ID NO: 7504534 - DNA, 22 bp, Homo sapiens
agctatgtgggagggtgagagc

SEQ ID NO: 7504535 - DNA, 22 bp, Homo sapiens
agctatgttctgtgtctgtgga

SEQ ID NO: 7504536 - DNA, 22 bp, Homo sapiens
agctatgtttgacagaaagtga

SEQ ID NO: 7504537 - DNA, 22 bp, Homo sapiens
agctatgttatcattggtcctt

SEQ ID NO: 7504538 - DNA, 22 bp, Homo sapiens
agctatgttcctcgatgctcag

SEQ ID NO: 7504539 - DNA, 20 bp, Homo sapiens
agctatgtgacctgatggaa

SEQ ID NO: 7504540 - DNA, 20 bp, Homo sapiens
agctatgtgacctgatggaa

SEQ ID NO: 7504541 - DNA, 22 bp, Homo sapiens
agctatgtcatttggggctctg

SEQ ID NO: 7504542 - DNA, 21 bp, Homo sapiens
agctatgtcccaccatgacac

SEQ ID NO: 7504543 - DNA, 22 bp, Homo sapiens
agctatgacacggggagcggct

SEQ ID NO: 7504544 - DNA, 22 bp, Homo sapiens
agctatgtaacagtgccatgga

SEQ ID NO: 7504545 - DNA, 22 bp, Homo sapiens
agctatgtataaataggccact

SEQ ID NO: 7504546 - DNA, 22 bp, Homo sapiens
taccattttgaaacatttcatc

SEQ ID NO: 7504547 - DNA, 22 bp, Homo sapiens
taccattttgaaacatttcatc

SEQ ID NO: 7504548 - DNA, 23 bp, Homo sapiens
tactacagggtcttgctatgaat

SEQ ID NO: 7504549 - DNA, 22 bp, Homo sapiens
tactacaagggccctaaaaggt

SEQ ID NO: 7504550 - DNA, 22 bp, Homo sapiens
tactacaaggccgaagctctca

SEQ ID NO: 7504551 - DNA, 22 bp, Homo sapiens
tactacaaggccgaagctctca

SEQ ID NO: 7504552 - DNA, 22 bp, Homo sapiens
tactacaaggccgaagctctca

SEQ ID NO: 7504553 - DNA, 22 bp, Homo sapiens
tactacaagggccctaaaaggt

SEQ ID NO: 7504554 - DNA, 22 bp, Homo sapiens
taccatttgagagagaacataa

SEQ ID NO: 7504555 - DNA, 22 bp, Homo sapiens
taccatttgagagagaacataa

SEQ ID NO: 7504556 - DNA, 22 bp, Homo sapiens
taccatttgagagagaacataa

SEQ ID NO: 7504557 - DNA, 22 bp, Homo sapiens
taccatttgagagagaacataa

SEQ ID NO: 7504558 - DNA, 22 bp, Homo sapiens
taccatttgagagagaacataa

SEQ ID NO: 7504559 - DNA, 22 bp, Homo sapiens
taccatttgagagagaacataa

SEQ ID NO: 7504560 - DNA, 22 bp, Homo sapiens
taccatttgagagagaacataa

SEQ ID NO: 7504561 - DNA, 22 bp, Homo sapiens
taccatttcattctttcctcat

SEQ ID NO: 7504562 - DNA, 22 bp, Homo sapiens
taccatttcattctttcctcat

SEQ ID NO: 7504563 - DNA, 22 bp, Homo sapiens
taccatttcattctttcctcat

SEQ ID NO: 7504564 - DNA, 22 bp, Homo sapiens
taccatttctacatatcttgtc

SEQ ID NO: 7504565 - DNA, 22 bp, Homo sapiens
taccatttctacatatcttgtc

SEQ ID NO: 7504566 - DNA, 22 bp, Homo sapiens
taccatttctacatatcttgtc

SEQ ID NO: 7504567 - DNA, 22 bp, Homo sapiens
tactacatacagaatttagaga

SEQ ID NO: 7504568 - DNA, 22 bp, Homo sapiens
tactacatacagaatttagaga

SEQ ID NO: 7504569 - DNA, 21 bp, Homo sapiens
tactacagtctctttatcagt

SEQ ID NO: 7504570 - DNA, 23 bp, Homo sapiens
tactacagggtcttgctatgaat

SEQ ID NO: 7504571 - DNA, 22 bp, Homo sapiens
tactacacccccttgtgagtgg

SEQ ID NO: 7504572 - DNA, 23 bp, Homo sapiens
tactacagggtcttgctatgaat

SEQ ID NO: 7504573 - DNA, 22 bp, Homo sapiens
tactacagtatgtgtgttatac

SEQ ID NO: 7504574 - DNA, 21 bp, Homo sapiens
tactacagtctctttatcagt

SEQ ID NO: 7504575 - DNA, 22 bp, Homo sapiens
tactactttcccccacatattt

SEQ ID NO: 7504576 - DNA, 22 bp, Homo sapiens
tactactttcattcatctgact

SEQ ID NO: 7504577 - DNA, 22 bp, Homo sapiens
tactactttcccccacatattt

SEQ ID NO: 7504578 - DNA, 22 bp, Homo sapiens
tactacattaataaaacattca

SEQ ID NO: 7504579 - DNA, 22 bp, Homo sapiens
tactacattaataaaacattca

SEQ ID NO: 7504580 - DNA, 22 bp, Homo sapiens
tactacattaataaaacattca

SEQ ID NO: 7504581 - DNA, 22 bp, Homo sapiens
tactacatacagaatttagaga

SEQ ID NO: 7504582 - DNA, 22 bp, Homo sapiens
tactacatacagaatttagaga

SEQ ID NO: 7504583 - DNA, 22 bp, Homo sapiens
tactacatacagaatttagaga

SEQ ID NO: 7504584 - DNA, 22 bp, Homo sapiens
tactacatacagaatttagaga

SEQ ID NO: 7504585 - DNA, 22 bp, Homo sapiens
tactacattaataaaacattca

SEQ ID NO: 7504586 - DNA, 19 bp, Homo sapiens
tactccaatcaggaacaca

SEQ ID NO: 7504587 - DNA, 21 bp, Homo sapiens
tactatgtagtgattgcagga

SEQ ID NO: 7504588 - DNA, 23 bp, Homo sapiens
tactatggttattatccctctcc

SEQ ID NO: 7504589 - DNA, 22 bp, Homo sapiens
tactatactctccattttatag

SEQ ID NO: 7504590 - DNA, 22 bp, Homo sapiens
tactataccatgtaagatatga

SEQ ID NO: 7504591 - DNA, 23 bp, Homo sapiens
tactatggttattatccctctcc

SEQ ID NO: 7504592 - DNA, 17 bp, Homo sapiens
tactatgagaaagtagg

SEQ ID NO: 7504593 - DNA, 22 bp, Homo sapiens
tactatctggccctttacagaa

SEQ ID NO: 7504594 - DNA, 22 bp, Homo sapiens
tactagtttctaccttacagaa

SEQ ID NO: 7504595 - DNA, 22 bp, Homo sapiens
tactataaagtcttaatgagtc

SEQ ID NO: 7504596 - DNA, 22 bp, Homo sapiens
tactataacttcgaagtcctgg

SEQ ID NO: 7504597 - DNA, 22 bp, Homo sapiens
tactatactctccattttatag

SEQ ID NO: 7504598 - DNA, 23 bp, Homo sapiens
tactataacgctgtgtcagctcc

SEQ ID NO: 7504599 - DNA, 23 bp, Homo sapiens
tactataacgctgtgtcagctcc

SEQ ID NO: 7504600 - DNA, 23 bp, Homo sapiens
tactataacgctgtgtcagctcc

SEQ ID NO: 7504601 - DNA, 22 bp, Homo sapiens
tactagaaattaccttctcact

SEQ ID NO: 7504602 - DNA, 22 bp, Homo sapiens
tactagaacctcacaacaatcc

SEQ ID NO: 7504603 - DNA, 22 bp, Homo sapiens
tactagaacctcacaacaatcc

SEQ ID NO: 7504604 - DNA, 22 bp, Homo sapiens
tactagaaaaacacatgctctg

SEQ ID NO: 7504605 - DNA, 22 bp, Homo sapiens
tactagaaaaacacatgctctg

SEQ ID NO: 7504606 - DNA, 22 bp, Homo sapiens
tactagaagctgtaatttttca

SEQ ID NO: 7504607 - DNA, 22 bp, Homo sapiens
tactactttggatctggcacca

SEQ ID NO: 7504608 - DNA, 17 bp, Homo sapiens
tactagaatagagacag

SEQ ID NO: 7504609 - DNA, 22 bp, Homo sapiens
tactagaagctgtaatttttca

SEQ ID NO: 7504610 - DNA, 22 bp, Homo sapiens
tactagaagctgtaatttttca

SEQ ID NO: 7504611 - DNA, 22 bp, Homo sapiens
tactagtttctaccttacagaa

SEQ ID NO: 7504612 - DNA, 22 bp, Homo sapiens
tactagttctcatatgaaataa

SEQ ID NO: 7504613 - DNA, 22 bp, Homo sapiens
tactagttcccagctaaaagta

SEQ ID NO: 7504614 - DNA, 22 bp, Homo sapiens
tactagaatgccactgttagtg

SEQ ID NO: 7504615 - DNA, 22 bp, Homo sapiens
tactagctaacattctcaccaa

SEQ ID NO: 7504616 - DNA, 22 bp, Homo sapiens
tactagctaacattctcaccaa

SEQ ID NO: 7504617 - DNA, 20 bp, Homo sapiens
taccacttatttgaataatt

SEQ ID NO: 7504618 - DNA, 22 bp, Homo sapiens
taccagaatcattttatgttgg

SEQ ID NO: 7504619 - DNA, 22 bp, Homo sapiens
taccagaatcattttatgttgg

SEQ ID NO: 7504620 - DNA, 22 bp, Homo sapiens
taccagcaactggaagtcagat

SEQ ID NO: 7504621 - DNA, 22 bp, Homo sapiens
taccagcaatgtatgagtgttt

SEQ ID NO: 7504622 - DNA, 22 bp, Homo sapiens
taccactggcaggccactacta

SEQ ID NO: 7504623 - DNA, 20 bp, Homo sapiens
taccacttatttgaataatt

SEQ ID NO: 7504624 - DNA, 22 bp, Homo sapiens
taccacctccatcctcctttca

SEQ ID NO: 7504625 - DNA, 22 bp, Homo sapiens
taccactacatttgctaatggc

SEQ ID NO: 7504626 - DNA, 21 bp, Homo sapiens
taccaattgccttctagttgt

SEQ ID NO: 7504627 - DNA, 22 bp, Homo sapiens
taccaattctattttggattga

SEQ ID NO: 7504628 - DNA, 22 bp, Homo sapiens
taccacagacagatttcagtaa

SEQ ID NO: 7504629 - DNA, 22 bp, Homo sapiens
taccacagcaaatgaggccaac

SEQ ID NO: 7504630 - DNA, 22 bp, Homo sapiens
taccacctcaacctcatctgac

SEQ ID NO: 7504631 - DNA, 22 bp, Homo sapiens
taccacagtttatctattcagc

SEQ ID NO: 7504632 - DNA, 22 bp, Homo sapiens
taccacaggccaaatttgaggt

SEQ ID NO: 7504633 - DNA, 22 bp, Homo sapiens
taccacagtttatctattcagc

SEQ ID NO: 7504634 - DNA, 19 bp, Homo sapiens
taccagcctcctgcctgat

SEQ ID NO: 7504635 - DNA, 22 bp, Homo sapiens
taccagcctcagttgtgagccc

SEQ ID NO: 7504636 - DNA, 22 bp, Homo sapiens
taccagcctcagttgtgagccc

SEQ ID NO: 7504637 - DNA, 22 bp, Homo sapiens
taccagcatcacagcatgttgg

SEQ ID NO: 7504638 - DNA, 22 bp, Homo sapiens
taccagcctcagttgtgagccc

SEQ ID NO: 7504639 - DNA, 22 bp, Homo sapiens
taccagctcacacaatctttgt

SEQ ID NO: 7504640 - DNA, 22 bp, Homo sapiens
taccagccttttaacatgggcc

SEQ ID NO: 7504641 - DNA, 22 bp, Homo sapiens
taccagccttttaacatgggcc

SEQ ID NO: 7504642 - DNA, 22 bp, Homo sapiens
taccagcctctgttgggggtgg

SEQ ID NO: 7504643 - DNA, 22 bp, Homo sapiens
taccagcctctgttgggggtgg

SEQ ID NO: 7504644 - DNA, 22 bp, Homo sapiens
taccagcctctgttgggggtgg

SEQ ID NO: 7504645 - DNA, 22 bp, Homo sapiens
taccagcctgaccctgtctgac

SEQ ID NO: 7504646 - DNA, 22 bp, Homo sapiens
taccagcctgaccctgtctgac

SEQ ID NO: 7504647 - DNA, 22 bp, Homo sapiens
taccaggaatggggtcaccgtc

SEQ ID NO: 7504648 - DNA, 22 bp, Homo sapiens
taccagcttccttcaagatgtg

SEQ ID NO: 7504649 - DNA, 15 bp, Homo sapiens
taccagctgatccgt

SEQ ID NO: 7504650 - DNA, 22 bp, Homo sapiens
taccagccttttaacatgggcc

SEQ ID NO: 7504651 - DNA, 22 bp, Homo sapiens
taccaggaattattttacattt

SEQ ID NO: 7504652 - DNA, 22 bp, Homo sapiens
taccaggcagctgcacagaggc

SEQ ID NO: 7504653 - DNA, 22 bp, Homo sapiens
taccatttcagtaaaaacttag

SEQ ID NO: 7504654 - DNA, 22 bp, Homo sapiens
taccatttcagtaaaaacttag

SEQ ID NO: 7504655 - DNA, 22 bp, Homo sapiens
taccatttcagtaaaaacttag

SEQ ID NO: 7504656 - DNA, 22 bp, Homo sapiens
taccatttcagtaaaaacttag

SEQ ID NO: 7504657 - DNA, 22 bp, Homo sapiens
taccattattcacatgatcttt

SEQ ID NO: 7504658 - DNA, 22 bp, Homo sapiens
taccatgtcaagcgagacatgt

SEQ ID NO: 7504659 - DNA, 22 bp, Homo sapiens
taccatttacttgaaaataaaa

SEQ ID NO: 7504660 - DNA, 22 bp, Homo sapiens
taccatttacttgaaaataaaa

SEQ ID NO: 7504661 - DNA, 22 bp, Homo sapiens
taccatttacttgaaaataaaa

SEQ ID NO: 7504662 - DNA, 22 bp, Homo sapiens
taccatttcagtaaaaacttag

SEQ ID NO: 7504663 - DNA, 22 bp, Homo sapiens
taccatttcagtaaaaacttag

SEQ ID NO: 7504664 - DNA, 22 bp, Homo sapiens
taccatttacttgaaaataaaa

SEQ ID NO: 7504665 - DNA, 22 bp, Homo sapiens
taccatttacttgaaaataaaa

SEQ ID NO: 7504666 - DNA, 22 bp, Homo sapiens
taccatttacttgaaaataaaa

SEQ ID NO: 7504667 - DNA, 22 bp, Homo sapiens
taccatttacttgaaaataaaa

SEQ ID NO: 7504668 - DNA, 22 bp, Homo sapiens
taccatgcttgagatacagtga

SEQ ID NO: 7504669 - DNA, 22 bp, Homo sapiens
taccatgctggctcataatcag

SEQ ID NO: 7504670 - DNA, 22 bp, Homo sapiens
taccatgatgtttgagttacta

SEQ ID NO: 7504671 - DNA, 22 bp, Homo sapiens
taccatgatgtttgagttacta

SEQ ID NO: 7504672 - DNA, 22 bp, Homo sapiens
taccatgatcaggctcatcctt

SEQ ID NO: 7504673 - DNA, 22 bp, Homo sapiens
taccatgatcaggctcatcctt

SEQ ID NO: 7504674 - DNA, 22 bp, Homo sapiens
taccatgatcaggctcatcctt

SEQ ID NO: 7504675 - DNA, 22 bp, Homo sapiens
taccatgtcaagcgagacatgt

SEQ ID NO: 7504676 - DNA, 22 bp, Homo sapiens
taccatgtcttcaataagtcta

SEQ ID NO: 7504677 - DNA, 22 bp, Homo sapiens
taccattgtaccaaggtaattt

SEQ ID NO: 7504678 - DNA, 19 bp, Homo sapiens
taccatgttgactttcctg

SEQ ID NO: 7504679 - DNA, 22 bp, Homo sapiens
taccagggaacagggatattaa

SEQ ID NO: 7504680 - DNA, 22 bp, Homo sapiens
taccagggaacagggatattaa

SEQ ID NO: 7504681 - DNA, 22 bp, Homo sapiens
taccaggtctgtgcaggtgtca

SEQ ID NO: 7504682 - DNA, 22 bp, Homo sapiens
taccaggcagctgcacagaggc

SEQ ID NO: 7504683 - DNA, 22 bp, Homo sapiens
taccaggcagctgcacagaggc

SEQ ID NO: 7504684 - DNA, 22 bp, Homo sapiens
taccagggaacagggatattaa

SEQ ID NO: 7504685 - DNA, 22 bp, Homo sapiens
taccagggaacagggatattaa

SEQ ID NO: 7504686 - DNA, 20 bp, Homo sapiens
taccatcatatgcatttaat

SEQ ID NO: 7504687 - DNA, 20 bp, Homo sapiens
taccatcatatgcatttaat

SEQ ID NO: 7504688 - DNA, 22 bp, Homo sapiens
taccatcattgtcacaccggaa

SEQ ID NO: 7504689 - DNA, 19 bp, Homo sapiens
taccatccaagctggtttg

SEQ ID NO: 7504690 - DNA, 22 bp, Homo sapiens
taccataacgtaatgaacttga

SEQ ID NO: 7504691 - DNA, 22 bp, Homo sapiens
taccagttgatgttttaaatag

SEQ ID NO: 7504692 - DNA, 19 bp, Homo sapiens
taccatgaccctctttccc

SEQ ID NO: 7504693 - DNA, 22 bp, Homo sapiens
taccatgagaatactaagagag

SEQ ID NO: 7504694 - DNA, 19 bp, Homo sapiens
taccatccaagctggtttg

SEQ ID NO: 7504695 - DNA, 19 bp, Homo sapiens
taccatccaagctggtttg

SEQ ID NO: 7504696 - DNA, 22 bp, Homo sapiens
taccatgatcaggctcatcctt

SEQ ID NO: 7504697 - DNA, 19 bp, Homo sapiens
taccatgaccctctttccc

SEQ ID NO: 7504698 - DNA, 22 bp, Homo sapiens
taccatgaggacccctgtgtca

SEQ ID NO: 7504699 - DNA, 22 bp, Homo sapiens
taccatgaggacccctgtgtca

SEQ ID NO: 7504700 - DNA, 22 bp, Homo sapiens
tactgtttttgcctctttagaa

SEQ ID NO: 7504701 - DNA, 22 bp, Homo sapiens
tactgtttttaaaattgcatcc

SEQ ID NO: 7504702 - DNA, 22 bp, Homo sapiens
tactgttttctttatagtacag

SEQ ID NO: 7504703 - DNA, 22 bp, Homo sapiens
tactgttttctttatagtacag

SEQ ID NO: 7504704 - DNA, 22 bp, Homo sapiens
tactgttttctttacaccatgt

SEQ ID NO: 7504705 - DNA, 22 bp, Homo sapiens
tactgttttctttatagtacag

SEQ ID NO: 7504706 - DNA, 22 bp, Homo sapiens
tactgttttctttatagtacag

SEQ ID NO: 7504707 - DNA, 22 bp, Homo sapiens
tactgtttttgcctctttagaa

SEQ ID NO: 7504708 - DNA, 22 bp, Homo sapiens
tacttaaaaattatcaaagtgg

SEQ ID NO: 7504709 - DNA, 22 bp, Homo sapiens
tacttaaaaattatcaaagtgg

SEQ ID NO: 7504710 - DNA, 22 bp, Homo sapiens
tactgttttttagactcatggt

SEQ ID NO: 7504711 - DNA, 22 bp, Homo sapiens
tactgttttttagactcatggt

SEQ ID NO: 7504712 - DNA, 22 bp, Homo sapiens
tacttaaaaattatcaaagtgg

SEQ ID NO: 7504713 - DNA, 22 bp, Homo sapiens
tacttaaaaattatcaaagtgg

SEQ ID NO: 7504714 - DNA, 22 bp, Homo sapiens
tacttaaaaattatcaaagtgg

SEQ ID NO: 7504715 - DNA, 22 bp, Homo sapiens
tacttaaaaattatcaaagtgg

SEQ ID NO: 7504716 - DNA, 22 bp, Homo sapiens
tactgttttctataatggctgt

SEQ ID NO: 7504717 - DNA, 22 bp, Homo sapiens
tactgttttaaaaggtacttgt

SEQ ID NO: 7504718 - DNA, 22 bp, Homo sapiens
tactgtttgcagtttgcagtat

SEQ ID NO: 7504719 - DNA, 22 bp, Homo sapiens
tactgttatatatagcagcagt

SEQ ID NO: 7504720 - DNA, 22 bp, Homo sapiens
tactgttatatatagcagcagt

SEQ ID NO: 7504721 - DNA, 22 bp, Homo sapiens
tactgttatatatagcagcagt

SEQ ID NO: 7504722 - DNA, 22 bp, Homo sapiens
tactgttagagcgatttgtcct

SEQ ID NO: 7504723 - DNA, 22 bp, Homo sapiens
tactgttagagccagaaaccta

SEQ ID NO: 7504724 - DNA, 22 bp, Homo sapiens
tactgttaatgttaaattcagg

SEQ ID NO: 7504725 - DNA, 22 bp, Homo sapiens
tactgttacagggagtgttcaa

SEQ ID NO: 7504726 - DNA, 18 bp, Homo sapiens
tactgtttaattgattac

SEQ ID NO: 7504727 - DNA, 22 bp, Homo sapiens
tactgtttcaagccctcacaga

SEQ ID NO: 7504728 - DNA, 18 bp, Homo sapiens
tactgtttaattgattac

SEQ ID NO: 7504729 - DNA, 22 bp, Homo sapiens
tacttaaaactgatagaatctc

SEQ ID NO: 7504730 - DNA, 22 bp, Homo sapiens
tacttaaaactgatagaatctc

SEQ ID NO: 7504731 - DNA, 22 bp, Homo sapiens
tacttaaaactgatagaatctc

SEQ ID NO: 7504732 - DNA, 22 bp, Homo sapiens
tacttaaaactgatagaatctc

SEQ ID NO: 7504733 - DNA, 22 bp, Homo sapiens
tacttaaaactgatagaatctc

SEQ ID NO: 7504734 - DNA, 22 bp, Homo sapiens
tacttaaaaattatcaaagtgg

SEQ ID NO: 7504735 - DNA, 22 bp, Homo sapiens
tacttaaaactgatagaatctc

SEQ ID NO: 7504736 - DNA, 22 bp, Homo sapiens
tacttaaaactgatagaatctc

SEQ ID NO: 7504737 - DNA, 22 bp, Homo sapiens
tacttaaaactgatagaatctc

SEQ ID NO: 7504738 - DNA, 22 bp, Homo sapiens
tacttaaataattgctgctatt

SEQ ID NO: 7504739 - DNA, 22 bp, Homo sapiens
tacttaaaactgatagaatctc

SEQ ID NO: 7504740 - DNA, 22 bp, Homo sapiens
tacttaaaactgatagaatctc

SEQ ID NO: 7504741 - DNA, 22 bp, Homo sapiens
tacttaaaactgatagaatctc

SEQ ID NO: 7504742 - DNA, 22 bp, Homo sapiens
tacttaaataattgctgctatt

SEQ ID NO: 7504743 - DNA, 22 bp, Homo sapiens
tacttaaataattgctgctatt

SEQ ID NO: 7504744 - DNA, 22 bp, Homo sapiens
tacttaatgccactgaattgta

SEQ ID NO: 7504745 - DNA, 22 bp, Homo sapiens
tacttaatgccactgaattgta

SEQ ID NO: 7504746 - DNA, 22 bp, Homo sapiens
tacttaatgccactgaattgta

SEQ ID NO: 7504747 - DNA, 22 bp, Homo sapiens
tacttacacagctgtagaaggt

SEQ ID NO: 7504748 - DNA, 22 bp, Homo sapiens
tacttacagaaggaagcaattg

SEQ ID NO: 7504749 - DNA, 22 bp, Homo sapiens
tacttacagaaggaagcaattg

SEQ ID NO: 7504750 - DNA, 22 bp, Homo sapiens
tacttacagaaggaagcaattg

SEQ ID NO: 7504751 - DNA, 22 bp, Homo sapiens
tacttacagaaggaagcaattg

SEQ ID NO: 7504752 - DNA, 22 bp, Homo sapiens
tacttacacagctgtagaaggt

SEQ ID NO: 7504753 - DNA, 22 bp, Homo sapiens
tacttacactgaagcaaagata

SEQ ID NO: 7504754 - DNA, 22 bp, Homo sapiens
tacttacagaaggaagcaattg

SEQ ID NO: 7504755 - DNA, 22 bp, Homo sapiens
tacttacataaaaactgaatgt

SEQ ID NO: 7504756 - DNA, 22 bp, Homo sapiens
tacttacataaaaactgaatgt

SEQ ID NO: 7504757 - DNA, 22 bp, Homo sapiens
tacttacataaaaactgaatgt

SEQ ID NO: 7504758 - DNA, 22 bp, Homo sapiens
tacttacatgaattcaagagca

SEQ ID NO: 7504759 - DNA, 22 bp, Homo sapiens
tacttacagttacggcaagtgg

SEQ ID NO: 7504760 - DNA, 22 bp, Homo sapiens
tacttacagagcttataagtta

SEQ ID NO: 7504761 - DNA, 22 bp, Homo sapiens
tacttacagttgatcgatgtat

SEQ ID NO: 7504762 - DNA, 22 bp, Homo sapiens
tacttacagagcttataagtta

SEQ ID NO: 7504763 - DNA, 22 bp, Homo sapiens
tacttacagagcttataagtta

SEQ ID NO: 7504764 - DNA, 22 bp, Homo sapiens
tacttacagagcttataagtta

SEQ ID NO: 7504765 - DNA, 21 bp, Homo sapiens
tactgtagccttgcactgtag

SEQ ID NO: 7504766 - DNA, 22 bp, Homo sapiens
tactgtgtcttaggatgtggaa

SEQ ID NO: 7504767 - DNA, 21 bp, Homo sapiens
tactgtagccttgcactgtag

SEQ ID NO: 7504768 - DNA, 21 bp, Homo sapiens
tactgtagccttgcactgtag

SEQ ID NO: 7504769 - DNA, 22 bp, Homo sapiens
tactgtgtgattccatttacgt

SEQ ID NO: 7504770 - DNA, 22 bp, Homo sapiens
tactgtgtgcccagccgagctg

SEQ ID NO: 7504771 - DNA, 22 bp, Homo sapiens
tactgtgtgcccagccgagctg

SEQ ID NO: 7504772 - DNA, 22 bp, Homo sapiens
tactgtgtgcccagccgagctg

SEQ ID NO: 7504773 - DNA, 22 bp, Homo sapiens
tactgtgtgcccagccgagctg

SEQ ID NO: 7504774 - DNA, 22 bp, Homo sapiens
tactgtgtgcccagccgagctg

SEQ ID NO: 7504775 - DNA, 22 bp, Homo sapiens
tactgtgttgtgctgaaaggga

SEQ ID NO: 7504776 - DNA, 22 bp, Homo sapiens
tactgttaatgttaaattcagg

SEQ ID NO: 7504777 - DNA, 22 bp, Homo sapiens
tactgtactcaacatgtgagtt

SEQ ID NO: 7504778 - DNA, 22 bp, Homo sapiens
tactgtaatgagattagcttcc

SEQ ID NO: 7504779 - DNA, 22 bp, Homo sapiens
tactgtactcaacatgtgagtt

SEQ ID NO: 7504780 - DNA, 22 bp, Homo sapiens
tactgtactgcagttctgcaaa

SEQ ID NO: 7504781 - DNA, 22 bp, Homo sapiens
tactgtactgcagttctgcaaa

SEQ ID NO: 7504782 - DNA, 22 bp, Homo sapiens
tactgtactcaacatgtgagtt

SEQ ID NO: 7504783 - DNA, 22 bp, Homo sapiens
tactgtactcaacatgtgagtt

SEQ ID NO: 7504784 - DNA, 22 bp, Homo sapiens
tactgtacattccgtttgttgc

SEQ ID NO: 7504785 - DNA, 22 bp, Homo sapiens
tactgtactgcagttctgcaaa

SEQ ID NO: 7504786 - DNA, 22 bp, Homo sapiens
tactgtactgcagttctgcaaa

SEQ ID NO: 7504787 - DNA, 22 bp, Homo sapiens
tactgtactgtcttttttgctg

SEQ ID NO: 7504788 - DNA, 22 bp, Homo sapiens
tactgtactgtcttttttgctg

SEQ ID NO: 7504789 - DNA, 22 bp, Homo sapiens
tactgaaagaatacataatttc

SEQ ID NO: 7504790 - DNA, 22 bp, Homo sapiens
tactgaaacttttcttcaactg

SEQ ID NO: 7504791 - DNA, 22 bp, Homo sapiens
tactgaaagaatacataatttc

SEQ ID NO: 7504792 - DNA, 22 bp, Homo sapiens
tactgaaacttttcttcaactg

SEQ ID NO: 7504793 - DNA, 22 bp, Homo sapiens
tactgtacattccgtttgttgc

SEQ ID NO: 7504794 - DNA, 22 bp, Homo sapiens
tactgaaagaatacataatttc

SEQ ID NO: 7504795 - DNA, 22 bp, Homo sapiens
tactgaaagaatacataatttc

SEQ ID NO: 7504796 - DNA, 22 bp, Homo sapiens
tactctggaaaacagaaagttg

SEQ ID NO: 7504797 - DNA, 22 bp, Homo sapiens
tactctcagggttagtacagga

SEQ ID NO: 7504798 - DNA, 22 bp, Homo sapiens
tactctcagggttagtacagga

SEQ ID NO: 7504799 - DNA, 22 bp, Homo sapiens
tactctaaaattagctcttggc

SEQ ID NO: 7504800 - DNA, 22 bp, Homo sapiens
tactctaacatttgttagatgt

SEQ ID NO: 7504801 - DNA, 22 bp, Homo sapiens
tactctctggaaattatagtga

SEQ ID NO: 7504802 - DNA, 22 bp, Homo sapiens
tactccctttcacagtctgttt

SEQ ID NO: 7504803 - DNA, 22 bp, Homo sapiens
tactcctgctgatcctgccagc

SEQ ID NO: 7504804 - DNA, 22 bp, Homo sapiens
tactcgaaatcagagagaataa

SEQ ID NO: 7504805 - DNA, 22 bp, Homo sapiens
tactcgaaatttactaaggtgt

SEQ ID NO: 7504806 - DNA, 22 bp, Homo sapiens
tactctaaaaagaagcagatct

SEQ ID NO: 7504807 - DNA, 22 bp, Homo sapiens
tactcctgctgatcctgccagc

SEQ ID NO: 7504808 - DNA, 22 bp, Homo sapiens
tactcctgctgatcctgccagc

SEQ ID NO: 7504809 - DNA, 22 bp, Homo sapiens
tactccaggactccatttgaaa

SEQ ID NO: 7504810 - DNA, 22 bp, Homo sapiens
tactatctagctctttgcagag

SEQ ID NO: 7504811 - DNA, 22 bp, Homo sapiens
tactccagacattctgtcctcg

SEQ ID NO: 7504812 - DNA, 22 bp, Homo sapiens
tactccaggactccatttgaaa

SEQ ID NO: 7504813 - DNA, 22 bp, Homo sapiens
tactgaaaatcctgcctgtcct

SEQ ID NO: 7504814 - DNA, 22 bp, Homo sapiens
tactgaaactcttgtaaatatc

SEQ ID NO: 7504815 - DNA, 22 bp, Homo sapiens
tactgaaactcttgtaaatatc

SEQ ID NO: 7504816 - DNA, 22 bp, Homo sapiens
tactgaaactcttgtaaatatc

SEQ ID NO: 7504817 - DNA, 22 bp, Homo sapiens
tactgaaactcttgtaaatatc

SEQ ID NO: 7504818 - DNA, 22 bp, Homo sapiens
tactgaaacttttcttcaactg

SEQ ID NO: 7504819 - DNA, 22 bp, Homo sapiens
tactgaaacttttcttcaactg

SEQ ID NO: 7504820 - DNA, 22 bp, Homo sapiens
tactgaaactcttgtaaatatc

SEQ ID NO: 7504821 - DNA, 22 bp, Homo sapiens
tactgaaactcttgtaaatatc

SEQ ID NO: 7504822 - DNA, 22 bp, Homo sapiens
tactgaaactcttgtaaatatc

SEQ ID NO: 7504823 - DNA, 22 bp, Homo sapiens
tactgaaactcttgtaaatatc

SEQ ID NO: 7504824 - DNA, 22 bp, Homo sapiens
tactgaaactcttgtaaatatc

SEQ ID NO: 7504825 - DNA, 22 bp, Homo sapiens
tactgaaaaagaatccagacct

SEQ ID NO: 7504826 - DNA, 22 bp, Homo sapiens
tactgaaaactgagtcttccgt

SEQ ID NO: 7504827 - DNA, 22 bp, Homo sapiens
tactgaaaagccacaaggacca

SEQ ID NO: 7504828 - DNA, 22 bp, Homo sapiens
tactgaaaagccacaaggacca

SEQ ID NO: 7504829 - DNA, 22 bp, Homo sapiens
tactgaaaaagaatccagacct

SEQ ID NO: 7504830 - DNA, 22 bp, Homo sapiens
tactgaaaaagaatccagacct

SEQ ID NO: 7504831 - DNA, 22 bp, Homo sapiens
tacatggatgttatccttactg

SEQ ID NO: 7504832 - DNA, 22 bp, Homo sapiens
tacatgcttctatatgtgaagt

SEQ ID NO: 7504833 - DNA, 22 bp, Homo sapiens
tacatgctggtgactgtagaca

SEQ ID NO: 7504834 - DNA, 22 bp, Homo sapiens
tacatggttggcccattcttct

SEQ ID NO: 7504835 - DNA, 22 bp, Homo sapiens
tacatgtaagacatgagactct

SEQ ID NO: 7504836 - DNA, 22 bp, Homo sapiens
tacatgtaagacatgagactct

SEQ ID NO: 7504837 - DNA, 22 bp, Homo sapiens
tacatgtaagacatgagactct

SEQ ID NO: 7504838 - DNA, 22 bp, Homo sapiens
tacatggtggtggcacttgact

SEQ ID NO: 7504839 - DNA, 22 bp, Homo sapiens
tacatggtggtggtgtctcggc

SEQ ID NO: 7504840 - DNA, 22 bp, Homo sapiens
tacatgtaattttcatagtaag

SEQ ID NO: 7504841 - DNA, 22 bp, Homo sapiens
tacatgtaagacatgagactct

SEQ ID NO: 7504842 - DNA, 22 bp, Homo sapiens
tacatgtaattttcatagtaag

SEQ ID NO: 7504843 - DNA, 22 bp, Homo sapiens
tacatgtaagacatgagactct

SEQ ID NO: 7504844 - DNA, 22 bp, Homo sapiens
tacatgtaagacatgagactct

SEQ ID NO: 7504845 - DNA, 22 bp, Homo sapiens
tacatgcatgtgtgtaaatata

SEQ ID NO: 7504846 - DNA, 22 bp, Homo sapiens
tacatgcatgtgtgtaaatata

SEQ ID NO: 7504847 - DNA, 22 bp, Homo sapiens
tacatgcatgtcacagaatgaa

SEQ ID NO: 7504848 - DNA, 22 bp, Homo sapiens
tacatgcatgtcacagaatgaa

SEQ ID NO: 7504849 - DNA, 22 bp, Homo sapiens
tacatgcattggatggcaatag

SEQ ID NO: 7504850 - DNA, 22 bp, Homo sapiens
tacatgcattggatggcaatag

SEQ ID NO: 7504851 - DNA, 22 bp, Homo sapiens
tacatgcattggatggcaatag

SEQ ID NO: 7504852 - DNA, 22 bp, Homo sapiens
tacatgcatgtgtgtaaatata

SEQ ID NO: 7504853 - DNA, 22 bp, Homo sapiens
tacatgcatgtgtgtaaatata

SEQ ID NO: 7504854 - DNA, 22 bp, Homo sapiens
tacatgctccactttctcctgt

SEQ ID NO: 7504855 - DNA, 22 bp, Homo sapiens
tacatgctccactttctcctgt

SEQ ID NO: 7504856 - DNA, 22 bp, Homo sapiens
tacatgctccactttctcctgt

SEQ ID NO: 7504857 - DNA, 22 bp, Homo sapiens
tacatgctccttatgagaatct

SEQ ID NO: 7504858 - DNA, 22 bp, Homo sapiens
tacatgcattggatggcaatag

SEQ ID NO: 7504859 - DNA, 18 bp, Homo sapiens
tacatgccagagagttac

SEQ ID NO: 7504860 - DNA, 22 bp, Homo sapiens
tacatgctcagtaactttcagt

SEQ ID NO: 7504861 - DNA, 22 bp, Homo sapiens
taccaaatgtaatcattctaat

SEQ ID NO: 7504862 - DNA, 22 bp, Homo sapiens
taccaaatgtaatcattctaat

SEQ ID NO: 7504863 - DNA, 22 bp, Homo sapiens
taccaaatgtaatcattctaat

SEQ ID NO: 7504864 - DNA, 19 bp, Homo sapiens
taccaaattgcattatggc

SEQ ID NO: 7504865 - DNA, 19 bp, Homo sapiens
taccaaattgcattatggc

SEQ ID NO: 7504866 - DNA, 18 bp, Homo sapiens
taccaaaggctttctttt

SEQ ID NO: 7504867 - DNA, 18 bp, Homo sapiens
taccaaaggctttctttt

SEQ ID NO: 7504868 - DNA, 22 bp, Homo sapiens
taccaaatgctttgtgccctga

SEQ ID NO: 7504869 - DNA, 22 bp, Homo sapiens
taccaaatgtaatcattctaat

SEQ ID NO: 7504870 - DNA, 22 bp, Homo sapiens
taccaaatgtaatcattctaat

SEQ ID NO: 7504871 - DNA, 18 bp, Homo sapiens
taccaaaggctttctttt

SEQ ID NO: 7504872 - DNA, 22 bp, Homo sapiens
taccaaagttttctgagtgata

SEQ ID NO: 7504873 - DNA, 22 bp, Homo sapiens
taccaaagttttctgagtgata

SEQ ID NO: 7504874 - DNA, 19 bp, Homo sapiens
taccaaattgcattatggc

SEQ ID NO: 7504875 - DNA, 19 bp, Homo sapiens
taccaaattgcattatggc

SEQ ID NO: 7504876 - DNA, 20 bp, Homo sapiens
taccaacagcaggaagcata

SEQ ID NO: 7504877 - DNA, 20 bp, Homo sapiens
taccaacagcaggaagcata

SEQ ID NO: 7504878 - DNA, 22 bp, Homo sapiens
taccaaggcttgtgggggcaac

SEQ ID NO: 7504879 - DNA, 22 bp, Homo sapiens
taccaagaaaagggattaaatg

SEQ ID NO: 7504880 - DNA, 21 bp, Homo sapiens
taccaagaagtttgggaaagc

SEQ ID NO: 7504881 - DNA, 20 bp, Homo sapiens
taccaacagcaggaagcata

SEQ ID NO: 7504882 - DNA, 22 bp, Homo sapiens
taccaagagttcttgcctgttt

SEQ ID NO: 7504883 - DNA, 22 bp, Homo sapiens
taccaatgataagacagataat

SEQ ID NO: 7504884 - DNA, 22 bp, Homo sapiens
tacatgtaattttcatagtaag

SEQ ID NO: 7504885 - DNA, 22 bp, Homo sapiens
tacatgtaattttcatagtaag

SEQ ID NO: 7504886 - DNA, 22 bp, Homo sapiens
tacatgtaattttcatagtaag

SEQ ID NO: 7504887 - DNA, 22 bp, Homo sapiens
tacatgtacatgcataggtaga

SEQ ID NO: 7504888 - DNA, 22 bp, Homo sapiens
tacatgtacatgcataggtaga

SEQ ID NO: 7504889 - DNA, 22 bp, Homo sapiens
tacatgtacatgcataggtaga

SEQ ID NO: 7504890 - DNA, 22 bp, Homo sapiens
tacatgtacattgggcattaat

SEQ ID NO: 7504891 - DNA, 22 bp, Homo sapiens
tacatgtacatgcataggtaga

SEQ ID NO: 7504892 - DNA, 22 bp, Homo sapiens
tacatgtaggtgacattttaat

SEQ ID NO: 7504893 - DNA, 22 bp, Homo sapiens
tacatgtaggtgacattttaat

SEQ ID NO: 7504894 - DNA, 22 bp, Homo sapiens
tacatgtacatgcataggtaga

SEQ ID NO: 7504895 - DNA, 22 bp, Homo sapiens
tacatgtagttcactggtggca

SEQ ID NO: 7504896 - DNA, 22 bp, Homo sapiens
tacatgtatgtgttaatatctg

SEQ ID NO: 7504897 - DNA, 22 bp, Homo sapiens
tacatgtatgtgttaatatctg

SEQ ID NO: 7504898 - DNA, 22 bp, Homo sapiens
tacatgtatgtgttaatatctg

SEQ ID NO: 7504899 - DNA, 22 bp, Homo sapiens
tacatgtatgtgtacgtgcatg

SEQ ID NO: 7504900 - DNA, 22 bp, Homo sapiens
tacatgtatgtgttaatatctg

SEQ ID NO: 7504901 - DNA, 22 bp, Homo sapiens
tacatgtatgtgttaatatctg

SEQ ID NO: 7504902 - DNA, 22 bp, Homo sapiens
tacatgtatgtgttaatatctg

SEQ ID NO: 7504903 - DNA, 22 bp, Homo sapiens
tacatgtatgtttatcttgaga

SEQ ID NO: 7504904 - DNA, 22 bp, Homo sapiens
taccaaagattaaatagcaaca

SEQ ID NO: 7504905 - DNA, 22 bp, Homo sapiens
tacagtgtctggatatcaaagg

SEQ ID NO: 7504906 - DNA, 22 bp, Homo sapiens
tacagtgtgaataagcaggcat

SEQ ID NO: 7504907 - DNA, 22 bp, Homo sapiens
tacagtgtgaataagcaggcat

SEQ ID NO: 7504908 - DNA, 22 bp, Homo sapiens
tacagtgtgacatttctacaaa

SEQ ID NO: 7504909 - DNA, 22 bp, Homo sapiens
tacagtgtgacatttctacaaa

SEQ ID NO: 7504910 - DNA, 22 bp, Homo sapiens
tacagtgtgacatttctacaaa

SEQ ID NO: 7504911 - DNA, 22 bp, Homo sapiens
tacagtgtgacatttctacaaa

SEQ ID NO: 7504912 - DNA, 22 bp, Homo sapiens
tacagtgtgacatttctacaaa

SEQ ID NO: 7504913 - DNA, 22 bp, Homo sapiens
tacatgaacaaaatagcagaaa

SEQ ID NO: 7504914 - DNA, 22 bp, Homo sapiens
tacatgaacaaaatagcagaaa

SEQ ID NO: 7504915 - DNA, 22 bp, Homo sapiens
tacatgaacaaaatagcagaaa

SEQ ID NO: 7504916 - DNA, 22 bp, Homo sapiens
tacatgaacaaaatagcagaaa

SEQ ID NO: 7504917 - DNA, 22 bp, Homo sapiens
tacagttaaaaagttcaatggt

SEQ ID NO: 7504918 - DNA, 22 bp, Homo sapiens
tacagttaaaaagttcaatggt

SEQ ID NO: 7504919 - DNA, 22 bp, Homo sapiens
tacagtgtttcccccaggatag

SEQ ID NO: 7504920 - DNA, 22 bp, Homo sapiens
tacagtgtttcccccaggatag

SEQ ID NO: 7504921 - DNA, 22 bp, Homo sapiens
tacatgaagatgaatgtatggc

SEQ ID NO: 7504922 - DNA, 22 bp, Homo sapiens
tacatgaagaaaattaagcagt

SEQ ID NO: 7504923 - DNA, 22 bp, Homo sapiens
tacatgaagaaaattaagcagt

SEQ ID NO: 7504924 - DNA, 22 bp, Homo sapiens
tacatgaagaaaattaagcagt

SEQ ID NO: 7504925 - DNA, 22 bp, Homo sapiens
tacatgaagaaaattaagcagt

SEQ ID NO: 7504926 - DNA, 22 bp, Homo sapiens
tacatgaagatgaatgtatggc

SEQ ID NO: 7504927 - DNA, 22 bp, Homo sapiens
tacatgaacctttatgtgtgat

SEQ ID NO: 7504928 - DNA, 22 bp, Homo sapiens
tacatgaacctttatgtgtgat

SEQ ID NO: 7504929 - DNA, 22 bp, Homo sapiens
tacatgaagaaaattaagcagt

SEQ ID NO: 7504930 - DNA, 22 bp, Homo sapiens
tacatgaagaaaattaagcagt

SEQ ID NO: 7504931 - DNA, 22 bp, Homo sapiens
tacatgaagaaaattaagcagt

SEQ ID NO: 7504932 - DNA, 22 bp, Homo sapiens
tacatgaagttgtctaaactgg

SEQ ID NO: 7504933 - DNA, 22 bp, Homo sapiens
tacatgaagttgtctaaactgg

SEQ ID NO: 7504934 - DNA, 22 bp, Homo sapiens
tacatgaatgtttcaatattgt

SEQ ID NO: 7504935 - DNA, 22 bp, Homo sapiens
tacatgaagttgtctaaactgg

SEQ ID NO: 7504936 - DNA, 22 bp, Homo sapiens
tacatgaagttgtctaaactgg

SEQ ID NO: 7504937 - DNA, 22 bp, Homo sapiens
tacatgaagttgtctaaactgg

SEQ ID NO: 7504938 - DNA, 21 bp, Homo sapiens
tacatgaagctggtgtttgtc

SEQ ID NO: 7504939 - DNA, 21 bp, Homo sapiens
tacatgaagctggtgtttgtc

SEQ ID NO: 7504940 - DNA, 22 bp, Homo sapiens
tacatgaatgtttcaatattgt

SEQ ID NO: 7504941 - DNA, 22 bp, Homo sapiens
tacatgaatgtttcaatattgt

SEQ ID NO: 7504942 - DNA, 22 bp, Homo sapiens
tacatgaatgtttcaatattgt

SEQ ID NO: 7504943 - DNA, 22 bp, Homo sapiens
tacatgaatgtttcaatattgt

SEQ ID NO: 7504944 - DNA, 22 bp, Homo sapiens
tacatgaatgtttcaatattgt

SEQ ID NO: 7504945 - DNA, 22 bp, Homo sapiens
tacatgcatgtcacagaatgaa

SEQ ID NO: 7504946 - DNA, 22 bp, Homo sapiens
tacatgcatgtcacagaatgaa

SEQ ID NO: 7504947 - DNA, 22 bp, Homo sapiens
tacatgcatgatacaaagttgc

SEQ ID NO: 7504948 - DNA, 22 bp, Homo sapiens
tacatgcatgatacaaagttgc

SEQ ID NO: 7504949 - DNA, 22 bp, Homo sapiens
tacatgcatacttgtgtgtgta

SEQ ID NO: 7504950 - DNA, 18 bp, Homo sapiens
tacatgcataaatgaagc

SEQ ID NO: 7504951 - DNA, 22 bp, Homo sapiens
tacatgcatacttgtgtgtgta

SEQ ID NO: 7504952 - DNA, 22 bp, Homo sapiens
tacatgcatgatacaaagttgc

SEQ ID NO: 7504953 - DNA, 22 bp, Homo sapiens
tacatgcatgatacaaagttgc

SEQ ID NO: 7504954 - DNA, 19 bp, Homo sapiens
tacatgcagcaggcacgca

SEQ ID NO: 7504955 - DNA, 18 bp, Homo sapiens
tacatgcataaatgaagc

SEQ ID NO: 7504956 - DNA, 18 bp, Homo sapiens
tacatgcataaatgaagc

SEQ ID NO: 7504957 - DNA, 18 bp, Homo sapiens
tacatgcataaatgaagc

SEQ ID NO: 7504958 - DNA, 18 bp, Homo sapiens
tacatgcataaatgaagc

SEQ ID NO: 7504959 - DNA, 19 bp, Homo sapiens
tacatgcacatgtgcgtgc

SEQ ID NO: 7504960 - DNA, 19 bp, Homo sapiens
tacatgcacatgtgcgtgc

SEQ ID NO: 7504961 - DNA, 22 bp, Homo sapiens
tacatgcacatgaacatgtgtg

SEQ ID NO: 7504962 - DNA, 22 bp, Homo sapiens
tacatgcacatgaacatgtgtg

SEQ ID NO: 7504963 - DNA, 22 bp, Homo sapiens
tacatgcacatgaacatgtgtg

SEQ ID NO: 7504964 - DNA, 22 bp, Homo sapiens
tacatgcacatgaacatgtgtg

SEQ ID NO: 7504965 - DNA, 22 bp, Homo sapiens
tacatgcacatgaacatgtgtg

SEQ ID NO: 7504966 - DNA, 22 bp, Homo sapiens
tacatgcacatgaacatgtgtg

SEQ ID NO: 7504967 - DNA, 22 bp, Homo sapiens
tacatgcacatgaacatgtgtg

SEQ ID NO: 7504968 - DNA, 22 bp, Homo sapiens
tacatgcaattaagagggtgaa

SEQ ID NO: 7504969 - DNA, 22 bp, Homo sapiens
tacatgcaaggatatttgtgcg

SEQ ID NO: 7504970 - DNA, 22 bp, Homo sapiens
tacatgcaaggatatttgtgcg

SEQ ID NO: 7504971 - DNA, 22 bp, Homo sapiens
tacatgcaatgaggattctagt

SEQ ID NO: 7504972 - DNA, 22 bp, Homo sapiens
tacatgcaatgaggattctagt

SEQ ID NO: 7504973 - DNA, 22 bp, Homo sapiens
tacatgaatttgagtcagagga

SEQ ID NO: 7504974 - DNA, 21 bp, Homo sapiens
tacatgagtgtatgagcatat

SEQ ID NO: 7504975 - DNA, 21 bp, Homo sapiens
tacatgagtgtatgagcatat

SEQ ID NO: 7504976 - DNA, 20 bp, Homo sapiens
tacatgagccctggcctcac

SEQ ID NO: 7504977 - DNA, 20 bp, Homo sapiens
tacatgagccctggcctcac

SEQ ID NO: 7504978 - DNA, 22 bp, Homo sapiens
tacatgagggcactctgcatct

SEQ ID NO: 7504979 - DNA, 22 bp, Homo sapiens
tacatgagggcactctgcatct

SEQ ID NO: 7504980 - DNA, 22 bp, Homo sapiens
tacatgaatttgagtcagagga

SEQ ID NO: 7504981 - DNA, 22 bp, Homo sapiens
tacatgaatgtttcaatattgt

SEQ ID NO: 7504982 - DNA, 22 bp, Homo sapiens
tacatgaatgtttcaatattgt

SEQ ID NO: 7504983 - DNA, 22 bp, Homo sapiens
tacatgaatgtttcaatattgt

SEQ ID NO: 7504984 - DNA, 22 bp, Homo sapiens
tacatgaatgtttcaatattgt

SEQ ID NO: 7504985 - DNA, 20 bp, Homo sapiens
tacagtgtatgtatttaggc

SEQ ID NO: 7504986 - DNA, 20 bp, Homo sapiens
tacagtgtatgtatttaggc

SEQ ID NO: 7504987 - DNA, 20 bp, Homo sapiens
tacagtgtatgtatttaggc

SEQ ID NO: 7504988 - DNA, 20 bp, Homo sapiens
tacagtgtatgtatttaggc

SEQ ID NO: 7504989 - DNA, 22 bp, Homo sapiens
tacagtggggagctcaggagag

SEQ ID NO: 7504990 - DNA, 22 bp, Homo sapiens
tacagtggggagctcaggagag

SEQ ID NO: 7504991 - DNA, 22 bp, Homo sapiens
tacagtggtgacaatatggaca

SEQ ID NO: 7504992 - DNA, 22 bp, Homo sapiens
tacagtggtgacaatatggaca

SEQ ID NO: 7504993 - DNA, 22 bp, Homo sapiens
tacagtgcttggtatctagtaa

SEQ ID NO: 7504994 - DNA, 22 bp, Homo sapiens
tacagtgctttttggtggagaa

SEQ ID NO: 7504995 - DNA, 22 bp, Homo sapiens
tacagtgctttttggtggagaa

SEQ ID NO: 7504996 - DNA, 22 bp, Homo sapiens
tacagtggaaaactcagtgtgt

SEQ ID NO: 7504997 - DNA, 22 bp, Homo sapiens
tacagtgtccctttttcagaca

SEQ ID NO: 7504998 - DNA, 22 bp, Homo sapiens
tacagtgtccctttttcagaca

SEQ ID NO: 7504999 - DNA, 22 bp, Homo sapiens
tacagtgtctgcaactgcacac

SEQ ID NO: 7505000 - DNA, 22 bp, Homo sapiens
tacagtgtatgtatttgtaggt

SEQ ID NO: 7505001 - DNA, 20 bp, Homo sapiens
tacagtgtatgtatttaggc

SEQ ID NO: 7505002 - DNA, 22 bp, Homo sapiens
tacagtgtatgtatttgtaggt

SEQ ID NO: 7505003 - DNA, 22 bp, Homo sapiens
tacagtgcaatgtgatgtagat

SEQ ID NO: 7505004 - DNA, 22 bp, Homo sapiens
tacagtgcaatgtgatgtagat

SEQ ID NO: 7505005 - DNA, 22 bp, Homo sapiens
tacagtgatagagagtagctat

SEQ ID NO: 7505006 - DNA, 22 bp, Homo sapiens
tacagtgatttctactggtgtt

SEQ ID NO: 7505007 - DNA, 22 bp, Homo sapiens
tacagtgatttctactggtgtt

SEQ ID NO: 7505008 - DNA, 22 bp, Homo sapiens
tacagtgatagagagtagctat

SEQ ID NO: 7505009 - DNA, 22 bp, Homo sapiens
tacagtgagtggcagagccaga

SEQ ID NO: 7505010 - DNA, 22 bp, Homo sapiens
tacagtgcacatttcttaggaa

SEQ ID NO: 7505011 - DNA, 22 bp, Homo sapiens
tacagtgcacatttcttaggaa

SEQ ID NO: 7505012 - DNA, 22 bp, Homo sapiens
tacagtgcaatgtgatgtagat

SEQ ID NO: 7505013 - DNA, 22 bp, Homo sapiens
tacagtgcttggtatctagtaa

SEQ ID NO: 7505014 - DNA, 22 bp, Homo sapiens
tacagtgcttggtatctagtaa

SEQ ID NO: 7505015 - DNA, 22 bp, Homo sapiens
tacagtgcttggtatctagtaa

SEQ ID NO: 7505016 - DNA, 22 bp, Homo sapiens
tacagtgcgggtgcgggcctct

SEQ ID NO: 7505017 - DNA, 22 bp, Homo sapiens
tacagtgctagaacctgctgta

SEQ ID NO: 7505018 - DNA, 22 bp, Homo sapiens
tacagtgcttggtatctagtaa

SEQ ID NO: 7505019 - DNA, 22 bp, Homo sapiens
tacagtgcgatttttaggcctc

SEQ ID NO: 7505020 - DNA, 22 bp, Homo sapiens
tacagtgcgatttttaggcctc

SEQ ID NO: 7505021 - DNA, 22 bp, Homo sapiens
tacagtgcatagaggcatgata

SEQ ID NO: 7505022 - DNA, 22 bp, Homo sapiens
tacagtgcacatttcttaggaa

SEQ ID NO: 7505023 - DNA, 22 bp, Homo sapiens
tacagtatttgaagaatatgag

SEQ ID NO: 7505024 - DNA, 22 bp, Homo sapiens
tacagtatttgaagaatatgag

SEQ ID NO: 7505025 - DNA, 22 bp, Homo sapiens
tacagtatttgaagaatatgag

SEQ ID NO: 7505026 - DNA, 22 bp, Homo sapiens
tacagtcaacattgatgatgat

SEQ ID NO: 7505027 - DNA, 22 bp, Homo sapiens
tacagtcaacattgatgatgat

SEQ ID NO: 7505028 - DNA, 22 bp, Homo sapiens
tacagtatttgaagaatatgag

SEQ ID NO: 7505029 - DNA, 18 bp, Homo sapiens
tacagtattttctcgcct

SEQ ID NO: 7505030 - DNA, 22 bp, Homo sapiens
tacagtcaagcataagaagtca

SEQ ID NO: 7505031 - DNA, 22 bp, Homo sapiens
tacagtcaacattgatgatgat

SEQ ID NO: 7505032 - DNA, 22 bp, Homo sapiens
tacagtcacattctgaggtctt

SEQ ID NO: 7505033 - DNA, 22 bp, Homo sapiens
tacagtcaagcataagaagtca

SEQ ID NO: 7505034 - DNA, 22 bp, Homo sapiens
tacagtcaatactaggaccata

SEQ ID NO: 7505035 - DNA, 22 bp, Homo sapiens
tacagtctctttgagtgattgt

SEQ ID NO: 7505036 - DNA, 22 bp, Homo sapiens
tacagtctctttgagtgattgt

SEQ ID NO: 7505037 - DNA, 22 bp, Homo sapiens
tacagtctttggaaagagatag

SEQ ID NO: 7505038 - DNA, 22 bp, Homo sapiens
tacagtctctgataactgtcag

SEQ ID NO: 7505039 - DNA, 22 bp, Homo sapiens
tacagtctctgataactgtcag

SEQ ID NO: 7505040 - DNA, 22 bp, Homo sapiens
tacagtcagagtgcctttctaa

SEQ ID NO: 7505041 - DNA, 20 bp, Homo sapiens
tacagtcagggcacaggcag

SEQ ID NO: 7505042 - DNA, 21 bp, Homo sapiens
tacagtctcccctgttgtcca

SEQ ID NO: 7505043 - DNA, 21 bp, Homo sapiens
tacagtctcccctgttgtcca

SEQ ID NO: 7505044 - DNA, 21 bp, Homo sapiens
tacagtctcccctgttgtcca

SEQ ID NO: 7505045 - DNA, 21 bp, Homo sapiens
tacagtctcccctgttgtcca

SEQ ID NO: 7505046 - DNA, 21 bp, Homo sapiens
tacagtgaggtgttaggatgt

SEQ ID NO: 7505047 - DNA, 22 bp, Homo sapiens
tacagtgaggtggtttccttta

SEQ ID NO: 7505048 - DNA, 22 bp, Homo sapiens
tacagtgatagagagtagctat

SEQ ID NO: 7505049 - DNA, 22 bp, Homo sapiens
tacagtgatagagagtagctat

SEQ ID NO: 7505050 - DNA, 21 bp, Homo sapiens
tacagtgaggtgttaggatgt

SEQ ID NO: 7505051 - DNA, 22 bp, Homo sapiens
tacagtgagtggcagagccaga

SEQ ID NO: 7505052 - DNA, 22 bp, Homo sapiens
tacagtgagactggctcaggga

SEQ ID NO: 7505053 - DNA, 22 bp, Homo sapiens
tacagtgaggtggtttccttta

SEQ ID NO: 7505054 - DNA, 22 bp, Homo sapiens
tacagtgactggactttgtcat

SEQ ID NO: 7505055 - DNA, 22 bp, Homo sapiens
tacagtgacctagaataaatac

SEQ ID NO: 7505056 - DNA, 22 bp, Homo sapiens
tacagtgacctagaataaatac

SEQ ID NO: 7505057 - DNA, 22 bp, Homo sapiens
tacagtgactggactttgtcat

SEQ ID NO: 7505058 - DNA, 22 bp, Homo sapiens
tacagtgactggactttgtcat

SEQ ID NO: 7505059 - DNA, 22 bp, Homo sapiens
tacagtgacctagaataaatac

SEQ ID NO: 7505060 - DNA, 22 bp, Homo sapiens
tacagtgaccctatttccaaat

SEQ ID NO: 7505061 - DNA, 22 bp, Homo sapiens
tacagtgacctagaataaatac

SEQ ID NO: 7505062 - DNA, 22 bp, Homo sapiens
tacagtgaccctatttccaaat

SEQ ID NO: 7505063 - DNA, 22 bp, Homo sapiens
tacagtgacagatagggataga

SEQ ID NO: 7505064 - DNA, 19 bp, Homo sapiens
tacagtgaaccaggaggag

SEQ ID NO: 7505065 - DNA, 22 bp, Homo sapiens
tacagtctttggaaagagatag

SEQ ID NO: 7505066 - DNA, 22 bp, Homo sapiens
tacagtctctttgagtgattgt

SEQ ID NO: 7505067 - DNA, 22 bp, Homo sapiens
tacagtctttggaaagagatag

SEQ ID NO: 7505068 - DNA, 22 bp, Homo sapiens
tacagtgaatgaatggctgtgc

SEQ ID NO: 7505069 - DNA, 19 bp, Homo sapiens
tacagtgaaccaggaggag

SEQ ID NO: 7505070 - DNA, 22 bp, Homo sapiens
tacagtctctttgagtgattgt

SEQ ID NO: 7505071 - DNA, 22 bp, Homo sapiens
tacagacagtttttcagatatt

SEQ ID NO: 7505072 - DNA, 22 bp, Homo sapiens
tacagacagtttttcagatatt

SEQ ID NO: 7505073 - DNA, 20 bp, Homo sapiens
tacagacatgacaataatgg

SEQ ID NO: 7505074 - DNA, 20 bp, Homo sapiens
tacagacatgacaataatgg

SEQ ID NO: 7505075 - DNA, 20 bp, Homo sapiens
tacagacatgacaataatgg

SEQ ID NO: 7505076 - DNA, 20 bp, Homo sapiens
tacagacatgacaataatgg

SEQ ID NO: 7505077 - DNA, 22 bp, Homo sapiens
tacagagatactctagatcaaa

SEQ ID NO: 7505078 - DNA, 22 bp, Homo sapiens
tacagagatactctagatcaaa

SEQ ID NO: 7505079 - DNA, 22 bp, Homo sapiens
tacagagatactctagatcaaa

SEQ ID NO: 7505080 - DNA, 22 bp, Homo sapiens
tacagagatactctagatcaaa

SEQ ID NO: 7505081 - DNA, 22 bp, Homo sapiens
tacagagatactctagatcaaa

SEQ ID NO: 7505082 - DNA, 22 bp, Homo sapiens
tacagagatactctagatcaaa

SEQ ID NO: 7505083 - DNA, 22 bp, Homo sapiens
tacagagatactctagatcaaa

SEQ ID NO: 7505084 - DNA, 22 bp, Homo sapiens
tacagagatgccgaagagtgaa

SEQ ID NO: 7505085 - DNA, 22 bp, Homo sapiens
tacagagatgccgaagagtgaa

SEQ ID NO: 7505086 - DNA, 22 bp, Homo sapiens
tacagagatgccgaagagtgaa

SEQ ID NO: 7505087 - DNA, 22 bp, Homo sapiens
tacagagatgccgaagagtgaa

SEQ ID NO: 7505088 - DNA, 22 bp, Homo sapiens
tacagagatgtgaaaagctcta

SEQ ID NO: 7505089 - DNA, 22 bp, Homo sapiens
tacagagatgtgaaaagctcta

SEQ ID NO: 7505090 - DNA, 22 bp, Homo sapiens
tacagagatttattgctaaggc

SEQ ID NO: 7505091 - DNA, 22 bp, Homo sapiens
tacagagatttattgctaaggc

SEQ ID NO: 7505092 - DNA, 22 bp, Homo sapiens
tacagagatttattgctaaggc

SEQ ID NO: 7505093 - DNA, 22 bp, Homo sapiens
tacagaggcacatgcaattttc

SEQ ID NO: 7505094 - DNA, 22 bp, Homo sapiens
tacagaggaggtggttgggagt

SEQ ID NO: 7505095 - DNA, 22 bp, Homo sapiens
tacagaggagaccaaggctcag

SEQ ID NO: 7505096 - DNA, 22 bp, Homo sapiens
tacagaggaggggattttaata

SEQ ID NO: 7505097 - DNA, 22 bp, Homo sapiens
tacagaggagaccaaggctcag

SEQ ID NO: 7505098 - DNA, 22 bp, Homo sapiens
tacagagtaatttgcatgggga

SEQ ID NO: 7505099 - DNA, 22 bp, Homo sapiens
tacagagtaatttgcatgggga

SEQ ID NO: 7505100 - DNA, 22 bp, Homo sapiens
tacagtaggattttcagggtct

SEQ ID NO: 7505101 - DNA, 22 bp, Homo sapiens
tacagagtatttttaatatggt

SEQ ID NO: 7505102 - DNA, 22 bp, Homo sapiens
tacagtagtcgtcttattttga

SEQ ID NO: 7505103 - DNA, 22 bp, Homo sapiens
tacagtagtcgtcttattttga

SEQ ID NO: 7505104 - DNA, 22 bp, Homo sapiens
tacagtatagaatgtgtattaa

SEQ ID NO: 7505105 - DNA, 22 bp, Homo sapiens
tacagtagtatcttcatttgtt

SEQ ID NO: 7505106 - DNA, 22 bp, Homo sapiens
tacagtagtaagaatgccttat

SEQ ID NO: 7505107 - DNA, 22 bp, Homo sapiens
tacagtagtaagaatgccttat

SEQ ID NO: 7505108 - DNA, 22 bp, Homo sapiens
tacagagggtaattgatcaagg

SEQ ID NO: 7505109 - DNA, 22 bp, Homo sapiens
tacagaggggacatggaagaca

SEQ ID NO: 7505110 - DNA, 22 bp, Homo sapiens
tacagaggggacatggaagaca

SEQ ID NO: 7505111 - DNA, 22 bp, Homo sapiens
tacagagggattatctaagggt

SEQ ID NO: 7505112 - DNA, 22 bp, Homo sapiens
tacagaggctgggttttcaggg

SEQ ID NO: 7505113 - DNA, 22 bp, Homo sapiens
tacagtatggaaaatgtatagt

SEQ ID NO: 7505114 - DNA, 22 bp, Homo sapiens
tacagtatggaaaatgtatagt

SEQ ID NO: 7505115 - DNA, 22 bp, Homo sapiens
tacagtatggaaaatgtatagt

SEQ ID NO: 7505116 - DNA, 22 bp, Homo sapiens
tacagtatggaaaatgtatagt

SEQ ID NO: 7505117 - DNA, 22 bp, Homo sapiens
tacagtatggaaaatgtatagt

SEQ ID NO: 7505118 - DNA, 22 bp, Homo sapiens
tacagtatatactgtgtgtaga

SEQ ID NO: 7505119 - DNA, 22 bp, Homo sapiens
tacagtatatactgtgtgtaga

SEQ ID NO: 7505120 - DNA, 22 bp, Homo sapiens
tacagtatcttctggcaagcat

SEQ ID NO: 7505121 - DNA, 22 bp, Homo sapiens
tacagtattatgagtgattgaa

SEQ ID NO: 7505122 - DNA, 22 bp, Homo sapiens
tacagtatttgaagaatatgag

SEQ ID NO: 7505123 - DNA, 22 bp, Homo sapiens
tacagtattactgtgttgtttt

SEQ ID NO: 7505124 - DNA, 22 bp, Homo sapiens
tacagtatgttcttgaatttgg

SEQ ID NO: 7505125 - DNA, 22 bp, Homo sapiens
tacagtatgttcttgaatttgg

SEQ ID NO: 7505126 - DNA, 22 bp, Homo sapiens
tacagtatgttcttgaatttgg

SEQ ID NO: 7505127 - DNA, 22 bp, Homo sapiens
tacagtatggaaaatgtatagt

SEQ ID NO: 7505128 - DNA, 22 bp, Homo sapiens
tacagtatgttcttgaatttgg

SEQ ID NO: 7505129 - DNA, 22 bp, Homo sapiens
taatttatgatgcaaagaaaag

SEQ ID NO: 7505130 - DNA, 22 bp, Homo sapiens
taatttatgatgcaaagaaaag

SEQ ID NO: 7505131 - DNA, 22 bp, Homo sapiens
taatttatgatgcaaagaaaag

SEQ ID NO: 7505132 - DNA, 22 bp, Homo sapiens
taatttatgatgcaaagaaaag

SEQ ID NO: 7505133 - DNA, 22 bp, Homo sapiens
taatttatatggaattgttgct

SEQ ID NO: 7505134 - DNA, 22 bp, Homo sapiens
taatttatgatgcaaagaaaag

SEQ ID NO: 7505135 - DNA, 22 bp, Homo sapiens
taatttatgatgcaaagaaaag

SEQ ID NO: 7505136 - DNA, 22 bp, Homo sapiens
taatttatatggaattgttgct

SEQ ID NO: 7505137 - DNA, 22 bp, Homo sapiens
taatttatatggaattgttgct

SEQ ID NO: 7505138 - DNA, 22 bp, Homo sapiens
taatttatatggaattgttgct

SEQ ID NO: 7505139 - DNA, 22 bp, Homo sapiens
taatttatagaatttcttggat

SEQ ID NO: 7505140 - DNA, 22 bp, Homo sapiens
taatttatatggaattgttgct

SEQ ID NO: 7505141 - DNA, 22 bp, Homo sapiens
taatttatagaatttcttggat

SEQ ID NO: 7505142 - DNA, 22 bp, Homo sapiens
taatttatagaatttcttggat

SEQ ID NO: 7505143 - DNA, 22 bp, Homo sapiens
taatttacttgcaaataacaat

SEQ ID NO: 7505144 - DNA, 22 bp, Homo sapiens
taatttagtccaatgtgaatat

SEQ ID NO: 7505145 - DNA, 22 bp, Homo sapiens
taattgaactaacatgcaaaca

SEQ ID NO: 7505146 - DNA, 22 bp, Homo sapiens
taattgcagggtgtcagaatac

SEQ ID NO: 7505147 - DNA, 22 bp, Homo sapiens
taatttacttgcaaataacaat

SEQ ID NO: 7505148 - DNA, 22 bp, Homo sapiens
taattgctccaaggagaactaa

SEQ ID NO: 7505149 - DNA, 22 bp, Homo sapiens
taattccttaagctgaagactt

SEQ ID NO: 7505150 - DNA, 22 bp, Homo sapiens
taattcctagaaattattctca

SEQ ID NO: 7505151 - DNA, 22 bp, Homo sapiens
taattccttaagctgaagactt

SEQ ID NO: 7505152 - DNA, 21 bp, Homo sapiens
taattccagaggtcactgaag

SEQ ID NO: 7505153 - DNA, 22 bp, Homo sapiens
taattcctagaaattattctca

SEQ ID NO: 7505154 - DNA, 21 bp, Homo sapiens
taattccagaggtcactgaag

SEQ ID NO: 7505155 - DNA, 21 bp, Homo sapiens
taattccagaggtcactgaag

SEQ ID NO: 7505156 - DNA, 22 bp, Homo sapiens
taattccacctttttccaactt

SEQ ID NO: 7505157 - DNA, 22 bp, Homo sapiens
taattccaagttgagacatgca

SEQ ID NO: 7505158 - DNA, 22 bp, Homo sapiens
taattccaagttgagacatgca

SEQ ID NO: 7505159 - DNA, 22 bp, Homo sapiens
taattcatgggcccagtgatat

SEQ ID NO: 7505160 - DNA, 22 bp, Homo sapiens
taattgaaatcatttcaattca

SEQ ID NO: 7505161 - DNA, 22 bp, Homo sapiens
taattgaactaacatgcaaaca

SEQ ID NO: 7505162 - DNA, 22 bp, Homo sapiens
taattgaactaacatgcaaaca

SEQ ID NO: 7505163 - DNA, 22 bp, Homo sapiens
taattcttcaggccttttgtct

SEQ ID NO: 7505164 - DNA, 22 bp, Homo sapiens
taattctagattgacattttga

SEQ ID NO: 7505165 - DNA, 22 bp, Homo sapiens
taattctagattgacattttga

SEQ ID NO: 7505166 - DNA, 22 bp, Homo sapiens
taattctagattgacattttga

SEQ ID NO: 7505167 - DNA, 22 bp, Homo sapiens
taattcttcaggccttttgtct

SEQ ID NO: 7505168 - DNA, 22 bp, Homo sapiens
taattctagattgacattttga

SEQ ID NO: 7505169 - DNA, 22 bp, Homo sapiens
taattattgtctgaagagttat

SEQ ID NO: 7505170 - DNA, 22 bp, Homo sapiens
taattattgtctgaagagttat

SEQ ID NO: 7505171 - DNA, 22 bp, Homo sapiens
taattattgtctgaagagttat

SEQ ID NO: 7505172 - DNA, 22 bp, Homo sapiens
taattattgtctgaagagttat

SEQ ID NO: 7505173 - DNA, 22 bp, Homo sapiens
taattatttgaagacattagag

SEQ ID NO: 7505174 - DNA, 22 bp, Homo sapiens
taattatttgaagacattagag

SEQ ID NO: 7505175 - DNA, 22 bp, Homo sapiens
taattatttgaagacattagag

SEQ ID NO: 7505176 - DNA, 22 bp, Homo sapiens
taattatttgaagacattagag

SEQ ID NO: 7505177 - DNA, 22 bp, Homo sapiens
taattatttgaagacattagag

SEQ ID NO: 7505178 - DNA, 22 bp, Homo sapiens
taattatttgaagacattagag

SEQ ID NO: 7505179 - DNA, 22 bp, Homo sapiens
taattcatgggcccagtgatat

SEQ ID NO: 7505180 - DNA, 22 bp, Homo sapiens
taattcatgggcccagtgatat

SEQ ID NO: 7505181 - DNA, 22 bp, Homo sapiens
taattcagtgttcacttggaca

SEQ ID NO: 7505182 - DNA, 22 bp, Homo sapiens
taattcagctgaacaactgtgt

SEQ ID NO: 7505183 - DNA, 22 bp, Homo sapiens
taattatttgaagacattagag

SEQ ID NO: 7505184 - DNA, 22 bp, Homo sapiens
taattatttgaagacattagag

SEQ ID NO: 7505185 - DNA, 23 bp, Homo sapiens
taattcacatatacattgcttca

SEQ ID NO: 7505186 - DNA, 23 bp, Homo sapiens
taattcacatatacattgcttca

SEQ ID NO: 7505187 - DNA, 23 bp, Homo sapiens
taatatcctgcaatgcacagaac

SEQ ID NO: 7505188 - DNA, 22 bp, Homo sapiens
taatatctacttcatagagttt

SEQ ID NO: 7505189 - DNA, 22 bp, Homo sapiens
taatatctacttcatagagttt

SEQ ID NO: 7505190 - DNA, 22 bp, Homo sapiens
taatccagggtattctagtttc

SEQ ID NO: 7505191 - DNA, 22 bp, Homo sapiens
taatccaggtaagacataatag

SEQ ID NO: 7505192 - DNA, 18 bp, Homo sapiens
taatccatatgctttgcc

SEQ ID NO: 7505193 - DNA, 22 bp, Homo sapiens
taatcctgcttcttctcccttt

SEQ ID NO: 7505194 - DNA, 22 bp, Homo sapiens
taatcctgcttcttctcccttt

SEQ ID NO: 7505195 - DNA, 22 bp, Homo sapiens
taatcctggtgagtttgaaaaa

SEQ ID NO: 7505196 - DNA, 22 bp, Homo sapiens
taatccaggtaagacataatag

SEQ ID NO: 7505197 - DNA, 22 bp, Homo sapiens
taatatatttctgctaagctca

SEQ ID NO: 7505198 - DNA, 22 bp, Homo sapiens
taatatatttctgctaagctca

SEQ ID NO: 7505199 - DNA, 22 bp, Homo sapiens
taatatatttctgctaagctca

SEQ ID NO: 7505200 - DNA, 22 bp, Homo sapiens
taatatatttctgctaagctca

SEQ ID NO: 7505201 - DNA, 22 bp, Homo sapiens
taatatatttctgctaagctca

SEQ ID NO: 7505202 - DNA, 22 bp, Homo sapiens
taatatatttctgctaagctca

SEQ ID NO: 7505203 - DNA, 22 bp, Homo sapiens
taatatatttctgctaagctca

SEQ ID NO: 7505204 - DNA, 22 bp, Homo sapiens
taatatatttctgctaagctca

SEQ ID NO: 7505205 - DNA, 22 bp, Homo sapiens
taatatatttctgctaagctca

SEQ ID NO: 7505206 - DNA, 22 bp, Homo sapiens
taatctagaacatatgagagca

SEQ ID NO: 7505207 - DNA, 22 bp, Homo sapiens
taatcgtatgtgtatcaaatca

SEQ ID NO: 7505208 - DNA, 22 bp, Homo sapiens
taatcctgtgctgtgtaagtac

SEQ ID NO: 7505209 - DNA, 22 bp, Homo sapiens
taatcctgtcttgaccatcagg

SEQ ID NO: 7505210 - DNA, 22 bp, Homo sapiens
taatccttgcttagtgtggggc

SEQ ID NO: 7505211 - DNA, 22 bp, Homo sapiens
taatctctagcccatgcaaaga

SEQ ID NO: 7505212 - DNA, 22 bp, Homo sapiens
taatctatcaagcaacaaagtg

SEQ ID NO: 7505213 - DNA, 22 bp, Homo sapiens
taatctatcaagcaacaaagtg

SEQ ID NO: 7505214 - DNA, 22 bp, Homo sapiens
taatctagtcccacatggaatt

SEQ ID NO: 7505215 - DNA, 22 bp, Homo sapiens
taatctatcaagcaacaaagtg

SEQ ID NO: 7505216 - DNA, 22 bp, Homo sapiens
taatctctttatgagaagaagg

SEQ ID NO: 7505217 - DNA, 22 bp, Homo sapiens
taatctctttatgagaagaagg

SEQ ID NO: 7505218 - DNA, 22 bp, Homo sapiens
taatctctttatgagaagaagg

SEQ ID NO: 7505219 - DNA, 22 bp, Homo sapiens
taattattatgacaacaattgc

SEQ ID NO: 7505220 - DNA, 22 bp, Homo sapiens
taattattatgacaacaattgc

SEQ ID NO: 7505221 - DNA, 22 bp, Homo sapiens
taattattatgacaacaattgc

SEQ ID NO: 7505222 - DNA, 22 bp, Homo sapiens
taattattatgacaacaattgc

SEQ ID NO: 7505223 - DNA, 22 bp, Homo sapiens
taattattatgacaacaattgc

SEQ ID NO: 7505224 - DNA, 22 bp, Homo sapiens
taattattatgacaacaattgc

SEQ ID NO: 7505225 - DNA, 22 bp, Homo sapiens
taattattatgacaacaattgc

SEQ ID NO: 7505226 - DNA, 22 bp, Homo sapiens
taattattctagtcacatagca

SEQ ID NO: 7505227 - DNA, 22 bp, Homo sapiens
taattattctagtcacatagca

SEQ ID NO: 7505228 - DNA, 22 bp, Homo sapiens
taattattctagtcacatagca

SEQ ID NO: 7505229 - DNA, 22 bp, Homo sapiens
taattattctagtcacatagca

SEQ ID NO: 7505230 - DNA, 22 bp, Homo sapiens
taattattctagtcacatagca

SEQ ID NO: 7505231 - DNA, 22 bp, Homo sapiens
taattattctagtcacatagca

SEQ ID NO: 7505232 - DNA, 22 bp, Homo sapiens
taattattctagtcacatagca

SEQ ID NO: 7505233 - DNA, 22 bp, Homo sapiens
taattattgtctgaagagttat

SEQ ID NO: 7505234 - DNA, 22 bp, Homo sapiens
taattattgtctgaagagttat

SEQ ID NO: 7505235 - DNA, 22 bp, Homo sapiens
taatctgttgttaatattgact

SEQ ID NO: 7505236 - DNA, 22 bp, Homo sapiens
taatctgttgttaatattgact

SEQ ID NO: 7505237 - DNA, 22 bp, Homo sapiens
taatctgtttcccaaggtgata

SEQ ID NO: 7505238 - DNA, 22 bp, Homo sapiens
taatctgttaatatttgtatcc

SEQ ID NO: 7505239 - DNA, 22 bp, Homo sapiens
taatctgttgactaacttggga

SEQ ID NO: 7505240 - DNA, 22 bp, Homo sapiens
taatctgttgttaatattgact

SEQ ID NO: 7505241 - DNA, 22 bp, Homo sapiens
taatctgttaatatttgtatcc

SEQ ID NO: 7505242 - DNA, 22 bp, Homo sapiens
taatctgttaatatttgtatcc

SEQ ID NO: 7505243 - DNA, 22 bp, Homo sapiens
taatctgttgactaacttggga

SEQ ID NO: 7505244 - DNA, 22 bp, Homo sapiens
taatctgtattcctactttgca

SEQ ID NO: 7505245 - DNA, 22 bp, Homo sapiens
taatctgtgtaccttcatcgga

SEQ ID NO: 7505246 - DNA, 22 bp, Homo sapiens
taatctgtgtaccttcatcgga

SEQ ID NO: 7505247 - DNA, 22 bp, Homo sapiens
taatctgtaatttttgcaatag

SEQ ID NO: 7505248 - DNA, 22 bp, Homo sapiens
taatctgtattcctactttgca

SEQ ID NO: 7505249 - DNA, 22 bp, Homo sapiens
taatctctttatgagaagaagg

SEQ ID NO: 7505250 - DNA, 22 bp, Homo sapiens
taatctgtaatttttgcaatag

SEQ ID NO: 7505251 - DNA, 21 bp, Homo sapiens
taatcttcgaaaatgtattag

SEQ ID NO: 7505252 - DNA, 19 bp, Homo sapiens
taatcttattgggcagatt

SEQ ID NO: 7505253 - DNA, 22 bp, Homo sapiens
taatgaacaatatatcaatagc

SEQ ID NO: 7505254 - DNA, 22 bp, Homo sapiens
taatgaacacagaatttcactt

SEQ ID NO: 7505255 - DNA, 22 bp, Homo sapiens
taatgaacaatatatcaatagc

SEQ ID NO: 7505256 - DNA, 21 bp, Homo sapiens
taatcttcgaaaatgtattag

SEQ ID NO: 7505257 - DNA, 22 bp, Homo sapiens
taatcttagacatgtatttttc

SEQ ID NO: 7505258 - DNA, 22 bp, Homo sapiens
taatcttagacatgtatttttc

SEQ ID NO: 7505259 - DNA, 22 bp, Homo sapiens
taatcttagcaacctccagtgt

SEQ ID NO: 7505260 - DNA, 22 bp, Homo sapiens
taatcttagacatgtatttttc

SEQ ID NO: 7505261 - DNA, 18 bp, Homo sapiens
taatcttacagacaggat

SEQ ID NO: 7505262 - DNA, 18 bp, Homo sapiens
taatcttacagacaggat

SEQ ID NO: 7505263 - DNA, 22 bp, Homo sapiens
taaggaggttggtgggttggat

SEQ ID NO: 7505264 - DNA, 22 bp, Homo sapiens
taaggattaaataagaatattt

SEQ ID NO: 7505265 - DNA, 22 bp, Homo sapiens
taatagtcattgtataccttgg

SEQ ID NO: 7505266 - DNA, 22 bp, Homo sapiens
taaggattaaataagaatattt

SEQ ID NO: 7505267 - DNA, 22 bp, Homo sapiens
taatagttgtgactttgtaaag

SEQ ID NO: 7505268 - DNA, 22 bp, Homo sapiens
taatagttgtgactttgtaaag

SEQ ID NO: 7505269 - DNA, 22 bp, Homo sapiens
taatagttgtgactttgtaaag

SEQ ID NO: 7505270 - DNA, 22 bp, Homo sapiens
taatagttatggttggttctca

SEQ ID NO: 7505271 - DNA, 22 bp, Homo sapiens
taatagttatggttggttctca

SEQ ID NO: 7505272 - DNA, 22 bp, Homo sapiens
taatagttatggttggttctca

SEQ ID NO: 7505273 - DNA, 22 bp, Homo sapiens
taaggagggggaatgattggca

SEQ ID NO: 7505274 - DNA, 22 bp, Homo sapiens
taaggagggggaatgattggca

SEQ ID NO: 7505275 - DNA, 22 bp, Homo sapiens
taaggagggggaatgattggca

SEQ ID NO: 7505276 - DNA, 22 bp, Homo sapiens
taaggaggtgcccactctcagg

SEQ ID NO: 7505277 - DNA, 22 bp, Homo sapiens
taaggaggttggtgggttggat

SEQ ID NO: 7505278 - DNA, 22 bp, Homo sapiens
taaggaggttggtgggttggat

SEQ ID NO: 7505279 - DNA, 22 bp, Homo sapiens
taaggaggtgcccactctcagg

SEQ ID NO: 7505280 - DNA, 22 bp, Homo sapiens
taaggaggtgcccactctcagg

SEQ ID NO: 7505281 - DNA, 22 bp, Homo sapiens
taaggaggctgctgtgaagaaa

SEQ ID NO: 7505282 - DNA, 22 bp, Homo sapiens
taaggaggctgctgtgaagaaa

SEQ ID NO: 7505283 - DNA, 22 bp, Homo sapiens
taaggaggctgctgtgaagaaa

SEQ ID NO: 7505284 - DNA, 22 bp, Homo sapiens
taaggaggcgaggtggtgagca

SEQ ID NO: 7505285 - DNA, 22 bp, Homo sapiens
taaggaggctgctgtgaagaaa

SEQ ID NO: 7505286 - DNA, 22 bp, Homo sapiens
taaggaggctgctgtgaagaaa

SEQ ID NO: 7505287 - DNA, 22 bp, Homo sapiens
taaggacattggttttgagtaa

SEQ ID NO: 7505288 - DNA, 22 bp, Homo sapiens
taaggacattggttttgagtaa

SEQ ID NO: 7505289 - DNA, 22 bp, Homo sapiens
taaggacattggttttgagtaa

SEQ ID NO: 7505290 - DNA, 22 bp, Homo sapiens
taaggacattagaaatgatgct

SEQ ID NO: 7505291 - DNA, 22 bp, Homo sapiens
taaggacagcagctacttttcc

SEQ ID NO: 7505292 - DNA, 22 bp, Homo sapiens
taaggacattagaaatgatgct

SEQ ID NO: 7505293 - DNA, 22 bp, Homo sapiens
taaggacattagaaatgatgct

SEQ ID NO: 7505294 - DNA, 22 bp, Homo sapiens
taaggaggcagtcattatcagg

SEQ ID NO: 7505295 - DNA, 22 bp, Homo sapiens
taaggaggcgaggtggtgagca

SEQ ID NO: 7505296 - DNA, 22 bp, Homo sapiens
taaggaggcgaggtggtgagca

SEQ ID NO: 7505297 - DNA, 22 bp, Homo sapiens
taaggaggcagtcattatcagg

SEQ ID NO: 7505298 - DNA, 22 bp, Homo sapiens
taaggaggcagtcattatcagg

SEQ ID NO: 7505299 - DNA, 22 bp, Homo sapiens
taaggacattggttttgagtaa

SEQ ID NO: 7505300 - DNA, 22 bp, Homo sapiens
taaggacaatcaggttagtagc

SEQ ID NO: 7505301 - DNA, 22 bp, Homo sapiens
taaggacaatcaggttagtagc

SEQ ID NO: 7505302 - DNA, 22 bp, Homo sapiens
taaggacaatttgtcgcttgca

SEQ ID NO: 7505303 - DNA, 22 bp, Homo sapiens
taaggacaatttgtcgcttgca

SEQ ID NO: 7505304 - DNA, 22 bp, Homo sapiens
taaggaagtcacaagaatcgct

SEQ ID NO: 7505305 - DNA, 22 bp, Homo sapiens
taaggaatagtgctatgaaaaa

SEQ ID NO: 7505306 - DNA, 22 bp, Homo sapiens
taaggaatagtgctatgaaaaa

SEQ ID NO: 7505307 - DNA, 22 bp, Homo sapiens
taaggaatatcataagaagtag

SEQ ID NO: 7505308 - DNA, 22 bp, Homo sapiens
taaggaatatcataagaagtag

SEQ ID NO: 7505309 - DNA, 22 bp, Homo sapiens
taaggaatatcataagaagtag

SEQ ID NO: 7505310 - DNA, 22 bp, Homo sapiens
taaggaatatcataagaagtag

SEQ ID NO: 7505311 - DNA, 22 bp, Homo sapiens
taaggaatgcttgaatgttcct

SEQ ID NO: 7505312 - DNA, 22 bp, Homo sapiens
taatatatacctttgttaggaa

SEQ ID NO: 7505313 - DNA, 22 bp, Homo sapiens
taatatatacctttgttaggaa

SEQ ID NO: 7505314 - DNA, 22 bp, Homo sapiens
taatatatacctttgttaggaa

SEQ ID NO: 7505315 - DNA, 22 bp, Homo sapiens
taatatatacctttgttaggaa

SEQ ID NO: 7505316 - DNA, 22 bp, Homo sapiens
taatatatacctttgttaggaa

SEQ ID NO: 7505317 - DNA, 22 bp, Homo sapiens
taatatatacctttgttaggaa

SEQ ID NO: 7505318 - DNA, 22 bp, Homo sapiens
taatatatacctttgttaggaa

SEQ ID NO: 7505319 - DNA, 22 bp, Homo sapiens
taatatatacctttgttaggaa

SEQ ID NO: 7505320 - DNA, 21 bp, Homo sapiens
taatataggttcacaactagt

SEQ ID NO: 7505321 - DNA, 21 bp, Homo sapiens
taatataggttcacaactagt

SEQ ID NO: 7505322 - DNA, 22 bp, Homo sapiens
taatatacttcccatagtttga

SEQ ID NO: 7505323 - DNA, 22 bp, Homo sapiens
taatatacttcccatagtttga

SEQ ID NO: 7505324 - DNA, 22 bp, Homo sapiens
taatatacttcccatagtttga

SEQ ID NO: 7505325 - DNA, 22 bp, Homo sapiens
taatatacttcccatagtttga

SEQ ID NO: 7505326 - DNA, 22 bp, Homo sapiens
taatatacttcccatagtttga

SEQ ID NO: 7505327 - DNA, 22 bp, Homo sapiens
taatatacttcccatagtttga

SEQ ID NO: 7505328 - DNA, 22 bp, Homo sapiens
taatatacttcccatagtttga

SEQ ID NO: 7505329 - DNA, 22 bp, Homo sapiens
taatatacttcccatagtttga

SEQ ID NO: 7505330 - DNA, 22 bp, Homo sapiens
taatataccaaactgtaatttt

SEQ ID NO: 7505331 - DNA, 22 bp, Homo sapiens
taatataccaaactgtaatttt

SEQ ID NO: 7505332 - DNA, 22 bp, Homo sapiens
taatataccaaactgtaatttt

SEQ ID NO: 7505333 - DNA, 22 bp, Homo sapiens
taatataccaaactgtaatttt

SEQ ID NO: 7505334 - DNA, 22 bp, Homo sapiens
taatataccaaactgtaatttt

SEQ ID NO: 7505335 - DNA, 22 bp, Homo sapiens
taatataccaaactgtaatttt

SEQ ID NO: 7505336 - DNA, 22 bp, Homo sapiens
taatataccaaactgtaatttt

SEQ ID NO: 7505337 - DNA, 19 bp, Homo sapiens
taatatacagacccatctg

SEQ ID NO: 7505338 - DNA, 22 bp, Homo sapiens
taatataccaaactgtaatttt

SEQ ID NO: 7505339 - DNA, 22 bp, Homo sapiens
taatataccaaactgtaatttt

SEQ ID NO: 7505340 - DNA, 22 bp, Homo sapiens
taatagtttcataatgtgcttc

SEQ ID NO: 7505341 - DNA, 22 bp, Homo sapiens
taatagtttcataatgtgcttc

SEQ ID NO: 7505342 - DNA, 22 bp, Homo sapiens
taatagtttcataatgtgcttc

SEQ ID NO: 7505343 - DNA, 19 bp, Homo sapiens
taatatacagacccatctg

SEQ ID NO: 7505344 - DNA, 19 bp, Homo sapiens
taatatacagacccatctg

SEQ ID NO: 7505345 - DNA, 22 bp, Homo sapiens
taaggaaaatggacatcaaaca

SEQ ID NO: 7505346 - DNA, 22 bp, Homo sapiens
taaggaaaatggacatcaaaca

SEQ ID NO: 7505347 - DNA, 22 bp, Homo sapiens
taaggaaaatggacatcaaaca

SEQ ID NO: 7505348 - DNA, 22 bp, Homo sapiens
taaggaaacaacttgtattttt

SEQ ID NO: 7505349 - DNA, 22 bp, Homo sapiens
taaggaaacaacttgtattttt

SEQ ID NO: 7505350 - DNA, 22 bp, Homo sapiens
taaggaaacaacttgtattttt

SEQ ID NO: 7505351 - DNA, 22 bp, Homo sapiens
taaggaaacaacttgtattttt

SEQ ID NO: 7505352 - DNA, 22 bp, Homo sapiens
taaggaaacaacttgtattttt

SEQ ID NO: 7505353 - DNA, 22 bp, Homo sapiens
taaggaaacaacttgtattttt

SEQ ID NO: 7505354 - DNA, 22 bp, Homo sapiens
taaggaaacaacttgtattttt

SEQ ID NO: 7505355 - DNA, 22 bp, Homo sapiens
taaggaaacaacttgtattttt

SEQ ID NO: 7505356 - DNA, 22 bp, Homo sapiens
taaggaaagtgccatgatttct

SEQ ID NO: 7505357 - DNA, 22 bp, Homo sapiens
taaggaaagtgccatgatttct

SEQ ID NO: 7505358 - DNA, 22 bp, Homo sapiens
taaggaaagtgccatgatttct

SEQ ID NO: 7505359 - DNA, 22 bp, Homo sapiens
taaggaaagtgccatgatttct

SEQ ID NO: 7505360 - DNA, 22 bp, Homo sapiens
taaggaaagtgccatgatttct

SEQ ID NO: 7505361 - DNA, 22 bp, Homo sapiens
taaggaaagtgccatgatttct

SEQ ID NO: 7505362 - DNA, 22 bp, Homo sapiens
taaggaaagtacatgttttgac

SEQ ID NO: 7505363 - DNA, 22 bp, Homo sapiens
taaggaaagtacatgttttgac

SEQ ID NO: 7505364 - DNA, 22 bp, Homo sapiens
taaggaaagtacatgttttgac

SEQ ID NO: 7505365 - DNA, 22 bp, Homo sapiens
taaggaaacaacttgtattttt

SEQ ID NO: 7505366 - DNA, 22 bp, Homo sapiens
taaggaaagtacatgttttgac

SEQ ID NO: 7505367 - DNA, 22 bp, Homo sapiens
taaggaaagtacatgttttgac

SEQ ID NO: 7505368 - DNA, 22 bp, Homo sapiens
taaggaagagcttggtaatagg

SEQ ID NO: 7505369 - DNA, 21 bp, Homo sapiens
taaggaagagcattttaggtc

SEQ ID NO: 7505370 - DNA, 21 bp, Homo sapiens
taaggaagagcattttaggtc

SEQ ID NO: 7505371 - DNA, 22 bp, Homo sapiens
taaggaaagtgccatgatttct

SEQ ID NO: 7505372 - DNA, 22 bp, Homo sapiens
taaggaaagtgccatgatttct

SEQ ID NO: 7505373 - DNA, 22 bp, Homo sapiens
taaggaaagtgccatgatttct

SEQ ID NO: 7505374 - DNA, 22 bp, Homo sapiens
taaggaaggggaaagacatgtc

SEQ ID NO: 7505375 - DNA, 22 bp, Homo sapiens
taaggaaggggaaagacatgtc

SEQ ID NO: 7505376 - DNA, 22 bp, Homo sapiens
taaggaaagtacatgttttgac

SEQ ID NO: 7505377 - DNA, 22 bp, Homo sapiens
taaggaagagcttggtaatagg

SEQ ID NO: 7505378 - DNA, 22 bp, Homo sapiens
taaggaagagcttggtaatagg

SEQ ID NO: 7505379 - DNA, 22 bp, Homo sapiens
taaggaagtcacaagaatcgct

SEQ ID NO: 7505380 - DNA, 22 bp, Homo sapiens
taaggaagtacccattcttagg

SEQ ID NO: 7505381 - DNA, 22 bp, Homo sapiens
taaggaagtacccattcttagg

SEQ ID NO: 7505382 - DNA, 22 bp, Homo sapiens
taaggaagtcacaagaatcgct

SEQ ID NO: 7505383 - DNA, 22 bp, Homo sapiens
taaggaagtcacaagaatcgct

SEQ ID NO: 7505384 - DNA, 22 bp, Homo sapiens
taaggaatagtgctatgaaaaa

SEQ ID NO: 7505385 - DNA, 18 bp, Homo sapiens
taaggaagggggtgaaga

SEQ ID NO: 7505386 - DNA, 22 bp, Homo sapiens
taaggaagtacccattcttagg

SEQ ID NO: 7505387 - DNA, 18 bp, Homo sapiens
taaggaagggggtgaaga

SEQ ID NO: 7505388 - DNA, 22 bp, Homo sapiens
taaggaaggggaaagacatgtc

SEQ ID NO: 7505389 - DNA, 22 bp, Homo sapiens
taagccactagtctgttatgaa

SEQ ID NO: 7505390 - DNA, 22 bp, Homo sapiens
taagccactgagatttggggtt

SEQ ID NO: 7505391 - DNA, 21 bp, Homo sapiens
taagccaccatgtgaaaccag

SEQ ID NO: 7505392 - DNA, 22 bp, Homo sapiens
taagccactagtctgttatgaa

SEQ ID NO: 7505393 - DNA, 22 bp, Homo sapiens
taagcctgcatgaaccatgaga

SEQ ID NO: 7505394 - DNA, 22 bp, Homo sapiens
taagcctgcatgaaccatgaga

SEQ ID NO: 7505395 - DNA, 21 bp, Homo sapiens
taagccaccatgtgaaaccag

SEQ ID NO: 7505396 - DNA, 22 bp, Homo sapiens
taagccaaaatcaggacacaga

SEQ ID NO: 7505397 - DNA, 22 bp, Homo sapiens
taagcattaactctgctgcaag

SEQ ID NO: 7505398 - DNA, 21 bp, Homo sapiens
taagcatatcagatagactct

SEQ ID NO: 7505399 - DNA, 22 bp, Homo sapiens
taaggaaaatggacatcaaaca

SEQ ID NO: 7505400 - DNA, 22 bp, Homo sapiens
taaggaaaatggacatcaaaca

SEQ ID NO: 7505401 - DNA, 22 bp, Homo sapiens
taaggaaaatggacatcaaaca

SEQ ID NO: 7505402 - DNA, 22 bp, Homo sapiens
taaggaaaatggacatcaaaca

SEQ ID NO: 7505403 - DNA, 22 bp, Homo sapiens
taaggaaaatggacatcaaaca

SEQ ID NO: 7505404 - DNA, 22 bp, Homo sapiens
taagctctgttatccagagccc

SEQ ID NO: 7505405 - DNA, 22 bp, Homo sapiens
taagctggggctatgctaaata

SEQ ID NO: 7505406 - DNA, 22 bp, Homo sapiens
taagctctccaggtgatcatga

SEQ ID NO: 7505407 - DNA, 22 bp, Homo sapiens
taagctctgttatccagagccc

SEQ ID NO: 7505408 - DNA, 22 bp, Homo sapiens
taagccccctcaccctggcttc

SEQ ID NO: 7505409 - DNA, 22 bp, Homo sapiens
taagctaacgtccatggaaatg

SEQ ID NO: 7505410 - DNA, 22 bp, Homo sapiens
taagctattcctgaagaaggtt

SEQ ID NO: 7505411 - DNA, 22 bp, Homo sapiens
taagctcactgtaagaactgat

SEQ ID NO: 7505412 - DNA, 22 bp, Homo sapiens
taagctcactgtaagaactgat

SEQ ID NO: 7505413 - DNA, 22 bp, Homo sapiens
taagctcactgtaagaactgat

SEQ ID NO: 7505414 - DNA, 22 bp, Homo sapiens
taagcctgtgcatgggcagatg

SEQ ID NO: 7505415 - DNA, 22 bp, Homo sapiens
taagcgctacttccagggttgc

SEQ ID NO: 7505416 - DNA, 22 bp, Homo sapiens
taagcctgcatgaaccatgaga

SEQ ID NO: 7505417 - DNA, 21 bp, Homo sapiens
taatttattcagcacagtgtt

SEQ ID NO: 7505418 - DNA, 21 bp, Homo sapiens
taatttattcagcacagtgtt

SEQ ID NO: 7505419 - DNA, 21 bp, Homo sapiens
taatttattcagcacagtgtt

SEQ ID NO: 7505420 - DNA, 21 bp, Homo sapiens
taatttattcagcacagtgtt

SEQ ID NO: 7505421 - DNA, 21 bp, Homo sapiens
taatttattcagcacagtgtt

SEQ ID NO: 7505422 - DNA, 22 bp, Homo sapiens
taatttatttcaactgccaagg

SEQ ID NO: 7505423 - DNA, 22 bp, Homo sapiens
taatttatttcaactgccaagg

SEQ ID NO: 7505424 - DNA, 22 bp, Homo sapiens
taatttatttcaactgccaagg

SEQ ID NO: 7505425 - DNA, 21 bp, Homo sapiens
taatttattcagcacagtgtt

SEQ ID NO: 7505426 - DNA, 21 bp, Homo sapiens
taatttattcagcacagtgtt

SEQ ID NO: 7505427 - DNA, 21 bp, Homo sapiens
taatttattcagcacagtgtt

SEQ ID NO: 7505428 - DNA, 21 bp, Homo sapiens
taatttattcagcacagtgtt

SEQ ID NO: 7505429 - DNA, 21 bp, Homo sapiens
taatttattcagcacagtgtt

SEQ ID NO: 7505430 - DNA, 22 bp, Homo sapiens
taatttatggtatgtgtgtaat

SEQ ID NO: 7505431 - DNA, 22 bp, Homo sapiens
taatttatggtatgtgtgtaat

SEQ ID NO: 7505432 - DNA, 22 bp, Homo sapiens
taatttatggtatgtgtgtaat

SEQ ID NO: 7505433 - DNA, 22 bp, Homo sapiens
taatttatggtatgtgtgtaat

SEQ ID NO: 7505434 - DNA, 22 bp, Homo sapiens
taatttatggtatgtgtgtaat

SEQ ID NO: 7505435 - DNA, 22 bp, Homo sapiens
taatttatgatgcaaagaaaag

SEQ ID NO: 7505436 - DNA, 22 bp, Homo sapiens
taatttatgatgcaaagaaaag

SEQ ID NO: 7505437 - DNA, 22 bp, Homo sapiens
tacaacataacgggcattcagt

SEQ ID NO: 7505438 - DNA, 22 bp, Homo sapiens
tacaacataacgggcattcagt

SEQ ID NO: 7505439 - DNA, 22 bp, Homo sapiens
tacaacataacgggcattcagt

SEQ ID NO: 7505440 - DNA, 22 bp, Homo sapiens
tacaacatgtaaagtggtttaa

SEQ ID NO: 7505441 - DNA, 22 bp, Homo sapiens
tacaacatgtggtcctttatga

SEQ ID NO: 7505442 - DNA, 22 bp, Homo sapiens
tacaacatgtggtcctttatga

SEQ ID NO: 7505443 - DNA, 22 bp, Homo sapiens
tacaacatgtggtcctttatga

SEQ ID NO: 7505444 - DNA, 22 bp, Homo sapiens
tacaacatgtggtcctttatga

SEQ ID NO: 7505445 - DNA, 22 bp, Homo sapiens
tacaacattgtgttgcttcata

SEQ ID NO: 7505446 - DNA, 22 bp, Homo sapiens
taatttcaaatttcttagcgtg

SEQ ID NO: 7505447 - DNA, 22 bp, Homo sapiens
tacaacataacgggcattcagt

SEQ ID NO: 7505448 - DNA, 22 bp, Homo sapiens
tacaacataacgggcattcagt

SEQ ID NO: 7505449 - DNA, 22 bp, Homo sapiens
taatttatttcaactgccaagg

SEQ ID NO: 7505450 - DNA, 22 bp, Homo sapiens
taatttatttcaactgccaagg

SEQ ID NO: 7505451 - DNA, 22 bp, Homo sapiens
tacaagaaagtccagtgggttt

SEQ ID NO: 7505452 - DNA, 22 bp, Homo sapiens
tacaagaaagtccagtgggttt

SEQ ID NO: 7505453 - DNA, 22 bp, Homo sapiens
tacaagaaactacatgaatgca

SEQ ID NO: 7505454 - DNA, 22 bp, Homo sapiens
tacaagaaactacatgaatgca

SEQ ID NO: 7505455 - DNA, 22 bp, Homo sapiens
tacaacttccagctttcagccc

SEQ ID NO: 7505456 - DNA, 22 bp, Homo sapiens
tacaagaaactacatgaatgca

SEQ ID NO: 7505457 - DNA, 22 bp, Homo sapiens
tacaacttccagctttcagccc

SEQ ID NO: 7505458 - DNA, 22 bp, Homo sapiens
tacaacttacttgaatggcttt

SEQ ID NO: 7505459 - DNA, 22 bp, Homo sapiens
tacaagaaactacatgaatgca

SEQ ID NO: 7505460 - DNA, 22 bp, Homo sapiens
tacaagaaactacatgaatgca

SEQ ID NO: 7505461 - DNA, 22 bp, Homo sapiens
tacaagaaactacatgaatgca

SEQ ID NO: 7505462 - DNA, 22 bp, Homo sapiens
tacaagaaatttctgcatatat

SEQ ID NO: 7505463 - DNA, 22 bp, Homo sapiens
tacaagaaatttctgcatatat

SEQ ID NO: 7505464 - DNA, 22 bp, Homo sapiens
tacaagaagaggcagagctgga

SEQ ID NO: 7505465 - DNA, 22 bp, Homo sapiens
tacaagaaatttctgcatatat

SEQ ID NO: 7505466 - DNA, 22 bp, Homo sapiens
tacaagaaatttctgcatatat

SEQ ID NO: 7505467 - DNA, 22 bp, Homo sapiens
tacaagaaatttctgcatatat

SEQ ID NO: 7505468 - DNA, 22 bp, Homo sapiens
tacaagaaatttctgcatatat

SEQ ID NO: 7505469 - DNA, 22 bp, Homo sapiens
tacaagaaatttctgcatatat

SEQ ID NO: 7505470 - DNA, 22 bp, Homo sapiens
tacaagaaatttctgcatatat

SEQ ID NO: 7505471 - DNA, 22 bp, Homo sapiens
tacaagaaatttctgcatatat

SEQ ID NO: 7505472 - DNA, 22 bp, Homo sapiens
tacaacatttacgttaggctgt

SEQ ID NO: 7505473 - DNA, 22 bp, Homo sapiens
tacaacattgtgttgcttcata

SEQ ID NO: 7505474 - DNA, 22 bp, Homo sapiens
tacaacattgtgttgcttcata

SEQ ID NO: 7505475 - DNA, 22 bp, Homo sapiens
tacaacatgtaaagtggtttaa

SEQ ID NO: 7505476 - DNA, 22 bp, Homo sapiens
tacaacattgtgttgcttcata

SEQ ID NO: 7505477 - DNA, 22 bp, Homo sapiens
tacaacattgtgttgcttcata

SEQ ID NO: 7505478 - DNA, 22 bp, Homo sapiens
tacaaccatagacatatactag

SEQ ID NO: 7505479 - DNA, 22 bp, Homo sapiens
tacaaccatagacatatactag

SEQ ID NO: 7505480 - DNA, 22 bp, Homo sapiens
tacaaccatagacatatactag

SEQ ID NO: 7505481 - DNA, 22 bp, Homo sapiens
tacaacatttacgttaggctgt

SEQ ID NO: 7505482 - DNA, 22 bp, Homo sapiens
tacaacatttacgttaggctgt

SEQ ID NO: 7505483 - DNA, 22 bp, Homo sapiens
tacaacatttacgttaggctgt

SEQ ID NO: 7505484 - DNA, 22 bp, Homo sapiens
tacaacttacttgaatggcttt

SEQ ID NO: 7505485 - DNA, 22 bp, Homo sapiens
tacaacttacttgaatggcttt

SEQ ID NO: 7505486 - DNA, 17 bp, Homo sapiens
tacaactgttgtttata

SEQ ID NO: 7505487 - DNA, 22 bp, Homo sapiens
tacaactgtcagatgttttgag

SEQ ID NO: 7505488 - DNA, 22 bp, Homo sapiens
tacaactgtgtgaaggaatctg

SEQ ID NO: 7505489 - DNA, 22 bp, Homo sapiens
tacaactgcacatctgaatcac

SEQ ID NO: 7505490 - DNA, 22 bp, Homo sapiens
tacaactgcacatctgaatcac

SEQ ID NO: 7505491 - DNA, 22 bp, Homo sapiens
tacaaccatagacatatactag

SEQ ID NO: 7505492 - DNA, 22 bp, Homo sapiens
tacaacctctgcctcccaagtt

SEQ ID NO: 7505493 - DNA, 22 bp, Homo sapiens
tacaaccatagacatatactag

SEQ ID NO: 7505494 - DNA, 22 bp, Homo sapiens
tacaaccatagacatatactag

SEQ ID NO: 7505495 - DNA, 22 bp, Homo sapiens
tacaaccatagacatatactag

SEQ ID NO: 7505496 - DNA, 22 bp, Homo sapiens
tacaagataagaattggcaagg

SEQ ID NO: 7505497 - DNA, 22 bp, Homo sapiens
tacaagataagaattggcaagg

SEQ ID NO: 7505498 - DNA, 22 bp, Homo sapiens
tacaagagtgagattatcatgt

SEQ ID NO: 7505499 - DNA, 22 bp, Homo sapiens
tacaagaggtatatagaaacag

SEQ ID NO: 7505500 - DNA, 22 bp, Homo sapiens
tacaagaggtatatagaaacag

SEQ ID NO: 7505501 - DNA, 22 bp, Homo sapiens
tacaagaggatgtggacatgga

SEQ ID NO: 7505502 - DNA, 22 bp, Homo sapiens
tacaagaggatgtggacatgga

SEQ ID NO: 7505503 - DNA, 22 bp, Homo sapiens
tacaagaggatgtggacatgga

SEQ ID NO: 7505504 - DNA, 22 bp, Homo sapiens
tacaagaggtatatagaaacag

SEQ ID NO: 7505505 - DNA, 22 bp, Homo sapiens
tacaagaggtatatagaaacag

SEQ ID NO: 7505506 - DNA, 22 bp, Homo sapiens
tacaagaggtatatagaaacag

SEQ ID NO: 7505507 - DNA, 22 bp, Homo sapiens
tacaagaggtatatagaaacag

SEQ ID NO: 7505508 - DNA, 21 bp, Homo sapiens
tacaagatagaggtaatatat

SEQ ID NO: 7505509 - DNA, 21 bp, Homo sapiens
tacaagatagaggtaatatat

SEQ ID NO: 7505510 - DNA, 21 bp, Homo sapiens
tacaagatagaggtaatatat

SEQ ID NO: 7505511 - DNA, 21 bp, Homo sapiens
tacaagatagaggtaatatat

SEQ ID NO: 7505512 - DNA, 22 bp, Homo sapiens
tacaagatgacaggtgcatgat

SEQ ID NO: 7505513 - DNA, 22 bp, Homo sapiens
tacaagatgacaggtgcatgat

SEQ ID NO: 7505514 - DNA, 22 bp, Homo sapiens
tacaagatgtactaaaaattat

SEQ ID NO: 7505515 - DNA, 22 bp, Homo sapiens
tacaagatgtactaaaaattat

SEQ ID NO: 7505516 - DNA, 22 bp, Homo sapiens
tacaagatgtactaaaaattat

SEQ ID NO: 7505517 - DNA, 22 bp, Homo sapiens
tacaagatgtactaaaaattat

SEQ ID NO: 7505518 - DNA, 22 bp, Homo sapiens
tacaagatgtactaaaaattat

SEQ ID NO: 7505519 - DNA, 22 bp, Homo sapiens
tacacaatgacttaagatgtca

SEQ ID NO: 7505520 - DNA, 22 bp, Homo sapiens
tacacaatgacttaagatgtca

SEQ ID NO: 7505521 - DNA, 22 bp, Homo sapiens
tacacaatgacttaagatgtca

SEQ ID NO: 7505522 - DNA, 22 bp, Homo sapiens
tacacaatgacttaagatgtca

SEQ ID NO: 7505523 - DNA, 22 bp, Homo sapiens
tacacaatgacttaagatgtca

SEQ ID NO: 7505524 - DNA, 22 bp, Homo sapiens
tacacaatgacttaagatgtca

SEQ ID NO: 7505525 - DNA, 22 bp, Homo sapiens
tacacaatctgtttttccattt

SEQ ID NO: 7505526 - DNA, 22 bp, Homo sapiens
tacacaactgacaaccattctg

SEQ ID NO: 7505527 - DNA, 22 bp, Homo sapiens
tacacaactgacaaccattctg

SEQ ID NO: 7505528 - DNA, 22 bp, Homo sapiens
tacacaatctgtttttccattt

SEQ ID NO: 7505529 - DNA, 22 bp, Homo sapiens
tacacaatctgtttttccattt

SEQ ID NO: 7505530 - DNA, 22 bp, Homo sapiens
tacacaatctgtttttccattt

SEQ ID NO: 7505531 - DNA, 22 bp, Homo sapiens
tacaagctcacaaatttttaag

SEQ ID NO: 7505532 - DNA, 22 bp, Homo sapiens
tacaagctcacaaatttttaag

SEQ ID NO: 7505533 - DNA, 22 bp, Homo sapiens
tacaagattaaaacttatacca

SEQ ID NO: 7505534 - DNA, 22 bp, Homo sapiens
tacaagattaaaacttatacca

SEQ ID NO: 7505535 - DNA, 22 bp, Homo sapiens
tacaagaatgtcttaaaagctc

SEQ ID NO: 7505536 - DNA, 22 bp, Homo sapiens
tacaagaatgtcttaaaagctc

SEQ ID NO: 7505537 - DNA, 22 bp, Homo sapiens
tacaagaatgtcttaaaagctc

SEQ ID NO: 7505538 - DNA, 22 bp, Homo sapiens
tacaagaatgtcttaaaagctc

SEQ ID NO: 7505539 - DNA, 22 bp, Homo sapiens
tacaagaatgtcttaaaagctc

SEQ ID NO: 7505540 - DNA, 22 bp, Homo sapiens
tacaagaatgtcttaaaagctc

SEQ ID NO: 7505541 - DNA, 22 bp, Homo sapiens
tacaagaatgtcttaaaagctc

SEQ ID NO: 7505542 - DNA, 22 bp, Homo sapiens
tacaagaatgtcttaaaagctc

SEQ ID NO: 7505543 - DNA, 22 bp, Homo sapiens
tacaagaatgtcttaaaagctc

SEQ ID NO: 7505544 - DNA, 20 bp, Homo sapiens
tacaagaatccccagttgtc

SEQ ID NO: 7505545 - DNA, 20 bp, Homo sapiens
tacaagaatccccagttgtc

SEQ ID NO: 7505546 - DNA, 22 bp, Homo sapiens
tacaagaaggatggagcccact

SEQ ID NO: 7505547 - DNA, 22 bp, Homo sapiens
tacaagaaggaaaactagcaat

SEQ ID NO: 7505548 - DNA, 22 bp, Homo sapiens
tacaagaaggaaaactagcaat

SEQ ID NO: 7505549 - DNA, 22 bp, Homo sapiens
tacaagaagaggcagagctgga

SEQ ID NO: 7505550 - DNA, 22 bp, Homo sapiens
tacaagaagaggcagagctgga

SEQ ID NO: 7505551 - DNA, 22 bp, Homo sapiens
tacaagaaggaaaactagcaat

SEQ ID NO: 7505552 - DNA, 22 bp, Homo sapiens
tacaagaaggaaaactagcaat

SEQ ID NO: 7505553 - DNA, 22 bp, Homo sapiens
tacaagaaggaaaactagcaat

SEQ ID NO: 7505554 - DNA, 22 bp, Homo sapiens
tacaagaaggaaaactagcaat

SEQ ID NO: 7505555 - DNA, 22 bp, Homo sapiens
tacaagaaggatggagcccact

SEQ ID NO: 7505556 - DNA, 22 bp, Homo sapiens
tacaagaaggaaaactagcaat

SEQ ID NO: 7505557 - DNA, 22 bp, Homo sapiens
tacaagaaggaaaactagcaat

SEQ ID NO: 7505558 - DNA, 22 bp, Homo sapiens
tacaagagcagtaagcttgtcc

SEQ ID NO: 7505559 - DNA, 22 bp, Homo sapiens
tacaagagcagtaagcttgtcc

SEQ ID NO: 7505560 - DNA, 22 bp, Homo sapiens
tacaagagcagtaagcttgtcc

SEQ ID NO: 7505561 - DNA, 22 bp, Homo sapiens
tacaagagacaccagggaggct

SEQ ID NO: 7505562 - DNA, 22 bp, Homo sapiens
tacaagagacaccagggaggct

SEQ ID NO: 7505563 - DNA, 22 bp, Homo sapiens
tacaagagacaccagggaggct

SEQ ID NO: 7505564 - DNA, 22 bp, Homo sapiens
tacaagagaactaatgtaagtc

SEQ ID NO: 7505565 - DNA, 22 bp, Homo sapiens
tacaagagaactaatgtaagtc

SEQ ID NO: 7505566 - DNA, 22 bp, Homo sapiens
tacaagagaactaatgtaagtc

SEQ ID NO: 7505567 - DNA, 22 bp, Homo sapiens
tacaagagaactaatgtaagtc

SEQ ID NO: 7505568 - DNA, 22 bp, Homo sapiens
tacaagacgagggaagttcttt

SEQ ID NO: 7505569 - DNA, 22 bp, Homo sapiens
tacaagacgagggaagttcttt

SEQ ID NO: 7505570 - DNA, 22 bp, Homo sapiens
tacaagacgagggaagttcttt

SEQ ID NO: 7505571 - DNA, 21 bp, Homo sapiens
tacaagaccggattcgggccc

SEQ ID NO: 7505572 - DNA, 22 bp, Homo sapiens
tacaagaatttctttctggttg

SEQ ID NO: 7505573 - DNA, 22 bp, Homo sapiens
tacaagacgagggaagttcttt

SEQ ID NO: 7505574 - DNA, 22 bp, Homo sapiens
tacaagacgagggaagttcttt

SEQ ID NO: 7505575 - DNA, 22 bp, Homo sapiens
tacaagaatgtcttaaaagctc

SEQ ID NO: 7505576 - DNA, 22 bp, Homo sapiens
tacaagaatttctttctggttg

SEQ ID NO: 7505577 - DNA, 22 bp, Homo sapiens
tacaagaatttctttctggttg

SEQ ID NO: 7505578 - DNA, 21 bp, Homo sapiens
tacaagaccggattcgggccc

SEQ ID NO: 7505579 - DNA, 22 bp, Homo sapiens
tacagaatgtgtatcattacca

SEQ ID NO: 7505580 - DNA, 22 bp, Homo sapiens
tacagaatgtgtatcattacca

SEQ ID NO: 7505581 - DNA, 22 bp, Homo sapiens
tacagaatgttatgaagcatag

SEQ ID NO: 7505582 - DNA, 22 bp, Homo sapiens
tacagaatgtgtatcattacca

SEQ ID NO: 7505583 - DNA, 22 bp, Homo sapiens
tacagaatgtgtatcattacca

SEQ ID NO: 7505584 - DNA, 22 bp, Homo sapiens
tacagaatgtgtatcattacca

SEQ ID NO: 7505585 - DNA, 21 bp, Homo sapiens
tacagaatgcgcttcagtctg

SEQ ID NO: 7505586 - DNA, 21 bp, Homo sapiens
tacagaatgcgcttcagtctg

SEQ ID NO: 7505587 - DNA, 21 bp, Homo sapiens
tacagaatgcgcttcagtctg

SEQ ID NO: 7505588 - DNA, 20 bp, Homo sapiens
tacagaatgcaataaaatgg

SEQ ID NO: 7505589 - DNA, 22 bp, Homo sapiens
tacagaattagattattagaga

SEQ ID NO: 7505590 - DNA, 22 bp, Homo sapiens
tacagaattagattattagaga

SEQ ID NO: 7505591 - DNA, 22 bp, Homo sapiens
tacagaattagattattagaga

SEQ ID NO: 7505592 - DNA, 22 bp, Homo sapiens
tacagaattagattattagaga

SEQ ID NO: 7505593 - DNA, 22 bp, Homo sapiens
tacagaatgttatgaagcatag

SEQ ID NO: 7505594 - DNA, 22 bp, Homo sapiens
tacagaatgttatgaagcatag

SEQ ID NO: 7505595 - DNA, 22 bp, Homo sapiens
tacagaatgttatgaagcatag

SEQ ID NO: 7505596 - DNA, 22 bp, Homo sapiens
tacagaatgttatgaagcatag

SEQ ID NO: 7505597 - DNA, 22 bp, Homo sapiens
tacagaatgttatgaagcatag

SEQ ID NO: 7505598 - DNA, 22 bp, Homo sapiens
tacagaatgttatgaagcatag

SEQ ID NO: 7505599 - DNA, 22 bp, Homo sapiens
tacagaattagattattagaga

SEQ ID NO: 7505600 - DNA, 22 bp, Homo sapiens
tacagaattagattattagaga

SEQ ID NO: 7505601 - DNA, 22 bp, Homo sapiens
tacagaattagattattagaga

SEQ ID NO: 7505602 - DNA, 22 bp, Homo sapiens
tacagaattagattattagaga

SEQ ID NO: 7505603 - DNA, 22 bp, Homo sapiens
tacagaattagattattagaga

SEQ ID NO: 7505604 - DNA, 22 bp, Homo sapiens
tacagacaaagagcatgcggta

SEQ ID NO: 7505605 - DNA, 22 bp, Homo sapiens
tacagacaaagagcatgcggta

SEQ ID NO: 7505606 - DNA, 22 bp, Homo sapiens
tacagacaaagagcatgcggta

SEQ ID NO: 7505607 - DNA, 22 bp, Homo sapiens
tacagacagtttttcagatatt

SEQ ID NO: 7505608 - DNA, 22 bp, Homo sapiens
tacagacagtttttcagatatt

SEQ ID NO: 7505609 - DNA, 22 bp, Homo sapiens
tacagacagtttttcagatatt

SEQ ID NO: 7505610 - DNA, 22 bp, Homo sapiens
tacagacagacttcccaccctc

SEQ ID NO: 7505611 - DNA, 22 bp, Homo sapiens
tacagacaaagtgctatagggt

SEQ ID NO: 7505612 - DNA, 22 bp, Homo sapiens
tacagacaaagtgctatagggt

SEQ ID NO: 7505613 - DNA, 22 bp, Homo sapiens
tacagacaaagtgctatagggt

SEQ ID NO: 7505614 - DNA, 22 bp, Homo sapiens
tacagacagacttcccaccctc

SEQ ID NO: 7505615 - DNA, 22 bp, Homo sapiens
tacacataggtctgaataaaaa

SEQ ID NO: 7505616 - DNA, 22 bp, Homo sapiens
tacacataggtctgaataaaaa

SEQ ID NO: 7505617 - DNA, 22 bp, Homo sapiens
tacacataggtctgaataaaaa

SEQ ID NO: 7505618 - DNA, 22 bp, Homo sapiens
tacagaatagaatagggacagg

SEQ ID NO: 7505619 - DNA, 22 bp, Homo sapiens
tacagaatagaatagggacagg

SEQ ID NO: 7505620 - DNA, 22 bp, Homo sapiens
tacagaatagaatagggacagg

SEQ ID NO: 7505621 - DNA, 22 bp, Homo sapiens
tacagaatagaatagggacagg

SEQ ID NO: 7505622 - DNA, 22 bp, Homo sapiens
tacacataggtctgaataaaaa

SEQ ID NO: 7505623 - DNA, 22 bp, Homo sapiens
tacagaataaagcgtgaagctt

SEQ ID NO: 7505624 - DNA, 22 bp, Homo sapiens
tacagaataaagcgtgaagctt

SEQ ID NO: 7505625 - DNA, 22 bp, Homo sapiens
tacacataggagggtaataaaa

SEQ ID NO: 7505626 - DNA, 22 bp, Homo sapiens
tacacataggagggtaataaaa

SEQ ID NO: 7505627 - DNA, 22 bp, Homo sapiens
tacacataggagggtaataaaa

SEQ ID NO: 7505628 - DNA, 22 bp, Homo sapiens
tacacatacattgcttacaagg

SEQ ID NO: 7505629 - DNA, 22 bp, Homo sapiens
tacacataggagggtaataaaa

SEQ ID NO: 7505630 - DNA, 22 bp, Homo sapiens
tacacataggagggtaataaaa

SEQ ID NO: 7505631 - DNA, 20 bp, Homo sapiens
tacagaatgcaataaaatgg

SEQ ID NO: 7505632 - DNA, 20 bp, Homo sapiens
tacagaatgcaataaaatgg

SEQ ID NO: 7505633 - DNA, 22 bp, Homo sapiens
tacagaatgatgtgtttaaata

SEQ ID NO: 7505634 - DNA, 22 bp, Homo sapiens
tacagaatgatgtgtttaaata

SEQ ID NO: 7505635 - DNA, 22 bp, Homo sapiens
tacagaatgatgtgtttaaata

SEQ ID NO: 7505636 - DNA, 22 bp, Homo sapiens
tacagaatgatgtgtttaaata

SEQ ID NO: 7505637 - DNA, 20 bp, Homo sapiens
tacagaatgcaataaaatgg

SEQ ID NO: 7505638 - DNA, 20 bp, Homo sapiens
tacagaatgcaataaaatgg

SEQ ID NO: 7505639 - DNA, 20 bp, Homo sapiens
tacagaatgcaataaaatgg

SEQ ID NO: 7505640 - DNA, 20 bp, Homo sapiens
tacagaatgcaataaaatgg

SEQ ID NO: 7505641 - DNA, 22 bp, Homo sapiens
tacagaatatagaagctggaag

SEQ ID NO: 7505642 - DNA, 22 bp, Homo sapiens
tacagaatatagaagctggaag

SEQ ID NO: 7505643 - DNA, 22 bp, Homo sapiens
tacagaatatagaagctggaag

SEQ ID NO: 7505644 - DNA, 22 bp, Homo sapiens
tacagaatatttctgccctgag

SEQ ID NO: 7505645 - DNA, 22 bp, Homo sapiens
tacagaatatttctgccctgag

SEQ ID NO: 7505646 - DNA, 22 bp, Homo sapiens
tacagaatatagaagctggaag

SEQ ID NO: 7505647 - DNA, 22 bp, Homo sapiens
tacagaatctatgcttcacagt

SEQ ID NO: 7505648 - DNA, 22 bp, Homo sapiens
tacagaatctatgcttcacagt

SEQ ID NO: 7505649 - DNA, 22 bp, Homo sapiens
tacagaatctatgcttcacagt

SEQ ID NO: 7505650 - DNA, 22 bp, Homo sapiens
tacagaatatttctgccctgag

SEQ ID NO: 7505651 - DNA, 22 bp, Homo sapiens
tacagaatctatgcttcacagt

SEQ ID NO: 7505652 - DNA, 22 bp, Homo sapiens
tacagaatctatgcttcacagt

SEQ ID NO: 7505653 - DNA, 22 bp, Homo sapiens
tacagaatgatgtgtttaaata

SEQ ID NO: 7505654 - DNA, 22 bp, Homo sapiens
tacagaatctatgcttcacagt

SEQ ID NO: 7505655 - DNA, 22 bp, Homo sapiens
tacacataaaatgctcatggta

SEQ ID NO: 7505656 - DNA, 22 bp, Homo sapiens
tacacagtatatgggatcacag

SEQ ID NO: 7505657 - DNA, 22 bp, Homo sapiens
tacacagtgagtcctctctgcc

SEQ ID NO: 7505658 - DNA, 22 bp, Homo sapiens
tacacagtgagtcctctctgcc

SEQ ID NO: 7505659 - DNA, 22 bp, Homo sapiens
tacacagtgagtcctctctgcc

SEQ ID NO: 7505660 - DNA, 22 bp, Homo sapiens
tacacagttccatttaagccag

SEQ ID NO: 7505661 - DNA, 22 bp, Homo sapiens
tacacagttccatttaagccag

SEQ ID NO: 7505662 - DNA, 22 bp, Homo sapiens
tacacagtgagtcctctctgcc

SEQ ID NO: 7505663 - DNA, 22 bp, Homo sapiens
tacacagttttgctcccatgat

SEQ ID NO: 7505664 - DNA, 22 bp, Homo sapiens
tacacatacaccaatgtggtca

SEQ ID NO: 7505665 - DNA, 22 bp, Homo sapiens
tacacatacaccaatgtggtca

SEQ ID NO: 7505666 - DNA, 22 bp, Homo sapiens
tacacatacattgcttacaagg

SEQ ID NO: 7505667 - DNA, 22 bp, Homo sapiens
tacacatacattgcttacaagg

SEQ ID NO: 7505668 - DNA, 22 bp, Homo sapiens
tacacatacattgcttacaagg

SEQ ID NO: 7505669 - DNA, 22 bp, Homo sapiens
tacacatacattgcttacaagg

SEQ ID NO: 7505670 - DNA, 22 bp, Homo sapiens
tacacatacattgcttacaagg

SEQ ID NO: 7505671 - DNA, 22 bp, Homo sapiens
tacacagtaaatggtaaataca

SEQ ID NO: 7505672 - DNA, 22 bp, Homo sapiens
tacacagtaaatggtaaataca

SEQ ID NO: 7505673 - DNA, 22 bp, Homo sapiens
tacacagtaaatggtaaataca

SEQ ID NO: 7505674 - DNA, 22 bp, Homo sapiens
tacacagtagagtataatgcgt

SEQ ID NO: 7505675 - DNA, 22 bp, Homo sapiens
tacacagtagagtataatgcgt

SEQ ID NO: 7505676 - DNA, 22 bp, Homo sapiens
tacacagtagagtataatgcgt

SEQ ID NO: 7505677 - DNA, 22 bp, Homo sapiens
tacacagtagagtataatgcgt

SEQ ID NO: 7505678 - DNA, 22 bp, Homo sapiens
tacacagtatatgggatcacag

SEQ ID NO: 7505679 - DNA, 22 bp, Homo sapiens
tacacagtatatgggatcacag

SEQ ID NO: 7505680 - DNA, 22 bp, Homo sapiens
tacacagaacctggtgtacagt

SEQ ID NO: 7505681 - DNA, 22 bp, Homo sapiens
tacacagaacctggtgtacagt

SEQ ID NO: 7505682 - DNA, 22 bp, Homo sapiens
tacacagaacctggtgtacagt

SEQ ID NO: 7505683 - DNA, 22 bp, Homo sapiens
tacacagaacctggtgtacagt

SEQ ID NO: 7505684 - DNA, 22 bp, Homo sapiens
tacacacttactggagatgaag

SEQ ID NO: 7505685 - DNA, 22 bp, Homo sapiens
tacacagaaattgtgtagggat

SEQ ID NO: 7505686 - DNA, 22 bp, Homo sapiens
tacacagaaattgtgtagggat

SEQ ID NO: 7505687 - DNA, 22 bp, Homo sapiens
tacacacttactggagatgaag

SEQ ID NO: 7505688 - DNA, 22 bp, Homo sapiens
tacacagaaattgtgtagggat

SEQ ID NO: 7505689 - DNA, 22 bp, Homo sapiens
tacacacagaggccatgggatt

SEQ ID NO: 7505690 - DNA, 22 bp, Homo sapiens
tacacacagaggccatgggatt

SEQ ID NO: 7505691 - DNA, 22 bp, Homo sapiens
tacacacagaggccatgggatt

SEQ ID NO: 7505692 - DNA, 22 bp, Homo sapiens
tacacacagaggccatgggatt

SEQ ID NO: 7505693 - DNA, 22 bp, Homo sapiens
tacacacagaggccatgggatt

SEQ ID NO: 7505694 - DNA, 22 bp, Homo sapiens
tacacacagaggccatgggatt

SEQ ID NO: 7505695 - DNA, 22 bp, Homo sapiens
tacacacagaggccatgggatt

SEQ ID NO: 7505696 - DNA, 22 bp, Homo sapiens
tacacacagaggccatgggatt

SEQ ID NO: 7505697 - DNA, 22 bp, Homo sapiens
tacacacagaggccatgggatt

SEQ ID NO: 7505698 - DNA, 22 bp, Homo sapiens
tacacacagaggccatgggatt

SEQ ID NO: 7505699 - DNA, 22 bp, Homo sapiens
tacacaattagttgcaaagtga

SEQ ID NO: 7505700 - DNA, 22 bp, Homo sapiens
tacacaattctggatgcatgtc

SEQ ID NO: 7505701 - DNA, 22 bp, Homo sapiens
tacacaatgacttaagatgtca

SEQ ID NO: 7505702 - DNA, 22 bp, Homo sapiens
tacacaattagttgcaaagtga

SEQ ID NO: 7505703 - DNA, 22 bp, Homo sapiens
tacacaattagttgcaaagtga

SEQ ID NO: 7505704 - DNA, 22 bp, Homo sapiens
tacacaattagttgcaaagtga

SEQ ID NO: 7505705 - DNA, 22 bp, Homo sapiens
tacacacatgcatttgccttat

SEQ ID NO: 7505706 - DNA, 22 bp, Homo sapiens
tacacacatgcatttgccttat

SEQ ID NO: 7505707 - DNA, 22 bp, Homo sapiens
tacacacatgcatttgccttat

SEQ ID NO: 7505708 - DNA, 22 bp, Homo sapiens
tacacactgtgataatgaagca

SEQ ID NO: 7505709 - DNA, 22 bp, Homo sapiens
tacacacttactggagatgaag

SEQ ID NO: 7505710 - DNA, 22 bp, Homo sapiens
tacacacctgcctgcagactct

SEQ ID NO: 7505711 - DNA, 22 bp, Homo sapiens
tacacactgtgataatgaagca

SEQ ID NO: 7505712 - DNA, 22 bp, Homo sapiens
tacacactgtgataatgaagca

SEQ ID NO: 7505713 - DNA, 22 bp, Homo sapiens
tacacactgtgataatgaagca

SEQ ID NO: 7505714 - DNA, 22 bp, Homo sapiens
tacacacctgcctgcagactct

SEQ ID NO: 7505715 - DNA, 22 bp, Homo sapiens
tacacacatgcatttgccttat

SEQ ID NO: 7505716 - DNA, 22 bp, Homo sapiens
tacacacatgcatttgccttat

SEQ ID NO: 7505717 - DNA, 22 bp, Homo sapiens
tacacacatgcatttgccttat

SEQ ID NO: 7505718 - DNA, 22 bp, Homo sapiens
tacacacagaggccatgggatt

SEQ ID NO: 7505719 - DNA, 22 bp, Homo sapiens
tacacacatgcatttgccttat

SEQ ID NO: 7505720 - DNA, 22 bp, Homo sapiens
tacacacatgcatttgccttat

SEQ ID NO: 7505721 - DNA, 22 bp, Homo sapiens
taaagcaaaaatgaactgccat

SEQ ID NO: 7505722 - DNA, 22 bp, Homo sapiens
taaagcaaaaatgaactgccat

SEQ ID NO: 7505723 - DNA, 23 bp, Homo sapiens
taaagcaaagtcaagtgcactcc

SEQ ID NO: 7505724 - DNA, 22 bp, Homo sapiens
taaagcaaaaatgaactgccat

SEQ ID NO: 7505725 - DNA, 23 bp, Homo sapiens
taaagcaaagtcaagtgcactcc

SEQ ID NO: 7505726 - DNA, 23 bp, Homo sapiens
taaagcaaagtcaagtgcactcc

SEQ ID NO: 7505727 - DNA, 23 bp, Homo sapiens
taaagcaaagtcaagtgcactcc

SEQ ID NO: 7505728 - DNA, 23 bp, Homo sapiens
taaagcaaagtcaagtgcactcc

SEQ ID NO: 7505729 - DNA, 22 bp, Homo sapiens
taaagatgttctcatttcatag

SEQ ID NO: 7505730 - DNA, 22 bp, Homo sapiens
taaagatggagatgacctagga

SEQ ID NO: 7505731 - DNA, 22 bp, Homo sapiens
taaagatgctatagtgaaggag

SEQ ID NO: 7505732 - DNA, 22 bp, Homo sapiens
taaagatgcccacattgcaggt

SEQ ID NO: 7505733 - DNA, 22 bp, Homo sapiens
taaagattgctcaaaactgtga

SEQ ID NO: 7505734 - DNA, 22 bp, Homo sapiens
taaagatgttctcatttcatag

SEQ ID NO: 7505735 - DNA, 22 bp, Homo sapiens
taaagatgttctcatttcatag

SEQ ID NO: 7505736 - DNA, 22 bp, Homo sapiens
taaagacatggtgtaggtgaac

SEQ ID NO: 7505737 - DNA, 22 bp, Homo sapiens
taaagacatggtgtaggtgaac

SEQ ID NO: 7505738 - DNA, 22 bp, Homo sapiens
taaagagcacgcttttctctct

SEQ ID NO: 7505739 - DNA, 22 bp, Homo sapiens
taaagagcacgcttttctctct

SEQ ID NO: 7505740 - DNA, 22 bp, Homo sapiens
taaagaccaaacacagtgcaga

SEQ ID NO: 7505741 - DNA, 22 bp, Homo sapiens
taaagacatggtgtaggtgaac

SEQ ID NO: 7505742 - DNA, 22 bp, Homo sapiens
taaagatgcccacattgcaggt

SEQ ID NO: 7505743 - DNA, 22 bp, Homo sapiens
taaagatcttaggaagattttc

SEQ ID NO: 7505744 - DNA, 22 bp, Homo sapiens
taaagataagacatcaactgag

SEQ ID NO: 7505745 - DNA, 17 bp, Homo sapiens
taaagatcagccatgta

SEQ ID NO: 7505746 - DNA, 22 bp, Homo sapiens
taaagataagacatcaactgag

SEQ ID NO: 7505747 - DNA, 22 bp, Homo sapiens
taaagataagacatcaactgag

SEQ ID NO: 7505748 - DNA, 22 bp, Homo sapiens
taaagataagacatcaactgag

SEQ ID NO: 7505749 - DNA, 22 bp, Homo sapiens
taaagagcgatatgctttaaag

SEQ ID NO: 7505750 - DNA, 22 bp, Homo sapiens
taaagagccattgtatggtttt

SEQ ID NO: 7505751 - DNA, 22 bp, Homo sapiens
taaagagccattgtatggtttt

SEQ ID NO: 7505752 - DNA, 22 bp, Homo sapiens
taaagcaaggaatagagtagtc

SEQ ID NO: 7505753 - DNA, 22 bp, Homo sapiens
taaagcaagacacacccatagc

SEQ ID NO: 7505754 - DNA, 22 bp, Homo sapiens
taaagcaaggaatagagtagtc

SEQ ID NO: 7505755 - DNA, 22 bp, Homo sapiens
taaagcaaggaatagagtagtc

SEQ ID NO: 7505756 - DNA, 22 bp, Homo sapiens
taaagcaagacacacccatagc

SEQ ID NO: 7505757 - DNA, 23 bp, Homo sapiens
taaagcaaagtcaagtgcactcc

SEQ ID NO: 7505758 - DNA, 23 bp, Homo sapiens
taaagcaaagtcaagtgcactcc

SEQ ID NO: 7505759 - DNA, 22 bp, Homo sapiens
taaagcaagacacacccatagc

SEQ ID NO: 7505760 - DNA, 22 bp, Homo sapiens
taaagcaagacacacccatagc

SEQ ID NO: 7505761 - DNA, 22 bp, Homo sapiens
taaagcaagacacacccatagc

SEQ ID NO: 7505762 - DNA, 22 bp, Homo sapiens
taaagcaaggcaaattgttggt

SEQ ID NO: 7505763 - DNA, 22 bp, Homo sapiens
taaagcaaggcaaattgttggt

SEQ ID NO: 7505764 - DNA, 22 bp, Homo sapiens
taaagcaaggcaaattgttggt

SEQ ID NO: 7505765 - DNA, 22 bp, Homo sapiens
taaagcaaggaatagagtagtc

SEQ ID NO: 7505766 - DNA, 22 bp, Homo sapiens
taaagcaaggaatagagtagtc

SEQ ID NO: 7505767 - DNA, 22 bp, Homo sapiens
taaagcaaggaatagagtagtc

SEQ ID NO: 7505768 - DNA, 22 bp, Homo sapiens
taaagcaaggaatagagtagtc

SEQ ID NO: 7505769 - DNA, 22 bp, Homo sapiens
taaagcaaggaatagagtagtc

SEQ ID NO: 7505770 - DNA, 22 bp, Homo sapiens
taaagcaatgaaagttttgcag

SEQ ID NO: 7505771 - DNA, 22 bp, Homo sapiens
taaagcaatgaaagttttgcag

SEQ ID NO: 7505772 - DNA, 22 bp, Homo sapiens
taaagcaatgaaagttttgcag

SEQ ID NO: 7505773 - DNA, 22 bp, Homo sapiens
taaagcaaggcaaattgttggt

SEQ ID NO: 7505774 - DNA, 22 bp, Homo sapiens
taaagcaattactcagtggctt

SEQ ID NO: 7505775 - DNA, 22 bp, Homo sapiens
taaagcaatgaaagttttgcag

SEQ ID NO: 7505776 - DNA, 22 bp, Homo sapiens
taaagcaattactcagtggctt

SEQ ID NO: 7505777 - DNA, 22 bp, Homo sapiens
taaagcaatgaaagttttgcag

SEQ ID NO: 7505778 - DNA, 22 bp, Homo sapiens
taaagcaatgaaagttttgcag

SEQ ID NO: 7505779 - DNA, 22 bp, Homo sapiens
taaagcaatgaaagttttgcag

SEQ ID NO: 7505780 - DNA, 22 bp, Homo sapiens
taaagcaatttgagcaagttct

SEQ ID NO: 7505781 - DNA, 22 bp, Homo sapiens
taaagcaatttgagcaagttct

SEQ ID NO: 7505782 - DNA, 22 bp, Homo sapiens
taaagcaatttgagcaagttct

SEQ ID NO: 7505783 - DNA, 22 bp, Homo sapiens
taaagcaattactcagtggctt

SEQ ID NO: 7505784 - DNA, 19 bp, Homo sapiens
taaagcacatagcaaaagt

SEQ ID NO: 7505785 - DNA, 19 bp, Homo sapiens
taaagcacatagcaaaagt

SEQ ID NO: 7505786 - DNA, 22 bp, Homo sapiens
taaagcacagtatgagcattgg

SEQ ID NO: 7505787 - DNA, 22 bp, Homo sapiens
taaagcaatttgagcaagttct

SEQ ID NO: 7505788 - DNA, 22 bp, Homo sapiens
taaagcaatttgagcaagttct

SEQ ID NO: 7505789 - DNA, 22 bp, Homo sapiens
taaagcaatttgagcaagttct

SEQ ID NO: 7505790 - DNA, 22 bp, Homo sapiens
taaatgatttatgtatgtgaaa

SEQ ID NO: 7505791 - DNA, 22 bp, Homo sapiens
taaatgatttatgtatgtgaaa

SEQ ID NO: 7505792 - DNA, 22 bp, Homo sapiens
taaatgatttatgtatgtgaaa

SEQ ID NO: 7505793 - DNA, 22 bp, Homo sapiens
taaatgatttatgtatgtgaaa

SEQ ID NO: 7505794 - DNA, 22 bp, Homo sapiens
taaatgatttatgtatgtgaaa

SEQ ID NO: 7505795 - DNA, 20 bp, Homo sapiens
taaagcagccgtggagggta

SEQ ID NO: 7505796 - DNA, 20 bp, Homo sapiens
taaagcagccgtggagggta

SEQ ID NO: 7505797 - DNA, 22 bp, Homo sapiens
taaatgataataatgctagtgt

SEQ ID NO: 7505798 - DNA, 22 bp, Homo sapiens
taaatgataataatgctagtgt

SEQ ID NO: 7505799 - DNA, 22 bp, Homo sapiens
taaagcagccagggtctaagcc

SEQ ID NO: 7505800 - DNA, 22 bp, Homo sapiens
taaagcagccagggtctaagcc

SEQ ID NO: 7505801 - DNA, 22 bp, Homo sapiens
taaagcaccatttgtttatcca

SEQ ID NO: 7505802 - DNA, 19 bp, Homo sapiens
taaagcacatagcaaaagt

SEQ ID NO: 7505803 - DNA, 19 bp, Homo sapiens
taaagcacatagcaaaagt

SEQ ID NO: 7505804 - DNA, 22 bp, Homo sapiens
taaagcacatatcttacaataa

SEQ ID NO: 7505805 - DNA, 22 bp, Homo sapiens
taaatgcaagtgctcctgggag

SEQ ID NO: 7505806 - DNA, 22 bp, Homo sapiens
taaatgcaatgtgctttaccag

SEQ ID NO: 7505807 - DNA, 22 bp, Homo sapiens
taaatgcaatgtgctttaccag

SEQ ID NO: 7505808 - DNA, 22 bp, Homo sapiens
taaatgcaatgtgctttaccag

SEQ ID NO: 7505809 - DNA, 22 bp, Homo sapiens
taaatgcaagtgctcctgggag

SEQ ID NO: 7505810 - DNA, 22 bp, Homo sapiens
taaatgcaagtgctcctgggag

SEQ ID NO: 7505811 - DNA, 22 bp, Homo sapiens
taaatgcaagtgctcctgggag

SEQ ID NO: 7505812 - DNA, 22 bp, Homo sapiens
taaatgcaagtgctcctgggag

SEQ ID NO: 7505813 - DNA, 22 bp, Homo sapiens
taaatgcaagggaaaggcaaga

SEQ ID NO: 7505814 - DNA, 22 bp, Homo sapiens
taaatgcaagggaaaggcaaga

SEQ ID NO: 7505815 - DNA, 22 bp, Homo sapiens
taaatgcaagggaaaggcaaga

SEQ ID NO: 7505816 - DNA, 22 bp, Homo sapiens
taaatgcaagggaaaggcaaga

SEQ ID NO: 7505817 - DNA, 22 bp, Homo sapiens
taaatgcaagggaaaggcaaga

SEQ ID NO: 7505818 - DNA, 22 bp, Homo sapiens
taaatgcaaagcttggcgctta

SEQ ID NO: 7505819 - DNA, 22 bp, Homo sapiens
taaatgatttatgtatgtgaaa

SEQ ID NO: 7505820 - DNA, 22 bp, Homo sapiens
taaatgcaaagcttggcgctta

SEQ ID NO: 7505821 - DNA, 22 bp, Homo sapiens
taaatgcaaagcttggcgctta

SEQ ID NO: 7505822 - DNA, 22 bp, Homo sapiens
taaatgcaaagcttggcgctta

SEQ ID NO: 7505823 - DNA, 22 bp, Homo sapiens
taaatgcaaagcttggcgctta

SEQ ID NO: 7505824 - DNA, 22 bp, Homo sapiens
taaatgatttatgtatgtgaaa

SEQ ID NO: 7505825 - DNA, 22 bp, Homo sapiens
taaatgatttatgtatgtgaaa

SEQ ID NO: 7505826 - DNA, 22 bp, Homo sapiens
taaatgatttatgtatgtgaaa

SEQ ID NO: 7505827 - DNA, 22 bp, Homo sapiens
taaatgatttatgtatgtgaaa

SEQ ID NO: 7505828 - DNA, 22 bp, Homo sapiens
taaatgcaatgtgctttaccag

SEQ ID NO: 7505829 - DNA, 22 bp, Homo sapiens
taaatgcaatgtgctttaccag

SEQ ID NO: 7505830 - DNA, 22 bp, Homo sapiens
taaatgcaatgtgctttaccag

SEQ ID NO: 7505831 - DNA, 22 bp, Homo sapiens
taaatgcaatgtgctttaccag

SEQ ID NO: 7505832 - DNA, 22 bp, Homo sapiens
taaatgcagattcctgagccta

SEQ ID NO: 7505833 - DNA, 22 bp, Homo sapiens
taaatgcaatgtgctttaccag

SEQ ID NO: 7505834 - DNA, 22 bp, Homo sapiens
taaatgcagattcctgagccta

SEQ ID NO: 7505835 - DNA, 22 bp, Homo sapiens
taaatgcagattcctgagccta

SEQ ID NO: 7505836 - DNA, 22 bp, Homo sapiens
taaatgcagcagtttctgttct

SEQ ID NO: 7505837 - DNA, 22 bp, Homo sapiens
taaatgcagcagtttctgttct

SEQ ID NO: 7505838 - DNA, 22 bp, Homo sapiens
taaatgcagattcctgagccta

SEQ ID NO: 7505839 - DNA, 22 bp, Homo sapiens
taaatgcagcagtttctgttct

SEQ ID NO: 7505840 - DNA, 22 bp, Homo sapiens
taaatgcagcagtttctgttct

SEQ ID NO: 7505841 - DNA, 22 bp, Homo sapiens
taaatgcagttagtacttgcca

SEQ ID NO: 7505842 - DNA, 22 bp, Homo sapiens
taaatgcagttagtacttgcca

SEQ ID NO: 7505843 - DNA, 22 bp, Homo sapiens
taaatgcagtacaaattgttct

SEQ ID NO: 7505844 - DNA, 22 bp, Homo sapiens
taaatgcagtacaaattgttct

SEQ ID NO: 7505845 - DNA, 22 bp, Homo sapiens
taaatgcagtacaaattgttct

SEQ ID NO: 7505846 - DNA, 22 bp, Homo sapiens
taaatgcagtacaaattgttct

SEQ ID NO: 7505847 - DNA, 22 bp, Homo sapiens
taaatgcagtacaaattgttct

SEQ ID NO: 7505848 - DNA, 22 bp, Homo sapiens
taaatgcagtacaaattgttct

SEQ ID NO: 7505849 - DNA, 22 bp, Homo sapiens
taaatgcagcagtttctgttct

SEQ ID NO: 7505850 - DNA, 22 bp, Homo sapiens
taaatgcagcagtttctgttct

SEQ ID NO: 7505851 - DNA, 22 bp, Homo sapiens
taaatgcagcagtttctgttct

SEQ ID NO: 7505852 - DNA, 22 bp, Homo sapiens
taaatgcagcagtttctgttct

SEQ ID NO: 7505853 - DNA, 22 bp, Homo sapiens
taaatgcagttagtacttgcca

SEQ ID NO: 7505854 - DNA, 20 bp, Homo sapiens
taaatgcatctgttcaactg

SEQ ID NO: 7505855 - DNA, 20 bp, Homo sapiens
taaatgcatctgttcaactg

SEQ ID NO: 7505856 - DNA, 20 bp, Homo sapiens
taaatgcatgaatgtaaggc

SEQ ID NO: 7505857 - DNA, 20 bp, Homo sapiens
taaatgcatgaatgtaaggc

SEQ ID NO: 7505858 - DNA, 20 bp, Homo sapiens
taaatgcatgaatgtaaggc

SEQ ID NO: 7505859 - DNA, 20 bp, Homo sapiens
taaatgcatctgttcaactg

SEQ ID NO: 7505860 - DNA, 20 bp, Homo sapiens
taaatgcatctgttcaactg

SEQ ID NO: 7505861 - DNA, 22 bp, Homo sapiens
taaatgcagttagtacttgcca

SEQ ID NO: 7505862 - DNA, 22 bp, Homo sapiens
taaatgcagttagtacttgcca

SEQ ID NO: 7505863 - DNA, 22 bp, Homo sapiens
taaatgcagttagtacttgcca

SEQ ID NO: 7505864 - DNA, 22 bp, Homo sapiens
taaatgcagttagtacttgcca

SEQ ID NO: 7505865 - DNA, 22 bp, Homo sapiens
taaatgcagttagtacttgcca

SEQ ID NO: 7505866 - DNA, 18 bp, Homo sapiens
taaatgcatgttaataac

SEQ ID NO: 7505867 - DNA, 18 bp, Homo sapiens
taaatgcatgttaataac

SEQ ID NO: 7505868 - DNA, 18 bp, Homo sapiens
taaatgcatgttaataac

SEQ ID NO: 7505869 - DNA, 18 bp, Homo sapiens
taaatgcatgttaataac

SEQ ID NO: 7505870 - DNA, 20 bp, Homo sapiens
taaatgcatgaatgtaaggc

SEQ ID NO: 7505871 - DNA, 20 bp, Homo sapiens
taaatgcatgaatgtaaggc

SEQ ID NO: 7505872 - DNA, 18 bp, Homo sapiens
taaatgcatgttaataac

SEQ ID NO: 7505873 - DNA, 20 bp, Homo sapiens
taaatgcatgaatgtaaggc

SEQ ID NO: 7505874 - DNA, 20 bp, Homo sapiens
taaatgcatgaatgtaaggc

SEQ ID NO: 7505875 - DNA, 20 bp, Homo sapiens
taaatgcatgaatgtaaggc

SEQ ID NO: 7505876 - DNA, 20 bp, Homo sapiens
taaatgcatgaatgtaaggc

SEQ ID NO: 7505877 - DNA, 21 bp, Homo sapiens
gttttaagggagaaaacctag

SEQ ID NO: 7505878 - DNA, 22 bp, Homo sapiens
gttttacaaatgacggcattca

SEQ ID NO: 7505879 - DNA, 21 bp, Homo sapiens
gttttaagggagaaaacctag

SEQ ID NO: 7505880 - DNA, 21 bp, Homo sapiens
gttttaagggagaaaacctag

SEQ ID NO: 7505881 - DNA, 22 bp, Homo sapiens
gttttacaaatgacggcattca

SEQ ID NO: 7505882 - DNA, 22 bp, Homo sapiens
taaaactgaatacatactgagg

SEQ ID NO: 7505883 - DNA, 22 bp, Homo sapiens
taaaactgaatacatactgagg

SEQ ID NO: 7505884 - DNA, 22 bp, Homo sapiens
taaaactgaatacatactgagg

SEQ ID NO: 7505885 - DNA, 22 bp, Homo sapiens
taaaactgaatacatactgagg

SEQ ID NO: 7505886 - DNA, 22 bp, Homo sapiens
taaaactgcttggtatggtcta

SEQ ID NO: 7505887 - DNA, 22 bp, Homo sapiens
taaaactgcttggtatggtcta

SEQ ID NO: 7505888 - DNA, 22 bp, Homo sapiens
taaaactgcttggtatggtcta

SEQ ID NO: 7505889 - DNA, 22 bp, Homo sapiens
taaaactgcttggtatggtcta

SEQ ID NO: 7505890 - DNA, 22 bp, Homo sapiens
taaaactgaatacatactgagg

SEQ ID NO: 7505891 - DNA, 22 bp, Homo sapiens
taaaactgcttggtatggtcta

SEQ ID NO: 7505892 - DNA, 21 bp, Homo sapiens
taaaactgtaactttgtcctg

SEQ ID NO: 7505893 - DNA, 22 bp, Homo sapiens
taaaacttaactatccagatta

SEQ ID NO: 7505894 - DNA, 21 bp, Homo sapiens
taaaactgtaactttgtcctg

SEQ ID NO: 7505895 - DNA, 21 bp, Homo sapiens
taaaactgtaactttgtcctg

SEQ ID NO: 7505896 - DNA, 22 bp, Homo sapiens
taaaacttctcatttttatggt

SEQ ID NO: 7505897 - DNA, 22 bp, Homo sapiens
taaaacttctcatttttatggt

SEQ ID NO: 7505898 - DNA, 22 bp, Homo sapiens
taaaacttctcatttttatggt

SEQ ID NO: 7505899 - DNA, 22 bp, Homo sapiens
taaaacttaactatccagatta

SEQ ID NO: 7505900 - DNA, 22 bp, Homo sapiens
taaaacttctcatttttatggt

SEQ ID NO: 7505901 - DNA, 22 bp, Homo sapiens
taaaacttctcatttttatggt

SEQ ID NO: 7505902 - DNA, 22 bp, Homo sapiens
taaaacttctcatttttatggt

SEQ ID NO: 7505903 - DNA, 22 bp, Homo sapiens
taaaactttgaaggtgctcagt

SEQ ID NO: 7505904 - DNA, 22 bp, Homo sapiens
taaaactttgaaggtgctcagt

SEQ ID NO: 7505905 - DNA, 22 bp, Homo sapiens
taaaagagaatggataacagag

SEQ ID NO: 7505906 - DNA, 22 bp, Homo sapiens
taaaagagaatggataacagag

SEQ ID NO: 7505907 - DNA, 22 bp, Homo sapiens
taaaagagaatggataacagag

SEQ ID NO: 7505908 - DNA, 22 bp, Homo sapiens
taaaagagaatggataacagag

SEQ ID NO: 7505909 - DNA, 22 bp, Homo sapiens
taaaagaccctctagagtccca

SEQ ID NO: 7505910 - DNA, 22 bp, Homo sapiens
taaaagaccacaaggtggtaat

SEQ ID NO: 7505911 - DNA, 22 bp, Homo sapiens
taaaagacatataactgtagga

SEQ ID NO: 7505912 - DNA, 22 bp, Homo sapiens
taaaagaccacaaggtggtaat

SEQ ID NO: 7505913 - DNA, 22 bp, Homo sapiens
taaaagaccctctagagtccca

SEQ ID NO: 7505914 - DNA, 22 bp, Homo sapiens
taaaagaccctctagagtccca

SEQ ID NO: 7505915 - DNA, 22 bp, Homo sapiens
taaaagaccctctagagtccca

SEQ ID NO: 7505916 - DNA, 22 bp, Homo sapiens
taaaagaagcttcaaggccggc

SEQ ID NO: 7505917 - DNA, 22 bp, Homo sapiens
taaaagaagcttcaaggccggc

SEQ ID NO: 7505918 - DNA, 22 bp, Homo sapiens
taaaagaagcttcaaggccggc

SEQ ID NO: 7505919 - DNA, 22 bp, Homo sapiens
taaaagaagcttcaaggccggc

SEQ ID NO: 7505920 - DNA, 22 bp, Homo sapiens
taaaagaagcttcaaggccggc

SEQ ID NO: 7505921 - DNA, 22 bp, Homo sapiens
taaaagacatataactgtagga

SEQ ID NO: 7505922 - DNA, 22 bp, Homo sapiens
taaaagacatataactgtagga

SEQ ID NO: 7505923 - DNA, 22 bp, Homo sapiens
taaaagaagcttcaaggccggc

SEQ ID NO: 7505924 - DNA, 22 bp, Homo sapiens
taaaagacatataactgtagga

SEQ ID NO: 7505925 - DNA, 22 bp, Homo sapiens
taaaagacatataactgtagga

SEQ ID NO: 7505926 - DNA, 21 bp, Homo sapiens
taaaagatgacaagacagctc

SEQ ID NO: 7505927 - DNA, 21 bp, Homo sapiens
taaaagatgacaagacagctc

SEQ ID NO: 7505928 - DNA, 22 bp, Homo sapiens
taaaagattttataggaacaag

SEQ ID NO: 7505929 - DNA, 22 bp, Homo sapiens
taaaagattttataggaacaag

SEQ ID NO: 7505930 - DNA, 22 bp, Homo sapiens
taaaagattttataggaacaag

SEQ ID NO: 7505931 - DNA, 21 bp, Homo sapiens
taaaagatgacaagacagctc

SEQ ID NO: 7505932 - DNA, 21 bp, Homo sapiens
taaaagatgacaagacagctc

SEQ ID NO: 7505933 - DNA, 21 bp, Homo sapiens
taaaagatgacaagacagctc

SEQ ID NO: 7505934 - DNA, 21 bp, Homo sapiens
taaaagatgacaagacagctc

SEQ ID NO: 7505935 - DNA, 21 bp, Homo sapiens
taaaagatgacaagacagctc

SEQ ID NO: 7505936 - DNA, 22 bp, Homo sapiens
taaaagagaatggataacagag

SEQ ID NO: 7505937 - DNA, 22 bp, Homo sapiens
taaaagagaatggataacagag

SEQ ID NO: 7505938 - DNA, 22 bp, Homo sapiens
taaaagagaatggataacagag

SEQ ID NO: 7505939 - DNA, 22 bp, Homo sapiens
taaaagatatcttagggatttg

SEQ ID NO: 7505940 - DNA, 22 bp, Homo sapiens
taaaagatatcttagggatttg

SEQ ID NO: 7505941 - DNA, 22 bp, Homo sapiens
taaaagagaatggataacagag

SEQ ID NO: 7505942 - DNA, 22 bp, Homo sapiens
taaaagagaatggataacagag

SEQ ID NO: 7505943 - DNA, 22 bp, Homo sapiens
taaaagatcactggctgcttta

SEQ ID NO: 7505944 - DNA, 22 bp, Homo sapiens
taaaaggcaatactagatgagt

SEQ ID NO: 7505945 - DNA, 22 bp, Homo sapiens
taaaaggcaatactagatgagt

SEQ ID NO: 7505946 - DNA, 22 bp, Homo sapiens
taaaaggcaatactagatgagt

SEQ ID NO: 7505947 - DNA, 22 bp, Homo sapiens
taaaaggattagcaggatgggc

SEQ ID NO: 7505948 - DNA, 22 bp, Homo sapiens
taaaaggcacttggatgctgag

SEQ ID NO: 7505949 - DNA, 22 bp, Homo sapiens
taaaaggcacttggatgctgag

SEQ ID NO: 7505950 - DNA, 22 bp, Homo sapiens
taaaaggcacttggatgctgag

SEQ ID NO: 7505951 - DNA, 22 bp, Homo sapiens
taaaagtaggaatgaaacgcat

SEQ ID NO: 7505952 - DNA, 22 bp, Homo sapiens
taaaagtaggaatgaaacgcat

SEQ ID NO: 7505953 - DNA, 22 bp, Homo sapiens
taaaagtaggaatgaaacgcat

SEQ ID NO: 7505954 - DNA, 22 bp, Homo sapiens
taaaagtaggaatgaaacgcat

SEQ ID NO: 7505955 - DNA, 22 bp, Homo sapiens
taaaagtaggaatgaaacgcat

SEQ ID NO: 7505956 - DNA, 19 bp, Homo sapiens
taaaaggatgtggaaggat

SEQ ID NO: 7505957 - DNA, 22 bp, Homo sapiens
taaaagtatactttcaaaggag

SEQ ID NO: 7505958 - DNA, 22 bp, Homo sapiens
taaaagtatactttcaaaggag

SEQ ID NO: 7505959 - DNA, 22 bp, Homo sapiens
taaaagattttataggaacaag

SEQ ID NO: 7505960 - DNA, 22 bp, Homo sapiens
taaaagattttataggaacaag

SEQ ID NO: 7505961 - DNA, 22 bp, Homo sapiens
taaaagattttataggaacaag

SEQ ID NO: 7505962 - DNA, 22 bp, Homo sapiens
taaaaggaggttgaagctgtca

SEQ ID NO: 7505963 - DNA, 22 bp, Homo sapiens
taaaagctgagatatcctgtac

SEQ ID NO: 7505964 - DNA, 22 bp, Homo sapiens
taaaagctcttctgttgagtta

SEQ ID NO: 7505965 - DNA, 22 bp, Homo sapiens
taaaagctgagatatcctgtac

SEQ ID NO: 7505966 - DNA, 22 bp, Homo sapiens
taaaagctgagatatcctgtac

SEQ ID NO: 7505967 - DNA, 22 bp, Homo sapiens
taaaaggattagcaggatgggc

SEQ ID NO: 7505968 - DNA, 22 bp, Homo sapiens
taaaaggattagcaggatgggc

SEQ ID NO: 7505969 - DNA, 19 bp, Homo sapiens
taaaaggatgtggaaggat

SEQ ID NO: 7505970 - DNA, 19 bp, Homo sapiens
taaaaggatgtggaaggat

SEQ ID NO: 7505971 - DNA, 22 bp, Homo sapiens
taaaaggattagcaggatgggc

SEQ ID NO: 7505972 - DNA, 22 bp, Homo sapiens
taaaaggattagcaggatgggc

SEQ ID NO: 7505973 - DNA, 19 bp, Homo sapiens
taaaaggatgtggaaggat

SEQ ID NO: 7505974 - DNA, 22 bp, Homo sapiens
taaaaggaggttgaagctgtca

SEQ ID NO: 7505975 - DNA, 22 bp, Homo sapiens
taaaaggaggttgaagctgtca

SEQ ID NO: 7505976 - DNA, 22 bp, Homo sapiens
taaaaggaggttgaagctgtca

SEQ ID NO: 7505977 - DNA, 22 bp, Homo sapiens
taaaaggaggttgaagctgtca

SEQ ID NO: 7505978 - DNA, 22 bp, Homo sapiens
taaaagtggataagctgtagga

SEQ ID NO: 7505979 - DNA, 22 bp, Homo sapiens
taaaagtggataagctgtagga

SEQ ID NO: 7505980 - DNA, 22 bp, Homo sapiens
taaaagttagctaggacaaagt

SEQ ID NO: 7505981 - DNA, 22 bp, Homo sapiens
taaaagttagctaggacaaagt

SEQ ID NO: 7505982 - DNA, 22 bp, Homo sapiens
taaaagttagctaggacaaagt

SEQ ID NO: 7505983 - DNA, 22 bp, Homo sapiens
taaaagtggataagctgtagga

SEQ ID NO: 7505984 - DNA, 22 bp, Homo sapiens
taaaagttagctaggacaaagt

SEQ ID NO: 7505985 - DNA, 22 bp, Homo sapiens
taaaagttagctaggacaaagt

SEQ ID NO: 7505986 - DNA, 22 bp, Homo sapiens
taaagacactggttttaatcat

SEQ ID NO: 7505987 - DNA, 22 bp, Homo sapiens
taaagacactggttttaatcat

SEQ ID NO: 7505988 - DNA, 23 bp, Homo sapiens
taaagacagccttcaggattctg

SEQ ID NO: 7505989 - DNA, 20 bp, Homo sapiens
taaagacataagctactatc

SEQ ID NO: 7505990 - DNA, 20 bp, Homo sapiens
taaagacataagctactatc

SEQ ID NO: 7505991 - DNA, 23 bp, Homo sapiens
taaagacagccttcaggattctg

SEQ ID NO: 7505992 - DNA, 22 bp, Homo sapiens
taaagacactggttttaatcat

SEQ ID NO: 7505993 - DNA, 22 bp, Homo sapiens
taaagacagatggaccagccat

SEQ ID NO: 7505994 - DNA, 22 bp, Homo sapiens
taaagacagatggaccagccat

SEQ ID NO: 7505995 - DNA, 23 bp, Homo sapiens
taaagacagccttcaggattctg

SEQ ID NO: 7505996 - DNA, 23 bp, Homo sapiens
taaagacagccttcaggattctg

SEQ ID NO: 7505997 - DNA, 20 bp, Homo sapiens
taaagacataagctactatc

SEQ ID NO: 7505998 - DNA, 20 bp, Homo sapiens
taaagacataagctactatc

SEQ ID NO: 7505999 - DNA, 20 bp, Homo sapiens
taaagacataagctactatc

SEQ ID NO: 7506000 - DNA, 22 bp, Homo sapiens
taaagacataggatcagggaga

SEQ ID NO: 7506001 - DNA, 22 bp, Homo sapiens
taaagacataggatcagggaga

SEQ ID NO: 7506002 - DNA, 20 bp, Homo sapiens
taaagacataagctactatc

SEQ ID NO: 7506003 - DNA, 22 bp, Homo sapiens
taaagacataggatcagggaga

SEQ ID NO: 7506004 - DNA, 22 bp, Homo sapiens
taaagacataggatcagggaga

SEQ ID NO: 7506005 - DNA, 22 bp, Homo sapiens
taaagacatgcaaagtctaatt

SEQ ID NO: 7506006 - DNA, 22 bp, Homo sapiens
taaagacatgcaaagtctaatt

SEQ ID NO: 7506007 - DNA, 22 bp, Homo sapiens
taaagacatgcaaagtctaatt

SEQ ID NO: 7506008 - DNA, 22 bp, Homo sapiens
taaagacataggatcagggaga

SEQ ID NO: 7506009 - DNA, 22 bp, Homo sapiens
taaagacatgcaaagtctaatt

SEQ ID NO: 7506010 - DNA, 22 bp, Homo sapiens
taaagacatgcaaagtctaatt

SEQ ID NO: 7506011 - DNA, 22 bp, Homo sapiens
taaagacatggtgtaggtgaac

SEQ ID NO: 7506012 - DNA, 22 bp, Homo sapiens
taaagacatgcaaagtctaatt

SEQ ID NO: 7506013 - DNA, 22 bp, Homo sapiens
taaagacatggtgtaggtgaac

SEQ ID NO: 7506014 - DNA, 22 bp, Homo sapiens
taaagacatgcaaagtctaatt

SEQ ID NO: 7506015 - DNA, 22 bp, Homo sapiens
taacagtatagcctaacatttc

SEQ ID NO: 7506016 - DNA, 22 bp, Homo sapiens
taacagtatagcctaacatttc

SEQ ID NO: 7506017 - DNA, 22 bp, Homo sapiens
taacagtatagcctaacatttc

SEQ ID NO: 7506018 - DNA, 22 bp, Homo sapiens
taacagtatagcctaacatttc

SEQ ID NO: 7506019 - DNA, 22 bp, Homo sapiens
taacagtaccattaactttgat

SEQ ID NO: 7506020 - DNA, 22 bp, Homo sapiens
taacagtaccattaactttgat

SEQ ID NO: 7506021 - DNA, 22 bp, Homo sapiens
taacagtagccttatgtggtct

SEQ ID NO: 7506022 - DNA, 22 bp, Homo sapiens
taacaggtggtagtttgtgctc

SEQ ID NO: 7506023 - DNA, 22 bp, Homo sapiens
taacagtaaagtaagttagctt

SEQ ID NO: 7506024 - DNA, 22 bp, Homo sapiens
taacagtaaagtaagttagctt

SEQ ID NO: 7506025 - DNA, 20 bp, Homo sapiens
taacagtaagtgatgttaca

SEQ ID NO: 7506026 - DNA, 20 bp, Homo sapiens
taacagtaagtgatgttaca

SEQ ID NO: 7506027 - DNA, 20 bp, Homo sapiens
taacagtaagtgatgttaca

SEQ ID NO: 7506028 - DNA, 22 bp, Homo sapiens
taacagtgacctgaatgtcaat

SEQ ID NO: 7506029 - DNA, 22 bp, Homo sapiens
taacagtgtgtccagtcagttt

SEQ ID NO: 7506030 - DNA, 22 bp, Homo sapiens
taacagtgacctgaatgtcaat

SEQ ID NO: 7506031 - DNA, 22 bp, Homo sapiens
taacagtgacctgaatgtcaat

SEQ ID NO: 7506032 - DNA, 22 bp, Homo sapiens
taacagtattgaagataaacta

SEQ ID NO: 7506033 - DNA, 22 bp, Homo sapiens
taacagtatatttaccaaacct

SEQ ID NO: 7506034 - DNA, 22 bp, Homo sapiens
taacagtatagcctaacatttc

SEQ ID NO: 7506035 - DNA, 22 bp, Homo sapiens
taacagtattgaagataaacta

SEQ ID NO: 7506036 - DNA, 22 bp, Homo sapiens
taacagtattgaagataaacta

SEQ ID NO: 7506037 - DNA, 22 bp, Homo sapiens
taacatcaaacatgttttaaag

SEQ ID NO: 7506038 - DNA, 22 bp, Homo sapiens
taacatagtgctttatctggtg

SEQ ID NO: 7506039 - DNA, 22 bp, Homo sapiens
taacatattgtgtggcactagg

SEQ ID NO: 7506040 - DNA, 20 bp, Homo sapiens
taacatagtccagagaacga

SEQ ID NO: 7506041 - DNA, 22 bp, Homo sapiens
taacatcaaactgcattttcta

SEQ ID NO: 7506042 - DNA, 22 bp, Homo sapiens
taacatcaaactgcattttcta

SEQ ID NO: 7506043 - DNA, 22 bp, Homo sapiens
taacatccacattagatgattc

SEQ ID NO: 7506044 - DNA, 22 bp, Homo sapiens
taacatccacattagatgattc

SEQ ID NO: 7506045 - DNA, 22 bp, Homo sapiens
taacatcctacactgttgtctt

SEQ ID NO: 7506046 - DNA, 22 bp, Homo sapiens
taacatctaagggagagaaagt

SEQ ID NO: 7506047 - DNA, 20 bp, Homo sapiens
taacagttgtagagggtttt

SEQ ID NO: 7506048 - DNA, 22 bp, Homo sapiens
taacagttttgagttttgcttc

SEQ ID NO: 7506049 - DNA, 22 bp, Homo sapiens
taacagttggtgtaatttcttg

SEQ ID NO: 7506050 - DNA, 22 bp, Homo sapiens
taacagttggtgtaatttcttg

SEQ ID NO: 7506051 - DNA, 22 bp, Homo sapiens
taacagttggtgtaatttcttg

SEQ ID NO: 7506052 - DNA, 20 bp, Homo sapiens
taacagttgaagaacaagga

SEQ ID NO: 7506053 - DNA, 20 bp, Homo sapiens
taacagttgaagaacaagga

SEQ ID NO: 7506054 - DNA, 22 bp, Homo sapiens
taacatgagagctaagacatta

SEQ ID NO: 7506055 - DNA, 22 bp, Homo sapiens
taacatctttagcagctcgaac

SEQ ID NO: 7506056 - DNA, 22 bp, Homo sapiens
taacatgaaactccaaatggta

SEQ ID NO: 7506057 - DNA, 22 bp, Homo sapiens
taacatctttagcagctcgaac

SEQ ID NO: 7506058 - DNA, 22 bp, Homo sapiens
taacatgatttgctatttagat

SEQ ID NO: 7506059 - DNA, 22 bp, Homo sapiens
taacatgagagctaagacatta

SEQ ID NO: 7506060 - DNA, 22 bp, Homo sapiens
taacatgagagctaagacatta

SEQ ID NO: 7506061 - DNA, 22 bp, Homo sapiens
taacatctaagggagagaaagt

SEQ ID NO: 7506062 - DNA, 22 bp, Homo sapiens
taacatctaagggagagaaagt

SEQ ID NO: 7506063 - DNA, 22 bp, Homo sapiens
taacatctccctgacttttgct

SEQ ID NO: 7506064 - DNA, 22 bp, Homo sapiens
taacatcaaacatgttttaaag

SEQ ID NO: 7506065 - DNA, 22 bp, Homo sapiens
taacatctgggctgcgtcctga

SEQ ID NO: 7506066 - DNA, 22 bp, Homo sapiens
taacatctccctgacttttgct

SEQ ID NO: 7506067 - DNA, 22 bp, Homo sapiens
taacatcttaactggatacttc

SEQ ID NO: 7506068 - DNA, 22 bp, Homo sapiens
taacatcttaactggatacttc

SEQ ID NO: 7506069 - DNA, 22 bp, Homo sapiens
taacatcttattggcaaagata

SEQ ID NO: 7506070 - DNA, 22 bp, Homo sapiens
taacatcttattggcaaagata

SEQ ID NO: 7506071 - DNA, 22 bp, Homo sapiens
taacatcttgcagtagcagaac

SEQ ID NO: 7506072 - DNA, 22 bp, Homo sapiens
taacatcttgcagtagcagaac

SEQ ID NO: 7506073 - DNA, 22 bp, Homo sapiens
taacatcttgcagtagcagaac

SEQ ID NO: 7506074 - DNA, 22 bp, Homo sapiens
taacatctttagcagctcgaac

SEQ ID NO: 7506075 - DNA, 22 bp, Homo sapiens
taaatgtttagtcttatttggg

SEQ ID NO: 7506076 - DNA, 22 bp, Homo sapiens
taaatgtttagtcttatttggg

SEQ ID NO: 7506077 - DNA, 22 bp, Homo sapiens
taaatgtttagtcttatttggg

SEQ ID NO: 7506078 - DNA, 22 bp, Homo sapiens
taaatgtttagtcttatttggg

SEQ ID NO: 7506079 - DNA, 22 bp, Homo sapiens
taaatgtttagtcttatttggg

SEQ ID NO: 7506080 - DNA, 22 bp, Homo sapiens
taaatgtttagtcttatttggg

SEQ ID NO: 7506081 - DNA, 22 bp, Homo sapiens
taaatgttttgtgggttgagtt

SEQ ID NO: 7506082 - DNA, 22 bp, Homo sapiens
taaattaaagattggagaagga

SEQ ID NO: 7506083 - DNA, 22 bp, Homo sapiens
taaattaaagattggagaagga

SEQ ID NO: 7506084 - DNA, 22 bp, Homo sapiens
taaatgtttagtcttatttggg

SEQ ID NO: 7506085 - DNA, 22 bp, Homo sapiens
taaatgtttagtcttatttggg

SEQ ID NO: 7506086 - DNA, 22 bp, Homo sapiens
taaatgttgtaagtacatctaa

SEQ ID NO: 7506087 - DNA, 22 bp, Homo sapiens
taaatgttgtaagtacatctaa

SEQ ID NO: 7506088 - DNA, 22 bp, Homo sapiens
taaatgttgtaagtacatctaa

SEQ ID NO: 7506089 - DNA, 22 bp, Homo sapiens
taaatgttgtaagtacatctaa

SEQ ID NO: 7506090 - DNA, 22 bp, Homo sapiens
taaatgttgtaagtacatctaa

SEQ ID NO: 7506091 - DNA, 22 bp, Homo sapiens
taaatgttgtaagtacatctaa

SEQ ID NO: 7506092 - DNA, 22 bp, Homo sapiens
taacaggatgacagcagacatt

SEQ ID NO: 7506093 - DNA, 22 bp, Homo sapiens
taacagctctgtgtggctgtaa

SEQ ID NO: 7506094 - DNA, 22 bp, Homo sapiens
taacagctggcgttataggaat

SEQ ID NO: 7506095 - DNA, 22 bp, Homo sapiens
taacaggatgacagcagacatt

SEQ ID NO: 7506096 - DNA, 20 bp, Homo sapiens
taacagggccctagaaagag

SEQ ID NO: 7506097 - DNA, 19 bp, Homo sapiens
taacaggggaaaatgatca

SEQ ID NO: 7506098 - DNA, 22 bp, Homo sapiens
taacaggctgatcatatatcct

SEQ ID NO: 7506099 - DNA, 22 bp, Homo sapiens
taacaggcaaggtcacaccttg

SEQ ID NO: 7506100 - DNA, 20 bp, Homo sapiens
taacaggaagcattatttta

SEQ ID NO: 7506101 - DNA, 22 bp, Homo sapiens
taacagctggcgttataggaat

SEQ ID NO: 7506102 - DNA, 22 bp, Homo sapiens
taacagctggcgttataggaat

SEQ ID NO: 7506103 - DNA, 22 bp, Homo sapiens
taaatgtttagtcttatttggg

SEQ ID NO: 7506104 - DNA, 22 bp, Homo sapiens
taacagcatatgaaattactgg

SEQ ID NO: 7506105 - DNA, 22 bp, Homo sapiens
taacagcatatgaaattactgg

SEQ ID NO: 7506106 - DNA, 22 bp, Homo sapiens
taacagcagtcctcttctcatg

SEQ ID NO: 7506107 - DNA, 22 bp, Homo sapiens
taaattaaagattggagaagga

SEQ ID NO: 7506108 - DNA, 22 bp, Homo sapiens
taaattaaagattggagaagga

SEQ ID NO: 7506109 - DNA, 22 bp, Homo sapiens
taacagccctccctccatcctg

SEQ ID NO: 7506110 - DNA, 22 bp, Homo sapiens
taacagctctgtgtggctgtaa

SEQ ID NO: 7506111 - DNA, 22 bp, Homo sapiens
taacagctctgtgtggctgtaa

SEQ ID NO: 7506112 - DNA, 22 bp, Homo sapiens
taaatgtgtgtagccatctgtg

SEQ ID NO: 7506113 - DNA, 22 bp, Homo sapiens
taaatgtgtgtagccatctgtg

SEQ ID NO: 7506114 - DNA, 22 bp, Homo sapiens
taaatgtgttagtcatggtttt

SEQ ID NO: 7506115 - DNA, 22 bp, Homo sapiens
taaatgtgtgtagccatctgtg

SEQ ID NO: 7506116 - DNA, 22 bp, Homo sapiens
taaatgtgttagtcatggtttt

SEQ ID NO: 7506117 - DNA, 22 bp, Homo sapiens
taaatgtgttgtggatgaagtt

SEQ ID NO: 7506118 - DNA, 22 bp, Homo sapiens
taaatgtgggggccacgggctt

SEQ ID NO: 7506119 - DNA, 22 bp, Homo sapiens
taaatgtgggggccacgggctt

SEQ ID NO: 7506120 - DNA, 22 bp, Homo sapiens
taaatgtgtaaacctccattac

SEQ ID NO: 7506121 - DNA, 22 bp, Homo sapiens
taaatgtgtaaacctccattac

SEQ ID NO: 7506122 - DNA, 22 bp, Homo sapiens
taaatgtgtctatggacccgcc

SEQ ID NO: 7506123 - DNA, 22 bp, Homo sapiens
taaatgtgtctttttaaggcct

SEQ ID NO: 7506124 - DNA, 22 bp, Homo sapiens
taaatgtgttgtggatgaagtt

SEQ ID NO: 7506125 - DNA, 22 bp, Homo sapiens
taaatgttactttcctttcaca

SEQ ID NO: 7506126 - DNA, 22 bp, Homo sapiens
taaatgttactttcctttcaca

SEQ ID NO: 7506127 - DNA, 22 bp, Homo sapiens
taaatgttatgcccatcatcca

SEQ ID NO: 7506128 - DNA, 22 bp, Homo sapiens
taaatgttatgcccatcatcca

SEQ ID NO: 7506129 - DNA, 22 bp, Homo sapiens
taaatgtggagactcaggagtc

SEQ ID NO: 7506130 - DNA, 22 bp, Homo sapiens
taaatgtggagactcaggagtc

SEQ ID NO: 7506131 - DNA, 22 bp, Homo sapiens
taaatgtggagactcaggagtc

SEQ ID NO: 7506132 - DNA, 22 bp, Homo sapiens
taaatgtgcactttacttttca

SEQ ID NO: 7506133 - DNA, 22 bp, Homo sapiens
taaatgtgcactttacttttca

SEQ ID NO: 7506134 - DNA, 22 bp, Homo sapiens
taaatgctccatacatacacca

SEQ ID NO: 7506135 - DNA, 22 bp, Homo sapiens
taaatgtgcacaggttagaagg

SEQ ID NO: 7506136 - DNA, 22 bp, Homo sapiens
taaatgtgcactttacttttca

SEQ ID NO: 7506137 - DNA, 22 bp, Homo sapiens
taaatgctcaataaatgttgct

SEQ ID NO: 7506138 - DNA, 22 bp, Homo sapiens
taaatgctcagaccttattcca

SEQ ID NO: 7506139 - DNA, 18 bp, Homo sapiens
taaatgcatgttaataac

SEQ ID NO: 7506140 - DNA, 18 bp, Homo sapiens
taaatgcatgttaataac

SEQ ID NO: 7506141 - DNA, 22 bp, Homo sapiens
taaatgccattcgtttcataca

SEQ ID NO: 7506142 - DNA, 18 bp, Homo sapiens
taaatgcatgttaataac

SEQ ID NO: 7506143 - DNA, 22 bp, Homo sapiens
taaatgccattcgtttcataca

SEQ ID NO: 7506144 - DNA, 22 bp, Homo sapiens
taaatgccattcgtttcataca

SEQ ID NO: 7506145 - DNA, 22 bp, Homo sapiens
taaatgcctctgaatcttcata

SEQ ID NO: 7506146 - DNA, 22 bp, Homo sapiens
taaatgctcaataaatgttgct

SEQ ID NO: 7506147 - DNA, 22 bp, Homo sapiens
taaatgctatcgcataaaacct

SEQ ID NO: 7506148 - DNA, 22 bp, Homo sapiens
taaatgctatcgcataaaacct

SEQ ID NO: 7506149 - DNA, 22 bp, Homo sapiens
taaatgcctctgaatcttcata

SEQ ID NO: 7506150 - DNA, 22 bp, Homo sapiens
taaatgctatcgcataaaacct

SEQ ID NO: 7506151 - DNA, 22 bp, Homo sapiens
taagagatgcttttctaaataa

SEQ ID NO: 7506152 - DNA, 22 bp, Homo sapiens
taagagacttaagaataattga

SEQ ID NO: 7506153 - DNA, 22 bp, Homo sapiens
taagagaccgatattcttaagt

SEQ ID NO: 7506154 - DNA, 22 bp, Homo sapiens
taagagactattgagcatcttg

SEQ ID NO: 7506155 - DNA, 22 bp, Homo sapiens
taagagacttaagaataattga

SEQ ID NO: 7506156 - DNA, 22 bp, Homo sapiens
taagagatgcttttctaaataa

SEQ ID NO: 7506157 - DNA, 22 bp, Homo sapiens
taagagacttaagaataattga

SEQ ID NO: 7506158 - DNA, 22 bp, Homo sapiens
taagagatgcttttctaaataa

SEQ ID NO: 7506159 - DNA, 22 bp, Homo sapiens
taagagatggttatcaaaagca

SEQ ID NO: 7506160 - DNA, 22 bp, Homo sapiens
taagagatggttatcaaaagca

SEQ ID NO: 7506161 - DNA, 22 bp, Homo sapiens
taagagatggttatcaaaagca

SEQ ID NO: 7506162 - DNA, 22 bp, Homo sapiens
taagagattctaaagctactgg

SEQ ID NO: 7506163 - DNA, 22 bp, Homo sapiens
taagagattaaagatgtaattt

SEQ ID NO: 7506164 - DNA, 22 bp, Homo sapiens
taagagatgcttttctaaataa

SEQ ID NO: 7506165 - DNA, 22 bp, Homo sapiens
taagagattaaagatgtaattt

SEQ ID NO: 7506166 - DNA, 22 bp, Homo sapiens
taagagattctaaagctactgg

SEQ ID NO: 7506167 - DNA, 22 bp, Homo sapiens
taagagcactgaagtcttctta

SEQ ID NO: 7506168 - DNA, 22 bp, Homo sapiens
taagagcactgaagtcttctta

SEQ ID NO: 7506169 - DNA, 22 bp, Homo sapiens
taagagcagaacagcaacatat

SEQ ID NO: 7506170 - DNA, 22 bp, Homo sapiens
taagagatggttatcaaaagca

SEQ ID NO: 7506171 - DNA, 22 bp, Homo sapiens
taagagattctaaagctactgg

SEQ ID NO: 7506172 - DNA, 22 bp, Homo sapiens
taagagcactgaagtcttctta

SEQ ID NO: 7506173 - DNA, 22 bp, Homo sapiens
taagagaaggatctgttccagg

SEQ ID NO: 7506174 - DNA, 22 bp, Homo sapiens
taagagaaggatctgttccagg

SEQ ID NO: 7506175 - DNA, 22 bp, Homo sapiens
taagagaaggatctgttccagg

SEQ ID NO: 7506176 - DNA, 22 bp, Homo sapiens
taagagaaggatctgttccagg

SEQ ID NO: 7506177 - DNA, 22 bp, Homo sapiens
taagagaaggatctgttccagg

SEQ ID NO: 7506178 - DNA, 22 bp, Homo sapiens
taagagaatgtcaggagtggat

SEQ ID NO: 7506179 - DNA, 22 bp, Homo sapiens
taagagaatgtcaggagtggat

SEQ ID NO: 7506180 - DNA, 22 bp, Homo sapiens
taagagaaggatctgttccagg

SEQ ID NO: 7506181 - DNA, 22 bp, Homo sapiens
taagagaatgttgtggctaggt

SEQ ID NO: 7506182 - DNA, 22 bp, Homo sapiens
taagagaatgttgtggctaggt

SEQ ID NO: 7506183 - DNA, 22 bp, Homo sapiens
taagagaatgtcaggagtggat

SEQ ID NO: 7506184 - DNA, 22 bp, Homo sapiens
taagacttcattagtaatatgg

SEQ ID NO: 7506185 - DNA, 22 bp, Homo sapiens
taagacttccaggaaaaggtgg

SEQ ID NO: 7506186 - DNA, 22 bp, Homo sapiens
taagagaactggatagatagga

SEQ ID NO: 7506187 - DNA, 22 bp, Homo sapiens
taagagaactggatagatagga

SEQ ID NO: 7506188 - DNA, 22 bp, Homo sapiens
taagagaactggatagatagga

SEQ ID NO: 7506189 - DNA, 22 bp, Homo sapiens
taagagcagaggttgaataaat

SEQ ID NO: 7506190 - DNA, 22 bp, Homo sapiens
taagagcagaggttgaataaat

SEQ ID NO: 7506191 - DNA, 22 bp, Homo sapiens
taagagcagaggttgaataaat

SEQ ID NO: 7506192 - DNA, 22 bp, Homo sapiens
taagagcagaggttgaataaat

SEQ ID NO: 7506193 - DNA, 22 bp, Homo sapiens
taagagcataggcttgaaaata

SEQ ID NO: 7506194 - DNA, 22 bp, Homo sapiens
taagagcataggcttgaaaata

SEQ ID NO: 7506195 - DNA, 18 bp, Homo sapiens
taagagcagactgtaggc

SEQ ID NO: 7506196 - DNA, 18 bp, Homo sapiens
taagagcagactgtaggc

SEQ ID NO: 7506197 - DNA, 18 bp, Homo sapiens
taagagcagactgtaggc

SEQ ID NO: 7506198 - DNA, 22 bp, Homo sapiens
taagagcagaggttgaataaat

SEQ ID NO: 7506199 - DNA, 22 bp, Homo sapiens
taagagcattgtaaaataatct

SEQ ID NO: 7506200 - DNA, 22 bp, Homo sapiens
taagagcattgtaaaataatct

SEQ ID NO: 7506201 - DNA, 22 bp, Homo sapiens
taagagcattgtaaaataatct

SEQ ID NO: 7506202 - DNA, 22 bp, Homo sapiens
taagagcctgtgctttgagttc

SEQ ID NO: 7506203 - DNA, 22 bp, Homo sapiens
taagagcattgtaaaataatct

SEQ ID NO: 7506204 - DNA, 22 bp, Homo sapiens
taagagcattgtaaaataatct

SEQ ID NO: 7506205 - DNA, 21 bp, Homo sapiens
taagagctattattgcaaacc

SEQ ID NO: 7506206 - DNA, 22 bp, Homo sapiens
taagagctacagcccagggttc

SEQ ID NO: 7506207 - DNA, 22 bp, Homo sapiens
taagagctaggattttaaatca

SEQ ID NO: 7506208 - DNA, 22 bp, Homo sapiens
taagaggatatttggccagaag

SEQ ID NO: 7506209 - DNA, 20 bp, Homo sapiens
taagcatagttgtcagggtc

SEQ ID NO: 7506210 - DNA, 20 bp, Homo sapiens
taagcatagttgtcagggtc

SEQ ID NO: 7506211 - DNA, 22 bp, Homo sapiens
taagaggcaaaagatactcaga

SEQ ID NO: 7506212 - DNA, 22 bp, Homo sapiens
taagaggatatttggccagaag

SEQ ID NO: 7506213 - DNA, 22 bp, Homo sapiens
taagcatggtggtaaaagaggt

SEQ ID NO: 7506214 - DNA, 22 bp, Homo sapiens
taagcatattccagtcatgtcc

SEQ ID NO: 7506215 - DNA, 21 bp, Homo sapiens
taagcatatcagatagactct

SEQ ID NO: 7506216 - DNA, 22 bp, Homo sapiens
taagcatattccagtcatgtcc

SEQ ID NO: 7506217 - DNA, 22 bp, Homo sapiens
taagaggatatttggccagaag

SEQ ID NO: 7506218 - DNA, 22 bp, Homo sapiens
taagagcttagctaaggatgtg

SEQ ID NO: 7506219 - DNA, 22 bp, Homo sapiens
taagagctcccttctccttgca

SEQ ID NO: 7506220 - DNA, 22 bp, Homo sapiens
taagacaagcctcgcatttgta

SEQ ID NO: 7506221 - DNA, 22 bp, Homo sapiens
taagacaagcctcgcatttgta

SEQ ID NO: 7506222 - DNA, 22 bp, Homo sapiens
taagacaattcttcagtcacaa

SEQ ID NO: 7506223 - DNA, 22 bp, Homo sapiens
taagacaaatactatttcaaga

SEQ ID NO: 7506224 - DNA, 22 bp, Homo sapiens
taagacaaatactatttcaaga

SEQ ID NO: 7506225 - DNA, 22 bp, Homo sapiens
taagacaaatactatttcaaga

SEQ ID NO: 7506226 - DNA, 22 bp, Homo sapiens
taagacaaatactatttcaaga

SEQ ID NO: 7506227 - DNA, 22 bp, Homo sapiens
taagacaaatactatttcaaga

SEQ ID NO: 7506228 - DNA, 22 bp, Homo sapiens
taagacaggtagtaagaacatt

SEQ ID NO: 7506229 - DNA, 22 bp, Homo sapiens
taagacaggtagtaagaacatt

SEQ ID NO: 7506230 - DNA, 22 bp, Homo sapiens
taagacagggtctattcttagt

SEQ ID NO: 7506231 - DNA, 22 bp, Homo sapiens
taagacagggagggctctcagc

SEQ ID NO: 7506232 - DNA, 22 bp, Homo sapiens
taagacagggagggctctcagc

SEQ ID NO: 7506233 - DNA, 22 bp, Homo sapiens
taagacagggagggctctcagc

SEQ ID NO: 7506234 - DNA, 22 bp, Homo sapiens
taagacagggagggctctcagc

SEQ ID NO: 7506235 - DNA, 22 bp, Homo sapiens
taagacaattcttcagtcacaa

SEQ ID NO: 7506236 - DNA, 22 bp, Homo sapiens
taagacaattcttcagtcacaa

SEQ ID NO: 7506237 - DNA, 22 bp, Homo sapiens
taagacaattcttcagtcacaa

SEQ ID NO: 7506238 - DNA, 22 bp, Homo sapiens
taagacaattcttcagtcacaa

SEQ ID NO: 7506239 - DNA, 22 bp, Homo sapiens
taacatgtggagagaatggtga

SEQ ID NO: 7506240 - DNA, 22 bp, Homo sapiens
taacatgttaagaaattagata

SEQ ID NO: 7506241 - DNA, 22 bp, Homo sapiens
taacatgttaagaaattagata

SEQ ID NO: 7506242 - DNA, 22 bp, Homo sapiens
taacatgttaagaaattagata

SEQ ID NO: 7506243 - DNA, 22 bp, Homo sapiens
taacatgttaagaaattagata

SEQ ID NO: 7506244 - DNA, 22 bp, Homo sapiens
taacatgttcagactacctgtg

SEQ ID NO: 7506245 - DNA, 22 bp, Homo sapiens
taacatgtttgtacactgaaac

SEQ ID NO: 7506246 - DNA, 18 bp, Homo sapiens
taacatgttttcattaag

SEQ ID NO: 7506247 - DNA, 18 bp, Homo sapiens
taacatgttttcattaag

SEQ ID NO: 7506248 - DNA, 18 bp, Homo sapiens
taacatgttttcattaag

SEQ ID NO: 7506249 - DNA, 22 bp, Homo sapiens
taacatgtccctgattctttgt

SEQ ID NO: 7506250 - DNA, 22 bp, Homo sapiens
taacatgtccctgattctttgt

SEQ ID NO: 7506251 - DNA, 22 bp, Homo sapiens
taacatgtccctgattctttgt

SEQ ID NO: 7506252 - DNA, 22 bp, Homo sapiens
taacatgcagagtttagctttt

SEQ ID NO: 7506253 - DNA, 22 bp, Homo sapiens
taacatgatttgctatttagat

SEQ ID NO: 7506254 - DNA, 22 bp, Homo sapiens
taagacatcctggatgttcaaa

SEQ ID NO: 7506255 - DNA, 22 bp, Homo sapiens
taagacatcctggatgttcaaa

SEQ ID NO: 7506256 - DNA, 22 bp, Homo sapiens
taagacatccgttgcttataat

SEQ ID NO: 7506257 - DNA, 22 bp, Homo sapiens
taagacatccgttgcttataat

SEQ ID NO: 7506258 - DNA, 22 bp, Homo sapiens
taagacatcattaaacagcaat

SEQ ID NO: 7506259 - DNA, 22 bp, Homo sapiens
taagacatcctggatgttcaaa

SEQ ID NO: 7506260 - DNA, 22 bp, Homo sapiens
taagacatgagactcagccagt

SEQ ID NO: 7506261 - DNA, 22 bp, Homo sapiens
taagacatcctggatgttcaaa

SEQ ID NO: 7506262 - DNA, 22 bp, Homo sapiens
taagacatagccaagagcatcc

SEQ ID NO: 7506263 - DNA, 22 bp, Homo sapiens
taagacatagccaagagcatcc

SEQ ID NO: 7506264 - DNA, 22 bp, Homo sapiens
taagacatagccaagagcatcc

SEQ ID NO: 7506265 - DNA, 22 bp, Homo sapiens
taagacatcattaaacagcaat

SEQ ID NO: 7506266 - DNA, 22 bp, Homo sapiens
taagacaggtagtaagaacatt

SEQ ID NO: 7506267 - DNA, 22 bp, Homo sapiens
taagacatggttgatctagtgt

SEQ ID NO: 7506268 - DNA, 22 bp, Homo sapiens
taagacatttgaaatgtgatcc

SEQ ID NO: 7506269 - DNA, 22 bp, Homo sapiens
taagacatttgaaatgtgatcc

SEQ ID NO: 7506270 - DNA, 22 bp, Homo sapiens
taagacatttgacaaaccattt

SEQ ID NO: 7506271 - DNA, 22 bp, Homo sapiens
taagacatttgacaaaccattt

SEQ ID NO: 7506272 - DNA, 22 bp, Homo sapiens
taagacatgtccaggctgtgag

SEQ ID NO: 7506273 - DNA, 22 bp, Homo sapiens
taagacatggttgatctagtgt

SEQ ID NO: 7506274 - DNA, 22 bp, Homo sapiens
taagactgtgagctcagagact

SEQ ID NO: 7506275 - DNA, 22 bp, Homo sapiens
taagactgtgagctcagagact

SEQ ID NO: 7506276 - DNA, 22 bp, Homo sapiens
taagactagttgaatggttttc

SEQ ID NO: 7506277 - DNA, 22 bp, Homo sapiens
taagacttaggtcgagtttggc

SEQ ID NO: 7506278 - DNA, 22 bp, Homo sapiens
taagaccaaagttctgtaggga

SEQ ID NO: 7506279 - DNA, 22 bp, Homo sapiens
taagacatttgacaaaccattt

SEQ ID NO: 7506280 - DNA, 22 bp, Homo sapiens
taagaccaatcctgtgtacctc

SEQ ID NO: 7506281 - DNA, 22 bp, Homo sapiens
gttctgcttccttgcttgcgca

SEQ ID NO: 7506282 - DNA, 22 bp, Homo sapiens
gttctggaaagcaagaaagagt

SEQ ID NO: 7506283 - DNA, 22 bp, Homo sapiens
gttctggaaagcaagaaagagt

SEQ ID NO: 7506284 - DNA, 22 bp, Homo sapiens
gttctgctgtgtctcagcaggt

SEQ ID NO: 7506285 - DNA, 22 bp, Homo sapiens
gttctgcttaaattattgatcc

SEQ ID NO: 7506286 - DNA, 22 bp, Homo sapiens
gttctgcttaaattattgatcc

SEQ ID NO: 7506287 - DNA, 22 bp, Homo sapiens
gttctgcttaaattattgatcc

SEQ ID NO: 7506288 - DNA, 22 bp, Homo sapiens
gttctgctgtgtctcagcaggt

SEQ ID NO: 7506289 - DNA, 22 bp, Homo sapiens
gttattttaacttctcagtaat

SEQ ID NO: 7506290 - DNA, 22 bp, Homo sapiens
gttattttaacttctcagtaat

SEQ ID NO: 7506291 - DNA, 22 bp, Homo sapiens
gttctggaggagagcctggtgt

SEQ ID NO: 7506292 - DNA, 22 bp, Homo sapiens
gttctggaattgtctgaaatcc

SEQ ID NO: 7506293 - DNA, 21 bp, Homo sapiens
gttctggagcctggaagtcca

SEQ ID NO: 7506294 - DNA, 21 bp, Homo sapiens
gttctggagcctggaagtcca

SEQ ID NO: 7506295 - DNA, 22 bp, Homo sapiens
gttctggaagcttttgagcaac

SEQ ID NO: 7506296 - DNA, 22 bp, Homo sapiens
gttctggaagcttttgagcaac

SEQ ID NO: 7506297 - DNA, 21 bp, Homo sapiens
gttctggaggctgcaagtcca

SEQ ID NO: 7506298 - DNA, 21 bp, Homo sapiens
gttctggaggctgcaagtcca

SEQ ID NO: 7506299 - DNA, 22 bp, Homo sapiens
gttcttcaggctgtgctctaga

SEQ ID NO: 7506300 - DNA, 22 bp, Homo sapiens
gttctggagtggtgccaggcct

SEQ ID NO: 7506301 - DNA, 22 bp, Homo sapiens
gttcttcagtcacatcacagaa

SEQ ID NO: 7506302 - DNA, 22 bp, Homo sapiens
gttcttcagtcacatcacagaa

SEQ ID NO: 7506303 - DNA, 22 bp, Homo sapiens
gttcttcagtcacatcacagaa

SEQ ID NO: 7506304 - DNA, 22 bp, Homo sapiens
gttcttcagttcaggctgttca

SEQ ID NO: 7506305 - DNA, 22 bp, Homo sapiens
gttcttcagtaaaattaaatgt

SEQ ID NO: 7506306 - DNA, 22 bp, Homo sapiens
gttcttcagtaaaattaaatgt

SEQ ID NO: 7506307 - DNA, 22 bp, Homo sapiens
gttcttcaggctgtgctctaga

SEQ ID NO: 7506308 - DNA, 22 bp, Homo sapiens
gttcttcagtaaaattaaatgt

SEQ ID NO: 7506309 - DNA, 22 bp, Homo sapiens
gttcttcatcattttagatagg

SEQ ID NO: 7506310 - DNA, 22 bp, Homo sapiens
gttcttcatcattaacactctg

SEQ ID NO: 7506311 - DNA, 22 bp, Homo sapiens
gttcttcatcttaaccatctgt

SEQ ID NO: 7506312 - DNA, 22 bp, Homo sapiens
gttcttccctttggggattgtg

SEQ ID NO: 7506313 - DNA, 21 bp, Homo sapiens
gttcttcatttaggtgggctt

SEQ ID NO: 7506314 - DNA, 22 bp, Homo sapiens
gttcttcatcttaaccatctgt

SEQ ID NO: 7506315 - DNA, 22 bp, Homo sapiens
gttcttcattacaagggaacca

SEQ ID NO: 7506316 - DNA, 22 bp, Homo sapiens
gttatttataaggtgtaactcc

SEQ ID NO: 7506317 - DNA, 22 bp, Homo sapiens
gttatttataaggtgtaactcc

SEQ ID NO: 7506318 - DNA, 22 bp, Homo sapiens
gttatttataaggtgtaactcc

SEQ ID NO: 7506319 - DNA, 22 bp, Homo sapiens
gttatttataaggtgtaactcc

SEQ ID NO: 7506320 - DNA, 22 bp, Homo sapiens
gttatttaactttgtagcatgg

SEQ ID NO: 7506321 - DNA, 22 bp, Homo sapiens
gttatttaactttgtagcatgg

SEQ ID NO: 7506322 - DNA, 22 bp, Homo sapiens
gttatttataaggtgtaactcc

SEQ ID NO: 7506323 - DNA, 22 bp, Homo sapiens
gttatttataaggtgtaactcc

SEQ ID NO: 7506324 - DNA, 22 bp, Homo sapiens
gttatttcagccacagagtgca

SEQ ID NO: 7506325 - DNA, 22 bp, Homo sapiens
gttatttcagccacagagtgca

SEQ ID NO: 7506326 - DNA, 22 bp, Homo sapiens
gttatttataaggtgtaactcc

SEQ ID NO: 7506327 - DNA, 22 bp, Homo sapiens
gttattgtccatttatttagca

SEQ ID NO: 7506328 - DNA, 22 bp, Homo sapiens
gttattgtccatttatttagca

SEQ ID NO: 7506329 - DNA, 22 bp, Homo sapiens
gttattgtccagcacagttggg

SEQ ID NO: 7506330 - DNA, 22 bp, Homo sapiens
gttattgtttatcctgcacccc

SEQ ID NO: 7506331 - DNA, 22 bp, Homo sapiens
gttattgtgtttgttcagggca

SEQ ID NO: 7506332 - DNA, 22 bp, Homo sapiens
gttattgtgtttgttcagggca

SEQ ID NO: 7506333 - DNA, 22 bp, Homo sapiens
gttatttaactttgtagcatgg

SEQ ID NO: 7506334 - DNA, 22 bp, Homo sapiens
gttatttaactttgtagcatgg

SEQ ID NO: 7506335 - DNA, 22 bp, Homo sapiens
gttatttaactttgtagcatgg

SEQ ID NO: 7506336 - DNA, 22 bp, Homo sapiens
gttatttaactttgtagcatgg

SEQ ID NO: 7506337 - DNA, 22 bp, Homo sapiens
gttattgtttatcctgcacccc

SEQ ID NO: 7506338 - DNA, 22 bp, Homo sapiens
gttattggaaagcctggagggc

SEQ ID NO: 7506339 - DNA, 22 bp, Homo sapiens
gttattggaaagcctggagggc

SEQ ID NO: 7506340 - DNA, 20 bp, Homo sapiens
gttattggaaatattgtgtg

SEQ ID NO: 7506341 - DNA, 20 bp, Homo sapiens
gttattggaaatattgtgtg

SEQ ID NO: 7506342 - DNA, 22 bp, Homo sapiens
gttattggcagcatttcagagt

SEQ ID NO: 7506343 - DNA, 22 bp, Homo sapiens
gttattggcagcatttcagagt

SEQ ID NO: 7506344 - DNA, 22 bp, Homo sapiens
gttattgcttttttacaaatca

SEQ ID NO: 7506345 - DNA, 22 bp, Homo sapiens
gttattgcttttttacaaatca

SEQ ID NO: 7506346 - DNA, 23 bp, Homo sapiens
gttattgctggtgctggccagcc

SEQ ID NO: 7506347 - DNA, 23 bp, Homo sapiens
gttattgctggtgctggccagcc

SEQ ID NO: 7506348 - DNA, 22 bp, Homo sapiens
gttattgctggatagatacatc

SEQ ID NO: 7506349 - DNA, 22 bp, Homo sapiens
gttattgctggatagatacatc

SEQ ID NO: 7506350 - DNA, 22 bp, Homo sapiens
gttattgctggatagatacatc

SEQ ID NO: 7506351 - DNA, 22 bp, Homo sapiens
gttattgctggatagatacatc

SEQ ID NO: 7506352 - DNA, 22 bp, Homo sapiens
gttattgctctactcaatgtta

SEQ ID NO: 7506353 - DNA, 22 bp, Homo sapiens
gttattgctctactcaatgtta

SEQ ID NO: 7506354 - DNA, 17 bp, Homo sapiens
gttattgctgcttcctt

SEQ ID NO: 7506355 - DNA, 17 bp, Homo sapiens
gttattgctgcttcctt

SEQ ID NO: 7506356 - DNA, 22 bp, Homo sapiens
gttattggcagcatttcagagt

SEQ ID NO: 7506357 - DNA, 22 bp, Homo sapiens
gttattgggtgcctcaggccct

SEQ ID NO: 7506358 - DNA, 20 bp, Homo sapiens
gttattggtcatttttgcca

SEQ ID NO: 7506359 - DNA, 20 bp, Homo sapiens
gttattggtcatttttgcca

SEQ ID NO: 7506360 - DNA, 22 bp, Homo sapiens
gttattgggtgcctcaggccct

SEQ ID NO: 7506361 - DNA, 21 bp, Homo sapiens
gttattggttacactgcactt

SEQ ID NO: 7506362 - DNA, 21 bp, Homo sapiens
gttattggttacactgcactt

SEQ ID NO: 7506363 - DNA, 22 bp, Homo sapiens
gttattgtccagcacagttggg

SEQ ID NO: 7506364 - DNA, 22 bp, Homo sapiens
gttattgtccagcacagttggg

SEQ ID NO: 7506365 - DNA, 22 bp, Homo sapiens
gttattgtccagcacagttggg

SEQ ID NO: 7506366 - DNA, 22 bp, Homo sapiens
gttatattggcagaagagaaga

SEQ ID NO: 7506367 - DNA, 22 bp, Homo sapiens
gttatattggcagaagagaaga

SEQ ID NO: 7506368 - DNA, 22 bp, Homo sapiens
gttatattggcagaagagaaga

SEQ ID NO: 7506369 - DNA, 22 bp, Homo sapiens
gttatattgccaagtatattgt

SEQ ID NO: 7506370 - DNA, 22 bp, Homo sapiens
gttatattgccaagtatattgt

SEQ ID NO: 7506371 - DNA, 22 bp, Homo sapiens
gttatattgccaagtatattgt

SEQ ID NO: 7506372 - DNA, 22 bp, Homo sapiens
gttatattgccaagtatattgt

SEQ ID NO: 7506373 - DNA, 22 bp, Homo sapiens
gttatattgccaagtatattgt

SEQ ID NO: 7506374 - DNA, 22 bp, Homo sapiens
gttatcttccctttgatgattt

SEQ ID NO: 7506375 - DNA, 22 bp, Homo sapiens
gttatcttctatttctcatact

SEQ ID NO: 7506376 - DNA, 22 bp, Homo sapiens
gttatcatgcttcatcatcact

SEQ ID NO: 7506377 - DNA, 22 bp, Homo sapiens
gttatcatgcttcatcatcact

SEQ ID NO: 7506378 - DNA, 22 bp, Homo sapiens
gttatccatagaataagtcatc

SEQ ID NO: 7506379 - DNA, 22 bp, Homo sapiens
gttatctagaccaaaagcctaa

SEQ ID NO: 7506380 - DNA, 22 bp, Homo sapiens
gttatgaaataaatatagatca

SEQ ID NO: 7506381 - DNA, 22 bp, Homo sapiens
gttatgaagtcattcacaaata

SEQ ID NO: 7506382 - DNA, 22 bp, Homo sapiens
gttatgctgagttgcatgaggt

SEQ ID NO: 7506383 - DNA, 22 bp, Homo sapiens
gttatgtaatctaacactcagt

SEQ ID NO: 7506384 - DNA, 22 bp, Homo sapiens
gttatgtaatctaacactcagt

SEQ ID NO: 7506385 - DNA, 22 bp, Homo sapiens
gttatgtactttttaaatcttg

SEQ ID NO: 7506386 - DNA, 22 bp, Homo sapiens
gttatgtactttttaaatcttg

SEQ ID NO: 7506387 - DNA, 22 bp, Homo sapiens
gttatgtactttttaaatcttg

SEQ ID NO: 7506388 - DNA, 22 bp, Homo sapiens
gttattgctaaaggttttcatt

SEQ ID NO: 7506389 - DNA, 22 bp, Homo sapiens
gttattgctaaaggttttcatt

SEQ ID NO: 7506390 - DNA, 22 bp, Homo sapiens
gttattgctatacatgtacact

SEQ ID NO: 7506391 - DNA, 22 bp, Homo sapiens
gttattgctatacatgtacact

SEQ ID NO: 7506392 - DNA, 22 bp, Homo sapiens
gttattgctatacatgtacact

SEQ ID NO: 7506393 - DNA, 22 bp, Homo sapiens
gttattgcagtatagaggtcta

SEQ ID NO: 7506394 - DNA, 22 bp, Homo sapiens
gttattgcagtatagaggtcta

SEQ ID NO: 7506395 - DNA, 22 bp, Homo sapiens
gttattgcagtatagaggtcta

SEQ ID NO: 7506396 - DNA, 20 bp, Homo sapiens
gttattgcgtaagactcgct

SEQ ID NO: 7506397 - DNA, 20 bp, Homo sapiens
gttattgcgtaagactcgct

SEQ ID NO: 7506398 - DNA, 22 bp, Homo sapiens
gttatgtactttttaaatcttg

SEQ ID NO: 7506399 - DNA, 22 bp, Homo sapiens
gttatgtactttttaaatcttg

SEQ ID NO: 7506400 - DNA, 22 bp, Homo sapiens
gttatgtatcttgattgggtgg

SEQ ID NO: 7506401 - DNA, 22 bp, Homo sapiens
gttatgtatcttgattgggtgg

SEQ ID NO: 7506402 - DNA, 22 bp, Homo sapiens
gttatgtatgagggaatgatta

SEQ ID NO: 7506403 - DNA, 22 bp, Homo sapiens
gttatgtatgagggaatgatta

SEQ ID NO: 7506404 - DNA, 22 bp, Homo sapiens
gttatgtatgagggaatgatta

SEQ ID NO: 7506405 - DNA, 22 bp, Homo sapiens
gttattgcacagtgggtgaggt

SEQ ID NO: 7506406 - DNA, 22 bp, Homo sapiens
gttatataagacaaatcagagt

SEQ ID NO: 7506407 - DNA, 22 bp, Homo sapiens
gttatatatagtatttctctga

SEQ ID NO: 7506408 - DNA, 22 bp, Homo sapiens
gttatatatagtatttctctga

SEQ ID NO: 7506409 - DNA, 22 bp, Homo sapiens
gttatatatagtatttctctga

SEQ ID NO: 7506410 - DNA, 22 bp, Homo sapiens
gttatattcaaaatgaggctgt

SEQ ID NO: 7506411 - DNA, 22 bp, Homo sapiens
gttatattcaaaatgaggctgt

SEQ ID NO: 7506412 - DNA, 22 bp, Homo sapiens
gttatattcaaaatgaggctgt

SEQ ID NO: 7506413 - DNA, 22 bp, Homo sapiens
gttatattcaaaatgaggctgt

SEQ ID NO: 7506414 - DNA, 22 bp, Homo sapiens
gttatattcaaaatgaggctgt

SEQ ID NO: 7506415 - DNA, 22 bp, Homo sapiens
gttatattcaaaatgaggctgt

SEQ ID NO: 7506416 - DNA, 22 bp, Homo sapiens
gttatataagacaaatcagagt

SEQ ID NO: 7506417 - DNA, 22 bp, Homo sapiens
gttatataattcctgtggtagt

SEQ ID NO: 7506418 - DNA, 22 bp, Homo sapiens
gttatagcagcacaaagtggac

SEQ ID NO: 7506419 - DNA, 18 bp, Homo sapiens
gttatagcagcagcattt

SEQ ID NO: 7506420 - DNA, 22 bp, Homo sapiens
gttatataagacaaatcagagt

SEQ ID NO: 7506421 - DNA, 22 bp, Homo sapiens
gttatataagacaaatcagagt

SEQ ID NO: 7506422 - DNA, 22 bp, Homo sapiens
gttatacatatgtgttaacaaa

SEQ ID NO: 7506423 - DNA, 22 bp, Homo sapiens
gttatacacattcctggtgagg

SEQ ID NO: 7506424 - DNA, 22 bp, Homo sapiens
gttatacagttttgggtctgct

SEQ ID NO: 7506425 - DNA, 22 bp, Homo sapiens
gttatacagttttgggtctgct

SEQ ID NO: 7506426 - DNA, 22 bp, Homo sapiens
gttatacatatgtgttaacaaa

SEQ ID NO: 7506427 - DNA, 22 bp, Homo sapiens
gttatacatatgtgttaacaaa

SEQ ID NO: 7506428 - DNA, 22 bp, Homo sapiens
gttatacatatgtgttaacaaa

SEQ ID NO: 7506429 - DNA, 22 bp, Homo sapiens
gttatacttatgtgcaaaaata

SEQ ID NO: 7506430 - DNA, 21 bp, Homo sapiens
gttatacattctatggatttg

SEQ ID NO: 7506431 - DNA, 21 bp, Homo sapiens
gttatacattctatggatttg

SEQ ID NO: 7506432 - DNA, 22 bp, Homo sapiens
gttataaatgactgcaaaagtt

SEQ ID NO: 7506433 - DNA, 22 bp, Homo sapiens
gttataaatgactgcaaaagtt

SEQ ID NO: 7506434 - DNA, 22 bp, Homo sapiens
gttataaatacctaataggatt

SEQ ID NO: 7506435 - DNA, 22 bp, Homo sapiens
gttataaatgactgcaaaagtt

SEQ ID NO: 7506436 - DNA, 22 bp, Homo sapiens
gttataaatgactgcaaaagtt

SEQ ID NO: 7506437 - DNA, 22 bp, Homo sapiens
gttataaatgactgcaaaagtt

SEQ ID NO: 7506438 - DNA, 22 bp, Homo sapiens
gttataaatgactgcaaaagtt

SEQ ID NO: 7506439 - DNA, 22 bp, Homo sapiens
gttataaatgactgcaaaagtt

SEQ ID NO: 7506440 - DNA, 22 bp, Homo sapiens
gttataaatgactgcaaaagtt

SEQ ID NO: 7506441 - DNA, 22 bp, Homo sapiens
gttataaatgactgcaaaagtt

SEQ ID NO: 7506442 - DNA, 22 bp, Homo sapiens
gttataaatgactgcaaaagtt

SEQ ID NO: 7506443 - DNA, 22 bp, Homo sapiens
gttataaatgactgcaaaagtt

SEQ ID NO: 7506444 - DNA, 22 bp, Homo sapiens
gttatacacattcctggtgagg

SEQ ID NO: 7506445 - DNA, 20 bp, Homo sapiens
gtgtttcatgtgatacaatg

SEQ ID NO: 7506446 - DNA, 22 bp, Homo sapiens
gtgtttcccaagcctgggaagg

SEQ ID NO: 7506447 - DNA, 22 bp, Homo sapiens
gtgtttccagttcagaaagcaa

SEQ ID NO: 7506448 - DNA, 20 bp, Homo sapiens
gtgtttcatgtgatacaatg

SEQ ID NO: 7506449 - DNA, 22 bp, Homo sapiens
gtgtttatgtttgtgtagggga

SEQ ID NO: 7506450 - DNA, 22 bp, Homo sapiens
gtgtttataggagtgaatgctg

SEQ ID NO: 7506451 - DNA, 22 bp, Homo sapiens
gtgtttatgagtgaccttgtct

SEQ ID NO: 7506452 - DNA, 19 bp, Homo sapiens
gtgtttactgtgtgcagaa

SEQ ID NO: 7506453 - DNA, 22 bp, Homo sapiens
gtgtttatacagcaaagagcat

SEQ ID NO: 7506454 - DNA, 22 bp, Homo sapiens
gtgtttaataggtagctgaatc

SEQ ID NO: 7506455 - DNA, 22 bp, Homo sapiens
gtgtttaataggtagctgaatc

SEQ ID NO: 7506456 - DNA, 22 bp, Homo sapiens
gtgtttaataggtagctgaatc

SEQ ID NO: 7506457 - DNA, 22 bp, Homo sapiens
gtgtttaataggtagctgaatc

SEQ ID NO: 7506458 - DNA, 22 bp, Homo sapiens
gtgtttaatgcagatgtgggtg

SEQ ID NO: 7506459 - DNA, 22 bp, Homo sapiens
gtgtttgctggagctctgggtc

SEQ ID NO: 7506460 - DNA, 22 bp, Homo sapiens
gtgtttgctggagctctgggtc

SEQ ID NO: 7506461 - DNA, 22 bp, Homo sapiens
gttaaataacctcatgtccgtt

SEQ ID NO: 7506462 - DNA, 22 bp, Homo sapiens
gtgtttctggggcattcatagt

SEQ ID NO: 7506463 - DNA, 22 bp, Homo sapiens
gtgtttcttgcactccccggac

SEQ ID NO: 7506464 - DNA, 22 bp, Homo sapiens
gttaaataacctcatgtccgtt

SEQ ID NO: 7506465 - DNA, 22 bp, Homo sapiens
gttaaataacctcatgtccgtt

SEQ ID NO: 7506466 - DNA, 22 bp, Homo sapiens
gttaaataacctcatgtccgtt

SEQ ID NO: 7506467 - DNA, 22 bp, Homo sapiens
gtgtttccctggcacaagaacc

SEQ ID NO: 7506468 - DNA, 22 bp, Homo sapiens
gtgtttcccctcctggagaagg

SEQ ID NO: 7506469 - DNA, 22 bp, Homo sapiens
gtgtttcccctcctggagaagg

SEQ ID NO: 7506470 - DNA, 22 bp, Homo sapiens
gtgtttcccctcctggagaagg

SEQ ID NO: 7506471 - DNA, 22 bp, Homo sapiens
gtgtttcctagtttaatgaatg

SEQ ID NO: 7506472 - DNA, 22 bp, Homo sapiens
gtgtttcctcacttctctgact

SEQ ID NO: 7506473 - DNA, 22 bp, Homo sapiens
gtgtttcctctagaagccatgg

SEQ ID NO: 7506474 - DNA, 22 bp, Homo sapiens
gtgtttcctctagaagccatgg

SEQ ID NO: 7506475 - DNA, 22 bp, Homo sapiens
gtgtttcctcacttctctgact

SEQ ID NO: 7506476 - DNA, 21 bp, Homo sapiens
gtgtttcctgtttatggcttg

SEQ ID NO: 7506477 - DNA, 21 bp, Homo sapiens
gtgtttcctgtttatggcttg

SEQ ID NO: 7506478 - DNA, 21 bp, Homo sapiens
gtgtttcctgtttatggcttg

SEQ ID NO: 7506479 - DNA, 22 bp, Homo sapiens
gttaaattcgatgatggataaa

SEQ ID NO: 7506480 - DNA, 22 bp, Homo sapiens
gttaacaaatgtaaagcaatta

SEQ ID NO: 7506481 - DNA, 22 bp, Homo sapiens
gttaacaaatgtaaagcaatta

SEQ ID NO: 7506482 - DNA, 22 bp, Homo sapiens
gttaacaaatgtaaagcaatta

SEQ ID NO: 7506483 - DNA, 22 bp, Homo sapiens
gttaaattcgatgatggataaa

SEQ ID NO: 7506484 - DNA, 22 bp, Homo sapiens
gttaaattcgatgatggataaa

SEQ ID NO: 7506485 - DNA, 22 bp, Homo sapiens
gttaaatgcattttccaagcac

SEQ ID NO: 7506486 - DNA, 22 bp, Homo sapiens
gttaaatgcattttccaagcac

SEQ ID NO: 7506487 - DNA, 22 bp, Homo sapiens
gttaaatgcagattctgactca

SEQ ID NO: 7506488 - DNA, 22 bp, Homo sapiens
gttaaatgcattttccaagcac

SEQ ID NO: 7506489 - DNA, 22 bp, Homo sapiens
gttaaatgcagattctgactca

SEQ ID NO: 7506490 - DNA, 22 bp, Homo sapiens
gttaaatgcagattctgactca

SEQ ID NO: 7506491 - DNA, 22 bp, Homo sapiens
gttaaatgcagattctgactca

SEQ ID NO: 7506492 - DNA, 22 bp, Homo sapiens
gttaaatgcagattctgactca

SEQ ID NO: 7506493 - DNA, 22 bp, Homo sapiens
gttaaatgcactattgaaagct

SEQ ID NO: 7506494 - DNA, 22 bp, Homo sapiens
gttaaatgcactattgaaagct

SEQ ID NO: 7506495 - DNA, 22 bp, Homo sapiens
gttaaataacctcatgtccgtt

SEQ ID NO: 7506496 - DNA, 22 bp, Homo sapiens
gttaaatgcactattgaaagct

SEQ ID NO: 7506497 - DNA, 22 bp, Homo sapiens
gttaaataacctcatgtccgtt

SEQ ID NO: 7506498 - DNA, 22 bp, Homo sapiens
gttaaataacctcatgtccgtt

SEQ ID NO: 7506499 - DNA, 22 bp, Homo sapiens
gttaacataggagtttgttgta

SEQ ID NO: 7506500 - DNA, 22 bp, Homo sapiens
gttaacataggagtttgttgta

SEQ ID NO: 7506501 - DNA, 22 bp, Homo sapiens
gttaacaggaactagggctatg

SEQ ID NO: 7506502 - DNA, 18 bp, Homo sapiens
gttaacaattactaacgc

SEQ ID NO: 7506503 - DNA, 22 bp, Homo sapiens
gttaacaaccaaacagaagttc

SEQ ID NO: 7506504 - DNA, 22 bp, Homo sapiens
gttaacaaccaaacagaagttc

SEQ ID NO: 7506505 - DNA, 22 bp, Homo sapiens
gttaacaacactgtgagtgctg

SEQ ID NO: 7506506 - DNA, 22 bp, Homo sapiens
gttaacaaggtgtagaggtttt

SEQ ID NO: 7506507 - DNA, 22 bp, Homo sapiens
gttaacaagaattactctggaa

SEQ ID NO: 7506508 - DNA, 23 bp, Homo sapiens
gttaacatggtccatggaagagc

SEQ ID NO: 7506509 - DNA, 23 bp, Homo sapiens
gttaacatggtccatggaagagc

SEQ ID NO: 7506510 - DNA, 23 bp, Homo sapiens
gttaacatggtccatggaagagc

SEQ ID NO: 7506511 - DNA, 22 bp, Homo sapiens
gttaacattcaattaaacagtc

SEQ ID NO: 7506512 - DNA, 22 bp, Homo sapiens
gttaacattcaattaaacagtc

SEQ ID NO: 7506513 - DNA, 22 bp, Homo sapiens
gttataaatacctaataggatt

SEQ ID NO: 7506514 - DNA, 22 bp, Homo sapiens
gttataaatacctaataggatt

SEQ ID NO: 7506515 - DNA, 22 bp, Homo sapiens
gtgctggctgccaggaggctgc

SEQ ID NO: 7506516 - DNA, 22 bp, Homo sapiens
gtgctggctgccaggaggctgc

SEQ ID NO: 7506517 - DNA, 17 bp, Homo sapiens
gtgctggcctggggctc

SEQ ID NO: 7506518 - DNA, 17 bp, Homo sapiens
gtgctggcctggggctc

SEQ ID NO: 7506519 - DNA, 17 bp, Homo sapiens
gtgctggcctggggctc

SEQ ID NO: 7506520 - DNA, 17 bp, Homo sapiens
gtgctggcctggggctc

SEQ ID NO: 7506521 - DNA, 22 bp, Homo sapiens
gtgctggcctcagagggtcatg

SEQ ID NO: 7506522 - DNA, 17 bp, Homo sapiens
gtgctggcctggggctc

SEQ ID NO: 7506523 - DNA, 17 bp, Homo sapiens
gtgctggcctggggctc

SEQ ID NO: 7506524 - DNA, 22 bp, Homo sapiens
gtgctggcctcagagggtcatg

SEQ ID NO: 7506525 - DNA, 22 bp, Homo sapiens
gtgctggctggacatggagcac

SEQ ID NO: 7506526 - DNA, 22 bp, Homo sapiens
gtgctggctggacatggagcac

SEQ ID NO: 7506527 - DNA, 22 bp, Homo sapiens
gtgctggctggacatggagcac

SEQ ID NO: 7506528 - DNA, 22 bp, Homo sapiens
gtgctggctggacatggagcac

SEQ ID NO: 7506529 - DNA, 22 bp, Homo sapiens
gtgctggctggacatggagcac

SEQ ID NO: 7506530 - DNA, 22 bp, Homo sapiens
gtgctggctgccaggaggctgc

SEQ ID NO: 7506531 - DNA, 22 bp, Homo sapiens
gtgctggctgccaggaggctgc

SEQ ID NO: 7506532 - DNA, 22 bp, Homo sapiens
gtgctggctgccaggaggctgc

SEQ ID NO: 7506533 - DNA, 22 bp, Homo sapiens
gtgctggctgccaggaggctgc

SEQ ID NO: 7506534 - DNA, 22 bp, Homo sapiens
gtgttattagagcattaatttt

SEQ ID NO: 7506535 - DNA, 22 bp, Homo sapiens
gtgctgggattacaggtgtgag

SEQ ID NO: 7506536 - DNA, 22 bp, Homo sapiens
gtgttattagagcattaatttt

SEQ ID NO: 7506537 - DNA, 22 bp, Homo sapiens
gtgttattagagcattaatttt

SEQ ID NO: 7506538 - DNA, 22 bp, Homo sapiens
gtgctgggattacaggtgtgag

SEQ ID NO: 7506539 - DNA, 21 bp, Homo sapiens
gtgctgggacacagccaggct

SEQ ID NO: 7506540 - DNA, 21 bp, Homo sapiens
gtgctgggacacagccaggct

SEQ ID NO: 7506541 - DNA, 21 bp, Homo sapiens
gtgctgggacacagccaggct

SEQ ID NO: 7506542 - DNA, 21 bp, Homo sapiens
gtgctgggacacagccaggct

SEQ ID NO: 7506543 - DNA, 21 bp, Homo sapiens
gtgctgggacacagccaggct

SEQ ID NO: 7506544 - DNA, 22 bp, Homo sapiens
gtgctggctggggcatcaggca

SEQ ID NO: 7506545 - DNA, 22 bp, Homo sapiens
gtgctggctggggcatcaggca

SEQ ID NO: 7506546 - DNA, 22 bp, Homo sapiens
gtgctggctggggcatcaggca

SEQ ID NO: 7506547 - DNA, 22 bp, Homo sapiens
gtgctggctggacatggagcac

SEQ ID NO: 7506548 - DNA, 21 bp, Homo sapiens
gtgctgggacacagccaggct

SEQ ID NO: 7506549 - DNA, 21 bp, Homo sapiens
gtgctgggacacagccaggct

SEQ ID NO: 7506550 - DNA, 21 bp, Homo sapiens
gtgctgggacacagccaggct

SEQ ID NO: 7506551 - DNA, 21 bp, Homo sapiens
gtgctgggacacagccaggct

SEQ ID NO: 7506552 - DNA, 22 bp, Homo sapiens
gtgttgtggagcttgtcagggg

SEQ ID NO: 7506553 - DNA, 21 bp, Homo sapiens
gtgttggcatatggtggttga

SEQ ID NO: 7506554 - DNA, 22 bp, Homo sapiens
gtgtttaacatctggtttatac

SEQ ID NO: 7506555 - DNA, 22 bp, Homo sapiens
gtgtttaacatctggtttatac

SEQ ID NO: 7506556 - DNA, 22 bp, Homo sapiens
gtgttgcttcatctttatggtg

SEQ ID NO: 7506557 - DNA, 23 bp, Homo sapiens
gtgttggcagcagtgctctgggg

SEQ ID NO: 7506558 - DNA, 23 bp, Homo sapiens
gtgttggcagcagtgctctgggg

SEQ ID NO: 7506559 - DNA, 22 bp, Homo sapiens
gtgttggacagcttctactgtg

SEQ ID NO: 7506560 - DNA, 22 bp, Homo sapiens
gtgttgacacagccatcttgtc

SEQ ID NO: 7506561 - DNA, 22 bp, Homo sapiens
gtgttgatgacattttagaaac

SEQ ID NO: 7506562 - DNA, 22 bp, Homo sapiens
gtgttctttatttagtgatgct

SEQ ID NO: 7506563 - DNA, 22 bp, Homo sapiens
gtgttctttatttagtgatgct

SEQ ID NO: 7506564 - DNA, 22 bp, Homo sapiens
gtgttctgggatgattgtagtg

SEQ ID NO: 7506565 - DNA, 22 bp, Homo sapiens
gtgttcttttgcttcacagaaa

SEQ ID NO: 7506566 - DNA, 22 bp, Homo sapiens
gtgttcttttgcttcacagaaa

SEQ ID NO: 7506567 - DNA, 22 bp, Homo sapiens
gtgttcttttgcttcacagaaa

SEQ ID NO: 7506568 - DNA, 22 bp, Homo sapiens
gtgttccatgtttgaggtagtt

SEQ ID NO: 7506569 - DNA, 22 bp, Homo sapiens
gtgttcctggacagcaagtgag

SEQ ID NO: 7506570 - DNA, 22 bp, Homo sapiens
gtgttctctagagctgtacaaa

SEQ ID NO: 7506571 - DNA, 22 bp, Homo sapiens
gtgttcctggacagcaagtgag

SEQ ID NO: 7506572 - DNA, 22 bp, Homo sapiens
gtgttcattgctagtgaggtgt

SEQ ID NO: 7506573 - DNA, 22 bp, Homo sapiens
gtgttcattgctagtgaggtgt

SEQ ID NO: 7506574 - DNA, 22 bp, Homo sapiens
gtgttctctagagctgtacaaa

SEQ ID NO: 7506575 - DNA, 22 bp, Homo sapiens
gtgttctctctacaggaattta

SEQ ID NO: 7506576 - DNA, 22 bp, Homo sapiens
gtgttctctctacaggaattta

SEQ ID NO: 7506577 - DNA, 22 bp, Homo sapiens
gtgttctgcagaccagcatcat

SEQ ID NO: 7506578 - DNA, 22 bp, Homo sapiens
gtgttctgcagaccagcatcat

SEQ ID NO: 7506579 - DNA, 22 bp, Homo sapiens
gtgttctgggatgattgtagtg

SEQ ID NO: 7506580 - DNA, 22 bp, Homo sapiens
gtgttctgggatgattgtagtg

SEQ ID NO: 7506581 - DNA, 22 bp, Homo sapiens
gtgttctgcagaccagcatcat

SEQ ID NO: 7506582 - DNA, 22 bp, Homo sapiens
gtgttatttgagtgggagcgtg

SEQ ID NO: 7506583 - DNA, 22 bp, Homo sapiens
gtgttcatcccaatgctgatag

SEQ ID NO: 7506584 - DNA, 17 bp, Homo sapiens
gtgttcacaatgactgt

SEQ ID NO: 7506585 - DNA, 22 bp, Homo sapiens
gtgttcatgccccagtgcagga

SEQ ID NO: 7506586 - DNA, 22 bp, Homo sapiens
gtgttcatgccccagtgcagga

SEQ ID NO: 7506587 - DNA, 22 bp, Homo sapiens
gtgttcatcccaatgctgatag

SEQ ID NO: 7506588 - DNA, 22 bp, Homo sapiens
gtgttcatggatgtcaatttga

SEQ ID NO: 7506589 - DNA, 22 bp, Homo sapiens
gtgttcatggatgtcaatttga

SEQ ID NO: 7506590 - DNA, 22 bp, Homo sapiens
gtttcaaagcacagctcacatt

SEQ ID NO: 7506591 - DNA, 22 bp, Homo sapiens
gtttcaaagggaagacgctgga

SEQ ID NO: 7506592 - DNA, 22 bp, Homo sapiens
gtttcaaaggtgtcaggcagtt

SEQ ID NO: 7506593 - DNA, 22 bp, Homo sapiens
gtttcaaagggaagacgctgga

SEQ ID NO: 7506594 - DNA, 22 bp, Homo sapiens
gtttcaaagtcagaaaaggagg

SEQ ID NO: 7506595 - DNA, 22 bp, Homo sapiens
gtttcaaaggtgtcaggcagtt

SEQ ID NO: 7506596 - DNA, 22 bp, Homo sapiens
gtttcaaagtcagaaaaggagg

SEQ ID NO: 7506597 - DNA, 22 bp, Homo sapiens
gtttcaaagtcagaaaaggagg

SEQ ID NO: 7506598 - DNA, 22 bp, Homo sapiens
gtttcaaagtcagaaaaggagg

SEQ ID NO: 7506599 - DNA, 22 bp, Homo sapiens
gtttattatacaacaaaagcta

SEQ ID NO: 7506600 - DNA, 22 bp, Homo sapiens
gtttattatacaacaaaagcta

SEQ ID NO: 7506601 - DNA, 22 bp, Homo sapiens
gtttattatacaacaaaagcta

SEQ ID NO: 7506602 - DNA, 22 bp, Homo sapiens
gtttattatacaacaaaagcta

SEQ ID NO: 7506603 - DNA, 22 bp, Homo sapiens
gtttattatacaacaaaagcta

SEQ ID NO: 7506604 - DNA, 22 bp, Homo sapiens
gtttattatacaacaaaagcta

SEQ ID NO: 7506605 - DNA, 22 bp, Homo sapiens
gtttattagagttttctgtctg

SEQ ID NO: 7506606 - DNA, 22 bp, Homo sapiens
gtttattagagttttctgtctg

SEQ ID NO: 7506607 - DNA, 22 bp, Homo sapiens
gtttattagagttttctgtctg

SEQ ID NO: 7506608 - DNA, 22 bp, Homo sapiens
gtttattagagttttctgtctg

SEQ ID NO: 7506609 - DNA, 22 bp, Homo sapiens
gtttattagagttttctgtctg

SEQ ID NO: 7506610 - DNA, 22 bp, Homo sapiens
gtttattagagttttctgtctg

SEQ ID NO: 7506611 - DNA, 22 bp, Homo sapiens
gtttattagagttttctgtctg

SEQ ID NO: 7506612 - DNA, 22 bp, Homo sapiens
gtttattagagttttctgtctg

SEQ ID NO: 7506613 - DNA, 22 bp, Homo sapiens
gtttattagagttttctgtctg

SEQ ID NO: 7506614 - DNA, 22 bp, Homo sapiens
gtttattaactgtcaagtgatt

SEQ ID NO: 7506615 - DNA, 22 bp, Homo sapiens
gtttattaactgtcaagtgatt

SEQ ID NO: 7506616 - DNA, 22 bp, Homo sapiens
gtttattaactgtcaagtgatt

SEQ ID NO: 7506617 - DNA, 22 bp, Homo sapiens
gtttattaactgtcaagtgatt

SEQ ID NO: 7506618 - DNA, 22 bp, Homo sapiens
gtttattaactgtcaagtgatt

SEQ ID NO: 7506619 - DNA, 22 bp, Homo sapiens
gtttattaactgtcaagtgatt

SEQ ID NO: 7506620 - DNA, 22 bp, Homo sapiens
gtttatggagggggtgaaggca

SEQ ID NO: 7506621 - DNA, 22 bp, Homo sapiens
gtttatgaggaaaagttatgat

SEQ ID NO: 7506622 - DNA, 22 bp, Homo sapiens
gtttatgagttacgtaggggtt

SEQ ID NO: 7506623 - DNA, 22 bp, Homo sapiens
gtttatgaattgcattcccttt

SEQ ID NO: 7506624 - DNA, 22 bp, Homo sapiens
gtttatgaattgcattcccttt

SEQ ID NO: 7506625 - DNA, 22 bp, Homo sapiens
gtttatgaatgttactatagag

SEQ ID NO: 7506626 - DNA, 22 bp, Homo sapiens
gtttatgaatgttactatagag

SEQ ID NO: 7506627 - DNA, 21 bp, Homo sapiens
gtttatgaatcttgtcctgct

SEQ ID NO: 7506628 - DNA, 21 bp, Homo sapiens
gtttatgaatcttgtcctgct

SEQ ID NO: 7506629 - DNA, 22 bp, Homo sapiens
gtttatgaatgtgtcagacata

SEQ ID NO: 7506630 - DNA, 22 bp, Homo sapiens
gttgagagttaagcgggctaat

SEQ ID NO: 7506631 - DNA, 22 bp, Homo sapiens
gttgagcaaggccagagaagcc

SEQ ID NO: 7506632 - DNA, 22 bp, Homo sapiens
gtttatattcaacggagtatct

SEQ ID NO: 7506633 - DNA, 22 bp, Homo sapiens
gttgagctctccagcttcattt

SEQ ID NO: 7506634 - DNA, 22 bp, Homo sapiens
gtttatattcaacggagtatct

SEQ ID NO: 7506635 - DNA, 22 bp, Homo sapiens
gtttatattcaacggagtatct

SEQ ID NO: 7506636 - DNA, 22 bp, Homo sapiens
gtttatcacaataaataattct

SEQ ID NO: 7506637 - DNA, 22 bp, Homo sapiens
gtttatcagagagcagaggtgg

SEQ ID NO: 7506638 - DNA, 22 bp, Homo sapiens
gtttatcagagagcagaggtgg

SEQ ID NO: 7506639 - DNA, 22 bp, Homo sapiens
gtttatctagtgaagtgaagaa

SEQ ID NO: 7506640 - DNA, 22 bp, Homo sapiens
gtttatcttaatggactcagag

SEQ ID NO: 7506641 - DNA, 22 bp, Homo sapiens
gtttatctgcactctcttgtag

SEQ ID NO: 7506642 - DNA, 22 bp, Homo sapiens
gtttatctagtgaagtgaagaa

SEQ ID NO: 7506643 - DNA, 22 bp, Homo sapiens
gtttatctgcactctcttgtag

SEQ ID NO: 7506644 - DNA, 22 bp, Homo sapiens
gtttatcttaatggactcagag

SEQ ID NO: 7506645 - DNA, 22 bp, Homo sapiens
gtttatgaaatttcaggcattt

SEQ ID NO: 7506646 - DNA, 22 bp, Homo sapiens
gttcttctcttgtaatggaatc

SEQ ID NO: 7506647 - DNA, 22 bp, Homo sapiens
gttcttctcttgtaatggaatc

SEQ ID NO: 7506648 - DNA, 22 bp, Homo sapiens
gttcttctcttgtaatggaatc

SEQ ID NO: 7506649 - DNA, 21 bp, Homo sapiens
gttcttgcaggatttccttcc

SEQ ID NO: 7506650 - DNA, 22 bp, Homo sapiens
gttcttgagtcagactattttg

SEQ ID NO: 7506651 - DNA, 22 bp, Homo sapiens
gttcttgagtcagactattttg

SEQ ID NO: 7506652 - DNA, 21 bp, Homo sapiens
gttcttcctgactagagtagt

SEQ ID NO: 7506653 - DNA, 21 bp, Homo sapiens
gttcttcctgactagagtagt

SEQ ID NO: 7506654 - DNA, 22 bp, Homo sapiens
gttcttcctggaagtggatttc

SEQ ID NO: 7506655 - DNA, 21 bp, Homo sapiens
gttcttcctgactagagtagt

SEQ ID NO: 7506656 - DNA, 22 bp, Homo sapiens
gttcttcctcattgctttgaag

SEQ ID NO: 7506657 - DNA, 22 bp, Homo sapiens
gttctttaagtggagaaggaaa

SEQ ID NO: 7506658 - DNA, 22 bp, Homo sapiens
gttctttaagtggagaaggaaa

SEQ ID NO: 7506659 - DNA, 22 bp, Homo sapiens
gttctttaagtggagaaggaaa

SEQ ID NO: 7506660 - DNA, 22 bp, Homo sapiens
gttctttaaactgctgctctgt

SEQ ID NO: 7506661 - DNA, 22 bp, Homo sapiens
gttctttaacctagtctcattt

SEQ ID NO: 7506662 - DNA, 21 bp, Homo sapiens
gttcttgcaggatttccttcc

SEQ ID NO: 7506663 - DNA, 21 bp, Homo sapiens
gttcttgcaggatttccttcc

SEQ ID NO: 7506664 - DNA, 22 bp, Homo sapiens
gttcttggaccagcagcattga

SEQ ID NO: 7506665 - DNA, 22 bp, Homo sapiens
gttcttggaccagcagcattga

SEQ ID NO: 7506666 - DNA, 22 bp, Homo sapiens
gttcttttggtagagtgtgcat

SEQ ID NO: 7506667 - DNA, 19 bp, Homo sapiens
gttcttttcacctctgtgc

SEQ ID NO: 7506668 - DNA, 19 bp, Homo sapiens
gttcttttcacctctgtgc

SEQ ID NO: 7506669 - DNA, 22 bp, Homo sapiens
gttcttttggtagagtgtgcat

SEQ ID NO: 7506670 - DNA, 22 bp, Homo sapiens
gttgaaaatacagattcctagg

SEQ ID NO: 7506671 - DNA, 19 bp, Homo sapiens
gttctttcatagtaagagc

SEQ ID NO: 7506672 - DNA, 22 bp, Homo sapiens
gttctttgactccaagaaagta

SEQ ID NO: 7506673 - DNA, 22 bp, Homo sapiens
gttctttgactccaagaaagta

SEQ ID NO: 7506674 - DNA, 19 bp, Homo sapiens
gttcttttcacctctgtgc

SEQ ID NO: 7506675 - DNA, 19 bp, Homo sapiens
gttcttttcacctctgtgc

SEQ ID NO: 7506676 - DNA, 19 bp, Homo sapiens
gttcttttcacctctgtgc

SEQ ID NO: 7506677 - DNA, 22 bp, Homo sapiens
gttctttgactccaagaaagta

SEQ ID NO: 7506678 - DNA, 22 bp, Homo sapiens
gttctttaggggcccaatttcc

SEQ ID NO: 7506679 - DNA, 22 bp, Homo sapiens
gttgaaaatacagattcctagg

SEQ ID NO: 7506680 - DNA, 22 bp, Homo sapiens
gttgaaaatgactttataccat

SEQ ID NO: 7506681 - DNA, 22 bp, Homo sapiens
gttgaaagatgtcttggttccc

SEQ ID NO: 7506682 - DNA, 22 bp, Homo sapiens
gttgaaagatcatgtggctgcc

SEQ ID NO: 7506683 - DNA, 22 bp, Homo sapiens
gttgaaagatgtcttggttccc

SEQ ID NO: 7506684 - DNA, 22 bp, Homo sapiens
gttgaaagtagatgctatttgg

SEQ ID NO: 7506685 - DNA, 22 bp, Homo sapiens
gttgaaagcttttcatttagtt

SEQ ID NO: 7506686 - DNA, 22 bp, Homo sapiens
gttgaaagcttttcatttagtt

SEQ ID NO: 7506687 - DNA, 22 bp, Homo sapiens
gttgaaagtagatgctatttgg

SEQ ID NO: 7506688 - DNA, 22 bp, Homo sapiens
gttgaaatcctaaccccctagt

SEQ ID NO: 7506689 - DNA, 22 bp, Homo sapiens
gttgaaatttgtgataatttag

SEQ ID NO: 7506690 - DNA, 22 bp, Homo sapiens
gttgaaatgagggattaatcag

SEQ ID NO: 7506691 - DNA, 22 bp, Homo sapiens
gttgaaatttgtgataatttag

SEQ ID NO: 7506692 - DNA, 22 bp, Homo sapiens
gttgaaatcctaaccccctagt

SEQ ID NO: 7506693 - DNA, 22 bp, Homo sapiens
gttgaaatcctaaccccctagt

SEQ ID NO: 7506694 - DNA, 22 bp, Homo sapiens
gttgaaatcctaaccccctagt

SEQ ID NO: 7506695 - DNA, 22 bp, Homo sapiens
gttgacagtgaccctgaaagca

SEQ ID NO: 7506696 - DNA, 22 bp, Homo sapiens
gttgacagaattgtgtggctgg

SEQ ID NO: 7506697 - DNA, 22 bp, Homo sapiens
gttgaatatcgtgttcttgttt

SEQ ID NO: 7506698 - DNA, 22 bp, Homo sapiens
gttgacagaaaaataacatagc

SEQ ID NO: 7506699 - DNA, 22 bp, Homo sapiens
gttgaatattttaagagttttg

SEQ ID NO: 7506700 - DNA, 22 bp, Homo sapiens
gttgaatatcgtgttcttgttt

SEQ ID NO: 7506701 - DNA, 22 bp, Homo sapiens
gttgaatatcccgtatcttaaa

SEQ ID NO: 7506702 - DNA, 22 bp, Homo sapiens
gttgaatatcccgtatcttaaa

SEQ ID NO: 7506703 - DNA, 21 bp, Homo sapiens
gttgaatatccatgtatgtgt

SEQ ID NO: 7506704 - DNA, 21 bp, Homo sapiens
gttgaatatccatgtatgtgt

SEQ ID NO: 7506705 - DNA, 22 bp, Homo sapiens
gttgaatacttgagaaatccat

SEQ ID NO: 7506706 - DNA, 22 bp, Homo sapiens
gttgaatatacctgcatttgtg

SEQ ID NO: 7506707 - DNA, 22 bp, Homo sapiens
gttgaataattcatagaagcta

SEQ ID NO: 7506708 - DNA, 22 bp, Homo sapiens
gttgaacatgtgagtctcagga

SEQ ID NO: 7506709 - DNA, 22 bp, Homo sapiens
gttgaactatgttttatctgac

SEQ ID NO: 7506710 - DNA, 22 bp, Homo sapiens
gtttcttatttcaactggaaca

SEQ ID NO: 7506711 - DNA, 22 bp, Homo sapiens
gtttcttatttcaactggaaca

SEQ ID NO: 7506712 - DNA, 22 bp, Homo sapiens
gtttcttatttcaactggaaca

SEQ ID NO: 7506713 - DNA, 22 bp, Homo sapiens
gtttcttatttgcaggttgctt

SEQ ID NO: 7506714 - DNA, 22 bp, Homo sapiens
gtttcttatttgcaggttgctt

SEQ ID NO: 7506715 - DNA, 22 bp, Homo sapiens
gtttctttctattgactgaaca

SEQ ID NO: 7506716 - DNA, 22 bp, Homo sapiens
gtttctttctattgactgaaca

SEQ ID NO: 7506717 - DNA, 22 bp, Homo sapiens
gtttctttctattgactgaaca

SEQ ID NO: 7506718 - DNA, 22 bp, Homo sapiens
gtttctttctattgactgaaca

SEQ ID NO: 7506719 - DNA, 22 bp, Homo sapiens
gtttctttctattgactgaaca

SEQ ID NO: 7506720 - DNA, 22 bp, Homo sapiens
gtttctttctattgactgaaca

SEQ ID NO: 7506721 - DNA, 22 bp, Homo sapiens
gtttcttagacagacattatct

SEQ ID NO: 7506722 - DNA, 22 bp, Homo sapiens
gtttcttagacatatgccatga

SEQ ID NO: 7506723 - DNA, 22 bp, Homo sapiens
gtttcttagacagacattatct

SEQ ID NO: 7506724 - DNA, 22 bp, Homo sapiens
gtttcttagacagacattatct

SEQ ID NO: 7506725 - DNA, 22 bp, Homo sapiens
gtttcagaaatgttctcctgct

SEQ ID NO: 7506726 - DNA, 22 bp, Homo sapiens
gtttcttagacagacattatct

SEQ ID NO: 7506727 - DNA, 22 bp, Homo sapiens
gtttcttagacagacattatct

SEQ ID NO: 7506728 - DNA, 22 bp, Homo sapiens
gtttcttaggtaaattctttga

SEQ ID NO: 7506729 - DNA, 22 bp, Homo sapiens
gtttcttaggtaaattctttga

SEQ ID NO: 7506730 - DNA, 22 bp, Homo sapiens
gtttcttagacatatgccatga

SEQ ID NO: 7506731 - DNA, 22 bp, Homo sapiens
gtttcttagacatatgccatga

SEQ ID NO: 7506732 - DNA, 22 bp, Homo sapiens
gtttcttaggtaaattctttga

SEQ ID NO: 7506733 - DNA, 22 bp, Homo sapiens
gtttcttatttcaactggaaca

SEQ ID NO: 7506734 - DNA, 22 bp, Homo sapiens
gtttcttatttcaactggaaca

SEQ ID NO: 7506735 - DNA, 22 bp, Homo sapiens
gtttgaaaaaagcagtatgtaa

SEQ ID NO: 7506736 - DNA, 22 bp, Homo sapiens
gtttgaaaaaagcagtatgtaa

SEQ ID NO: 7506737 - DNA, 22 bp, Homo sapiens
gtttcttttgtgatcaccaacc

SEQ ID NO: 7506738 - DNA, 22 bp, Homo sapiens
gtttcttttgtgatcaccaacc

SEQ ID NO: 7506739 - DNA, 22 bp, Homo sapiens
gtttcttttgtgatcaccaacc

SEQ ID NO: 7506740 - DNA, 22 bp, Homo sapiens
gtttcttttgtgatcaccaacc

SEQ ID NO: 7506741 - DNA, 22 bp, Homo sapiens
gtttcttttgtgatcaccaacc

SEQ ID NO: 7506742 - DNA, 22 bp, Homo sapiens
gtttcttttaaaatatgtagac

SEQ ID NO: 7506743 - DNA, 22 bp, Homo sapiens
gtttcttttaaaatatgtagac

SEQ ID NO: 7506744 - DNA, 22 bp, Homo sapiens
gtttctttctattgactgaaca

SEQ ID NO: 7506745 - DNA, 22 bp, Homo sapiens
gtttcttttaaaatatgtagac

SEQ ID NO: 7506746 - DNA, 22 bp, Homo sapiens
gtttcttttaaaatatgtagac

SEQ ID NO: 7506747 - DNA, 22 bp, Homo sapiens
gtttcttttaaaatatgtagac

SEQ ID NO: 7506748 - DNA, 22 bp, Homo sapiens
gtttcttttaaaatatgtagac

SEQ ID NO: 7506749 - DNA, 22 bp, Homo sapiens
gtttcttttaaaatatgtagac

SEQ ID NO: 7506750 - DNA, 22 bp, Homo sapiens
gtttcttttaaaatatgtagac

SEQ ID NO: 7506751 - DNA, 22 bp, Homo sapiens
gtttcacagcaaagttccctgt

SEQ ID NO: 7506752 - DNA, 22 bp, Homo sapiens
gtttcacagggccatggaggaa

SEQ ID NO: 7506753 - DNA, 22 bp, Homo sapiens
gtttcacagggccatggaggaa

SEQ ID NO: 7506754 - DNA, 22 bp, Homo sapiens
gtttcacagggccatggaggaa

SEQ ID NO: 7506755 - DNA, 22 bp, Homo sapiens
gtttcacaggttggagccagca

SEQ ID NO: 7506756 - DNA, 22 bp, Homo sapiens
gtttcacaggttggagccagca

SEQ ID NO: 7506757 - DNA, 22 bp, Homo sapiens
gtttcacagatggtgttcatat

SEQ ID NO: 7506758 - DNA, 22 bp, Homo sapiens
gtttcacagcaaagttccctgt

SEQ ID NO: 7506759 - DNA, 22 bp, Homo sapiens
gtttcacagatggtgttcatat

SEQ ID NO: 7506760 - DNA, 22 bp, Homo sapiens
gtttcacagatggtgttcatat

SEQ ID NO: 7506761 - DNA, 22 bp, Homo sapiens
gtttcactgcactatagcacca

SEQ ID NO: 7506762 - DNA, 22 bp, Homo sapiens
gtttcagaaatggtttatgcaa

SEQ ID NO: 7506763 - DNA, 22 bp, Homo sapiens
gtttcactgcaaactgactttt

SEQ ID NO: 7506764 - DNA, 22 bp, Homo sapiens
gtttcacagtctgcagaatttt

SEQ ID NO: 7506765 - DNA, 22 bp, Homo sapiens
gtttcacataattttaaattgt

SEQ ID NO: 7506766 - DNA, 22 bp, Homo sapiens
gtttcaatttgaatgcgaggct

SEQ ID NO: 7506767 - DNA, 22 bp, Homo sapiens
gtttcacacatcctgcacatag

SEQ ID NO: 7506768 - DNA, 22 bp, Homo sapiens
gtttcacagatggggagacacg

SEQ ID NO: 7506769 - DNA, 22 bp, Homo sapiens
gtttcacacatcctgcacatag

SEQ ID NO: 7506770 - DNA, 22 bp, Homo sapiens
gtttcacagatggggagacacg

SEQ ID NO: 7506771 - DNA, 22 bp, Homo sapiens
gtttcaatttgaatgcgaggct

SEQ ID NO: 7506772 - DNA, 22 bp, Homo sapiens
gtttcaatttcactttccaggc

SEQ ID NO: 7506773 - DNA, 22 bp, Homo sapiens
gtttcaatttgacccaaatctt

SEQ ID NO: 7506774 - DNA, 22 bp, Homo sapiens
gtttcaatttgacccaaatctt

SEQ ID NO: 7506775 - DNA, 22 bp, Homo sapiens
gtttcaatttcactttccaggc

SEQ ID NO: 7506776 - DNA, 22 bp, Homo sapiens
gtttcaatttcactttccaggc

SEQ ID NO: 7506777 - DNA, 22 bp, Homo sapiens
gtttcaagtagctgctgattat

SEQ ID NO: 7506778 - DNA, 22 bp, Homo sapiens
gtttcaagtagctgctgattat

SEQ ID NO: 7506779 - DNA, 22 bp, Homo sapiens
gtttcaaataggtttcagcaaa

SEQ ID NO: 7506780 - DNA, 22 bp, Homo sapiens
gtttcaaataggtttcagcaaa

SEQ ID NO: 7506781 - DNA, 22 bp, Homo sapiens
gtttcaaataggtttcagcaaa

SEQ ID NO: 7506782 - DNA, 22 bp, Homo sapiens
gtttcaaataggtttcagcaaa

SEQ ID NO: 7506783 - DNA, 22 bp, Homo sapiens
gtttcaaataggtttcagcaaa

SEQ ID NO: 7506784 - DNA, 22 bp, Homo sapiens
gtttcaagagtggctcaaaact

SEQ ID NO: 7506785 - DNA, 22 bp, Homo sapiens
gtttcaagcagatggcctgagg

SEQ ID NO: 7506786 - DNA, 22 bp, Homo sapiens
gtttcaagcagatggcctgagg

SEQ ID NO: 7506787 - DNA, 22 bp, Homo sapiens
gtttcaagggaactgttttggt

SEQ ID NO: 7506788 - DNA, 22 bp, Homo sapiens
gtttgcataaagtggatgcagg

SEQ ID NO: 7506789 - DNA, 22 bp, Homo sapiens
gtttgcataaagtggatgcagg

SEQ ID NO: 7506790 - DNA, 21 bp, Homo sapiens
gtttgcagttgagtccttccc

SEQ ID NO: 7506791 - DNA, 22 bp, Homo sapiens
gtttgcatatttgcacaggaat

SEQ ID NO: 7506792 - DNA, 22 bp, Homo sapiens
gtttgcatatctgtgaaatgga

SEQ ID NO: 7506793 - DNA, 21 bp, Homo sapiens
gtttgcatgaacaagtcagcc

SEQ ID NO: 7506794 - DNA, 22 bp, Homo sapiens
gtttgcaaattgtgttaaagct

SEQ ID NO: 7506795 - DNA, 22 bp, Homo sapiens
gtttgcaaattgtgttaaagct

SEQ ID NO: 7506796 - DNA, 22 bp, Homo sapiens
gtttgatttgatccggagagat

SEQ ID NO: 7506797 - DNA, 22 bp, Homo sapiens
gtttgattcaagaacaaagagt

SEQ ID NO: 7506798 - DNA, 22 bp, Homo sapiens
gtttgattcaagaacaaagagt

SEQ ID NO: 7506799 - DNA, 22 bp, Homo sapiens
gtttgaaacatgcacctggagg

SEQ ID NO: 7506800 - DNA, 22 bp, Homo sapiens
gtttgaaagaccaattagattt

SEQ ID NO: 7506801 - DNA, 22 bp, Homo sapiens
gtttgaaagaccaattagattt

SEQ ID NO: 7506802 - DNA, 22 bp, Homo sapiens
gtttgaaagaccaattagattt

SEQ ID NO: 7506803 - DNA, 22 bp, Homo sapiens
gtttgaaagtggcaagtccttg

SEQ ID NO: 7506804 - DNA, 22 bp, Homo sapiens
gtttgaaagttcaacaggaaaa

SEQ ID NO: 7506805 - DNA, 20 bp, Homo sapiens
gtttgaaatgattggttggt

SEQ ID NO: 7506806 - DNA, 22 bp, Homo sapiens
gtttgaaagttcaacaggaaaa

SEQ ID NO: 7506807 - DNA, 22 bp, Homo sapiens
gtttgacactgagataaataaa

SEQ ID NO: 7506808 - DNA, 22 bp, Homo sapiens
gtttgacacggtgcgtcttcag

SEQ ID NO: 7506809 - DNA, 22 bp, Homo sapiens
gtttgaatgcagtatgcatttt

SEQ ID NO: 7506810 - DNA, 22 bp, Homo sapiens
gtttgacacggtgcgtcttcag

SEQ ID NO: 7506811 - DNA, 22 bp, Homo sapiens
gtttgaaatgtctgcaagggaa

SEQ ID NO: 7506812 - DNA, 22 bp, Homo sapiens
gtttgaaatgtctgcaagggaa

SEQ ID NO: 7506813 - DNA, 22 bp, Homo sapiens
gtttgtcaggaggttgaagtca

SEQ ID NO: 7506814 - DNA, 22 bp, Homo sapiens
gtttgtcaggaggttgaagtca

SEQ ID NO: 7506815 - DNA, 22 bp, Homo sapiens
gtttgcattccaatttagggga

SEQ ID NO: 7506816 - DNA, 22 bp, Homo sapiens
gtttgtatgaatgttttatgct

SEQ ID NO: 7506817 - DNA, 22 bp, Homo sapiens
gtttgcatgtgtacttaattgg

SEQ ID NO: 7506818 - DNA, 22 bp, Homo sapiens
gtttgcatgtgtacttaattgg

SEQ ID NO: 7506819 - DNA, 22 bp, Homo sapiens
gtttgcatgtgtacttaattgg

SEQ ID NO: 7506820 - DNA, 22 bp, Homo sapiens
gtttgcatggaagacagtgagt

SEQ ID NO: 7506821 - DNA, 22 bp, Homo sapiens
gtttgcatggaagacagtgagt

SEQ ID NO: 7506822 - DNA, 22 bp, Homo sapiens
gtttgcatgtattaagtcaata

SEQ ID NO: 7506823 - DNA, 22 bp, Homo sapiens
gtttgcatgtattaagtcaata

SEQ ID NO: 7506824 - DNA, 22 bp, Homo sapiens
gtttgtgtaacatgatgatgat

SEQ ID NO: 7506825 - DNA, 22 bp, Homo sapiens
gtttgtgtaacatgatgatgat

SEQ ID NO: 7506826 - DNA, 22 bp, Homo sapiens
gtttgtgtaacatgatgatgat

SEQ ID NO: 7506827 - DNA, 22 bp, Homo sapiens
gtttgtgtaacatgatgatgat

SEQ ID NO: 7506828 - DNA, 22 bp, Homo sapiens
gtttgtcatttgtacttctagc

SEQ ID NO: 7506829 - DNA, 22 bp, Homo sapiens
gtttgttagaagagcagaatct

SEQ ID NO: 7506830 - DNA, 22 bp, Homo sapiens
gtttgttagaagagcagaatct

SEQ ID NO: 7506831 - DNA, 22 bp, Homo sapiens
gtttgttcactatgactgtggt

SEQ ID NO: 7506832 - DNA, 22 bp, Homo sapiens
gtttgttcatggctgatgcttg

SEQ ID NO: 7506833 - DNA, 22 bp, Homo sapiens
gtttgttcactatgactgtggt

SEQ ID NO: 7506834 - DNA, 22 bp, Homo sapiens
gtttgttcatggctgatgcttg

SEQ ID NO: 7506835 - DNA, 22 bp, Homo sapiens
gtttgtttatacaaaagatcct

SEQ ID NO: 7506836 - DNA, 22 bp, Homo sapiens
gtttgtttatacaaaagatcct

SEQ ID NO: 7506837 - DNA, 22 bp, Homo sapiens
gtttgtttatacaaaagatcct

SEQ ID NO: 7506838 - DNA, 22 bp, Homo sapiens
gtttgtttatacaaaagatcct

SEQ ID NO: 7506839 - DNA, 22 bp, Homo sapiens
gtttgtttatacaaaagatcct

SEQ ID NO: 7506840 - DNA, 21 bp, Homo sapiens
gttttaagggagaaaacctag

SEQ ID NO: 7506841 - DNA, 20 bp, Homo sapiens
gttttaaggcacaggccttt

SEQ ID NO: 7506842 - DNA, 21 bp, Homo sapiens
gttttaagggagaaaacctag

SEQ ID NO: 7506843 - DNA, 20 bp, Homo sapiens
gttttaaggcacaggccttt

SEQ ID NO: 7506844 - DNA, 20 bp, Homo sapiens
gttttaaggcacaggccttt

SEQ ID NO: 7506845 - DNA, 22 bp, Homo sapiens
gtttgtttgtagggaagccgtg

SEQ ID NO: 7506846 - DNA, 22 bp, Homo sapiens
gtttgtttgtagggaagccgtg

SEQ ID NO: 7506847 - DNA, 22 bp, Homo sapiens
gtttgttttaagataggatgga

SEQ ID NO: 7506848 - DNA, 22 bp, Homo sapiens
gtttgttttaagataggatgga

SEQ ID NO: 7506849 - DNA, 22 bp, Homo sapiens
gtttgttttaagataggatgga

SEQ ID NO: 7506850 - DNA, 22 bp, Homo sapiens
tatcaggacttcattcctttta

SEQ ID NO: 7506851 - DNA, 22 bp, Homo sapiens
tatcatttaacagaatcattgc

SEQ ID NO: 7506852 - DNA, 22 bp, Homo sapiens
tatcaggaagaacacgtgaaat

SEQ ID NO: 7506853 - DNA, 22 bp, Homo sapiens
tatcaggaagaacacgtgaaat

SEQ ID NO: 7506854 - DNA, 22 bp, Homo sapiens
tatcaggaagaacacgtgaaat

SEQ ID NO: 7506855 - DNA, 22 bp, Homo sapiens
tatcagctcggaatctgttgaa

SEQ ID NO: 7506856 - DNA, 22 bp, Homo sapiens
tatcagctcggaatctgttgaa

SEQ ID NO: 7506857 - DNA, 22 bp, Homo sapiens
tatcagcgtgcaaatctttgga

SEQ ID NO: 7506858 - DNA, 22 bp, Homo sapiens
tatcagcatctcctcaaagata

SEQ ID NO: 7506859 - DNA, 22 bp, Homo sapiens
tatcagcatatttactttcttg

SEQ ID NO: 7506860 - DNA, 22 bp, Homo sapiens
tatcagcatctcctcaaagata

SEQ ID NO: 7506861 - DNA, 22 bp, Homo sapiens
tatcagcatatttactttcttg

SEQ ID NO: 7506862 - DNA, 22 bp, Homo sapiens
tatcagcatatttactttcttg

SEQ ID NO: 7506863 - DNA, 22 bp, Homo sapiens
tatcagcaccgcggacagcatc

SEQ ID NO: 7506864 - DNA, 22 bp, Homo sapiens
tatcagcaagatggcagtatag

SEQ ID NO: 7506865 - DNA, 22 bp, Homo sapiens
tatcagcaactcagagcagtct

SEQ ID NO: 7506866 - DNA, 22 bp, Homo sapiens
tatcagatatagcattcactgg

SEQ ID NO: 7506867 - DNA, 22 bp, Homo sapiens
tatcagatgacatcttctatgg

SEQ ID NO: 7506868 - DNA, 22 bp, Homo sapiens
tatcagatgacatcttctatgg

SEQ ID NO: 7506869 - DNA, 22 bp, Homo sapiens
tatcagatggtgatacatatca

SEQ ID NO: 7506870 - DNA, 22 bp, Homo sapiens
tatcagatggtgatacatatca

SEQ ID NO: 7506871 - DNA, 22 bp, Homo sapiens
tatcagatggtgatacatatca

SEQ ID NO: 7506872 - DNA, 22 bp, Homo sapiens
tatcagatatagcattcactgg

SEQ ID NO: 7506873 - DNA, 22 bp, Homo sapiens
tatcagatatagcattcactgg

SEQ ID NO: 7506874 - DNA, 22 bp, Homo sapiens
tatcagatagtagatatttagc

SEQ ID NO: 7506875 - DNA, 22 bp, Homo sapiens
tatcagataatcttttacaagc

SEQ ID NO: 7506876 - DNA, 22 bp, Homo sapiens
tatcagatatagcattcactgg

SEQ ID NO: 7506877 - DNA, 21 bp, Homo sapiens
tatcagactcctagtaaccac

SEQ ID NO: 7506878 - DNA, 17 bp, Homo sapiens
tatcagaatgtgtttac

SEQ ID NO: 7506879 - DNA, 17 bp, Homo sapiens
tatcagaatgtgtttac

SEQ ID NO: 7506880 - DNA, 22 bp, Homo sapiens
tatcagaaggcacatggagtct

SEQ ID NO: 7506881 - DNA, 22 bp, Homo sapiens
tatcagaatgcagccatgtgca

SEQ ID NO: 7506882 - DNA, 22 bp, Homo sapiens
tatcagaatgcagccatgtgca

SEQ ID NO: 7506883 - DNA, 22 bp, Homo sapiens
tatcagaatgcagccatgtgca

SEQ ID NO: 7506884 - DNA, 22 bp, Homo sapiens
tatcagaaggcacatggagtct

SEQ ID NO: 7506885 - DNA, 22 bp, Homo sapiens
tatcagaaggcacatggagtct

SEQ ID NO: 7506886 - DNA, 22 bp, Homo sapiens
tatcagaaggaagtgcctttaa

SEQ ID NO: 7506887 - DNA, 21 bp, Homo sapiens
tatcagaagagaaagaatgat

SEQ ID NO: 7506888 - DNA, 21 bp, Homo sapiens
tatcagaagagaaagaatgat

SEQ ID NO: 7506889 - DNA, 22 bp, Homo sapiens
tatcagaagacttacagtatcg

SEQ ID NO: 7506890 - DNA, 22 bp, Homo sapiens
tatcagaagacttacagtatcg

SEQ ID NO: 7506891 - DNA, 22 bp, Homo sapiens
tatcacatcaatgttttaaaat

SEQ ID NO: 7506892 - DNA, 22 bp, Homo sapiens
tatcacatcaatgttttaaaat

SEQ ID NO: 7506893 - DNA, 22 bp, Homo sapiens
tatcacatcaatgttttaaaat

SEQ ID NO: 7506894 - DNA, 22 bp, Homo sapiens
tatcacatttggagatttatga

SEQ ID NO: 7506895 - DNA, 22 bp, Homo sapiens
tatcaccagagggatagtctct

SEQ ID NO: 7506896 - DNA, 22 bp, Homo sapiens
tatcacatttggagatttatga

SEQ ID NO: 7506897 - DNA, 22 bp, Homo sapiens
tatcacatttggagatttatga

SEQ ID NO: 7506898 - DNA, 22 bp, Homo sapiens
tatcactacacctggctaatta

SEQ ID NO: 7506899 - DNA, 22 bp, Homo sapiens
tatcactacacctggctaatta

SEQ ID NO: 7506900 - DNA, 22 bp, Homo sapiens
tatcacatagtgtttagtaaat

SEQ ID NO: 7506901 - DNA, 22 bp, Homo sapiens
tatcacatagtgtttagtaaat

SEQ ID NO: 7506902 - DNA, 22 bp, Homo sapiens
tatcacatacttctcatccagg

SEQ ID NO: 7506903 - DNA, 22 bp, Homo sapiens
tatcacaggtgtgatttacatt

SEQ ID NO: 7506904 - DNA, 21 bp, Homo sapiens
tatcacagtagaataggatct

SEQ ID NO: 7506905 - DNA, 22 bp, Homo sapiens
tatcagaagacttacagtatcg

SEQ ID NO: 7506906 - DNA, 22 bp, Homo sapiens
tatcagaagacttacagtatcg

SEQ ID NO: 7506907 - DNA, 22 bp, Homo sapiens
tatcagaagacttacagtatcg

SEQ ID NO: 7506908 - DNA, 22 bp, Homo sapiens
tatcagaacacatgttttgcag

SEQ ID NO: 7506909 - DNA, 22 bp, Homo sapiens
tatcagaaatgccttaaattgg

SEQ ID NO: 7506910 - DNA, 22 bp, Homo sapiens
tatcagaacacagccacagcca

SEQ ID NO: 7506911 - DNA, 22 bp, Homo sapiens
tatcagaaatgccttaaattgg

SEQ ID NO: 7506912 - DNA, 22 bp, Homo sapiens
tatcagaaatgccttaaattgg

SEQ ID NO: 7506913 - DNA, 22 bp, Homo sapiens
tatcagaaatcaacacacagtg

SEQ ID NO: 7506914 - DNA, 22 bp, Homo sapiens
tatcagaaatgccttaaattgg

SEQ ID NO: 7506915 - DNA, 22 bp, Homo sapiens
tatcagaaatgccttaaattgg

SEQ ID NO: 7506916 - DNA, 22 bp, Homo sapiens
tatcacttgcgttttggcagag

SEQ ID NO: 7506917 - DNA, 19 bp, Homo sapiens
tatcactgggcactgagga

SEQ ID NO: 7506918 - DNA, 22 bp, Homo sapiens
tatcagaaatcaacacacagtg

SEQ ID NO: 7506919 - DNA, 22 bp, Homo sapiens
tatcagaaatcaacacacagtg

SEQ ID NO: 7506920 - DNA, 22 bp, Homo sapiens
tatcagaaagatattactgggg

SEQ ID NO: 7506921 - DNA, 22 bp, Homo sapiens
tatcagaaactctggggcaggg

SEQ ID NO: 7506922 - DNA, 18 bp, Homo sapiens
tatcactgctgaacaaga

SEQ ID NO: 7506923 - DNA, 22 bp, Homo sapiens
tatcactgacctgtatcagttg

SEQ ID NO: 7506924 - DNA, 22 bp, Homo sapiens
tatcactacacttcagctttaa

SEQ ID NO: 7506925 - DNA, 22 bp, Homo sapiens
tatcactgacctgtatcagttg

SEQ ID NO: 7506926 - DNA, 22 bp, Homo sapiens
tataaaattctcagtttggggt

SEQ ID NO: 7506927 - DNA, 22 bp, Homo sapiens
tataaaattctcagtttggggt

SEQ ID NO: 7506928 - DNA, 22 bp, Homo sapiens
tataaaattctcagtttggggt

SEQ ID NO: 7506929 - DNA, 18 bp, Homo sapiens
tataaacacacttaggtt

SEQ ID NO: 7506930 - DNA, 22 bp, Homo sapiens
tataaaattctcagtttggggt

SEQ ID NO: 7506931 - DNA, 22 bp, Homo sapiens
tataaaattctcagtttggggt

SEQ ID NO: 7506932 - DNA, 22 bp, Homo sapiens
tataaaatggcatcagctccaa

SEQ ID NO: 7506933 - DNA, 22 bp, Homo sapiens
tataaaatggcatcagctccaa

SEQ ID NO: 7506934 - DNA, 22 bp, Homo sapiens
tataaaatggcatcagctccaa

SEQ ID NO: 7506935 - DNA, 22 bp, Homo sapiens
tataaaatggcatcagctccaa

SEQ ID NO: 7506936 - DNA, 22 bp, Homo sapiens
tataaaatggcatcagctccaa

SEQ ID NO: 7506937 - DNA, 22 bp, Homo sapiens
tataaaatggcatcagctccaa

SEQ ID NO: 7506938 - DNA, 22 bp, Homo sapiens
tataaaatggcatcagctccaa

SEQ ID NO: 7506939 - DNA, 22 bp, Homo sapiens
tataaaatggcatcagctccaa

SEQ ID NO: 7506940 - DNA, 22 bp, Homo sapiens
tataaaatggcatcagctccaa

SEQ ID NO: 7506941 - DNA, 22 bp, Homo sapiens
tataaaatggcatcagctccaa

SEQ ID NO: 7506942 - DNA, 22 bp, Homo sapiens
tagttttttcaacaaatggtgc

SEQ ID NO: 7506943 - DNA, 22 bp, Homo sapiens
tagttttttcaacaaatggtgc

SEQ ID NO: 7506944 - DNA, 22 bp, Homo sapiens
tataaagaaatgatttccagaa

SEQ ID NO: 7506945 - DNA, 22 bp, Homo sapiens
tataaagaaatgatttccagaa

SEQ ID NO: 7506946 - DNA, 22 bp, Homo sapiens
tataaactttaaccaggatgtc

SEQ ID NO: 7506947 - DNA, 22 bp, Homo sapiens
tataaagaaatgatttccagaa

SEQ ID NO: 7506948 - DNA, 22 bp, Homo sapiens
tataaactttaaccaggatgtc

SEQ ID NO: 7506949 - DNA, 22 bp, Homo sapiens
tataaacttaatggttccgaat

SEQ ID NO: 7506950 - DNA, 22 bp, Homo sapiens
tataaactttaaccaggatgtc

SEQ ID NO: 7506951 - DNA, 22 bp, Homo sapiens
tataaagaaatgatttccagaa

SEQ ID NO: 7506952 - DNA, 22 bp, Homo sapiens
tataaagaaggcacagcaagac

SEQ ID NO: 7506953 - DNA, 22 bp, Homo sapiens
tataaagaaggcacagcaagac

SEQ ID NO: 7506954 - DNA, 22 bp, Homo sapiens
tataaagaaggcacagcaagac

SEQ ID NO: 7506955 - DNA, 22 bp, Homo sapiens
tataaagaaggcacagcaagac

SEQ ID NO: 7506956 - DNA, 22 bp, Homo sapiens
tataaagaaggcacagcaagac

SEQ ID NO: 7506957 - DNA, 22 bp, Homo sapiens
tataaactcctcttgcattcct

SEQ ID NO: 7506958 - DNA, 22 bp, Homo sapiens
tataaactatatgttagccaga

SEQ ID NO: 7506959 - DNA, 22 bp, Homo sapiens
tataaactcctcttgcattcct

SEQ ID NO: 7506960 - DNA, 22 bp, Homo sapiens
tataaactcctcttgcattcct

SEQ ID NO: 7506961 - DNA, 18 bp, Homo sapiens
tataaacacacttaggtt

SEQ ID NO: 7506962 - DNA, 22 bp, Homo sapiens
tataaagctgactcatgaaact

SEQ ID NO: 7506963 - DNA, 22 bp, Homo sapiens
tataaagctgactcatgaaact

SEQ ID NO: 7506964 - DNA, 22 bp, Homo sapiens
tataaagtgtgaactgtgagta

SEQ ID NO: 7506965 - DNA, 22 bp, Homo sapiens
tataaagtgtgaactgtgagta

SEQ ID NO: 7506966 - DNA, 22 bp, Homo sapiens
tataaagtgtgaactgtgagta

SEQ ID NO: 7506967 - DNA, 22 bp, Homo sapiens
tataaagagtctcaaagaagtt

SEQ ID NO: 7506968 - DNA, 22 bp, Homo sapiens
tataaagagtctcaaagaagtt

SEQ ID NO: 7506969 - DNA, 22 bp, Homo sapiens
tataaagctgactcatgaaact

SEQ ID NO: 7506970 - DNA, 22 bp, Homo sapiens
tataaagttggggctgaagtaa

SEQ ID NO: 7506971 - DNA, 22 bp, Homo sapiens
tataaagttggggctgaagtaa

SEQ ID NO: 7506972 - DNA, 22 bp, Homo sapiens
tataaagttggggctgaagtaa

SEQ ID NO: 7506973 - DNA, 22 bp, Homo sapiens
tatcacaggtgtgatttacatt

SEQ ID NO: 7506974 - DNA, 22 bp, Homo sapiens
tatcacaggtgtgatttacatt

SEQ ID NO: 7506975 - DNA, 22 bp, Homo sapiens
tatcacaggtgtgatttacatt

SEQ ID NO: 7506976 - DNA, 22 bp, Homo sapiens
tataaagtttcgaaagatgtat

SEQ ID NO: 7506977 - DNA, 22 bp, Homo sapiens
tataaagtttcgaaagatgtat

SEQ ID NO: 7506978 - DNA, 22 bp, Homo sapiens
tataaagagtctcaaagaagtt

SEQ ID NO: 7506979 - DNA, 22 bp, Homo sapiens
tataaagagtctcaaagaagtt

SEQ ID NO: 7506980 - DNA, 22 bp, Homo sapiens
tataaagagtctcaaagaagtt

SEQ ID NO: 7506981 - DNA, 22 bp, Homo sapiens
tataaagagtctcaaagaagtt

SEQ ID NO: 7506982 - DNA, 22 bp, Homo sapiens
tataaagagtctcaaagaagtt

SEQ ID NO: 7506983 - DNA, 22 bp, Homo sapiens
tataaagagtctcaaagaagtt

SEQ ID NO: 7506984 - DNA, 22 bp, Homo sapiens
tataaagagtctcaaagaagtt

SEQ ID NO: 7506985 - DNA, 22 bp, Homo sapiens
tataaagagtctatctggtggc

SEQ ID NO: 7506986 - DNA, 22 bp, Homo sapiens
tataaagagtctatctggtggc

SEQ ID NO: 7506987 - DNA, 22 bp, Homo sapiens
tataaagagtctatctggtggc

SEQ ID NO: 7506988 - DNA, 22 bp, Homo sapiens
tataaagaatccagaagagaca

SEQ ID NO: 7506989 - DNA, 22 bp, Homo sapiens
tataaagaatccagaagagaca

SEQ ID NO: 7506990 - DNA, 22 bp, Homo sapiens
tataaagaagtgtaaacaggaa

SEQ ID NO: 7506991 - DNA, 22 bp, Homo sapiens
tataaagaagtgtaaacaggaa

SEQ ID NO: 7506992 - DNA, 22 bp, Homo sapiens
tataaagaagtgtaaacaggaa

SEQ ID NO: 7506993 - DNA, 22 bp, Homo sapiens
tataaagaagtgtaaacaggaa

SEQ ID NO: 7506994 - DNA, 22 bp, Homo sapiens
tataaagaagtgtaaacaggaa

SEQ ID NO: 7506995 - DNA, 22 bp, Homo sapiens
tataaagaaggcacagcaagac

SEQ ID NO: 7506996 - DNA, 22 bp, Homo sapiens
tataaagaaggcacagcaagac

SEQ ID NO: 7506997 - DNA, 22 bp, Homo sapiens
tatgaaattgccatttttatgg

SEQ ID NO: 7506998 - DNA, 22 bp, Homo sapiens
tatgaaattgccatttttatgg

SEQ ID NO: 7506999 - DNA, 22 bp, Homo sapiens
tatgaaatggtagtaggaaggg

SEQ ID NO: 7507000 - DNA, 22 bp, Homo sapiens
tatgaaatggtagtaggaaggg

SEQ ID NO: 7507001 - DNA, 22 bp, Homo sapiens
tatgaaattgccatttttatgg

SEQ ID NO: 7507002 - DNA, 22 bp, Homo sapiens
tatgaaattgccatttttatgg

SEQ ID NO: 7507003 - DNA, 22 bp, Homo sapiens
tatgaaattgccatttttatgg

SEQ ID NO: 7507004 - DNA, 22 bp, Homo sapiens
tatgaaattgccatttttatgg

SEQ ID NO: 7507005 - DNA, 22 bp, Homo sapiens
tatgaaattgccatttttatgg

SEQ ID NO: 7507006 - DNA, 22 bp, Homo sapiens
tatgaaatgatggggaaaatag

SEQ ID NO: 7507007 - DNA, 22 bp, Homo sapiens
tatgaaagcaatcattatgtac

SEQ ID NO: 7507008 - DNA, 18 bp, Homo sapiens
tatgaaagtccactctca

SEQ ID NO: 7507009 - DNA, 22 bp, Homo sapiens
tatgaaatgatggggaaaatag

SEQ ID NO: 7507010 - DNA, 22 bp, Homo sapiens
tatgaaatgatggggaaaatag

SEQ ID NO: 7507011 - DNA, 22 bp, Homo sapiens
tatgaaatgatggggaaaatag

SEQ ID NO: 7507012 - DNA, 22 bp, Homo sapiens
tatgaaatggtagtaggaaggg

SEQ ID NO: 7507013 - DNA, 22 bp, Homo sapiens
tatgaaatggtagtaggaaggg

SEQ ID NO: 7507014 - DNA, 22 bp, Homo sapiens
tatgaaatgatggggaaaatag

SEQ ID NO: 7507015 - DNA, 22 bp, Homo sapiens
tatgaaatgatggggaaaatag

SEQ ID NO: 7507016 - DNA, 22 bp, Homo sapiens
tatgaaatgatggggaaaatag

SEQ ID NO: 7507017 - DNA, 22 bp, Homo sapiens
tatgaaatttaaacacagatca

SEQ ID NO: 7507018 - DNA, 22 bp, Homo sapiens
tatgaaatttaaacacagatca

SEQ ID NO: 7507019 - DNA, 22 bp, Homo sapiens
tatgaaatttaaacacagatca

SEQ ID NO: 7507020 - DNA, 22 bp, Homo sapiens
tatgaaatttaaacacagatca

SEQ ID NO: 7507021 - DNA, 22 bp, Homo sapiens
tatgaaatttaaacacagatca

SEQ ID NO: 7507022 - DNA, 22 bp, Homo sapiens
tatgaaatttaaacacagatca

SEQ ID NO: 7507023 - DNA, 22 bp, Homo sapiens
tatgaaatttaaacacagatca

SEQ ID NO: 7507024 - DNA, 22 bp, Homo sapiens
tatgaaatttaaacacagatca

SEQ ID NO: 7507025 - DNA, 22 bp, Homo sapiens
tatgaaatttctagttctgctt

SEQ ID NO: 7507026 - DNA, 22 bp, Homo sapiens
tatgaaatttctagttctgctt

SEQ ID NO: 7507027 - DNA, 22 bp, Homo sapiens
tatgaacacactttggaagtga

SEQ ID NO: 7507028 - DNA, 22 bp, Homo sapiens
tatgaacacactttggaagtga

SEQ ID NO: 7507029 - DNA, 22 bp, Homo sapiens
tatgaaatttctagttctgctt

SEQ ID NO: 7507030 - DNA, 20 bp, Homo sapiens
tatgaagatatgtgaacagc

SEQ ID NO: 7507031 - DNA, 22 bp, Homo sapiens
tatgaacacactttggaagtga

SEQ ID NO: 7507032 - DNA, 22 bp, Homo sapiens
tatgaagattgcggtctggaat

SEQ ID NO: 7507033 - DNA, 22 bp, Homo sapiens
tatgacaaggtggagtatgagt

SEQ ID NO: 7507034 - DNA, 22 bp, Homo sapiens
tatgacaaggtggagtatgagt

SEQ ID NO: 7507035 - DNA, 20 bp, Homo sapiens
tatgacaacgcagcaaggca

SEQ ID NO: 7507036 - DNA, 20 bp, Homo sapiens
tatgacaacgcagcaaggca

SEQ ID NO: 7507037 - DNA, 22 bp, Homo sapiens
tatgacaagaaatacagaggta

SEQ ID NO: 7507038 - DNA, 20 bp, Homo sapiens
tatgacaacgcagcaaggca

SEQ ID NO: 7507039 - DNA, 22 bp, Homo sapiens
tatgacaagaaatacagaggta

SEQ ID NO: 7507040 - DNA, 22 bp, Homo sapiens
tatgaattctgttcattgatga

SEQ ID NO: 7507041 - DNA, 22 bp, Homo sapiens
tatgacaaagagaggcccatgc

SEQ ID NO: 7507042 - DNA, 22 bp, Homo sapiens
tatgacaaagagaggcccatgc

SEQ ID NO: 7507043 - DNA, 22 bp, Homo sapiens
tatgacaaatgatatatttggc

SEQ ID NO: 7507044 - DNA, 22 bp, Homo sapiens
tatgacaaatgatatatttggc

SEQ ID NO: 7507045 - DNA, 22 bp, Homo sapiens
tatgacaaatgatatatttggc

SEQ ID NO: 7507046 - DNA, 22 bp, Homo sapiens
tatgaattctgttcattgatga

SEQ ID NO: 7507047 - DNA, 22 bp, Homo sapiens
tatgaattctgttcattgatga

SEQ ID NO: 7507048 - DNA, 20 bp, Homo sapiens
tatgaattctggtccctggg

SEQ ID NO: 7507049 - DNA, 20 bp, Homo sapiens
tatgaattctggtccctggg

SEQ ID NO: 7507050 - DNA, 22 bp, Homo sapiens
tatgaattctcttgtgtatagt

SEQ ID NO: 7507051 - DNA, 22 bp, Homo sapiens
tatgaagtagagcagagatgcc

SEQ ID NO: 7507052 - DNA, 22 bp, Homo sapiens
tatgaagtctctgatgttgagt

SEQ ID NO: 7507053 - DNA, 22 bp, Homo sapiens
tatgaagtctctgatgttgagt

SEQ ID NO: 7507054 - DNA, 22 bp, Homo sapiens
tatgaagtgagttatggttgct

SEQ ID NO: 7507055 - DNA, 22 bp, Homo sapiens
tatgaagtggtagagagtggtg

SEQ ID NO: 7507056 - DNA, 22 bp, Homo sapiens
tatgaagctttgaaaagcttac

SEQ ID NO: 7507057 - DNA, 22 bp, Homo sapiens
tatgaagctttgaaaagcttac

SEQ ID NO: 7507058 - DNA, 22 bp, Homo sapiens
tatgaagctgataatcactgat

SEQ ID NO: 7507059 - DNA, 22 bp, Homo sapiens
tatgaagattgcggtctggaat

SEQ ID NO: 7507060 - DNA, 22 bp, Homo sapiens
tatgaagattgcggtctggaat

SEQ ID NO: 7507061 - DNA, 22 bp, Homo sapiens
tatgaagctctcactgtgtgtc

SEQ ID NO: 7507062 - DNA, 19 bp, Homo sapiens
tatgaagttgataaaagtt

SEQ ID NO: 7507063 - DNA, 20 bp, Homo sapiens
tatgaagtgttcttctggta

SEQ ID NO: 7507064 - DNA, 22 bp, Homo sapiens
tatgaagtgtctgttgtatctg

SEQ ID NO: 7507065 - DNA, 22 bp, Homo sapiens
tatgaatataccacaatttagg

SEQ ID NO: 7507066 - DNA, 22 bp, Homo sapiens
tatgaatataccacaatttagg

SEQ ID NO: 7507067 - DNA, 22 bp, Homo sapiens
tatgaatataccacaatttagg

SEQ ID NO: 7507068 - DNA, 22 bp, Homo sapiens
tatgaatataccacaatttagg

SEQ ID NO: 7507069 - DNA, 22 bp, Homo sapiens
tatgaatataccacaatttagg

SEQ ID NO: 7507070 - DNA, 22 bp, Homo sapiens
tatgaatggctcatggtgagtg

SEQ ID NO: 7507071 - DNA, 22 bp, Homo sapiens
tatgaatgctccagtaactttc

SEQ ID NO: 7507072 - DNA, 22 bp, Homo sapiens
tatgaatgctccagtaactttc

SEQ ID NO: 7507073 - DNA, 22 bp, Homo sapiens
tatgaatgctccagtaactttc

SEQ ID NO: 7507074 - DNA, 22 bp, Homo sapiens
tatgaatataccacaatttagg

SEQ ID NO: 7507075 - DNA, 22 bp, Homo sapiens
tatgaatgatgcagcctggagt

SEQ ID NO: 7507076 - DNA, 22 bp, Homo sapiens
tatgaatataccacaatttagg

SEQ ID NO: 7507077 - DNA, 22 bp, Homo sapiens
tatgaatataccacaatttagg

SEQ ID NO: 7507078 - DNA, 22 bp, Homo sapiens
tatgaatataccacaatttagg

SEQ ID NO: 7507079 - DNA, 22 bp, Homo sapiens
tatccaaaggaacaatcacagc

SEQ ID NO: 7507080 - DNA, 22 bp, Homo sapiens
tatccaaagtggcatattatag

SEQ ID NO: 7507081 - DNA, 22 bp, Homo sapiens
tatccaaagtggcatattatag

SEQ ID NO: 7507082 - DNA, 22 bp, Homo sapiens
tatccaaagtggcatattatag

SEQ ID NO: 7507083 - DNA, 22 bp, Homo sapiens
tatccaaaggaacaatcacagc

SEQ ID NO: 7507084 - DNA, 22 bp, Homo sapiens
tatccaaaggaacaatcacagc

SEQ ID NO: 7507085 - DNA, 22 bp, Homo sapiens
tatccaaagagattcatgttct

SEQ ID NO: 7507086 - DNA, 22 bp, Homo sapiens
tatccaaagagattcatgttct

SEQ ID NO: 7507087 - DNA, 22 bp, Homo sapiens
tatccaaagagattcatgttct

SEQ ID NO: 7507088 - DNA, 22 bp, Homo sapiens
tatccaaacatatagtctctct

SEQ ID NO: 7507089 - DNA, 22 bp, Homo sapiens
tatcattttactgtgacatttt

SEQ ID NO: 7507090 - DNA, 22 bp, Homo sapiens
tatcattttactgtgacatttt

SEQ ID NO: 7507091 - DNA, 22 bp, Homo sapiens
tatcattttactgtgacatttt

SEQ ID NO: 7507092 - DNA, 22 bp, Homo sapiens
tatcattttactgtgacatttt

SEQ ID NO: 7507093 - DNA, 22 bp, Homo sapiens
tatcattttactgtgacatttt

SEQ ID NO: 7507094 - DNA, 22 bp, Homo sapiens
tatcattttactgtgacatttt

SEQ ID NO: 7507095 - DNA, 22 bp, Homo sapiens
tatcattttactgtgacatttt

SEQ ID NO: 7507096 - DNA, 22 bp, Homo sapiens
tatcattttactgtgacatttt

SEQ ID NO: 7507097 - DNA, 22 bp, Homo sapiens
tatcatttgttattattagtgg

SEQ ID NO: 7507098 - DNA, 22 bp, Homo sapiens
tatcatttgttattattagtgg

SEQ ID NO: 7507099 - DNA, 22 bp, Homo sapiens
tatcatttgttattattagtgg

SEQ ID NO: 7507100 - DNA, 23 bp, Homo sapiens
tatcatttcagctctctgcctgg

SEQ ID NO: 7507101 - DNA, 23 bp, Homo sapiens
tatcatttcagctctctgcctgg

SEQ ID NO: 7507102 - DNA, 23 bp, Homo sapiens
tatcatttcagctctctgcctgg

SEQ ID NO: 7507103 - DNA, 22 bp, Homo sapiens
tatcatttgttattattagtgg

SEQ ID NO: 7507104 - DNA, 22 bp, Homo sapiens
tatcatttgttattattagtgg

SEQ ID NO: 7507105 - DNA, 22 bp, Homo sapiens
tatcatttgttattattagtgg

SEQ ID NO: 7507106 - DNA, 22 bp, Homo sapiens
tatcatttagagtatttcttca

SEQ ID NO: 7507107 - DNA, 22 bp, Homo sapiens
tatcatttagagtatttcttca

SEQ ID NO: 7507108 - DNA, 22 bp, Homo sapiens
tatcatttagagtatttcttca

SEQ ID NO: 7507109 - DNA, 22 bp, Homo sapiens
tatcaggaattgaatggcttca

SEQ ID NO: 7507110 - DNA, 22 bp, Homo sapiens
tatcaggaattgaatggcttca

SEQ ID NO: 7507111 - DNA, 22 bp, Homo sapiens
tatcaggaattgaatggcttca

SEQ ID NO: 7507112 - DNA, 23 bp, Homo sapiens
tatcatttcagctctctgcctgg

SEQ ID NO: 7507113 - DNA, 22 bp, Homo sapiens
tatcatttagagtatttcttca

SEQ ID NO: 7507114 - DNA, 22 bp, Homo sapiens
tatcatttagagtatttcttca

SEQ ID NO: 7507115 - DNA, 22 bp, Homo sapiens
tatcatttagagtatttcttca

SEQ ID NO: 7507116 - DNA, 22 bp, Homo sapiens
tatcagccactggttctatgat

SEQ ID NO: 7507117 - DNA, 22 bp, Homo sapiens
tatcttttgagttctcaagatg

SEQ ID NO: 7507118 - DNA, 22 bp, Homo sapiens
tatcttttgagttctcaagatg

SEQ ID NO: 7507119 - DNA, 22 bp, Homo sapiens
tatcttttgagttctcaagatg

SEQ ID NO: 7507120 - DNA, 22 bp, Homo sapiens
tatcttttgagttctcaagatg

SEQ ID NO: 7507121 - DNA, 22 bp, Homo sapiens
tatctttgtgtcccttttgatg

SEQ ID NO: 7507122 - DNA, 22 bp, Homo sapiens
tatctttgtgtcccttttgatg

SEQ ID NO: 7507123 - DNA, 18 bp, Homo sapiens
tatcttttccagtggtat

SEQ ID NO: 7507124 - DNA, 18 bp, Homo sapiens
tatcttttccagtggtat

SEQ ID NO: 7507125 - DNA, 18 bp, Homo sapiens
tatcttttccagtggtat

SEQ ID NO: 7507126 - DNA, 22 bp, Homo sapiens
tatgaaaaggtggccaatgtag

SEQ ID NO: 7507127 - DNA, 22 bp, Homo sapiens
tatgaaaaggtggccaatgtag

SEQ ID NO: 7507128 - DNA, 22 bp, Homo sapiens
tatgaaaaggtggccaatgtag

SEQ ID NO: 7507129 - DNA, 22 bp, Homo sapiens
tatcttttgagttctcaagatg

SEQ ID NO: 7507130 - DNA, 23 bp, Homo sapiens
tatctttttcaatgttggaaata

SEQ ID NO: 7507131 - DNA, 23 bp, Homo sapiens
tatctttttcaatgttggaaata

SEQ ID NO: 7507132 - DNA, 23 bp, Homo sapiens
tatctttttcaatgttggaaata

SEQ ID NO: 7507133 - DNA, 23 bp, Homo sapiens
tatctttttcaatgttggaaata

SEQ ID NO: 7507134 - DNA, 23 bp, Homo sapiens
tatctttttcaatgttggaaata

SEQ ID NO: 7507135 - DNA, 22 bp, Homo sapiens
tatgaaaatttagctgaagcat

SEQ ID NO: 7507136 - DNA, 22 bp, Homo sapiens
tatgaaaatttagctgaagcat

SEQ ID NO: 7507137 - DNA, 22 bp, Homo sapiens
tatgaaaatttagctgaagcat

SEQ ID NO: 7507138 - DNA, 22 bp, Homo sapiens
tatgaaagcaatcattatgtac

SEQ ID NO: 7507139 - DNA, 22 bp, Homo sapiens
tatgaaagcaatcattatgtac

SEQ ID NO: 7507140 - DNA, 22 bp, Homo sapiens
tatgaaacattcatacaaataa

SEQ ID NO: 7507141 - DNA, 22 bp, Homo sapiens
tatgaaagaatctcagagcaca

SEQ ID NO: 7507142 - DNA, 22 bp, Homo sapiens
tatgaaagaatctcagagcaca

SEQ ID NO: 7507143 - DNA, 22 bp, Homo sapiens
tatgaaaaggtggccaatgtag

SEQ ID NO: 7507144 - DNA, 22 bp, Homo sapiens
tatgaaaaggtggccaatgtag

SEQ ID NO: 7507145 - DNA, 22 bp, Homo sapiens
tatgaaaatttagctgaagcat

SEQ ID NO: 7507146 - DNA, 22 bp, Homo sapiens
tatgaaaatttagctgaagcat

SEQ ID NO: 7507147 - DNA, 22 bp, Homo sapiens
tatgaaaatttagctgaagcat

SEQ ID NO: 7507148 - DNA, 22 bp, Homo sapiens
tatgaaaatttagctgaagcat

SEQ ID NO: 7507149 - DNA, 22 bp, Homo sapiens
tatgaaaatttagctgaagcat

SEQ ID NO: 7507150 - DNA, 22 bp, Homo sapiens
tatgtatagagtcttttaaatt

SEQ ID NO: 7507151 - DNA, 22 bp, Homo sapiens
tatgtataatcacagagtgtca

SEQ ID NO: 7507152 - DNA, 22 bp, Homo sapiens
tatgtatagagtcttttaaatt

SEQ ID NO: 7507153 - DNA, 22 bp, Homo sapiens
tatgtatagagtcttttaaatt

SEQ ID NO: 7507154 - DNA, 22 bp, Homo sapiens
tatgtatagagtcttttaaatt

SEQ ID NO: 7507155 - DNA, 22 bp, Homo sapiens
tatgtatagagtcttttaaatt

SEQ ID NO: 7507156 - DNA, 22 bp, Homo sapiens
tatgtatagagtcttttaaatt

SEQ ID NO: 7507157 - DNA, 22 bp, Homo sapiens
tatgtatataggtgtgtgtctc

SEQ ID NO: 7507158 - DNA, 22 bp, Homo sapiens
tatgtatataggtgtgtgtctc

SEQ ID NO: 7507159 - DNA, 22 bp, Homo sapiens
tatgtataatcacagagtgtca

SEQ ID NO: 7507160 - DNA, 22 bp, Homo sapiens
tatgtataaatgcatgtgtgga

SEQ ID NO: 7507161 - DNA, 18 bp, Homo sapiens
tatgtataacatagttca

SEQ ID NO: 7507162 - DNA, 22 bp, Homo sapiens
tatgtataaatgcatgtgtgga

SEQ ID NO: 7507163 - DNA, 22 bp, Homo sapiens
tatgtagcaatagcatcatact

SEQ ID NO: 7507164 - DNA, 22 bp, Homo sapiens
tatgtagatttctctgtttttc

SEQ ID NO: 7507165 - DNA, 22 bp, Homo sapiens
tatgtagatgtcatataaattg

SEQ ID NO: 7507166 - DNA, 22 bp, Homo sapiens
tatgtagatgtcatataaattg

SEQ ID NO: 7507167 - DNA, 22 bp, Homo sapiens
tatgtagatttctctgtttttc

SEQ ID NO: 7507168 - DNA, 22 bp, Homo sapiens
tatgtagagataaaatccaaat

SEQ ID NO: 7507169 - DNA, 22 bp, Homo sapiens
tatgtagacttcattgtttact

SEQ ID NO: 7507170 - DNA, 22 bp, Homo sapiens
tatgtagacttcattgtttact

SEQ ID NO: 7507171 - DNA, 22 bp, Homo sapiens
tatgtagtacttagtgcataca

SEQ ID NO: 7507172 - DNA, 22 bp, Homo sapiens
tatgtaggtaaacacagacata

SEQ ID NO: 7507173 - DNA, 22 bp, Homo sapiens
tatgtagcaatagcatcatact

SEQ ID NO: 7507174 - DNA, 22 bp, Homo sapiens
tatgtaggaaacatagggaaac

SEQ ID NO: 7507175 - DNA, 18 bp, Homo sapiens
tatgtagtatatgtgtat

SEQ ID NO: 7507176 - DNA, 22 bp, Homo sapiens
tatgtagtgttgagaatgcttg

SEQ ID NO: 7507177 - DNA, 22 bp, Homo sapiens
tatgtagtcaagtggatatatg

SEQ ID NO: 7507178 - DNA, 22 bp, Homo sapiens
tatgtagtacttagtgcataca

SEQ ID NO: 7507179 - DNA, 17 bp, Homo sapiens
tatgtagtacttataaa

SEQ ID NO: 7507180 - DNA, 17 bp, Homo sapiens
tatgtagtacttataaa

SEQ ID NO: 7507181 - DNA, 22 bp, Homo sapiens
tatgtatatggtagaagtatgt

SEQ ID NO: 7507182 - DNA, 22 bp, Homo sapiens
tatgtatccgtgtgtgtacaga

SEQ ID NO: 7507183 - DNA, 22 bp, Homo sapiens
tatgtatcatggacatgagact

SEQ ID NO: 7507184 - DNA, 22 bp, Homo sapiens
tatgtatccgtgtgtgtacaga

SEQ ID NO: 7507185 - DNA, 22 bp, Homo sapiens
tatgtatccgtgtgtgtacaga

SEQ ID NO: 7507186 - DNA, 22 bp, Homo sapiens
tatgtatcttttgttttccctg

SEQ ID NO: 7507187 - DNA, 20 bp, Homo sapiens
tatgtatgcctacatgctat

SEQ ID NO: 7507188 - DNA, 22 bp, Homo sapiens
tatgtatctggatacatcagtg

SEQ ID NO: 7507189 - DNA, 22 bp, Homo sapiens
tatgtatatgtgtgttgacaac

SEQ ID NO: 7507190 - DNA, 22 bp, Homo sapiens
tatgtatctgttcatcagttaa

SEQ ID NO: 7507191 - DNA, 22 bp, Homo sapiens
tatgtatctgttcatcagttaa

SEQ ID NO: 7507192 - DNA, 22 bp, Homo sapiens
tatgtatccgtgtgtgtacaga

SEQ ID NO: 7507193 - DNA, 22 bp, Homo sapiens
tatgtatatatgttgggtagaa

SEQ ID NO: 7507194 - DNA, 22 bp, Homo sapiens
tatgtatatggtagaagtatgt

SEQ ID NO: 7507195 - DNA, 22 bp, Homo sapiens
tatgtatatatgttgggtagaa

SEQ ID NO: 7507196 - DNA, 22 bp, Homo sapiens
tatgtatatgtatacacacaca

SEQ ID NO: 7507197 - DNA, 22 bp, Homo sapiens
tatgtatatgtatacacacaca

SEQ ID NO: 7507198 - DNA, 22 bp, Homo sapiens
tatgtattctgagtacaagttc

SEQ ID NO: 7507199 - DNA, 22 bp, Homo sapiens
tatgtattctgagtacaagttc

SEQ ID NO: 7507200 - DNA, 22 bp, Homo sapiens
tatgtattctgagtacaagttc

SEQ ID NO: 7507201 - DNA, 22 bp, Homo sapiens
tatgtattctcagatttactaa

SEQ ID NO: 7507202 - DNA, 22 bp, Homo sapiens
tatgtattctcagatttactaa

SEQ ID NO: 7507203 - DNA, 22 bp, Homo sapiens
tatgtcaaaaaagattatgttt

SEQ ID NO: 7507204 - DNA, 22 bp, Homo sapiens
tatgtattctgagtacaagttc

SEQ ID NO: 7507205 - DNA, 22 bp, Homo sapiens
tatgtattctgagtacaagttc

SEQ ID NO: 7507206 - DNA, 22 bp, Homo sapiens
tatgtcaaagttaagaaatagg

SEQ ID NO: 7507207 - DNA, 22 bp, Homo sapiens
tatgtcaaagttaagaaatagg

SEQ ID NO: 7507208 - DNA, 22 bp, Homo sapiens
tatgtcaaaaaagattatgttt

SEQ ID NO: 7507209 - DNA, 22 bp, Homo sapiens
tatgtattagagctccatgagg

SEQ ID NO: 7507210 - DNA, 22 bp, Homo sapiens
tatgtattagagctccatgagg

SEQ ID NO: 7507211 - DNA, 23 bp, Homo sapiens
tatgtatgtatgtttgtatggaa

SEQ ID NO: 7507212 - DNA, 23 bp, Homo sapiens
tatgtatgtatgtttgtatggaa

SEQ ID NO: 7507213 - DNA, 22 bp, Homo sapiens
tatgtattattcatcagtggga

SEQ ID NO: 7507214 - DNA, 22 bp, Homo sapiens
tatgtattagagctccatgagg

SEQ ID NO: 7507215 - DNA, 22 bp, Homo sapiens
tatgtattctcagatttactaa

SEQ ID NO: 7507216 - DNA, 22 bp, Homo sapiens
tatgtattctcagatttactaa

SEQ ID NO: 7507217 - DNA, 22 bp, Homo sapiens
tatgtattctcagatttactaa

SEQ ID NO: 7507218 - DNA, 22 bp, Homo sapiens
tatgtcaactgtgctggttaat

SEQ ID NO: 7507219 - DNA, 22 bp, Homo sapiens
tatgtcacattgtaacagtgtg

SEQ ID NO: 7507220 - DNA, 22 bp, Homo sapiens
tatgtcaactgtgctggttaat

SEQ ID NO: 7507221 - DNA, 22 bp, Homo sapiens
tatgtcacattgtaacagtgtg

SEQ ID NO: 7507222 - DNA, 22 bp, Homo sapiens
tatgtcatgggtcaaaatgaag

SEQ ID NO: 7507223 - DNA, 19 bp, Homo sapiens
tatgtccctttcccccatt

SEQ ID NO: 7507224 - DNA, 22 bp, Homo sapiens
tatgtcctaggcatttctctta

SEQ ID NO: 7507225 - DNA, 22 bp, Homo sapiens
tatgtcctaggcatttctctta

SEQ ID NO: 7507226 - DNA, 22 bp, Homo sapiens
tatgtttcatcaggcatggagt

SEQ ID NO: 7507227 - DNA, 22 bp, Homo sapiens
tatgtttcattcttttctggta

SEQ ID NO: 7507228 - DNA, 22 bp, Homo sapiens
tatgtttctgggcttgatattt

SEQ ID NO: 7507229 - DNA, 22 bp, Homo sapiens
tatgtttctgggcttgatattt

SEQ ID NO: 7507230 - DNA, 22 bp, Homo sapiens
tatgtttcctgagcttacacca

SEQ ID NO: 7507231 - DNA, 22 bp, Homo sapiens
tatgtttctgggcttgatattt

SEQ ID NO: 7507232 - DNA, 22 bp, Homo sapiens
tatgtttctgggcttgatattt

SEQ ID NO: 7507233 - DNA, 22 bp, Homo sapiens
tattaacatgaactgacttttc

SEQ ID NO: 7507234 - DNA, 22 bp, Homo sapiens
tattaacacgtataaagtgttt

SEQ ID NO: 7507235 - DNA, 22 bp, Homo sapiens
tattaacacgtataaagtgttt

SEQ ID NO: 7507236 - DNA, 22 bp, Homo sapiens
tattaacacgtataaagtgttt

SEQ ID NO: 7507237 - DNA, 22 bp, Homo sapiens
tattaaattatggatttaggag

SEQ ID NO: 7507238 - DNA, 22 bp, Homo sapiens
tattaaattatggatttaggag

SEQ ID NO: 7507239 - DNA, 22 bp, Homo sapiens
tattaaattatggatttaggag

SEQ ID NO: 7507240 - DNA, 22 bp, Homo sapiens
tattaaattatggatttaggag

SEQ ID NO: 7507241 - DNA, 22 bp, Homo sapiens
tatgtttcttccttttcataca

SEQ ID NO: 7507242 - DNA, 22 bp, Homo sapiens
tatgtttcttccttttcataca

SEQ ID NO: 7507243 - DNA, 22 bp, Homo sapiens
tatgtttcttccttttcataca

SEQ ID NO: 7507244 - DNA, 22 bp, Homo sapiens
tattaaattatggatttaggag

SEQ ID NO: 7507245 - DNA, 22 bp, Homo sapiens
tattaaattatggatttaggag

SEQ ID NO: 7507246 - DNA, 22 bp, Homo sapiens
tattaaattatggatttaggag

SEQ ID NO: 7507247 - DNA, 22 bp, Homo sapiens
tattaaattatggatttaggag

SEQ ID NO: 7507248 - DNA, 22 bp, Homo sapiens
tattaaattatggatttaggag

SEQ ID NO: 7507249 - DNA, 22 bp, Homo sapiens
tattaacattttatgaaaataa

SEQ ID NO: 7507250 - DNA, 22 bp, Homo sapiens
tattaacattttatgaaaataa

SEQ ID NO: 7507251 - DNA, 22 bp, Homo sapiens
tattaagagatgtatgaagaga

SEQ ID NO: 7507252 - DNA, 22 bp, Homo sapiens
tattaacatgaactgacttttc

SEQ ID NO: 7507253 - DNA, 22 bp, Homo sapiens
tattaacatgaactgacttttc

SEQ ID NO: 7507254 - DNA, 22 bp, Homo sapiens
tattaacatgaactgacttttc

SEQ ID NO: 7507255 - DNA, 22 bp, Homo sapiens
tattaacattttatgaaaataa

SEQ ID NO: 7507256 - DNA, 22 bp, Homo sapiens
tattaacatgaactgacttttc

SEQ ID NO: 7507257 - DNA, 22 bp, Homo sapiens
tattaagagatgtatgaagaga

SEQ ID NO: 7507258 - DNA, 22 bp, Homo sapiens
tattaagatacgtagttgtaaa

SEQ ID NO: 7507259 - DNA, 22 bp, Homo sapiens
tattaagatacgtagttgtaaa

SEQ ID NO: 7507260 - DNA, 22 bp, Homo sapiens
tattaataaatatgtaggggcc

SEQ ID NO: 7507261 - DNA, 22 bp, Homo sapiens
tattaataaatatgtaggggcc

SEQ ID NO: 7507262 - DNA, 22 bp, Homo sapiens
tattaataaatatgtaggggcc

SEQ ID NO: 7507263 - DNA, 22 bp, Homo sapiens
tattaataaatatgtaggggcc

SEQ ID NO: 7507264 - DNA, 22 bp, Homo sapiens
tattaataaatatgtaggggcc

SEQ ID NO: 7507265 - DNA, 22 bp, Homo sapiens
tattaagtatcttgatgacaaa

SEQ ID NO: 7507266 - DNA, 22 bp, Homo sapiens
tattaagtatcttgatgacaaa

SEQ ID NO: 7507267 - DNA, 21 bp, Homo sapiens
tattaatatgtctaagctgat

SEQ ID NO: 7507268 - DNA, 21 bp, Homo sapiens
tattaatatgtctaagctgat

SEQ ID NO: 7507269 - DNA, 22 bp, Homo sapiens
tattaataagtgactactagct

SEQ ID NO: 7507270 - DNA, 21 bp, Homo sapiens
tattaatatgtctaagctgat

SEQ ID NO: 7507271 - DNA, 21 bp, Homo sapiens
tattaatatgtctaagctgat

SEQ ID NO: 7507272 - DNA, 22 bp, Homo sapiens
tattaataagtgactactagct

SEQ ID NO: 7507273 - DNA, 22 bp, Homo sapiens
tattaataagtgactactagct

SEQ ID NO: 7507274 - DNA, 22 bp, Homo sapiens
tattaataagtgactactagct

SEQ ID NO: 7507275 - DNA, 22 bp, Homo sapiens
tattaataagtgactactagct

SEQ ID NO: 7507276 - DNA, 22 bp, Homo sapiens
tattaataagtgactactagct

SEQ ID NO: 7507277 - DNA, 22 bp, Homo sapiens
tattaatatgtgtgtgcatgta

SEQ ID NO: 7507278 - DNA, 22 bp, Homo sapiens
tattaatatgtgtgtgcatgta

SEQ ID NO: 7507279 - DNA, 21 bp, Homo sapiens
tattaatatgtctaagctgat

SEQ ID NO: 7507280 - DNA, 21 bp, Homo sapiens
tattaatatgtctaagctgat

SEQ ID NO: 7507281 - DNA, 22 bp, Homo sapiens
tattaatatgtgtgtgcatgta

SEQ ID NO: 7507282 - DNA, 22 bp, Homo sapiens
tattaatatgtgtgtgcatgta

SEQ ID NO: 7507283 - DNA, 22 bp, Homo sapiens
tattaatatgtgtgtgcatgta

SEQ ID NO: 7507284 - DNA, 22 bp, Homo sapiens
tattaattcttgccaattctcc

SEQ ID NO: 7507285 - DNA, 22 bp, Homo sapiens
tattaatatgtgtgtgcatgta

SEQ ID NO: 7507286 - DNA, 22 bp, Homo sapiens
tattaattcttgccaattctcc

SEQ ID NO: 7507287 - DNA, 22 bp, Homo sapiens
tattaattcttgccaattctcc

SEQ ID NO: 7507288 - DNA, 22 bp, Homo sapiens
tattaattcttgccaattctcc

SEQ ID NO: 7507289 - DNA, 22 bp, Homo sapiens
tattaattcttgccaattctcc

SEQ ID NO: 7507290 - DNA, 19 bp, Homo sapiens
tatgacaagtactagttct

SEQ ID NO: 7507291 - DNA, 19 bp, Homo sapiens
tatgacaagtactagttct

SEQ ID NO: 7507292 - DNA, 19 bp, Homo sapiens
tatgacaagtactagttct

SEQ ID NO: 7507293 - DNA, 22 bp, Homo sapiens
tatgctttaaccctcttatatt

SEQ ID NO: 7507294 - DNA, 22 bp, Homo sapiens
tatgctttaacattaaacaaca

SEQ ID NO: 7507295 - DNA, 22 bp, Homo sapiens
tatgctttaaccctcttatatt

SEQ ID NO: 7507296 - DNA, 22 bp, Homo sapiens
tatgctttaaccctcttatatt

SEQ ID NO: 7507297 - DNA, 22 bp, Homo sapiens
tatgctttaaccctcttatatt

SEQ ID NO: 7507298 - DNA, 22 bp, Homo sapiens
tatgctttaaccctcttatatt

SEQ ID NO: 7507299 - DNA, 22 bp, Homo sapiens
tatgctttaaccctcttatatt

SEQ ID NO: 7507300 - DNA, 22 bp, Homo sapiens
tatgctttcattcatatgtgag

SEQ ID NO: 7507301 - DNA, 22 bp, Homo sapiens
tatgctttcattcatatgtgag

SEQ ID NO: 7507302 - DNA, 22 bp, Homo sapiens
tatgctttgaaaatgtgctgaa

SEQ ID NO: 7507303 - DNA, 22 bp, Homo sapiens
tatgctttacttttcattgtga

SEQ ID NO: 7507304 - DNA, 22 bp, Homo sapiens
tatgctttacttttcattgtga

SEQ ID NO: 7507305 - DNA, 22 bp, Homo sapiens
tatgctttacttttcattgtga

SEQ ID NO: 7507306 - DNA, 22 bp, Homo sapiens
tatgctttgatttcctcagctg

SEQ ID NO: 7507307 - DNA, 22 bp, Homo sapiens
tatgctttgatttcctcagctg

SEQ ID NO: 7507308 - DNA, 22 bp, Homo sapiens
tatgctttgcaattggaaaagg

SEQ ID NO: 7507309 - DNA, 22 bp, Homo sapiens
tatgctttgcaattggaaaagg

SEQ ID NO: 7507310 - DNA, 22 bp, Homo sapiens
tatgctttgcaattggaaaagg

SEQ ID NO: 7507311 - DNA, 22 bp, Homo sapiens
tatgctttgcaattggaaaagg

SEQ ID NO: 7507312 - DNA, 22 bp, Homo sapiens
tatgcttttaacctgtaactga

SEQ ID NO: 7507313 - DNA, 22 bp, Homo sapiens
tatgctttggtagagagttgtg

SEQ ID NO: 7507314 - DNA, 22 bp, Homo sapiens
tatgctttggtagagagttgtg

SEQ ID NO: 7507315 - DNA, 22 bp, Homo sapiens
tatgcttttaacctgtaactga

SEQ ID NO: 7507316 - DNA, 22 bp, Homo sapiens
tatgcttttaacctgtaactga

SEQ ID NO: 7507317 - DNA, 22 bp, Homo sapiens
tatgcttttctcttggaatgtg

SEQ ID NO: 7507318 - DNA, 22 bp, Homo sapiens
tatgcttttctcttggaatgtg

SEQ ID NO: 7507319 - DNA, 17 bp, Homo sapiens
tatgcttttcttctcca

SEQ ID NO: 7507320 - DNA, 17 bp, Homo sapiens
tatgcttttcttctcca

SEQ ID NO: 7507321 - DNA, 20 bp, Homo sapiens
tatgctttttataagattga

SEQ ID NO: 7507322 - DNA, 20 bp, Homo sapiens
tatgctttttataagattga

SEQ ID NO: 7507323 - DNA, 20 bp, Homo sapiens
tatgctttttataagattga

SEQ ID NO: 7507324 - DNA, 20 bp, Homo sapiens
tatgctttttataagattga

SEQ ID NO: 7507325 - DNA, 17 bp, Homo sapiens
tatgcttttcttctcca

SEQ ID NO: 7507326 - DNA, 22 bp, Homo sapiens
tatggaaaaatgtatcttgtca

SEQ ID NO: 7507327 - DNA, 22 bp, Homo sapiens
tatggaaaaatgtatcttgtca

SEQ ID NO: 7507328 - DNA, 22 bp, Homo sapiens
tatggaaaaatgtatcttgtca

SEQ ID NO: 7507329 - DNA, 22 bp, Homo sapiens
tatggaaaaatgtatcttgtca

SEQ ID NO: 7507330 - DNA, 22 bp, Homo sapiens
tatggaaactaattcatttttc

SEQ ID NO: 7507331 - DNA, 22 bp, Homo sapiens
tatggaaactaattcatttttc

SEQ ID NO: 7507332 - DNA, 22 bp, Homo sapiens
tatggaaactaattcatttttc

SEQ ID NO: 7507333 - DNA, 22 bp, Homo sapiens
tatggaaaaatgtatcttgtca

SEQ ID NO: 7507334 - DNA, 22 bp, Homo sapiens
tatggaaagtgttttcttctgt

SEQ ID NO: 7507335 - DNA, 22 bp, Homo sapiens
tatggaaagggagtttaatttg

SEQ ID NO: 7507336 - DNA, 22 bp, Homo sapiens
tatggaaagtgttttcttctgt

SEQ ID NO: 7507337 - DNA, 22 bp, Homo sapiens
tatggaaagtgttttcttctgt

SEQ ID NO: 7507338 - DNA, 22 bp, Homo sapiens
tatggaaagtgttttcttctgt

SEQ ID NO: 7507339 - DNA, 22 bp, Homo sapiens
tatggaaagctctttttgattg

SEQ ID NO: 7507340 - DNA, 22 bp, Homo sapiens
tatggaaagctctttttgattg

SEQ ID NO: 7507341 - DNA, 22 bp, Homo sapiens
tatggaaagctctttttgattg

SEQ ID NO: 7507342 - DNA, 22 bp, Homo sapiens
tatggaaagctctttttgattg

SEQ ID NO: 7507343 - DNA, 22 bp, Homo sapiens
tatggaaagggagtttaatttg

SEQ ID NO: 7507344 - DNA, 22 bp, Homo sapiens
tatggcttcttttgcaactact

SEQ ID NO: 7507345 - DNA, 22 bp, Homo sapiens
tatggcttcttgtgttactgtg

SEQ ID NO: 7507346 - DNA, 22 bp, Homo sapiens
tatggcttctgggccaaattta

SEQ ID NO: 7507347 - DNA, 22 bp, Homo sapiens
tatggacatgagtcaaggtgct

SEQ ID NO: 7507348 - DNA, 20 bp, Homo sapiens
tatggcttgcagccaccctt

SEQ ID NO: 7507349 - DNA, 20 bp, Homo sapiens
tatggcttggcaaagcttca

SEQ ID NO: 7507350 - DNA, 22 bp, Homo sapiens
tatggcttgacttgcaccggca

SEQ ID NO: 7507351 - DNA, 22 bp, Homo sapiens
tatggcttgagtttcagactat

SEQ ID NO: 7507352 - DNA, 22 bp, Homo sapiens
tatggcttgagtttcagactat

SEQ ID NO: 7507353 - DNA, 22 bp, Homo sapiens
tatggaaataattagacaagtg

SEQ ID NO: 7507354 - DNA, 22 bp, Homo sapiens
tatggaaataattagacaagtg

SEQ ID NO: 7507355 - DNA, 22 bp, Homo sapiens
tatggaaataattagacaagtg

SEQ ID NO: 7507356 - DNA, 22 bp, Homo sapiens
tatggaaataattagacaagtg

SEQ ID NO: 7507357 - DNA, 22 bp, Homo sapiens
tatggaaataattagacaagtg

SEQ ID NO: 7507358 - DNA, 22 bp, Homo sapiens
tatggaatggctattttctagg

SEQ ID NO: 7507359 - DNA, 22 bp, Homo sapiens
tatggacatctgaagttgcaga

SEQ ID NO: 7507360 - DNA, 22 bp, Homo sapiens
tatggacatgagtcaaggtgct

SEQ ID NO: 7507361 - DNA, 22 bp, Homo sapiens
tatggaatggctattttctagg

SEQ ID NO: 7507362 - DNA, 22 bp, Homo sapiens
tatggaactgggtgaaggcacg

SEQ ID NO: 7507363 - DNA, 22 bp, Homo sapiens
tatggaacgctagaggaagaaa

SEQ ID NO: 7507364 - DNA, 22 bp, Homo sapiens
tatggaacgctagaggaagaaa

SEQ ID NO: 7507365 - DNA, 22 bp, Homo sapiens
tatgtaaaaattcatcaggctg

SEQ ID NO: 7507366 - DNA, 22 bp, Homo sapiens
tatgtaaagtagatggcaggta

SEQ ID NO: 7507367 - DNA, 22 bp, Homo sapiens
tatgtaaagtagatggcaggta

SEQ ID NO: 7507368 - DNA, 22 bp, Homo sapiens
tatgtaagtgagatcatggagt

SEQ ID NO: 7507369 - DNA, 22 bp, Homo sapiens
tatgtacaagcacacatgtgac

SEQ ID NO: 7507370 - DNA, 22 bp, Homo sapiens
tatgtacaagcacacatgtgac

SEQ ID NO: 7507371 - DNA, 22 bp, Homo sapiens
tatgtacaagcacacatgtgac

SEQ ID NO: 7507372 - DNA, 22 bp, Homo sapiens
tatgtacatacatgtgcatacg

SEQ ID NO: 7507373 - DNA, 22 bp, Homo sapiens
tatgtacaagcacacatgtgac

SEQ ID NO: 7507374 - DNA, 22 bp, Homo sapiens
tatgtacatacatgtgcatacg

SEQ ID NO: 7507375 - DNA, 22 bp, Homo sapiens
tatgtacatacatgtgcatacg

SEQ ID NO: 7507376 - DNA, 22 bp, Homo sapiens
tatgtactctaatttgtctcat

SEQ ID NO: 7507377 - DNA, 22 bp, Homo sapiens
tatgtactctaatttgtctcat

SEQ ID NO: 7507378 - DNA, 22 bp, Homo sapiens
tatgtactcatcaactattgaa

SEQ ID NO: 7507379 - DNA, 22 bp, Homo sapiens
tatgtactcatcaactattgaa

SEQ ID NO: 7507380 - DNA, 22 bp, Homo sapiens
tatgtagacaggctgcttttcc

SEQ ID NO: 7507381 - DNA, 22 bp, Homo sapiens
tatgtagacaggctgcttttcc

SEQ ID NO: 7507382 - DNA, 21 bp, Homo sapiens
tatgtagactcgttagaatgc

SEQ ID NO: 7507383 - DNA, 22 bp, Homo sapiens
tatgtactttcctgggaatgtt

SEQ ID NO: 7507384 - DNA, 22 bp, Homo sapiens
tatgtagaaaacaaaagttgaa

SEQ ID NO: 7507385 - DNA, 22 bp, Homo sapiens
tatgtagaagctgctcaaagaa

SEQ ID NO: 7507386 - DNA, 22 bp, Homo sapiens
tatgtacatatacacgtgtgtg

SEQ ID NO: 7507387 - DNA, 22 bp, Homo sapiens
tatgtacatatacacgtgtgtg

SEQ ID NO: 7507388 - DNA, 22 bp, Homo sapiens
tatgtacatacatgtgcatacg

SEQ ID NO: 7507389 - DNA, 22 bp, Homo sapiens
tatgtacatacatgtgcatacg

SEQ ID NO: 7507390 - DNA, 22 bp, Homo sapiens
tatgtacatacatgtgcatacg

SEQ ID NO: 7507391 - DNA, 22 bp, Homo sapiens
tatgtacatatacacgtgtgtg

SEQ ID NO: 7507392 - DNA, 22 bp, Homo sapiens
tatgtacatatacacgtgtgtg

SEQ ID NO: 7507393 - DNA, 22 bp, Homo sapiens
tatgtactacactagaacattt

SEQ ID NO: 7507394 - DNA, 22 bp, Homo sapiens
tatgtactacactagaacattt

SEQ ID NO: 7507395 - DNA, 22 bp, Homo sapiens
tatgggtctggaaaatggcttg

SEQ ID NO: 7507396 - DNA, 22 bp, Homo sapiens
tatgggtatctgtactgattgt

SEQ ID NO: 7507397 - DNA, 22 bp, Homo sapiens
tatgggtattattggtaagaat

SEQ ID NO: 7507398 - DNA, 22 bp, Homo sapiens
tatgggtaggcctgccgcctgt

SEQ ID NO: 7507399 - DNA, 22 bp, Homo sapiens
tatgggtagggtttgataagat

SEQ ID NO: 7507400 - DNA, 22 bp, Homo sapiens
tatgggtataaacaggtcctaa

SEQ ID NO: 7507401 - DNA, 22 bp, Homo sapiens
tatgggtatcaatgacaaacat

SEQ ID NO: 7507402 - DNA, 21 bp, Homo sapiens
tatggtaaccagacaagaatg

SEQ ID NO: 7507403 - DNA, 22 bp, Homo sapiens
tatgggtattttatacataacc

SEQ ID NO: 7507404 - DNA, 22 bp, Homo sapiens
tatgggtgttaatggtgagaga

SEQ ID NO: 7507405 - DNA, 22 bp, Homo sapiens
tatggtaaatgagcatatgttc

SEQ ID NO: 7507406 - DNA, 22 bp, Homo sapiens
tatggtaataatatgaaggtct

SEQ ID NO: 7507407 - DNA, 21 bp, Homo sapiens
tatggtaaccagacaagaatg

SEQ ID NO: 7507408 - DNA, 21 bp, Homo sapiens
tatggtaaccagacaagaatg

SEQ ID NO: 7507409 - DNA, 22 bp, Homo sapiens
tatggtagaaaaactgagtccc

SEQ ID NO: 7507410 - DNA, 22 bp, Homo sapiens
tatggtcaaagatatgaagccc

SEQ ID NO: 7507411 - DNA, 21 bp, Homo sapiens
tatggctttactaagctgcac

SEQ ID NO: 7507412 - DNA, 18 bp, Homo sapiens
tatggtactgggagcccc

SEQ ID NO: 7507413 - DNA, 22 bp, Homo sapiens
tatggcttttggcttctctctg

SEQ ID NO: 7507414 - DNA, 22 bp, Homo sapiens
tatggcttttctttcctagtgt

SEQ ID NO: 7507415 - DNA, 22 bp, Homo sapiens
tatggcttttcttcctccccca

SEQ ID NO: 7507416 - DNA, 22 bp, Homo sapiens
tatggcttttctttcctagtgt

SEQ ID NO: 7507417 - DNA, 22 bp, Homo sapiens
tatggcttttctttcctagtgt

SEQ ID NO: 7507418 - DNA, 22 bp, Homo sapiens
tatggctttttattcatcttac

SEQ ID NO: 7507419 - DNA, 22 bp, Homo sapiens
tatggctttttattcatcttac

SEQ ID NO: 7507420 - DNA, 22 bp, Homo sapiens
tatgggctgggtatgagctggt

SEQ ID NO: 7507421 - DNA, 22 bp, Homo sapiens
tatgggtaaagggctagggttt

SEQ ID NO: 7507422 - DNA, 22 bp, Homo sapiens
tatgggtaaataataattttag

SEQ ID NO: 7507423 - DNA, 22 bp, Homo sapiens
tatgggtaagatcttttgtatt

SEQ ID NO: 7507424 - DNA, 22 bp, Homo sapiens
tatgggtactttgatttagaaa

SEQ ID NO: 7507425 - DNA, 22 bp, Homo sapiens
tatgggtagaagtggcccaagc

SEQ ID NO: 7507426 - DNA, 22 bp, Homo sapiens
tatgggtagagatgggggttag

SEQ ID NO: 7507427 - DNA, 22 bp, Homo sapiens
tatggcttttaactgtcgtatg

SEQ ID NO: 7507428 - DNA, 22 bp, Homo sapiens
tatggctttgggccaaatctac

SEQ ID NO: 7507429 - DNA, 22 bp, Homo sapiens
tatggcttttcattcctatgtg

SEQ ID NO: 7507430 - DNA, 22 bp, Homo sapiens
tatggcttttcattcctatgtg

SEQ ID NO: 7507431 - DNA, 22 bp, Homo sapiens
tatggcttttaaggagatctga

SEQ ID NO: 7507432 - DNA, 22 bp, Homo sapiens
tatggcttttaaggagatctga

SEQ ID NO: 7507433 - DNA, 22 bp, Homo sapiens
tatggctttcaaaggaactcgg

SEQ ID NO: 7507434 - DNA, 22 bp, Homo sapiens
tatggctttcaaaggaactcgg

SEQ ID NO: 7507435 - DNA, 22 bp, Homo sapiens
tatggctttcaaaggaactcgg

SEQ ID NO: 7507436 - DNA, 22 bp, Homo sapiens
tatggctttgaaagggcttttc

SEQ ID NO: 7507437 - DNA, 22 bp, Homo sapiens
tatggctttctccatagggcag

SEQ ID NO: 7507438 - DNA, 22 bp, Homo sapiens
tatggctttaaacaacttaggt

SEQ ID NO: 7507439 - DNA, 22 bp, Homo sapiens
tatggctttaaacaacttaggt

SEQ ID NO: 7507440 - DNA, 22 bp, Homo sapiens
tatggcttgtggagagttgtag

SEQ ID NO: 7507441 - DNA, 22 bp, Homo sapiens
tatggcttgtctttataccagg

SEQ ID NO: 7507442 - DNA, 22 bp, Homo sapiens
tatggcttgtccctggtcagtc

SEQ ID NO: 7507443 - DNA, 22 bp, Homo sapiens
tatggctttaaattgaaggagt

SEQ ID NO: 7507444 - DNA, 22 bp, Homo sapiens
tatggctttaaattgaaggagt

SEQ ID NO: 7507445 - DNA, 22 bp, Homo sapiens
tatggctttaaacttttcattt

SEQ ID NO: 7507446 - DNA, 21 bp, Homo sapiens
tatggctttactaagctgcac

SEQ ID NO: 7507447 - DNA, 22 bp, Homo sapiens
tatggctttaaattgaaggagt

SEQ ID NO: 7507448 - DNA, 22 bp, Homo sapiens
tatttaactggaaacacaatga

SEQ ID NO: 7507449 - DNA, 22 bp, Homo sapiens
tatttaactggaaacacaatga

SEQ ID NO: 7507450 - DNA, 22 bp, Homo sapiens
tatttaactggaaacacaatga

SEQ ID NO: 7507451 - DNA, 22 bp, Homo sapiens
tatttaaccagttaaatttcca

SEQ ID NO: 7507452 - DNA, 22 bp, Homo sapiens
tatttaactggaaacacaatga

SEQ ID NO: 7507453 - DNA, 22 bp, Homo sapiens
tatttaactggaaacacaatga

SEQ ID NO: 7507454 - DNA, 22 bp, Homo sapiens
tatttaagatgtgtcataaaga

SEQ ID NO: 7507455 - DNA, 22 bp, Homo sapiens
tatttaagatgtgtcataaaga

SEQ ID NO: 7507456 - DNA, 22 bp, Homo sapiens
tatttaactggaaacacaatga

SEQ ID NO: 7507457 - DNA, 22 bp, Homo sapiens
tatttaagatgtgtcataaaga

SEQ ID NO: 7507458 - DNA, 22 bp, Homo sapiens
tatttaagatgtgtcataaaga

SEQ ID NO: 7507459 - DNA, 22 bp, Homo sapiens
tatttaataaaactatggcatg

SEQ ID NO: 7507460 - DNA, 22 bp, Homo sapiens
tatttaagatgtgtcataaaga

SEQ ID NO: 7507461 - DNA, 22 bp, Homo sapiens
tatttaataaaactatggcatg

SEQ ID NO: 7507462 - DNA, 22 bp, Homo sapiens
tatttaataaaactatggcatg

SEQ ID NO: 7507463 - DNA, 22 bp, Homo sapiens
tatttaataaaactatggcatg

SEQ ID NO: 7507464 - DNA, 22 bp, Homo sapiens
tatttaataaaactatggcatg

SEQ ID NO: 7507465 - DNA, 22 bp, Homo sapiens
tatttaaccagttaaatttcca

SEQ ID NO: 7507466 - DNA, 22 bp, Homo sapiens
tatttaaaatagtgctccagca

SEQ ID NO: 7507467 - DNA, 22 bp, Homo sapiens
tatttaaaatagtgctccagca

SEQ ID NO: 7507468 - DNA, 22 bp, Homo sapiens
tatttaaaatagtgctccagca

SEQ ID NO: 7507469 - DNA, 22 bp, Homo sapiens
tatttaaaatagtgctccagca

SEQ ID NO: 7507470 - DNA, 22 bp, Homo sapiens
tatttaaaatagtgctccagca

SEQ ID NO: 7507471 - DNA, 22 bp, Homo sapiens
tatttaaaatagtgctccagca

SEQ ID NO: 7507472 - DNA, 22 bp, Homo sapiens
tatttaaaatagtgctccagca

SEQ ID NO: 7507473 - DNA, 22 bp, Homo sapiens
tatttaaaatagtgctccagca

SEQ ID NO: 7507474 - DNA, 22 bp, Homo sapiens
tatttaaaataagccccagtgg

SEQ ID NO: 7507475 - DNA, 22 bp, Homo sapiens
tatttaaaataagccccagtgg

SEQ ID NO: 7507476 - DNA, 22 bp, Homo sapiens
tatttaaaataagccccagtgg

SEQ ID NO: 7507477 - DNA, 22 bp, Homo sapiens
tatttaaaataagccccagtgg

SEQ ID NO: 7507478 - DNA, 22 bp, Homo sapiens
tatttaaaataagccccagtgg

SEQ ID NO: 7507479 - DNA, 22 bp, Homo sapiens
tatttaaaaagaggccagctgg

SEQ ID NO: 7507480 - DNA, 22 bp, Homo sapiens
tatttaaaaagaggccagctgg

SEQ ID NO: 7507481 - DNA, 22 bp, Homo sapiens
tatttaaaaagaggccagctgg

SEQ ID NO: 7507482 - DNA, 22 bp, Homo sapiens
tatttaaaataagccccagtgg

SEQ ID NO: 7507483 - DNA, 22 bp, Homo sapiens
tatttaaaataagccccagtgg

SEQ ID NO: 7507484 - DNA, 22 bp, Homo sapiens
tatttaaaataagccccagtgg

SEQ ID NO: 7507485 - DNA, 22 bp, Homo sapiens
tattgtcttcaactctactttt

SEQ ID NO: 7507486 - DNA, 22 bp, Homo sapiens
tattgtgaagggaaaaatagtg

SEQ ID NO: 7507487 - DNA, 22 bp, Homo sapiens
tattgtgaagggaaaaatagtg

SEQ ID NO: 7507488 - DNA, 22 bp, Homo sapiens
tattgtgaagggaaaaatagtg

SEQ ID NO: 7507489 - DNA, 22 bp, Homo sapiens
tattgtgaagggaaaaatagtg

SEQ ID NO: 7507490 - DNA, 22 bp, Homo sapiens
tattgtgaataatgccgcaata

SEQ ID NO: 7507491 - DNA, 22 bp, Homo sapiens
tattgtgagtataactgcattt

SEQ ID NO: 7507492 - DNA, 22 bp, Homo sapiens
tattgtgagggcaaagtttcta

SEQ ID NO: 7507493 - DNA, 22 bp, Homo sapiens
tattgtgacttttactgagtaa

SEQ ID NO: 7507494 - DNA, 22 bp, Homo sapiens
tattgtgaatttggaagcaatg

SEQ ID NO: 7507495 - DNA, 22 bp, Homo sapiens
tattgtgaatagtgccgcaata

SEQ ID NO: 7507496 - DNA, 22 bp, Homo sapiens
tattgtgccaggtaatgtgttc

SEQ ID NO: 7507497 - DNA, 22 bp, Homo sapiens
tattgtgccaggtaatgtgttc

SEQ ID NO: 7507498 - DNA, 22 bp, Homo sapiens
tattgtgcatgttgaataacta

SEQ ID NO: 7507499 - DNA, 22 bp, Homo sapiens
tattgtgcacccttgcgttctg

SEQ ID NO: 7507500 - DNA, 22 bp, Homo sapiens
tattgtgatgaacacaaggctt

SEQ ID NO: 7507501 - DNA, 20 bp, Homo sapiens
tattgtgataggtgttaatc

SEQ ID NO: 7507502 - DNA, 20 bp, Homo sapiens
tattgtgataggtgttaatc

SEQ ID NO: 7507503 - DNA, 22 bp, Homo sapiens
tattgtgagttcagactaaaaa

SEQ ID NO: 7507504 - DNA, 22 bp, Homo sapiens
tattgtgagtataactgcattt

SEQ ID NO: 7507505 - DNA, 22 bp, Homo sapiens
tattgtgagtataactgcattt

SEQ ID NO: 7507506 - DNA, 20 bp, Homo sapiens
tattgtgataggtgttaatc

SEQ ID NO: 7507507 - DNA, 22 bp, Homo sapiens
tattgtgcttctgttgtgcaat

SEQ ID NO: 7507508 - DNA, 22 bp, Homo sapiens
tattgtgctcaccattacatcc

SEQ ID NO: 7507509 - DNA, 22 bp, Homo sapiens
tattgtgctcaccattacatcc

SEQ ID NO: 7507510 - DNA, 22 bp, Homo sapiens
tattgtgcccctcccaggaaca

SEQ ID NO: 7507511 - DNA, 22 bp, Homo sapiens
tattgttcttcactggtcttat

SEQ ID NO: 7507512 - DNA, 22 bp, Homo sapiens
tattgtttctggctgtggcagc

SEQ ID NO: 7507513 - DNA, 22 bp, Homo sapiens
tatttaaaaagaggccagctgg

SEQ ID NO: 7507514 - DNA, 22 bp, Homo sapiens
tatttaaaaagaggccagctgg

SEQ ID NO: 7507515 - DNA, 22 bp, Homo sapiens
tatttaaaaagaggccagctgg

SEQ ID NO: 7507516 - DNA, 22 bp, Homo sapiens
tatttaaaaagaggccagctgg

SEQ ID NO: 7507517 - DNA, 22 bp, Homo sapiens
tatttaaaaagaggccagctgg

SEQ ID NO: 7507518 - DNA, 22 bp, Homo sapiens
tatttaaaaagaggccagctgg

SEQ ID NO: 7507519 - DNA, 22 bp, Homo sapiens
tatttaaaaagaggccagctgg

SEQ ID NO: 7507520 - DNA, 22 bp, Homo sapiens
tatttaaaaagaggccagctgg

SEQ ID NO: 7507521 - DNA, 22 bp, Homo sapiens
tatttaaaaagaggccagctgg

SEQ ID NO: 7507522 - DNA, 22 bp, Homo sapiens
tattgtatcttctgtttagaag

SEQ ID NO: 7507523 - DNA, 22 bp, Homo sapiens
tattgtatcttctgtttagaag

SEQ ID NO: 7507524 - DNA, 22 bp, Homo sapiens
tattgtatcttctgtttagaag

SEQ ID NO: 7507525 - DNA, 22 bp, Homo sapiens
tattgtatcttctgtttagaag

SEQ ID NO: 7507526 - DNA, 22 bp, Homo sapiens
tattgtcaagaagtttatagtg

SEQ ID NO: 7507527 - DNA, 21 bp, Homo sapiens
tattgtcaatctgctttcaga

SEQ ID NO: 7507528 - DNA, 22 bp, Homo sapiens
tattgtcaagaagtttatagtg

SEQ ID NO: 7507529 - DNA, 22 bp, Homo sapiens
tattgtcacgtcttaattctag

SEQ ID NO: 7507530 - DNA, 22 bp, Homo sapiens
tattgtattaaggattcaagta

SEQ ID NO: 7507531 - DNA, 22 bp, Homo sapiens
tattgtattaaggattcaagta

SEQ ID NO: 7507532 - DNA, 22 bp, Homo sapiens
tattgtattaaggattcaagta

SEQ ID NO: 7507533 - DNA, 22 bp, Homo sapiens
tattgtattaaggattcaagta

SEQ ID NO: 7507534 - DNA, 22 bp, Homo sapiens
tattgtcaagaagtttatagtg

SEQ ID NO: 7507535 - DNA, 22 bp, Homo sapiens
tattgtctgcaaaggtttataa

SEQ ID NO: 7507536 - DNA, 22 bp, Homo sapiens
tattgtctgtccgggtcaaagc

SEQ ID NO: 7507537 - DNA, 22 bp, Homo sapiens
tattgtctgtccgggtcaaagc

SEQ ID NO: 7507538 - DNA, 22 bp, Homo sapiens
tattgtctgtttgaatgactat

SEQ ID NO: 7507539 - DNA, 22 bp, Homo sapiens
tattgtctcacagttttggagg

SEQ ID NO: 7507540 - DNA, 22 bp, Homo sapiens
tattgtctaggaattgtttaaa

SEQ ID NO: 7507541 - DNA, 22 bp, Homo sapiens
tattgtctctgcgttgttctat

SEQ ID NO: 7507542 - DNA, 21 bp, Homo sapiens
tattgtcaatctgctttcaga

SEQ ID NO: 7507543 - DNA, 22 bp, Homo sapiens
tattgtccaataggatgttcct

SEQ ID NO: 7507544 - DNA, 22 bp, Homo sapiens
tattgtcacgtcttaattctag

SEQ ID NO: 7507545 - DNA, 22 bp, Homo sapiens
tattgtctaggaattgtttaaa

SEQ ID NO: 7507546 - DNA, 22 bp, Homo sapiens
tattgtccaataggatgttcct

SEQ ID NO: 7507547 - DNA, 23 bp, Homo sapiens
tattacaattggtcttattaaga

SEQ ID NO: 7507548 - DNA, 23 bp, Homo sapiens
tattacaattggtcttattaaga

SEQ ID NO: 7507549 - DNA, 23 bp, Homo sapiens
tattacaattggtcttattaaga

SEQ ID NO: 7507550 - DNA, 23 bp, Homo sapiens
tattacaattggtcttattaaga

SEQ ID NO: 7507551 - DNA, 23 bp, Homo sapiens
tattacaattggtcttattaaga

SEQ ID NO: 7507552 - DNA, 23 bp, Homo sapiens
tattacaattggtcttattaaga

SEQ ID NO: 7507553 - DNA, 23 bp, Homo sapiens
tattacaattggtcttattaaga

SEQ ID NO: 7507554 - DNA, 23 bp, Homo sapiens
tattacaattggtcttattaaga

SEQ ID NO: 7507555 - DNA, 23 bp, Homo sapiens
tattacaattggtcttattaaga

SEQ ID NO: 7507556 - DNA, 23 bp, Homo sapiens
tattacaattggtcttattaaga

SEQ ID NO: 7507557 - DNA, 23 bp, Homo sapiens
tattacaattggtcttattaaga

SEQ ID NO: 7507558 - DNA, 23 bp, Homo sapiens
tattacaattggtcttattaaga

SEQ ID NO: 7507559 - DNA, 23 bp, Homo sapiens
tattacaattggtcttattaaga

SEQ ID NO: 7507560 - DNA, 23 bp, Homo sapiens
tattacaattggtcttattaaga

SEQ ID NO: 7507561 - DNA, 23 bp, Homo sapiens
tattacaattggtcttattaaga

SEQ ID NO: 7507562 - DNA, 22 bp, Homo sapiens
tattacaatttacattgcactt

SEQ ID NO: 7507563 - DNA, 22 bp, Homo sapiens
tattacaatttacattgcactt

SEQ ID NO: 7507564 - DNA, 23 bp, Homo sapiens
tattacaattggtcttattaaga

SEQ ID NO: 7507565 - DNA, 23 bp, Homo sapiens
tattacaattggtcttattaaga

SEQ ID NO: 7507566 - DNA, 22 bp, Homo sapiens
tattacaatttacattgcactt

SEQ ID NO: 7507567 - DNA, 22 bp, Homo sapiens
tattacaatttacattgcactt

SEQ ID NO: 7507568 - DNA, 22 bp, Homo sapiens
tattacaatttacattgcactt

SEQ ID NO: 7507569 - DNA, 22 bp, Homo sapiens
tattacaatttacattgcactt

SEQ ID NO: 7507570 - DNA, 22 bp, Homo sapiens
tattacaatttacattgcactt

SEQ ID NO: 7507571 - DNA, 22 bp, Homo sapiens
tattacaatttacattgcactt

SEQ ID NO: 7507572 - DNA, 22 bp, Homo sapiens
tattacaatttacattgcactt

SEQ ID NO: 7507573 - DNA, 22 bp, Homo sapiens
tattacaaattataatgggaga

SEQ ID NO: 7507574 - DNA, 22 bp, Homo sapiens
tattacaaattataatgggaga

SEQ ID NO: 7507575 - DNA, 22 bp, Homo sapiens
tattacaaattataatgggaga

SEQ ID NO: 7507576 - DNA, 21 bp, Homo sapiens
tattaatttttcttcccacta

SEQ ID NO: 7507577 - DNA, 21 bp, Homo sapiens
tattaatttttcttcccacta

SEQ ID NO: 7507578 - DNA, 22 bp, Homo sapiens
tattacaaattataatgggaga

SEQ ID NO: 7507579 - DNA, 22 bp, Homo sapiens
tattacaaattataatgggaga

SEQ ID NO: 7507580 - DNA, 22 bp, Homo sapiens
tattacaaattataatgggaga

SEQ ID NO: 7507581 - DNA, 22 bp, Homo sapiens
tattaatttaatctccatggta

SEQ ID NO: 7507582 - DNA, 21 bp, Homo sapiens
tattaatttttcttcccacta

SEQ ID NO: 7507583 - DNA, 22 bp, Homo sapiens
tattaatttaatctccatggta

SEQ ID NO: 7507584 - DNA, 22 bp, Homo sapiens
tattacaaattataatgggaga

SEQ ID NO: 7507585 - DNA, 22 bp, Homo sapiens
tattacaaattataatgggaga

SEQ ID NO: 7507586 - DNA, 22 bp, Homo sapiens
tattacaagaaagggcatgaat

SEQ ID NO: 7507587 - DNA, 22 bp, Homo sapiens
tattacaagaaagggcatgaat

SEQ ID NO: 7507588 - DNA, 22 bp, Homo sapiens
tattacaagaaagggcatgaat

SEQ ID NO: 7507589 - DNA, 22 bp, Homo sapiens
tattacaagaaagggcatgaat

SEQ ID NO: 7507590 - DNA, 22 bp, Homo sapiens
tattacaagaaagggcatgaat

SEQ ID NO: 7507591 - DNA, 22 bp, Homo sapiens
tattacaagaaagggcatgaat

SEQ ID NO: 7507592 - DNA, 22 bp, Homo sapiens
tattacaagaaagggcatgaat

SEQ ID NO: 7507593 - DNA, 22 bp, Homo sapiens
tattacaagaaagggcatgaat

SEQ ID NO: 7507594 - DNA, 22 bp, Homo sapiens
tatttggagataagatttttag

SEQ ID NO: 7507595 - DNA, 22 bp, Homo sapiens
tatttggagataagggctttaa

SEQ ID NO: 7507596 - DNA, 22 bp, Homo sapiens
tatttggagatgggatcttcaa

SEQ ID NO: 7507597 - DNA, 22 bp, Homo sapiens
tatttggagataagatttttag

SEQ ID NO: 7507598 - DNA, 22 bp, Homo sapiens
tatttggagcctatccatagat

SEQ ID NO: 7507599 - DNA, 22 bp, Homo sapiens
tatttggagcctatccatagat

SEQ ID NO: 7507600 - DNA, 23 bp, Homo sapiens
tattttccaaatgatgactacat

SEQ ID NO: 7507601 - DNA, 22 bp, Homo sapiens
tattttcattctgtgtgactgt

SEQ ID NO: 7507602 - DNA, 23 bp, Homo sapiens
tattttcctggcaacaggggaac

SEQ ID NO: 7507603 - DNA, 23 bp, Homo sapiens
tattttccaaatgatgactacat

SEQ ID NO: 7507604 - DNA, 23 bp, Homo sapiens
tattttccaaatgatgactacat

SEQ ID NO: 7507605 - DNA, 22 bp, Homo sapiens
tattttctggacagtcttgctt

SEQ ID NO: 7507606 - DNA, 22 bp, Homo sapiens
tattttccttggtggacccagt

SEQ ID NO: 7507607 - DNA, 22 bp, Homo sapiens
tattttccttggtggacccagt

SEQ ID NO: 7507608 - DNA, 22 bp, Homo sapiens
tattttctggacagtcttgctt

SEQ ID NO: 7507609 - DNA, 22 bp, Homo sapiens
tattttctggacagtcttgctt

SEQ ID NO: 7507610 - DNA, 22 bp, Homo sapiens
tattttgacgattttatgcaaa

SEQ ID NO: 7507611 - DNA, 22 bp, Homo sapiens
tattttgacgattttatgcaaa

SEQ ID NO: 7507612 - DNA, 22 bp, Homo sapiens
tattttgacgattttatgcaaa

SEQ ID NO: 7507613 - DNA, 22 bp, Homo sapiens
tattttgacgattttatgcaaa

SEQ ID NO: 7507614 - DNA, 22 bp, Homo sapiens
tattttgacgattttatgcaaa

SEQ ID NO: 7507615 - DNA, 22 bp, Homo sapiens
tattttgaaagtctgttttgaa

SEQ ID NO: 7507616 - DNA, 22 bp, Homo sapiens
tattttgaaagtctgttttgaa

SEQ ID NO: 7507617 - DNA, 22 bp, Homo sapiens
tattttgaaagtctgttttgaa

SEQ ID NO: 7507618 - DNA, 22 bp, Homo sapiens
tattttgaaagtctgttttgaa

SEQ ID NO: 7507619 - DNA, 22 bp, Homo sapiens
tattttgaaagtctgttttgaa

SEQ ID NO: 7507620 - DNA, 22 bp, Homo sapiens
tattttctgtggaggaccagat

SEQ ID NO: 7507621 - DNA, 22 bp, Homo sapiens
tattttctggggagagtgaacc

SEQ ID NO: 7507622 - DNA, 22 bp, Homo sapiens
tattttctggggagagtgaacc

SEQ ID NO: 7507623 - DNA, 22 bp, Homo sapiens
tattttctggacagtcttgctt

SEQ ID NO: 7507624 - DNA, 22 bp, Homo sapiens
tattttctggacagtcttgctt

SEQ ID NO: 7507625 - DNA, 22 bp, Homo sapiens
tattttctgtggaggaccagat

SEQ ID NO: 7507626 - DNA, 22 bp, Homo sapiens
tattttctggggagagtgaacc

SEQ ID NO: 7507627 - DNA, 22 bp, Homo sapiens
tattttctggggagagtgaacc

SEQ ID NO: 7507628 - DNA, 22 bp, Homo sapiens
tattttctggggagagtgaacc

SEQ ID NO: 7507629 - DNA, 22 bp, Homo sapiens
tatttggaaacaattcacatgc

SEQ ID NO: 7507630 - DNA, 22 bp, Homo sapiens
tatttggaaacaattcacatgc

SEQ ID NO: 7507631 - DNA, 22 bp, Homo sapiens
tatttggaaaagggaagggaca

SEQ ID NO: 7507632 - DNA, 22 bp, Homo sapiens
tatttggaaaagggaagggaca

SEQ ID NO: 7507633 - DNA, 22 bp, Homo sapiens
tatttgcttttgtgccacagat

SEQ ID NO: 7507634 - DNA, 22 bp, Homo sapiens
tatttgcttttgtgccacagat

SEQ ID NO: 7507635 - DNA, 22 bp, Homo sapiens
tatttgctttgctttatagaga

SEQ ID NO: 7507636 - DNA, 22 bp, Homo sapiens
tatttgctttgctttatagaga

SEQ ID NO: 7507637 - DNA, 22 bp, Homo sapiens
tatttgctttggtcctccaagc

SEQ ID NO: 7507638 - DNA, 22 bp, Homo sapiens
tatttgcttggaaacctaatcc

SEQ ID NO: 7507639 - DNA, 22 bp, Homo sapiens
tatttgcttgaagcctggttct

SEQ ID NO: 7507640 - DNA, 22 bp, Homo sapiens
tatttgctttgctttatagaga

SEQ ID NO: 7507641 - DNA, 22 bp, Homo sapiens
tatttgctgtgcttattccatt

SEQ ID NO: 7507642 - DNA, 21 bp, Homo sapiens
tatttgctgccatctttgagg

SEQ ID NO: 7507643 - DNA, 21 bp, Homo sapiens
tatttgctgccatctttgagg

SEQ ID NO: 7507644 - DNA, 21 bp, Homo sapiens
tatttgctgccatctttgagg

SEQ ID NO: 7507645 - DNA, 22 bp, Homo sapiens
tatttgctgaatctgattcaga

SEQ ID NO: 7507646 - DNA, 22 bp, Homo sapiens
tatttgctctcggcccggcccc

SEQ ID NO: 7507647 - DNA, 22 bp, Homo sapiens
tatttgctgaatctgattcaga

SEQ ID NO: 7507648 - DNA, 22 bp, Homo sapiens
tatttgctgacagtgctggagc

SEQ ID NO: 7507649 - DNA, 22 bp, Homo sapiens
tatttgctgacagtgctggagc

SEQ ID NO: 7507650 - DNA, 22 bp, Homo sapiens
tatttggaaaggacatgtaagt

SEQ ID NO: 7507651 - DNA, 22 bp, Homo sapiens
tatttggaaaggacatgtaagt

SEQ ID NO: 7507652 - DNA, 23 bp, Homo sapiens
tatttggaaagagggaagaagac

SEQ ID NO: 7507653 - DNA, 23 bp, Homo sapiens
tatttggaaagagggaagaagac

SEQ ID NO: 7507654 - DNA, 22 bp, Homo sapiens
tatttggaaagtttatctatct

SEQ ID NO: 7507655 - DNA, 22 bp, Homo sapiens
tatttggaaagtttatctatct

SEQ ID NO: 7507656 - DNA, 22 bp, Homo sapiens
tatttggaaatagggctttgta

SEQ ID NO: 7507657 - DNA, 22 bp, Homo sapiens
tatttggaaatagggctttgta

SEQ ID NO: 7507658 - DNA, 22 bp, Homo sapiens
tatttggaaatgataaagtact

SEQ ID NO: 7507659 - DNA, 22 bp, Homo sapiens
tatttggaaatgataaagtact

SEQ ID NO: 7507660 - DNA, 22 bp, Homo sapiens
tatttggaaatgataaagtact

SEQ ID NO: 7507661 - DNA, 22 bp, Homo sapiens
tatttggaaatgataaagtact

SEQ ID NO: 7507662 - DNA, 22 bp, Homo sapiens
tatttggaaggtataaacacaa

SEQ ID NO: 7507663 - DNA, 22 bp, Homo sapiens
tatttggaaggtataaacacaa

SEQ ID NO: 7507664 - DNA, 22 bp, Homo sapiens
tatttggaatagcttgctaatg

SEQ ID NO: 7507665 - DNA, 22 bp, Homo sapiens
tatttggacaccaagtagaagt

SEQ ID NO: 7507666 - DNA, 22 bp, Homo sapiens
tatttggacaccaagtagaagt

SEQ ID NO: 7507667 - DNA, 22 bp, Homo sapiens
tatttggaatctgccttaggac

SEQ ID NO: 7507668 - DNA, 22 bp, Homo sapiens
tatttggaatagcttgctaatg

SEQ ID NO: 7507669 - DNA, 22 bp, Homo sapiens
tatttgcaaagaactacactag

SEQ ID NO: 7507670 - DNA, 22 bp, Homo sapiens
tatttgcaaagaactacactag

SEQ ID NO: 7507671 - DNA, 22 bp, Homo sapiens
tatttgatggttctaaaacagc

SEQ ID NO: 7507672 - DNA, 22 bp, Homo sapiens
tatttgatggttctaaaacagc

SEQ ID NO: 7507673 - DNA, 22 bp, Homo sapiens
tatttgatggttctaaaacagc

SEQ ID NO: 7507674 - DNA, 22 bp, Homo sapiens
tatttgcaacataaaactctga

SEQ ID NO: 7507675 - DNA, 22 bp, Homo sapiens
tatttgcaacataaaactctga

SEQ ID NO: 7507676 - DNA, 22 bp, Homo sapiens
tatttgcaacataaaactctga

SEQ ID NO: 7507677 - DNA, 22 bp, Homo sapiens
tatttgcaacataaaactctga

SEQ ID NO: 7507678 - DNA, 22 bp, Homo sapiens
tatttgatgaaggtaaagtctt

SEQ ID NO: 7507679 - DNA, 22 bp, Homo sapiens
tatttgatagagataaatgata

SEQ ID NO: 7507680 - DNA, 22 bp, Homo sapiens
tatttgatagagataaatgata

SEQ ID NO: 7507681 - DNA, 22 bp, Homo sapiens
tatttgatggttctaaaacagc

SEQ ID NO: 7507682 - DNA, 22 bp, Homo sapiens
tatttgatgaaggtaaagtctt

SEQ ID NO: 7507683 - DNA, 22 bp, Homo sapiens
tatttgatggttctaaaacagc

SEQ ID NO: 7507684 - DNA, 22 bp, Homo sapiens
tatttgatgaaggtaaagtctt

SEQ ID NO: 7507685 - DNA, 22 bp, Homo sapiens
tatttgctcaaccctgcctcca

SEQ ID NO: 7507686 - DNA, 22 bp, Homo sapiens
tatttgctcaataatagtttta

SEQ ID NO: 7507687 - DNA, 22 bp, Homo sapiens
tatttgctcaataatagtttta

SEQ ID NO: 7507688 - DNA, 22 bp, Homo sapiens
tatttgctcaataatagtttta

SEQ ID NO: 7507689 - DNA, 22 bp, Homo sapiens
tatttgctccttaggcatattt

SEQ ID NO: 7507690 - DNA, 23 bp, Homo sapiens
tatttgctactggtaattctgga

SEQ ID NO: 7507691 - DNA, 22 bp, Homo sapiens
tatttgcaggcttttgtcatgg

SEQ ID NO: 7507692 - DNA, 22 bp, Homo sapiens
tatttgcaggacatagatatgg

SEQ ID NO: 7507693 - DNA, 22 bp, Homo sapiens
tatttgcaggcttttgtcatgg

SEQ ID NO: 7507694 - DNA, 22 bp, Homo sapiens
tatttgcaggcttttgtcatgg

SEQ ID NO: 7507695 - DNA, 22 bp, Homo sapiens
tatttgcaggcttttgtcatgg

SEQ ID NO: 7507696 - DNA, 22 bp, Homo sapiens
tatttgcaggcttttgtcatgg

SEQ ID NO: 7507697 - DNA, 22 bp, Homo sapiens
tatttgcaggcttttgtcatgg

SEQ ID NO: 7507698 - DNA, 22 bp, Homo sapiens
tatttgcaggacatagatatgg

SEQ ID NO: 7507699 - DNA, 22 bp, Homo sapiens
tatttgcaggacatagatatgg

SEQ ID NO: 7507700 - DNA, 22 bp, Homo sapiens
tatttgcaggacatagatatgg

SEQ ID NO: 7507701 - DNA, 22 bp, Homo sapiens
tatttgcaggacatagatatgg

SEQ ID NO: 7507702 - DNA, 22 bp, Homo sapiens
tatttgcaggacatagatatgg

SEQ ID NO: 7507703 - DNA, 22 bp, Homo sapiens
tatttgcaggacatagatatgg

SEQ ID NO: 7507704 - DNA, 22 bp, Homo sapiens
tatttgatagagataaatgata

SEQ ID NO: 7507705 - DNA, 22 bp, Homo sapiens
tatttgatagagataaatgata

SEQ ID NO: 7507706 - DNA, 22 bp, Homo sapiens
tatttgatagagataaatgata

SEQ ID NO: 7507707 - DNA, 22 bp, Homo sapiens
tatttgaccgtgaggaatatga

SEQ ID NO: 7507708 - DNA, 22 bp, Homo sapiens
tatttgaccgtgaggaatatga

SEQ ID NO: 7507709 - DNA, 22 bp, Homo sapiens
tatttgaagggagaaagtgcca

SEQ ID NO: 7507710 - DNA, 22 bp, Homo sapiens
tatttgaagggagaaagtgcca

SEQ ID NO: 7507711 - DNA, 22 bp, Homo sapiens
tatttgaataaaggataaggaa

SEQ ID NO: 7507712 - DNA, 22 bp, Homo sapiens
tatttgaataaaggataaggaa

SEQ ID NO: 7507713 - DNA, 22 bp, Homo sapiens
tatttgaatcctggttcttcag

SEQ ID NO: 7507714 - DNA, 22 bp, Homo sapiens
tatttgaaggcatacattttga

SEQ ID NO: 7507715 - DNA, 22 bp, Homo sapiens
tatttgaaggcatacattttga

SEQ ID NO: 7507716 - DNA, 22 bp, Homo sapiens
tatttgaaggcatacattttga

SEQ ID NO: 7507717 - DNA, 22 bp, Homo sapiens
tatttgaagggagaaagtgcca

SEQ ID NO: 7507718 - DNA, 22 bp, Homo sapiens
tatttcttgttattctcgttga

SEQ ID NO: 7507719 - DNA, 22 bp, Homo sapiens
tatttcttgttattctcgttga

SEQ ID NO: 7507720 - DNA, 22 bp, Homo sapiens
tatttcttgttattctcgttga

SEQ ID NO: 7507721 - DNA, 22 bp, Homo sapiens
tatttcttgttattctcgttga

SEQ ID NO: 7507722 - DNA, 22 bp, Homo sapiens
tatttgaaggcatacattttga

SEQ ID NO: 7507723 - DNA, 22 bp, Homo sapiens
tatttgaaggcatacattttga

SEQ ID NO: 7507724 - DNA, 22 bp, Homo sapiens
tatttgaaggcatacattttga

SEQ ID NO: 7507725 - DNA, 22 bp, Homo sapiens
tatttgaaggcatacattttga

SEQ ID NO: 7507726 - DNA, 22 bp, Homo sapiens
tatttaattagtgattgtagag

SEQ ID NO: 7507727 - DNA, 22 bp, Homo sapiens
tatttaattagtgattgtagag

SEQ ID NO: 7507728 - DNA, 22 bp, Homo sapiens
tatttaattagtgattgtagag

SEQ ID NO: 7507729 - DNA, 22 bp, Homo sapiens
tatttaattagtgattgtagag

SEQ ID NO: 7507730 - DNA, 22 bp, Homo sapiens
tatttcttgttattctcgttga

SEQ ID NO: 7507731 - DNA, 22 bp, Homo sapiens
tatttcttgttattctcgttga

SEQ ID NO: 7507732 - DNA, 22 bp, Homo sapiens
tatttcttgagtggtcagtttc

SEQ ID NO: 7507733 - DNA, 22 bp, Homo sapiens
tatttcttgttattctcgttga

SEQ ID NO: 7507734 - DNA, 22 bp, Homo sapiens
tcaaaaatggtctttgagctgc

SEQ ID NO: 7507735 - DNA, 22 bp, Homo sapiens
tcaaaaatggtctttgagctgc

SEQ ID NO: 7507736 - DNA, 22 bp, Homo sapiens
tcaaactgaattaaacacttgt

SEQ ID NO: 7507737 - DNA, 22 bp, Homo sapiens
tcaaactgctaccttttatgtg

SEQ ID NO: 7507738 - DNA, 22 bp, Homo sapiens
tcaaactggcagacttctactt

SEQ ID NO: 7507739 - DNA, 22 bp, Homo sapiens
tcaaaaatggtctttgagctgc

SEQ ID NO: 7507740 - DNA, 22 bp, Homo sapiens
tcaaactggggaacttatttat

SEQ ID NO: 7507741 - DNA, 18 bp, Homo sapiens
tcaaactgtcattggtga

SEQ ID NO: 7507742 - DNA, 18 bp, Homo sapiens
tcaaactgtcattggtga

SEQ ID NO: 7507743 - DNA, 22 bp, Homo sapiens
tcaaacttggtaagagaaatac

SEQ ID NO: 7507744 - DNA, 22 bp, Homo sapiens
tcaaacttggtaagagaaatac

SEQ ID NO: 7507745 - DNA, 22 bp, Homo sapiens
tcaaagaacatcatctgaaatg

SEQ ID NO: 7507746 - DNA, 22 bp, Homo sapiens
tcaaagaacatcatctgaaatg

SEQ ID NO: 7507747 - DNA, 22 bp, Homo sapiens
tcaaactgttcagaactccttt

SEQ ID NO: 7507748 - DNA, 22 bp, Homo sapiens
tcaaactgttcagaactccttt

SEQ ID NO: 7507749 - DNA, 22 bp, Homo sapiens
tcaaactgtttacagtgagata

SEQ ID NO: 7507750 - DNA, 22 bp, Homo sapiens
tcaaagaagtgcaaacctcatc

SEQ ID NO: 7507751 - DNA, 20 bp, Homo sapiens
tcaaagaagattcagctcaa

SEQ ID NO: 7507752 - DNA, 20 bp, Homo sapiens
tcaaagacaagctctcatcc

SEQ ID NO: 7507753 - DNA, 20 bp, Homo sapiens
tcaaagacaagctctcatcc

SEQ ID NO: 7507754 - DNA, 20 bp, Homo sapiens
tcaaagacaagctctcatcc

SEQ ID NO: 7507755 - DNA, 22 bp, Homo sapiens
tcaaagaatgttatgagggtag

SEQ ID NO: 7507756 - DNA, 22 bp, Homo sapiens
tcaaagaatgttatgagggtag

SEQ ID NO: 7507757 - DNA, 17 bp, Homo sapiens
tcaaagaatgcatgcag

SEQ ID NO: 7507758 - DNA, 17 bp, Homo sapiens
tcaaagaatgcatgcag

SEQ ID NO: 7507759 - DNA, 17 bp, Homo sapiens
tcaaagaatgcatgcag

SEQ ID NO: 7507760 - DNA, 22 bp, Homo sapiens
tcaaagagctattcagttgtgg

SEQ ID NO: 7507761 - DNA, 22 bp, Homo sapiens
tcaaagagctattcagttgtgg

SEQ ID NO: 7507762 - DNA, 22 bp, Homo sapiens
tcaaagagctctatcttcaaaa

SEQ ID NO: 7507763 - DNA, 22 bp, Homo sapiens
tcaaagatagatgttgagaaat

SEQ ID NO: 7507764 - DNA, 22 bp, Homo sapiens
tcaaagagctctatcttcaaaa

SEQ ID NO: 7507765 - DNA, 22 bp, Homo sapiens
tcaaagatagatgttgagaaat

SEQ ID NO: 7507766 - DNA, 22 bp, Homo sapiens
tcaaagactatatattttattt

SEQ ID NO: 7507767 - DNA, 22 bp, Homo sapiens
tcaaagactatatattttattt

SEQ ID NO: 7507768 - DNA, 22 bp, Homo sapiens
tcaaagactatatattttattt

SEQ ID NO: 7507769 - DNA, 22 bp, Homo sapiens
tcaaagacatggggaagctgag

SEQ ID NO: 7507770 - DNA, 22 bp, Homo sapiens
tcaaagacatggggaagctgag

SEQ ID NO: 7507771 - DNA, 22 bp, Homo sapiens
tcaaagacagacatcagtcaaa

SEQ ID NO: 7507772 - DNA, 22 bp, Homo sapiens
tcaaagacagacatcagtcaaa

SEQ ID NO: 7507773 - DNA, 22 bp, Homo sapiens
tcaaagacatctggtagctgag

SEQ ID NO: 7507774 - DNA, 22 bp, Homo sapiens
tcaaagacatctggtagctgag

SEQ ID NO: 7507775 - DNA, 22 bp, Homo sapiens
tcaaagagctattcagttgtgg

SEQ ID NO: 7507776 - DNA, 22 bp, Homo sapiens
tcaaagactatatattttattt

SEQ ID NO: 7507777 - DNA, 21 bp, Homo sapiens
tcaaagactggggctgtgtgc

SEQ ID NO: 7507778 - DNA, 21 bp, Homo sapiens
tcaaagactggggctgtgtgc

SEQ ID NO: 7507779 - DNA, 19 bp, Homo sapiens
tcaaagcaagcatgttctg

SEQ ID NO: 7507780 - DNA, 19 bp, Homo sapiens
tcaaagcaagcatgttctg

SEQ ID NO: 7507781 - DNA, 20 bp, Homo sapiens
tcaaagcaaagggagatgat

SEQ ID NO: 7507782 - DNA, 19 bp, Homo sapiens
tcaaagcaagcatgttctg

SEQ ID NO: 7507783 - DNA, 20 bp, Homo sapiens
tcaaagcaaagggagatgat

SEQ ID NO: 7507784 - DNA, 22 bp, Homo sapiens
tcaaagatgatgctgaagttat

SEQ ID NO: 7507785 - DNA, 22 bp, Homo sapiens
tcaaagatgggttttgtttgat

SEQ ID NO: 7507786 - DNA, 22 bp, Homo sapiens
tcaaagatgatgctgaagttat

SEQ ID NO: 7507787 - DNA, 22 bp, Homo sapiens
tcaaagatgatgctgaagttat

SEQ ID NO: 7507788 - DNA, 22 bp, Homo sapiens
tcaaagatgataggaaatcata

SEQ ID NO: 7507789 - DNA, 22 bp, Homo sapiens
tcaaagatgataggaaatcata

SEQ ID NO: 7507790 - DNA, 22 bp, Homo sapiens
tcaaagatgataggaaatcata

SEQ ID NO: 7507791 - DNA, 22 bp, Homo sapiens
tcaaagatgataggaaatcata

SEQ ID NO: 7507792 - DNA, 22 bp, Homo sapiens
tcaaagatcagatggttgtagg

SEQ ID NO: 7507793 - DNA, 22 bp, Homo sapiens
tcaaagatagatgttgagaaat

SEQ ID NO: 7507794 - DNA, 22 bp, Homo sapiens
tattttgacgattttatgcaaa

SEQ ID NO: 7507795 - DNA, 22 bp, Homo sapiens
tattttgacgattttatgcaaa

SEQ ID NO: 7507796 - DNA, 22 bp, Homo sapiens
tattttgacgattttatgcaaa

SEQ ID NO: 7507797 - DNA, 22 bp, Homo sapiens
tattttgactattaaaccaaca

SEQ ID NO: 7507798 - DNA, 22 bp, Homo sapiens
tattttgactattaaaccaaca

SEQ ID NO: 7507799 - DNA, 22 bp, Homo sapiens
tattttgagcccctgacatcta

SEQ ID NO: 7507800 - DNA, 22 bp, Homo sapiens
tattttgactattaaaccaaca

SEQ ID NO: 7507801 - DNA, 22 bp, Homo sapiens
tattttgactattaaaccaaca

SEQ ID NO: 7507802 - DNA, 22 bp, Homo sapiens
tattttgaggtatttttgagct

SEQ ID NO: 7507803 - DNA, 22 bp, Homo sapiens
tattttgaggtatttttgagct

SEQ ID NO: 7507804 - DNA, 22 bp, Homo sapiens
tattttgcaaacctgagtttga

SEQ ID NO: 7507805 - DNA, 22 bp, Homo sapiens
tattttgcaaacctgagtttga

SEQ ID NO: 7507806 - DNA, 22 bp, Homo sapiens
tattttgcaaacctgagtttga

SEQ ID NO: 7507807 - DNA, 22 bp, Homo sapiens
tattttgcaaacctgagtttga

SEQ ID NO: 7507808 - DNA, 22 bp, Homo sapiens
tattttgagcccctgacatcta

SEQ ID NO: 7507809 - DNA, 22 bp, Homo sapiens
tattttgagcccctgacatcta

SEQ ID NO: 7507810 - DNA, 22 bp, Homo sapiens
tattttgaggtatttttgagct

SEQ ID NO: 7507811 - DNA, 22 bp, Homo sapiens
tattttgaggtatttttgagct

SEQ ID NO: 7507812 - DNA, 22 bp, Homo sapiens
tattttgaggtatttttgagct

SEQ ID NO: 7507813 - DNA, 22 bp, Homo sapiens
tattttgaggtatttttgagct

SEQ ID NO: 7507814 - DNA, 22 bp, Homo sapiens
tattttgagcccctgacatcta

SEQ ID NO: 7507815 - DNA, 22 bp, Homo sapiens
tattttgcgttgagtcagattt

SEQ ID NO: 7507816 - DNA, 20 bp, Homo sapiens
tattttgcaattatggttca

SEQ ID NO: 7507817 - DNA, 20 bp, Homo sapiens
tattttgcaattatggttca

SEQ ID NO: 7507818 - DNA, 20 bp, Homo sapiens
tattttgcaattatggttca

SEQ ID NO: 7507819 - DNA, 22 bp, Homo sapiens
tattttgcaaacctgagtttga

SEQ ID NO: 7507820 - DNA, 20 bp, Homo sapiens
tattttgcaattatggttca

SEQ ID NO: 7507821 - DNA, 22 bp, Homo sapiens
tattttgcaaacctgagtttga

SEQ ID NO: 7507822 - DNA, 20 bp, Homo sapiens
tattttgcaattatggttca

SEQ ID NO: 7507823 - DNA, 22 bp, Homo sapiens
tattttgctttagctgactgtt

SEQ ID NO: 7507824 - DNA, 22 bp, Homo sapiens
tattttgcgttgagtcagattt

SEQ ID NO: 7507825 - DNA, 22 bp, Homo sapiens
tattttgctttagctgactgtt

SEQ ID NO: 7507826 - DNA, 22 bp, Homo sapiens
tattttgctttagctgactgtt

SEQ ID NO: 7507827 - DNA, 22 bp, Homo sapiens
tattttgctttagctgactgtt

SEQ ID NO: 7507828 - DNA, 20 bp, Homo sapiens
tattttgcaattatggttca

SEQ ID NO: 7507829 - DNA, 22 bp, Homo sapiens
tattttgagcccctgacatcta

SEQ ID NO: 7507830 - DNA, 22 bp, Homo sapiens
tattttgcgttgagtcagattt

SEQ ID NO: 7507831 - DNA, 22 bp, Homo sapiens
tattttgcgttgagtcagattt

SEQ ID NO: 7507832 - DNA, 22 bp, Homo sapiens
tattttgtaattggtcatagct

SEQ ID NO: 7507833 - DNA, 22 bp, Homo sapiens
tattttgtatttatgcaagaaa

SEQ ID NO: 7507834 - DNA, 22 bp, Homo sapiens
tattttgtatttatgcaagaaa

SEQ ID NO: 7507835 - DNA, 22 bp, Homo sapiens
tattttgtatttatgcaagaaa

SEQ ID NO: 7507836 - DNA, 22 bp, Homo sapiens
tattttgtatttatgcaagaaa

SEQ ID NO: 7507837 - DNA, 22 bp, Homo sapiens
tattttggctgattcatcatgt

SEQ ID NO: 7507838 - DNA, 22 bp, Homo sapiens
tattttggctgattcatcatgt

SEQ ID NO: 7507839 - DNA, 22 bp, Homo sapiens
tattttggctgattcatcatgt

SEQ ID NO: 7507840 - DNA, 22 bp, Homo sapiens
tattttgtaattggtcatagct

SEQ ID NO: 7507841 - DNA, 22 bp, Homo sapiens
tattttgtaattggtcatagct

SEQ ID NO: 7507842 - DNA, 22 bp, Homo sapiens
tattttgtaattggtcatagct

SEQ ID NO: 7507843 - DNA, 22 bp, Homo sapiens
tattttgtaattggtcatagct

SEQ ID NO: 7507844 - DNA, 22 bp, Homo sapiens
tattttgttaataatccagtcc

SEQ ID NO: 7507845 - DNA, 22 bp, Homo sapiens
tattttgttaataatccagtcc

SEQ ID NO: 7507846 - DNA, 22 bp, Homo sapiens
tattttgttaataatccagtcc

SEQ ID NO: 7507847 - DNA, 22 bp, Homo sapiens
tattttgttaataatccagtcc

SEQ ID NO: 7507848 - DNA, 22 bp, Homo sapiens
tattttgttaataatccagtcc

SEQ ID NO: 7507849 - DNA, 22 bp, Homo sapiens
tattttgttttgtatccactgt

SEQ ID NO: 7507850 - DNA, 22 bp, Homo sapiens
tattttgttttgtatccactgt

SEQ ID NO: 7507851 - DNA, 22 bp, Homo sapiens
tattttgttttgtatccactgt

SEQ ID NO: 7507852 - DNA, 22 bp, Homo sapiens
tattttgttttgtatccactgt

SEQ ID NO: 7507853 - DNA, 22 bp, Homo sapiens
tattttgttttgtatccactgt

SEQ ID NO: 7507854 - DNA, 22 bp, Homo sapiens
tattttgtatttatgcaagaaa

SEQ ID NO: 7507855 - DNA, 22 bp, Homo sapiens
tattttgtatttatgcaagaaa

SEQ ID NO: 7507856 - DNA, 22 bp, Homo sapiens
tattttgtatttatgcaagaaa

SEQ ID NO: 7507857 - DNA, 22 bp, Homo sapiens
tattttgtgccatgcactgcct

SEQ ID NO: 7507858 - DNA, 22 bp, Homo sapiens
tattttgtgccatgcactgcct

SEQ ID NO: 7507859 - DNA, 22 bp, Homo sapiens
tattttgtgccatgcactgcct

SEQ ID NO: 7507860 - DNA, 22 bp, Homo sapiens
tattttgtcttctgctcatcac

SEQ ID NO: 7507861 - DNA, 22 bp, Homo sapiens
tattttgtcttctgctcatcac

SEQ ID NO: 7507862 - DNA, 22 bp, Homo sapiens
tcaaaaatggtctttgagctgc

SEQ ID NO: 7507863 - DNA, 22 bp, Homo sapiens
tcaaaaataagatattctggac

SEQ ID NO: 7507864 - DNA, 22 bp, Homo sapiens
tcaaaaataagatattctggac

SEQ ID NO: 7507865 - DNA, 22 bp, Homo sapiens
tcaaaaataagatattctggac

SEQ ID NO: 7507866 - DNA, 22 bp, Homo sapiens
tcaaaaataagatattctggac

SEQ ID NO: 7507867 - DNA, 22 bp, Homo sapiens
tcaaaaataagatattctggac

SEQ ID NO: 7507868 - DNA, 22 bp, Homo sapiens
tcaaaaataagatattctggac

SEQ ID NO: 7507869 - DNA, 22 bp, Homo sapiens
tcaaaaataagatattctggac

SEQ ID NO: 7507870 - DNA, 22 bp, Homo sapiens
tcaaaaataagatattctggac

SEQ ID NO: 7507871 - DNA, 22 bp, Homo sapiens
tcaaaaataagatattctggac

SEQ ID NO: 7507872 - DNA, 22 bp, Homo sapiens
tcaaaaagttgaagagttgggg

SEQ ID NO: 7507873 - DNA, 22 bp, Homo sapiens
tatttttgcctctcagataaaa

SEQ ID NO: 7507874 - DNA, 22 bp, Homo sapiens
tatttttgcctctcagataaaa

SEQ ID NO: 7507875 - DNA, 22 bp, Homo sapiens
tatttttgcctctcagataaaa

SEQ ID NO: 7507876 - DNA, 22 bp, Homo sapiens
tatttttgcctctcagataaaa

SEQ ID NO: 7507877 - DNA, 22 bp, Homo sapiens
tattttgttttgtatccactgt

SEQ ID NO: 7507878 - DNA, 22 bp, Homo sapiens
tatttttgcctctcagataaaa

SEQ ID NO: 7507879 - DNA, 22 bp, Homo sapiens
tatttttgcctctcagataaaa

SEQ ID NO: 7507880 - DNA, 22 bp, Homo sapiens
tatttttgcctctcagataaaa

SEQ ID NO: 7507881 - DNA, 22 bp, Homo sapiens
tcaaagtattttaactgtatcc

SEQ ID NO: 7507882 - DNA, 22 bp, Homo sapiens
tcaaagtatgctttctttggga

SEQ ID NO: 7507883 - DNA, 17 bp, Homo sapiens
tcaaagtattctgatgc

SEQ ID NO: 7507884 - DNA, 22 bp, Homo sapiens
tcaaagtataattgcttttttg

SEQ ID NO: 7507885 - DNA, 22 bp, Homo sapiens
tcaaagtatatcccttcgaaac

SEQ ID NO: 7507886 - DNA, 22 bp, Homo sapiens
tcaaagtcatggcaggctcaga

SEQ ID NO: 7507887 - DNA, 22 bp, Homo sapiens
tcaaagtcacaactctctaatt

SEQ ID NO: 7507888 - DNA, 22 bp, Homo sapiens
tcaaagtcatggcaggctcaga

SEQ ID NO: 7507889 - DNA, 22 bp, Homo sapiens
tcaaagtcatggcaggctcaga

SEQ ID NO: 7507890 - DNA, 22 bp, Homo sapiens
tcaaagtattttaactgtatcc

SEQ ID NO: 7507891 - DNA, 22 bp, Homo sapiens
tcaaagtattttaactgtatcc

SEQ ID NO: 7507892 - DNA, 22 bp, Homo sapiens
tcaaagtcatggctagtaatga

SEQ ID NO: 7507893 - DNA, 22 bp, Homo sapiens
tcaaagtcatggctagtaatga

SEQ ID NO: 7507894 - DNA, 22 bp, Homo sapiens
tcaaagtccttgctttttctgt

SEQ ID NO: 7507895 - DNA, 22 bp, Homo sapiens
tcaaagtctatctgtaattact

SEQ ID NO: 7507896 - DNA, 22 bp, Homo sapiens
tcaaagtctctgcttctgtaac

SEQ ID NO: 7507897 - DNA, 22 bp, Homo sapiens
tcaaagtctctgcttctgtaac

SEQ ID NO: 7507898 - DNA, 19 bp, Homo sapiens
tcaaagtctgagtcacttt

SEQ ID NO: 7507899 - DNA, 19 bp, Homo sapiens
tcaaagtctgagtcacttt

SEQ ID NO: 7507900 - DNA, 22 bp, Homo sapiens
tcaaataatgccattcatcatc

SEQ ID NO: 7507901 - DNA, 22 bp, Homo sapiens
tcaaataatgccattcatcatc

SEQ ID NO: 7507902 - DNA, 22 bp, Homo sapiens
tcaaataatgccattcatcatc

SEQ ID NO: 7507903 - DNA, 22 bp, Homo sapiens
tcaaataatgccattcatcatc

SEQ ID NO: 7507904 - DNA, 22 bp, Homo sapiens
tcaaataatgccattcatcatc

SEQ ID NO: 7507905 - DNA, 22 bp, Homo sapiens
tcaaataatgccattcatcatc

SEQ ID NO: 7507906 - DNA, 22 bp, Homo sapiens
tcaaataaggagtcatgaccat

SEQ ID NO: 7507907 - DNA, 22 bp, Homo sapiens
tcaaataatgccattcatcatc

SEQ ID NO: 7507908 - DNA, 22 bp, Homo sapiens
tcaaataatgccattcatcatc

SEQ ID NO: 7507909 - DNA, 22 bp, Homo sapiens
tcaaataaggagtcatgaccat

SEQ ID NO: 7507910 - DNA, 22 bp, Homo sapiens
tcaaagttggaaaagctggccc

SEQ ID NO: 7507911 - DNA, 22 bp, Homo sapiens
tcaaataaggagtcatgaccat

SEQ ID NO: 7507912 - DNA, 22 bp, Homo sapiens
tcaaataaggagtcatgaccat

SEQ ID NO: 7507913 - DNA, 22 bp, Homo sapiens
tcaaagtttgtggcaatttatt

SEQ ID NO: 7507914 - DNA, 22 bp, Homo sapiens
tcaaagtttttgagaattacat

SEQ ID NO: 7507915 - DNA, 22 bp, Homo sapiens
tcaaagtttgtggcaatttatt

SEQ ID NO: 7507916 - DNA, 22 bp, Homo sapiens
tcaaagtcatggcaggctcaga

SEQ ID NO: 7507917 - DNA, 18 bp, Homo sapiens
tcaaagtctggctccact

SEQ ID NO: 7507918 - DNA, 22 bp, Homo sapiens
tcaaaggttaactctgttgttc

SEQ ID NO: 7507919 - DNA, 22 bp, Homo sapiens
tcaaagggtccttaacatgaga

SEQ ID NO: 7507920 - DNA, 22 bp, Homo sapiens
tcaaagggtccttaacatgaga

SEQ ID NO: 7507921 - DNA, 22 bp, Homo sapiens
tcaaagggtagcccagggaaga

SEQ ID NO: 7507922 - DNA, 22 bp, Homo sapiens
tcaaagggtagcccagggaaga

SEQ ID NO: 7507923 - DNA, 22 bp, Homo sapiens
tcaaagtaaaagtatagagttt

SEQ ID NO: 7507924 - DNA, 22 bp, Homo sapiens
tcaaagggtccttaacatgaga

SEQ ID NO: 7507925 - DNA, 22 bp, Homo sapiens
tcaaagtaaaagtatagagttt

SEQ ID NO: 7507926 - DNA, 22 bp, Homo sapiens
tcaaagggtaatgtaatagtct

SEQ ID NO: 7507927 - DNA, 22 bp, Homo sapiens
tcaaagggtaatgtaatagtct

SEQ ID NO: 7507928 - DNA, 22 bp, Homo sapiens
tcaaaggcttgtggttctggga

SEQ ID NO: 7507929 - DNA, 19 bp, Homo sapiens
tcaaaggcttttaggagac

SEQ ID NO: 7507930 - DNA, 19 bp, Homo sapiens
tcaaaggcttttaggagac

SEQ ID NO: 7507931 - DNA, 22 bp, Homo sapiens
tcaaaggcttgtggttctggga

SEQ ID NO: 7507932 - DNA, 22 bp, Homo sapiens
tcaaagtactactcagttcagc

SEQ ID NO: 7507933 - DNA, 22 bp, Homo sapiens
tcaaagtaagaatttattacaa

SEQ ID NO: 7507934 - DNA, 22 bp, Homo sapiens
tcaaagtaagattgttgaagct

SEQ ID NO: 7507935 - DNA, 22 bp, Homo sapiens
tcaaagtagagttcagtgcagc

SEQ ID NO: 7507936 - DNA, 22 bp, Homo sapiens
tcaaagtagagttcagtgcagc

SEQ ID NO: 7507937 - DNA, 22 bp, Homo sapiens
tcaaagtagagttcagtgcagc

SEQ ID NO: 7507938 - DNA, 22 bp, Homo sapiens
tcaaagtagccggatggaattt

SEQ ID NO: 7507939 - DNA, 22 bp, Homo sapiens
tcaaagtagccggatggaattt

SEQ ID NO: 7507940 - DNA, 22 bp, Homo sapiens
tcaaagtagccggatggaattt

SEQ ID NO: 7507941 - DNA, 22 bp, Homo sapiens
tcaaagtaggggtaagccaggc

SEQ ID NO: 7507942 - DNA, 22 bp, Homo sapiens
tcaaatgaagacagttgacttg

SEQ ID NO: 7507943 - DNA, 22 bp, Homo sapiens
tcaaatgaagacagttgacttg

SEQ ID NO: 7507944 - DNA, 22 bp, Homo sapiens
tcaaatgacaagcacttttggg

SEQ ID NO: 7507945 - DNA, 22 bp, Homo sapiens
tcaaatgagaggcagggcagct

SEQ ID NO: 7507946 - DNA, 22 bp, Homo sapiens
tcaaatgagaggcagggcagct

SEQ ID NO: 7507947 - DNA, 22 bp, Homo sapiens
tcaaatgagaggcagggcagct

SEQ ID NO: 7507948 - DNA, 22 bp, Homo sapiens
tcaaatctttgaccacttatgt

SEQ ID NO: 7507949 - DNA, 22 bp, Homo sapiens
tcaaatctttaacatgtgcaaa

SEQ ID NO: 7507950 - DNA, 17 bp, Homo sapiens
tcaaatcctctgtctgg

SEQ ID NO: 7507951 - DNA, 21 bp, Homo sapiens
tcaaatcatgtactgaccaca

SEQ ID NO: 7507952 - DNA, 21 bp, Homo sapiens
tcaaatcatgtactgaccaca

SEQ ID NO: 7507953 - DNA, 22 bp, Homo sapiens
tcaaatcccagctcagcctctc

SEQ ID NO: 7507954 - DNA, 21 bp, Homo sapiens
tcaaatcaggtatcactattg

SEQ ID NO: 7507955 - DNA, 22 bp, Homo sapiens
tcaaatattggctatttcacat

SEQ ID NO: 7507956 - DNA, 22 bp, Homo sapiens
tcaaatattggctatttcacat

SEQ ID NO: 7507957 - DNA, 22 bp, Homo sapiens
tcaaatattggctatttcacat

SEQ ID NO: 7507958 - DNA, 22 bp, Homo sapiens
tcaaatattggctatttcacat

SEQ ID NO: 7507959 - DNA, 22 bp, Homo sapiens
tcaaatattggctatttcacat

SEQ ID NO: 7507960 - DNA, 22 bp, Homo sapiens
tcaaatattggctatttcacat

SEQ ID NO: 7507961 - DNA, 22 bp, Homo sapiens
tcaaatattggctatttcacat

SEQ ID NO: 7507962 - DNA, 22 bp, Homo sapiens
tcaaatcaccaaactcactggc

SEQ ID NO: 7507963 - DNA, 22 bp, Homo sapiens
tcaaatcaccaaactcactggc

SEQ ID NO: 7507964 - DNA, 22 bp, Homo sapiens
tcaaatcaccaaactcactggc

SEQ ID NO: 7507965 - DNA, 22 bp, Homo sapiens
tcaaatattggctatttcacat

SEQ ID NO: 7507966 - DNA, 21 bp, Homo sapiens
tcaaatcaggtatcactattg

SEQ ID NO: 7507967 - DNA, 22 bp, Homo sapiens
tcaaatcagcaagcagcttccc

SEQ ID NO: 7507968 - DNA, 22 bp, Homo sapiens
tcaaatcaccaaactcactggc

SEQ ID NO: 7507969 - DNA, 22 bp, Homo sapiens
tcaaatcagcaagcagcttccc

SEQ ID NO: 7507970 - DNA, 21 bp, Homo sapiens
tcaaatcatgtactgaccaca

SEQ ID NO: 7507971 - DNA, 21 bp, Homo sapiens
tcaaatcaggtatcactattg

SEQ ID NO: 7507972 - DNA, 21 bp, Homo sapiens
tcaaatcaggtatcactattg

SEQ ID NO: 7507973 - DNA, 21 bp, Homo sapiens
tcaaatcaggtatcactattg

SEQ ID NO: 7507974 - DNA, 21 bp, Homo sapiens
tcaaatcaggtatcactattg

SEQ ID NO: 7507975 - DNA, 22 bp, Homo sapiens
tcaaataggtatgagtagaaat

SEQ ID NO: 7507976 - DNA, 22 bp, Homo sapiens
tcaaatagttgacattaacttg

SEQ ID NO: 7507977 - DNA, 22 bp, Homo sapiens
tcaaatagttgacattaacttg

SEQ ID NO: 7507978 - DNA, 22 bp, Homo sapiens
tcaaatatgtgatagaagctaa

SEQ ID NO: 7507979 - DNA, 22 bp, Homo sapiens
tcaaataccagcaatttcatgt

SEQ ID NO: 7507980 - DNA, 22 bp, Homo sapiens
tcaaatatgtgatagaagctaa

SEQ ID NO: 7507981 - DNA, 22 bp, Homo sapiens
tcaaatatgtgatagaagctaa

SEQ ID NO: 7507982 - DNA, 22 bp, Homo sapiens
tcaaatatgtgatagaagctaa

SEQ ID NO: 7507983 - DNA, 22 bp, Homo sapiens
tcaaatatgtgatagaagctaa

SEQ ID NO: 7507984 - DNA, 22 bp, Homo sapiens
tcaaatatgtgatagaagctaa

SEQ ID NO: 7507985 - DNA, 22 bp, Homo sapiens
tcaaatatgtgatagaagctaa

SEQ ID NO: 7507986 - DNA, 22 bp, Homo sapiens
tcaaatatgtgatagaagctaa

SEQ ID NO: 7507987 - DNA, 22 bp, Homo sapiens
tcaaatatgtgatagaagctaa

SEQ ID NO: 7507988 - DNA, 22 bp, Homo sapiens
tcaaatatgtgatagaagctaa

SEQ ID NO: 7507989 - DNA, 22 bp, Homo sapiens
tcaaatacatggtcaatcaact

SEQ ID NO: 7507990 - DNA, 22 bp, Homo sapiens
tcaaatacatggtcaatcaact

SEQ ID NO: 7507991 - DNA, 22 bp, Homo sapiens
tcaaatacatggtcaatcaact

SEQ ID NO: 7507992 - DNA, 22 bp, Homo sapiens
tcaaatacatggtcaatcaact

SEQ ID NO: 7507993 - DNA, 22 bp, Homo sapiens
tcaaatacagaagatcctttcc

SEQ ID NO: 7507994 - DNA, 22 bp, Homo sapiens
tcaaataatgccattcatcatc

SEQ ID NO: 7507995 - DNA, 22 bp, Homo sapiens
tcaaataatgccattcatcatc

SEQ ID NO: 7507996 - DNA, 22 bp, Homo sapiens
tcaaatacatggtcaatcaact

SEQ ID NO: 7507997 - DNA, 22 bp, Homo sapiens
tcaaataccagcaatttcatgt

SEQ ID NO: 7507998 - DNA, 22 bp, Homo sapiens
tcaaataccagcaatttcatgt

SEQ ID NO: 7507999 - DNA, 22 bp, Homo sapiens
taggcccagttccgcctcccgg

SEQ ID NO: 7508000 - DNA, 22 bp, Homo sapiens
tagggcagagtccaggatgggc

SEQ ID NO: 7508001 - DNA, 22 bp, Homo sapiens
tagggcagagtccaggatgggc

SEQ ID NO: 7508002 - DNA, 22 bp, Homo sapiens
tagggcagagtccaggatgggc

SEQ ID NO: 7508003 - DNA, 22 bp, Homo sapiens
tagggcagagtccaggatgggc

SEQ ID NO: 7508004 - DNA, 22 bp, Homo sapiens
taggcccagttccgcctcccgg

SEQ ID NO: 7508005 - DNA, 22 bp, Homo sapiens
taggccattgatttttataagt

SEQ ID NO: 7508006 - DNA, 22 bp, Homo sapiens
taggccattcttggagcttact

SEQ ID NO: 7508007 - DNA, 22 bp, Homo sapiens
tagggcagagtccaggatgggc

SEQ ID NO: 7508008 - DNA, 22 bp, Homo sapiens
tagggcagagtccaggatgggc

SEQ ID NO: 7508009 - DNA, 22 bp, Homo sapiens
tagggcagagtccaggatgggc

SEQ ID NO: 7508010 - DNA, 22 bp, Homo sapiens
tagggcagagtccaggatgggc

SEQ ID NO: 7508011 - DNA, 22 bp, Homo sapiens
tagggcagagtccaggatgggc

SEQ ID NO: 7508012 - DNA, 22 bp, Homo sapiens
tagggcagagtccaggatgggc

SEQ ID NO: 7508013 - DNA, 22 bp, Homo sapiens
tagggcagagtccaggatgggc

SEQ ID NO: 7508014 - DNA, 22 bp, Homo sapiens
tagggcagagtccaggatgggc

SEQ ID NO: 7508015 - DNA, 22 bp, Homo sapiens
tagggcagagtccaggatgggc

SEQ ID NO: 7508016 - DNA, 22 bp, Homo sapiens
tagggcagattcggtggagttt

SEQ ID NO: 7508017 - DNA, 22 bp, Homo sapiens
tagggcagattcggtggagttt

SEQ ID NO: 7508018 - DNA, 22 bp, Homo sapiens
tagggcagattcggtggagttt

SEQ ID NO: 7508019 - DNA, 22 bp, Homo sapiens
tagggcagccacccaggctgct

SEQ ID NO: 7508020 - DNA, 22 bp, Homo sapiens
tagggcagattcggtggagttt

SEQ ID NO: 7508021 - DNA, 22 bp, Homo sapiens
tagggcagattcggtggagttt

SEQ ID NO: 7508022 - DNA, 22 bp, Homo sapiens
tagggcagattcggtggagttt

SEQ ID NO: 7508023 - DNA, 22 bp, Homo sapiens
tagggcagattcggtggagttt

SEQ ID NO: 7508024 - DNA, 22 bp, Homo sapiens
tagggcagattcggtggagttt

SEQ ID NO: 7508025 - DNA, 22 bp, Homo sapiens
tagggcagccacccaggctgct

SEQ ID NO: 7508026 - DNA, 22 bp, Homo sapiens
tagggcagccacccaggctgct

SEQ ID NO: 7508027 - DNA, 22 bp, Homo sapiens
tagggcagccacccaggctgct

SEQ ID NO: 7508028 - DNA, 22 bp, Homo sapiens
tagggcagccacccaggctgct

SEQ ID NO: 7508029 - DNA, 22 bp, Homo sapiens
tagggcagccacccaggctgct

SEQ ID NO: 7508030 - DNA, 22 bp, Homo sapiens
tagggcagccacccaggctgct

SEQ ID NO: 7508031 - DNA, 22 bp, Homo sapiens
tagggcagccacccaggctgct

SEQ ID NO: 7508032 - DNA, 22 bp, Homo sapiens
tagggcagccacccaggctgct

SEQ ID NO: 7508033 - DNA, 22 bp, Homo sapiens
tagggcagccttatagctccca

SEQ ID NO: 7508034 - DNA, 22 bp, Homo sapiens
tagggcagccttatagctccca

SEQ ID NO: 7508035 - DNA, 22 bp, Homo sapiens
tagggcagccttatagctccca

SEQ ID NO: 7508036 - DNA, 22 bp, Homo sapiens
tagggcagctgcatcaggcact

SEQ ID NO: 7508037 - DNA, 22 bp, Homo sapiens
tagggcagccttatagctccca

SEQ ID NO: 7508038 - DNA, 22 bp, Homo sapiens
tagggcagccttatagctccca

SEQ ID NO: 7508039 - DNA, 22 bp, Homo sapiens
tagggcagccttatagctccca

SEQ ID NO: 7508040 - DNA, 22 bp, Homo sapiens
tagggcagccacccaggctgct

SEQ ID NO: 7508041 - DNA, 22 bp, Homo sapiens
tagggcagccacccaggctgct

SEQ ID NO: 7508042 - DNA, 22 bp, Homo sapiens
tagggcagctgcatcaggcact

SEQ ID NO: 7508043 - DNA, 22 bp, Homo sapiens
tagggcagctgcatcaggcact

SEQ ID NO: 7508044 - DNA, 22 bp, Homo sapiens
tagggcagctgcatcaggcact

SEQ ID NO: 7508045 - DNA, 23 bp, Homo sapiens
tagggcagctgggagggacatgc

SEQ ID NO: 7508046 - DNA, 23 bp, Homo sapiens
tagggcagctgggagggacatgc

SEQ ID NO: 7508047 - DNA, 22 bp, Homo sapiens
tagggcagctgcatcaggcact

SEQ ID NO: 7508048 - DNA, 22 bp, Homo sapiens
tagggcagctgcatcaggcact

SEQ ID NO: 7508049 - DNA, 22 bp, Homo sapiens
tagggcagctgcatcaggcact

SEQ ID NO: 7508050 - DNA, 23 bp, Homo sapiens
tagggcagctgggagggacatgc

SEQ ID NO: 7508051 - DNA, 23 bp, Homo sapiens
tagggcagctgggagggacatgc

SEQ ID NO: 7508052 - DNA, 23 bp, Homo sapiens
tagggcagctgggagggacatgc

SEQ ID NO: 7508053 - DNA, 23 bp, Homo sapiens
tagggcagctgggagggacatgc

SEQ ID NO: 7508054 - DNA, 23 bp, Homo sapiens
tagggcagctgggagggacatgc

SEQ ID NO: 7508055 - DNA, 23 bp, Homo sapiens
tagggcagctgggagggacatgc

SEQ ID NO: 7508056 - DNA, 23 bp, Homo sapiens
tagggcagctgggagggacatgc

SEQ ID NO: 7508057 - DNA, 23 bp, Homo sapiens
tagggcagctgggagggacatgc

SEQ ID NO: 7508058 - DNA, 23 bp, Homo sapiens
tagggcagctgggagggacatgc

SEQ ID NO: 7508059 - DNA, 23 bp, Homo sapiens
tagggcagctgggagggacatgc

SEQ ID NO: 7508060 - DNA, 23 bp, Homo sapiens
tagggcagctgggagggacatgc

SEQ ID NO: 7508061 - DNA, 23 bp, Homo sapiens
tagggcagctgggagggacatgc

SEQ ID NO: 7508062 - DNA, 21 bp, Homo sapiens
tagggctctatttttatttca

SEQ ID NO: 7508063 - DNA, 18 bp, Homo sapiens
tagggctctagggagtga

SEQ ID NO: 7508064 - DNA, 18 bp, Homo sapiens
tagggctctagggagtga

SEQ ID NO: 7508065 - DNA, 21 bp, Homo sapiens
tagggctctatttttatttca

SEQ ID NO: 7508066 - DNA, 21 bp, Homo sapiens
tagggctctatttttatttca

SEQ ID NO: 7508067 - DNA, 22 bp, Homo sapiens
tagggctgaggcaacaagggag

SEQ ID NO: 7508068 - DNA, 22 bp, Homo sapiens
tagggctctgctcatcagttgt

SEQ ID NO: 7508069 - DNA, 22 bp, Homo sapiens
tagggctctggtgggctctgtt

SEQ ID NO: 7508070 - DNA, 22 bp, Homo sapiens
tagggctgaggcaacaagggag

SEQ ID NO: 7508071 - DNA, 21 bp, Homo sapiens
tagggctctctgtgtcaggtg

SEQ ID NO: 7508072 - DNA, 22 bp, Homo sapiens
tagggctctgagagttcagcct

SEQ ID NO: 7508073 - DNA, 22 bp, Homo sapiens
tagggctgtgtctccaggacca

SEQ ID NO: 7508074 - DNA, 22 bp, Homo sapiens
tagggctgtggtcagtcctcta

SEQ ID NO: 7508075 - DNA, 22 bp, Homo sapiens
tagggctgtggtcagtcctcta

SEQ ID NO: 7508076 - DNA, 22 bp, Homo sapiens
tagggctgtggtcagtcctcta

SEQ ID NO: 7508077 - DNA, 22 bp, Homo sapiens
tagggctgggtacactcttgcc

SEQ ID NO: 7508078 - DNA, 22 bp, Homo sapiens
tagggctgggtacactcttgcc

SEQ ID NO: 7508079 - DNA, 22 bp, Homo sapiens
tagggctgggtacactcttgcc

SEQ ID NO: 7508080 - DNA, 22 bp, Homo sapiens
tagggctgggtacactcttgcc

SEQ ID NO: 7508081 - DNA, 22 bp, Homo sapiens
tagggctgtggtcagtcctcta

SEQ ID NO: 7508082 - DNA, 22 bp, Homo sapiens
tagggctggcgtgctcagggaa

SEQ ID NO: 7508083 - DNA, 16 bp, Homo sapiens
tagggctgggaaggag

SEQ ID NO: 7508084 - DNA, 16 bp, Homo sapiens
tagggctgggaaggag

SEQ ID NO: 7508085 - DNA, 16 bp, Homo sapiens
tagggctgggaaggag

SEQ ID NO: 7508086 - DNA, 16 bp, Homo sapiens
tagggctgggaaggag

SEQ ID NO: 7508087 - DNA, 16 bp, Homo sapiens
tagggctgggaaggag

SEQ ID NO: 7508088 - DNA, 22 bp, Homo sapiens
tagggctgggtacactcttgcc

SEQ ID NO: 7508089 - DNA, 22 bp, Homo sapiens
tagggctgtttaaaagtgaggt

SEQ ID NO: 7508090 - DNA, 22 bp, Homo sapiens
tagggcttcaggtgtgaggcag

SEQ ID NO: 7508091 - DNA, 22 bp, Homo sapiens
tagggcttcaggtgtgaggcag

SEQ ID NO: 7508092 - DNA, 22 bp, Homo sapiens
tagggctgtttaaaagtgaggt

SEQ ID NO: 7508093 - DNA, 22 bp, Homo sapiens
tagggctgtttaaaagtgaggt

SEQ ID NO: 7508094 - DNA, 22 bp, Homo sapiens
tagggctgtttaaaagtgaggt

SEQ ID NO: 7508095 - DNA, 22 bp, Homo sapiens
tagggctgtttaaaagtgaggt

SEQ ID NO: 7508096 - DNA, 22 bp, Homo sapiens
tagggctgtttaaaagtgaggt

SEQ ID NO: 7508097 - DNA, 22 bp, Homo sapiens
tagggctgtgtctccaggacca

SEQ ID NO: 7508098 - DNA, 22 bp, Homo sapiens
tagggctgttagtaattctcag

SEQ ID NO: 7508099 - DNA, 22 bp, Homo sapiens
tagggctgttagtaattctcag

SEQ ID NO: 7508100 - DNA, 22 bp, Homo sapiens
tagggctgtgtctccaggacca

SEQ ID NO: 7508101 - DNA, 22 bp, Homo sapiens
tagggctgtgtctccaggacca

SEQ ID NO: 7508102 - DNA, 22 bp, Homo sapiens
tagggctgtgtctccaggacca

SEQ ID NO: 7508103 - DNA, 22 bp, Homo sapiens
tagggctgggtacactcttgcc

SEQ ID NO: 7508104 - DNA, 22 bp, Homo sapiens
tagggctgtgtctccaggacca

SEQ ID NO: 7508105 - DNA, 22 bp, Homo sapiens
tagggctgtgtctccaggacca

SEQ ID NO: 7508106 - DNA, 19 bp, Homo sapiens
tagggctggccgggcggtg

SEQ ID NO: 7508107 - DNA, 19 bp, Homo sapiens
tagggctggccgggcggtg

SEQ ID NO: 7508108 - DNA, 19 bp, Homo sapiens
tagggctggccgggcggtg

SEQ ID NO: 7508109 - DNA, 19 bp, Homo sapiens
tagggctggccgggcggtg

SEQ ID NO: 7508110 - DNA, 22 bp, Homo sapiens
tagggctgctttgtattctgct

SEQ ID NO: 7508111 - DNA, 19 bp, Homo sapiens
tagggctggccgggcggtg

SEQ ID NO: 7508112 - DNA, 22 bp, Homo sapiens
tagggctggcgtgctcagggaa

SEQ ID NO: 7508113 - DNA, 22 bp, Homo sapiens
tagggctggcgtgctcagggaa

SEQ ID NO: 7508114 - DNA, 22 bp, Homo sapiens
tagggctggcgtgctcagggaa

SEQ ID NO: 7508115 - DNA, 22 bp, Homo sapiens
tagggctggcgtgctcagggaa

SEQ ID NO: 7508116 - DNA, 19 bp, Homo sapiens
tagggctggccgggcggtg

SEQ ID NO: 7508117 - DNA, 22 bp, Homo sapiens
tagggctggcgtgctcagggaa

SEQ ID NO: 7508118 - DNA, 22 bp, Homo sapiens
tagggctgctgcagatgacagg

SEQ ID NO: 7508119 - DNA, 22 bp, Homo sapiens
tagggctgcctatggctagata

SEQ ID NO: 7508120 - DNA, 22 bp, Homo sapiens
tagggctgctgcagatgacagg

SEQ ID NO: 7508121 - DNA, 22 bp, Homo sapiens
tagggctgctgcagatgacagg

SEQ ID NO: 7508122 - DNA, 22 bp, Homo sapiens
tagggctgctttgtattctgct

SEQ ID NO: 7508123 - DNA, 19 bp, Homo sapiens
tagggctggccgggcggtg

SEQ ID NO: 7508124 - DNA, 22 bp, Homo sapiens
tagggctgctttgtattctgct

SEQ ID NO: 7508125 - DNA, 22 bp, Homo sapiens
tagggctgctttgtattctgct

SEQ ID NO: 7508126 - DNA, 22 bp, Homo sapiens
tagggctgcctatggctagata

SEQ ID NO: 7508127 - DNA, 22 bp, Homo sapiens
tagggctgctgcagatgacagg

SEQ ID NO: 7508128 - DNA, 22 bp, Homo sapiens
tagggctgcctatggctagata

SEQ ID NO: 7508129 - DNA, 22 bp, Homo sapiens
tagggctgcctatggctagata

SEQ ID NO: 7508130 - DNA, 22 bp, Homo sapiens
tagggctgcctatggctagata

SEQ ID NO: 7508131 - DNA, 22 bp, Homo sapiens
tagggctgccatttgcttttct

SEQ ID NO: 7508132 - DNA, 22 bp, Homo sapiens
tagggctgccatttgcttttct

SEQ ID NO: 7508133 - DNA, 22 bp, Homo sapiens
tagggctgcctatggctagata

SEQ ID NO: 7508134 - DNA, 22 bp, Homo sapiens
tagggctgcctatggctagata

SEQ ID NO: 7508135 - DNA, 22 bp, Homo sapiens
tagggctgcagaacaatggcct

SEQ ID NO: 7508136 - DNA, 22 bp, Homo sapiens
tagggctgcagaacaatggcct

SEQ ID NO: 7508137 - DNA, 22 bp, Homo sapiens
tagggctgcagaacaatggcct

SEQ ID NO: 7508138 - DNA, 22 bp, Homo sapiens
tagggctgaggcaacaagggag

SEQ ID NO: 7508139 - DNA, 22 bp, Homo sapiens
tagggctgcagaacaatggcct

SEQ ID NO: 7508140 - DNA, 22 bp, Homo sapiens
tagggctgaggcaacaagggag

SEQ ID NO: 7508141 - DNA, 22 bp, Homo sapiens
tagggctgccatttgcttttct

SEQ ID NO: 7508142 - DNA, 22 bp, Homo sapiens
tagggctgccatttgcttttct

SEQ ID NO: 7508143 - DNA, 22 bp, Homo sapiens
tagggctgccatttgcttttct

SEQ ID NO: 7508144 - DNA, 22 bp, Homo sapiens
tagggctgcagaacaatggcct

SEQ ID NO: 7508145 - DNA, 20 bp, Homo sapiens
taggcagcttgacccttggt

SEQ ID NO: 7508146 - DNA, 23 bp, Homo sapiens
taggcaggactcagatatgacag

SEQ ID NO: 7508147 - DNA, 23 bp, Homo sapiens
taggcaggactcagatatgacag

SEQ ID NO: 7508148 - DNA, 23 bp, Homo sapiens
taggcaggactcagatatgacag

SEQ ID NO: 7508149 - DNA, 22 bp, Homo sapiens
taggcaggctgaatgtagattt

SEQ ID NO: 7508150 - DNA, 23 bp, Homo sapiens
taggcaggactcagatatgacag

SEQ ID NO: 7508151 - DNA, 23 bp, Homo sapiens
taggcaggactcagatatgacag

SEQ ID NO: 7508152 - DNA, 22 bp, Homo sapiens
taggcaggctgaatgtagattt

SEQ ID NO: 7508153 - DNA, 22 bp, Homo sapiens
taggcagcttaggttagaagtg

SEQ ID NO: 7508154 - DNA, 22 bp, Homo sapiens
taggcagcttaggttagaagtg

SEQ ID NO: 7508155 - DNA, 23 bp, Homo sapiens
taggcaggactcagatatgacag

SEQ ID NO: 7508156 - DNA, 22 bp, Homo sapiens
taggcagcttaggttagaagtg

SEQ ID NO: 7508157 - DNA, 20 bp, Homo sapiens
taggcagcttgacccttggt

SEQ ID NO: 7508158 - DNA, 22 bp, Homo sapiens
taggcagattccatattttggc

SEQ ID NO: 7508159 - DNA, 22 bp, Homo sapiens
taggcagcagtgctatgattct

SEQ ID NO: 7508160 - DNA, 22 bp, Homo sapiens
taggcagcagtgctatgattct

SEQ ID NO: 7508161 - DNA, 22 bp, Homo sapiens
taggcagcatggattctgaata

SEQ ID NO: 7508162 - DNA, 22 bp, Homo sapiens
taggcagcgcttggctgtgctt

SEQ ID NO: 7508163 - DNA, 22 bp, Homo sapiens
taggcagcgcttggctgtgctt

SEQ ID NO: 7508164 - DNA, 22 bp, Homo sapiens
taggcagccagcatcagttggg

SEQ ID NO: 7508165 - DNA, 22 bp, Homo sapiens
taggcagcgcttggctgtgctt

SEQ ID NO: 7508166 - DNA, 22 bp, Homo sapiens
taggcagcgcttggctgtgctt

SEQ ID NO: 7508167 - DNA, 22 bp, Homo sapiens
taggcagctgcaaacttcggtc

SEQ ID NO: 7508168 - DNA, 22 bp, Homo sapiens
taggcagctgcaaacttcggtc

SEQ ID NO: 7508169 - DNA, 22 bp, Homo sapiens
taggcagcgcttggctgtgctt

SEQ ID NO: 7508170 - DNA, 22 bp, Homo sapiens
taggcagatgttaacaggaaaa

SEQ ID NO: 7508171 - DNA, 22 bp, Homo sapiens
taggcagatgttaacaggaaaa

SEQ ID NO: 7508172 - DNA, 22 bp, Homo sapiens
taggcagatgttaacaggaaaa

SEQ ID NO: 7508173 - DNA, 22 bp, Homo sapiens
taggcagatgttaacaggaaaa

SEQ ID NO: 7508174 - DNA, 22 bp, Homo sapiens
taggcagatgttaacaggaaaa

SEQ ID NO: 7508175 - DNA, 22 bp, Homo sapiens
taggcagattccatattttggc

SEQ ID NO: 7508176 - DNA, 22 bp, Homo sapiens
taggcagattccatattttggc

SEQ ID NO: 7508177 - DNA, 22 bp, Homo sapiens
taggcagattccatattttggc

SEQ ID NO: 7508178 - DNA, 22 bp, Homo sapiens
taggcagatgttaacaggaaaa

SEQ ID NO: 7508179 - DNA, 22 bp, Homo sapiens
taggcagagtttaatggttaag

SEQ ID NO: 7508180 - DNA, 22 bp, Homo sapiens
taggcagaggtatggtaaggac

SEQ ID NO: 7508181 - DNA, 22 bp, Homo sapiens
taggcagagtttaatggttaag

SEQ ID NO: 7508182 - DNA, 22 bp, Homo sapiens
taggcagaggtatggtaaggac

SEQ ID NO: 7508183 - DNA, 22 bp, Homo sapiens
taggcagaggtatggtaaggac

SEQ ID NO: 7508184 - DNA, 21 bp, Homo sapiens
taggcagaggagcaggtatct

SEQ ID NO: 7508185 - DNA, 21 bp, Homo sapiens
taggcagaggagcaggtatct

SEQ ID NO: 7508186 - DNA, 21 bp, Homo sapiens
taggcagaggagcaggtatct

SEQ ID NO: 7508187 - DNA, 22 bp, Homo sapiens
taggccagcccttagtcctgtc

SEQ ID NO: 7508188 - DNA, 22 bp, Homo sapiens
taggccagattgttatccatgg

SEQ ID NO: 7508189 - DNA, 22 bp, Homo sapiens
taggccagattgttatccatgg

SEQ ID NO: 7508190 - DNA, 22 bp, Homo sapiens
taggcagggattagggttgatt

SEQ ID NO: 7508191 - DNA, 22 bp, Homo sapiens
taggccagcccttagtcctgtc

SEQ ID NO: 7508192 - DNA, 22 bp, Homo sapiens
taggccagcccttagtcctgtc

SEQ ID NO: 7508193 - DNA, 22 bp, Homo sapiens
taggccaggaatcagcaagctt

SEQ ID NO: 7508194 - DNA, 22 bp, Homo sapiens
taggcaggctgaatgtagattt

SEQ ID NO: 7508195 - DNA, 22 bp, Homo sapiens
taggcaggctgaatgtagattt

SEQ ID NO: 7508196 - DNA, 22 bp, Homo sapiens
taggcaggctgaatgtagattt

SEQ ID NO: 7508197 - DNA, 22 bp, Homo sapiens
taggcaggctgaatgtagattt

SEQ ID NO: 7508198 - DNA, 22 bp, Homo sapiens
taggccagaggagcagctttgg

SEQ ID NO: 7508199 - DNA, 22 bp, Homo sapiens
taggccagattactagagtagg

SEQ ID NO: 7508200 - DNA, 22 bp, Homo sapiens
taggcagggattagggttgatt

SEQ ID NO: 7508201 - DNA, 22 bp, Homo sapiens
taggccagattactagagtagg

SEQ ID NO: 7508202 - DNA, 23 bp, Homo sapiens
taggccagggtgacctggggaga

SEQ ID NO: 7508203 - DNA, 23 bp, Homo sapiens
taggccagggtgacctggggaga

SEQ ID NO: 7508204 - DNA, 22 bp, Homo sapiens
taggccaggaatcagcaagctt

SEQ ID NO: 7508205 - DNA, 22 bp, Homo sapiens
taggccaggacagagcttccag

SEQ ID NO: 7508206 - DNA, 22 bp, Homo sapiens
taggccaggagtcagacagatt

SEQ ID NO: 7508207 - DNA, 23 bp, Homo sapiens
taggccagggtgacctggggaga

SEQ ID NO: 7508208 - DNA, 22 bp, Homo sapiens
taggccagtaaaatgtttcagt

SEQ ID NO: 7508209 - DNA, 18 bp, Homo sapiens
taggccagtatacttttc

SEQ ID NO: 7508210 - DNA, 22 bp, Homo sapiens
taggccagtggcaggttgtgtg

SEQ ID NO: 7508211 - DNA, 22 bp, Homo sapiens
taggccagtggcaggttgtgtg

SEQ ID NO: 7508212 - DNA, 22 bp, Homo sapiens
taggccagttggtggccctgga

SEQ ID NO: 7508213 - DNA, 22 bp, Homo sapiens
taggccagttggtggccctgga

SEQ ID NO: 7508214 - DNA, 22 bp, Homo sapiens
tagctggttctccaggagctag

SEQ ID NO: 7508215 - DNA, 22 bp, Homo sapiens
tagctgtcagcaatcaagtggt

SEQ ID NO: 7508216 - DNA, 22 bp, Homo sapiens
tagctgtcagctgcaggcaggc

SEQ ID NO: 7508217 - DNA, 22 bp, Homo sapiens
tagctgtccagtgagtcccttt

SEQ ID NO: 7508218 - DNA, 22 bp, Homo sapiens
tagctgtgaaacagcagaagag

SEQ ID NO: 7508219 - DNA, 22 bp, Homo sapiens
tagctgtgacgtatctctatgg

SEQ ID NO: 7508220 - DNA, 22 bp, Homo sapiens
tagctgtggagcagaggtctcc

SEQ ID NO: 7508221 - DNA, 22 bp, Homo sapiens
tagctggggctttcattcttgc

SEQ ID NO: 7508222 - DNA, 22 bp, Homo sapiens
tagctgggagtgtctgatgggt

SEQ ID NO: 7508223 - DNA, 22 bp, Homo sapiens
tagctgggagtgtctgatgggt

SEQ ID NO: 7508224 - DNA, 22 bp, Homo sapiens
tagctgggagtgtctgatgggt

SEQ ID NO: 7508225 - DNA, 22 bp, Homo sapiens
tagctgggagtgtctgatgggt

SEQ ID NO: 7508226 - DNA, 22 bp, Homo sapiens
tagctgggagtgtctgatgggt

SEQ ID NO: 7508227 - DNA, 22 bp, Homo sapiens
tagctgggactactggccctgc

SEQ ID NO: 7508228 - DNA, 22 bp, Homo sapiens
tagctgggactactggccctgc

SEQ ID NO: 7508229 - DNA, 22 bp, Homo sapiens
tagctgggactactggccctgc

SEQ ID NO: 7508230 - DNA, 22 bp, Homo sapiens
tagctgggttgaggtcatctac

SEQ ID NO: 7508231 - DNA, 22 bp, Homo sapiens
tagctgggttgaggtcatctac

SEQ ID NO: 7508232 - DNA, 22 bp, Homo sapiens
tagctgggttgaggtcatctac

SEQ ID NO: 7508233 - DNA, 22 bp, Homo sapiens
tagctgggttgaggtcatctac

SEQ ID NO: 7508234 - DNA, 22 bp, Homo sapiens
tagctggtctttaagcatgtaa

SEQ ID NO: 7508235 - DNA, 22 bp, Homo sapiens
tagctggtcctcagctccagcc

SEQ ID NO: 7508236 - DNA, 22 bp, Homo sapiens
tagctgggtctctgttttctca

SEQ ID NO: 7508237 - DNA, 22 bp, Homo sapiens
tagctgggtctctgttttctca

SEQ ID NO: 7508238 - DNA, 22 bp, Homo sapiens
tagctggggctttcattcttgc

SEQ ID NO: 7508239 - DNA, 22 bp, Homo sapiens
tagctggggctttcattcttgc

SEQ ID NO: 7508240 - DNA, 22 bp, Homo sapiens
tagctgggtctctgttttctca

SEQ ID NO: 7508241 - DNA, 22 bp, Homo sapiens
tagctgttaatatacaaatggt

SEQ ID NO: 7508242 - DNA, 22 bp, Homo sapiens
taggcagaaaggaaggcaagtt

SEQ ID NO: 7508243 - DNA, 22 bp, Homo sapiens
tagctgttacccataaaagcca

SEQ ID NO: 7508244 - DNA, 22 bp, Homo sapiens
tagctgtgtagacactcagagc

SEQ ID NO: 7508245 - DNA, 23 bp, Homo sapiens
tagctgtggcgtaaggctcagct

SEQ ID NO: 7508246 - DNA, 22 bp, Homo sapiens
tagctgtgtaacatgagaatgt

SEQ ID NO: 7508247 - DNA, 22 bp, Homo sapiens
taggcagaattgttgaatgaag

SEQ ID NO: 7508248 - DNA, 22 bp, Homo sapiens
taggcagaattgttgaatgaag

SEQ ID NO: 7508249 - DNA, 22 bp, Homo sapiens
taggcagaattgttgaatgaag

SEQ ID NO: 7508250 - DNA, 22 bp, Homo sapiens
taggcagagaggccataagaat

SEQ ID NO: 7508251 - DNA, 22 bp, Homo sapiens
taggcagagaggccataagaat

SEQ ID NO: 7508252 - DNA, 22 bp, Homo sapiens
taggcagaattcattgtgctgc

SEQ ID NO: 7508253 - DNA, 22 bp, Homo sapiens
taggcagaattgtgggctctaa

SEQ ID NO: 7508254 - DNA, 22 bp, Homo sapiens
taggcagaattcattgtgctgc

SEQ ID NO: 7508255 - DNA, 22 bp, Homo sapiens
taggcagagaggccataagaat

SEQ ID NO: 7508256 - DNA, 22 bp, Homo sapiens
taggcagagaggccataagaat

SEQ ID NO: 7508257 - DNA, 20 bp, Homo sapiens
taggcagagctgtgcagcct

SEQ ID NO: 7508258 - DNA, 20 bp, Homo sapiens
taggcagagctgtgcagcct

SEQ ID NO: 7508259 - DNA, 20 bp, Homo sapiens
taggcagagctgtgcagcct

SEQ ID NO: 7508260 - DNA, 20 bp, Homo sapiens
taggcagagctgtgcagcct

SEQ ID NO: 7508261 - DNA, 20 bp, Homo sapiens
taggcagagctgtgcagcct

SEQ ID NO: 7508262 - DNA, 20 bp, Homo sapiens
taggcagagctgtgcagcct

SEQ ID NO: 7508263 - DNA, 20 bp, Homo sapiens
taggcagagctgtgcagcct

SEQ ID NO: 7508264 - DNA, 22 bp, Homo sapiens
tagttcaggaagagaaacaaca

SEQ ID NO: 7508265 - DNA, 22 bp, Homo sapiens
tagttcacccctctttattttc

SEQ ID NO: 7508266 - DNA, 21 bp, Homo sapiens
tagttcaagttctttcagttc

SEQ ID NO: 7508267 - DNA, 22 bp, Homo sapiens
tagttcaggaagagaaacaaca

SEQ ID NO: 7508268 - DNA, 22 bp, Homo sapiens
tagttctataagcagatagagt

SEQ ID NO: 7508269 - DNA, 23 bp, Homo sapiens
tagttattttctctgtaatttgc

SEQ ID NO: 7508270 - DNA, 22 bp, Homo sapiens
tagttcaaagtctgtcaaagga

SEQ ID NO: 7508271 - DNA, 22 bp, Homo sapiens
tagttcaaagtctgtcaaagga

SEQ ID NO: 7508272 - DNA, 22 bp, Homo sapiens
tagttcaaccgtcttctcccct

SEQ ID NO: 7508273 - DNA, 23 bp, Homo sapiens
tagttattttctctgtaatttgc

SEQ ID NO: 7508274 - DNA, 22 bp, Homo sapiens
tagttattgcctaggagcagct

SEQ ID NO: 7508275 - DNA, 22 bp, Homo sapiens
tagttattattgttactatcag

SEQ ID NO: 7508276 - DNA, 22 bp, Homo sapiens
tagttatgtctgcatgcatatt

SEQ ID NO: 7508277 - DNA, 22 bp, Homo sapiens
tagttattattgttactatcag

SEQ ID NO: 7508278 - DNA, 22 bp, Homo sapiens
tagttattattgttactatcag

SEQ ID NO: 7508279 - DNA, 22 bp, Homo sapiens
tagttacagtgcatagcaagat

SEQ ID NO: 7508280 - DNA, 22 bp, Homo sapiens
tagttacagtgcatagcaagat

SEQ ID NO: 7508281 - DNA, 22 bp, Homo sapiens
tagttacagtgcatagcaagat

SEQ ID NO: 7508282 - DNA, 22 bp, Homo sapiens
tagttacaggagtttctgaaat

SEQ ID NO: 7508283 - DNA, 22 bp, Homo sapiens
tagttacagtgcatagcaagat

SEQ ID NO: 7508284 - DNA, 22 bp, Homo sapiens
tagttacagcaggcaggatata

SEQ ID NO: 7508285 - DNA, 22 bp, Homo sapiens
tagttacagcaggcaggatata

SEQ ID NO: 7508286 - DNA, 23 bp, Homo sapiens
tagttacattattgtcagagctg

SEQ ID NO: 7508287 - DNA, 22 bp, Homo sapiens
tagttacttttgctcttcatta

SEQ ID NO: 7508288 - DNA, 22 bp, Homo sapiens
tagttacttttgctcttcatta

SEQ ID NO: 7508289 - DNA, 22 bp, Homo sapiens
tagttagagaagccacagtgga

SEQ ID NO: 7508290 - DNA, 22 bp, Homo sapiens
tagttatatccagtctttaaaa

SEQ ID NO: 7508291 - DNA, 22 bp, Homo sapiens
tagttatatccagtctttaaaa

SEQ ID NO: 7508292 - DNA, 22 bp, Homo sapiens
tagtttagaatgttgcaataca

SEQ ID NO: 7508293 - DNA, 22 bp, Homo sapiens
tagtttagaatgttgcaataca

SEQ ID NO: 7508294 - DNA, 22 bp, Homo sapiens
tagtttagacttcaaccctttg

SEQ ID NO: 7508295 - DNA, 22 bp, Homo sapiens
tagtttagacttcaaccctttg

SEQ ID NO: 7508296 - DNA, 22 bp, Homo sapiens
tagtttagagaattggggatga

SEQ ID NO: 7508297 - DNA, 22 bp, Homo sapiens
tagtttagagaattggggatga

SEQ ID NO: 7508298 - DNA, 22 bp, Homo sapiens
tagtttactgttcactttgccc

SEQ ID NO: 7508299 - DNA, 22 bp, Homo sapiens
tagtttactgttcactttgccc

SEQ ID NO: 7508300 - DNA, 22 bp, Homo sapiens
tagtttactgttcactttgccc

SEQ ID NO: 7508301 - DNA, 22 bp, Homo sapiens
tagtttactgttcactttgccc

SEQ ID NO: 7508302 - DNA, 22 bp, Homo sapiens
tagtttagaatgttgcaataca

SEQ ID NO: 7508303 - DNA, 22 bp, Homo sapiens
tagtttagagaattggggatga

SEQ ID NO: 7508304 - DNA, 22 bp, Homo sapiens
tagtttagcactaagaaaaaca

SEQ ID NO: 7508305 - DNA, 22 bp, Homo sapiens
tagtttagcactaagaaaaaca

SEQ ID NO: 7508306 - DNA, 22 bp, Homo sapiens
tagtttagcatacatcttcagg

SEQ ID NO: 7508307 - DNA, 22 bp, Homo sapiens
tagtttagcactaagaaaaaca

SEQ ID NO: 7508308 - DNA, 22 bp, Homo sapiens
tagtttagccccacgtgtgctt

SEQ ID NO: 7508309 - DNA, 22 bp, Homo sapiens
tagtttagccccacgtgtgctt

SEQ ID NO: 7508310 - DNA, 22 bp, Homo sapiens
tagtttagccatttaggaattg

SEQ ID NO: 7508311 - DNA, 22 bp, Homo sapiens
tagtttagcatacatcttcagg

SEQ ID NO: 7508312 - DNA, 22 bp, Homo sapiens
tagtttagccatttaggaattg

SEQ ID NO: 7508313 - DNA, 22 bp, Homo sapiens
tagtttaccaaattgatcttcc

SEQ ID NO: 7508314 - DNA, 22 bp, Homo sapiens
tagtttaccaaattgatcttcc

SEQ ID NO: 7508315 - DNA, 22 bp, Homo sapiens
tagtttaccaaattgatcttcc

SEQ ID NO: 7508316 - DNA, 22 bp, Homo sapiens
tagtttaatggtcaactaatga

SEQ ID NO: 7508317 - DNA, 22 bp, Homo sapiens
tagtttaatggtcaactaatga

SEQ ID NO: 7508318 - DNA, 22 bp, Homo sapiens
tagtttactcatctataaaatg

SEQ ID NO: 7508319 - DNA, 22 bp, Homo sapiens
tagtttactcatctataaaatg

SEQ ID NO: 7508320 - DNA, 22 bp, Homo sapiens
tagtttactcatctataaaatg

SEQ ID NO: 7508321 - DNA, 22 bp, Homo sapiens
tagtttactcatctataaaatg

SEQ ID NO: 7508322 - DNA, 22 bp, Homo sapiens
tagtttactcatctataaaatg

SEQ ID NO: 7508323 - DNA, 22 bp, Homo sapiens
tagtttaccaaattgatcttcc

SEQ ID NO: 7508324 - DNA, 22 bp, Homo sapiens
tagtttaccaaattgatcttcc

SEQ ID NO: 7508325 - DNA, 20 bp, Homo sapiens
tagttgccaaaatgccctgc

SEQ ID NO: 7508326 - DNA, 22 bp, Homo sapiens
tagtttaaaagttagggatgat

SEQ ID NO: 7508327 - DNA, 22 bp, Homo sapiens
tagtttaaaagttagggatgat

SEQ ID NO: 7508328 - DNA, 22 bp, Homo sapiens
tagtttaatggtcaactaatga

SEQ ID NO: 7508329 - DNA, 22 bp, Homo sapiens
tagtttaatggtcaactaatga

SEQ ID NO: 7508330 - DNA, 22 bp, Homo sapiens
tagttgctaaaaagtgcctaac

SEQ ID NO: 7508331 - DNA, 22 bp, Homo sapiens
tagtttaatggtcaactaatga

SEQ ID NO: 7508332 - DNA, 22 bp, Homo sapiens
tagtttaatggtcaactaatga

SEQ ID NO: 7508333 - DNA, 22 bp, Homo sapiens
tagtttaatggtcaactaatga

SEQ ID NO: 7508334 - DNA, 22 bp, Homo sapiens
tagttcttcatgaattcagctt

SEQ ID NO: 7508335 - DNA, 22 bp, Homo sapiens
tagttcttcatgaattcagctt

SEQ ID NO: 7508336 - DNA, 22 bp, Homo sapiens
tagttctggtatttgctgacaa

SEQ ID NO: 7508337 - DNA, 22 bp, Homo sapiens
tagttgaaagggattattgtgg

SEQ ID NO: 7508338 - DNA, 22 bp, Homo sapiens
tagtttttactgcgagttataa

SEQ ID NO: 7508339 - DNA, 22 bp, Homo sapiens
tagtttttactgcgagttataa

SEQ ID NO: 7508340 - DNA, 22 bp, Homo sapiens
tagttttttcaacaaatggtgc

SEQ ID NO: 7508341 - DNA, 22 bp, Homo sapiens
tagttttttcaacaaatggtgc

SEQ ID NO: 7508342 - DNA, 22 bp, Homo sapiens
tagtttttaagtgtacaatttc

SEQ ID NO: 7508343 - DNA, 22 bp, Homo sapiens
tagtttttactgcgagttataa

SEQ ID NO: 7508344 - DNA, 22 bp, Homo sapiens
tagtttttactgcgagttataa

SEQ ID NO: 7508345 - DNA, 22 bp, Homo sapiens
tagtttttaagtgtacaatttc

SEQ ID NO: 7508346 - DNA, 22 bp, Homo sapiens
tagtttttaagtgtacaatttc

SEQ ID NO: 7508347 - DNA, 22 bp, Homo sapiens
tagtttttaagtgtacaatttc

SEQ ID NO: 7508348 - DNA, 22 bp, Homo sapiens
tagtttttaagtgtacaatttc

SEQ ID NO: 7508349 - DNA, 22 bp, Homo sapiens
tagtttttaagtgtacaatttc

SEQ ID NO: 7508350 - DNA, 22 bp, Homo sapiens
tagtttttaagtgtacaatttc

SEQ ID NO: 7508351 - DNA, 22 bp, Homo sapiens
tagtttttaagtgtacaatttc

SEQ ID NO: 7508352 - DNA, 22 bp, Homo sapiens
tagttttatgaattggtataat

SEQ ID NO: 7508353 - DNA, 22 bp, Homo sapiens
tagttttatgaattggtataat

SEQ ID NO: 7508354 - DNA, 22 bp, Homo sapiens
tagttttgattagtattgtctt

SEQ ID NO: 7508355 - DNA, 22 bp, Homo sapiens
tagttttatgaattggtataat

SEQ ID NO: 7508356 - DNA, 22 bp, Homo sapiens
tagttttgaggattatatgtga

SEQ ID NO: 7508357 - DNA, 21 bp, Homo sapiens
tagtttctacccagttaatgg

SEQ ID NO: 7508358 - DNA, 22 bp, Homo sapiens
tagttttataatgttaacatct

SEQ ID NO: 7508359 - DNA, 22 bp, Homo sapiens
tagttttataatgttaacatct

SEQ ID NO: 7508360 - DNA, 21 bp, Homo sapiens
tagtttctacccagttaatgg

SEQ ID NO: 7508361 - DNA, 18 bp, Homo sapiens
tagtttctaatggccttt

SEQ ID NO: 7508362 - DNA, 22 bp, Homo sapiens
tagtttctaaagcttcctaggt

SEQ ID NO: 7508363 - DNA, 22 bp, Homo sapiens
tagtttctaaagcttcctaggt

SEQ ID NO: 7508364 - DNA, 22 bp, Homo sapiens
tagtttctaaactgaactgtca

SEQ ID NO: 7508365 - DNA, 22 bp, Homo sapiens
tagtttcctaggctgtattgtt

SEQ ID NO: 7508366 - DNA, 22 bp, Homo sapiens
tagtttccttggctattaggca

SEQ ID NO: 7508367 - DNA, 22 bp, Homo sapiens
tagtttctaaagcttcctaggt

SEQ ID NO: 7508368 - DNA, 22 bp, Homo sapiens
tagtttctaaagcttcctaggt

SEQ ID NO: 7508369 - DNA, 22 bp, Homo sapiens
tagttttatgaattggtataat

SEQ ID NO: 7508370 - DNA, 22 bp, Homo sapiens
tagttttatgaattggtataat

SEQ ID NO: 7508371 - DNA, 22 bp, Homo sapiens
tagttttatgaattggtataat

SEQ ID NO: 7508372 - DNA, 22 bp, Homo sapiens
tagttttatgaattggtataat

SEQ ID NO: 7508373 - DNA, 22 bp, Homo sapiens
tagttttataatgttaacatct

SEQ ID NO: 7508374 - DNA, 22 bp, Homo sapiens
tagttttataatgttaacatct

SEQ ID NO: 7508375 - DNA, 22 bp, Homo sapiens
tagttttataatgttaacatct

SEQ ID NO: 7508376 - DNA, 22 bp, Homo sapiens
tagttttataatgttaacatct

SEQ ID NO: 7508377 - DNA, 22 bp, Homo sapiens
tagttttataatgttaacatct

SEQ ID NO: 7508378 - DNA, 22 bp, Homo sapiens
tagttttataatgttaacatct

SEQ ID NO: 7508379 - DNA, 22 bp, Homo sapiens
tagttttataatgttaacatct

SEQ ID NO: 7508380 - DNA, 22 bp, Homo sapiens
tagttttataatgttaacatct

SEQ ID NO: 7508381 - DNA, 22 bp, Homo sapiens
tagttttataatgttaacatct

SEQ ID NO: 7508382 - DNA, 22 bp, Homo sapiens
tagtttatgattttttggaagg

SEQ ID NO: 7508383 - DNA, 22 bp, Homo sapiens
tagtttatgattttttggaagg

SEQ ID NO: 7508384 - DNA, 22 bp, Homo sapiens
tagtttatgattttttggaagg

SEQ ID NO: 7508385 - DNA, 22 bp, Homo sapiens
tagtttatgattttttggaagg

SEQ ID NO: 7508386 - DNA, 22 bp, Homo sapiens
tagtttatgctgctgcagtgag

SEQ ID NO: 7508387 - DNA, 22 bp, Homo sapiens
tagtttatgctgctgcagtgag

SEQ ID NO: 7508388 - DNA, 22 bp, Homo sapiens
tagtttatgattttttggaagg

SEQ ID NO: 7508389 - DNA, 22 bp, Homo sapiens
tagtttatgctgctgcagtgag

SEQ ID NO: 7508390 - DNA, 22 bp, Homo sapiens
tagtttagtaagaggagagctg

SEQ ID NO: 7508391 - DNA, 22 bp, Homo sapiens
tagtttaggtggggtagacaga

SEQ ID NO: 7508392 - DNA, 22 bp, Homo sapiens
tagtttaggtcgtacaagcaaa

SEQ ID NO: 7508393 - DNA, 22 bp, Homo sapiens
tagtttaggtggggtagacaga

SEQ ID NO: 7508394 - DNA, 22 bp, Homo sapiens
tagtttaggtcgtacaagcaaa

SEQ ID NO: 7508395 - DNA, 22 bp, Homo sapiens
tagtttagtgaatggttaaaga

SEQ ID NO: 7508396 - DNA, 22 bp, Homo sapiens
tagtttagtgaatggttaaaga

SEQ ID NO: 7508397 - DNA, 22 bp, Homo sapiens
tagtttagtaagaggagagctg

SEQ ID NO: 7508398 - DNA, 22 bp, Homo sapiens
tagtttatagttagcgagcacg

SEQ ID NO: 7508399 - DNA, 22 bp, Homo sapiens
tagtttatagttagcgagcacg

SEQ ID NO: 7508400 - DNA, 22 bp, Homo sapiens
tagtttaggatcttttttgtgc

SEQ ID NO: 7508401 - DNA, 22 bp, Homo sapiens
tagtttaggatccaatctaaga

SEQ ID NO: 7508402 - DNA, 22 bp, Homo sapiens
tagtttaggatccaatctaaga

SEQ ID NO: 7508403 - DNA, 22 bp, Homo sapiens
tagtttaggtcgtacaagcaaa

SEQ ID NO: 7508404 - DNA, 22 bp, Homo sapiens
tagtttaggatcttttttgtgc

SEQ ID NO: 7508405 - DNA, 22 bp, Homo sapiens
tagtttaggaattatgagggtg

SEQ ID NO: 7508406 - DNA, 22 bp, Homo sapiens
tagtttaggatccaatctaaga

SEQ ID NO: 7508407 - DNA, 22 bp, Homo sapiens
tagtttaggaacaagtagtgga

SEQ ID NO: 7508408 - DNA, 22 bp, Homo sapiens
tagtttaggaattatgagggtg

SEQ ID NO: 7508409 - DNA, 22 bp, Homo sapiens
tagtttaggaacaagtagtgga

SEQ ID NO: 7508410 - DNA, 22 bp, Homo sapiens
tagtttagcttagccttctggt

SEQ ID NO: 7508411 - DNA, 22 bp, Homo sapiens
tagtttagcttagccttctggt

SEQ ID NO: 7508412 - DNA, 22 bp, Homo sapiens
tagtttcatatgcaaaatagta

SEQ ID NO: 7508413 - DNA, 22 bp, Homo sapiens
tagtttcagattgctttcatat

SEQ ID NO: 7508414 - DNA, 22 bp, Homo sapiens
tagtttcagctccttcatcctg

SEQ ID NO: 7508415 - DNA, 22 bp, Homo sapiens
tagtttcatatgcaaaatagta

SEQ ID NO: 7508416 - DNA, 22 bp, Homo sapiens
tagtttcatatgcaaaatagta

SEQ ID NO: 7508417 - DNA, 22 bp, Homo sapiens
tagtttcagattgctttcatat

SEQ ID NO: 7508418 - DNA, 22 bp, Homo sapiens
tagtttatgctgctgcagtgag

SEQ ID NO: 7508419 - DNA, 22 bp, Homo sapiens
tagtttcatatgcaaaatagta

SEQ ID NO: 7508420 - DNA, 22 bp, Homo sapiens
tagtttcatctccaccctgccc

SEQ ID NO: 7508421 - DNA, 22 bp, Homo sapiens
tagtttcatctccaccctgccc

SEQ ID NO: 7508422 - DNA, 22 bp, Homo sapiens
tagtttcatctccaccctgccc

SEQ ID NO: 7508423 - DNA, 22 bp, Homo sapiens
tagtttcatctccaccctgccc

SEQ ID NO: 7508424 - DNA, 22 bp, Homo sapiens
tagtttccatgttatacagttt

SEQ ID NO: 7508425 - DNA, 22 bp, Homo sapiens
tagtttccatgttatacagttt

SEQ ID NO: 7508426 - DNA, 22 bp, Homo sapiens
tagtttcctaggctgtattgtt

SEQ ID NO: 7508427 - DNA, 22 bp, Homo sapiens
tagtttcctaggctgtattgtt

SEQ ID NO: 7508428 - DNA, 22 bp, Homo sapiens
tagtttccttggctattaggca

SEQ ID NO: 7508429 - DNA, 22 bp, Homo sapiens
tagtgcttattactgtgctgtc

SEQ ID NO: 7508430 - DNA, 22 bp, Homo sapiens
tagtgcttattactgtgctgtc

SEQ ID NO: 7508431 - DNA, 22 bp, Homo sapiens
tagtgcttctaccctaggcagg

SEQ ID NO: 7508432 - DNA, 22 bp, Homo sapiens
tagtgcttgagtctctccgtac

SEQ ID NO: 7508433 - DNA, 22 bp, Homo sapiens
tagtgcttggccctaccagata

SEQ ID NO: 7508434 - DNA, 22 bp, Homo sapiens
tagtgcttggtggagatggaga

SEQ ID NO: 7508435 - DNA, 22 bp, Homo sapiens
tagtgctttaagtttacagaga

SEQ ID NO: 7508436 - DNA, 22 bp, Homo sapiens
tagtgctttaagtttacagaga

SEQ ID NO: 7508437 - DNA, 22 bp, Homo sapiens
tagtggagaagtggagtctgtg

SEQ ID NO: 7508438 - DNA, 18 bp, Homo sapiens
tagtggaactgctctggg

SEQ ID NO: 7508439 - DNA, 22 bp, Homo sapiens
tagtgctttggagctttctcct

SEQ ID NO: 7508440 - DNA, 22 bp, Homo sapiens
tagtgctttaggcctgagtgtc

SEQ ID NO: 7508441 - DNA, 22 bp, Homo sapiens
tagtgctttattgttcctgaaa

SEQ ID NO: 7508442 - DNA, 22 bp, Homo sapiens
tagtgcttaaaagtggaagaga

SEQ ID NO: 7508443 - DNA, 22 bp, Homo sapiens
tagtgcttaataaatttcagaa

SEQ ID NO: 7508444 - DNA, 22 bp, Homo sapiens
tagtgctatagaagtgcttgcg

SEQ ID NO: 7508445 - DNA, 22 bp, Homo sapiens
tagtgctatggccagagccctt

SEQ ID NO: 7508446 - DNA, 22 bp, Homo sapiens
tagtgcttaaaagtggaagaga

SEQ ID NO: 7508447 - DNA, 22 bp, Homo sapiens
tagtgcttaacacaaagtgatt

SEQ ID NO: 7508448 - DNA, 22 bp, Homo sapiens
tagtgcttaaaagtggaagaga

SEQ ID NO: 7508449 - DNA, 22 bp, Homo sapiens
tagtgctattaaggatacagag

SEQ ID NO: 7508450 - DNA, 22 bp, Homo sapiens
tagtgctattaaggatacagag

SEQ ID NO: 7508451 - DNA, 22 bp, Homo sapiens
tagtgccctcccctttgggata

SEQ ID NO: 7508452 - DNA, 22 bp, Homo sapiens
tagtgccctcccctttgggata

SEQ ID NO: 7508453 - DNA, 22 bp, Homo sapiens
tagtgcccaaatcccagctctg

SEQ ID NO: 7508454 - DNA, 22 bp, Homo sapiens
tagtgccattgccaggaagggc

SEQ ID NO: 7508455 - DNA, 20 bp, Homo sapiens
tagtgccagtgtgcatgcta

SEQ ID NO: 7508456 - DNA, 22 bp, Homo sapiens
tagttacagcaggcaggatata

SEQ ID NO: 7508457 - DNA, 22 bp, Homo sapiens
tagttacagcaggcaggatata

SEQ ID NO: 7508458 - DNA, 22 bp, Homo sapiens
tagttacagagaaatgatttga

SEQ ID NO: 7508459 - DNA, 22 bp, Homo sapiens
tagttacagagaaatgatttga

SEQ ID NO: 7508460 - DNA, 22 bp, Homo sapiens
tagttacagaagataagggtat

SEQ ID NO: 7508461 - DNA, 22 bp, Homo sapiens
tagttacaaaccaacaggcagc

SEQ ID NO: 7508462 - DNA, 22 bp, Homo sapiens
tagttacaaaccaacaggcagc

SEQ ID NO: 7508463 - DNA, 22 bp, Homo sapiens
tagttacaaaccaacaggcagc

SEQ ID NO: 7508464 - DNA, 22 bp, Homo sapiens
tagttacaatgggttctgtgac

SEQ ID NO: 7508465 - DNA, 22 bp, Homo sapiens
tagttacaattatgcatggaaa

SEQ ID NO: 7508466 - DNA, 22 bp, Homo sapiens
tagttacaattatgcatggaaa

SEQ ID NO: 7508467 - DNA, 22 bp, Homo sapiens
tagttacacatgggtagggaat

SEQ ID NO: 7508468 - DNA, 19 bp, Homo sapiens
tagtggagtgacaagttct

SEQ ID NO: 7508469 - DNA, 22 bp, Homo sapiens
tagtggagtagaaaccaaagaa

SEQ ID NO: 7508470 - DNA, 22 bp, Homo sapiens
tagtggagtagaaaccaaagaa

SEQ ID NO: 7508471 - DNA, 22 bp, Homo sapiens
tagtggaggtggtctgtgaact

SEQ ID NO: 7508472 - DNA, 22 bp, Homo sapiens
tagtggaggtggtctgtgaact

SEQ ID NO: 7508473 - DNA, 22 bp, Homo sapiens
tagtggaggtggtctgtgaact

SEQ ID NO: 7508474 - DNA, 22 bp, Homo sapiens
tagtggaggtggtctgtgaact

SEQ ID NO: 7508475 - DNA, 22 bp, Homo sapiens
tagtggagggtgtagctgctgg

SEQ ID NO: 7508476 - DNA, 22 bp, Homo sapiens
tagtggagggtgtagctgctgg

SEQ ID NO: 7508477 - DNA, 22 bp, Homo sapiens
tagtggaggtggtctgtgaact

SEQ ID NO: 7508478 - DNA, 22 bp, Homo sapiens
tagtggagggtgtagctgctgg

SEQ ID NO: 7508479 - DNA, 22 bp, Homo sapiens
tagtggaggggatgcaaagctt

SEQ ID NO: 7508480 - DNA, 22 bp, Homo sapiens
tagtggaggggatgcaaagctt

SEQ ID NO: 7508481 - DNA, 22 bp, Homo sapiens
tagtggaggcctgttgtgtgca

SEQ ID NO: 7508482 - DNA, 22 bp, Homo sapiens
tagtggagagttgttttgtgca

SEQ ID NO: 7508483 - DNA, 22 bp, Homo sapiens
tagtggagaggatgtggagaaa

SEQ ID NO: 7508484 - DNA, 22 bp, Homo sapiens
tagtggagaggatgtggagaaa

SEQ ID NO: 7508485 - DNA, 22 bp, Homo sapiens
tagtggagaagtggagtctgtg

SEQ ID NO: 7508486 - DNA, 22 bp, Homo sapiens
tagtggagaagtggagtctgtg

SEQ ID NO: 7508487 - DNA, 21 bp, Homo sapiens
tagggggcagtgggatgctta

SEQ ID NO: 7508488 - DNA, 21 bp, Homo sapiens
tagggggcagtgggatgctta

SEQ ID NO: 7508489 - DNA, 21 bp, Homo sapiens
tagggggcagtgggatgctta

SEQ ID NO: 7508490 - DNA, 21 bp, Homo sapiens
tagggggcagtgggatgctta

SEQ ID NO: 7508491 - DNA, 22 bp, Homo sapiens
taggggcttgtaatttaataga

SEQ ID NO: 7508492 - DNA, 22 bp, Homo sapiens
taggggcttgtaatttaataga

SEQ ID NO: 7508493 - DNA, 22 bp, Homo sapiens
tagggggctttgctgcttgaca

SEQ ID NO: 7508494 - DNA, 22 bp, Homo sapiens
tagggggctttgctgcttgaca

SEQ ID NO: 7508495 - DNA, 22 bp, Homo sapiens
tagggggctgtcctgtgcatta

SEQ ID NO: 7508496 - DNA, 22 bp, Homo sapiens
tagggggctttgctgcttgaca

SEQ ID NO: 7508497 - DNA, 21 bp, Homo sapiens
tagggggcagtgggatgctta

SEQ ID NO: 7508498 - DNA, 22 bp, Homo sapiens
tagggggctgtcctgtgcatta

SEQ ID NO: 7508499 - DNA, 22 bp, Homo sapiens
tagggggctgtcctgtgcatta

SEQ ID NO: 7508500 - DNA, 22 bp, Homo sapiens
tagggggctgtcctgtgcatta

SEQ ID NO: 7508501 - DNA, 23 bp, Homo sapiens
taggggctggcgtggagcctgcg

SEQ ID NO: 7508502 - DNA, 23 bp, Homo sapiens
taggggctggcgtggagcctgcg

SEQ ID NO: 7508503 - DNA, 23 bp, Homo sapiens
taggggctggcgtggagcctgcg

SEQ ID NO: 7508504 - DNA, 21 bp, Homo sapiens
taggggctggggctccagctg

SEQ ID NO: 7508505 - DNA, 21 bp, Homo sapiens
taggggctggggctccagctg

SEQ ID NO: 7508506 - DNA, 21 bp, Homo sapiens
taggggctggggctccagctg

SEQ ID NO: 7508507 - DNA, 22 bp, Homo sapiens
taggggctcagaacatgtcctt

SEQ ID NO: 7508508 - DNA, 23 bp, Homo sapiens
taggggctggcgtggagcctgcg

SEQ ID NO: 7508509 - DNA, 22 bp, Homo sapiens
taggggcaggatcctttgagcc

SEQ ID NO: 7508510 - DNA, 22 bp, Homo sapiens
taggggctcagaacatgtcctt

SEQ ID NO: 7508511 - DNA, 22 bp, Homo sapiens
taggggctcagaacatgtcctt

SEQ ID NO: 7508512 - DNA, 22 bp, Homo sapiens
taggggaggggatcatgtgctg

SEQ ID NO: 7508513 - DNA, 22 bp, Homo sapiens
taggggaggggatcatgtgctg

SEQ ID NO: 7508514 - DNA, 22 bp, Homo sapiens
taggggcagaagcggcggtcca

SEQ ID NO: 7508515 - DNA, 22 bp, Homo sapiens
taggggcagaagcggcggtcca

SEQ ID NO: 7508516 - DNA, 22 bp, Homo sapiens
taggggactgacaagcggggac

SEQ ID NO: 7508517 - DNA, 22 bp, Homo sapiens
taggggaggggatcatgtgctg

SEQ ID NO: 7508518 - DNA, 22 bp, Homo sapiens
taggggaggggatcatgtgctg

SEQ ID NO: 7508519 - DNA, 22 bp, Homo sapiens
taggggaggggatcatgtgctg

SEQ ID NO: 7508520 - DNA, 22 bp, Homo sapiens
taggggaggccaggaagtttta

SEQ ID NO: 7508521 - DNA, 22 bp, Homo sapiens
taggggaggccaggaagtttta

SEQ ID NO: 7508522 - DNA, 22 bp, Homo sapiens
taggggagctcgggtgcaatcg

SEQ ID NO: 7508523 - DNA, 22 bp, Homo sapiens
taggggagctcgggtgcaatcg

SEQ ID NO: 7508524 - DNA, 22 bp, Homo sapiens
taggggagctcgggtgcaatcg

SEQ ID NO: 7508525 - DNA, 22 bp, Homo sapiens
taggggaactggcacagggcag

SEQ ID NO: 7508526 - DNA, 22 bp, Homo sapiens
taggggaactggcacagggcag

SEQ ID NO: 7508527 - DNA, 22 bp, Homo sapiens
taggggaactggcacagggcag

SEQ ID NO: 7508528 - DNA, 23 bp, Homo sapiens
taggggaaaaatcttctgcaatt

SEQ ID NO: 7508529 - DNA, 22 bp, Homo sapiens
taggggagctcgggtgcaatcg

SEQ ID NO: 7508530 - DNA, 22 bp, Homo sapiens
taggggagctcgggtgcaatcg

SEQ ID NO: 7508531 - DNA, 22 bp, Homo sapiens
taggggaactggcacagggcag

SEQ ID NO: 7508532 - DNA, 22 bp, Homo sapiens
taggggaagtctcagaatgcag

SEQ ID NO: 7508533 - DNA, 22 bp, Homo sapiens
taggggaattgcagtgtgtcca

SEQ ID NO: 7508534 - DNA, 22 bp, Homo sapiens
taggggaattgcagtgtgtcca

SEQ ID NO: 7508535 - DNA, 22 bp, Homo sapiens
tagtgcacacgcatgtagcagt

SEQ ID NO: 7508536 - DNA, 22 bp, Homo sapiens
tagtgcagaggaggagcctctg

SEQ ID NO: 7508537 - DNA, 22 bp, Homo sapiens
tagtgcaatgtgaggcagtacc

SEQ ID NO: 7508538 - DNA, 22 bp, Homo sapiens
tagtgcaattccccatactaac

SEQ ID NO: 7508539 - DNA, 22 bp, Homo sapiens
tagtgcaattccccatactaac

SEQ ID NO: 7508540 - DNA, 22 bp, Homo sapiens
tagtgcagaggaggagcctctg

SEQ ID NO: 7508541 - DNA, 22 bp, Homo sapiens
tagtgcagggttttaagcactg

SEQ ID NO: 7508542 - DNA, 22 bp, Homo sapiens
tagtgcaggttaataggacttc

SEQ ID NO: 7508543 - DNA, 22 bp, Homo sapiens
tagtgcaggttaataggacttc

SEQ ID NO: 7508544 - DNA, 22 bp, Homo sapiens
tagtgcatacctaacatttttg

SEQ ID NO: 7508545 - DNA, 22 bp, Homo sapiens
tagtgcatataactagaatacc

SEQ ID NO: 7508546 - DNA, 22 bp, Homo sapiens
tagtgccaaagcctggtgtcat

SEQ ID NO: 7508547 - DNA, 22 bp, Homo sapiens
tagtgcattcatctgatcctgt

SEQ ID NO: 7508548 - DNA, 22 bp, Homo sapiens
tagtgcatacacagcttatttc

SEQ ID NO: 7508549 - DNA, 22 bp, Homo sapiens
tagtgcatacctaacatttttg

SEQ ID NO: 7508550 - DNA, 22 bp, Homo sapiens
tagtgcatacctaacatttttg

SEQ ID NO: 7508551 - DNA, 22 bp, Homo sapiens
tagtgccaagctaatgccagaa

SEQ ID NO: 7508552 - DNA, 22 bp, Homo sapiens
tagtgccaaggttcgaagtaca

SEQ ID NO: 7508553 - DNA, 22 bp, Homo sapiens
tagtgccaccttccaagtatca

SEQ ID NO: 7508554 - DNA, 22 bp, Homo sapiens
tagggggctttgctgcttgaca

SEQ ID NO: 7508555 - DNA, 21 bp, Homo sapiens
tagggggcagtgggatgctta

SEQ ID NO: 7508556 - DNA, 23 bp, Homo sapiens
taggggctggcgtggagcctgcg

SEQ ID NO: 7508557 - DNA, 22 bp, Homo sapiens
taggggtcccactctcagagtt

SEQ ID NO: 7508558 - DNA, 22 bp, Homo sapiens
taggggtcttgttggcatcacg

SEQ ID NO: 7508559 - DNA, 22 bp, Homo sapiens
tagtctctgctttgcccttggc

SEQ ID NO: 7508560 - DNA, 22 bp, Homo sapiens
tagtctctggagactctagggg

SEQ ID NO: 7508561 - DNA, 22 bp, Homo sapiens
tagtgcaaaggtcttgcaccag

SEQ ID NO: 7508562 - DNA, 22 bp, Homo sapiens
tagtgcaaaggccctgagatgg

SEQ ID NO: 7508563 - DNA, 22 bp, Homo sapiens
tagtgcaacagggaaagagtgt

SEQ ID NO: 7508564 - DNA, 22 bp, Homo sapiens
tagtgcaaggattgctgcagag

SEQ ID NO: 7508565 - DNA, 21 bp, Homo sapiens
tagagaaaagaagctgttcct

SEQ ID NO: 7508566 - DNA, 21 bp, Homo sapiens
tagagaaaagaagctgttcct

SEQ ID NO: 7508567 - DNA, 22 bp, Homo sapiens
tagagaaaaccactggtgagct

SEQ ID NO: 7508568 - DNA, 22 bp, Homo sapiens
tagagaaaaccactggtgagct

SEQ ID NO: 7508569 - DNA, 22 bp, Homo sapiens
tagagaaaaccactggtgagct

SEQ ID NO: 7508570 - DNA, 22 bp, Homo sapiens
tagagaaaagcagggatcagga

SEQ ID NO: 7508571 - DNA, 21 bp, Homo sapiens
tagagaaaagaagctgttcct

SEQ ID NO: 7508572 - DNA, 21 bp, Homo sapiens
tagagaaaagaagctgttcct

SEQ ID NO: 7508573 - DNA, 21 bp, Homo sapiens
tagagaaaagaagctgttcct

SEQ ID NO: 7508574 - DNA, 21 bp, Homo sapiens
tagagaaaagaagctgttcct

SEQ ID NO: 7508575 - DNA, 21 bp, Homo sapiens
tagagaaaagaagctgttcct

SEQ ID NO: 7508576 - DNA, 22 bp, Homo sapiens
tagagaaaaccactggtgagct

SEQ ID NO: 7508577 - DNA, 22 bp, Homo sapiens
tagagaaaaccactggtgagct

SEQ ID NO: 7508578 - DNA, 22 bp, Homo sapiens
tagagaaaaccactggtgagct

SEQ ID NO: 7508579 - DNA, 22 bp, Homo sapiens
tagacttttcaaaatctagacc

SEQ ID NO: 7508580 - DNA, 20 bp, Homo sapiens
tagacttttcatcaacctta

SEQ ID NO: 7508581 - DNA, 22 bp, Homo sapiens
tagactttgatattgtacaccc

SEQ ID NO: 7508582 - DNA, 22 bp, Homo sapiens
tagactttgatattgtacaccc

SEQ ID NO: 7508583 - DNA, 22 bp, Homo sapiens
tagactttgatattgtacaccc

SEQ ID NO: 7508584 - DNA, 22 bp, Homo sapiens
tagagaaacagaaccaacaggg

SEQ ID NO: 7508585 - DNA, 22 bp, Homo sapiens
tagagaaacagaaccaacaggg

SEQ ID NO: 7508586 - DNA, 22 bp, Homo sapiens
tagagaaacagaaccaacaggg

SEQ ID NO: 7508587 - DNA, 22 bp, Homo sapiens
tagagaaacagaaccaacaggg

SEQ ID NO: 7508588 - DNA, 22 bp, Homo sapiens
tagagaaaagcagggatcagga

SEQ ID NO: 7508589 - DNA, 22 bp, Homo sapiens
tagagaaaagcagggatcagga

SEQ ID NO: 7508590 - DNA, 22 bp, Homo sapiens
tagagaaacagaaccaacaggg

SEQ ID NO: 7508591 - DNA, 22 bp, Homo sapiens
tagagaaaagcagggatcagga

SEQ ID NO: 7508592 - DNA, 22 bp, Homo sapiens
tagagaaaagcagggatcagga

SEQ ID NO: 7508593 - DNA, 22 bp, Homo sapiens
tagagaaaagcagggatcagga

SEQ ID NO: 7508594 - DNA, 22 bp, Homo sapiens
tagagaaaagcagggatcagga

SEQ ID NO: 7508595 - DNA, 22 bp, Homo sapiens
tagagaaaagcagggatcagga

SEQ ID NO: 7508596 - DNA, 22 bp, Homo sapiens
tagagaaaagcagggatcagga

SEQ ID NO: 7508597 - DNA, 22 bp, Homo sapiens
tagagaaataagctttgccttg

SEQ ID NO: 7508598 - DNA, 22 bp, Homo sapiens
tagagaaataagctttgccttg

SEQ ID NO: 7508599 - DNA, 23 bp, Homo sapiens
tagagaaagccaccgagtctctc

SEQ ID NO: 7508600 - DNA, 23 bp, Homo sapiens
tagagaaagccaccgagtctctc

SEQ ID NO: 7508601 - DNA, 22 bp, Homo sapiens
tagagaaataagctttgccttg

SEQ ID NO: 7508602 - DNA, 22 bp, Homo sapiens
tagagaaataagctttgccttg

SEQ ID NO: 7508603 - DNA, 22 bp, Homo sapiens
tagagaaataagctttgccttg

SEQ ID NO: 7508604 - DNA, 23 bp, Homo sapiens
tagagaaagccaccgagtctctc

SEQ ID NO: 7508605 - DNA, 22 bp, Homo sapiens
tagagaaacagaaccaacaggg

SEQ ID NO: 7508606 - DNA, 23 bp, Homo sapiens
tagagaaagccaccgagtctctc

SEQ ID NO: 7508607 - DNA, 23 bp, Homo sapiens
tagagaaagccaccgagtctctc

SEQ ID NO: 7508608 - DNA, 22 bp, Homo sapiens
tagagaaacagaaccaacaggg

SEQ ID NO: 7508609 - DNA, 22 bp, Homo sapiens
tagagaaacagaaccaacaggg

SEQ ID NO: 7508610 - DNA, 22 bp, Homo sapiens
tagagagccagttgtcatagtt

SEQ ID NO: 7508611 - DNA, 22 bp, Homo sapiens
tagagagccagttgtcatagtt

SEQ ID NO: 7508612 - DNA, 22 bp, Homo sapiens
tagagagctgtttgaaagcagg

SEQ ID NO: 7508613 - DNA, 22 bp, Homo sapiens
tagagaggccgcgggtcccctc

SEQ ID NO: 7508614 - DNA, 16 bp, Homo sapiens
tagagagggcagggag

SEQ ID NO: 7508615 - DNA, 16 bp, Homo sapiens
tagagagggcagggag

SEQ ID NO: 7508616 - DNA, 16 bp, Homo sapiens
tagagagggcagggag

SEQ ID NO: 7508617 - DNA, 16 bp, Homo sapiens
tagagagggcagggag

SEQ ID NO: 7508618 - DNA, 22 bp, Homo sapiens
tagagaggccgcgggtcccctc

SEQ ID NO: 7508619 - DNA, 22 bp, Homo sapiens
tagagaggccgcgggtcccctc

SEQ ID NO: 7508620 - DNA, 22 bp, Homo sapiens
tagagaggccgcgggtcccctc

SEQ ID NO: 7508621 - DNA, 22 bp, Homo sapiens
tagagtccattaatgcaagttt

SEQ ID NO: 7508622 - DNA, 22 bp, Homo sapiens
tagagtcagagaatcattacag

SEQ ID NO: 7508623 - DNA, 22 bp, Homo sapiens
tagagtatataggcctttgtgt

SEQ ID NO: 7508624 - DNA, 22 bp, Homo sapiens
tagagaggtttgaattggctgc

SEQ ID NO: 7508625 - DNA, 16 bp, Homo sapiens
tagagagggcagggag

SEQ ID NO: 7508626 - DNA, 22 bp, Homo sapiens
tagagaggtttgaattggctgc

SEQ ID NO: 7508627 - DNA, 22 bp, Homo sapiens
tagagaggtttgaattggctgc

SEQ ID NO: 7508628 - DNA, 22 bp, Homo sapiens
tagagaggtttgaattggctgc

SEQ ID NO: 7508629 - DNA, 22 bp, Homo sapiens
tagagtaacacaaacgaattgg

SEQ ID NO: 7508630 - DNA, 22 bp, Homo sapiens
tagagtatagctaactgtatta

SEQ ID NO: 7508631 - DNA, 22 bp, Homo sapiens
tagagagagctgtggtggctct

SEQ ID NO: 7508632 - DNA, 20 bp, Homo sapiens
tagagagaggatattaaagt

SEQ ID NO: 7508633 - DNA, 20 bp, Homo sapiens
tagagagaggatattaaagt

SEQ ID NO: 7508634 - DNA, 22 bp, Homo sapiens
tagagagagctgtggtggctct

SEQ ID NO: 7508635 - DNA, 22 bp, Homo sapiens
tagagagagctgtggtggctct

SEQ ID NO: 7508636 - DNA, 22 bp, Homo sapiens
tagagagagctgtggtggctct

SEQ ID NO: 7508637 - DNA, 22 bp, Homo sapiens
tagagagagatatatacacaca

SEQ ID NO: 7508638 - DNA, 22 bp, Homo sapiens
tagagagagatatatacacaca

SEQ ID NO: 7508639 - DNA, 22 bp, Homo sapiens
tagagacagaaagtagaatggt

SEQ ID NO: 7508640 - DNA, 22 bp, Homo sapiens
tagagaatggccttgaagtagt

SEQ ID NO: 7508641 - DNA, 22 bp, Homo sapiens
tagagaatggccttgaagtagt

SEQ ID NO: 7508642 - DNA, 22 bp, Homo sapiens
tagagacagaaagtagaatggt

SEQ ID NO: 7508643 - DNA, 22 bp, Homo sapiens
tagagacagaaagtagaatggt

SEQ ID NO: 7508644 - DNA, 22 bp, Homo sapiens
tagagacagaaagtagaatggt

SEQ ID NO: 7508645 - DNA, 22 bp, Homo sapiens
tagagacaccagtaccattctg

SEQ ID NO: 7508646 - DNA, 22 bp, Homo sapiens
tagagacaccagtaccattctg

SEQ ID NO: 7508647 - DNA, 22 bp, Homo sapiens
tagagacaccagtaccattctg

SEQ ID NO: 7508648 - DNA, 22 bp, Homo sapiens
tagagaattgtagcctgcaaga

SEQ ID NO: 7508649 - DNA, 22 bp, Homo sapiens
tagagacaccagtaccattctg

SEQ ID NO: 7508650 - DNA, 22 bp, Homo sapiens
tagatacatacattttaaaatg

SEQ ID NO: 7508651 - DNA, 22 bp, Homo sapiens
tagatacatacattttaaaatg

SEQ ID NO: 7508652 - DNA, 22 bp, Homo sapiens
tagatacatacattttaaaatg

SEQ ID NO: 7508653 - DNA, 22 bp, Homo sapiens
tagatacatacattttaaaatg

SEQ ID NO: 7508654 - DNA, 22 bp, Homo sapiens
tagatacatacattttaaaatg

SEQ ID NO: 7508655 - DNA, 22 bp, Homo sapiens
tagatacatacattttaaaatg

SEQ ID NO: 7508656 - DNA, 22 bp, Homo sapiens
tagatacatttttctttcctgt

SEQ ID NO: 7508657 - DNA, 22 bp, Homo sapiens
tagatacctgctggacctcatt

SEQ ID NO: 7508658 - DNA, 20 bp, Homo sapiens
tagatacccaatgctcatca

SEQ ID NO: 7508659 - DNA, 22 bp, Homo sapiens
tagatacatttttctttcctgt

SEQ ID NO: 7508660 - DNA, 22 bp, Homo sapiens
tagatacatttttctttcctgt

SEQ ID NO: 7508661 - DNA, 22 bp, Homo sapiens
tagatacatacattttaaaatg

SEQ ID NO: 7508662 - DNA, 22 bp, Homo sapiens
tagatacatgaaatggcagata

SEQ ID NO: 7508663 - DNA, 22 bp, Homo sapiens
tagatacatgaaatggcagata

SEQ ID NO: 7508664 - DNA, 22 bp, Homo sapiens
tagatacatgaaatggcagata

SEQ ID NO: 7508665 - DNA, 22 bp, Homo sapiens
tagatacatttttctttcctgt

SEQ ID NO: 7508666 - DNA, 22 bp, Homo sapiens
tagagtggttaacagtttagaa

SEQ ID NO: 7508667 - DNA, 22 bp, Homo sapiens
tagatacagtgttaagtgtgga

SEQ ID NO: 7508668 - DNA, 22 bp, Homo sapiens
tagatacagtgttaagtgtgga

SEQ ID NO: 7508669 - DNA, 22 bp, Homo sapiens
tagatacagtgttaagtgtgga

SEQ ID NO: 7508670 - DNA, 22 bp, Homo sapiens
tagatacagtgttaagtgtgga

SEQ ID NO: 7508671 - DNA, 22 bp, Homo sapiens
tagagtctagtgtatacaaagt

SEQ ID NO: 7508672 - DNA, 22 bp, Homo sapiens
tagagtctagagtgggaccgag

SEQ ID NO: 7508673 - DNA, 22 bp, Homo sapiens
tagatacttattcgttgtttac

SEQ ID NO: 7508674 - DNA, 22 bp, Homo sapiens
tagatacttataatcttccaag

SEQ ID NO: 7508675 - DNA, 22 bp, Homo sapiens
tagatagactaatccagcaact

SEQ ID NO: 7508676 - DNA, 22 bp, Homo sapiens
tagataggtgattaggaaaagc

SEQ ID NO: 7508677 - DNA, 22 bp, Homo sapiens
tagatactcagaaatgctttca

SEQ ID NO: 7508678 - DNA, 22 bp, Homo sapiens
tagatacctgctggacctcatt

SEQ ID NO: 7508679 - DNA, 22 bp, Homo sapiens
tagatactgcccattgagcaat

SEQ ID NO: 7508680 - DNA, 22 bp, Homo sapiens
tagatataggacagtactgtat

SEQ ID NO: 7508681 - DNA, 22 bp, Homo sapiens
tagatataggacagtactgtat

SEQ ID NO: 7508682 - DNA, 22 bp, Homo sapiens
tagatataaggtccttagaaca

SEQ ID NO: 7508683 - DNA, 22 bp, Homo sapiens
tagatataaggtccttagaaca

SEQ ID NO: 7508684 - DNA, 22 bp, Homo sapiens
tagatataaggtccttagaaca

SEQ ID NO: 7508685 - DNA, 22 bp, Homo sapiens
tagatataaggtccttagaaca

SEQ ID NO: 7508686 - DNA, 22 bp, Homo sapiens
tagatatatctgtcatactggt

SEQ ID NO: 7508687 - DNA, 22 bp, Homo sapiens
tagatataggacagtactgtat

SEQ ID NO: 7508688 - DNA, 22 bp, Homo sapiens
tagatataggacagtactgtat

SEQ ID NO: 7508689 - DNA, 22 bp, Homo sapiens
tagatatatctgtcatactggt

SEQ ID NO: 7508690 - DNA, 22 bp, Homo sapiens
tagatatatctgtcatactggt

SEQ ID NO: 7508691 - DNA, 22 bp, Homo sapiens
tagatatatctgtcatactggt

SEQ ID NO: 7508692 - DNA, 22 bp, Homo sapiens
tagatatgatgagtcacttgag

SEQ ID NO: 7508693 - DNA, 22 bp, Homo sapiens
tagatatgacagcagaacaagc

SEQ ID NO: 7508694 - DNA, 22 bp, Homo sapiens
tagatatcagaaatagaattta

SEQ ID NO: 7508695 - DNA, 22 bp, Homo sapiens
tagatatggccgtctgttttaa

SEQ ID NO: 7508696 - DNA, 22 bp, Homo sapiens
tagatatggccgtctgttttaa
